United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 173

SEQ ID NO: 7227246 - DNA, 22 bp, Homo sapiens
tggagagaacagtgtctgaaag

SEQ ID NO: 7227247 - DNA, 22 bp, Homo sapiens
tggagagaagaggcagtgtgct

SEQ ID NO: 7227248 - DNA, 22 bp, Homo sapiens
tggagagaagaggcagtgtgct

SEQ ID NO: 7227249 - DNA, 22 bp, Homo sapiens
tggagagaagaggcagtgtgct

SEQ ID NO: 7227250 - DNA, 22 bp, Homo sapiens
tggagagaaagttgaatggagg

SEQ ID NO: 7227251 - DNA, 22 bp, Homo sapiens
tggagagaaagttgaatggagg

SEQ ID NO: 7227252 - DNA, 22 bp, Homo sapiens
tggagagaaagttgaatggagg

SEQ ID NO: 7227253 - DNA, 22 bp, Homo sapiens
tggagagaaaaaagacagttct

SEQ ID NO: 7227254 - DNA, 22 bp, Homo sapiens
tggagagaaaaaagacagttct

SEQ ID NO: 7227255 - DNA, 22 bp, Homo sapiens
tggagaagtcaaagtgaacagg

SEQ ID NO: 7227256 - DNA, 22 bp, Homo sapiens
tggagaagtcaaagtgaacagg

SEQ ID NO: 7227257 - DNA, 22 bp, Homo sapiens
tggagaatctggaaactgttga

SEQ ID NO: 7227258 - DNA, 22 bp, Homo sapiens
tggagaaggggcagggtctcca

SEQ ID NO: 7227259 - DNA, 22 bp, Homo sapiens
tggagaaggggcagggtctcca

SEQ ID NO: 7227260 - DNA, 22 bp, Homo sapiens
tggagaaggccggccaggagtg

SEQ ID NO: 7227261 - DNA, 22 bp, Homo sapiens
tggagaaggccggccaggagtg

SEQ ID NO: 7227262 - DNA, 22 bp, Homo sapiens
tggagaaggccggccaggagtg

SEQ ID NO: 7227263 - DNA, 22 bp, Homo sapiens
tggagaaggacagcctgagaaa

SEQ ID NO: 7227264 - DNA, 22 bp, Homo sapiens
tggagaagctgtaggtggactc

SEQ ID NO: 7227265 - DNA, 22 bp, Homo sapiens
tggagaagctgtaggtggactc

SEQ ID NO: 7227266 - DNA, 22 bp, Homo sapiens
tggagaaggacagcctgagaaa

SEQ ID NO: 7227267 - DNA, 22 bp, Homo sapiens
tggagaaggacagcctgagaaa

SEQ ID NO: 7227268 - DNA, 22 bp, Homo sapiens
tggagaaggacagcctgagaaa

SEQ ID NO: 7227269 - DNA, 22 bp, Homo sapiens
tggagaagctgtaggtggactc

SEQ ID NO: 7227270 - DNA, 22 bp, Homo sapiens
tggagaagattggtcaccattc

SEQ ID NO: 7227271 - DNA, 19 bp, Homo sapiens
tggacttgagctgctttga

SEQ ID NO: 7227272 - DNA, 19 bp, Homo sapiens
tggacttgagctgctttga

SEQ ID NO: 7227273 - DNA, 22 bp, Homo sapiens
tggactttcacatagcaaagga

SEQ ID NO: 7227274 - DNA, 22 bp, Homo sapiens
tggacttgcagagaagcccttc

SEQ ID NO: 7227275 - DNA, 22 bp, Homo sapiens
tggactttctagggtagaggaa

SEQ ID NO: 7227276 - DNA, 22 bp, Homo sapiens
tggactttttaactgataggag

SEQ ID NO: 7227277 - DNA, 22 bp, Homo sapiens
tggactttttaactgataggag

SEQ ID NO: 7227278 - DNA, 22 bp, Homo sapiens
tggagaaaaggttgaatccatc

SEQ ID NO: 7227279 - DNA, 22 bp, Homo sapiens
tggagcagccttttctaagcaa

SEQ ID NO: 7227280 - DNA, 22 bp, Homo sapiens
tggagcagccatgatgacagag

SEQ ID NO: 7227281 - DNA, 22 bp, Homo sapiens
tggagcagccatgatgacagag

SEQ ID NO: 7227282 - DNA, 22 bp, Homo sapiens
tggagcagccttttctaagcaa

SEQ ID NO: 7227283 - DNA, 22 bp, Homo sapiens
tggagcagccttttctaagcaa

SEQ ID NO: 7227284 - DNA, 22 bp, Homo sapiens
tggagcagccatgatgacagag

SEQ ID NO: 7227285 - DNA, 22 bp, Homo sapiens
tggagcagccatgatgacagag

SEQ ID NO: 7227286 - DNA, 22 bp, Homo sapiens
tggagcagccatgatgacagag

SEQ ID NO: 7227287 - DNA, 22 bp, Homo sapiens
tggagcagccatgatgacagag

SEQ ID NO: 7227288 - DNA, 22 bp, Homo sapiens
tggagcagccatgatgacagag

SEQ ID NO: 7227289 - DNA, 22 bp, Homo sapiens
tggagcagcattcatccagcag

SEQ ID NO: 7227290 - DNA, 22 bp, Homo sapiens
tggagcagcattcatccagcag

SEQ ID NO: 7227291 - DNA, 22 bp, Homo sapiens
tggagcagcacaagaaagggga

SEQ ID NO: 7227292 - DNA, 22 bp, Homo sapiens
tggagcagcacaagaaagggga

SEQ ID NO: 7227293 - DNA, 22 bp, Homo sapiens
tggagcagcatcactttgagct

SEQ ID NO: 7227294 - DNA, 22 bp, Homo sapiens
tggagcagcacaagaaagggga

SEQ ID NO: 7227295 - DNA, 22 bp, Homo sapiens
tggagcagcacaagaaagggga

SEQ ID NO: 7227296 - DNA, 22 bp, Homo sapiens
tggagcagcacaagaaagggga

SEQ ID NO: 7227297 - DNA, 22 bp, Homo sapiens
tggagcagcacaagaaagggga

SEQ ID NO: 7227298 - DNA, 22 bp, Homo sapiens
tggagcagcacaagaaagggga

SEQ ID NO: 7227299 - DNA, 22 bp, Homo sapiens
tggagcagagttcagcggggag

SEQ ID NO: 7227300 - DNA, 22 bp, Homo sapiens
tggagcagagttcagcggggag

SEQ ID NO: 7227301 - DNA, 22 bp, Homo sapiens
tggagcagaggaagaaggcttt

SEQ ID NO: 7227302 - DNA, 22 bp, Homo sapiens
tggagcagaggctgaggttggg

SEQ ID NO: 7227303 - DNA, 22 bp, Homo sapiens
tggagcagaggctgaggttggg

SEQ ID NO: 7227304 - DNA, 22 bp, Homo sapiens
tggagcagagttcagcggggag

SEQ ID NO: 7227305 - DNA, 22 bp, Homo sapiens
tggagcagagttcagcggggag

SEQ ID NO: 7227306 - DNA, 22 bp, Homo sapiens
tggagcagaggaagaaggcttt

SEQ ID NO: 7227307 - DNA, 22 bp, Homo sapiens
tggagcagaggaagaaggcttt

SEQ ID NO: 7227308 - DNA, 22 bp, Homo sapiens
tggagcagaggaagaaggcttt

SEQ ID NO: 7227309 - DNA, 22 bp, Homo sapiens
tggagcagaggaagaaggcttt

SEQ ID NO: 7227310 - DNA, 22 bp, Homo sapiens
tggagcagaggaagaaggcttt

SEQ ID NO: 7227311 - DNA, 22 bp, Homo sapiens
tggagcagaggaagaaggcttt

SEQ ID NO: 7227312 - DNA, 22 bp, Homo sapiens
tggagcagaggaagaaggcttt

SEQ ID NO: 7227313 - DNA, 22 bp, Homo sapiens
tggagcagagatggtggccttc

SEQ ID NO: 7227314 - DNA, 22 bp, Homo sapiens
tggagcagagatggtggccttc

SEQ ID NO: 7227315 - DNA, 22 bp, Homo sapiens
tggagcagagatgggagcccaa

SEQ ID NO: 7227316 - DNA, 22 bp, Homo sapiens
tggagcagaaatggcctcttgt

SEQ ID NO: 7227317 - DNA, 22 bp, Homo sapiens
tggagcagaaatttgaagccat

SEQ ID NO: 7227318 - DNA, 22 bp, Homo sapiens
tggagcagaaatttgaagccat

SEQ ID NO: 7227319 - DNA, 22 bp, Homo sapiens
tggagcagaaatggcctcttgt

SEQ ID NO: 7227320 - DNA, 22 bp, Homo sapiens
tggagcagagatgggagcccaa

SEQ ID NO: 7227321 - DNA, 22 bp, Homo sapiens
tggagagtctctgagccagggc

SEQ ID NO: 7227322 - DNA, 22 bp, Homo sapiens
tggagagtctctgagccagggc

SEQ ID NO: 7227323 - DNA, 22 bp, Homo sapiens
tggagagtctcaaggcaggaaa

SEQ ID NO: 7227324 - DNA, 22 bp, Homo sapiens
tggagagtctctgagccagggc

SEQ ID NO: 7227325 - DNA, 22 bp, Homo sapiens
tggagagtctctgagccagggc

SEQ ID NO: 7227326 - DNA, 21 bp, Homo sapiens
tggagagtgatttcagtgtgg

SEQ ID NO: 7227327 - DNA, 22 bp, Homo sapiens
tggagagtggatatgggagcaa

SEQ ID NO: 7227328 - DNA, 22 bp, Homo sapiens
tggagagtggatatgggagcaa

SEQ ID NO: 7227329 - DNA, 22 bp, Homo sapiens
tggagagtggatatgggagcaa

SEQ ID NO: 7227330 - DNA, 22 bp, Homo sapiens
tggagagtggtttgggggacat

SEQ ID NO: 7227331 - DNA, 22 bp, Homo sapiens
tggagaggagcaccatggccat

SEQ ID NO: 7227332 - DNA, 22 bp, Homo sapiens
tggagaggagcaccatggccat

SEQ ID NO: 7227333 - DNA, 22 bp, Homo sapiens
tggagaggagcaccatggccat

SEQ ID NO: 7227334 - DNA, 22 bp, Homo sapiens
tggagaggagcaccatggccat

SEQ ID NO: 7227335 - DNA, 19 bp, Homo sapiens
tggagaggaaatgctgctc

SEQ ID NO: 7227336 - DNA, 22 bp, Homo sapiens
tggagaggttgaataacttgtc

SEQ ID NO: 7227337 - DNA, 22 bp, Homo sapiens
tggagaggttgaataacttgtc

SEQ ID NO: 7227338 - DNA, 22 bp, Homo sapiens
tggagaggtttaaacaaaagtt

SEQ ID NO: 7227339 - DNA, 22 bp, Homo sapiens
tggagagtaaatggcagaatca

SEQ ID NO: 7227340 - DNA, 22 bp, Homo sapiens
tggagagtaaatggcagaatca

SEQ ID NO: 7227341 - DNA, 22 bp, Homo sapiens
tggagaggtttaaacaaaagtt

SEQ ID NO: 7227342 - DNA, 22 bp, Homo sapiens
tggagagtaaatggcagaatca

SEQ ID NO: 7227343 - DNA, 22 bp, Homo sapiens
tggagagtaatttctgaagacc

SEQ ID NO: 7227344 - DNA, 22 bp, Homo sapiens
tggagagtctcaaggcaggaaa

SEQ ID NO: 7227345 - DNA, 22 bp, Homo sapiens
tggagcaggtgccaggtgtgtg

SEQ ID NO: 7227346 - DNA, 22 bp, Homo sapiens
tggagcaggtgccaggtgtgtg

SEQ ID NO: 7227347 - DNA, 22 bp, Homo sapiens
tggagcaggtgccaggtgtgtg

SEQ ID NO: 7227348 - DNA, 22 bp, Homo sapiens
tggagcaggtgccaggtgtgtg

SEQ ID NO: 7227349 - DNA, 22 bp, Homo sapiens
tggagcaggtgccaggtgtgtg

SEQ ID NO: 7227350 - DNA, 22 bp, Homo sapiens
tggagcaggtgccaggtgtgtg

SEQ ID NO: 7227351 - DNA, 22 bp, Homo sapiens
tggagcaggtgctcagggtaat

SEQ ID NO: 7227352 - DNA, 22 bp, Homo sapiens
tggagcaggtgctcagggtaat

SEQ ID NO: 7227353 - DNA, 22 bp, Homo sapiens
tggagcaggtgctcagggtaat

SEQ ID NO: 7227354 - DNA, 22 bp, Homo sapiens
tggagcaggaagtctatggctg

SEQ ID NO: 7227355 - DNA, 22 bp, Homo sapiens
tggagcaggacggggagtggta

SEQ ID NO: 7227356 - DNA, 22 bp, Homo sapiens
tggagcaggacggggagtggta

SEQ ID NO: 7227357 - DNA, 22 bp, Homo sapiens
tggagcaggaagtctatggctg

SEQ ID NO: 7227358 - DNA, 22 bp, Homo sapiens
tggagcaggacggggagtggta

SEQ ID NO: 7227359 - DNA, 22 bp, Homo sapiens
tggagcaggacggggagtggta

SEQ ID NO: 7227360 - DNA, 22 bp, Homo sapiens
tggagcaggacggggagtggta

SEQ ID NO: 7227361 - DNA, 18 bp, Homo sapiens
tggagcaggtaggcatga

SEQ ID NO: 7227362 - DNA, 22 bp, Homo sapiens
tggagcaggaagtctatggctg

SEQ ID NO: 7227363 - DNA, 22 bp, Homo sapiens
tggagcaggaagtctatggctg

SEQ ID NO: 7227364 - DNA, 22 bp, Homo sapiens
tggagcaggaagtctatggctg

SEQ ID NO: 7227365 - DNA, 22 bp, Homo sapiens
tggagcaggaagtctatggctg

SEQ ID NO: 7227366 - DNA, 18 bp, Homo sapiens
tggagcaggaagcctggc

SEQ ID NO: 7227367 - DNA, 18 bp, Homo sapiens
tggagcaggaagcctggc

SEQ ID NO: 7227368 - DNA, 18 bp, Homo sapiens
tggagcaggaagcctggc

SEQ ID NO: 7227369 - DNA, 22 bp, Homo sapiens
tggagcagctaagcctctgaga

SEQ ID NO: 7227370 - DNA, 22 bp, Homo sapiens
tggagcagctaagcctctgaga

SEQ ID NO: 7227371 - DNA, 22 bp, Homo sapiens
tggagcagctctagcgggcgcc

SEQ ID NO: 7227372 - DNA, 22 bp, Homo sapiens
tggagcagctctagcgggcgcc

SEQ ID NO: 7227373 - DNA, 22 bp, Homo sapiens
tggagcagctctagcgggcgcc

SEQ ID NO: 7227374 - DNA, 22 bp, Homo sapiens
tggagcagctctagcgggcgcc

SEQ ID NO: 7227375 - DNA, 22 bp, Homo sapiens
tggagcagctgaacagagttga

SEQ ID NO: 7227376 - DNA, 22 bp, Homo sapiens
tggagcagctgaacagagttga

SEQ ID NO: 7227377 - DNA, 22 bp, Homo sapiens
tggagccaatgaacatttgctg

SEQ ID NO: 7227378 - DNA, 22 bp, Homo sapiens
tggagccaatgaacatttgctg

SEQ ID NO: 7227379 - DNA, 23 bp, Homo sapiens
tggagccaaacatcacatgcctg

SEQ ID NO: 7227380 - DNA, 22 bp, Homo sapiens
tggagcagtggtcctggagatg

SEQ ID NO: 7227381 - DNA, 22 bp, Homo sapiens
tggagcagtggtcctggagatg

SEQ ID NO: 7227382 - DNA, 22 bp, Homo sapiens
tggagcatactaacccactctg

SEQ ID NO: 7227383 - DNA, 22 bp, Homo sapiens
tggagcattcaggtttcccttt

SEQ ID NO: 7227384 - DNA, 22 bp, Homo sapiens
tggagccaaaaagggaaggaga

SEQ ID NO: 7227385 - DNA, 22 bp, Homo sapiens
tggagccaaaaagggaaggaga

SEQ ID NO: 7227386 - DNA, 22 bp, Homo sapiens
tggagccaaaaagggaaggaga

SEQ ID NO: 7227387 - DNA, 22 bp, Homo sapiens
tggagcaggtgctcagggtaat

SEQ ID NO: 7227388 - DNA, 22 bp, Homo sapiens
tggagcaggtgctcagggtaat

SEQ ID NO: 7227389 - DNA, 22 bp, Homo sapiens
tggagcaggtgctcagggtaat

SEQ ID NO: 7227390 - DNA, 22 bp, Homo sapiens
tggagcagtggtcctggagatg

SEQ ID NO: 7227391 - DNA, 22 bp, Homo sapiens
tggagcagtggtcctggagatg

SEQ ID NO: 7227392 - DNA, 22 bp, Homo sapiens
tggagccagcccaggcccctct

SEQ ID NO: 7227393 - DNA, 22 bp, Homo sapiens
tggagccagcaggactcagagg

SEQ ID NO: 7227394 - DNA, 22 bp, Homo sapiens
tggagccagcaggactcagagg

SEQ ID NO: 7227395 - DNA, 22 bp, Homo sapiens
tggagccactcactatctgagt

SEQ ID NO: 7227396 - DNA, 22 bp, Homo sapiens
tggagccagaagagccagttca

SEQ ID NO: 7227397 - DNA, 22 bp, Homo sapiens
tggagccagagcgcagcctggg

SEQ ID NO: 7227398 - DNA, 22 bp, Homo sapiens
tggagccagagcgcagcctggg

SEQ ID NO: 7227399 - DNA, 22 bp, Homo sapiens
tggagccagagcgcagcctggg

SEQ ID NO: 7227400 - DNA, 22 bp, Homo sapiens
tggagccagagcgcagcctggg

SEQ ID NO: 7227401 - DNA, 22 bp, Homo sapiens
tggagccaatgaacatttgctg

SEQ ID NO: 7227402 - DNA, 20 bp, Homo sapiens
tggagccacagtcaggttcc

SEQ ID NO: 7227403 - DNA, 20 bp, Homo sapiens
tggagccacagtcaggttcc

SEQ ID NO: 7227404 - DNA, 22 bp, Homo sapiens
tggagccaccttcttatttgtc

SEQ ID NO: 7227405 - DNA, 22 bp, Homo sapiens
tggagccagcggcctgctgagg

SEQ ID NO: 7227406 - DNA, 22 bp, Homo sapiens
tggagccagcggcctgctgagg

SEQ ID NO: 7227407 - DNA, 22 bp, Homo sapiens
tggagccagcccaggcccctct

SEQ ID NO: 7227408 - DNA, 22 bp, Homo sapiens
tggagccagcgagccgaggcgg

SEQ ID NO: 7227409 - DNA, 22 bp, Homo sapiens
tggagccagcggcctgctgagg

SEQ ID NO: 7227410 - DNA, 22 bp, Homo sapiens
tggagccaggagcctgggagtc

SEQ ID NO: 7227411 - DNA, 18 bp, Homo sapiens
tggagccagctctaggat

SEQ ID NO: 7227412 - DNA, 22 bp, Homo sapiens
tggagccaggagcctgggagtc

SEQ ID NO: 7227413 - DNA, 22 bp, Homo sapiens
tggagccaggctggccctgcca

SEQ ID NO: 7227414 - DNA, 22 bp, Homo sapiens
tggagctgggagtcctgggctg

SEQ ID NO: 7227415 - DNA, 22 bp, Homo sapiens
tggagctggcttgtggaagttg

SEQ ID NO: 7227416 - DNA, 22 bp, Homo sapiens
tggagctggcttgtggaagttg

SEQ ID NO: 7227417 - DNA, 22 bp, Homo sapiens
tggagctggaatttgagctgga

SEQ ID NO: 7227418 - DNA, 22 bp, Homo sapiens
tggagctggaatttgagctgga

SEQ ID NO: 7227419 - DNA, 22 bp, Homo sapiens
tggagctggaatttgagctgga

SEQ ID NO: 7227420 - DNA, 22 bp, Homo sapiens
tggagctggcagcggaaaaggg

SEQ ID NO: 7227421 - DNA, 22 bp, Homo sapiens
tggagctggcagcggaaaaggg

SEQ ID NO: 7227422 - DNA, 22 bp, Homo sapiens
tggagctggaatttgagctgga

SEQ ID NO: 7227423 - DNA, 22 bp, Homo sapiens
tggagctggaatttgagctgga

SEQ ID NO: 7227424 - DNA, 22 bp, Homo sapiens
tggagctggaatttctgggcct

SEQ ID NO: 7227425 - DNA, 22 bp, Homo sapiens
tggagctggaagaatgtagacg

SEQ ID NO: 7227426 - DNA, 22 bp, Homo sapiens
tggagctggaagaatgtagacg

SEQ ID NO: 7227427 - DNA, 22 bp, Homo sapiens
tggagctggaagaatgtagacg

SEQ ID NO: 7227428 - DNA, 22 bp, Homo sapiens
tggagctggaagaatgtagacg

SEQ ID NO: 7227429 - DNA, 22 bp, Homo sapiens
tggagctggaagaatgtagacg

SEQ ID NO: 7227430 - DNA, 22 bp, Homo sapiens
tggagctggaagaatgtagacg

SEQ ID NO: 7227431 - DNA, 22 bp, Homo sapiens
tggagctggaagacagtgatat

SEQ ID NO: 7227432 - DNA, 22 bp, Homo sapiens
tggagctggaagacagtgatat

SEQ ID NO: 7227433 - DNA, 22 bp, Homo sapiens
tggagctgatacagctggcttt

SEQ ID NO: 7227434 - DNA, 22 bp, Homo sapiens
tggagctgatacagctggcttt

SEQ ID NO: 7227435 - DNA, 18 bp, Homo sapiens
tggagctgagtgctgtgc

SEQ ID NO: 7227436 - DNA, 18 bp, Homo sapiens
tggagctgagtgctgtgc

SEQ ID NO: 7227437 - DNA, 21 bp, Homo sapiens
tggagctgccacttgagctgc

SEQ ID NO: 7227438 - DNA, 18 bp, Homo sapiens
tggagctgagtgctgtgc

SEQ ID NO: 7227439 - DNA, 23 bp, Homo sapiens
tggagctgacagtcagagggagg

SEQ ID NO: 7227440 - DNA, 23 bp, Homo sapiens
tggagctgacagtcagagggagg

SEQ ID NO: 7227441 - DNA, 22 bp, Homo sapiens
tggagctgaactttgaggccag

SEQ ID NO: 7227442 - DNA, 22 bp, Homo sapiens
tggagcgagctcaaaggcagga

SEQ ID NO: 7227443 - DNA, 20 bp, Homo sapiens
tggagctccagcgtccatgt

SEQ ID NO: 7227444 - DNA, 22 bp, Homo sapiens
tggagctgaactttgaggccag

SEQ ID NO: 7227445 - DNA, 22 bp, Homo sapiens
tggagctgaactttgaggccag

SEQ ID NO: 7227446 - DNA, 22 bp, Homo sapiens
tggagcccagacactggcattg

SEQ ID NO: 7227447 - DNA, 22 bp, Homo sapiens
tggagcccagacactggcattg

SEQ ID NO: 7227448 - DNA, 22 bp, Homo sapiens
tggagcccatgagccataccag

SEQ ID NO: 7227449 - DNA, 22 bp, Homo sapiens
tggagcccctcacccacacctg

SEQ ID NO: 7227450 - DNA, 22 bp, Homo sapiens
tggagcctccagtctttctaga

SEQ ID NO: 7227451 - DNA, 18 bp, Homo sapiens
tggagccattgccaccat

SEQ ID NO: 7227452 - DNA, 18 bp, Homo sapiens
tggagccattgccaccat

SEQ ID NO: 7227453 - DNA, 22 bp, Homo sapiens
tggagcccacggatgtcgcttt

SEQ ID NO: 7227454 - DNA, 22 bp, Homo sapiens
tggagccagggtagaagcagag

SEQ ID NO: 7227455 - DNA, 22 bp, Homo sapiens
tggagccaggctggccctgcca

SEQ ID NO: 7227456 - DNA, 22 bp, Homo sapiens
tggagccataaccctttcgtac

SEQ ID NO: 7227457 - DNA, 22 bp, Homo sapiens
tgcgggtcccagggtcacaggc

SEQ ID NO: 7227458 - DNA, 22 bp, Homo sapiens
tgcgggggaagctgtgggagaa

SEQ ID NO: 7227459 - DNA, 23 bp, Homo sapiens
tgcgtacggctgccagtgtgact

SEQ ID NO: 7227460 - DNA, 22 bp, Homo sapiens
tgcgtagtacgaatttgtgcct

SEQ ID NO: 7227461 - DNA, 22 bp, Homo sapiens
tgcgtctggagtggagtttgaa

SEQ ID NO: 7227462 - DNA, 22 bp, Homo sapiens
tgcgtggcgcagcgtgtgggat

SEQ ID NO: 7227463 - DNA, 22 bp, Homo sapiens
tgcgtggcgcagcgtgtgggat

SEQ ID NO: 7227464 - DNA, 22 bp, Homo sapiens
tgcgtggctgcgaggacccagc

SEQ ID NO: 7227465 - DNA, 22 bp, Homo sapiens
tgcgtggctggtccctgtgacc

SEQ ID NO: 7227466 - DNA, 21 bp, Homo sapiens
tgcgtgtgcatggccttcggg

SEQ ID NO: 7227467 - DNA, 22 bp, Homo sapiens
tgcgtgtgtgtatatacacagg

SEQ ID NO: 7227468 - DNA, 23 bp, Homo sapiens
tgcgtgtgtgctgaggggcgtcc

SEQ ID NO: 7227469 - DNA, 20 bp, Homo sapiens
tgcgtgtgtatttattttct

SEQ ID NO: 7227470 - DNA, 22 bp, Homo sapiens
tgcgtggctggtccctgtgacc

SEQ ID NO: 7227471 - DNA, 22 bp, Homo sapiens
tgctaaataagtggaatagaca

SEQ ID NO: 7227472 - DNA, 22 bp, Homo sapiens
tgctaaattcattattgattta

SEQ ID NO: 7227473 - DNA, 22 bp, Homo sapiens
tgcggcagccaccgcgtggccc

SEQ ID NO: 7227474 - DNA, 22 bp, Homo sapiens
tgcggcggcgggcagaggacta

SEQ ID NO: 7227475 - DNA, 22 bp, Homo sapiens
tgcggctggtgctgaagctgag

SEQ ID NO: 7227476 - DNA, 22 bp, Homo sapiens
tgcggctggtgctgaagctgag

SEQ ID NO: 7227477 - DNA, 22 bp, Homo sapiens
tgcgggagggcaacgcggcatt

SEQ ID NO: 7227478 - DNA, 22 bp, Homo sapiens
tgcgggagtgcgccgagctctc

SEQ ID NO: 7227479 - DNA, 22 bp, Homo sapiens
tgcggggagagaggtccaggat

SEQ ID NO: 7227480 - DNA, 22 bp, Homo sapiens
tgcggagggagcagtcggctgt

SEQ ID NO: 7227481 - DNA, 22 bp, Homo sapiens
tgcggaggtcggtgctgcgggc

SEQ ID NO: 7227482 - DNA, 22 bp, Homo sapiens
tgcgcggctcagtcatctccag

SEQ ID NO: 7227483 - DNA, 22 bp, Homo sapiens
tgcgcgggtgcctatctgtata

SEQ ID NO: 7227484 - DNA, 22 bp, Homo sapiens
tgcgctggtggcggataagggt

SEQ ID NO: 7227485 - DNA, 22 bp, Homo sapiens
tgcgcccagccaagtctggcac

SEQ ID NO: 7227486 - DNA, 22 bp, Homo sapiens
tgcgcctctaatctcgggcgtc

SEQ ID NO: 7227487 - DNA, 22 bp, Homo sapiens
tgcgcctgtaagtccagagtcc

SEQ ID NO: 7227488 - DNA, 22 bp, Homo sapiens
tgcgcctgtaagtccagagtcc

SEQ ID NO: 7227489 - DNA, 22 bp, Homo sapiens
tgcgcaggagctctgccaggag

SEQ ID NO: 7227490 - DNA, 22 bp, Homo sapiens
tgcgcatgcgtggctctccggc

SEQ ID NO: 7227491 - DNA, 22 bp, Homo sapiens
tgcgccatgtgctctcggccct

SEQ ID NO: 7227492 - DNA, 22 bp, Homo sapiens
tgctataagtagacattcaaca

SEQ ID NO: 7227493 - DNA, 22 bp, Homo sapiens
tgctatggaaaacagaatggca

SEQ ID NO: 7227494 - DNA, 22 bp, Homo sapiens
tgctatgtaaagctctgggttt

SEQ ID NO: 7227495 - DNA, 22 bp, Homo sapiens
tgctataagctccacgctgtag

SEQ ID NO: 7227496 - DNA, 22 bp, Homo sapiens
tgctataagagtcacttttcct

SEQ ID NO: 7227497 - DNA, 22 bp, Homo sapiens
tgctataagtagacattcaaca

SEQ ID NO: 7227498 - DNA, 22 bp, Homo sapiens
tgctataagaattatattactc

SEQ ID NO: 7227499 - DNA, 22 bp, Homo sapiens
tgctataagaattatattactc

SEQ ID NO: 7227500 - DNA, 22 bp, Homo sapiens
tgctatgtccagcacagagtgg

SEQ ID NO: 7227501 - DNA, 22 bp, Homo sapiens
tgctatgttgcctagtgtaata

SEQ ID NO: 7227502 - DNA, 22 bp, Homo sapiens
tgctattaaattaaattgatat

SEQ ID NO: 7227503 - DNA, 22 bp, Homo sapiens
tgctattaaattaaattgatat

SEQ ID NO: 7227504 - DNA, 22 bp, Homo sapiens
tgctatttttatcttgatcaaa

SEQ ID NO: 7227505 - DNA, 22 bp, Homo sapiens
tgctatttttatcttgatcaaa

SEQ ID NO: 7227506 - DNA, 22 bp, Homo sapiens
tgctattttagacatactttgt

SEQ ID NO: 7227507 - DNA, 16 bp, Homo sapiens
tgctattttagagagg

SEQ ID NO: 7227508 - DNA, 19 bp, Homo sapiens
tgctatttgaagaagtgta

SEQ ID NO: 7227509 - DNA, 22 bp, Homo sapiens
tgctatttggaaaagcatttgg

SEQ ID NO: 7227510 - DNA, 22 bp, Homo sapiens
tgctatttgggggctacatgat

SEQ ID NO: 7227511 - DNA, 22 bp, Homo sapiens
tgctcattggcgatctgaggga

SEQ ID NO: 7227512 - DNA, 22 bp, Homo sapiens
tgctcattggcgatctgaggga

SEQ ID NO: 7227513 - DNA, 22 bp, Homo sapiens
tgctcattggcgatctgaggga

SEQ ID NO: 7227514 - DNA, 22 bp, Homo sapiens
tgctcattggcgatctgaggga

SEQ ID NO: 7227515 - DNA, 22 bp, Homo sapiens
tgctcattggcgatctgaggga

SEQ ID NO: 7227516 - DNA, 22 bp, Homo sapiens
tgctcatttgcccattagcatc

SEQ ID NO: 7227517 - DNA, 22 bp, Homo sapiens
tgctcatttgcccattagcatc

SEQ ID NO: 7227518 - DNA, 22 bp, Homo sapiens
tgctccacctcccagctaacat

SEQ ID NO: 7227519 - DNA, 22 bp, Homo sapiens
tgctccactaagccatcccatt

SEQ ID NO: 7227520 - DNA, 22 bp, Homo sapiens
tgctccactgtgcgtggccata

SEQ ID NO: 7227521 - DNA, 22 bp, Homo sapiens
tgctccacttgggcacccccca

SEQ ID NO: 7227522 - DNA, 22 bp, Homo sapiens
tgctccactgtgcgtggccata

SEQ ID NO: 7227523 - DNA, 22 bp, Homo sapiens
tgctccacttgggcacccccca

SEQ ID NO: 7227524 - DNA, 22 bp, Homo sapiens
tgctccagaaaaacttgagact

SEQ ID NO: 7227525 - DNA, 22 bp, Homo sapiens
tgctccagaacctgaccatgct

SEQ ID NO: 7227526 - DNA, 22 bp, Homo sapiens
tgctccagaacctgaccatgct

SEQ ID NO: 7227527 - DNA, 22 bp, Homo sapiens
tgctccagaacctgaccatgct

SEQ ID NO: 7227528 - DNA, 22 bp, Homo sapiens
tgctccagaacctgaccatgct

SEQ ID NO: 7227529 - DNA, 22 bp, Homo sapiens
tgctccagcaacaggcttagct

SEQ ID NO: 7227530 - DNA, 22 bp, Homo sapiens
tgctccagcaacaggcttagct

SEQ ID NO: 7227531 - DNA, 22 bp, Homo sapiens
tgctccagcaacaggcttagct

SEQ ID NO: 7227532 - DNA, 22 bp, Homo sapiens
tgctccagcaccaagagctcca

SEQ ID NO: 7227533 - DNA, 22 bp, Homo sapiens
tgctcatcaacatgatgatcat

SEQ ID NO: 7227534 - DNA, 21 bp, Homo sapiens
tgctcatgagcccacagctgc

SEQ ID NO: 7227535 - DNA, 22 bp, Homo sapiens
tgctcatgatgccttttaaaag

SEQ ID NO: 7227536 - DNA, 22 bp, Homo sapiens
tgctcatgctggggacagatgt

SEQ ID NO: 7227537 - DNA, 19 bp, Homo sapiens
tgctcatggggacttctcc

SEQ ID NO: 7227538 - DNA, 22 bp, Homo sapiens
tgctcattaggactgcaaattc

SEQ ID NO: 7227539 - DNA, 22 bp, Homo sapiens
tgctcagttccatgagtggagt

SEQ ID NO: 7227540 - DNA, 19 bp, Homo sapiens
tgctcagtggctaaaagca

SEQ ID NO: 7227541 - DNA, 22 bp, Homo sapiens
tgctcagcttcagaggatcccc

SEQ ID NO: 7227542 - DNA, 22 bp, Homo sapiens
tgctcagctggtgccagggtcc

SEQ ID NO: 7227543 - DNA, 22 bp, Homo sapiens
tgctcagctggtgccagggtcc

SEQ ID NO: 7227544 - DNA, 18 bp, Homo sapiens
tgctcagctggtgctgaa

SEQ ID NO: 7227545 - DNA, 22 bp, Homo sapiens
tgctcagacttaagaagatcag

SEQ ID NO: 7227546 - DNA, 22 bp, Homo sapiens
tgctcagactagctccagggaa

SEQ ID NO: 7227547 - DNA, 22 bp, Homo sapiens
tgctcagaattgcgctggtgga

SEQ ID NO: 7227548 - DNA, 22 bp, Homo sapiens
tgctcagaattgcgctggtgga

SEQ ID NO: 7227549 - DNA, 22 bp, Homo sapiens
tgctcagacaagctgaacagta

SEQ ID NO: 7227550 - DNA, 22 bp, Homo sapiens
tgctcagacaagctgaacagta

SEQ ID NO: 7227551 - DNA, 22 bp, Homo sapiens
tgctcagacttaagaagatcag

SEQ ID NO: 7227552 - DNA, 22 bp, Homo sapiens
tgctcagagctccagctctcct

SEQ ID NO: 7227553 - DNA, 22 bp, Homo sapiens
tgctcagagctccagctctcct

SEQ ID NO: 7227554 - DNA, 22 bp, Homo sapiens
tgctcagagctccagctctcct

SEQ ID NO: 7227555 - DNA, 22 bp, Homo sapiens
tgctcagagctctggtgcaggt

SEQ ID NO: 7227556 - DNA, 22 bp, Homo sapiens
tgctcagagctctggtgcaggt

SEQ ID NO: 7227557 - DNA, 22 bp, Homo sapiens
tgctcagattacagccccacat

SEQ ID NO: 7227558 - DNA, 21 bp, Homo sapiens
tgctcagattctccatctgga

SEQ ID NO: 7227559 - DNA, 22 bp, Homo sapiens
tgctcagcacagaccaggccag

SEQ ID NO: 7227560 - DNA, 22 bp, Homo sapiens
tgctcagcagatctcaggagat

SEQ ID NO: 7227561 - DNA, 22 bp, Homo sapiens
tgctcagcagatctcaggagat

SEQ ID NO: 7227562 - DNA, 22 bp, Homo sapiens
tgctcagccgtgagcagagccg

SEQ ID NO: 7227563 - DNA, 22 bp, Homo sapiens
tgctcagccgtgagcagagccg

SEQ ID NO: 7227564 - DNA, 22 bp, Homo sapiens
tgctcagcagtcaaggtcatag

SEQ ID NO: 7227565 - DNA, 22 bp, Homo sapiens
tgctcagctaggctgaagaaga

SEQ ID NO: 7227566 - DNA, 19 bp, Homo sapiens
tgctcagctcctgtgagtc

SEQ ID NO: 7227567 - DNA, 22 bp, Homo sapiens
tgctcactctattcacagtgcc

SEQ ID NO: 7227568 - DNA, 21 bp, Homo sapiens
tgctcacagatgtgctcagtg

SEQ ID NO: 7227569 - DNA, 22 bp, Homo sapiens
tgctcacagcccagaacataat

SEQ ID NO: 7227570 - DNA, 22 bp, Homo sapiens
tgctcacaggtgaccctgggca

SEQ ID NO: 7227571 - DNA, 22 bp, Homo sapiens
tgctcacattaggcatccatgg

SEQ ID NO: 7227572 - DNA, 22 bp, Homo sapiens
tgctcagaaacgaggtgcagcc

SEQ ID NO: 7227573 - DNA, 22 bp, Homo sapiens
tgctcagaaacgaggtgcagcc

SEQ ID NO: 7227574 - DNA, 17 bp, Homo sapiens
tgctcaaatacttttga

SEQ ID NO: 7227575 - DNA, 17 bp, Homo sapiens
tgctcaaatacttttga

SEQ ID NO: 7227576 - DNA, 22 bp, Homo sapiens
tgctcaagtgtttgttgaatgg

SEQ ID NO: 7227577 - DNA, 22 bp, Homo sapiens
tgctcacaattatcagaagtat

SEQ ID NO: 7227578 - DNA, 22 bp, Homo sapiens
tgctcacactcatgtccacgct

SEQ ID NO: 7227579 - DNA, 22 bp, Homo sapiens
tgctcacaattatcagaagtat

SEQ ID NO: 7227580 - DNA, 18 bp, Homo sapiens
tgctcacactgacctctg

SEQ ID NO: 7227581 - DNA, 21 bp, Homo sapiens
tgctcacagatgtgctcagtg

SEQ ID NO: 7227582 - DNA, 22 bp, Homo sapiens
tgctcacagcccagaacataat

SEQ ID NO: 7227583 - DNA, 22 bp, Homo sapiens
tgcctggccctgacagccctgg

SEQ ID NO: 7227584 - DNA, 22 bp, Homo sapiens
tgcctggccagaccctatagag

SEQ ID NO: 7227585 - DNA, 20 bp, Homo sapiens
tgcctggcctttctctgccc

SEQ ID NO: 7227586 - DNA, 22 bp, Homo sapiens
tgcctggctctatcagtggtgg

SEQ ID NO: 7227587 - DNA, 22 bp, Homo sapiens
tgcctggctctatcagtggtgg

SEQ ID NO: 7227588 - DNA, 22 bp, Homo sapiens
tgcctggctgaggtgacaggtt

SEQ ID NO: 7227589 - DNA, 22 bp, Homo sapiens
tgcctggctgaggtgacaggtt

SEQ ID NO: 7227590 - DNA, 22 bp, Homo sapiens
tgcctggctgggctgctcatgg

SEQ ID NO: 7227591 - DNA, 22 bp, Homo sapiens
tgcctgggaaccaatcctggct

SEQ ID NO: 7227592 - DNA, 22 bp, Homo sapiens
tgcctgggaaccaatcctggct

SEQ ID NO: 7227593 - DNA, 22 bp, Homo sapiens
tgcctgggaaccaatcctggct

SEQ ID NO: 7227594 - DNA, 22 bp, Homo sapiens
tgcctgggctcaccgcctcttt

SEQ ID NO: 7227595 - DNA, 22 bp, Homo sapiens
tgcctgggctcggtagccatcg

SEQ ID NO: 7227596 - DNA, 22 bp, Homo sapiens
tgcctggggattgctctgggcc

SEQ ID NO: 7227597 - DNA, 22 bp, Homo sapiens
tgcctggggattgctctgggcc

SEQ ID NO: 7227598 - DNA, 22 bp, Homo sapiens
tgcctggggattgctctgggcc

SEQ ID NO: 7227599 - DNA, 22 bp, Homo sapiens
tgcctggggattgctctgggcc

SEQ ID NO: 7227600 - DNA, 22 bp, Homo sapiens
tgcctgggggactaaggccaaa

SEQ ID NO: 7227601 - DNA, 22 bp, Homo sapiens
tgcctgggggactaaggccaaa

SEQ ID NO: 7227602 - DNA, 22 bp, Homo sapiens
tgcctgggggactaaggccaaa

SEQ ID NO: 7227603 - DNA, 22 bp, Homo sapiens
tgcctgggtccaggccaagcct

SEQ ID NO: 7227604 - DNA, 22 bp, Homo sapiens
tgcctgggtccaggccaagcct

SEQ ID NO: 7227605 - DNA, 22 bp, Homo sapiens
tgcctgggtgtaaagggccaac

SEQ ID NO: 7227606 - DNA, 22 bp, Homo sapiens
tgcctgggtgtaaagggccaac

SEQ ID NO: 7227607 - DNA, 22 bp, Homo sapiens
tgcctgggttcccaccccaaag

SEQ ID NO: 7227608 - DNA, 22 bp, Homo sapiens
tgcctgtaataatgctaagcac

SEQ ID NO: 7227609 - DNA, 22 bp, Homo sapiens
tgcctgggtgccctctgctcct

SEQ ID NO: 7227610 - DNA, 22 bp, Homo sapiens
tgcctgggtgccctctgctcct

SEQ ID NO: 7227611 - DNA, 22 bp, Homo sapiens
tgcctgggtgccctctgctcct

SEQ ID NO: 7227612 - DNA, 22 bp, Homo sapiens
tgcctgggtgctggctggtcac

SEQ ID NO: 7227613 - DNA, 22 bp, Homo sapiens
tgcctgggtgctggctggtcac

SEQ ID NO: 7227614 - DNA, 22 bp, Homo sapiens
tgcctgggtccaggccaagcct

SEQ ID NO: 7227615 - DNA, 22 bp, Homo sapiens
tgcctgggtgccctctgctcct

SEQ ID NO: 7227616 - DNA, 22 bp, Homo sapiens
tgcctgggtgctggctggtcac

SEQ ID NO: 7227617 - DNA, 22 bp, Homo sapiens
tgcctgggtgctggctggtcac

SEQ ID NO: 7227618 - DNA, 22 bp, Homo sapiens
tgcctgggtgtaaagggccaac

SEQ ID NO: 7227619 - DNA, 22 bp, Homo sapiens
tgcctgggtgtaaagggccaac

SEQ ID NO: 7227620 - DNA, 22 bp, Homo sapiens
tgcctgggtgtaaagggccaac

SEQ ID NO: 7227621 - DNA, 22 bp, Homo sapiens
tgcctgtctttcctccctcgta

SEQ ID NO: 7227622 - DNA, 22 bp, Homo sapiens
tgcctgtgaaaaccctggggtt

SEQ ID NO: 7227623 - DNA, 22 bp, Homo sapiens
tgcctgtgacccaaggatgcga

SEQ ID NO: 7227624 - DNA, 22 bp, Homo sapiens
tgcctgtgacccaaggatgcga

SEQ ID NO: 7227625 - DNA, 22 bp, Homo sapiens
tgcctgtgacccaaggatgcga

SEQ ID NO: 7227626 - DNA, 17 bp, Homo sapiens
tgcctgtgataagcaca

SEQ ID NO: 7227627 - DNA, 17 bp, Homo sapiens
tgcctgtgataagcaca

SEQ ID NO: 7227628 - DNA, 22 bp, Homo sapiens
tgcctgtgatcagctgagttca

SEQ ID NO: 7227629 - DNA, 19 bp, Homo sapiens
tgcctgtcagtagatctca

SEQ ID NO: 7227630 - DNA, 22 bp, Homo sapiens
tgcctgtgggtgccaccaccct

SEQ ID NO: 7227631 - DNA, 22 bp, Homo sapiens
tgcctgtgggtgccaccaccct

SEQ ID NO: 7227632 - DNA, 22 bp, Homo sapiens
tgcctgtggttccagttttttc

SEQ ID NO: 7227633 - DNA, 22 bp, Homo sapiens
tgcctgtgtatgtgcatgcaca

SEQ ID NO: 7227634 - DNA, 19 bp, Homo sapiens
tgcctgtggcgagcatctt

SEQ ID NO: 7227635 - DNA, 19 bp, Homo sapiens
tgcctgtggcgagcatctt

SEQ ID NO: 7227636 - DNA, 22 bp, Homo sapiens
tgcctgtgggcagagggccaga

SEQ ID NO: 7227637 - DNA, 22 bp, Homo sapiens
tgcctgtgggcagagggccaga

SEQ ID NO: 7227638 - DNA, 22 bp, Homo sapiens
tgcctgtgggcagagggccaga

SEQ ID NO: 7227639 - DNA, 22 bp, Homo sapiens
tgcctgtgggtgatgatttgat

SEQ ID NO: 7227640 - DNA, 22 bp, Homo sapiens
tgcctgtgggtgatgatttgat

SEQ ID NO: 7227641 - DNA, 22 bp, Homo sapiens
tgcctgtgcccttcttggcatt

SEQ ID NO: 7227642 - DNA, 22 bp, Homo sapiens
tgcctgtgcccttcttggcatt

SEQ ID NO: 7227643 - DNA, 22 bp, Homo sapiens
tgcctgtgcccttcttggcatt

SEQ ID NO: 7227644 - DNA, 22 bp, Homo sapiens
tgcctgtgcccttcttggcatt

SEQ ID NO: 7227645 - DNA, 22 bp, Homo sapiens
tgcctgtgccctttgctgggag

SEQ ID NO: 7227646 - DNA, 22 bp, Homo sapiens
tgcctgtgccctttgctgggag

SEQ ID NO: 7227647 - DNA, 22 bp, Homo sapiens
tgcctgtgccctttgctgggag

SEQ ID NO: 7227648 - DNA, 22 bp, Homo sapiens
tgcctgtgctgggattgcatgt

SEQ ID NO: 7227649 - DNA, 22 bp, Homo sapiens
tgcctgtgctgggattgcatgt

SEQ ID NO: 7227650 - DNA, 22 bp, Homo sapiens
tgcctgtggaaaggctggtgct

SEQ ID NO: 7227651 - DNA, 22 bp, Homo sapiens
tgcctgtggaaaggctggtgct

SEQ ID NO: 7227652 - DNA, 22 bp, Homo sapiens
tgcctgtggagccactagtttt

SEQ ID NO: 7227653 - DNA, 22 bp, Homo sapiens
tgcctgtggagccactagtttt

SEQ ID NO: 7227654 - DNA, 19 bp, Homo sapiens
tgcctgtggcgagcatctt

SEQ ID NO: 7227655 - DNA, 22 bp, Homo sapiens
tgcctgtgtgaccacgggcaag

SEQ ID NO: 7227656 - DNA, 22 bp, Homo sapiens
tgcctgtgtgaccacgggcaag

SEQ ID NO: 7227657 - DNA, 22 bp, Homo sapiens
tgcctgtgtcagcaggtggaag

SEQ ID NO: 7227658 - DNA, 22 bp, Homo sapiens
tgcctgtgtcagcaggtggaag

SEQ ID NO: 7227659 - DNA, 22 bp, Homo sapiens
tgcctgtgtccccttcttggca

SEQ ID NO: 7227660 - DNA, 22 bp, Homo sapiens
tgcctgtgtccccttcttggca

SEQ ID NO: 7227661 - DNA, 22 bp, Homo sapiens
tgcctgtgtatgtgcatgcaca

SEQ ID NO: 7227662 - DNA, 22 bp, Homo sapiens
tgcctgtgtatttccggcctgc

SEQ ID NO: 7227663 - DNA, 22 bp, Homo sapiens
tgcctgtgtatttccggcctgc

SEQ ID NO: 7227664 - DNA, 22 bp, Homo sapiens
tgcctgtgtcacagtgatgttt

SEQ ID NO: 7227665 - DNA, 22 bp, Homo sapiens
tgcctgtgtcacagtgatgttt

SEQ ID NO: 7227666 - DNA, 22 bp, Homo sapiens
tgccttgctgctttggagtcct

SEQ ID NO: 7227667 - DNA, 20 bp, Homo sapiens
tgccttggagcagccaaggt

SEQ ID NO: 7227668 - DNA, 20 bp, Homo sapiens
tgccttggagcagccaaggt

SEQ ID NO: 7227669 - DNA, 22 bp, Homo sapiens
tgccttcttctccctggctcag

SEQ ID NO: 7227670 - DNA, 22 bp, Homo sapiens
tgccttggattgcagggaacct

SEQ ID NO: 7227671 - DNA, 22 bp, Homo sapiens
tgccttggaggaatgatgagag

SEQ ID NO: 7227672 - DNA, 22 bp, Homo sapiens
tgccttggaggaatgatgagag

SEQ ID NO: 7227673 - DNA, 21 bp, Homo sapiens
tgccttggcaaatgaccatga

SEQ ID NO: 7227674 - DNA, 19 bp, Homo sapiens
tgccttggctgccaggaaa

SEQ ID NO: 7227675 - DNA, 19 bp, Homo sapiens
tgccttggctgccaggaaa

SEQ ID NO: 7227676 - DNA, 20 bp, Homo sapiens
tgccttgggacagtgcctgt

SEQ ID NO: 7227677 - DNA, 22 bp, Homo sapiens
tgccttgggagccagcatgcca

SEQ ID NO: 7227678 - DNA, 22 bp, Homo sapiens
tgccttgggagccagcatgcca

SEQ ID NO: 7227679 - DNA, 22 bp, Homo sapiens
tgccttgggatatatggacact

SEQ ID NO: 7227680 - DNA, 22 bp, Homo sapiens
tgccttgggtcaacctttgagt

SEQ ID NO: 7227681 - DNA, 22 bp, Homo sapiens
tgccttggtgcttcttcatgtg

SEQ ID NO: 7227682 - DNA, 22 bp, Homo sapiens
tgccttggtgcttcttcatgtg

SEQ ID NO: 7227683 - DNA, 22 bp, Homo sapiens
tgccttggtggcagtctgcggt

SEQ ID NO: 7227684 - DNA, 22 bp, Homo sapiens
tgccttggtggcagtctgcggt

SEQ ID NO: 7227685 - DNA, 22 bp, Homo sapiens
tgccttggtggcagtctgcggt

SEQ ID NO: 7227686 - DNA, 22 bp, Homo sapiens
tgccttggttctctacttggag

SEQ ID NO: 7227687 - DNA, 22 bp, Homo sapiens
tgccttggttctctacttggag

SEQ ID NO: 7227688 - DNA, 22 bp, Homo sapiens
tgccttggttctctacttggag

SEQ ID NO: 7227689 - DNA, 22 bp, Homo sapiens
tgccttggtttccccatctgta

SEQ ID NO: 7227690 - DNA, 22 bp, Homo sapiens
tgccttggtttccccatctgta

SEQ ID NO: 7227691 - DNA, 22 bp, Homo sapiens
tgccttgtccttcgtcagggct

SEQ ID NO: 7227692 - DNA, 22 bp, Homo sapiens
tgccttttccagttcctagaag

SEQ ID NO: 7227693 - DNA, 20 bp, Homo sapiens
tgcctttcctgtttcatctt

SEQ ID NO: 7227694 - DNA, 22 bp, Homo sapiens
tgcctttggtttgctacatgcc

SEQ ID NO: 7227695 - DNA, 22 bp, Homo sapiens
tgcgatggcgtagacaaatccc

SEQ ID NO: 7227696 - DNA, 22 bp, Homo sapiens
tgcgatgtatgcagtatttgtt

SEQ ID NO: 7227697 - DNA, 17 bp, Homo sapiens
tgcgatgtctgtgtttg

SEQ ID NO: 7227698 - DNA, 22 bp, Homo sapiens
tgctgagcgcatccggcggccg

SEQ ID NO: 7227699 - DNA, 22 bp, Homo sapiens
tgctgagcgcatccggcggccg

SEQ ID NO: 7227700 - DNA, 22 bp, Homo sapiens
tgctgagcccagaacggcctgg

SEQ ID NO: 7227701 - DNA, 21 bp, Homo sapiens
tgctgagatttgcctgattac

SEQ ID NO: 7227702 - DNA, 22 bp, Homo sapiens
tgctgaagggaaggtcttgaat

SEQ ID NO: 7227703 - DNA, 22 bp, Homo sapiens
tgctgagcgcatccggcggccg

SEQ ID NO: 7227704 - DNA, 22 bp, Homo sapiens
tgctgagcgcatccggcggccg

SEQ ID NO: 7227705 - DNA, 22 bp, Homo sapiens
tgctgaggaaaaatgtgactct

SEQ ID NO: 7227706 - DNA, 22 bp, Homo sapiens
tgctgaagggaaggtcttgaat

SEQ ID NO: 7227707 - DNA, 22 bp, Homo sapiens
tgctgaaggcaggggaggtggc

SEQ ID NO: 7227708 - DNA, 22 bp, Homo sapiens
tgctgaaggcaggggaggtggc

SEQ ID NO: 7227709 - DNA, 20 bp, Homo sapiens
tgctgaagaatcacagatgg

SEQ ID NO: 7227710 - DNA, 22 bp, Homo sapiens
tgctgaaagaccgtatttatct

SEQ ID NO: 7227711 - DNA, 22 bp, Homo sapiens
tgctgaaagaccgtatttatct

SEQ ID NO: 7227712 - DNA, 19 bp, Homo sapiens
tgctgaggatgcaagatcc

SEQ ID NO: 7227713 - DNA, 19 bp, Homo sapiens
tgctgaggatgcaagatcc

SEQ ID NO: 7227714 - DNA, 19 bp, Homo sapiens
tgctgaggatgcaagatcc

SEQ ID NO: 7227715 - DNA, 19 bp, Homo sapiens
tgctgaggatgcaagatcc

SEQ ID NO: 7227716 - DNA, 22 bp, Homo sapiens
tgctgaggaggtggctgtgctt

SEQ ID NO: 7227717 - DNA, 22 bp, Homo sapiens
tgctgaggaggtggctgtgctt

SEQ ID NO: 7227718 - DNA, 22 bp, Homo sapiens
tgctgaggaggtggctgtgctt

SEQ ID NO: 7227719 - DNA, 22 bp, Homo sapiens
tgctgaggagggcacccggggg

SEQ ID NO: 7227720 - DNA, 22 bp, Homo sapiens
tgctgaggaggtggctgtgctt

SEQ ID NO: 7227721 - DNA, 22 bp, Homo sapiens
tgctgaggagggcacccggggg

SEQ ID NO: 7227722 - DNA, 22 bp, Homo sapiens
tgctgaggactaaaggagatga

SEQ ID NO: 7227723 - DNA, 22 bp, Homo sapiens
tgctgaggacacctagccttct

SEQ ID NO: 7227724 - DNA, 22 bp, Homo sapiens
tgctgaggacacctagccttct

SEQ ID NO: 7227725 - DNA, 22 bp, Homo sapiens
tgctgaggactaaaggagatga

SEQ ID NO: 7227726 - DNA, 22 bp, Homo sapiens
tgctgaggaatttggtttatgt

SEQ ID NO: 7227727 - DNA, 22 bp, Homo sapiens
tgctgaggaatttggtttatgt

SEQ ID NO: 7227728 - DNA, 22 bp, Homo sapiens
tgctgaggactaaaggagatga

SEQ ID NO: 7227729 - DNA, 22 bp, Homo sapiens
tgctgaggactaaaggagatga

SEQ ID NO: 7227730 - DNA, 22 bp, Homo sapiens
tgctgaggactaaaggagatga

SEQ ID NO: 7227731 - DNA, 22 bp, Homo sapiens
tgctgaggaataattgttcctg

SEQ ID NO: 7227732 - DNA, 22 bp, Homo sapiens
tgctgaggaataattgttcctg

SEQ ID NO: 7227733 - DNA, 22 bp, Homo sapiens
tgctgaggaaagaggataaaag

SEQ ID NO: 7227734 - DNA, 22 bp, Homo sapiens
tgctgaggaataattgttcctg

SEQ ID NO: 7227735 - DNA, 22 bp, Homo sapiens
tgctgaggaaagaggataaaag

SEQ ID NO: 7227736 - DNA, 22 bp, Homo sapiens
tgctgaggaaaaatgtgactct

SEQ ID NO: 7227737 - DNA, 22 bp, Homo sapiens
tgctgaggaaaaatgtgactct

SEQ ID NO: 7227738 - DNA, 22 bp, Homo sapiens
tgctctgtccagtgcaccatca

SEQ ID NO: 7227739 - DNA, 22 bp, Homo sapiens
tgctctgtccagtgcaccatca

SEQ ID NO: 7227740 - DNA, 20 bp, Homo sapiens
tgctctgtctaaaacttccc

SEQ ID NO: 7227741 - DNA, 20 bp, Homo sapiens
tgctctgtctaaaacttccc

SEQ ID NO: 7227742 - DNA, 22 bp, Homo sapiens
tgctctgtggtccaagatggct

SEQ ID NO: 7227743 - DNA, 22 bp, Homo sapiens
tgctctgtaacaaattgacatg

SEQ ID NO: 7227744 - DNA, 22 bp, Homo sapiens
tgctctgtaacaaattgacatg

SEQ ID NO: 7227745 - DNA, 22 bp, Homo sapiens
tgctctgtaggggaaagagagc

SEQ ID NO: 7227746 - DNA, 22 bp, Homo sapiens
tgctctgtaaggtcagaaaagg

SEQ ID NO: 7227747 - DNA, 22 bp, Homo sapiens
tgctctgtcaagaaaagatgcc

SEQ ID NO: 7227748 - DNA, 22 bp, Homo sapiens
tgctctgtgtgtggttatttcc

SEQ ID NO: 7227749 - DNA, 22 bp, Homo sapiens
tgctctgttcagtgtatcttgt

SEQ ID NO: 7227750 - DNA, 18 bp, Homo sapiens
tgctctgtttaatgattt

SEQ ID NO: 7227751 - DNA, 22 bp, Homo sapiens
tgctcttcacagtttcagcatc

SEQ ID NO: 7227752 - DNA, 22 bp, Homo sapiens
tgctcttcggggccactgcttg

SEQ ID NO: 7227753 - DNA, 22 bp, Homo sapiens
tgctcttcggggccactgcttg

SEQ ID NO: 7227754 - DNA, 23 bp, Homo sapiens
tgctcttctcagacctgtcagcc

SEQ ID NO: 7227755 - DNA, 23 bp, Homo sapiens
tgctcttctcagacctgtcagcc

SEQ ID NO: 7227756 - DNA, 23 bp, Homo sapiens
tgctcttctcagacctgtcagcc

SEQ ID NO: 7227757 - DNA, 22 bp, Homo sapiens
tgctctggtcctccctcggcgc

SEQ ID NO: 7227758 - DNA, 22 bp, Homo sapiens
tgctctggtcctccctcggcgc

SEQ ID NO: 7227759 - DNA, 18 bp, Homo sapiens
tgctctggtctcacttgg

SEQ ID NO: 7227760 - DNA, 18 bp, Homo sapiens
tgctctggtctcacttgg

SEQ ID NO: 7227761 - DNA, 18 bp, Homo sapiens
tgctctggtctcacttgg

SEQ ID NO: 7227762 - DNA, 18 bp, Homo sapiens
tgctctggtctcacttgg

SEQ ID NO: 7227763 - DNA, 18 bp, Homo sapiens
tgctctggtctcacttgg

SEQ ID NO: 7227764 - DNA, 21 bp, Homo sapiens
tgctctggtagaaactctttc

SEQ ID NO: 7227765 - DNA, 21 bp, Homo sapiens
tgctctggtagaaactctttc

SEQ ID NO: 7227766 - DNA, 22 bp, Homo sapiens
tgctctggtaactcacttccat

SEQ ID NO: 7227767 - DNA, 22 bp, Homo sapiens
tgctctggtaactcacttccat

SEQ ID NO: 7227768 - DNA, 22 bp, Homo sapiens
tgctctggtaactcacttccat

SEQ ID NO: 7227769 - DNA, 22 bp, Homo sapiens
tgctctggtaactcacttccat

SEQ ID NO: 7227770 - DNA, 20 bp, Homo sapiens
tgctctgggggtggagagac

SEQ ID NO: 7227771 - DNA, 20 bp, Homo sapiens
tgctctgggggtggagagac

SEQ ID NO: 7227772 - DNA, 20 bp, Homo sapiens
tgctctgggggtggagagac

SEQ ID NO: 7227773 - DNA, 20 bp, Homo sapiens
tgctctgggggtggagagac

SEQ ID NO: 7227774 - DNA, 20 bp, Homo sapiens
tgctctgggggtggagagac

SEQ ID NO: 7227775 - DNA, 22 bp, Homo sapiens
tgctctgggtcctgggcctcct

SEQ ID NO: 7227776 - DNA, 22 bp, Homo sapiens
tgctctgggtcctgggcctcct

SEQ ID NO: 7227777 - DNA, 22 bp, Homo sapiens
tgctctgggttcttgctgttac

SEQ ID NO: 7227778 - DNA, 22 bp, Homo sapiens
tgctgcagggccttccctgcat

SEQ ID NO: 7227779 - DNA, 22 bp, Homo sapiens
tgctgcagggccttccctgcat

SEQ ID NO: 7227780 - DNA, 22 bp, Homo sapiens
tgctgcagggatttcagagaca

SEQ ID NO: 7227781 - DNA, 22 bp, Homo sapiens
tgctgcaggccaggtcgttgtc

SEQ ID NO: 7227782 - DNA, 22 bp, Homo sapiens
tgctgcaggccttggctgggaa

SEQ ID NO: 7227783 - DNA, 22 bp, Homo sapiens
tgctgcaggtgtgttcagtgag

SEQ ID NO: 7227784 - DNA, 19 bp, Homo sapiens
tgctgcagtcaggcgaggg

SEQ ID NO: 7227785 - DNA, 20 bp, Homo sapiens
tgctgcagtttcatgggact

SEQ ID NO: 7227786 - DNA, 22 bp, Homo sapiens
tgctgcagttattgaaactatg

SEQ ID NO: 7227787 - DNA, 22 bp, Homo sapiens
tgctgcagtgggattagcctga

SEQ ID NO: 7227788 - DNA, 22 bp, Homo sapiens
tgctgcagtgggattagcctga

SEQ ID NO: 7227789 - DNA, 22 bp, Homo sapiens
tgctgagtacactaaagaacat

SEQ ID NO: 7227790 - DNA, 22 bp, Homo sapiens
tgctgagtacactaaagaacat

SEQ ID NO: 7227791 - DNA, 22 bp, Homo sapiens
tgctgagtactctcctgtgtag

SEQ ID NO: 7227792 - DNA, 22 bp, Homo sapiens
tgctgaggtttctgactatgga

SEQ ID NO: 7227793 - DNA, 22 bp, Homo sapiens
tgctgaggtttcgtctgcttgc

SEQ ID NO: 7227794 - DNA, 22 bp, Homo sapiens
tgctgaggtttcgtctgcttgc

SEQ ID NO: 7227795 - DNA, 22 bp, Homo sapiens
tgctgaggtttctgactatgga

SEQ ID NO: 7227796 - DNA, 22 bp, Homo sapiens
tgctgaggttgtggagtgcatt

SEQ ID NO: 7227797 - DNA, 22 bp, Homo sapiens
tgctgaggttgtggagtgcatt

SEQ ID NO: 7227798 - DNA, 22 bp, Homo sapiens
tgctgaggttgtggagtgcatt

SEQ ID NO: 7227799 - DNA, 22 bp, Homo sapiens
tgctgaggttgtggagtgcatt

SEQ ID NO: 7227800 - DNA, 22 bp, Homo sapiens
tgctgaggttgtggagtgcatt

SEQ ID NO: 7227801 - DNA, 22 bp, Homo sapiens
tgctgaggttgtggagtgcatt

SEQ ID NO: 7227802 - DNA, 21 bp, Homo sapiens
tgctgatgtcagagaagcaag

SEQ ID NO: 7227803 - DNA, 22 bp, Homo sapiens
tgctgattttgcctactgatcc

SEQ ID NO: 7227804 - DNA, 18 bp, Homo sapiens
tgctgatggtccattagt

SEQ ID NO: 7227805 - DNA, 22 bp, Homo sapiens
tgctgagtatttgtttgaataa

SEQ ID NO: 7227806 - DNA, 22 bp, Homo sapiens
tgctgagtcgtattatttttta

SEQ ID NO: 7227807 - DNA, 22 bp, Homo sapiens
tgctgagtctgaaacagctcag

SEQ ID NO: 7227808 - DNA, 22 bp, Homo sapiens
tgctgagtgggattcctgtgct

SEQ ID NO: 7227809 - DNA, 22 bp, Homo sapiens
tgctgatatattctagttttct

SEQ ID NO: 7227810 - DNA, 22 bp, Homo sapiens
tgctgatgagtccttctatcgc

SEQ ID NO: 7227811 - DNA, 20 bp, Homo sapiens
tgctgaggttgacatgccca

SEQ ID NO: 7227812 - DNA, 20 bp, Homo sapiens
tgctgaggttgacatgccca

SEQ ID NO: 7227813 - DNA, 22 bp, Homo sapiens
tgctgaggtcatttccaagtga

SEQ ID NO: 7227814 - DNA, 20 bp, Homo sapiens
tgctgaggttgacatgccca

SEQ ID NO: 7227815 - DNA, 20 bp, Homo sapiens
tgctgaggttgacatgccca

SEQ ID NO: 7227816 - DNA, 22 bp, Homo sapiens
tgctgaggtcatttccaagtga

SEQ ID NO: 7227817 - DNA, 22 bp, Homo sapiens
tgctgaggtcatttccaagtga

SEQ ID NO: 7227818 - DNA, 22 bp, Homo sapiens
tgctgaggtcatttccaagtga

SEQ ID NO: 7227819 - DNA, 22 bp, Homo sapiens
tgctgaggtcacggcggccaga

SEQ ID NO: 7227820 - DNA, 22 bp, Homo sapiens
tgctgaggtcacggcggccaga

SEQ ID NO: 7227821 - DNA, 22 bp, Homo sapiens
tgctgaggtcacggcggccaga

SEQ ID NO: 7227822 - DNA, 22 bp, Homo sapiens
tgctgaggtcaccttgctgcta

SEQ ID NO: 7227823 - DNA, 22 bp, Homo sapiens
tgctgaggtcacggcggccaga

SEQ ID NO: 7227824 - DNA, 22 bp, Homo sapiens
tgctgaggtcaccttgctgcta

SEQ ID NO: 7227825 - DNA, 22 bp, Homo sapiens
tgctgaggtaaccatatcctgc

SEQ ID NO: 7227826 - DNA, 22 bp, Homo sapiens
tgctgaggtcaccttgctgcta

SEQ ID NO: 7227827 - DNA, 22 bp, Homo sapiens
tgctgagggctgttaaggaagc

SEQ ID NO: 7227828 - DNA, 22 bp, Homo sapiens
tgctgagggcagatgaattaga

SEQ ID NO: 7227829 - DNA, 22 bp, Homo sapiens
tgctgagggctgttaaggaagc

SEQ ID NO: 7227830 - DNA, 22 bp, Homo sapiens
tgctgagggaggggttttccag

SEQ ID NO: 7227831 - DNA, 22 bp, Homo sapiens
tgctgagggaggggttttccag

SEQ ID NO: 7227832 - DNA, 22 bp, Homo sapiens
tgctgagggagcatcaaagaaa

SEQ ID NO: 7227833 - DNA, 22 bp, Homo sapiens
tgctgagggagcatcaaagaaa

SEQ ID NO: 7227834 - DNA, 22 bp, Homo sapiens
tgctgaggctagacctggaagt

SEQ ID NO: 7227835 - DNA, 22 bp, Homo sapiens
tgctgagggagcatcaaagaaa

SEQ ID NO: 7227836 - DNA, 22 bp, Homo sapiens
tgctgagggagcatcaaagaaa

SEQ ID NO: 7227837 - DNA, 22 bp, Homo sapiens
tgctgaggcatttggacagagt

SEQ ID NO: 7227838 - DNA, 22 bp, Homo sapiens
tgctgaggcagtcctaacagga

SEQ ID NO: 7227839 - DNA, 22 bp, Homo sapiens
tgctgaggcatttggacagagt

SEQ ID NO: 7227840 - DNA, 22 bp, Homo sapiens
tgctgaggcatttggacagagt

SEQ ID NO: 7227841 - DNA, 22 bp, Homo sapiens
tgctgaggcatttggacagagt

SEQ ID NO: 7227842 - DNA, 22 bp, Homo sapiens
tgctgaggcagatgtctgtgac

SEQ ID NO: 7227843 - DNA, 22 bp, Homo sapiens
tgctgaggcagatgtctgtgac

SEQ ID NO: 7227844 - DNA, 22 bp, Homo sapiens
tgctgaggcagatgtctgtgac

SEQ ID NO: 7227845 - DNA, 22 bp, Homo sapiens
tgctgaggcagtcctaacagga

SEQ ID NO: 7227846 - DNA, 22 bp, Homo sapiens
tgctgaggcagatgtctgtgac

SEQ ID NO: 7227847 - DNA, 22 bp, Homo sapiens
tgctgaggcagatgtctgtgac

SEQ ID NO: 7227848 - DNA, 22 bp, Homo sapiens
tgctgaggcagatgtctgtgac

SEQ ID NO: 7227849 - DNA, 20 bp, Homo sapiens
tgctgaggcctgaggcctgg

SEQ ID NO: 7227850 - DNA, 22 bp, Homo sapiens
tgctgaggctagacctggaagt

SEQ ID NO: 7227851 - DNA, 22 bp, Homo sapiens
tgctgaggcccaggagcacttt

SEQ ID NO: 7227852 - DNA, 20 bp, Homo sapiens
tgctgaggcctgaggcctgg

SEQ ID NO: 7227853 - DNA, 20 bp, Homo sapiens
tgctgaggcctgaggcctgg

SEQ ID NO: 7227854 - DNA, 22 bp, Homo sapiens
tgctgaggcccaggagcacttt

SEQ ID NO: 7227855 - DNA, 22 bp, Homo sapiens
tgctgaggcccaggagcacttt

SEQ ID NO: 7227856 - DNA, 22 bp, Homo sapiens
tgctgaggcatttggacagagt

SEQ ID NO: 7227857 - DNA, 20 bp, Homo sapiens
tgctccaggaacactggccg

SEQ ID NO: 7227858 - DNA, 20 bp, Homo sapiens
tgctccaggaacactggccg

SEQ ID NO: 7227859 - DNA, 20 bp, Homo sapiens
tgctccaggaacactggccg

SEQ ID NO: 7227860 - DNA, 20 bp, Homo sapiens
tgctccaggaacactggccg

SEQ ID NO: 7227861 - DNA, 20 bp, Homo sapiens
tgctccaggaacactggccg

SEQ ID NO: 7227862 - DNA, 22 bp, Homo sapiens
tgctccaggagcaacctttgag

SEQ ID NO: 7227863 - DNA, 22 bp, Homo sapiens
tgctccagcgctgccaccagtt

SEQ ID NO: 7227864 - DNA, 22 bp, Homo sapiens
tgctccagcgctgccaccagtt

SEQ ID NO: 7227865 - DNA, 22 bp, Homo sapiens
tgctccagctggagatgggggc

SEQ ID NO: 7227866 - DNA, 20 bp, Homo sapiens
tgctccaggaacactggccg

SEQ ID NO: 7227867 - DNA, 22 bp, Homo sapiens
tgctccagcaccaagagctcca

SEQ ID NO: 7227868 - DNA, 22 bp, Homo sapiens
tgctccagcatgaccctcaatg

SEQ ID NO: 7227869 - DNA, 22 bp, Homo sapiens
tgctccagcatgaccctcaatg

SEQ ID NO: 7227870 - DNA, 22 bp, Homo sapiens
tgctccagcccctggtgcacag

SEQ ID NO: 7227871 - DNA, 22 bp, Homo sapiens
tgctccagcccctggtgcacag

SEQ ID NO: 7227872 - DNA, 22 bp, Homo sapiens
tgctccagcctatgctctccgg

SEQ ID NO: 7227873 - DNA, 22 bp, Homo sapiens
tgctccagcctatgctctccgg

SEQ ID NO: 7227874 - DNA, 22 bp, Homo sapiens
tgctccagcctatgctctccgg

SEQ ID NO: 7227875 - DNA, 22 bp, Homo sapiens
tgctccagcgctgccaccagtt

SEQ ID NO: 7227876 - DNA, 22 bp, Homo sapiens
tgctccaggagcactttccatt

SEQ ID NO: 7227877 - DNA, 21 bp, Homo sapiens
tgctccaggagggggcagtcc

SEQ ID NO: 7227878 - DNA, 21 bp, Homo sapiens
tgctccaggagggggcagtcc

SEQ ID NO: 7227879 - DNA, 21 bp, Homo sapiens
tgctccaggagggggcagtcc

SEQ ID NO: 7227880 - DNA, 22 bp, Homo sapiens
tgctccaggcaagctgagagtt

SEQ ID NO: 7227881 - DNA, 18 bp, Homo sapiens
tgctccaggcccatgggc

SEQ ID NO: 7227882 - DNA, 18 bp, Homo sapiens
tgctccaggcccatgggc

SEQ ID NO: 7227883 - DNA, 18 bp, Homo sapiens
tgctccaggcccatgggc

SEQ ID NO: 7227884 - DNA, 18 bp, Homo sapiens
tgctccaggcccatgggc

SEQ ID NO: 7227885 - DNA, 18 bp, Homo sapiens
tgctccaggcccatgggc

SEQ ID NO: 7227886 - DNA, 22 bp, Homo sapiens
tgctccaggccgcctggggctg

SEQ ID NO: 7227887 - DNA, 22 bp, Homo sapiens
tgctccaggccgcctggggctg

SEQ ID NO: 7227888 - DNA, 22 bp, Homo sapiens
tgctccaggccgcctggggctg

SEQ ID NO: 7227889 - DNA, 19 bp, Homo sapiens
tgctccaggccttgccgca

SEQ ID NO: 7227890 - DNA, 19 bp, Homo sapiens
tgctccaggccttgccgca

SEQ ID NO: 7227891 - DNA, 22 bp, Homo sapiens
tgctccaggctgctgaagatct

SEQ ID NO: 7227892 - DNA, 21 bp, Homo sapiens
tgctccagggcagcttccagc

SEQ ID NO: 7227893 - DNA, 21 bp, Homo sapiens
tgctccagggcagcttccagc

SEQ ID NO: 7227894 - DNA, 22 bp, Homo sapiens
tgctccagggcctccagtgggg

SEQ ID NO: 7227895 - DNA, 22 bp, Homo sapiens
tgctccagggcctccagtgggg

SEQ ID NO: 7227896 - DNA, 22 bp, Homo sapiens
tgctccgggaaagagcagccgc

SEQ ID NO: 7227897 - DNA, 22 bp, Homo sapiens
tgctcctgaacacagccctatg

SEQ ID NO: 7227898 - DNA, 22 bp, Homo sapiens
tgctcccagggactctggctgg

SEQ ID NO: 7227899 - DNA, 22 bp, Homo sapiens
tgctccctgacccaggtcttct

SEQ ID NO: 7227900 - DNA, 22 bp, Homo sapiens
tgctcccatgtgtgggtacaga

SEQ ID NO: 7227901 - DNA, 22 bp, Homo sapiens
tgctccagggcctccagtgggg

SEQ ID NO: 7227902 - DNA, 22 bp, Homo sapiens
tgctccagggcctccagtgggg

SEQ ID NO: 7227903 - DNA, 22 bp, Homo sapiens
tgctccagggcctccagtgggg

SEQ ID NO: 7227904 - DNA, 22 bp, Homo sapiens
tgctccagggcctccagtgggg

SEQ ID NO: 7227905 - DNA, 22 bp, Homo sapiens
tgctcccaggcattctctgttg

SEQ ID NO: 7227906 - DNA, 22 bp, Homo sapiens
tgctcccaggcattctctgttg

SEQ ID NO: 7227907 - DNA, 22 bp, Homo sapiens
tgctcccaggctctgtggtctg

SEQ ID NO: 7227908 - DNA, 22 bp, Homo sapiens
tgctcccagggactctggctgg

SEQ ID NO: 7227909 - DNA, 22 bp, Homo sapiens
tgctcctgagtgtgcaggagat

SEQ ID NO: 7227910 - DNA, 22 bp, Homo sapiens
tgctcctgaggttggagatcca

SEQ ID NO: 7227911 - DNA, 22 bp, Homo sapiens
tgctcctgaggttggagatcca

SEQ ID NO: 7227912 - DNA, 22 bp, Homo sapiens
tgctcctgagtgtgcaggagat

SEQ ID NO: 7227913 - DNA, 22 bp, Homo sapiens
tgctcctgagtgtgcaggagat

SEQ ID NO: 7227914 - DNA, 22 bp, Homo sapiens
tgctcctgatatctaatgtgta

SEQ ID NO: 7227915 - DNA, 22 bp, Homo sapiens
tgctcctgatatctaatgtgta

SEQ ID NO: 7227916 - DNA, 22 bp, Homo sapiens
tgctcctgaacacagccctatg

SEQ ID NO: 7227917 - DNA, 22 bp, Homo sapiens
tgctcctgaattacactactac

SEQ ID NO: 7227918 - DNA, 22 bp, Homo sapiens
tgctcctgacagagtccatatg

SEQ ID NO: 7227919 - DNA, 22 bp, Homo sapiens
tgctcctgacagagtccatatg

SEQ ID NO: 7227920 - DNA, 22 bp, Homo sapiens
tgctcctgacagttttaggctc

SEQ ID NO: 7227921 - DNA, 22 bp, Homo sapiens
tgctcctgacagttttaggctc

SEQ ID NO: 7227922 - DNA, 22 bp, Homo sapiens
tgctcctgagcggtttccatga

SEQ ID NO: 7227923 - DNA, 22 bp, Homo sapiens
tgctcctgagcggtttccatga

SEQ ID NO: 7227924 - DNA, 22 bp, Homo sapiens
tgctcctgctcctcccggttga

SEQ ID NO: 7227925 - DNA, 22 bp, Homo sapiens
tgctcctgctgcatgcatctcc

SEQ ID NO: 7227926 - DNA, 22 bp, Homo sapiens
tgctcctgctgcatgcatctcc

SEQ ID NO: 7227927 - DNA, 22 bp, Homo sapiens
tgctcctgctggccctcgtgcc

SEQ ID NO: 7227928 - DNA, 22 bp, Homo sapiens
tgctctagctcataggactcat

SEQ ID NO: 7227929 - DNA, 22 bp, Homo sapiens
tgctctaagaactctaggaatt

SEQ ID NO: 7227930 - DNA, 15 bp, Homo sapiens
tgctctaagatgagg

SEQ ID NO: 7227931 - DNA, 22 bp, Homo sapiens
tgctctaagaactctaggaatt

SEQ ID NO: 7227932 - DNA, 22 bp, Homo sapiens
tgctcgctgactcaacaagctt

SEQ ID NO: 7227933 - DNA, 22 bp, Homo sapiens
tgctcgccccacatgccctcat

SEQ ID NO: 7227934 - DNA, 22 bp, Homo sapiens
tgctctagctcataggactcat

SEQ ID NO: 7227935 - DNA, 22 bp, Homo sapiens
tgctctagtgggtagagcattg

SEQ ID NO: 7227936 - DNA, 22 bp, Homo sapiens
tgctctcagagtcaggaggtaa

SEQ ID NO: 7227937 - DNA, 22 bp, Homo sapiens
tgctcgccccacatgccctcat

SEQ ID NO: 7227938 - DNA, 22 bp, Homo sapiens
tgctcgaggtccccaccggctc

SEQ ID NO: 7227939 - DNA, 22 bp, Homo sapiens
tgctcgaggtccccaccggctc

SEQ ID NO: 7227940 - DNA, 22 bp, Homo sapiens
tgctcgccccacatgccctcat

SEQ ID NO: 7227941 - DNA, 22 bp, Homo sapiens
tgctccttcccttcccagtgag

SEQ ID NO: 7227942 - DNA, 22 bp, Homo sapiens
tgctccttcctcatcctgtgca

SEQ ID NO: 7227943 - DNA, 22 bp, Homo sapiens
tgctccttcctcatcctgtgca

SEQ ID NO: 7227944 - DNA, 21 bp, Homo sapiens
tgctcctttaccccacaagac

SEQ ID NO: 7227945 - DNA, 22 bp, Homo sapiens
tgctcctttcatccaattctca

SEQ ID NO: 7227946 - DNA, 22 bp, Homo sapiens
tgctcgaggtccccaccggctc

SEQ ID NO: 7227947 - DNA, 22 bp, Homo sapiens
tgctcctgtttcatcagctata

SEQ ID NO: 7227948 - DNA, 22 bp, Homo sapiens
tgctcctgtttcatcagctata

SEQ ID NO: 7227949 - DNA, 22 bp, Homo sapiens
tgctcctgtttcatcagctata

SEQ ID NO: 7227950 - DNA, 21 bp, Homo sapiens
tgctccttagctgcccctgcc

SEQ ID NO: 7227951 - DNA, 22 bp, Homo sapiens
tgctcctgtttcatcagctata

SEQ ID NO: 7227952 - DNA, 17 bp, Homo sapiens
tgctcctgggacaagga

SEQ ID NO: 7227953 - DNA, 22 bp, Homo sapiens
tgctcctgggctgaagcacact

SEQ ID NO: 7227954 - DNA, 17 bp, Homo sapiens
tgctcctgtggcagcct

SEQ ID NO: 7227955 - DNA, 17 bp, Homo sapiens
tgctcctgtggcagcct

SEQ ID NO: 7227956 - DNA, 17 bp, Homo sapiens
tgctcctgtggcagcct

SEQ ID NO: 7227957 - DNA, 17 bp, Homo sapiens
tgctcctgtggcagcct

SEQ ID NO: 7227958 - DNA, 17 bp, Homo sapiens
tgctcctgtggcagcct

SEQ ID NO: 7227959 - DNA, 17 bp, Homo sapiens
tgctcctgtggcagcct

SEQ ID NO: 7227960 - DNA, 22 bp, Homo sapiens
tgctcctggcatctctgcgtcc

SEQ ID NO: 7227961 - DNA, 22 bp, Homo sapiens
tgctcctggctccttccctaac

SEQ ID NO: 7227962 - DNA, 22 bp, Homo sapiens
tgctcctggctccttccctaac

SEQ ID NO: 7227963 - DNA, 22 bp, Homo sapiens
tgctcctggcttcaggttgggc

SEQ ID NO: 7227964 - DNA, 22 bp, Homo sapiens
tgctcctggactggtgtgagat

SEQ ID NO: 7227965 - DNA, 22 bp, Homo sapiens
tgctctggggctccccaccaga

SEQ ID NO: 7227966 - DNA, 22 bp, Homo sapiens
tgctctggggctccccaccaga

SEQ ID NO: 7227967 - DNA, 22 bp, Homo sapiens
tgctctgggggaagccagctgt

SEQ ID NO: 7227968 - DNA, 22 bp, Homo sapiens
tgctctgggggaagccagctgt

SEQ ID NO: 7227969 - DNA, 22 bp, Homo sapiens
tgctctgggggaagccagctgt

SEQ ID NO: 7227970 - DNA, 22 bp, Homo sapiens
tgctctgggggaagccagctgt

SEQ ID NO: 7227971 - DNA, 22 bp, Homo sapiens
tgctctgggggaagccagctgt

SEQ ID NO: 7227972 - DNA, 22 bp, Homo sapiens
tgctctgggggaagccagctgt

SEQ ID NO: 7227973 - DNA, 22 bp, Homo sapiens
tgctctggggagctcctctgcg

SEQ ID NO: 7227974 - DNA, 22 bp, Homo sapiens
tgctctggggagctcctctgcg

SEQ ID NO: 7227975 - DNA, 22 bp, Homo sapiens
tgctctggggagctcctctgcg

SEQ ID NO: 7227976 - DNA, 22 bp, Homo sapiens
tgctctggggagctcctctgcg

SEQ ID NO: 7227977 - DNA, 22 bp, Homo sapiens
tgctctggggagctcctctgcg

SEQ ID NO: 7227978 - DNA, 22 bp, Homo sapiens
tgctctggggagctcctctgcg

SEQ ID NO: 7227979 - DNA, 22 bp, Homo sapiens
tgctctgggctatctgagaaag

SEQ ID NO: 7227980 - DNA, 22 bp, Homo sapiens
tgctctgggctatctgagaaag

SEQ ID NO: 7227981 - DNA, 22 bp, Homo sapiens
tgctctgggctcaatggcagct

SEQ ID NO: 7227982 - DNA, 22 bp, Homo sapiens
tgctctgggctcaatggcagct

SEQ ID NO: 7227983 - DNA, 22 bp, Homo sapiens
tgctctgggctcaatggcagct

SEQ ID NO: 7227984 - DNA, 22 bp, Homo sapiens
tgctctgggctatctgagaaag

SEQ ID NO: 7227985 - DNA, 22 bp, Homo sapiens
tgctctgggcaacagcctccct

SEQ ID NO: 7227986 - DNA, 22 bp, Homo sapiens
tgctctgggcaacagcctccct

SEQ ID NO: 7227987 - DNA, 22 bp, Homo sapiens
tgctctgggattcagcagcctg

SEQ ID NO: 7227988 - DNA, 22 bp, Homo sapiens
tgctctgggcaacagcctccct

SEQ ID NO: 7227989 - DNA, 22 bp, Homo sapiens
tgctctgggattcagcagcctg

SEQ ID NO: 7227990 - DNA, 23 bp, Homo sapiens
tgctctgggaggccctggagagc

SEQ ID NO: 7227991 - DNA, 23 bp, Homo sapiens
tgctctgggaggccctggagagc

SEQ ID NO: 7227992 - DNA, 23 bp, Homo sapiens
tgctctgggaggccctggagagc

SEQ ID NO: 7227993 - DNA, 22 bp, Homo sapiens
tgctctggctgggatgagtgca

SEQ ID NO: 7227994 - DNA, 22 bp, Homo sapiens
tgctctggctggagcaatgact

SEQ ID NO: 7227995 - DNA, 22 bp, Homo sapiens
tgctctggctggagcaatgact

SEQ ID NO: 7227996 - DNA, 22 bp, Homo sapiens
tgctctggctgggatgagtgca

SEQ ID NO: 7227997 - DNA, 22 bp, Homo sapiens
tgctctccggcttccgtggcct

SEQ ID NO: 7227998 - DNA, 22 bp, Homo sapiens
tgctctccggcttccgtggcct

SEQ ID NO: 7227999 - DNA, 22 bp, Homo sapiens
tgctctcagagtcaggaggtaa

SEQ ID NO: 7228000 - DNA, 22 bp, Homo sapiens
tgctctcatggaggtagagaat

SEQ ID NO: 7228001 - DNA, 19 bp, Homo sapiens
tgctctctggtgcttcatg

SEQ ID NO: 7228002 - DNA, 19 bp, Homo sapiens
tgctctctggtgcttcatg

SEQ ID NO: 7228003 - DNA, 22 bp, Homo sapiens
tgctctcctgctcctcagccca

SEQ ID NO: 7228004 - DNA, 20 bp, Homo sapiens
tgctgggtgggcagctgtaa

SEQ ID NO: 7228005 - DNA, 22 bp, Homo sapiens
tgctgggtcccttgagagctca

SEQ ID NO: 7228006 - DNA, 21 bp, Homo sapiens
tgctgggtttgcccatcaggc

SEQ ID NO: 7228007 - DNA, 22 bp, Homo sapiens
tgctggtaccgcgcctccgcca

SEQ ID NO: 7228008 - DNA, 22 bp, Homo sapiens
tgctggtcccctgcagcctgtg

SEQ ID NO: 7228009 - DNA, 22 bp, Homo sapiens
tgctggtcctggagctgggttc

SEQ ID NO: 7228010 - DNA, 21 bp, Homo sapiens
tgctggtgagctcatgtggct

SEQ ID NO: 7228011 - DNA, 22 bp, Homo sapiens
tgctggtgaggtccttgctgga

SEQ ID NO: 7228012 - DNA, 22 bp, Homo sapiens
tgctggtgaggtccttgctgga

SEQ ID NO: 7228013 - DNA, 22 bp, Homo sapiens
tgctggtgaggtccttgctgga

SEQ ID NO: 7228014 - DNA, 22 bp, Homo sapiens
tgctggtggagaaagtggaggt

SEQ ID NO: 7228015 - DNA, 22 bp, Homo sapiens
tgctgtatatattttgaagtga

SEQ ID NO: 7228016 - DNA, 22 bp, Homo sapiens
tgctgtatatattttgaagtga

SEQ ID NO: 7228017 - DNA, 22 bp, Homo sapiens
tgctgtattacttttacaaact

SEQ ID NO: 7228018 - DNA, 22 bp, Homo sapiens
tgctgtatttatggccactgaa

SEQ ID NO: 7228019 - DNA, 22 bp, Homo sapiens
tgctgtcaaggttacatgcttt

SEQ ID NO: 7228020 - DNA, 22 bp, Homo sapiens
tgctgtcaatttagtttacctg

SEQ ID NO: 7228021 - DNA, 23 bp, Homo sapiens
tgctgtccaacagactggccatg

SEQ ID NO: 7228022 - DNA, 23 bp, Homo sapiens
tgctgtccaacagactggccatg

SEQ ID NO: 7228023 - DNA, 23 bp, Homo sapiens
tgctggtgtttttgggaccaggg

SEQ ID NO: 7228024 - DNA, 22 bp, Homo sapiens
tgctggttctttccttcccttc

SEQ ID NO: 7228025 - DNA, 22 bp, Homo sapiens
tgctggttctttccttcccttc

SEQ ID NO: 7228026 - DNA, 22 bp, Homo sapiens
tgctggttgtattttctctgtg

SEQ ID NO: 7228027 - DNA, 22 bp, Homo sapiens
tgctggttgtattttctctgtg

SEQ ID NO: 7228028 - DNA, 22 bp, Homo sapiens
tgctggttgtattttctctgtg

SEQ ID NO: 7228029 - DNA, 20 bp, Homo sapiens
tgctgtaagattagagagct

SEQ ID NO: 7228030 - DNA, 20 bp, Homo sapiens
tgctgtaagattagagagct

SEQ ID NO: 7228031 - DNA, 22 bp, Homo sapiens
tgctgtagccctgcacagtgca

SEQ ID NO: 7228032 - DNA, 22 bp, Homo sapiens
tgctgtatatattttgaagtga

SEQ ID NO: 7228033 - DNA, 22 bp, Homo sapiens
tgctggggatccgtaccaaccc

SEQ ID NO: 7228034 - DNA, 22 bp, Homo sapiens
tgctggggcagaagagccaaga

SEQ ID NO: 7228035 - DNA, 22 bp, Homo sapiens
tgctggggcagaagagccaaga

SEQ ID NO: 7228036 - DNA, 22 bp, Homo sapiens
tgctggggcagaagagccaaga

SEQ ID NO: 7228037 - DNA, 16 bp, Homo sapiens
tgctggggcgccgtcc

SEQ ID NO: 7228038 - DNA, 16 bp, Homo sapiens
tgctggggcgccgtcc

SEQ ID NO: 7228039 - DNA, 16 bp, Homo sapiens
tgctggggcgccgtcc

SEQ ID NO: 7228040 - DNA, 22 bp, Homo sapiens
tgctggggcagaagagccaaga

SEQ ID NO: 7228041 - DNA, 20 bp, Homo sapiens
tgctggggacatacagggtg

SEQ ID NO: 7228042 - DNA, 20 bp, Homo sapiens
tgctggggacatacagggtg

SEQ ID NO: 7228043 - DNA, 20 bp, Homo sapiens
tgctggggacatacagggtg

SEQ ID NO: 7228044 - DNA, 22 bp, Homo sapiens
tgctggggagtgattgaccatc

SEQ ID NO: 7228045 - DNA, 22 bp, Homo sapiens
tgctggggatccgtaccaaccc

SEQ ID NO: 7228046 - DNA, 22 bp, Homo sapiens
tgctggggatccgtaccaaccc

SEQ ID NO: 7228047 - DNA, 20 bp, Homo sapiens
tgctggggacatacagggtg

SEQ ID NO: 7228048 - DNA, 22 bp, Homo sapiens
tgctggggagtgattgaccatc

SEQ ID NO: 7228049 - DNA, 22 bp, Homo sapiens
tgctggggagtgattgaccatc

SEQ ID NO: 7228050 - DNA, 23 bp, Homo sapiens
tgctgggtatcagaatcactgag

SEQ ID NO: 7228051 - DNA, 22 bp, Homo sapiens
tgctgggtcaggcatctgcaga

SEQ ID NO: 7228052 - DNA, 19 bp, Homo sapiens
tgctgggtcatatggaaac

SEQ ID NO: 7228053 - DNA, 22 bp, Homo sapiens
tgctggggtctctccggtgccc

SEQ ID NO: 7228054 - DNA, 22 bp, Homo sapiens
tgctggggtctctccggtgccc

SEQ ID NO: 7228055 - DNA, 22 bp, Homo sapiens
tgctggggtctctccggtgccc

SEQ ID NO: 7228056 - DNA, 22 bp, Homo sapiens
tgctggggtcatggggcgcccg

SEQ ID NO: 7228057 - DNA, 22 bp, Homo sapiens
tgctggggtcatggggcgcccg

SEQ ID NO: 7228058 - DNA, 22 bp, Homo sapiens
tgctggggtcatggggcgcccg

SEQ ID NO: 7228059 - DNA, 23 bp, Homo sapiens
tgctggggtagtttgtggcacag

SEQ ID NO: 7228060 - DNA, 23 bp, Homo sapiens
tgctggggtagtttgtggcacag

SEQ ID NO: 7228061 - DNA, 22 bp, Homo sapiens
tgctggggtcatggggcgcccg

SEQ ID NO: 7228062 - DNA, 22 bp, Homo sapiens
tgctggggtcatggggcgcccg

SEQ ID NO: 7228063 - DNA, 22 bp, Homo sapiens
tgctggggctctgaccactcca

SEQ ID NO: 7228064 - DNA, 22 bp, Homo sapiens
tgctggggctctgaccactcca

SEQ ID NO: 7228065 - DNA, 22 bp, Homo sapiens
tgctgggcatcgtaggaggtac

SEQ ID NO: 7228066 - DNA, 22 bp, Homo sapiens
tgctgggcatcgtaggaggtac

SEQ ID NO: 7228067 - DNA, 23 bp, Homo sapiens
tgctgggcagagctggtgctgag

SEQ ID NO: 7228068 - DNA, 23 bp, Homo sapiens
tgctgggcagagctggtgctgag

SEQ ID NO: 7228069 - DNA, 23 bp, Homo sapiens
tgctgggcagagctggtgctgag

SEQ ID NO: 7228070 - DNA, 22 bp, Homo sapiens
tgctgggcagtgtgccctcgag

SEQ ID NO: 7228071 - DNA, 22 bp, Homo sapiens
tgctgggcagtgtgccctcgag

SEQ ID NO: 7228072 - DNA, 22 bp, Homo sapiens
tgctgggcatcgtaggaggtac

SEQ ID NO: 7228073 - DNA, 22 bp, Homo sapiens
tgctgggcatcgtaggaggtac

SEQ ID NO: 7228074 - DNA, 20 bp, Homo sapiens
tgctgggcatgcagtggaaa

SEQ ID NO: 7228075 - DNA, 20 bp, Homo sapiens
tgctgggcatgcagtggaaa

SEQ ID NO: 7228076 - DNA, 20 bp, Homo sapiens
tgctgggcatgcagtggaaa

SEQ ID NO: 7228077 - DNA, 20 bp, Homo sapiens
tgctgggcatgcagtggaaa

SEQ ID NO: 7228078 - DNA, 20 bp, Homo sapiens
tgctgggcatgcagtggaaa

SEQ ID NO: 7228079 - DNA, 23 bp, Homo sapiens
tgctgggcagagctggtgctgag

SEQ ID NO: 7228080 - DNA, 23 bp, Homo sapiens
tgctgggcagagctggtgctgag

SEQ ID NO: 7228081 - DNA, 22 bp, Homo sapiens
tgctgggcactgtctctgggga

SEQ ID NO: 7228082 - DNA, 22 bp, Homo sapiens
tgctgggcactgtctctgggga

SEQ ID NO: 7228083 - DNA, 22 bp, Homo sapiens
tgctgggcactgtctctgggga

SEQ ID NO: 7228084 - DNA, 20 bp, Homo sapiens
tgctgggcatgcagtggaaa

SEQ ID NO: 7228085 - DNA, 18 bp, Homo sapiens
tgctgggcattaggctta

SEQ ID NO: 7228086 - DNA, 18 bp, Homo sapiens
tgctgggcattaggctta

SEQ ID NO: 7228087 - DNA, 22 bp, Homo sapiens
tgctgggcatttatgcagatgg

SEQ ID NO: 7228088 - DNA, 22 bp, Homo sapiens
tgctgggcatttatgcagatgg

SEQ ID NO: 7228089 - DNA, 22 bp, Homo sapiens
tgctgggcatttatgcagatgg

SEQ ID NO: 7228090 - DNA, 22 bp, Homo sapiens
tgctgggcatttatgcagatgg

SEQ ID NO: 7228091 - DNA, 22 bp, Homo sapiens
tgctgggcatttatgcagatgg

SEQ ID NO: 7228092 - DNA, 22 bp, Homo sapiens
tgctgggcatttttatggctcc

SEQ ID NO: 7228093 - DNA, 22 bp, Homo sapiens
tgctgggcatttttatggctcc

SEQ ID NO: 7228094 - DNA, 22 bp, Homo sapiens
tgctgggccaaagcagggtttt

SEQ ID NO: 7228095 - DNA, 22 bp, Homo sapiens
tgctgggccaaagcagggtttt

SEQ ID NO: 7228096 - DNA, 22 bp, Homo sapiens
tgctgggccaaagcagggtttt

SEQ ID NO: 7228097 - DNA, 20 bp, Homo sapiens
tgctgggccatcttgcatgc

SEQ ID NO: 7228098 - DNA, 20 bp, Homo sapiens
tgctgggccatcttgcatgc

SEQ ID NO: 7228099 - DNA, 20 bp, Homo sapiens
tgctgggccatcttgcatgc

SEQ ID NO: 7228100 - DNA, 22 bp, Homo sapiens
tgctgggcccagggagcctctg

SEQ ID NO: 7228101 - DNA, 22 bp, Homo sapiens
tgctgggcccagggagcctctg

SEQ ID NO: 7228102 - DNA, 22 bp, Homo sapiens
tgctgggcccagggagcctctg

SEQ ID NO: 7228103 - DNA, 22 bp, Homo sapiens
tgctgggcccccagtgaccttc

SEQ ID NO: 7228104 - DNA, 22 bp, Homo sapiens
tgctgggcccccagtgaccttc

SEQ ID NO: 7228105 - DNA, 22 bp, Homo sapiens
tgctgggcccccagtgaccttc

SEQ ID NO: 7228106 - DNA, 22 bp, Homo sapiens
tgctgggcctcttccctggata

SEQ ID NO: 7228107 - DNA, 22 bp, Homo sapiens
tgctgggcctcttccctggata

SEQ ID NO: 7228108 - DNA, 22 bp, Homo sapiens
tgctgggcctcttccctggata

SEQ ID NO: 7228109 - DNA, 22 bp, Homo sapiens
tgctgggcctcttccctggata

SEQ ID NO: 7228110 - DNA, 22 bp, Homo sapiens
tgctgggcctgcccctgtcagc

SEQ ID NO: 7228111 - DNA, 22 bp, Homo sapiens
tgctgggcctgcccctgtcagc

SEQ ID NO: 7228112 - DNA, 22 bp, Homo sapiens
tgctgggctagaagctgaggcc

SEQ ID NO: 7228113 - DNA, 22 bp, Homo sapiens
tgctgggctagaagctgaggcc

SEQ ID NO: 7228114 - DNA, 22 bp, Homo sapiens
tgctgggctagaagctgaggcc

SEQ ID NO: 7228115 - DNA, 22 bp, Homo sapiens
tgctgggctagaagctgaggcc

SEQ ID NO: 7228116 - DNA, 22 bp, Homo sapiens
tgctgggcctgcccctgtcagc

SEQ ID NO: 7228117 - DNA, 22 bp, Homo sapiens
tgctgggcctttacctccaggg

SEQ ID NO: 7228118 - DNA, 22 bp, Homo sapiens
tgctgggcctttacctccaggg

SEQ ID NO: 7228119 - DNA, 22 bp, Homo sapiens
tgctgggcctttacctccaggg

SEQ ID NO: 7228120 - DNA, 22 bp, Homo sapiens
tgctgggcctttacctccaggg

SEQ ID NO: 7228121 - DNA, 22 bp, Homo sapiens
tgctgggcggtgggctcatccc

SEQ ID NO: 7228122 - DNA, 22 bp, Homo sapiens
tgctgggctagaagctgaggcc

SEQ ID NO: 7228123 - DNA, 22 bp, Homo sapiens
tgctgggctagaagctgaggcc

SEQ ID NO: 7228124 - DNA, 22 bp, Homo sapiens
tgctgggctagaagctgaggcc

SEQ ID NO: 7228125 - DNA, 22 bp, Homo sapiens
tgctgggctagaagctgaggcc

SEQ ID NO: 7228126 - DNA, 22 bp, Homo sapiens
tgctgggctagggtggagctct

SEQ ID NO: 7228127 - DNA, 22 bp, Homo sapiens
tgctgggctagggtggagctct

SEQ ID NO: 7228128 - DNA, 22 bp, Homo sapiens
tgctgggctagggtggagctct

SEQ ID NO: 7228129 - DNA, 22 bp, Homo sapiens
tgctgggctagggtggagctct

SEQ ID NO: 7228130 - DNA, 22 bp, Homo sapiens
tgctgggctcaacctccagagc

SEQ ID NO: 7228131 - DNA, 22 bp, Homo sapiens
tgctgggctcaacctccagagc

SEQ ID NO: 7228132 - DNA, 22 bp, Homo sapiens
tgctgggctcaacctccagagc

SEQ ID NO: 7228133 - DNA, 22 bp, Homo sapiens
tgctgggctcaacctccagagc

SEQ ID NO: 7228134 - DNA, 22 bp, Homo sapiens
tgctgggctcaacctccagagc

SEQ ID NO: 7228135 - DNA, 22 bp, Homo sapiens
tgctgggctgcacccccagagt

SEQ ID NO: 7228136 - DNA, 21 bp, Homo sapiens
tgctgggctgcaggggatgca

SEQ ID NO: 7228137 - DNA, 22 bp, Homo sapiens
tgctgggctggagctgccaggg

SEQ ID NO: 7228138 - DNA, 22 bp, Homo sapiens
tgctgggctggagctgccaggg

SEQ ID NO: 7228139 - DNA, 22 bp, Homo sapiens
tgctgggctggagctgccaggg

SEQ ID NO: 7228140 - DNA, 21 bp, Homo sapiens
tgctgggctgcaggggatgca

SEQ ID NO: 7228141 - DNA, 21 bp, Homo sapiens
tgctgggctgcaggggatgca

SEQ ID NO: 7228142 - DNA, 21 bp, Homo sapiens
tgctgggctgcaggggatgca

SEQ ID NO: 7228143 - DNA, 22 bp, Homo sapiens
tgctgggctggagctgccaggg

SEQ ID NO: 7228144 - DNA, 22 bp, Homo sapiens
tgctgggctggagctgccaggg

SEQ ID NO: 7228145 - DNA, 22 bp, Homo sapiens
tgctgggctggagctgccaggg

SEQ ID NO: 7228146 - DNA, 22 bp, Homo sapiens
tgctgggctggggcctcagacc

SEQ ID NO: 7228147 - DNA, 22 bp, Homo sapiens
tgctgggctggggcctcagacc

SEQ ID NO: 7228148 - DNA, 22 bp, Homo sapiens
tgctgggctggggcctcagacc

SEQ ID NO: 7228149 - DNA, 22 bp, Homo sapiens
tgctgggctgttcctgtccatg

SEQ ID NO: 7228150 - DNA, 22 bp, Homo sapiens
tgctgggctgttcctgtccatg

SEQ ID NO: 7228151 - DNA, 22 bp, Homo sapiens
tgctgggctgttcctgtccatg

SEQ ID NO: 7228152 - DNA, 22 bp, Homo sapiens
tgctgggctgttcctgtccatg

SEQ ID NO: 7228153 - DNA, 22 bp, Homo sapiens
tgctgggctgttcctgtccatg

SEQ ID NO: 7228154 - DNA, 22 bp, Homo sapiens
tgctgggcttcaactgcctgag

SEQ ID NO: 7228155 - DNA, 22 bp, Homo sapiens
tgctgggcttcaactgcctgag

SEQ ID NO: 7228156 - DNA, 22 bp, Homo sapiens
tgctgggcttcaactgcctgag

SEQ ID NO: 7228157 - DNA, 22 bp, Homo sapiens
tgctgggcttcacccccacagt

SEQ ID NO: 7228158 - DNA, 22 bp, Homo sapiens
tgctgggcttcacccccacagt

SEQ ID NO: 7228159 - DNA, 22 bp, Homo sapiens
tgctgggcttgaaagctgctaa

SEQ ID NO: 7228160 - DNA, 22 bp, Homo sapiens
tgctgggcttgaaagctgctaa

SEQ ID NO: 7228161 - DNA, 22 bp, Homo sapiens
tgctgggcttgaaagctgctaa

SEQ ID NO: 7228162 - DNA, 22 bp, Homo sapiens
tgctgggcttgaaagctgctaa

SEQ ID NO: 7228163 - DNA, 22 bp, Homo sapiens
tgctgggcttgaaagctgctaa

SEQ ID NO: 7228164 - DNA, 22 bp, Homo sapiens
tgctgtgatggagaattctgga

SEQ ID NO: 7228165 - DNA, 22 bp, Homo sapiens
tgctgtgcaaaggtgatgtgag

SEQ ID NO: 7228166 - DNA, 18 bp, Homo sapiens
tgctgtgcacagccctat

SEQ ID NO: 7228167 - DNA, 22 bp, Homo sapiens
tgctgtgcatcatagtgtttgg

SEQ ID NO: 7228168 - DNA, 22 bp, Homo sapiens
tgctgtgaggttgagaaggaag

SEQ ID NO: 7228169 - DNA, 22 bp, Homo sapiens
tgctgtgacgcctcaggaatcc

SEQ ID NO: 7228170 - DNA, 22 bp, Homo sapiens
tgctgtgacgcctcaggaatcc

SEQ ID NO: 7228171 - DNA, 22 bp, Homo sapiens
tgctgtgaggttgagaaggaag

SEQ ID NO: 7228172 - DNA, 22 bp, Homo sapiens
tgctgtgaggttgagaaggaag

SEQ ID NO: 7228173 - DNA, 23 bp, Homo sapiens
tgctgtgcctttgtctgcctcca

SEQ ID NO: 7228174 - DNA, 22 bp, Homo sapiens
tgcttaaaaacagtatggtagt

SEQ ID NO: 7228175 - DNA, 22 bp, Homo sapiens
tgcttaaaaacagtatggtagt

SEQ ID NO: 7228176 - DNA, 22 bp, Homo sapiens
tgcttaaaaagctccatcaata

SEQ ID NO: 7228177 - DNA, 22 bp, Homo sapiens
tgcttaaaaagctccatcaata

SEQ ID NO: 7228178 - DNA, 22 bp, Homo sapiens
tgcttaaaaagtaactgctgat

SEQ ID NO: 7228179 - DNA, 22 bp, Homo sapiens
tgcttaaaaagtaactgctgat

SEQ ID NO: 7228180 - DNA, 22 bp, Homo sapiens
tgcttaaaatagttcatttttg

SEQ ID NO: 7228181 - DNA, 22 bp, Homo sapiens
tgcttaaaaagtaactgctgat

SEQ ID NO: 7228182 - DNA, 22 bp, Homo sapiens
tgcttaaaaagtaactgctgat

SEQ ID NO: 7228183 - DNA, 22 bp, Homo sapiens
tgcttaaaatgatgattatttt

SEQ ID NO: 7228184 - DNA, 22 bp, Homo sapiens
tgctgtctttttcccttcctaa

SEQ ID NO: 7228185 - DNA, 22 bp, Homo sapiens
tgctgtctttcattgtctgcct

SEQ ID NO: 7228186 - DNA, 22 bp, Homo sapiens
tgctgtctttcattgtctgcct

SEQ ID NO: 7228187 - DNA, 22 bp, Homo sapiens
tgctgtcttccaggatggtgaa

SEQ ID NO: 7228188 - DNA, 21 bp, Homo sapiens
tgctgtcctagaaccagggcc

SEQ ID NO: 7228189 - DNA, 19 bp, Homo sapiens
tgctgtcctcagagtaagt

SEQ ID NO: 7228190 - DNA, 22 bp, Homo sapiens
tgcttaaagtagtggattgtta

SEQ ID NO: 7228191 - DNA, 22 bp, Homo sapiens
tgcttaaagctgctcagttgta

SEQ ID NO: 7228192 - DNA, 22 bp, Homo sapiens
tgcttaaaggatagtttaaact

SEQ ID NO: 7228193 - DNA, 22 bp, Homo sapiens
tgcttaaaccctgatcatgtgt

SEQ ID NO: 7228194 - DNA, 22 bp, Homo sapiens
tgcttaaaccctgatcatgtgt

SEQ ID NO: 7228195 - DNA, 22 bp, Homo sapiens
tgcttaaaccctgatcatgtgt

SEQ ID NO: 7228196 - DNA, 22 bp, Homo sapiens
tgcttaaaccctgatcatgtgt

SEQ ID NO: 7228197 - DNA, 22 bp, Homo sapiens
tgcttaaaccctgatcatgtgt

SEQ ID NO: 7228198 - DNA, 22 bp, Homo sapiens
tgcttaaagctgctcagttgta

SEQ ID NO: 7228199 - DNA, 22 bp, Homo sapiens
tgcttaaacatccagacagtat

SEQ ID NO: 7228200 - DNA, 22 bp, Homo sapiens
tgcttaaacatccagacagtat

SEQ ID NO: 7228201 - DNA, 22 bp, Homo sapiens
tgcttaaacatactatttatat

SEQ ID NO: 7228202 - DNA, 22 bp, Homo sapiens
tgcttaaacacatacatacata

SEQ ID NO: 7228203 - DNA, 22 bp, Homo sapiens
tgcttaaacacatacatacata

SEQ ID NO: 7228204 - DNA, 22 bp, Homo sapiens
tgcttaaaattttccaaggatt

SEQ ID NO: 7228205 - DNA, 22 bp, Homo sapiens
tgcttaaacacatacatacata

SEQ ID NO: 7228206 - DNA, 22 bp, Homo sapiens
tgcttaataggagttgaacatt

SEQ ID NO: 7228207 - DNA, 22 bp, Homo sapiens
tgcttaaagtgttaaccctgtt

SEQ ID NO: 7228208 - DNA, 22 bp, Homo sapiens
tgcttaaagtgttaaccctgtt

SEQ ID NO: 7228209 - DNA, 22 bp, Homo sapiens
tgcttaaatagctggaggctac

SEQ ID NO: 7228210 - DNA, 22 bp, Homo sapiens
tgcttaaatagctggaggctac

SEQ ID NO: 7228211 - DNA, 22 bp, Homo sapiens
tgcttaaatttcagcagcttaa

SEQ ID NO: 7228212 - DNA, 22 bp, Homo sapiens
tgcttaaatttcagcagcttaa

SEQ ID NO: 7228213 - DNA, 22 bp, Homo sapiens
tgcttaaagtgttaaccctgtt

SEQ ID NO: 7228214 - DNA, 22 bp, Homo sapiens
tgcttacaactttattgaggaa

SEQ ID NO: 7228215 - DNA, 22 bp, Homo sapiens
tgcttacattgcatctgtgcct

SEQ ID NO: 7228216 - DNA, 18 bp, Homo sapiens
tgcttacaggagttcctg

SEQ ID NO: 7228217 - DNA, 22 bp, Homo sapiens
tgcttagcacaagaataaactg

SEQ ID NO: 7228218 - DNA, 22 bp, Homo sapiens
tgcttaggatgctagcaggcat

SEQ ID NO: 7228219 - DNA, 22 bp, Homo sapiens
tgcttataatgttactgacaac

SEQ ID NO: 7228220 - DNA, 22 bp, Homo sapiens
tgcttcaggagatgtcaccatg

SEQ ID NO: 7228221 - DNA, 22 bp, Homo sapiens
tgcttcagtcctatgggcaggt

SEQ ID NO: 7228222 - DNA, 22 bp, Homo sapiens
tgcttcagcagggatcgggggg

SEQ ID NO: 7228223 - DNA, 22 bp, Homo sapiens
tgcttcagtgtgtcattattta

SEQ ID NO: 7228224 - DNA, 22 bp, Homo sapiens
tgcttccactaatgagctgtgt

SEQ ID NO: 7228225 - DNA, 22 bp, Homo sapiens
tgcttccactaatgagctgtgt

SEQ ID NO: 7228226 - DNA, 22 bp, Homo sapiens
tgcttccagcatccctggcctg

SEQ ID NO: 7228227 - DNA, 22 bp, Homo sapiens
tgcttcagaggaaaggcaaaag

SEQ ID NO: 7228228 - DNA, 22 bp, Homo sapiens
tgcttcagagaagaatggaaag

SEQ ID NO: 7228229 - DNA, 22 bp, Homo sapiens
tgcttcactggctccacatagg

SEQ ID NO: 7228230 - DNA, 22 bp, Homo sapiens
tgcttcaagttgaaatattctt

SEQ ID NO: 7228231 - DNA, 22 bp, Homo sapiens
tgcttcacaagaattcaggacc

SEQ ID NO: 7228232 - DNA, 22 bp, Homo sapiens
tgcttcaccttgtctgatacca

SEQ ID NO: 7228233 - DNA, 22 bp, Homo sapiens
tgcttattaaacatgcatattc

SEQ ID NO: 7228234 - DNA, 22 bp, Homo sapiens
tgcttattgctttcaagactgt

SEQ ID NO: 7228235 - DNA, 22 bp, Homo sapiens
tgcttcaaggacactgactttt

SEQ ID NO: 7228236 - DNA, 22 bp, Homo sapiens
tgcttctgaaatgcaggtcttc

SEQ ID NO: 7228237 - DNA, 22 bp, Homo sapiens
tgcttctctttatttgtaggtt

SEQ ID NO: 7228238 - DNA, 22 bp, Homo sapiens
tgcttctgaaatgcaggtcttc

SEQ ID NO: 7228239 - DNA, 23 bp, Homo sapiens
tgcttctctgcttgacagttctg

SEQ ID NO: 7228240 - DNA, 22 bp, Homo sapiens
tgcttctcccaaccagggcctg

SEQ ID NO: 7228241 - DNA, 21 bp, Homo sapiens
tgcttctctagatcaactact

SEQ ID NO: 7228242 - DNA, 22 bp, Homo sapiens
tgcttccctcacttcacctggc

SEQ ID NO: 7228243 - DNA, 22 bp, Homo sapiens
tgcttccctgaaggcacaggag

SEQ ID NO: 7228244 - DNA, 22 bp, Homo sapiens
tgcttccctgaaggcacaggag

SEQ ID NO: 7228245 - DNA, 22 bp, Homo sapiens
tgcttctagacactgcaattga

SEQ ID NO: 7228246 - DNA, 22 bp, Homo sapiens
tgcttctcaaaaggaggtaggt

SEQ ID NO: 7228247 - DNA, 22 bp, Homo sapiens
tgcttctgattcatggttattg

SEQ ID NO: 7228248 - DNA, 22 bp, Homo sapiens
tgcttctgcaacttgaatgtac

SEQ ID NO: 7228249 - DNA, 22 bp, Homo sapiens
tgcttctgcaggagctcctgat

SEQ ID NO: 7228250 - DNA, 22 bp, Homo sapiens
tgcttctgatgtgagcagcccc

SEQ ID NO: 7228251 - DNA, 22 bp, Homo sapiens
tgcttctgatgtgagcagcccc

SEQ ID NO: 7228252 - DNA, 22 bp, Homo sapiens
tgcttctgatgtgagcagcccc

SEQ ID NO: 7228253 - DNA, 22 bp, Homo sapiens
tgcttctgcaggagctcctgat

SEQ ID NO: 7228254 - DNA, 22 bp, Homo sapiens
tgcttctgcaggagctcctgat

SEQ ID NO: 7228255 - DNA, 22 bp, Homo sapiens
tgcttctgcaggagctcctgat

SEQ ID NO: 7228256 - DNA, 22 bp, Homo sapiens
tgcttctgcattcaatgttgga

SEQ ID NO: 7228257 - DNA, 22 bp, Homo sapiens
tgcttctgctcagcttcctact

SEQ ID NO: 7228258 - DNA, 22 bp, Homo sapiens
tgcttctgacatgttcttggtt

SEQ ID NO: 7228259 - DNA, 22 bp, Homo sapiens
tgcttctgacatgttcttggtt

SEQ ID NO: 7228260 - DNA, 22 bp, Homo sapiens
tgcttctgacatgttcttggtt

SEQ ID NO: 7228261 - DNA, 22 bp, Homo sapiens
tgcttctgaagtggatgggtgc

SEQ ID NO: 7228262 - DNA, 22 bp, Homo sapiens
tgcttctgaactcagcatgtgg

SEQ ID NO: 7228263 - DNA, 22 bp, Homo sapiens
tgcttctgaactcagcatgtgg

SEQ ID NO: 7228264 - DNA, 22 bp, Homo sapiens
tgcttctgaactcagcatgtgg

SEQ ID NO: 7228265 - DNA, 22 bp, Homo sapiens
tgcttctgagttgcaggacttg

SEQ ID NO: 7228266 - DNA, 22 bp, Homo sapiens
tgcttctgactgggtcagttga

SEQ ID NO: 7228267 - DNA, 22 bp, Homo sapiens
tgcttctgactgggtcagttga

SEQ ID NO: 7228268 - DNA, 22 bp, Homo sapiens
tgcttctgactaagctgcatga

SEQ ID NO: 7228269 - DNA, 22 bp, Homo sapiens
tgctgcattcaggagcacagtt

SEQ ID NO: 7228270 - DNA, 22 bp, Homo sapiens
tgctgcatttatcttctcaaac

SEQ ID NO: 7228271 - DNA, 22 bp, Homo sapiens
tgctgccaaatgcgagctctgt

SEQ ID NO: 7228272 - DNA, 22 bp, Homo sapiens
tgctgccaaatgcgagctctgt

SEQ ID NO: 7228273 - DNA, 22 bp, Homo sapiens
tgctgccaagcccgtgctcctg

SEQ ID NO: 7228274 - DNA, 17 bp, Homo sapiens
tgctgccaagtcccaac

SEQ ID NO: 7228275 - DNA, 22 bp, Homo sapiens
tgctgccaatttctggtcttga

SEQ ID NO: 7228276 - DNA, 22 bp, Homo sapiens
tgctgccaatttctggtcttga

SEQ ID NO: 7228277 - DNA, 22 bp, Homo sapiens
tgctgccacaaattcagctgcc

SEQ ID NO: 7228278 - DNA, 22 bp, Homo sapiens
tgctgccacccctcaccagagc

SEQ ID NO: 7228279 - DNA, 22 bp, Homo sapiens
tgctgccacctggtggctgaag

SEQ ID NO: 7228280 - DNA, 22 bp, Homo sapiens
tgctgccagccaggccatggag

SEQ ID NO: 7228281 - DNA, 22 bp, Homo sapiens
tgctgccagccaggccatggag

SEQ ID NO: 7228282 - DNA, 22 bp, Homo sapiens
tgctgccagccaggccatggag

SEQ ID NO: 7228283 - DNA, 22 bp, Homo sapiens
tgctgccacctgtggtagtctg

SEQ ID NO: 7228284 - DNA, 22 bp, Homo sapiens
tgctgccactggtagtctcatt

SEQ ID NO: 7228285 - DNA, 22 bp, Homo sapiens
tgctgccagagagacagggact

SEQ ID NO: 7228286 - DNA, 22 bp, Homo sapiens
tgctgccagggctctgcccaca

SEQ ID NO: 7228287 - DNA, 22 bp, Homo sapiens
tgctgccaggtcttgctgtcca

SEQ ID NO: 7228288 - DNA, 21 bp, Homo sapiens
tgctgccatagacctgaggga

SEQ ID NO: 7228289 - DNA, 21 bp, Homo sapiens
tgctgccatagacctgaggga

SEQ ID NO: 7228290 - DNA, 21 bp, Homo sapiens
tgctgccatcatgcagagatg

SEQ ID NO: 7228291 - DNA, 22 bp, Homo sapiens
tgctgccatctcaactgccctt

SEQ ID NO: 7228292 - DNA, 22 bp, Homo sapiens
tgctgcctccttcctgccagga

SEQ ID NO: 7228293 - DNA, 22 bp, Homo sapiens
tgctgcctctgctgatatggcc

SEQ ID NO: 7228294 - DNA, 22 bp, Homo sapiens
tgctgctcctgcctggctccca

SEQ ID NO: 7228295 - DNA, 22 bp, Homo sapiens
tgctgctctcagccaccaggaa

SEQ ID NO: 7228296 - DNA, 22 bp, Homo sapiens
tgctgctctggccaggaactgc

SEQ ID NO: 7228297 - DNA, 22 bp, Homo sapiens
tgctgctctgtaaagtgatgag

SEQ ID NO: 7228298 - DNA, 22 bp, Homo sapiens
tgctgctgaggctaaagtatag

SEQ ID NO: 7228299 - DNA, 22 bp, Homo sapiens
tgctgctgacatttggggcttg

SEQ ID NO: 7228300 - DNA, 22 bp, Homo sapiens
tgctgctgaaaaggtgtgctta

SEQ ID NO: 7228301 - DNA, 22 bp, Homo sapiens
tgctgccatggtcgctggtgtc

SEQ ID NO: 7228302 - DNA, 22 bp, Homo sapiens
tgctgccatggtcgctggtgtc

SEQ ID NO: 7228303 - DNA, 18 bp, Homo sapiens
tgctgcccaactctcccc

SEQ ID NO: 7228304 - DNA, 18 bp, Homo sapiens
tgctgcccaactctcccc

SEQ ID NO: 7228305 - DNA, 23 bp, Homo sapiens
tgctgcccactcttccagccctc

SEQ ID NO: 7228306 - DNA, 23 bp, Homo sapiens
tgctgcccgcttggcacgctccc

SEQ ID NO: 7228307 - DNA, 23 bp, Homo sapiens
tgctgccctgccttcagctctcc

SEQ ID NO: 7228308 - DNA, 23 bp, Homo sapiens
tgctgccctgccttcagctctcc

SEQ ID NO: 7228309 - DNA, 20 bp, Homo sapiens
tgctgcctactaagccctca

SEQ ID NO: 7228310 - DNA, 22 bp, Homo sapiens
tgctgcctcaactgtcaggaac

SEQ ID NO: 7228311 - DNA, 22 bp, Homo sapiens
tgctgcctcagcttcctgggct

SEQ ID NO: 7228312 - DNA, 22 bp, Homo sapiens
tgctgcctcagcttcctgggct

SEQ ID NO: 7228313 - DNA, 22 bp, Homo sapiens
tgctgcctccaactcctgggct

SEQ ID NO: 7228314 - DNA, 22 bp, Homo sapiens
tgctgcctccaactcctgggct

SEQ ID NO: 7228315 - DNA, 22 bp, Homo sapiens
tgctgcctccttcctgccagga

SEQ ID NO: 7228316 - DNA, 22 bp, Homo sapiens
tgctgcctccttcctgccagga

SEQ ID NO: 7228317 - DNA, 20 bp, Homo sapiens
tgctggaaattgttctagga

SEQ ID NO: 7228318 - DNA, 20 bp, Homo sapiens
tgctggaaattgttctagga

SEQ ID NO: 7228319 - DNA, 22 bp, Homo sapiens
tgctggaaccaggaatttgaag

SEQ ID NO: 7228320 - DNA, 22 bp, Homo sapiens
tgctggaactcagtgaatcatt

SEQ ID NO: 7228321 - DNA, 22 bp, Homo sapiens
tgctggaactcagtgaatcatt

SEQ ID NO: 7228322 - DNA, 22 bp, Homo sapiens
tgctggaagaaaattctttaac

SEQ ID NO: 7228323 - DNA, 22 bp, Homo sapiens
tgctggaaagagagtttcaatg

SEQ ID NO: 7228324 - DNA, 22 bp, Homo sapiens
tgctggaaagtgaggtgaatga

SEQ ID NO: 7228325 - DNA, 22 bp, Homo sapiens
tgctggaaagttaaattttgga

SEQ ID NO: 7228326 - DNA, 22 bp, Homo sapiens
tgctggaaagttaaattttgga

SEQ ID NO: 7228327 - DNA, 22 bp, Homo sapiens
tgctggaaataggcattgtagc

SEQ ID NO: 7228328 - DNA, 22 bp, Homo sapiens
tgctggaaataggcattgtagc

SEQ ID NO: 7228329 - DNA, 22 bp, Homo sapiens
tgctggaagctcctgcatgtct

SEQ ID NO: 7228330 - DNA, 22 bp, Homo sapiens
tgctggaagctcctgcatgtct

SEQ ID NO: 7228331 - DNA, 22 bp, Homo sapiens
tgctggaagggtagtattaact

SEQ ID NO: 7228332 - DNA, 22 bp, Homo sapiens
tgctggaataatttcatgttaa

SEQ ID NO: 7228333 - DNA, 22 bp, Homo sapiens
tgctggaataatttcatgttaa

SEQ ID NO: 7228334 - DNA, 22 bp, Homo sapiens
tgctggaattatagaaaaatag

SEQ ID NO: 7228335 - DNA, 22 bp, Homo sapiens
tgctggaattgacctagaagga

SEQ ID NO: 7228336 - DNA, 23 bp, Homo sapiens
tgctggaatttgtaccctggcag

SEQ ID NO: 7228337 - DNA, 22 bp, Homo sapiens
tgctggaatttttctaggattt

SEQ ID NO: 7228338 - DNA, 22 bp, Homo sapiens
tgctggagaactgctctgtgtt

SEQ ID NO: 7228339 - DNA, 22 bp, Homo sapiens
tgctggagaactgctctgtgtt

SEQ ID NO: 7228340 - DNA, 23 bp, Homo sapiens
tgctggagaagcaaagttctgag

SEQ ID NO: 7228341 - DNA, 23 bp, Homo sapiens
tgctggagaagcaaagttctgag

SEQ ID NO: 7228342 - DNA, 23 bp, Homo sapiens
tgctggagaagcaaagttctgag

SEQ ID NO: 7228343 - DNA, 23 bp, Homo sapiens
tgctggagaagcaaagttctgag

SEQ ID NO: 7228344 - DNA, 22 bp, Homo sapiens
tgctggagaagctcctgggact

SEQ ID NO: 7228345 - DNA, 22 bp, Homo sapiens
tgctggagaagctcctgggact

SEQ ID NO: 7228346 - DNA, 22 bp, Homo sapiens
tgctggagaagctcctgggact

SEQ ID NO: 7228347 - DNA, 22 bp, Homo sapiens
tgctggagcggaggtgagccag

SEQ ID NO: 7228348 - DNA, 22 bp, Homo sapiens
tgctggagctccgggctgtagg

SEQ ID NO: 7228349 - DNA, 22 bp, Homo sapiens
tgctggaggagaaggttgctca

SEQ ID NO: 7228350 - DNA, 22 bp, Homo sapiens
tgctggaggagaaggttgctca

SEQ ID NO: 7228351 - DNA, 22 bp, Homo sapiens
tgctgctgatggcacctaggca

SEQ ID NO: 7228352 - DNA, 22 bp, Homo sapiens
tgctgctgatggatgcctggac

SEQ ID NO: 7228353 - DNA, 20 bp, Homo sapiens
tgctgctgcctccgcctctg

SEQ ID NO: 7228354 - DNA, 22 bp, Homo sapiens
tgctgctgcttctgtacagcct

SEQ ID NO: 7228355 - DNA, 20 bp, Homo sapiens
tgctgctgcttcacccccat

SEQ ID NO: 7228356 - DNA, 22 bp, Homo sapiens
tgctgctgggtttgacagtcac

SEQ ID NO: 7228357 - DNA, 19 bp, Homo sapiens
tgctgctgtccttgcaggg

SEQ ID NO: 7228358 - DNA, 22 bp, Homo sapiens
tgctgctgggtttgacagtcac

SEQ ID NO: 7228359 - DNA, 22 bp, Homo sapiens
tgctgctgttgacggctgtcca

SEQ ID NO: 7228360 - DNA, 20 bp, Homo sapiens
tgctgctgtgagcgtccctg

SEQ ID NO: 7228361 - DNA, 20 bp, Homo sapiens
tgctgctgtgagcgtccctg

SEQ ID NO: 7228362 - DNA, 22 bp, Homo sapiens
tgctgcttcctggtagatagga

SEQ ID NO: 7228363 - DNA, 22 bp, Homo sapiens
tgctgctgttgacggctgtcca

SEQ ID NO: 7228364 - DNA, 22 bp, Homo sapiens
tgctgctgtttcctacatctca

SEQ ID NO: 7228365 - DNA, 22 bp, Homo sapiens
tgctgcttggcaccctcagagt

SEQ ID NO: 7228366 - DNA, 22 bp, Homo sapiens
tgctgcttgttttgtaaataaa

SEQ ID NO: 7228367 - DNA, 22 bp, Homo sapiens
tgctgcttttgtatatcagaga

SEQ ID NO: 7228368 - DNA, 22 bp, Homo sapiens
tgctgcttttagttggatagaa

SEQ ID NO: 7228369 - DNA, 22 bp, Homo sapiens
tgctggaggccgagaagcagca

SEQ ID NO: 7228370 - DNA, 22 bp, Homo sapiens
tgctggaggccgagaagcagca

SEQ ID NO: 7228371 - DNA, 22 bp, Homo sapiens
tgctggaggcctgactgtgttt

SEQ ID NO: 7228372 - DNA, 20 bp, Homo sapiens
tgctggaggcgccggcgctc

SEQ ID NO: 7228373 - DNA, 22 bp, Homo sapiens
tgctggaggcagtggaggtgcc

SEQ ID NO: 7228374 - DNA, 22 bp, Homo sapiens
tgctggaggcagtggaggtgcc

SEQ ID NO: 7228375 - DNA, 22 bp, Homo sapiens
tgctggaggccagaagtctgag

SEQ ID NO: 7228376 - DNA, 22 bp, Homo sapiens
tgctggaggagtttactgtggc

SEQ ID NO: 7228377 - DNA, 22 bp, Homo sapiens
tgctggaggattaaacaagtca

SEQ ID NO: 7228378 - DNA, 17 bp, Homo sapiens
tgctggaggcggggtat

SEQ ID NO: 7228379 - DNA, 22 bp, Homo sapiens
tgctggaggggatgccttcact

SEQ ID NO: 7228380 - DNA, 22 bp, Homo sapiens
tgctggaggggcctgaccagga

SEQ ID NO: 7228381 - DNA, 22 bp, Homo sapiens
tgctggaggggcctgaccagga

SEQ ID NO: 7228382 - DNA, 19 bp, Homo sapiens
tgctggagggtagtgagtc

SEQ ID NO: 7228383 - DNA, 19 bp, Homo sapiens
tgctggaggttgacagggt

SEQ ID NO: 7228384 - DNA, 19 bp, Homo sapiens
tgctggaggttgacagggt

SEQ ID NO: 7228385 - DNA, 19 bp, Homo sapiens
tgctggaggttgacagggt

SEQ ID NO: 7228386 - DNA, 19 bp, Homo sapiens
tgctggaggttgacagggt

SEQ ID NO: 7228387 - DNA, 22 bp, Homo sapiens
tgctggagtaacaagacactca

SEQ ID NO: 7228388 - DNA, 22 bp, Homo sapiens
tgctggagtgagattatgagtt

SEQ ID NO: 7228389 - DNA, 22 bp, Homo sapiens
tgctggcatggtcttggtgaca

SEQ ID NO: 7228390 - DNA, 22 bp, Homo sapiens
tgctggcatgcatgctgtagga

SEQ ID NO: 7228391 - DNA, 22 bp, Homo sapiens
tgctggcatgcatgctgtagga

SEQ ID NO: 7228392 - DNA, 22 bp, Homo sapiens
tgctggcatgcatgctgtagga

SEQ ID NO: 7228393 - DNA, 22 bp, Homo sapiens
tgctggcatgcatgctgtagga

SEQ ID NO: 7228394 - DNA, 20 bp, Homo sapiens
tgctggcatgcaagagggaa

SEQ ID NO: 7228395 - DNA, 20 bp, Homo sapiens
tgctggcatgcaagagggaa

SEQ ID NO: 7228396 - DNA, 22 bp, Homo sapiens
tgctggcatcttaatgttctgt

SEQ ID NO: 7228397 - DNA, 22 bp, Homo sapiens
tgctggcatatgaaaatcctta

SEQ ID NO: 7228398 - DNA, 22 bp, Homo sapiens
tgctggcatactctctttgttg

SEQ ID NO: 7228399 - DNA, 22 bp, Homo sapiens
tgctggcataccacctagttca

SEQ ID NO: 7228400 - DNA, 22 bp, Homo sapiens
tgctggcagtggcagtgatggt

SEQ ID NO: 7228401 - DNA, 22 bp, Homo sapiens
tgctggcagtggcagtgatggt

SEQ ID NO: 7228402 - DNA, 22 bp, Homo sapiens
tgctggcaggcacctcctgggg

SEQ ID NO: 7228403 - DNA, 22 bp, Homo sapiens
tgctggcagccatgccttggaa

SEQ ID NO: 7228404 - DNA, 22 bp, Homo sapiens
tgctggcagcttctttaaatgt

SEQ ID NO: 7228405 - DNA, 22 bp, Homo sapiens
tgctggcagccccagctttaac

SEQ ID NO: 7228406 - DNA, 22 bp, Homo sapiens
tgctggcagccccagctttaac

SEQ ID NO: 7228407 - DNA, 22 bp, Homo sapiens
tgctggcagccatgccttggaa

SEQ ID NO: 7228408 - DNA, 22 bp, Homo sapiens
tgctggcagaaggctcgtggaa

SEQ ID NO: 7228409 - DNA, 22 bp, Homo sapiens
tgctggcagaaggctcgtggaa

SEQ ID NO: 7228410 - DNA, 22 bp, Homo sapiens
tgctggcacgtggaccaggaga

SEQ ID NO: 7228411 - DNA, 22 bp, Homo sapiens
tgctggcacgtggaccaggaga

SEQ ID NO: 7228412 - DNA, 22 bp, Homo sapiens
tgctggcacgtgactgggaagt

SEQ ID NO: 7228413 - DNA, 22 bp, Homo sapiens
tgctggcacgtgactgggaagt

SEQ ID NO: 7228414 - DNA, 20 bp, Homo sapiens
tgctggcacgggtggactcc

SEQ ID NO: 7228415 - DNA, 22 bp, Homo sapiens
tgctggcacgaaagggtgtcca

SEQ ID NO: 7228416 - DNA, 22 bp, Homo sapiens
tgctggcaccattttcggacat

SEQ ID NO: 7228417 - DNA, 22 bp, Homo sapiens
tgctggcaccagaatgactgca

SEQ ID NO: 7228418 - DNA, 22 bp, Homo sapiens
tgctggcaccagaatgactgca

SEQ ID NO: 7228419 - DNA, 22 bp, Homo sapiens
tgctggcacatagagactggct

SEQ ID NO: 7228420 - DNA, 22 bp, Homo sapiens
tgctggcacatagagactggct

SEQ ID NO: 7228421 - DNA, 22 bp, Homo sapiens
tgctggcacatagagactggct

SEQ ID NO: 7228422 - DNA, 22 bp, Homo sapiens
tgctggcacatagagactggct

SEQ ID NO: 7228423 - DNA, 22 bp, Homo sapiens
tgctggcaatgctcttgacgtc

SEQ ID NO: 7228424 - DNA, 22 bp, Homo sapiens
tgctggcaagtcttggaattgt

SEQ ID NO: 7228425 - DNA, 22 bp, Homo sapiens
tgctggcaaggtaggtttcatt

SEQ ID NO: 7228426 - DNA, 21 bp, Homo sapiens
tgctggcaagactcaggaata

SEQ ID NO: 7228427 - DNA, 21 bp, Homo sapiens
tgctggcaagactcaggaata

SEQ ID NO: 7228428 - DNA, 21 bp, Homo sapiens
tgctggcaagactcaggaata

SEQ ID NO: 7228429 - DNA, 18 bp, Homo sapiens
tgctggcaactactattg

SEQ ID NO: 7228430 - DNA, 17 bp, Homo sapiens
tgctggcaacatacaaa

SEQ ID NO: 7228431 - DNA, 22 bp, Homo sapiens
tgctggagttcgacattgcaaa

SEQ ID NO: 7228432 - DNA, 23 bp, Homo sapiens
tgctggagtttactcaggccagc

SEQ ID NO: 7228433 - DNA, 23 bp, Homo sapiens
tgctggagtttactcaggccagc

SEQ ID NO: 7228434 - DNA, 23 bp, Homo sapiens
tgctggagtttactcaggccagc

SEQ ID NO: 7228435 - DNA, 23 bp, Homo sapiens
tgctggagtttactcaggccagc

SEQ ID NO: 7228436 - DNA, 23 bp, Homo sapiens
tgctggagtttactcaggccagc

SEQ ID NO: 7228437 - DNA, 22 bp, Homo sapiens
tgctggatgcttgattttgagg

SEQ ID NO: 7228438 - DNA, 22 bp, Homo sapiens
tgctggatgcttgattttgagg

SEQ ID NO: 7228439 - DNA, 22 bp, Homo sapiens
tgctggagtgcagtggcttaac

SEQ ID NO: 7228440 - DNA, 22 bp, Homo sapiens
tgctggagtggcactgtgtggc

SEQ ID NO: 7228441 - DNA, 22 bp, Homo sapiens
tgctggagtggcactgtgtggc

SEQ ID NO: 7228442 - DNA, 22 bp, Homo sapiens
tgctggagttcgacattgcaaa

SEQ ID NO: 7228443 - DNA, 22 bp, Homo sapiens
tgctggctgaggcctgagcggg

SEQ ID NO: 7228444 - DNA, 21 bp, Homo sapiens
tgctggctgaaaggcacagag

SEQ ID NO: 7228445 - DNA, 21 bp, Homo sapiens
tgctggctgaaaggcacagag

SEQ ID NO: 7228446 - DNA, 23 bp, Homo sapiens
tgctggctgaaacagccaaagga

SEQ ID NO: 7228447 - DNA, 22 bp, Homo sapiens
tgctggctcccaggagccgctg

SEQ ID NO: 7228448 - DNA, 22 bp, Homo sapiens
tgctggctctaggctgagacag

SEQ ID NO: 7228449 - DNA, 22 bp, Homo sapiens
tgctggctctaggctgagacag

SEQ ID NO: 7228450 - DNA, 22 bp, Homo sapiens
tgctggctctgggccaagcagg

SEQ ID NO: 7228451 - DNA, 22 bp, Homo sapiens
tgctggcatttcaggactcacc

SEQ ID NO: 7228452 - DNA, 21 bp, Homo sapiens
tgctggcattaccacaaaccc

SEQ ID NO: 7228453 - DNA, 22 bp, Homo sapiens
tgctggcattgcataggcagtt

SEQ ID NO: 7228454 - DNA, 22 bp, Homo sapiens
tgctggcattgcataggcagtt

SEQ ID NO: 7228455 - DNA, 22 bp, Homo sapiens
tgctggcattgcataggcagtt

SEQ ID NO: 7228456 - DNA, 22 bp, Homo sapiens
tgctggcatttcaggactcacc

SEQ ID NO: 7228457 - DNA, 22 bp, Homo sapiens
tgctggccaacaaggctccaag

SEQ ID NO: 7228458 - DNA, 22 bp, Homo sapiens
tgctggctatttaaagaagaaa

SEQ ID NO: 7228459 - DNA, 22 bp, Homo sapiens
tgctggctcagtttgcagactc

SEQ ID NO: 7228460 - DNA, 22 bp, Homo sapiens
tgctggctccaacctggcatct

SEQ ID NO: 7228461 - DNA, 22 bp, Homo sapiens
tgctggctggagtgcctctgga

SEQ ID NO: 7228462 - DNA, 22 bp, Homo sapiens
tgctggcttcctgtgcacagca

SEQ ID NO: 7228463 - DNA, 22 bp, Homo sapiens
tgctggcttatttagtaaatgt

SEQ ID NO: 7228464 - DNA, 23 bp, Homo sapiens
tgctggcttccagctgctccctc

SEQ ID NO: 7228465 - DNA, 22 bp, Homo sapiens
tgctggcttagatatcactgcc

SEQ ID NO: 7228466 - DNA, 22 bp, Homo sapiens
tgctggctgtccctacctggct

SEQ ID NO: 7228467 - DNA, 22 bp, Homo sapiens
tgctggctgtgtaccatctcaa

SEQ ID NO: 7228468 - DNA, 22 bp, Homo sapiens
tgctggctgtgtaccatctcaa

SEQ ID NO: 7228469 - DNA, 22 bp, Homo sapiens
tgctggctgtccctacctggct

SEQ ID NO: 7228470 - DNA, 23 bp, Homo sapiens
tgctggctgtgttattgccaaca

SEQ ID NO: 7228471 - DNA, 22 bp, Homo sapiens
tgaggggttgtgagaaatgtag

SEQ ID NO: 7228472 - DNA, 21 bp, Homo sapiens
tgaggggttataacagggtgg

SEQ ID NO: 7228473 - DNA, 21 bp, Homo sapiens
tgaggggttataacagggtgg

SEQ ID NO: 7228474 - DNA, 22 bp, Homo sapiens
tgaggggttgtgagaaatgtag

SEQ ID NO: 7228475 - DNA, 22 bp, Homo sapiens
tgagggtctggaatctgggctt

SEQ ID NO: 7228476 - DNA, 22 bp, Homo sapiens
tgagggtgcatttagcatgtag

SEQ ID NO: 7228477 - DNA, 22 bp, Homo sapiens
tgaggggtaagtaaaggaattg

SEQ ID NO: 7228478 - DNA, 22 bp, Homo sapiens
tgaggggtaagtaaaggaattg

SEQ ID NO: 7228479 - DNA, 22 bp, Homo sapiens
tgaggggttaccttggagttga

SEQ ID NO: 7228480 - DNA, 21 bp, Homo sapiens
tgaggggttataacagggtgg

SEQ ID NO: 7228481 - DNA, 22 bp, Homo sapiens
tgagggggttaattaggagagt

SEQ ID NO: 7228482 - DNA, 22 bp, Homo sapiens
tgagggggttaattaggagagt

SEQ ID NO: 7228483 - DNA, 22 bp, Homo sapiens
tgagggggttaattaggagagt

SEQ ID NO: 7228484 - DNA, 19 bp, Homo sapiens
tgaggggctcacagtctca

SEQ ID NO: 7228485 - DNA, 19 bp, Homo sapiens
tgaggggctcacagtctca

SEQ ID NO: 7228486 - DNA, 22 bp, Homo sapiens
tgaggggggtaatcactgggtt

SEQ ID NO: 7228487 - DNA, 22 bp, Homo sapiens
tgaggggggtaatcactgggtt

SEQ ID NO: 7228488 - DNA, 22 bp, Homo sapiens
tgaggggggtaatcactgggtt

SEQ ID NO: 7228489 - DNA, 22 bp, Homo sapiens
tgaggggggtaatcactgggtt

SEQ ID NO: 7228490 - DNA, 22 bp, Homo sapiens
tgaggggggtaatcactgggtt

SEQ ID NO: 7228491 - DNA, 22 bp, Homo sapiens
tgaggggggtaatcactgggtt

SEQ ID NO: 7228492 - DNA, 22 bp, Homo sapiens
tgaggggggtaatcactgggtt

SEQ ID NO: 7228493 - DNA, 19 bp, Homo sapiens
tgaggggctcacagtctca

SEQ ID NO: 7228494 - DNA, 19 bp, Homo sapiens
tgaggggctcacagtctca

SEQ ID NO: 7228495 - DNA, 19 bp, Homo sapiens
tgaggggctcacagtctca

SEQ ID NO: 7228496 - DNA, 22 bp, Homo sapiens
tgaggggcggcctgcagaggcc

SEQ ID NO: 7228497 - DNA, 22 bp, Homo sapiens
tgaggggcggcctgcagaggcc

SEQ ID NO: 7228498 - DNA, 22 bp, Homo sapiens
tgaggggcggcctgcagaggcc

SEQ ID NO: 7228499 - DNA, 19 bp, Homo sapiens
tgaggggctcacagtctca

SEQ ID NO: 7228500 - DNA, 22 bp, Homo sapiens
tgaggggcggcctgcagaggcc

SEQ ID NO: 7228501 - DNA, 22 bp, Homo sapiens
tgaggggcggcctgcagaggcc

SEQ ID NO: 7228502 - DNA, 22 bp, Homo sapiens
tgaggggcgctggcaggttcct

SEQ ID NO: 7228503 - DNA, 22 bp, Homo sapiens
tgaggggcgctggcaggttcct

SEQ ID NO: 7228504 - DNA, 22 bp, Homo sapiens
tgaggggcggcctgcagaggcc

SEQ ID NO: 7228505 - DNA, 22 bp, Homo sapiens
tgaggggcagagaggtgtccag

SEQ ID NO: 7228506 - DNA, 22 bp, Homo sapiens
tgaggggcagagaggtgtccag

SEQ ID NO: 7228507 - DNA, 22 bp, Homo sapiens
tgaggggcatgtgtttacacat

SEQ ID NO: 7228508 - DNA, 22 bp, Homo sapiens
tgaggggcatgtgtttacacat

SEQ ID NO: 7228509 - DNA, 22 bp, Homo sapiens
tgaggggccagaccccacctag

SEQ ID NO: 7228510 - DNA, 22 bp, Homo sapiens
tgaggggccagaccccacctag

SEQ ID NO: 7228511 - DNA, 22 bp, Homo sapiens
tgaggggccgcccaagcacttc

SEQ ID NO: 7228512 - DNA, 22 bp, Homo sapiens
tgaggggccgcccaagcacttc

SEQ ID NO: 7228513 - DNA, 22 bp, Homo sapiens
tgaggggccgcccaagcacttc

SEQ ID NO: 7228514 - DNA, 22 bp, Homo sapiens
tgaggggccgcccaagcacttc

SEQ ID NO: 7228515 - DNA, 22 bp, Homo sapiens
tgaggggccgcccaagcacttc

SEQ ID NO: 7228516 - DNA, 22 bp, Homo sapiens
tgaggggcgctggcaggttcct

SEQ ID NO: 7228517 - DNA, 22 bp, Homo sapiens
tgaggtgagtcagtttctgatg

SEQ ID NO: 7228518 - DNA, 22 bp, Homo sapiens
tgaggtgagtcatgcattggag

SEQ ID NO: 7228519 - DNA, 22 bp, Homo sapiens
tgaggtgagatggctaccccaa

SEQ ID NO: 7228520 - DNA, 22 bp, Homo sapiens
tgaggtgagcatctttatcttc

SEQ ID NO: 7228521 - DNA, 22 bp, Homo sapiens
tgaggtgaggttgaggaaagaa

SEQ ID NO: 7228522 - DNA, 22 bp, Homo sapiens
tgaggtgaggttgaggaaagaa

SEQ ID NO: 7228523 - DNA, 22 bp, Homo sapiens
tgaggtgaatggtgtccctgga

SEQ ID NO: 7228524 - DNA, 22 bp, Homo sapiens
tgaggtgaatggtgtccctgga

SEQ ID NO: 7228525 - DNA, 20 bp, Homo sapiens
tgaggtgaatgtcttttaga

SEQ ID NO: 7228526 - DNA, 22 bp, Homo sapiens
tgaggtgacaattcattctcca

SEQ ID NO: 7228527 - DNA, 22 bp, Homo sapiens
tgaggtgacaattcattctcca

SEQ ID NO: 7228528 - DNA, 22 bp, Homo sapiens
tgaggtgacacaatttactcca

SEQ ID NO: 7228529 - DNA, 22 bp, Homo sapiens
tgaggtgaccgcagatgggaag

SEQ ID NO: 7228530 - DNA, 22 bp, Homo sapiens
tgaggtgaccgcagatgggaag

SEQ ID NO: 7228531 - DNA, 22 bp, Homo sapiens
tgaggtgaaggagttttaaagt

SEQ ID NO: 7228532 - DNA, 22 bp, Homo sapiens
tgaggtgaagagtggagctcag

SEQ ID NO: 7228533 - DNA, 22 bp, Homo sapiens
tgaggtgaagagtggagctcag

SEQ ID NO: 7228534 - DNA, 22 bp, Homo sapiens
tgaggtcttttatagtgtgtca

SEQ ID NO: 7228535 - DNA, 22 bp, Homo sapiens
tgaggtgaagagtggagctcag

SEQ ID NO: 7228536 - DNA, 22 bp, Homo sapiens
tgaggtctgctcaagtccctgg

SEQ ID NO: 7228537 - DNA, 22 bp, Homo sapiens
tgaggtctcagctgggaagact

SEQ ID NO: 7228538 - DNA, 22 bp, Homo sapiens
tgaggtaggaatttgtattggg

SEQ ID NO: 7228539 - DNA, 22 bp, Homo sapiens
tgaggtaggaggattgattgag

SEQ ID NO: 7228540 - DNA, 22 bp, Homo sapiens
tgaggtaggagggtgatcagca

SEQ ID NO: 7228541 - DNA, 22 bp, Homo sapiens
tgaggtaggagtgggaaagtag

SEQ ID NO: 7228542 - DNA, 22 bp, Homo sapiens
tgagggtggcacaggcacaaag

SEQ ID NO: 7228543 - DNA, 22 bp, Homo sapiens
tgagggtggccttgtgtggact

SEQ ID NO: 7228544 - DNA, 22 bp, Homo sapiens
tgagggtgggccctgggcatct

SEQ ID NO: 7228545 - DNA, 22 bp, Homo sapiens
tgagggtgggcctgcaggaaga

SEQ ID NO: 7228546 - DNA, 22 bp, Homo sapiens
tgagggtgggcctgcaggaaga

SEQ ID NO: 7228547 - DNA, 22 bp, Homo sapiens
tgagggtgtgcggcccagacag

SEQ ID NO: 7228548 - DNA, 22 bp, Homo sapiens
tgaggtaaatagaaaaaccatg

SEQ ID NO: 7228549 - DNA, 22 bp, Homo sapiens
tgaggtaaattctggcccaaac

SEQ ID NO: 7228550 - DNA, 22 bp, Homo sapiens
tgaggtagaaaaagcttgtagt

SEQ ID NO: 7228551 - DNA, 22 bp, Homo sapiens
tgaggtagaagcctgggttgag

SEQ ID NO: 7228552 - DNA, 22 bp, Homo sapiens
tgaggtagaagttgggctgctt

SEQ ID NO: 7228553 - DNA, 22 bp, Homo sapiens
tgaggtagagattgtgactgta

SEQ ID NO: 7228554 - DNA, 21 bp, Homo sapiens
tgaggtagccagtgagatgga

SEQ ID NO: 7228555 - DNA, 21 bp, Homo sapiens
tgaggtagccagtgagatgga

SEQ ID NO: 7228556 - DNA, 22 bp, Homo sapiens
tgaggtagctgctatttgtagt

SEQ ID NO: 7228557 - DNA, 22 bp, Homo sapiens
tgaggtagctgtttagaaagac

SEQ ID NO: 7228558 - DNA, 22 bp, Homo sapiens
tgaggtagctgtttagaaagac

SEQ ID NO: 7228559 - DNA, 18 bp, Homo sapiens
tgaggtagctttcctcct

SEQ ID NO: 7228560 - DNA, 22 bp, Homo sapiens
tgaggttagctgggatttcatg

SEQ ID NO: 7228561 - DNA, 22 bp, Homo sapiens
tgaggttatgcttgttgaggtt

SEQ ID NO: 7228562 - DNA, 22 bp, Homo sapiens
tgaggtgtgtccccagggaggt

SEQ ID NO: 7228563 - DNA, 22 bp, Homo sapiens
tgaggtgtgtccccagggaggt

SEQ ID NO: 7228564 - DNA, 22 bp, Homo sapiens
tgaggtggtttgtatcactggg

SEQ ID NO: 7228565 - DNA, 22 bp, Homo sapiens
tgaggtggtttgtatcactggg

SEQ ID NO: 7228566 - DNA, 22 bp, Homo sapiens
tgaggtggtttgtatcactggg

SEQ ID NO: 7228567 - DNA, 22 bp, Homo sapiens
tgaggtggttcaagagccttgt

SEQ ID NO: 7228568 - DNA, 22 bp, Homo sapiens
tgaggtggttcaagagccttgt

SEQ ID NO: 7228569 - DNA, 22 bp, Homo sapiens
tgaggtggttcaagagccttgt

SEQ ID NO: 7228570 - DNA, 22 bp, Homo sapiens
tgaggtggttactgtggtgctc

SEQ ID NO: 7228571 - DNA, 22 bp, Homo sapiens
tgaggtggttactgtggtgctc

SEQ ID NO: 7228572 - DNA, 22 bp, Homo sapiens
tgaggtggttactgtggtgctc

SEQ ID NO: 7228573 - DNA, 22 bp, Homo sapiens
tgaggtggttactgtggtgctc

SEQ ID NO: 7228574 - DNA, 22 bp, Homo sapiens
tgaggtggttactgtggtgctc

SEQ ID NO: 7228575 - DNA, 22 bp, Homo sapiens
tgaggtggtgctaatctctgct

SEQ ID NO: 7228576 - DNA, 22 bp, Homo sapiens
tgaggtggtgctaatctctgct

SEQ ID NO: 7228577 - DNA, 22 bp, Homo sapiens
tgaggtgggtgtcaggtcagag

SEQ ID NO: 7228578 - DNA, 22 bp, Homo sapiens
tgaggtgggtgtcaggtcagag

SEQ ID NO: 7228579 - DNA, 22 bp, Homo sapiens
tgaggtggtccaaagactgttt

SEQ ID NO: 7228580 - DNA, 22 bp, Homo sapiens
tgaggtgggtgtcaggtcagag

SEQ ID NO: 7228581 - DNA, 22 bp, Homo sapiens
tgaggtgggtgtcaggtcagag

SEQ ID NO: 7228582 - DNA, 22 bp, Homo sapiens
tgaggtggctggatctcagcct

SEQ ID NO: 7228583 - DNA, 22 bp, Homo sapiens
tgaggtggctagggaggcactc

SEQ ID NO: 7228584 - DNA, 22 bp, Homo sapiens
tgaggtggctagggaggcactc

SEQ ID NO: 7228585 - DNA, 22 bp, Homo sapiens
tgaggtggctggatctcagcct

SEQ ID NO: 7228586 - DNA, 22 bp, Homo sapiens
tgaggtggctggatctcagcct

SEQ ID NO: 7228587 - DNA, 22 bp, Homo sapiens
tgaggtggctagggaggcactc

SEQ ID NO: 7228588 - DNA, 22 bp, Homo sapiens
tgaggtggcacacacttcctgc

SEQ ID NO: 7228589 - DNA, 22 bp, Homo sapiens
tgaggtggcacacacttcctgc

SEQ ID NO: 7228590 - DNA, 22 bp, Homo sapiens
tgaggtggaaggatcctttgaa

SEQ ID NO: 7228591 - DNA, 22 bp, Homo sapiens
tgaggtgatacagaccctactt

SEQ ID NO: 7228592 - DNA, 22 bp, Homo sapiens
tgaggtgataataactccctgc

SEQ ID NO: 7228593 - DNA, 22 bp, Homo sapiens
tgaggtggccgaggagcaggac

SEQ ID NO: 7228594 - DNA, 22 bp, Homo sapiens
tgaggtggccgaggagcaggac

SEQ ID NO: 7228595 - DNA, 22 bp, Homo sapiens
tgaggtggccgaggagcaggac

SEQ ID NO: 7228596 - DNA, 22 bp, Homo sapiens
tgaggtggccgaggagcaggac

SEQ ID NO: 7228597 - DNA, 22 bp, Homo sapiens
tgaggtggccgaggagcaggac

SEQ ID NO: 7228598 - DNA, 22 bp, Homo sapiens
tgaggtggctagggaggcactc

SEQ ID NO: 7228599 - DNA, 22 bp, Homo sapiens
tgaggtggctagggaggcactc

SEQ ID NO: 7228600 - DNA, 22 bp, Homo sapiens
tgagtcacatccatttttgtgt

SEQ ID NO: 7228601 - DNA, 23 bp, Homo sapiens
tgagtcaccacagttacagtcac

SEQ ID NO: 7228602 - DNA, 22 bp, Homo sapiens
tgagtcacctctcagaagccac

SEQ ID NO: 7228603 - DNA, 22 bp, Homo sapiens
tgagtcactatcactttctctg

SEQ ID NO: 7228604 - DNA, 22 bp, Homo sapiens
tgagtcactggcaaggctttga

SEQ ID NO: 7228605 - DNA, 22 bp, Homo sapiens
tgagtatcaattacatagttgt

SEQ ID NO: 7228606 - DNA, 22 bp, Homo sapiens
tgagtattccttatctgaaatg

SEQ ID NO: 7228607 - DNA, 22 bp, Homo sapiens
tgagtattgaccagaaaattta

SEQ ID NO: 7228608 - DNA, 22 bp, Homo sapiens
tgagtattttccctatcaatgt

SEQ ID NO: 7228609 - DNA, 22 bp, Homo sapiens
tgagtcacacatttcttcatac

SEQ ID NO: 7228610 - DNA, 22 bp, Homo sapiens
tgagtaccgctacgttgtccat

SEQ ID NO: 7228611 - DNA, 22 bp, Homo sapiens
tgagtactcttctcactacacc

SEQ ID NO: 7228612 - DNA, 22 bp, Homo sapiens
tgagtactttatgttagttatt

SEQ ID NO: 7228613 - DNA, 22 bp, Homo sapiens
tgaggttatttattatgcatga

SEQ ID NO: 7228614 - DNA, 22 bp, Homo sapiens
tgagtaaaaattctacatttcc

SEQ ID NO: 7228615 - DNA, 22 bp, Homo sapiens
tgagtaaaaattctacatttcc

SEQ ID NO: 7228616 - DNA, 22 bp, Homo sapiens
tgagtaaaagtgaatcttatgt

SEQ ID NO: 7228617 - DNA, 22 bp, Homo sapiens
tgagtaaagggccagatagtaa

SEQ ID NO: 7228618 - DNA, 22 bp, Homo sapiens
tgagtaggatagggtggggctt

SEQ ID NO: 7228619 - DNA, 22 bp, Homo sapiens
tgagtagcggctatgtgtaact

SEQ ID NO: 7228620 - DNA, 22 bp, Homo sapiens
tgagtagagaattcagctaagg

SEQ ID NO: 7228621 - DNA, 22 bp, Homo sapiens
tgagtaggtggttaagcatgga

SEQ ID NO: 7228622 - DNA, 22 bp, Homo sapiens
tgagtataaaacatatacatca

SEQ ID NO: 7228623 - DNA, 22 bp, Homo sapiens
tgagtatatgatttgtgtttgc

SEQ ID NO: 7228624 - DNA, 22 bp, Homo sapiens
tgaggggagacagagtggactc

SEQ ID NO: 7228625 - DNA, 22 bp, Homo sapiens
tgaggggagcccgccctggacg

SEQ ID NO: 7228626 - DNA, 19 bp, Homo sapiens
tgaggggaggagaggcctg

SEQ ID NO: 7228627 - DNA, 19 bp, Homo sapiens
tgaggggaggagaggcctg

SEQ ID NO: 7228628 - DNA, 19 bp, Homo sapiens
tgaggggaggagaggcctg

SEQ ID NO: 7228629 - DNA, 19 bp, Homo sapiens
tgaggggaggagaggcctg

SEQ ID NO: 7228630 - DNA, 19 bp, Homo sapiens
tgaggggaggagaggcctg

SEQ ID NO: 7228631 - DNA, 19 bp, Homo sapiens
tgaggggaggagaggcctg

SEQ ID NO: 7228632 - DNA, 19 bp, Homo sapiens
tgaggggaggagaggcctg

SEQ ID NO: 7228633 - DNA, 22 bp, Homo sapiens
tgaggggaggttggggcacatc

SEQ ID NO: 7228634 - DNA, 22 bp, Homo sapiens
tgaggggaggttggggcacatc

SEQ ID NO: 7228635 - DNA, 22 bp, Homo sapiens
tgaggggaggttggggcacatc

SEQ ID NO: 7228636 - DNA, 22 bp, Homo sapiens
tgaggggaggttggggcacatc

SEQ ID NO: 7228637 - DNA, 22 bp, Homo sapiens
tgaggggatacggtacacattg

SEQ ID NO: 7228638 - DNA, 22 bp, Homo sapiens
tgaggggatacggtacacattg

SEQ ID NO: 7228639 - DNA, 22 bp, Homo sapiens
tgaggggagaagcagcagcctg

SEQ ID NO: 7228640 - DNA, 22 bp, Homo sapiens
tgagggagttgggtgtatagga

SEQ ID NO: 7228641 - DNA, 22 bp, Homo sapiens
tgaggggagacagagtggactc

SEQ ID NO: 7228642 - DNA, 22 bp, Homo sapiens
tgaggggagacagagtggactc

SEQ ID NO: 7228643 - DNA, 22 bp, Homo sapiens
tgaggggagaagcagcagcctg

SEQ ID NO: 7228644 - DNA, 22 bp, Homo sapiens
tgaggggagaagcagcagcctg

SEQ ID NO: 7228645 - DNA, 22 bp, Homo sapiens
tgagggagtgtggatacagtag

SEQ ID NO: 7228646 - DNA, 22 bp, Homo sapiens
tgagggagtgtggatacagtag

SEQ ID NO: 7228647 - DNA, 22 bp, Homo sapiens
tgagggagttgggtgtatagga

SEQ ID NO: 7228648 - DNA, 22 bp, Homo sapiens
tgagggagttgggtgtatagga

SEQ ID NO: 7228649 - DNA, 22 bp, Homo sapiens
tgagggagtgtggatacagtag

SEQ ID NO: 7228650 - DNA, 22 bp, Homo sapiens
tgagggagtgtggatacagtag

SEQ ID NO: 7228651 - DNA, 22 bp, Homo sapiens
tgagggagtcatgattaaggaa

SEQ ID NO: 7228652 - DNA, 22 bp, Homo sapiens
tgagggagcacacactgaagtg

SEQ ID NO: 7228653 - DNA, 22 bp, Homo sapiens
tgagggagcacacactgaagtg

SEQ ID NO: 7228654 - DNA, 22 bp, Homo sapiens
tgagggagctgacctttctgtg

SEQ ID NO: 7228655 - DNA, 22 bp, Homo sapiens
tgagggagctgacctttctgtg

SEQ ID NO: 7228656 - DNA, 22 bp, Homo sapiens
tgagggagctgacctttctgtg

SEQ ID NO: 7228657 - DNA, 22 bp, Homo sapiens
tgagggaggccctttgagcaga

SEQ ID NO: 7228658 - DNA, 22 bp, Homo sapiens
tgagggaggccctttgagcaga

SEQ ID NO: 7228659 - DNA, 22 bp, Homo sapiens
tgagggaggccctttgagcaga

SEQ ID NO: 7228660 - DNA, 22 bp, Homo sapiens
tgagggaggcctccatctgcca

SEQ ID NO: 7228661 - DNA, 22 bp, Homo sapiens
tgagggaggcctccatctgcca

SEQ ID NO: 7228662 - DNA, 20 bp, Homo sapiens
tgagggagtattgatttccc

SEQ ID NO: 7228663 - DNA, 20 bp, Homo sapiens
tgagggagtattgatttccc

SEQ ID NO: 7228664 - DNA, 22 bp, Homo sapiens
tgagggagtcatgattaaggaa

SEQ ID NO: 7228665 - DNA, 22 bp, Homo sapiens
tgagggaatattgatagatccg

SEQ ID NO: 7228666 - DNA, 22 bp, Homo sapiens
tgagggaatcctcacatcaatc

SEQ ID NO: 7228667 - DNA, 22 bp, Homo sapiens
tgagggaatcctcacatcaatc

SEQ ID NO: 7228668 - DNA, 23 bp, Homo sapiens
tgagggacatggtggcttctgag

SEQ ID NO: 7228669 - DNA, 22 bp, Homo sapiens
tgagggactcagaattcagcct

SEQ ID NO: 7228670 - DNA, 22 bp, Homo sapiens
tgagggactcccggccctgcca

SEQ ID NO: 7228671 - DNA, 22 bp, Homo sapiens
tgagggactgcatacccagctt

SEQ ID NO: 7228672 - DNA, 22 bp, Homo sapiens
tgagggactgcatacccagctt

SEQ ID NO: 7228673 - DNA, 22 bp, Homo sapiens
tgagggagagggcgaaaatgaa

SEQ ID NO: 7228674 - DNA, 22 bp, Homo sapiens
tgagggagagggcgaaaatgaa

SEQ ID NO: 7228675 - DNA, 22 bp, Homo sapiens
tgagggagagggcgaaaatgaa

SEQ ID NO: 7228676 - DNA, 22 bp, Homo sapiens
tgagggagagggcgaaaatgaa

SEQ ID NO: 7228677 - DNA, 22 bp, Homo sapiens
tgagggagcacacactgaagtg

SEQ ID NO: 7228678 - DNA, 22 bp, Homo sapiens
tgagggagcacacactgaagtg

SEQ ID NO: 7228679 - DNA, 22 bp, Homo sapiens
tgaggctccttgtagagagtgg

SEQ ID NO: 7228680 - DNA, 18 bp, Homo sapiens
tgaggctcagctcctggt

SEQ ID NO: 7228681 - DNA, 18 bp, Homo sapiens
tgaggctcagctcctggt

SEQ ID NO: 7228682 - DNA, 22 bp, Homo sapiens
tgaggctcagagaagtgctgtt

SEQ ID NO: 7228683 - DNA, 22 bp, Homo sapiens
tgaggctcagagaagtgctgtt

SEQ ID NO: 7228684 - DNA, 22 bp, Homo sapiens
tgaggctaaaggtgaccagatt

SEQ ID NO: 7228685 - DNA, 22 bp, Homo sapiens
tgaggccttagtaaccctgcac

SEQ ID NO: 7228686 - DNA, 20 bp, Homo sapiens
tgaggcgacgaagaggcggc

SEQ ID NO: 7228687 - DNA, 22 bp, Homo sapiens
tgaggcctgcttggaattgaat

SEQ ID NO: 7228688 - DNA, 22 bp, Homo sapiens
tgaggcctggactctgcatgga

SEQ ID NO: 7228689 - DNA, 22 bp, Homo sapiens
tgaggcctggagggaggagttt

SEQ ID NO: 7228690 - DNA, 22 bp, Homo sapiens
tgaggcctggagggaggagttt

SEQ ID NO: 7228691 - DNA, 22 bp, Homo sapiens
tgaggcctggagggaggagttt

SEQ ID NO: 7228692 - DNA, 22 bp, Homo sapiens
tgaggcctgggcacataacctc

SEQ ID NO: 7228693 - DNA, 22 bp, Homo sapiens
tgaggcttggagaggtcaggga

SEQ ID NO: 7228694 - DNA, 22 bp, Homo sapiens
tgaggcttgatttgcccgagag

SEQ ID NO: 7228695 - DNA, 22 bp, Homo sapiens
tgaggcttggagaggtcaggga

SEQ ID NO: 7228696 - DNA, 22 bp, Homo sapiens
tgaggcttagatttggtaactc

SEQ ID NO: 7228697 - DNA, 21 bp, Homo sapiens
tgaggctgttgtaccagggag

SEQ ID NO: 7228698 - DNA, 21 bp, Homo sapiens
tgaggctgttgtaccagggag

SEQ ID NO: 7228699 - DNA, 21 bp, Homo sapiens
tgaggctgttgtaccagggag

SEQ ID NO: 7228700 - DNA, 22 bp, Homo sapiens
tgaggctgttctaccagggcca

SEQ ID NO: 7228701 - DNA, 22 bp, Homo sapiens
tgaggctgttctaccagggcca

SEQ ID NO: 7228702 - DNA, 22 bp, Homo sapiens
tgaggctgttctaccagggcca

SEQ ID NO: 7228703 - DNA, 22 bp, Homo sapiens
tgaggctggcaaggctggtatt

SEQ ID NO: 7228704 - DNA, 22 bp, Homo sapiens
tgaggctgttctaccagggcca

SEQ ID NO: 7228705 - DNA, 22 bp, Homo sapiens
tgaggctgttctaccagggcca

SEQ ID NO: 7228706 - DNA, 22 bp, Homo sapiens
tgaggctggcaaggctggtatt

SEQ ID NO: 7228707 - DNA, 22 bp, Homo sapiens
tgaggctggcaaggctggtatt

SEQ ID NO: 7228708 - DNA, 22 bp, Homo sapiens
tgaggctggatgggatgcctcc

SEQ ID NO: 7228709 - DNA, 22 bp, Homo sapiens
tgaggctggatgggatgcctcc

SEQ ID NO: 7228710 - DNA, 22 bp, Homo sapiens
tgaggctggatgggatgcctcc

SEQ ID NO: 7228711 - DNA, 22 bp, Homo sapiens
tgaggctggatgggatgcctcc

SEQ ID NO: 7228712 - DNA, 22 bp, Homo sapiens
tgaggctggatgggatgcctcc

SEQ ID NO: 7228713 - DNA, 22 bp, Homo sapiens
tgaggctgccttgggaagaggg

SEQ ID NO: 7228714 - DNA, 22 bp, Homo sapiens
tgaggctgccttgggaagaggg

SEQ ID NO: 7228715 - DNA, 22 bp, Homo sapiens
tgaggctgccttgggaagaggg

SEQ ID NO: 7228716 - DNA, 22 bp, Homo sapiens
tgaggctgccttgggaagaggg

SEQ ID NO: 7228717 - DNA, 22 bp, Homo sapiens
tgaggctgccttgggaagaggg

SEQ ID NO: 7228718 - DNA, 22 bp, Homo sapiens
tgaggctgccttgggaagaggg

SEQ ID NO: 7228719 - DNA, 21 bp, Homo sapiens
tgaggctctgttgtgcctgca

SEQ ID NO: 7228720 - DNA, 21 bp, Homo sapiens
tgaggctctgttgtgcctgca

SEQ ID NO: 7228721 - DNA, 17 bp, Homo sapiens
tgaggctcggtgaggag

SEQ ID NO: 7228722 - DNA, 22 bp, Homo sapiens
tgaggcaggactgagcgggatg

SEQ ID NO: 7228723 - DNA, 22 bp, Homo sapiens
tgaggcaggactgagcgggatg

SEQ ID NO: 7228724 - DNA, 22 bp, Homo sapiens
tgaggcaggacatggacaactg

SEQ ID NO: 7228725 - DNA, 22 bp, Homo sapiens
tgaggcaggactgagcgggatg

SEQ ID NO: 7228726 - DNA, 22 bp, Homo sapiens
tgaggcaggactgagcgggatg

SEQ ID NO: 7228727 - DNA, 22 bp, Homo sapiens
tgaggcaggagaatcacatgaa

SEQ ID NO: 7228728 - DNA, 22 bp, Homo sapiens
tgaggcaggacttgcataaagt

SEQ ID NO: 7228729 - DNA, 22 bp, Homo sapiens
tgaggcaggactgagcgggatg

SEQ ID NO: 7228730 - DNA, 22 bp, Homo sapiens
tgaggcaggacttgcataaagt

SEQ ID NO: 7228731 - DNA, 20 bp, Homo sapiens
tgaggcaggagaatggcatg

SEQ ID NO: 7228732 - DNA, 22 bp, Homo sapiens
tgaggcaggagaatcaccggaa

SEQ ID NO: 7228733 - DNA, 22 bp, Homo sapiens
tgaggcaggagaatcaccggaa

SEQ ID NO: 7228734 - DNA, 20 bp, Homo sapiens
tgaggcaggagaatggcatg

SEQ ID NO: 7228735 - DNA, 20 bp, Homo sapiens
tgaggcaggagaatggcatg

SEQ ID NO: 7228736 - DNA, 22 bp, Homo sapiens
tgaggcaggagaatcacatgaa

SEQ ID NO: 7228737 - DNA, 22 bp, Homo sapiens
tgaggcaggagaatcacatgaa

SEQ ID NO: 7228738 - DNA, 22 bp, Homo sapiens
tgaggcaggagaatcaccggaa

SEQ ID NO: 7228739 - DNA, 22 bp, Homo sapiens
tgaggcaggagaatcaccggaa

SEQ ID NO: 7228740 - DNA, 22 bp, Homo sapiens
tgaggcaggagaatcacatgaa

SEQ ID NO: 7228741 - DNA, 22 bp, Homo sapiens
tgaggcagaaaatagcagttca

SEQ ID NO: 7228742 - DNA, 22 bp, Homo sapiens
tgaggcactgggagagcacact

SEQ ID NO: 7228743 - DNA, 22 bp, Homo sapiens
tgaggcagctttttctgtgtgt

SEQ ID NO: 7228744 - DNA, 22 bp, Homo sapiens
tgaggcagctttttctgtgtgt

SEQ ID NO: 7228745 - DNA, 22 bp, Homo sapiens
tgaggcaggaagttatataatg

SEQ ID NO: 7228746 - DNA, 22 bp, Homo sapiens
tgaggcagctttttctgtgtgt

SEQ ID NO: 7228747 - DNA, 22 bp, Homo sapiens
tgaggcagctttttctgtgtgt

SEQ ID NO: 7228748 - DNA, 22 bp, Homo sapiens
tgaggcagctttttctgtgtgt

SEQ ID NO: 7228749 - DNA, 22 bp, Homo sapiens
tgaggcaggaatggggaaaagt

SEQ ID NO: 7228750 - DNA, 22 bp, Homo sapiens
tgaggcaggaatggggaaaagt

SEQ ID NO: 7228751 - DNA, 22 bp, Homo sapiens
tgaggcaggaatggggaaaagt

SEQ ID NO: 7228752 - DNA, 22 bp, Homo sapiens
tgaggcaggaagttatataatg

SEQ ID NO: 7228753 - DNA, 22 bp, Homo sapiens
tgaggcaggaatggggaaaagt

SEQ ID NO: 7228754 - DNA, 22 bp, Homo sapiens
tgaggcaggactgagcgggatg

SEQ ID NO: 7228755 - DNA, 22 bp, Homo sapiens
tgaggcaggacatggacaactg

SEQ ID NO: 7228756 - DNA, 22 bp, Homo sapiens
tgaggcaggacatggacaactg

SEQ ID NO: 7228757 - DNA, 22 bp, Homo sapiens
tgaggcaggacatggacaactg

SEQ ID NO: 7228758 - DNA, 22 bp, Homo sapiens
tgaggcacatccaggccagctc

SEQ ID NO: 7228759 - DNA, 22 bp, Homo sapiens
tgaggcactccaggatgctgtt

SEQ ID NO: 7228760 - DNA, 22 bp, Homo sapiens
tgaggcactccaggatgctgtt

SEQ ID NO: 7228761 - DNA, 22 bp, Homo sapiens
tgaggcactgggagagcacact

SEQ ID NO: 7228762 - DNA, 22 bp, Homo sapiens
tgaggcacagaaaatggtaggg

SEQ ID NO: 7228763 - DNA, 19 bp, Homo sapiens
tgaggcacagtggtgaaat

SEQ ID NO: 7228764 - DNA, 22 bp, Homo sapiens
tgaggcacatccaggccagctc

SEQ ID NO: 7228765 - DNA, 22 bp, Homo sapiens
tgaggcaaggctgaatgaaggc

SEQ ID NO: 7228766 - DNA, 22 bp, Homo sapiens
tgaggcaagggatggccccgtg

SEQ ID NO: 7228767 - DNA, 22 bp, Homo sapiens
tgaggcaagtactttccctttt

SEQ ID NO: 7228768 - DNA, 22 bp, Homo sapiens
tgaggcaatccctagggtaagg

SEQ ID NO: 7228769 - DNA, 22 bp, Homo sapiens
tgaggcaatccctagggtaagg

SEQ ID NO: 7228770 - DNA, 21 bp, Homo sapiens
tgaggatgtgcagcagcagga

SEQ ID NO: 7228771 - DNA, 21 bp, Homo sapiens
tgaggatgtgcagcagcagga

SEQ ID NO: 7228772 - DNA, 22 bp, Homo sapiens
tgaggatggttaaagaacattg

SEQ ID NO: 7228773 - DNA, 22 bp, Homo sapiens
tgaggatggttaaagaacattg

SEQ ID NO: 7228774 - DNA, 22 bp, Homo sapiens
tgaggatgtctgtattttgcct

SEQ ID NO: 7228775 - DNA, 22 bp, Homo sapiens
tgaggattggcaaaactcaggg

SEQ ID NO: 7228776 - DNA, 22 bp, Homo sapiens
tgaggatttaatactcataagc

SEQ ID NO: 7228777 - DNA, 22 bp, Homo sapiens
tgaggatttaatgggactcatt

SEQ ID NO: 7228778 - DNA, 21 bp, Homo sapiens
tgaggatttcagtagatgcct

SEQ ID NO: 7228779 - DNA, 22 bp, Homo sapiens
tgaggcaaaaacactgattagg

SEQ ID NO: 7228780 - DNA, 22 bp, Homo sapiens
tgaggcaaaagttatgtggtag

SEQ ID NO: 7228781 - DNA, 22 bp, Homo sapiens
tgaggcaaagacaaagcagcat

SEQ ID NO: 7228782 - DNA, 22 bp, Homo sapiens
tgaggcaaagttcaagctgaaa

SEQ ID NO: 7228783 - DNA, 22 bp, Homo sapiens
tgaggcaagagtttgattagag

SEQ ID NO: 7228784 - DNA, 19 bp, Homo sapiens
tgaggcaagatggctctgg

SEQ ID NO: 7228785 - DNA, 22 bp, Homo sapiens
tgaggagtcgagaaggggtaat

SEQ ID NO: 7228786 - DNA, 22 bp, Homo sapiens
tgaggagtatggtggggtcatt

SEQ ID NO: 7228787 - DNA, 22 bp, Homo sapiens
tgaggagtatggtggggtcatt

SEQ ID NO: 7228788 - DNA, 22 bp, Homo sapiens
tgaggaggtgggcacacagagt

SEQ ID NO: 7228789 - DNA, 22 bp, Homo sapiens
tgaggagtcgagaaggggtaat

SEQ ID NO: 7228790 - DNA, 22 bp, Homo sapiens
tgaggagtgtggatggagcttg

SEQ ID NO: 7228791 - DNA, 22 bp, Homo sapiens
tgaggagtgtggatggagcttg

SEQ ID NO: 7228792 - DNA, 22 bp, Homo sapiens
tgaggagtttagatatagggaa

SEQ ID NO: 7228793 - DNA, 22 bp, Homo sapiens
tgaggagtttttctagagctaa

SEQ ID NO: 7228794 - DNA, 22 bp, Homo sapiens
tgaggataacccaggcaaactg

SEQ ID NO: 7228795 - DNA, 22 bp, Homo sapiens
tgaggatgacgatggcaatggc

SEQ ID NO: 7228796 - DNA, 22 bp, Homo sapiens
tgaggatatagtggtaaacagt

SEQ ID NO: 7228797 - DNA, 22 bp, Homo sapiens
tgaggataacccaggcaaactg

SEQ ID NO: 7228798 - DNA, 21 bp, Homo sapiens
tgaggataagtaaagctgaag

SEQ ID NO: 7228799 - DNA, 21 bp, Homo sapiens
tgaggataagtaaagctgaag

SEQ ID NO: 7228800 - DNA, 22 bp, Homo sapiens
tgaggatgagatgagataacac

SEQ ID NO: 7228801 - DNA, 22 bp, Homo sapiens
tgaggatgagatgagataacac

SEQ ID NO: 7228802 - DNA, 22 bp, Homo sapiens
tgaggatgacgatggcaatggc

SEQ ID NO: 7228803 - DNA, 22 bp, Homo sapiens
tgaggatggcagtgtgctcagc

SEQ ID NO: 7228804 - DNA, 22 bp, Homo sapiens
tgaggatggaatgctgtgcaag

SEQ ID NO: 7228805 - DNA, 22 bp, Homo sapiens
tgaggatggaatgctgtgcaag

SEQ ID NO: 7228806 - DNA, 22 bp, Homo sapiens
tgaggatggcagtgtgctcagc

SEQ ID NO: 7228807 - DNA, 22 bp, Homo sapiens
tgaggatggtcccgaggacact

SEQ ID NO: 7228808 - DNA, 22 bp, Homo sapiens
tgaggatggtgttggagagggc

SEQ ID NO: 7228809 - DNA, 22 bp, Homo sapiens
tgaggatggtcccgaggacact

SEQ ID NO: 7228810 - DNA, 22 bp, Homo sapiens
tgaggagcgggcagggatgcag

SEQ ID NO: 7228811 - DNA, 22 bp, Homo sapiens
tgaggaggcccaggttggggct

SEQ ID NO: 7228812 - DNA, 22 bp, Homo sapiens
tgaggaggtcagagtctggctg

SEQ ID NO: 7228813 - DNA, 22 bp, Homo sapiens
tgaggaggtcagagtctggctg

SEQ ID NO: 7228814 - DNA, 22 bp, Homo sapiens
tgaggaggtgggcacacagagt

SEQ ID NO: 7228815 - DNA, 22 bp, Homo sapiens
tgaggaggtgggcacacagagt

SEQ ID NO: 7228816 - DNA, 22 bp, Homo sapiens
tgaggaggtgggcacacagagt

SEQ ID NO: 7228817 - DNA, 22 bp, Homo sapiens
tgaggaggtgggcacacagagt

SEQ ID NO: 7228818 - DNA, 22 bp, Homo sapiens
tgaggaggtgggcacacagagt

SEQ ID NO: 7228819 - DNA, 22 bp, Homo sapiens
tgaggaggcccaggttggggct

SEQ ID NO: 7228820 - DNA, 22 bp, Homo sapiens
tgaggaggcccaggttggggct

SEQ ID NO: 7228821 - DNA, 22 bp, Homo sapiens
tgaggaggtcagagtctggctg

SEQ ID NO: 7228822 - DNA, 22 bp, Homo sapiens
tgaggaggtcagagtctggctg

SEQ ID NO: 7228823 - DNA, 22 bp, Homo sapiens
tgaggaggtcagagtctggctg

SEQ ID NO: 7228824 - DNA, 22 bp, Homo sapiens
tgaggagaaatgctcagagcca

SEQ ID NO: 7228825 - DNA, 22 bp, Homo sapiens
tgaggagaaatgctcagagcca

SEQ ID NO: 7228826 - DNA, 22 bp, Homo sapiens
tgaggaagttgatctcatcagt

SEQ ID NO: 7228827 - DNA, 23 bp, Homo sapiens
tgaggaagtaattgtaaaggtct

SEQ ID NO: 7228828 - DNA, 22 bp, Homo sapiens
tgaggaagggtgtgacggcacc

SEQ ID NO: 7228829 - DNA, 22 bp, Homo sapiens
tgaggaagggtgtgacggcacc

SEQ ID NO: 7228830 - DNA, 22 bp, Homo sapiens
tgaggaagggtgtgacggcacc

SEQ ID NO: 7228831 - DNA, 22 bp, Homo sapiens
tgaggaaggaattgaggtttta

SEQ ID NO: 7228832 - DNA, 18 bp, Homo sapiens
tgaggaaggggaagtatt

SEQ ID NO: 7228833 - DNA, 22 bp, Homo sapiens
tgaggaagggtgtgacggcacc

SEQ ID NO: 7228834 - DNA, 22 bp, Homo sapiens
tgaggaagggtgtgacggcacc

SEQ ID NO: 7228835 - DNA, 22 bp, Homo sapiens
tgaggaagccaaacagctacac

SEQ ID NO: 7228836 - DNA, 22 bp, Homo sapiens
tgaggaagcaaaggcttgtgtg

SEQ ID NO: 7228837 - DNA, 22 bp, Homo sapiens
tgaggaagcaaaggcttgtgtg

SEQ ID NO: 7228838 - DNA, 22 bp, Homo sapiens
tgaggaagaacaagaatttaga

SEQ ID NO: 7228839 - DNA, 22 bp, Homo sapiens
tgaggaactcaccaggcagaga

SEQ ID NO: 7228840 - DNA, 22 bp, Homo sapiens
tgaggaactgccagactgtttt

SEQ ID NO: 7228841 - DNA, 22 bp, Homo sapiens
tgaggaaattgaggctcacaga

SEQ ID NO: 7228842 - DNA, 22 bp, Homo sapiens
tgaggaaattgaggctcacaga

SEQ ID NO: 7228843 - DNA, 22 bp, Homo sapiens
tgaggaaatatggtgaactctt

SEQ ID NO: 7228844 - DNA, 22 bp, Homo sapiens
tgaggaaatatggtgaactctt

SEQ ID NO: 7228845 - DNA, 21 bp, Homo sapiens
tgaggcctgccagtctcagaa

SEQ ID NO: 7228846 - DNA, 22 bp, Homo sapiens
tgaggcctgcattgaactagaa

SEQ ID NO: 7228847 - DNA, 17 bp, Homo sapiens
tgaggcctgcatcagtg

SEQ ID NO: 7228848 - DNA, 22 bp, Homo sapiens
tgaggcctgaagcctggagcct

SEQ ID NO: 7228849 - DNA, 21 bp, Homo sapiens
tgaggcctctcctgggctggc

SEQ ID NO: 7228850 - DNA, 18 bp, Homo sapiens
tgaggcctctgctgggcc

SEQ ID NO: 7228851 - DNA, 18 bp, Homo sapiens
tgaggcctctgctgggcc

SEQ ID NO: 7228852 - DNA, 22 bp, Homo sapiens
tgaggcctctgtgccatccagg

SEQ ID NO: 7228853 - DNA, 22 bp, Homo sapiens
tgaggcctgaagcctgaagtga

SEQ ID NO: 7228854 - DNA, 22 bp, Homo sapiens
tgaggcctgaagcctggagcct

SEQ ID NO: 7228855 - DNA, 22 bp, Homo sapiens
tgaggccctctgggctggtcct

SEQ ID NO: 7228856 - DNA, 22 bp, Homo sapiens
tgaggcctacccccctgtgttt

SEQ ID NO: 7228857 - DNA, 22 bp, Homo sapiens
tgaggccctagggcatgggaga

SEQ ID NO: 7228858 - DNA, 22 bp, Homo sapiens
tgaggccctctgggctggtcct

SEQ ID NO: 7228859 - DNA, 22 bp, Homo sapiens
tgaggcctcataatgagatttc

SEQ ID NO: 7228860 - DNA, 22 bp, Homo sapiens
tgaggcctcatttagggagagg

SEQ ID NO: 7228861 - DNA, 22 bp, Homo sapiens
tgaggcctcatttagggagagg

SEQ ID NO: 7228862 - DNA, 22 bp, Homo sapiens
tgaggcccgggtggaggaatgc

SEQ ID NO: 7228863 - DNA, 22 bp, Homo sapiens
tgaggccctagggcatgggaga

SEQ ID NO: 7228864 - DNA, 22 bp, Homo sapiens
tgaggccctagggcatgggaga

SEQ ID NO: 7228865 - DNA, 18 bp, Homo sapiens
tgaggcccgcagaggtgg

SEQ ID NO: 7228866 - DNA, 22 bp, Homo sapiens
tgaggccaggacccccagcagg

SEQ ID NO: 7228867 - DNA, 22 bp, Homo sapiens
tgaggccaggacccccagcagg

SEQ ID NO: 7228868 - DNA, 22 bp, Homo sapiens
tgaggccaggatcccaggctct

SEQ ID NO: 7228869 - DNA, 22 bp, Homo sapiens
tgaggccaggatcccaggctct

SEQ ID NO: 7228870 - DNA, 22 bp, Homo sapiens
tgaggccaggatcccaggctct

SEQ ID NO: 7228871 - DNA, 22 bp, Homo sapiens
tgaggccagcttcagcagtgga

SEQ ID NO: 7228872 - DNA, 22 bp, Homo sapiens
tgaggccagcttcagcagtgga

SEQ ID NO: 7228873 - DNA, 22 bp, Homo sapiens
tgaggccagcttcagcagtgga

SEQ ID NO: 7228874 - DNA, 19 bp, Homo sapiens
tgaggccagctggcatttt

SEQ ID NO: 7228875 - DNA, 22 bp, Homo sapiens
tgaggccagcttcagcagtgga

SEQ ID NO: 7228876 - DNA, 22 bp, Homo sapiens
tgaggccagcttcagcagtgga

SEQ ID NO: 7228877 - DNA, 22 bp, Homo sapiens
tgaggccaggacccccagcagg

SEQ ID NO: 7228878 - DNA, 22 bp, Homo sapiens
tgaggccaggacccccagcagg

SEQ ID NO: 7228879 - DNA, 18 bp, Homo sapiens
tgaggccagagtgggcat

SEQ ID NO: 7228880 - DNA, 18 bp, Homo sapiens
tgaggccagagtgggcat

SEQ ID NO: 7228881 - DNA, 18 bp, Homo sapiens
tgaggccagagtgggcat

SEQ ID NO: 7228882 - DNA, 22 bp, Homo sapiens
tgaggccagagtttttaattcc

SEQ ID NO: 7228883 - DNA, 22 bp, Homo sapiens
tgaggccagccacagccaccct

SEQ ID NO: 7228884 - DNA, 16 bp, Homo sapiens
tgaggccagccatttc

SEQ ID NO: 7228885 - DNA, 21 bp, Homo sapiens
tgaggccaatagcccctggac

SEQ ID NO: 7228886 - DNA, 21 bp, Homo sapiens
tgaggccaatagcccctggac

SEQ ID NO: 7228887 - DNA, 21 bp, Homo sapiens
tgaggccaatagcccctggac

SEQ ID NO: 7228888 - DNA, 21 bp, Homo sapiens
tgaggccaatagcccctggac

SEQ ID NO: 7228889 - DNA, 22 bp, Homo sapiens
tgaggccaatgaccctgggcag

SEQ ID NO: 7228890 - DNA, 22 bp, Homo sapiens
tgaggccaatgaccctgggcag

SEQ ID NO: 7228891 - DNA, 22 bp, Homo sapiens
tgaggccaatgaccctgggcag

SEQ ID NO: 7228892 - DNA, 22 bp, Homo sapiens
tgaggccacaggaaagggcccg

SEQ ID NO: 7228893 - DNA, 22 bp, Homo sapiens
tgaggccacagtatcagaacag

SEQ ID NO: 7228894 - DNA, 22 bp, Homo sapiens
tgaggccacagtatcagaacag

SEQ ID NO: 7228895 - DNA, 22 bp, Homo sapiens
tgaggccacagtatcagaacag

SEQ ID NO: 7228896 - DNA, 22 bp, Homo sapiens
tgaggccacttccccacagccc

SEQ ID NO: 7228897 - DNA, 22 bp, Homo sapiens
tgaggccacttccccacagccc

SEQ ID NO: 7228898 - DNA, 22 bp, Homo sapiens
tgaggccacttccccacagccc

SEQ ID NO: 7228899 - DNA, 22 bp, Homo sapiens
tgaggccacttccccacagccc

SEQ ID NO: 7228900 - DNA, 22 bp, Homo sapiens
tgaggccagactgaaaccaaca

SEQ ID NO: 7228901 - DNA, 22 bp, Homo sapiens
tgaggccagactgaaaccaaca

SEQ ID NO: 7228902 - DNA, 22 bp, Homo sapiens
tgaggccagagagtttgcattt

SEQ ID NO: 7228903 - DNA, 22 bp, Homo sapiens
tgaggcaggagaatggcgggaa

SEQ ID NO: 7228904 - DNA, 22 bp, Homo sapiens
tgaggcaggagaatggcgggaa

SEQ ID NO: 7228905 - DNA, 22 bp, Homo sapiens
tgaggcaggagaatggcgggaa

SEQ ID NO: 7228906 - DNA, 22 bp, Homo sapiens
tgaggcaggagaatggcgggaa

SEQ ID NO: 7228907 - DNA, 22 bp, Homo sapiens
tgaggcaggaggattgcaggat

SEQ ID NO: 7228908 - DNA, 20 bp, Homo sapiens
tgaggcaggagaatggcatg

SEQ ID NO: 7228909 - DNA, 20 bp, Homo sapiens
tgaggcaggagaatggcatg

SEQ ID NO: 7228910 - DNA, 20 bp, Homo sapiens
tgaggcaggagaatggcatg

SEQ ID NO: 7228911 - DNA, 20 bp, Homo sapiens
tgaggcaggagaatggcatg

SEQ ID NO: 7228912 - DNA, 22 bp, Homo sapiens
tgaggcaggagaatggcgggaa

SEQ ID NO: 7228913 - DNA, 22 bp, Homo sapiens
tgaggcaggagaatggcgggaa

SEQ ID NO: 7228914 - DNA, 20 bp, Homo sapiens
tgaggcaggagaatggcatg

SEQ ID NO: 7228915 - DNA, 22 bp, Homo sapiens
tgaggcaggaggattgcaggat

SEQ ID NO: 7228916 - DNA, 22 bp, Homo sapiens
tgaggcaggaggattgcaggat

SEQ ID NO: 7228917 - DNA, 22 bp, Homo sapiens
tgaggcaggaggattgcaggat

SEQ ID NO: 7228918 - DNA, 22 bp, Homo sapiens
tgaggcaggaggattgcaggat

SEQ ID NO: 7228919 - DNA, 22 bp, Homo sapiens
tgaggcaggaggattgcaggat

SEQ ID NO: 7228920 - DNA, 22 bp, Homo sapiens
tgaggcaggaggttgagaactg

SEQ ID NO: 7228921 - DNA, 22 bp, Homo sapiens
tgaggcaggagttaatgtgctc

SEQ ID NO: 7228922 - DNA, 22 bp, Homo sapiens
tgaggcaggaggttgagaactg

SEQ ID NO: 7228923 - DNA, 22 bp, Homo sapiens
tgaggcaggagttcaggctgcg

SEQ ID NO: 7228924 - DNA, 22 bp, Homo sapiens
tgaggcaggagttcaggctgcg

SEQ ID NO: 7228925 - DNA, 22 bp, Homo sapiens
tgaggcaggagttcaggctgcg

SEQ ID NO: 7228926 - DNA, 22 bp, Homo sapiens
tgaggcaggagttaatgtgctc

SEQ ID NO: 7228927 - DNA, 22 bp, Homo sapiens
tgaggcaggagttaatgtgctc

SEQ ID NO: 7228928 - DNA, 22 bp, Homo sapiens
tgaggcaggagttaatgtgctc

SEQ ID NO: 7228929 - DNA, 22 bp, Homo sapiens
tgaggcaggagttcaggctgcg

SEQ ID NO: 7228930 - DNA, 22 bp, Homo sapiens
tgaggcaggagttcaggctgcg

SEQ ID NO: 7228931 - DNA, 22 bp, Homo sapiens
tgaggcaggagttcaggctgcg

SEQ ID NO: 7228932 - DNA, 22 bp, Homo sapiens
tgaggcaggatgcttgcacagg

SEQ ID NO: 7228933 - DNA, 22 bp, Homo sapiens
tgaggcaggatgcttgcacagg

SEQ ID NO: 7228934 - DNA, 22 bp, Homo sapiens
tgaggcaggatgcttgcacagg

SEQ ID NO: 7228935 - DNA, 22 bp, Homo sapiens
tgaggcaggagttcaggctgcg

SEQ ID NO: 7228936 - DNA, 22 bp, Homo sapiens
tgaggcaggagttcaggctgcg

SEQ ID NO: 7228937 - DNA, 23 bp, Homo sapiens
tgaggcaggcggatcacgaggtc

SEQ ID NO: 7228938 - DNA, 23 bp, Homo sapiens
tgaggcaggcggatcacgaggtc

SEQ ID NO: 7228939 - DNA, 22 bp, Homo sapiens
tgaggcaggatgcttgcacagg

SEQ ID NO: 7228940 - DNA, 23 bp, Homo sapiens
tgaggcaggcggatcacgaggtc

SEQ ID NO: 7228941 - DNA, 23 bp, Homo sapiens
tgaggcaggcggatcacgaggtc

SEQ ID NO: 7228942 - DNA, 22 bp, Homo sapiens
tgaggccaactagggagatgga

SEQ ID NO: 7228943 - DNA, 22 bp, Homo sapiens
tgaggccaactagggagatgga

SEQ ID NO: 7228944 - DNA, 22 bp, Homo sapiens
tgaggccaactagggagatgga

SEQ ID NO: 7228945 - DNA, 22 bp, Homo sapiens
tgaggcattaaagggaggtcaa

SEQ ID NO: 7228946 - DNA, 22 bp, Homo sapiens
tgaggccaaaatgactcaaatg

SEQ ID NO: 7228947 - DNA, 22 bp, Homo sapiens
tgaggccaactagggagatgga

SEQ ID NO: 7228948 - DNA, 22 bp, Homo sapiens
tgaggccaactagggagatgga

SEQ ID NO: 7228949 - DNA, 22 bp, Homo sapiens
tgaggccaactagggagatgga

SEQ ID NO: 7228950 - DNA, 22 bp, Homo sapiens
tgaggcagttgagcttcctgag

SEQ ID NO: 7228951 - DNA, 22 bp, Homo sapiens
tgaggcagttgagcttcctgag

SEQ ID NO: 7228952 - DNA, 22 bp, Homo sapiens
tgaggcagttgagcttcctgag

SEQ ID NO: 7228953 - DNA, 22 bp, Homo sapiens
tgaggcagttgagcttcctgag

SEQ ID NO: 7228954 - DNA, 22 bp, Homo sapiens
tgaggcagttgagcttcctgag

SEQ ID NO: 7228955 - DNA, 22 bp, Homo sapiens
tgaggcagttgagcttcctgag

SEQ ID NO: 7228956 - DNA, 22 bp, Homo sapiens
tgaggccaagaaaagctgggtg

SEQ ID NO: 7228957 - DNA, 22 bp, Homo sapiens
tgaggccaagcctcctctgcca

SEQ ID NO: 7228958 - DNA, 22 bp, Homo sapiens
tgaggccaagcctcctctgcca

SEQ ID NO: 7228959 - DNA, 19 bp, Homo sapiens
tgaggccaaggtcacagat

SEQ ID NO: 7228960 - DNA, 22 bp, Homo sapiens
tgaggccaagcctcctctgcca

SEQ ID NO: 7228961 - DNA, 19 bp, Homo sapiens
tgaggccaaggtcacagat

SEQ ID NO: 7228962 - DNA, 19 bp, Homo sapiens
tgaggccaaggtcacagat

SEQ ID NO: 7228963 - DNA, 19 bp, Homo sapiens
tgaggccaaggtcacagat

SEQ ID NO: 7228964 - DNA, 22 bp, Homo sapiens
tgaggcagttcttacttgtatt

SEQ ID NO: 7228965 - DNA, 22 bp, Homo sapiens
tgaggcagttcttacttgtatt

SEQ ID NO: 7228966 - DNA, 22 bp, Homo sapiens
tgaggcagttcttacttgtatt

SEQ ID NO: 7228967 - DNA, 21 bp, Homo sapiens
tgaggcaggggtgcttttgtc

SEQ ID NO: 7228968 - DNA, 22 bp, Homo sapiens
tgaggcagttcttacttgtatt

SEQ ID NO: 7228969 - DNA, 21 bp, Homo sapiens
tgaggcaggggtgcttttgtc

SEQ ID NO: 7228970 - DNA, 22 bp, Homo sapiens
tgaggcagggagtttaattgtc

SEQ ID NO: 7228971 - DNA, 22 bp, Homo sapiens
tgaggcagggagtttaattgtc

SEQ ID NO: 7228972 - DNA, 22 bp, Homo sapiens
tgaggcagggagtttaattgtc

SEQ ID NO: 7228973 - DNA, 21 bp, Homo sapiens
tgaggcaggggtgcttttgtc

SEQ ID NO: 7228974 - DNA, 22 bp, Homo sapiens
tgaggcagggagagtggatatg

SEQ ID NO: 7228975 - DNA, 22 bp, Homo sapiens
tgaggcagggagagtggatatg

SEQ ID NO: 7228976 - DNA, 22 bp, Homo sapiens
tgaggcagggagagtggatatg

SEQ ID NO: 7228977 - DNA, 22 bp, Homo sapiens
tgaggcagggagagtggatatg

SEQ ID NO: 7228978 - DNA, 22 bp, Homo sapiens
tgaggcagggagtttaattgtc

SEQ ID NO: 7228979 - DNA, 22 bp, Homo sapiens
tgaggcagggagagtggatatg

SEQ ID NO: 7228980 - DNA, 22 bp, Homo sapiens
tgaggcagggagagtggatatg

SEQ ID NO: 7228981 - DNA, 23 bp, Homo sapiens
tgaggcaggcggatcacgaggtc

SEQ ID NO: 7228982 - DNA, 23 bp, Homo sapiens
tgaggcaggcggatcacgaggtc

SEQ ID NO: 7228983 - DNA, 23 bp, Homo sapiens
tgaggcaggcggatcacgaggtc

SEQ ID NO: 7228984 - DNA, 22 bp, Homo sapiens
tgagatgggatgtgcacttggc

SEQ ID NO: 7228985 - DNA, 22 bp, Homo sapiens
tgagatggctgggccccaggag

SEQ ID NO: 7228986 - DNA, 22 bp, Homo sapiens
tgagatggattgggttggttcc

SEQ ID NO: 7228987 - DNA, 22 bp, Homo sapiens
tgagatggcaacaccagctttg

SEQ ID NO: 7228988 - DNA, 22 bp, Homo sapiens
tgagatggagttttggggatat

SEQ ID NO: 7228989 - DNA, 22 bp, Homo sapiens
tgagatgggtcatcaggtttgg

SEQ ID NO: 7228990 - DNA, 22 bp, Homo sapiens
tgagatgggtggggagctcagg

SEQ ID NO: 7228991 - DNA, 22 bp, Homo sapiens
tgagatggggagggctgcagaa

SEQ ID NO: 7228992 - DNA, 22 bp, Homo sapiens
tgagatggggtcatgctttgtc

SEQ ID NO: 7228993 - DNA, 22 bp, Homo sapiens
tgagatgggtgggtagccaagg

SEQ ID NO: 7228994 - DNA, 22 bp, Homo sapiens
tgagatgggtgtccagggagga

SEQ ID NO: 7228995 - DNA, 22 bp, Homo sapiens
tgagatgggtgtccagggagga

SEQ ID NO: 7228996 - DNA, 22 bp, Homo sapiens
tgagatgggtgtccagggagga

SEQ ID NO: 7228997 - DNA, 22 bp, Homo sapiens
tgagatggtgaagaagacagca

SEQ ID NO: 7228998 - DNA, 22 bp, Homo sapiens
tgagatggtgaagaagacagca

SEQ ID NO: 7228999 - DNA, 22 bp, Homo sapiens
tgagatggttcacagagaaggc

SEQ ID NO: 7229000 - DNA, 22 bp, Homo sapiens
tgagatggttcacagagaaggc

SEQ ID NO: 7229001 - DNA, 22 bp, Homo sapiens
tgagatggttcacagagaaggc

SEQ ID NO: 7229002 - DNA, 22 bp, Homo sapiens
tgagatggttgaccagagagca

SEQ ID NO: 7229003 - DNA, 22 bp, Homo sapiens
tgagatggttgaccagagagca

SEQ ID NO: 7229004 - DNA, 22 bp, Homo sapiens
tgagatgtaaggtatgcttact

SEQ ID NO: 7229005 - DNA, 22 bp, Homo sapiens
tgagatgtaaggtatgcttact

SEQ ID NO: 7229006 - DNA, 22 bp, Homo sapiens
tgagatgtaaggtatgcttact

SEQ ID NO: 7229007 - DNA, 22 bp, Homo sapiens
tgagatgtaaggtatgcttact

SEQ ID NO: 7229008 - DNA, 19 bp, Homo sapiens
tgagatttcttaggtgatt

SEQ ID NO: 7229009 - DNA, 22 bp, Homo sapiens
tgagatttcgccgacagtattt

SEQ ID NO: 7229010 - DNA, 22 bp, Homo sapiens
tgagatttggaaaatttgatat

SEQ ID NO: 7229011 - DNA, 22 bp, Homo sapiens
tgagattcagttgattagtgat

SEQ ID NO: 7229012 - DNA, 22 bp, Homo sapiens
tgagatttcgccgacagtattt

SEQ ID NO: 7229013 - DNA, 22 bp, Homo sapiens
tgagattttcagcatcacttca

SEQ ID NO: 7229014 - DNA, 22 bp, Homo sapiens
tgagcaaaagttgatggtgctt

SEQ ID NO: 7229015 - DNA, 22 bp, Homo sapiens
tgagcaaaagttgatggtgctt

SEQ ID NO: 7229016 - DNA, 21 bp, Homo sapiens
tgagcaaaatttagagtgatg

SEQ ID NO: 7229017 - DNA, 21 bp, Homo sapiens
tgagcaaaatttagagtgatg

SEQ ID NO: 7229018 - DNA, 21 bp, Homo sapiens
tgagcaaaatttagagtgatg

SEQ ID NO: 7229019 - DNA, 21 bp, Homo sapiens
tgagcaaaatttagagtgatg

SEQ ID NO: 7229020 - DNA, 22 bp, Homo sapiens
tgagcaaagggatgaatcactg

SEQ ID NO: 7229021 - DNA, 22 bp, Homo sapiens
tgagatgctgctgtaacaaata

SEQ ID NO: 7229022 - DNA, 21 bp, Homo sapiens
tgagatgctagaaggcaggga

SEQ ID NO: 7229023 - DNA, 22 bp, Homo sapiens
tgagatgatgggataagagggc

SEQ ID NO: 7229024 - DNA, 22 bp, Homo sapiens
tgagatgcaggagatgggactg

SEQ ID NO: 7229025 - DNA, 22 bp, Homo sapiens
tgagatgatgggataagagggc

SEQ ID NO: 7229026 - DNA, 22 bp, Homo sapiens
tgagatgaataactcctgctaa

SEQ ID NO: 7229027 - DNA, 22 bp, Homo sapiens
tgagatgagggctgcactcaaa

SEQ ID NO: 7229028 - DNA, 22 bp, Homo sapiens
tgagatgaataactcctgctaa

SEQ ID NO: 7229029 - DNA, 17 bp, Homo sapiens
tgagatggaagaagact

SEQ ID NO: 7229030 - DNA, 17 bp, Homo sapiens
tgagatggaagaagact

SEQ ID NO: 7229031 - DNA, 17 bp, Homo sapiens
tgagatggaagaagact

SEQ ID NO: 7229032 - DNA, 22 bp, Homo sapiens
tgagatggaaggtgaggcagta

SEQ ID NO: 7229033 - DNA, 22 bp, Homo sapiens
tgagatggaaggtgaggcagta

SEQ ID NO: 7229034 - DNA, 22 bp, Homo sapiens
tgagatggaaggtgaggcagta

SEQ ID NO: 7229035 - DNA, 22 bp, Homo sapiens
tgagatggagccactgcactct

SEQ ID NO: 7229036 - DNA, 22 bp, Homo sapiens
tgagatggagtctcactctgtt

SEQ ID NO: 7229037 - DNA, 22 bp, Homo sapiens
tgagatggagtctcgctctgtt

SEQ ID NO: 7229038 - DNA, 22 bp, Homo sapiens
tgagatggagtctcgctctgtt

SEQ ID NO: 7229039 - DNA, 22 bp, Homo sapiens
tgagatggagtcttgctctgtt

SEQ ID NO: 7229040 - DNA, 22 bp, Homo sapiens
tgagatggagttctgctcttgt

SEQ ID NO: 7229041 - DNA, 22 bp, Homo sapiens
tgagatcatttatttacctttc

SEQ ID NO: 7229042 - DNA, 22 bp, Homo sapiens
tgagatcattgacttgttcctg

SEQ ID NO: 7229043 - DNA, 22 bp, Homo sapiens
tgagatccccaggaaggacaac

SEQ ID NO: 7229044 - DNA, 23 bp, Homo sapiens
tgagatcgcccagctggtaggca

SEQ ID NO: 7229045 - DNA, 23 bp, Homo sapiens
tgagatctacagatctcagatct

SEQ ID NO: 7229046 - DNA, 23 bp, Homo sapiens
tgagatctacagatctcagatct

SEQ ID NO: 7229047 - DNA, 22 bp, Homo sapiens
tgagatctctgcctatatggat

SEQ ID NO: 7229048 - DNA, 22 bp, Homo sapiens
tgagatctctgcctatatggat

SEQ ID NO: 7229049 - DNA, 22 bp, Homo sapiens
tgagatctgctaattgactgac

SEQ ID NO: 7229050 - DNA, 22 bp, Homo sapiens
tgagatctgtgcatgttagtta

SEQ ID NO: 7229051 - DNA, 22 bp, Homo sapiens
tgagatctgtgcatgttagtta

SEQ ID NO: 7229052 - DNA, 22 bp, Homo sapiens
tgagatcttcgctcttcacaga

SEQ ID NO: 7229053 - DNA, 22 bp, Homo sapiens
tgagatcttcgctcttcacaga

SEQ ID NO: 7229054 - DNA, 22 bp, Homo sapiens
tgagatcttcgctcttcacaga

SEQ ID NO: 7229055 - DNA, 23 bp, Homo sapiens
tgagatctttgtagtatcaatga

SEQ ID NO: 7229056 - DNA, 23 bp, Homo sapiens
tgagatctttgtagtatcaatga

SEQ ID NO: 7229057 - DNA, 22 bp, Homo sapiens
tgagatgaagtgatgtaaaaca

SEQ ID NO: 7229058 - DNA, 22 bp, Homo sapiens
tgagataattaaatcaaaacct

SEQ ID NO: 7229059 - DNA, 22 bp, Homo sapiens
tgagatatctgttaattttctt

SEQ ID NO: 7229060 - DNA, 22 bp, Homo sapiens
tgagatagtatgtagcacctga

SEQ ID NO: 7229061 - DNA, 22 bp, Homo sapiens
tgagatcattgacttgttcctg

SEQ ID NO: 7229062 - DNA, 22 bp, Homo sapiens
tgagagaaacgttccttacatc

SEQ ID NO: 7229063 - DNA, 22 bp, Homo sapiens
tgagagacacactgtgcatgta

SEQ ID NO: 7229064 - DNA, 18 bp, Homo sapiens
tgagagaatgttcatgct

SEQ ID NO: 7229065 - DNA, 21 bp, Homo sapiens
tgagagactggtggatacagg

SEQ ID NO: 7229066 - DNA, 22 bp, Homo sapiens
tgagagagcctgaatctcttac

SEQ ID NO: 7229067 - DNA, 22 bp, Homo sapiens
tgagagagcgcctgggatcatt

SEQ ID NO: 7229068 - DNA, 22 bp, Homo sapiens
tgagagagcgcctgggatcatt

SEQ ID NO: 7229069 - DNA, 22 bp, Homo sapiens
tgagagagcgcctgggatcatt

SEQ ID NO: 7229070 - DNA, 22 bp, Homo sapiens
tgagagagtaattgagtggtaa

SEQ ID NO: 7229071 - DNA, 22 bp, Homo sapiens
tgagagagtaattgagtggtaa

SEQ ID NO: 7229072 - DNA, 22 bp, Homo sapiens
tgagagagtaattgagtggtaa

SEQ ID NO: 7229073 - DNA, 22 bp, Homo sapiens
tgagagagtaattgagtggtaa

SEQ ID NO: 7229074 - DNA, 22 bp, Homo sapiens
tgagagagcgcctgggatcatt

SEQ ID NO: 7229075 - DNA, 22 bp, Homo sapiens
tgagagagcgcctgggatcatt

SEQ ID NO: 7229076 - DNA, 22 bp, Homo sapiens
tgagagaggatgccctcatatt

SEQ ID NO: 7229077 - DNA, 22 bp, Homo sapiens
tgagagagggatgcaccctcct

SEQ ID NO: 7229078 - DNA, 22 bp, Homo sapiens
tgagagaggggactgcctgctt

SEQ ID NO: 7229079 - DNA, 22 bp, Homo sapiens
tgagagaggggactgcctgctt

SEQ ID NO: 7229080 - DNA, 21 bp, Homo sapiens
tgagagagtagcaggacatat

SEQ ID NO: 7229081 - DNA, 21 bp, Homo sapiens
tgagagagtagcaggacatat

SEQ ID NO: 7229082 - DNA, 21 bp, Homo sapiens
tgagagagtagcaggacatat

SEQ ID NO: 7229083 - DNA, 21 bp, Homo sapiens
tgagagagtagcaggacatat

SEQ ID NO: 7229084 - DNA, 21 bp, Homo sapiens
tgagagagtagcaggacatat

SEQ ID NO: 7229085 - DNA, 22 bp, Homo sapiens
tgagagatgaactctgatatgt

SEQ ID NO: 7229086 - DNA, 22 bp, Homo sapiens
tgagagattttcatgagtgctt

SEQ ID NO: 7229087 - DNA, 22 bp, Homo sapiens
tgagagcaacacgcagtagtat

SEQ ID NO: 7229088 - DNA, 22 bp, Homo sapiens
tgagagcaacacgcagtagtat

SEQ ID NO: 7229089 - DNA, 22 bp, Homo sapiens
tgagagatgaactctgatatgt

SEQ ID NO: 7229090 - DNA, 22 bp, Homo sapiens
tgagagatgaagttagttgttc

SEQ ID NO: 7229091 - DNA, 22 bp, Homo sapiens
tgagagatgaagttagttgttc

SEQ ID NO: 7229092 - DNA, 22 bp, Homo sapiens
tgagagattgctgtatgttttg

SEQ ID NO: 7229093 - DNA, 22 bp, Homo sapiens
tgagagcctgtgttcaaatgcc

SEQ ID NO: 7229094 - DNA, 22 bp, Homo sapiens
tgagagcacacagaaatatttt

SEQ ID NO: 7229095 - DNA, 22 bp, Homo sapiens
tgagagcacagtgtggtctgga

SEQ ID NO: 7229096 - DNA, 22 bp, Homo sapiens
tgagagcagaggtgggcagcct

SEQ ID NO: 7229097 - DNA, 17 bp, Homo sapiens
tgagagcagggctgggc

SEQ ID NO: 7229098 - DNA, 17 bp, Homo sapiens
tgagagcagggctgggc

SEQ ID NO: 7229099 - DNA, 22 bp, Homo sapiens
tgagaggatattttgggaggat

SEQ ID NO: 7229100 - DNA, 20 bp, Homo sapiens
tgagaggacatttttcatgt

SEQ ID NO: 7229101 - DNA, 22 bp, Homo sapiens
tgagaggatattttgggaggat

SEQ ID NO: 7229102 - DNA, 22 bp, Homo sapiens
tgagaggcagaatggtgcctgc

SEQ ID NO: 7229103 - DNA, 22 bp, Homo sapiens
tgagaggcagaatggtgcctgc

SEQ ID NO: 7229104 - DNA, 22 bp, Homo sapiens
tgagaggagtgattgtaaaatt

SEQ ID NO: 7229105 - DNA, 22 bp, Homo sapiens
tgagaggaacaggcagtaggtt

SEQ ID NO: 7229106 - DNA, 22 bp, Homo sapiens
tgagaggaacaggcagtaggtt

SEQ ID NO: 7229107 - DNA, 22 bp, Homo sapiens
tgagaggaacaggcagtaggtt

SEQ ID NO: 7229108 - DNA, 22 bp, Homo sapiens
tgagaggaacaggcagtaggtt

SEQ ID NO: 7229109 - DNA, 22 bp, Homo sapiens
tgagagctgaagatatgttaac

SEQ ID NO: 7229110 - DNA, 22 bp, Homo sapiens
tgagagctgccacgtgaccatg

SEQ ID NO: 7229111 - DNA, 22 bp, Homo sapiens
tgagagctgctgagactgtcct

SEQ ID NO: 7229112 - DNA, 20 bp, Homo sapiens
tgagagctgggcagggatac

SEQ ID NO: 7229113 - DNA, 22 bp, Homo sapiens
tgagagctgtccacctgtggga

SEQ ID NO: 7229114 - DNA, 22 bp, Homo sapiens
tgagagcttgagtatcactggc

SEQ ID NO: 7229115 - DNA, 22 bp, Homo sapiens
tgagaggaacaggcagtaggtt

SEQ ID NO: 7229116 - DNA, 22 bp, Homo sapiens
tgagaggaacaggcagtaggtt

SEQ ID NO: 7229117 - DNA, 22 bp, Homo sapiens
tgagaggtaggaaatgaacaag

SEQ ID NO: 7229118 - DNA, 22 bp, Homo sapiens
tgagaggtaggaaatgaacaag

SEQ ID NO: 7229119 - DNA, 22 bp, Homo sapiens
tgagagggttcccaggggtttc

SEQ ID NO: 7229120 - DNA, 22 bp, Homo sapiens
tgagaggtaggaaatgaacaag

SEQ ID NO: 7229121 - DNA, 22 bp, Homo sapiens
tgagagggcccagagcacacca

SEQ ID NO: 7229122 - DNA, 22 bp, Homo sapiens
tgagagggcccagagcacacca

SEQ ID NO: 7229123 - DNA, 19 bp, Homo sapiens
tgagaggcttaaggcagct

SEQ ID NO: 7229124 - DNA, 19 bp, Homo sapiens
tgagaggcttaaggcagct

SEQ ID NO: 7229125 - DNA, 22 bp, Homo sapiens
tgagagggcccagagcacacca

SEQ ID NO: 7229126 - DNA, 22 bp, Homo sapiens
tgagagggcccagagcacacca

SEQ ID NO: 7229127 - DNA, 22 bp, Homo sapiens
tgagagggcccagagcacacca

SEQ ID NO: 7229128 - DNA, 18 bp, Homo sapiens
tgagaggctattttttgc

SEQ ID NO: 7229129 - DNA, 18 bp, Homo sapiens
tgagaggctattttttgc

SEQ ID NO: 7229130 - DNA, 22 bp, Homo sapiens
tgagaggctagatcagctctgt

SEQ ID NO: 7229131 - DNA, 18 bp, Homo sapiens
tgagaggctattttttgc

SEQ ID NO: 7229132 - DNA, 18 bp, Homo sapiens
tgagaggcaggtagagga

SEQ ID NO: 7229133 - DNA, 22 bp, Homo sapiens
tgagaggccccagctcttggcc

SEQ ID NO: 7229134 - DNA, 22 bp, Homo sapiens
tgagaggcgctcactctcaggt

SEQ ID NO: 7229135 - DNA, 22 bp, Homo sapiens
tgagaggcgctcactctcaggt

SEQ ID NO: 7229136 - DNA, 22 bp, Homo sapiens
tgagacagtcaccaggcaggcc

SEQ ID NO: 7229137 - DNA, 22 bp, Homo sapiens
tgagacagttctgcagctgggt

SEQ ID NO: 7229138 - DNA, 22 bp, Homo sapiens
tgagacagtcaccaggcaggcc

SEQ ID NO: 7229139 - DNA, 22 bp, Homo sapiens
tgagacagtcaccaggcaggcc

SEQ ID NO: 7229140 - DNA, 22 bp, Homo sapiens
tgagacagggtcttgctctgtt

SEQ ID NO: 7229141 - DNA, 22 bp, Homo sapiens
tgagacagtaattgtatagttt

SEQ ID NO: 7229142 - DNA, 17 bp, Homo sapiens
tgagacagggcaggccc

SEQ ID NO: 7229143 - DNA, 22 bp, Homo sapiens
tgagacagggtcttgctctgtt

SEQ ID NO: 7229144 - DNA, 17 bp, Homo sapiens
tgagacagggcaggccc

SEQ ID NO: 7229145 - DNA, 17 bp, Homo sapiens
tgagacagggcaggccc

SEQ ID NO: 7229146 - DNA, 17 bp, Homo sapiens
tgagacagggcaggccc

SEQ ID NO: 7229147 - DNA, 22 bp, Homo sapiens
tgagacagcctctgcactcatg

SEQ ID NO: 7229148 - DNA, 22 bp, Homo sapiens
tgagacagcccttctgcacagg

SEQ ID NO: 7229149 - DNA, 22 bp, Homo sapiens
tgagacagcagtcagggaaata

SEQ ID NO: 7229150 - DNA, 22 bp, Homo sapiens
tgagacagcccttctgcacagg

SEQ ID NO: 7229151 - DNA, 22 bp, Homo sapiens
tgagacagcagtcagggaaata

SEQ ID NO: 7229152 - DNA, 22 bp, Homo sapiens
tgagacagcccttctgcacagg

SEQ ID NO: 7229153 - DNA, 19 bp, Homo sapiens
tgagacagggattcaggtg

SEQ ID NO: 7229154 - DNA, 19 bp, Homo sapiens
tgagacagggattcaggtg

SEQ ID NO: 7229155 - DNA, 19 bp, Homo sapiens
tgagacagggattcaggtg

SEQ ID NO: 7229156 - DNA, 22 bp, Homo sapiens
tgagaattttttgtcatgcatt

SEQ ID NO: 7229157 - DNA, 22 bp, Homo sapiens
tgagacaaaattgacagacaaa

SEQ ID NO: 7229158 - DNA, 22 bp, Homo sapiens
tgagaattttcagtttcacttt

SEQ ID NO: 7229159 - DNA, 22 bp, Homo sapiens
tgagaatttttggcagaaacaa

SEQ ID NO: 7229160 - DNA, 22 bp, Homo sapiens
tgagaatttttggcagaaacaa

SEQ ID NO: 7229161 - DNA, 22 bp, Homo sapiens
tgagaattttcagtttcacttt

SEQ ID NO: 7229162 - DNA, 22 bp, Homo sapiens
tgagaatttgcatttctaacaa

SEQ ID NO: 7229163 - DNA, 22 bp, Homo sapiens
tgagaattacaaatgagtcaca

SEQ ID NO: 7229164 - DNA, 18 bp, Homo sapiens
tgagaatgtaagaaatgg

SEQ ID NO: 7229165 - DNA, 22 bp, Homo sapiens
tgagaagctgcttgtgctgtat

SEQ ID NO: 7229166 - DNA, 22 bp, Homo sapiens
tgagaagctgctgacttagcct

SEQ ID NO: 7229167 - DNA, 22 bp, Homo sapiens
tgagaagctgcttgtgctgtat

SEQ ID NO: 7229168 - DNA, 22 bp, Homo sapiens
tgagaaggaaacaatggctttt

SEQ ID NO: 7229169 - DNA, 22 bp, Homo sapiens
tgagaagctgctgacttagcct

SEQ ID NO: 7229170 - DNA, 22 bp, Homo sapiens
tgagaagctgctgacttagcct

SEQ ID NO: 7229171 - DNA, 22 bp, Homo sapiens
tgagaagctctgaaacagtatc

SEQ ID NO: 7229172 - DNA, 20 bp, Homo sapiens
tgagaagctcctgtctcctc

SEQ ID NO: 7229173 - DNA, 19 bp, Homo sapiens
tgagacagaagatgagcct

SEQ ID NO: 7229174 - DNA, 23 bp, Homo sapiens
tgagacactcattcatggagtat

SEQ ID NO: 7229175 - DNA, 22 bp, Homo sapiens
tgagacagcagtcagggaaata

SEQ ID NO: 7229176 - DNA, 23 bp, Homo sapiens
tgagacactcattcatggagtat

SEQ ID NO: 7229177 - DNA, 22 bp, Homo sapiens
tgagacaataaggctgagaagc

SEQ ID NO: 7229178 - DNA, 20 bp, Homo sapiens
tgagacaaggctggagagac

SEQ ID NO: 7229179 - DNA, 22 bp, Homo sapiens
tgagacaaagcagctgacagaa

SEQ ID NO: 7229180 - DNA, 22 bp, Homo sapiens
tgagacaacagcttgtgctgct

SEQ ID NO: 7229181 - DNA, 22 bp, Homo sapiens
tgagacaaggaaaggaagctga

SEQ ID NO: 7229182 - DNA, 20 bp, Homo sapiens
tgagacaaggctggagagac

SEQ ID NO: 7229183 - DNA, 23 bp, Homo sapiens
tgagaagccgccgggcagcctgg

SEQ ID NO: 7229184 - DNA, 22 bp, Homo sapiens
tgagaagcccaagccgggtggt

SEQ ID NO: 7229185 - DNA, 23 bp, Homo sapiens
tgagaagccattagagcaggtgg

SEQ ID NO: 7229186 - DNA, 23 bp, Homo sapiens
tgagaagccattagagcaggtgg

SEQ ID NO: 7229187 - DNA, 23 bp, Homo sapiens
tgagaagccaggggagcgtgagg

SEQ ID NO: 7229188 - DNA, 23 bp, Homo sapiens
tgagaagccaggggagcgtgagg

SEQ ID NO: 7229189 - DNA, 22 bp, Homo sapiens
tgagaagcagtttcagtaagaa

SEQ ID NO: 7229190 - DNA, 22 bp, Homo sapiens
tgagaagcagtttcagtaagaa

SEQ ID NO: 7229191 - DNA, 22 bp, Homo sapiens
tgagaagcagtttcagtaagaa

SEQ ID NO: 7229192 - DNA, 22 bp, Homo sapiens
tgagaagcagtttcagtaagaa

SEQ ID NO: 7229193 - DNA, 22 bp, Homo sapiens
tgagaagcagcttacaggtgtc

SEQ ID NO: 7229194 - DNA, 22 bp, Homo sapiens
tgagaagcagcttacaggtgtc

SEQ ID NO: 7229195 - DNA, 22 bp, Homo sapiens
tgagaagcagcttacaggtgtc

SEQ ID NO: 7229196 - DNA, 22 bp, Homo sapiens
tgagaagcacagctcactcacg

SEQ ID NO: 7229197 - DNA, 22 bp, Homo sapiens
tgagaagattgggcagagtgga

SEQ ID NO: 7229198 - DNA, 22 bp, Homo sapiens
tgagaagattgggcagagtgga

SEQ ID NO: 7229199 - DNA, 22 bp, Homo sapiens
tgagaagagcaaggaactggtt

SEQ ID NO: 7229200 - DNA, 22 bp, Homo sapiens
tgagaagattgggcagagtgga

SEQ ID NO: 7229201 - DNA, 22 bp, Homo sapiens
tgagaagagcaaggaactggtt

SEQ ID NO: 7229202 - DNA, 22 bp, Homo sapiens
tgagaactggtagcacttgtga

SEQ ID NO: 7229203 - DNA, 22 bp, Homo sapiens
tgagaacatttgcagggagagt

SEQ ID NO: 7229204 - DNA, 22 bp, Homo sapiens
tgagaaccacctggaggtgact

SEQ ID NO: 7229205 - DNA, 23 bp, Homo sapiens
tgagaaattttgattcagtagga

SEQ ID NO: 7229206 - DNA, 22 bp, Homo sapiens
tgagaacaaagttgaaagtttg

SEQ ID NO: 7229207 - DNA, 22 bp, Homo sapiens
tgagaacaatgagtcaggggct

SEQ ID NO: 7229208 - DNA, 22 bp, Homo sapiens
tgagaacacattcgtgccctac

SEQ ID NO: 7229209 - DNA, 22 bp, Homo sapiens
tgagaacagttggaagcagtca

SEQ ID NO: 7229210 - DNA, 22 bp, Homo sapiens
tgagaacagttggaagcagtca

SEQ ID NO: 7229211 - DNA, 22 bp, Homo sapiens
tgagaacagttggaagcagtca

SEQ ID NO: 7229212 - DNA, 22 bp, Homo sapiens
tgagaacagttggaagcagtca

SEQ ID NO: 7229213 - DNA, 22 bp, Homo sapiens
tgagaacatacaaacagagaaa

SEQ ID NO: 7229214 - DNA, 22 bp, Homo sapiens
tgagaacatacaaacagagaaa

SEQ ID NO: 7229215 - DNA, 22 bp, Homo sapiens
tgagaacatacaaacagagaaa

SEQ ID NO: 7229216 - DNA, 22 bp, Homo sapiens
tgagaacatacaaacagagaaa

SEQ ID NO: 7229217 - DNA, 22 bp, Homo sapiens
tgagaacatacaaacagagaaa

SEQ ID NO: 7229218 - DNA, 22 bp, Homo sapiens
tgagaacattgggaaagctatg

SEQ ID NO: 7229219 - DNA, 22 bp, Homo sapiens
tgagaacattgggaaagctatg

SEQ ID NO: 7229220 - DNA, 22 bp, Homo sapiens
tgagaacattgggaaagctatg

SEQ ID NO: 7229221 - DNA, 22 bp, Homo sapiens
tgagaacatttgcagggagagt

SEQ ID NO: 7229222 - DNA, 22 bp, Homo sapiens
tgagaacatttgcagggagagt

SEQ ID NO: 7229223 - DNA, 22 bp, Homo sapiens
tgagaacatttgcagggagagt

SEQ ID NO: 7229224 - DNA, 22 bp, Homo sapiens
tgagaaagtgggtgcctagcaa

SEQ ID NO: 7229225 - DNA, 22 bp, Homo sapiens
tgagaaagtgggtgcctagcaa

SEQ ID NO: 7229226 - DNA, 20 bp, Homo sapiens
tgagaaagtagagactcagg

SEQ ID NO: 7229227 - DNA, 22 bp, Homo sapiens
tgagaaatattgcacagtgagg

SEQ ID NO: 7229228 - DNA, 22 bp, Homo sapiens
tgagaaatattgcacagtgagg

SEQ ID NO: 7229229 - DNA, 22 bp, Homo sapiens
tgagaaatattgcacagtgagg

SEQ ID NO: 7229230 - DNA, 22 bp, Homo sapiens
tgagaaatccagatgtgcagtt

SEQ ID NO: 7229231 - DNA, 22 bp, Homo sapiens
tgagaaatccagatgtgcagtt

SEQ ID NO: 7229232 - DNA, 22 bp, Homo sapiens
tgagaaaggtatttcatgcact

SEQ ID NO: 7229233 - DNA, 22 bp, Homo sapiens
tgagaaaggtatttcatgcact

SEQ ID NO: 7229234 - DNA, 22 bp, Homo sapiens
tgagaaatccagatgtgcagtt

SEQ ID NO: 7229235 - DNA, 22 bp, Homo sapiens
tgagaaatggcagcattactgg

SEQ ID NO: 7229236 - DNA, 22 bp, Homo sapiens
tgagaaatggcagcattactgg

SEQ ID NO: 7229237 - DNA, 22 bp, Homo sapiens
tgagaaatgggtctgctgaaga

SEQ ID NO: 7229238 - DNA, 22 bp, Homo sapiens
tgagaaattacttcagtgatgg

SEQ ID NO: 7229239 - DNA, 22 bp, Homo sapiens
tgagaaattacttcagtgatgg

SEQ ID NO: 7229240 - DNA, 22 bp, Homo sapiens
tgagaaattacttcagtgatgg

SEQ ID NO: 7229241 - DNA, 19 bp, Homo sapiens
tgagaaattccacaggatg

SEQ ID NO: 7229242 - DNA, 22 bp, Homo sapiens
tgagaaattcgacatatattta

SEQ ID NO: 7229243 - DNA, 22 bp, Homo sapiens
tgagaaattcgacatatattta

SEQ ID NO: 7229244 - DNA, 23 bp, Homo sapiens
tgagaaattttgattcagtagga

SEQ ID NO: 7229245 - DNA, 22 bp, Homo sapiens
tgagaaaattactataattgtc

SEQ ID NO: 7229246 - DNA, 22 bp, Homo sapiens
tgagaaaatccagaggctagtt

SEQ ID NO: 7229247 - DNA, 22 bp, Homo sapiens
tgagaaaatccagaggctagtt

SEQ ID NO: 7229248 - DNA, 22 bp, Homo sapiens
tgagaaaattactataattgtc

SEQ ID NO: 7229249 - DNA, 22 bp, Homo sapiens
tgagaaaattactataattgtc

SEQ ID NO: 7229250 - DNA, 22 bp, Homo sapiens
tgagaaaattactataattgtc

SEQ ID NO: 7229251 - DNA, 22 bp, Homo sapiens
tgagaaaagtgtggaggtcaat

SEQ ID NO: 7229252 - DNA, 22 bp, Homo sapiens
tgagaaaagtgtggaggtcaat

SEQ ID NO: 7229253 - DNA, 22 bp, Homo sapiens
tgagaaaagtgtggaggtcaat

SEQ ID NO: 7229254 - DNA, 22 bp, Homo sapiens
tgagaaaagtgtggaggtcaat

SEQ ID NO: 7229255 - DNA, 22 bp, Homo sapiens
tgagaaaagtgtggaggtcaat

SEQ ID NO: 7229256 - DNA, 22 bp, Homo sapiens
tgagaaaatccagaggctagtt

SEQ ID NO: 7229257 - DNA, 22 bp, Homo sapiens
tgagaaaatccagaggctagtt

SEQ ID NO: 7229258 - DNA, 22 bp, Homo sapiens
tgagaaaatccagaggctagtt

SEQ ID NO: 7229259 - DNA, 22 bp, Homo sapiens
tgagaaacacaggcatgaatag

SEQ ID NO: 7229260 - DNA, 22 bp, Homo sapiens
tgagaaacacaggcatgaatag

SEQ ID NO: 7229261 - DNA, 22 bp, Homo sapiens
tgagaaacacaggcatgaatag

SEQ ID NO: 7229262 - DNA, 22 bp, Homo sapiens
tgagaaacatatgagagatttg

SEQ ID NO: 7229263 - DNA, 18 bp, Homo sapiens
tgagaaactgacacatgg

SEQ ID NO: 7229264 - DNA, 22 bp, Homo sapiens
tgagaaacttgccaagcatctc

SEQ ID NO: 7229265 - DNA, 22 bp, Homo sapiens
tgagaaacttgccaagcatctc

SEQ ID NO: 7229266 - DNA, 22 bp, Homo sapiens
tgagaaagacagacattcctaa

SEQ ID NO: 7229267 - DNA, 22 bp, Homo sapiens
tgagaaagcctttagtcccagg

SEQ ID NO: 7229268 - DNA, 22 bp, Homo sapiens
tgagaaagcctttagtcccagg

SEQ ID NO: 7229269 - DNA, 22 bp, Homo sapiens
tgagaaagcctttagtcccagg

SEQ ID NO: 7229270 - DNA, 22 bp, Homo sapiens
tgagaaagcctttagtcccagg

SEQ ID NO: 7229271 - DNA, 22 bp, Homo sapiens
tgagaaaggtatttcatgcact

SEQ ID NO: 7229272 - DNA, 22 bp, Homo sapiens
tgagaaaggtatttcatgcact

SEQ ID NO: 7229273 - DNA, 21 bp, Homo sapiens
tgagccaggctgacggctgtg

SEQ ID NO: 7229274 - DNA, 21 bp, Homo sapiens
tgagccaggctgacggctgtg

SEQ ID NO: 7229275 - DNA, 22 bp, Homo sapiens
tgagccaggctccatgccacct

SEQ ID NO: 7229276 - DNA, 22 bp, Homo sapiens
tgagccaggctcaagtgatcct

SEQ ID NO: 7229277 - DNA, 22 bp, Homo sapiens
tgagccaggctccatgccacct

SEQ ID NO: 7229278 - DNA, 21 bp, Homo sapiens
tgagccaggctgacggctgtg

SEQ ID NO: 7229279 - DNA, 22 bp, Homo sapiens
tgagccagggtttccggctgct

SEQ ID NO: 7229280 - DNA, 22 bp, Homo sapiens
tgagccagggtttccggctgct

SEQ ID NO: 7229281 - DNA, 19 bp, Homo sapiens
tgagccagggaggccatgc

SEQ ID NO: 7229282 - DNA, 19 bp, Homo sapiens
tgagccagggaggccatgc

SEQ ID NO: 7229283 - DNA, 19 bp, Homo sapiens
tgagccagggaggccatgc

SEQ ID NO: 7229284 - DNA, 19 bp, Homo sapiens
tgagccagggaggccatgc

SEQ ID NO: 7229285 - DNA, 19 bp, Homo sapiens
tgagccagggaggccatgc

SEQ ID NO: 7229286 - DNA, 21 bp, Homo sapiens
tgagccaggctgacggctgtg

SEQ ID NO: 7229287 - DNA, 22 bp, Homo sapiens
tgagccaggcccagtggggtca

SEQ ID NO: 7229288 - DNA, 22 bp, Homo sapiens
tgagccaggcccagtggggtca

SEQ ID NO: 7229289 - DNA, 20 bp, Homo sapiens
tgagccaggctaggaagggc

SEQ ID NO: 7229290 - DNA, 20 bp, Homo sapiens
tgagccaggctaggaagggc

SEQ ID NO: 7229291 - DNA, 20 bp, Homo sapiens
tgagccaggctaggaagggc

SEQ ID NO: 7229292 - DNA, 22 bp, Homo sapiens
tgagccaggcccagtggggtca

SEQ ID NO: 7229293 - DNA, 20 bp, Homo sapiens
tgagccaggctaggaagggc

SEQ ID NO: 7229294 - DNA, 22 bp, Homo sapiens
tgagccaggctcaagtgatcct

SEQ ID NO: 7229295 - DNA, 22 bp, Homo sapiens
tgagccaggctcaagtgatcct

SEQ ID NO: 7229296 - DNA, 20 bp, Homo sapiens
tgagccaggctaggaagggc

SEQ ID NO: 7229297 - DNA, 22 bp, Homo sapiens
tgagccaggctccatgccacct

SEQ ID NO: 7229298 - DNA, 22 bp, Homo sapiens
tgagccaggctccatgccacct

SEQ ID NO: 7229299 - DNA, 22 bp, Homo sapiens
tgagccaggctcaagtgatcct

SEQ ID NO: 7229300 - DNA, 22 bp, Homo sapiens
tgagccaggagtttgaggctgt

SEQ ID NO: 7229301 - DNA, 22 bp, Homo sapiens
tgagccaggagtttgaggctgt

SEQ ID NO: 7229302 - DNA, 22 bp, Homo sapiens
tgagccagctccttgcctgtca

SEQ ID NO: 7229303 - DNA, 22 bp, Homo sapiens
tgagccagctccttgcctgtca

SEQ ID NO: 7229304 - DNA, 22 bp, Homo sapiens
tgagccaggagtttgaggctgt

SEQ ID NO: 7229305 - DNA, 22 bp, Homo sapiens
tgagccaggagtttgaggctgt

SEQ ID NO: 7229306 - DNA, 22 bp, Homo sapiens
tgagccaggagtttgaggctgt

SEQ ID NO: 7229307 - DNA, 22 bp, Homo sapiens
tgagccaggagtttgaggctgt

SEQ ID NO: 7229308 - DNA, 22 bp, Homo sapiens
tgagccaggcactgctcctgga

SEQ ID NO: 7229309 - DNA, 22 bp, Homo sapiens
tgagccaggagtttgaggctgt

SEQ ID NO: 7229310 - DNA, 22 bp, Homo sapiens
tgagccaggcactgctcctgga

SEQ ID NO: 7229311 - DNA, 22 bp, Homo sapiens
tgagccaggcactgctcctgga

SEQ ID NO: 7229312 - DNA, 22 bp, Homo sapiens
tgagccaggcactgctcctgga

SEQ ID NO: 7229313 - DNA, 22 bp, Homo sapiens
tgagccaggcactgctcctgga

SEQ ID NO: 7229314 - DNA, 22 bp, Homo sapiens
tgagccagcaggcctccagtgg

SEQ ID NO: 7229315 - DNA, 22 bp, Homo sapiens
tgagccagataagggctcacgc

SEQ ID NO: 7229316 - DNA, 22 bp, Homo sapiens
tgagccagcctcagaagtcacg

SEQ ID NO: 7229317 - DNA, 22 bp, Homo sapiens
tgagccagcctcagaagtcacg

SEQ ID NO: 7229318 - DNA, 22 bp, Homo sapiens
tgagccagcctcagaagtcacg

SEQ ID NO: 7229319 - DNA, 22 bp, Homo sapiens
tgagccagcctcagaagtcacg

SEQ ID NO: 7229320 - DNA, 22 bp, Homo sapiens
tgagccagcctcagaagtcacg

SEQ ID NO: 7229321 - DNA, 22 bp, Homo sapiens
tgagccagccttgcagctgtgc

SEQ ID NO: 7229322 - DNA, 22 bp, Homo sapiens
tgagccagccttgcagctgtgc

SEQ ID NO: 7229323 - DNA, 22 bp, Homo sapiens
tgagccagccttgcagctgtgc

SEQ ID NO: 7229324 - DNA, 22 bp, Homo sapiens
tgagccagaggaggctgtgtgg

SEQ ID NO: 7229325 - DNA, 22 bp, Homo sapiens
tgagccagaggaggctgtgtgg

SEQ ID NO: 7229326 - DNA, 22 bp, Homo sapiens
tgagccagagaggttgaggcta

SEQ ID NO: 7229327 - DNA, 22 bp, Homo sapiens
tgagccagagtggagtgtgcct

SEQ ID NO: 7229328 - DNA, 22 bp, Homo sapiens
tgagccagagtggagtgtgcct

SEQ ID NO: 7229329 - DNA, 22 bp, Homo sapiens
tgagccagagtggagtgtgcct

SEQ ID NO: 7229330 - DNA, 22 bp, Homo sapiens
tgagccagagtggagtgtgcct

SEQ ID NO: 7229331 - DNA, 22 bp, Homo sapiens
tgagccagagtggagtgtgcct

SEQ ID NO: 7229332 - DNA, 22 bp, Homo sapiens
tgagccagataagggctcacgc

SEQ ID NO: 7229333 - DNA, 22 bp, Homo sapiens
tgagccagataagggctcacgc

SEQ ID NO: 7229334 - DNA, 22 bp, Homo sapiens
tgagccagataagggctcacgc

SEQ ID NO: 7229335 - DNA, 22 bp, Homo sapiens
tgagccagagaggttgaggcta

SEQ ID NO: 7229336 - DNA, 22 bp, Homo sapiens
tgagccagagaggttgaggcta

SEQ ID NO: 7229337 - DNA, 22 bp, Homo sapiens
tgagccagagaggttgaggcta

SEQ ID NO: 7229338 - DNA, 22 bp, Homo sapiens
tgagccagagaggttgaggcta

SEQ ID NO: 7229339 - DNA, 22 bp, Homo sapiens
tgagccagagaggttgaggcta

SEQ ID NO: 7229340 - DNA, 22 bp, Homo sapiens
tgagccaagttcacaccattgc

SEQ ID NO: 7229341 - DNA, 22 bp, Homo sapiens
tgagcatggtgggtgcagagca

SEQ ID NO: 7229342 - DNA, 22 bp, Homo sapiens
tgagcagggagctgggctgagc

SEQ ID NO: 7229343 - DNA, 22 bp, Homo sapiens
tgagcagggagctgggctgagc

SEQ ID NO: 7229344 - DNA, 22 bp, Homo sapiens
tgagcagggactttggagtctg

SEQ ID NO: 7229345 - DNA, 22 bp, Homo sapiens
tgagcagggactttggagtctg

SEQ ID NO: 7229346 - DNA, 22 bp, Homo sapiens
tgagcagggagctgggctgagc

SEQ ID NO: 7229347 - DNA, 22 bp, Homo sapiens
tgagcagggagctgggctgagc

SEQ ID NO: 7229348 - DNA, 22 bp, Homo sapiens
tgagcagggagctgggctgagc

SEQ ID NO: 7229349 - DNA, 22 bp, Homo sapiens
tgagcagggactttggagtctg

SEQ ID NO: 7229350 - DNA, 22 bp, Homo sapiens
tgagcagggactttggagtctg

SEQ ID NO: 7229351 - DNA, 22 bp, Homo sapiens
tgagcagggactttggagtctg

SEQ ID NO: 7229352 - DNA, 22 bp, Homo sapiens
tgagcagggactttggagtctg

SEQ ID NO: 7229353 - DNA, 22 bp, Homo sapiens
tgagcagggactttggagtctg

SEQ ID NO: 7229354 - DNA, 22 bp, Homo sapiens
tgagcagggactttggagtctg

SEQ ID NO: 7229355 - DNA, 19 bp, Homo sapiens
tgagcatgcgagctgagaa

SEQ ID NO: 7229356 - DNA, 22 bp, Homo sapiens
tgagcatagccttcagtagcag

SEQ ID NO: 7229357 - DNA, 22 bp, Homo sapiens
tgagcatctactatgaactggg

SEQ ID NO: 7229358 - DNA, 22 bp, Homo sapiens
tgagcatggtgggtgcagagca

SEQ ID NO: 7229359 - DNA, 22 bp, Homo sapiens
tgagcatggtgggtgcagagca

SEQ ID NO: 7229360 - DNA, 22 bp, Homo sapiens
tgagcagggagctgggctgagc

SEQ ID NO: 7229361 - DNA, 22 bp, Homo sapiens
tgagcatagcccttctagtgtt

SEQ ID NO: 7229362 - DNA, 22 bp, Homo sapiens
tgagcacactcctggtgagcga

SEQ ID NO: 7229363 - DNA, 22 bp, Homo sapiens
tgagcacagctcgcaccagctt

SEQ ID NO: 7229364 - DNA, 22 bp, Homo sapiens
tgagcaattaacagagtctaaa

SEQ ID NO: 7229365 - DNA, 19 bp, Homo sapiens
tgagcacacctgtacaccc

SEQ ID NO: 7229366 - DNA, 22 bp, Homo sapiens
tgagcacagctttcactagaaa

SEQ ID NO: 7229367 - DNA, 22 bp, Homo sapiens
tgagcacagctttcactagaaa

SEQ ID NO: 7229368 - DNA, 22 bp, Homo sapiens
tgagcacagctcgcaccagctt

SEQ ID NO: 7229369 - DNA, 22 bp, Homo sapiens
tgagcacagctttcactagaaa

SEQ ID NO: 7229370 - DNA, 22 bp, Homo sapiens
tgagcaagacccggcctctgcc

SEQ ID NO: 7229371 - DNA, 22 bp, Homo sapiens
tgagcaagacccggcctctgcc

SEQ ID NO: 7229372 - DNA, 22 bp, Homo sapiens
tgagcaactgtgctctgctaaa

SEQ ID NO: 7229373 - DNA, 22 bp, Homo sapiens
tgagcaagacccggcctctgcc

SEQ ID NO: 7229374 - DNA, 22 bp, Homo sapiens
tgagcaagagaaactgactgta

SEQ ID NO: 7229375 - DNA, 22 bp, Homo sapiens
tgagcaagagaaactgactgta

SEQ ID NO: 7229376 - DNA, 22 bp, Homo sapiens
tgagcaagagaaactgactgta

SEQ ID NO: 7229377 - DNA, 22 bp, Homo sapiens
tgagcaaggagcagtctttctt

SEQ ID NO: 7229378 - DNA, 22 bp, Homo sapiens
tgagcaaggagcagtctttctt

SEQ ID NO: 7229379 - DNA, 23 bp, Homo sapiens
tgagcaagtgaccaactgtctgt

SEQ ID NO: 7229380 - DNA, 23 bp, Homo sapiens
tgagcaagtgaccaactgtctgt

SEQ ID NO: 7229381 - DNA, 22 bp, Homo sapiens
tgagcacaagtttgcatgtgtg

SEQ ID NO: 7229382 - DNA, 22 bp, Homo sapiens
tgagcagagcaataggactctc

SEQ ID NO: 7229383 - DNA, 22 bp, Homo sapiens
tgagcagagcaggctgcgccct

SEQ ID NO: 7229384 - DNA, 22 bp, Homo sapiens
tgagcagagatgactgggcatt

SEQ ID NO: 7229385 - DNA, 22 bp, Homo sapiens
tgagcacatgccagcccttctc

SEQ ID NO: 7229386 - DNA, 22 bp, Homo sapiens
tgagcacatttcacatgacagg

SEQ ID NO: 7229387 - DNA, 22 bp, Homo sapiens
tgagcacatttcacatgacagg

SEQ ID NO: 7229388 - DNA, 20 bp, Homo sapiens
tgagcaccaagaatcaagaa

SEQ ID NO: 7229389 - DNA, 20 bp, Homo sapiens
tgagcaccaagaatcaagaa

SEQ ID NO: 7229390 - DNA, 21 bp, Homo sapiens
tgagcaccagctgcatgcccc

SEQ ID NO: 7229391 - DNA, 22 bp, Homo sapiens
tgagcaccaggcaccacagctc

SEQ ID NO: 7229392 - DNA, 22 bp, Homo sapiens
tgagcaccatctgtttgtgtgc

SEQ ID NO: 7229393 - DNA, 22 bp, Homo sapiens
tgagcagagacttcaagggcag

SEQ ID NO: 7229394 - DNA, 22 bp, Homo sapiens
tgagcagagatgactgggcatt

SEQ ID NO: 7229395 - DNA, 22 bp, Homo sapiens
tgagcagatggaggcttctgca

SEQ ID NO: 7229396 - DNA, 22 bp, Homo sapiens
tgagcagatgtctaacttttac

SEQ ID NO: 7229397 - DNA, 22 bp, Homo sapiens
tgagcagatggaggcttctgca

SEQ ID NO: 7229398 - DNA, 18 bp, Homo sapiens
tgagcagagtaaggcttt

SEQ ID NO: 7229399 - DNA, 22 bp, Homo sapiens
tgagcagagtcgctccagagtg

SEQ ID NO: 7229400 - DNA, 22 bp, Homo sapiens
tgagcagagttgtttctcctga

SEQ ID NO: 7229401 - DNA, 22 bp, Homo sapiens
tgagcagagcagtaacaggagc

SEQ ID NO: 7229402 - DNA, 22 bp, Homo sapiens
tgagcagagcagtaacaggagc

SEQ ID NO: 7229403 - DNA, 22 bp, Homo sapiens
tgagcagaggaggctgccaact

SEQ ID NO: 7229404 - DNA, 22 bp, Homo sapiens
tgagcagaggagtgacgtaggt

SEQ ID NO: 7229405 - DNA, 22 bp, Homo sapiens
tgagcagaggagtgacgtaggt

SEQ ID NO: 7229406 - DNA, 22 bp, Homo sapiens
tgagcagaggccagcacctggg

SEQ ID NO: 7229407 - DNA, 22 bp, Homo sapiens
tgagcagaggccagcacctggg

SEQ ID NO: 7229408 - DNA, 22 bp, Homo sapiens
tgagcaggcgcagcaggaggtc

SEQ ID NO: 7229409 - DNA, 22 bp, Homo sapiens
tgagcaggcgcagcaggaggtc

SEQ ID NO: 7229410 - DNA, 22 bp, Homo sapiens
tgagcaggcgcagcaggaggtc

SEQ ID NO: 7229411 - DNA, 22 bp, Homo sapiens
tgagcaggcgcagcaggaggtc

SEQ ID NO: 7229412 - DNA, 22 bp, Homo sapiens
tgagcaggattcgcctcttgca

SEQ ID NO: 7229413 - DNA, 21 bp, Homo sapiens
tgagcaggagtcatgggaatg

SEQ ID NO: 7229414 - DNA, 22 bp, Homo sapiens
tgagcaggattcgcctcttgca

SEQ ID NO: 7229415 - DNA, 22 bp, Homo sapiens
tgagcagggactttgagtgtag

SEQ ID NO: 7229416 - DNA, 22 bp, Homo sapiens
tgagcaggctcccacttcagtg

SEQ ID NO: 7229417 - DNA, 22 bp, Homo sapiens
tgagcagggactttgagtgtag

SEQ ID NO: 7229418 - DNA, 22 bp, Homo sapiens
tgagcagggactttgagtgtag

SEQ ID NO: 7229419 - DNA, 22 bp, Homo sapiens
tgagcagggactttgagtgtag

SEQ ID NO: 7229420 - DNA, 22 bp, Homo sapiens
tgagcaggcgcagcaggaggtc

SEQ ID NO: 7229421 - DNA, 22 bp, Homo sapiens
tgagcaggcgcagcaggaggtc

SEQ ID NO: 7229422 - DNA, 22 bp, Homo sapiens
tgagcaggcgcagcaggaggtc

SEQ ID NO: 7229423 - DNA, 22 bp, Homo sapiens
tgagcagatgtgccaaactgta

SEQ ID NO: 7229424 - DNA, 22 bp, Homo sapiens
tgagcagatttgttctaggggt

SEQ ID NO: 7229425 - DNA, 22 bp, Homo sapiens
tgagcagcaactgtccatggca

SEQ ID NO: 7229426 - DNA, 23 bp, Homo sapiens
tgagcagctaaaggtgatgcggg

SEQ ID NO: 7229427 - DNA, 23 bp, Homo sapiens
tgagcagctaaaggtgatgcggg

SEQ ID NO: 7229428 - DNA, 22 bp, Homo sapiens
tgagcagcttgttccgagtgtt

SEQ ID NO: 7229429 - DNA, 22 bp, Homo sapiens
tgagcagcttgttccgagtgtt

SEQ ID NO: 7229430 - DNA, 22 bp, Homo sapiens
tgagcaggactcactgcagcct

SEQ ID NO: 7229431 - DNA, 22 bp, Homo sapiens
tgagcaggactcactgcagcct

SEQ ID NO: 7229432 - DNA, 22 bp, Homo sapiens
tgagcaggactcactgcagcct

SEQ ID NO: 7229433 - DNA, 22 bp, Homo sapiens
tgagcaggactgaccggcctta

SEQ ID NO: 7229434 - DNA, 22 bp, Homo sapiens
tgagcaggactgaccggcctta

SEQ ID NO: 7229435 - DNA, 22 bp, Homo sapiens
tgagcaggagataaacaggtag

SEQ ID NO: 7229436 - DNA, 22 bp, Homo sapiens
tgagccaggttaagacaggagc

SEQ ID NO: 7229437 - DNA, 22 bp, Homo sapiens
tgagccaggttaagacaggagc

SEQ ID NO: 7229438 - DNA, 22 bp, Homo sapiens
tgagccaggttaagacaggagc

SEQ ID NO: 7229439 - DNA, 22 bp, Homo sapiens
tgagccaggttaagacaggagc

SEQ ID NO: 7229440 - DNA, 22 bp, Homo sapiens
tgagccaggttaagacaggagc

SEQ ID NO: 7229441 - DNA, 22 bp, Homo sapiens
tgagccaggtctcactcacctt

SEQ ID NO: 7229442 - DNA, 22 bp, Homo sapiens
tgagccaggttaagacaggagc

SEQ ID NO: 7229443 - DNA, 22 bp, Homo sapiens
tgagccaggttaagacaggagc

SEQ ID NO: 7229444 - DNA, 22 bp, Homo sapiens
tgagccaggttttccatcattc

SEQ ID NO: 7229445 - DNA, 22 bp, Homo sapiens
tgagccaggttttccatcattc

SEQ ID NO: 7229446 - DNA, 20 bp, Homo sapiens
tgagccagtcaagctacatt

SEQ ID NO: 7229447 - DNA, 20 bp, Homo sapiens
tgagccagtcaagctacatt

SEQ ID NO: 7229448 - DNA, 20 bp, Homo sapiens
tgagccagtcaagctacatt

SEQ ID NO: 7229449 - DNA, 20 bp, Homo sapiens
tgagccagtcaagctacatt

SEQ ID NO: 7229450 - DNA, 22 bp, Homo sapiens
tgagccagtctgtctgggtgaa

SEQ ID NO: 7229451 - DNA, 22 bp, Homo sapiens
tgagccagtctgtctgggtgaa

SEQ ID NO: 7229452 - DNA, 22 bp, Homo sapiens
tgagccagtctgtctgggtgaa

SEQ ID NO: 7229453 - DNA, 22 bp, Homo sapiens
tgagccagtctgtctgggtgaa

SEQ ID NO: 7229454 - DNA, 22 bp, Homo sapiens
tgagccagtctctcagaaccct

SEQ ID NO: 7229455 - DNA, 22 bp, Homo sapiens
tgagccagtctctcagaaccct

SEQ ID NO: 7229456 - DNA, 22 bp, Homo sapiens
tgagccagtctctcagaaccct

SEQ ID NO: 7229457 - DNA, 22 bp, Homo sapiens
tgagccagtctctcagaaccct

SEQ ID NO: 7229458 - DNA, 22 bp, Homo sapiens
tgagccagtggaagatggcagt

SEQ ID NO: 7229459 - DNA, 22 bp, Homo sapiens
tgagccagtggaagatggcagt

SEQ ID NO: 7229460 - DNA, 22 bp, Homo sapiens
tgagccagtctgtctgggtgaa

SEQ ID NO: 7229461 - DNA, 22 bp, Homo sapiens
tgagccagtctgtctgggtgaa

SEQ ID NO: 7229462 - DNA, 22 bp, Homo sapiens
tgagcccttgacatcgcccact

SEQ ID NO: 7229463 - DNA, 21 bp, Homo sapiens
tgagcccttgcctcagagccc

SEQ ID NO: 7229464 - DNA, 22 bp, Homo sapiens
tgagccctcggctggggcagag

SEQ ID NO: 7229465 - DNA, 22 bp, Homo sapiens
tgagccctgacctagcctggcc

SEQ ID NO: 7229466 - DNA, 22 bp, Homo sapiens
tgagccctggagccctctgtta

SEQ ID NO: 7229467 - DNA, 23 bp, Homo sapiens
tgagcccagttttccctcttgcc

SEQ ID NO: 7229468 - DNA, 23 bp, Homo sapiens
tgagcccagttttccctcttgcc

SEQ ID NO: 7229469 - DNA, 22 bp, Homo sapiens
tgagccctccaaacccaggatt

SEQ ID NO: 7229470 - DNA, 22 bp, Homo sapiens
tgagccctcggctggggcagag

SEQ ID NO: 7229471 - DNA, 22 bp, Homo sapiens
tgagcctgcaataagcacagcc

SEQ ID NO: 7229472 - DNA, 22 bp, Homo sapiens
tgagcctgcaataagcacagcc

SEQ ID NO: 7229473 - DNA, 22 bp, Homo sapiens
tgagcctgagttcaaggctgca

SEQ ID NO: 7229474 - DNA, 22 bp, Homo sapiens
tgagcctgagttcaaggctgca

SEQ ID NO: 7229475 - DNA, 22 bp, Homo sapiens
tgagcctgcaataagcacagcc

SEQ ID NO: 7229476 - DNA, 22 bp, Homo sapiens
tgagcctgcaataagcacagcc

SEQ ID NO: 7229477 - DNA, 22 bp, Homo sapiens
tgagcctgcctgcaggtgtgct

SEQ ID NO: 7229478 - DNA, 22 bp, Homo sapiens
tgagcctgcctgcaggtgtgct

SEQ ID NO: 7229479 - DNA, 23 bp, Homo sapiens
tgagcctgctgatagacacaatt

SEQ ID NO: 7229480 - DNA, 23 bp, Homo sapiens
tgagcctgctgatagacacaatt

SEQ ID NO: 7229481 - DNA, 20 bp, Homo sapiens
tgagcctgctgtaggaggcc

SEQ ID NO: 7229482 - DNA, 20 bp, Homo sapiens
tgagcctgctgtaggaggcc

SEQ ID NO: 7229483 - DNA, 22 bp, Homo sapiens
tgagcctgctgtcgctggaccc

SEQ ID NO: 7229484 - DNA, 22 bp, Homo sapiens
tgagcctgctgtcgctggaccc

SEQ ID NO: 7229485 - DNA, 22 bp, Homo sapiens
tgagcctggagcccagatgttt

SEQ ID NO: 7229486 - DNA, 22 bp, Homo sapiens
tgagcctggagcccagatgttt

SEQ ID NO: 7229487 - DNA, 22 bp, Homo sapiens
tgagcctggagtcgtggagggg

SEQ ID NO: 7229488 - DNA, 22 bp, Homo sapiens
tgagcctggcctgcagagacca

SEQ ID NO: 7229489 - DNA, 22 bp, Homo sapiens
tgagcctggcctgcagagacca

SEQ ID NO: 7229490 - DNA, 22 bp, Homo sapiens
tgagcctggagtcgtggagggg

SEQ ID NO: 7229491 - DNA, 22 bp, Homo sapiens
tgagcctggcggaagcagcgtg

SEQ ID NO: 7229492 - DNA, 22 bp, Homo sapiens
tgagcctggcggaagcagcgtg

SEQ ID NO: 7229493 - DNA, 22 bp, Homo sapiens
tgagcctggcggaagcagcgtg

SEQ ID NO: 7229494 - DNA, 23 bp, Homo sapiens
tgagcctgttaatactggctctg

SEQ ID NO: 7229495 - DNA, 22 bp, Homo sapiens
tgagcgtgcagtagtgttggta

SEQ ID NO: 7229496 - DNA, 22 bp, Homo sapiens
tgagcctgtcattattcagaga

SEQ ID NO: 7229497 - DNA, 22 bp, Homo sapiens
tgagcctgtcctgtgcatgtga

SEQ ID NO: 7229498 - DNA, 22 bp, Homo sapiens
tgagcctgtggggtgacaacca

SEQ ID NO: 7229499 - DNA, 22 bp, Homo sapiens
tgagctaggtcctgtgtcagct

SEQ ID NO: 7229500 - DNA, 22 bp, Homo sapiens
tgagctcatagctcttattatg

SEQ ID NO: 7229501 - DNA, 22 bp, Homo sapiens
tgagcctggggcctgggcagcg

SEQ ID NO: 7229502 - DNA, 22 bp, Homo sapiens
tgagcctggggcctgggcagcg

SEQ ID NO: 7229503 - DNA, 22 bp, Homo sapiens
tgagcctgggagatggaggctg

SEQ ID NO: 7229504 - DNA, 22 bp, Homo sapiens
tgagcctgggctttctctggag

SEQ ID NO: 7229505 - DNA, 22 bp, Homo sapiens
tgagcctgggagatggaggctg

SEQ ID NO: 7229506 - DNA, 22 bp, Homo sapiens
tgagcctgggtggtcgaggctg

SEQ ID NO: 7229507 - DNA, 22 bp, Homo sapiens
tgagcctggttgcagtgtctgg

SEQ ID NO: 7229508 - DNA, 22 bp, Homo sapiens
tgagcctggttgcagtgtctgg

SEQ ID NO: 7229509 - DNA, 22 bp, Homo sapiens
tgagcctggggcctgggcagcg

SEQ ID NO: 7229510 - DNA, 22 bp, Homo sapiens
tgagctgtctatggtcctgtct

SEQ ID NO: 7229511 - DNA, 22 bp, Homo sapiens
tgagctgtactcctccccaggg

SEQ ID NO: 7229512 - DNA, 22 bp, Homo sapiens
tgagctgtagcagatgctgttg

SEQ ID NO: 7229513 - DNA, 22 bp, Homo sapiens
tgagctgtctgaatggtgagga

SEQ ID NO: 7229514 - DNA, 22 bp, Homo sapiens
tgagctgtctgaatggtgagga

SEQ ID NO: 7229515 - DNA, 22 bp, Homo sapiens
tgagctgtggtggggtagagga

SEQ ID NO: 7229516 - DNA, 22 bp, Homo sapiens
tgagctgtgctacgccctggga

SEQ ID NO: 7229517 - DNA, 22 bp, Homo sapiens
tgagcttagagcctccaagttc

SEQ ID NO: 7229518 - DNA, 22 bp, Homo sapiens
tgagcttacttctgtacacaga

SEQ ID NO: 7229519 - DNA, 22 bp, Homo sapiens
tgagcttacgtgggaacagact

SEQ ID NO: 7229520 - DNA, 22 bp, Homo sapiens
tgagctgtttctctggtggctt

SEQ ID NO: 7229521 - DNA, 22 bp, Homo sapiens
tgagctgtgtcctgggggcagt

SEQ ID NO: 7229522 - DNA, 22 bp, Homo sapiens
tgagctgtgtcctgggggcagt

SEQ ID NO: 7229523 - DNA, 22 bp, Homo sapiens
tgagctgtgtgacattgagcca

SEQ ID NO: 7229524 - DNA, 22 bp, Homo sapiens
tgagcttatacatgtgaagtca

SEQ ID NO: 7229525 - DNA, 22 bp, Homo sapiens
tgagcttattcataaaagtgca

SEQ ID NO: 7229526 - DNA, 22 bp, Homo sapiens
tgagcttcaaagttggatctga

SEQ ID NO: 7229527 - DNA, 22 bp, Homo sapiens
tgagcttttaatatacaggtgt

SEQ ID NO: 7229528 - DNA, 22 bp, Homo sapiens
tgagcttccctcctgcactaca

SEQ ID NO: 7229529 - DNA, 22 bp, Homo sapiens
tgagcttcctccctgcatccat

SEQ ID NO: 7229530 - DNA, 22 bp, Homo sapiens
tgagcttccctcctgcactaca

SEQ ID NO: 7229531 - DNA, 22 bp, Homo sapiens
tgaggaaacttacaaggcagaa

SEQ ID NO: 7229532 - DNA, 22 bp, Homo sapiens
tgaggaaactgaggcacagatg

SEQ ID NO: 7229533 - DNA, 22 bp, Homo sapiens
tgaggaaactgaggcacagatg

SEQ ID NO: 7229534 - DNA, 22 bp, Homo sapiens
tgaggaaaacgtattgaaagga

SEQ ID NO: 7229535 - DNA, 22 bp, Homo sapiens
tgaggaaaatgtcttatagatt

SEQ ID NO: 7229536 - DNA, 22 bp, Homo sapiens
tgaggaaaatgtcttatagatt

SEQ ID NO: 7229537 - DNA, 22 bp, Homo sapiens
tgaggaaaatgtcttatagatt

SEQ ID NO: 7229538 - DNA, 22 bp, Homo sapiens
tgaggaaactgaggcacagatg

SEQ ID NO: 7229539 - DNA, 22 bp, Homo sapiens
tgagctggttcttgaggcatga

SEQ ID NO: 7229540 - DNA, 22 bp, Homo sapiens
tgagctggttcttgaggcatga

SEQ ID NO: 7229541 - DNA, 22 bp, Homo sapiens
tgagctggttcttgaggcatga

SEQ ID NO: 7229542 - DNA, 22 bp, Homo sapiens
tgagctggtcttgagtgtagct

SEQ ID NO: 7229543 - DNA, 22 bp, Homo sapiens
tgagctggtcttgagtgtagct

SEQ ID NO: 7229544 - DNA, 22 bp, Homo sapiens
tgagctggtcttgagtgtagct

SEQ ID NO: 7229545 - DNA, 22 bp, Homo sapiens
tgagctggagtctgtggctcct

SEQ ID NO: 7229546 - DNA, 22 bp, Homo sapiens
tgagctggagtctgtggctcct

SEQ ID NO: 7229547 - DNA, 22 bp, Homo sapiens
tgagctggatccaactccgttt

SEQ ID NO: 7229548 - DNA, 22 bp, Homo sapiens
tgagctggcacttttcctggga

SEQ ID NO: 7229549 - DNA, 22 bp, Homo sapiens
tgagctggcacttttcctggga

SEQ ID NO: 7229550 - DNA, 22 bp, Homo sapiens
tgagctggaggacaggagggta

SEQ ID NO: 7229551 - DNA, 22 bp, Homo sapiens
tgagctggaggacaggagggta

SEQ ID NO: 7229552 - DNA, 22 bp, Homo sapiens
tgagctggaatcttcttgactg

SEQ ID NO: 7229553 - DNA, 22 bp, Homo sapiens
tgagctggaatcttcttgactg

SEQ ID NO: 7229554 - DNA, 22 bp, Homo sapiens
tgagctggagtcgtgagcaaag

SEQ ID NO: 7229555 - DNA, 22 bp, Homo sapiens
tgagctgcattacagcctctgt

SEQ ID NO: 7229556 - DNA, 19 bp, Homo sapiens
tgagctgctgctgcccatc

SEQ ID NO: 7229557 - DNA, 22 bp, Homo sapiens
tgagctgctctaatctcgcctt

SEQ ID NO: 7229558 - DNA, 22 bp, Homo sapiens
tgagctctgttagggctggaac

SEQ ID NO: 7229559 - DNA, 22 bp, Homo sapiens
tgagctctgttagggctggaac

SEQ ID NO: 7229560 - DNA, 22 bp, Homo sapiens
tgagctcttgatatccttgttt

SEQ ID NO: 7229561 - DNA, 22 bp, Homo sapiens
tgagctctcagggacagactat

SEQ ID NO: 7229562 - DNA, 19 bp, Homo sapiens
tgagctctccacaatttcc

SEQ ID NO: 7229563 - DNA, 22 bp, Homo sapiens
tgagctctcagggacagactat

SEQ ID NO: 7229564 - DNA, 22 bp, Homo sapiens
tgagctctaagatcccctcaag

SEQ ID NO: 7229565 - DNA, 22 bp, Homo sapiens
tgaagctttaggatgggttcat

SEQ ID NO: 7229566 - DNA, 22 bp, Homo sapiens
tgaaggagatttttagggaggc

SEQ ID NO: 7229567 - DNA, 22 bp, Homo sapiens
tgaagcttgtatttaaataagt

SEQ ID NO: 7229568 - DNA, 22 bp, Homo sapiens
tgaagcttgtatttaaataagt

SEQ ID NO: 7229569 - DNA, 22 bp, Homo sapiens
tgaaggagatttttagggaggc

SEQ ID NO: 7229570 - DNA, 22 bp, Homo sapiens
tgaaggagctgatgtaaggggt

SEQ ID NO: 7229571 - DNA, 22 bp, Homo sapiens
tgaaggagctgatgtaaggggt

SEQ ID NO: 7229572 - DNA, 22 bp, Homo sapiens
tgaaggagctgatgtaaggggt

SEQ ID NO: 7229573 - DNA, 22 bp, Homo sapiens
tgaaggagctcaggagatagtc

SEQ ID NO: 7229574 - DNA, 22 bp, Homo sapiens
tgaaggagctcaggagatagtc

SEQ ID NO: 7229575 - DNA, 22 bp, Homo sapiens
tgaagctggcttgacatggcct

SEQ ID NO: 7229576 - DNA, 22 bp, Homo sapiens
tgaagctgcctgctcacagcca

SEQ ID NO: 7229577 - DNA, 22 bp, Homo sapiens
tgaaggcacgtgggtggatact

SEQ ID NO: 7229578 - DNA, 22 bp, Homo sapiens
tgaaggcacttgcctaggggca

SEQ ID NO: 7229579 - DNA, 22 bp, Homo sapiens
tgaaggcacttgcctaggggca

SEQ ID NO: 7229580 - DNA, 22 bp, Homo sapiens
tgaaggcacagtttaaccagta

SEQ ID NO: 7229581 - DNA, 22 bp, Homo sapiens
tgaaggcacgtgggtggatact

SEQ ID NO: 7229582 - DNA, 22 bp, Homo sapiens
tgaaggcacgtgggtggatact

SEQ ID NO: 7229583 - DNA, 22 bp, Homo sapiens
tgaaggcaaaacatgttacacc

SEQ ID NO: 7229584 - DNA, 22 bp, Homo sapiens
tgaaggcaaaacatgttacacc

SEQ ID NO: 7229585 - DNA, 22 bp, Homo sapiens
tgaaggcaacctctgtggtcct

SEQ ID NO: 7229586 - DNA, 22 bp, Homo sapiens
tgaaggcaacctctgtggtcct

SEQ ID NO: 7229587 - DNA, 22 bp, Homo sapiens
tgaaggcaactgagaaaaagca

SEQ ID NO: 7229588 - DNA, 22 bp, Homo sapiens
tgaaggcaactgagaaaaagca

SEQ ID NO: 7229589 - DNA, 19 bp, Homo sapiens
tgaaggagggggatggcca

SEQ ID NO: 7229590 - DNA, 22 bp, Homo sapiens
tgaaggagggaagaaggctctg

SEQ ID NO: 7229591 - DNA, 22 bp, Homo sapiens
tgaaggagggaagaaggctctg

SEQ ID NO: 7229592 - DNA, 22 bp, Homo sapiens
tgaaggagggaagaaggctctg

SEQ ID NO: 7229593 - DNA, 22 bp, Homo sapiens
tgaaggagggaagaaggctctg

SEQ ID NO: 7229594 - DNA, 22 bp, Homo sapiens
tgaaggagctgatgtaaggggt

SEQ ID NO: 7229595 - DNA, 22 bp, Homo sapiens
tgaaggaggaatgtggcctcca

SEQ ID NO: 7229596 - DNA, 22 bp, Homo sapiens
tgaaggagctgatgtaaggggt

SEQ ID NO: 7229597 - DNA, 22 bp, Homo sapiens
tgaagccataggacagaggata

SEQ ID NO: 7229598 - DNA, 22 bp, Homo sapiens
tgaagccagtcaatgttaagtt

SEQ ID NO: 7229599 - DNA, 22 bp, Homo sapiens
tgaagccagggactgacacttc

SEQ ID NO: 7229600 - DNA, 22 bp, Homo sapiens
tgaagccagtcaatgttaagtt

SEQ ID NO: 7229601 - DNA, 21 bp, Homo sapiens
tgaagccaggatcacgattct

SEQ ID NO: 7229602 - DNA, 22 bp, Homo sapiens
tgaagccagctttggaagacac

SEQ ID NO: 7229603 - DNA, 22 bp, Homo sapiens
tgaagccactttccagaatcac

SEQ ID NO: 7229604 - DNA, 22 bp, Homo sapiens
tgaagccactttccagaatcac

SEQ ID NO: 7229605 - DNA, 22 bp, Homo sapiens
tgaagccaccgaaccagaagag

SEQ ID NO: 7229606 - DNA, 22 bp, Homo sapiens
tgaagccacagagcatctgcct

SEQ ID NO: 7229607 - DNA, 22 bp, Homo sapiens
tgaagccactttccagaatcac

SEQ ID NO: 7229608 - DNA, 22 bp, Homo sapiens
tgaagccactttccagaatcac

SEQ ID NO: 7229609 - DNA, 22 bp, Homo sapiens
tgaagccacagagcatctgcct

SEQ ID NO: 7229610 - DNA, 22 bp, Homo sapiens
tgaagccacagagcatctgcct

SEQ ID NO: 7229611 - DNA, 22 bp, Homo sapiens
tgaagccacactagcttgtcct

SEQ ID NO: 7229612 - DNA, 22 bp, Homo sapiens
tgaagccaatctgccaggcaga

SEQ ID NO: 7229613 - DNA, 22 bp, Homo sapiens
tgaagccaaggatgcctttctc

SEQ ID NO: 7229614 - DNA, 22 bp, Homo sapiens
tgaagccaatctgccaggcaga

SEQ ID NO: 7229615 - DNA, 22 bp, Homo sapiens
tgaagcagttctcagaagtggg

SEQ ID NO: 7229616 - DNA, 22 bp, Homo sapiens
tgaagcataagagggttctttt

SEQ ID NO: 7229617 - DNA, 22 bp, Homo sapiens
tgaagccattactgtgttaggg

SEQ ID NO: 7229618 - DNA, 22 bp, Homo sapiens
tgaagccatctcagagtcaaga

SEQ ID NO: 7229619 - DNA, 22 bp, Homo sapiens
tgaagccattactgtgttaggg

SEQ ID NO: 7229620 - DNA, 23 bp, Homo sapiens
tgaagcccagtgattttgtttca

SEQ ID NO: 7229621 - DNA, 22 bp, Homo sapiens
tgaagccatccctcagatggcc

SEQ ID NO: 7229622 - DNA, 22 bp, Homo sapiens
tgaagccatctcagagtcaaga

SEQ ID NO: 7229623 - DNA, 22 bp, Homo sapiens
tgaagccatcaggaagccagca

SEQ ID NO: 7229624 - DNA, 22 bp, Homo sapiens
tgaagccatcaggaagccagca

SEQ ID NO: 7229625 - DNA, 22 bp, Homo sapiens
tgaagcctgaaagctggacagg

SEQ ID NO: 7229626 - DNA, 22 bp, Homo sapiens
tgaagccctgtgtcagcttcca

SEQ ID NO: 7229627 - DNA, 22 bp, Homo sapiens
tgaagctattggtaaggaagtg

SEQ ID NO: 7229628 - DNA, 21 bp, Homo sapiens
tgaagggcagcctcaggctcc

SEQ ID NO: 7229629 - DNA, 21 bp, Homo sapiens
tgaagggcagcctcaggctcc

SEQ ID NO: 7229630 - DNA, 22 bp, Homo sapiens
tgaagggcaaccccaggcccag

SEQ ID NO: 7229631 - DNA, 22 bp, Homo sapiens
tgaagggcaaccccaggcccag

SEQ ID NO: 7229632 - DNA, 21 bp, Homo sapiens
tgaagggcagcctcaggctcc

SEQ ID NO: 7229633 - DNA, 21 bp, Homo sapiens
tgaaggggccatcacaaaggc

SEQ ID NO: 7229634 - DNA, 22 bp, Homo sapiens
tgaagggggagatatatgtgtg

SEQ ID NO: 7229635 - DNA, 21 bp, Homo sapiens
tgaaggggtggcagtgtgctt

SEQ ID NO: 7229636 - DNA, 21 bp, Homo sapiens
tgaaggggtggcagtgtgctt

SEQ ID NO: 7229637 - DNA, 21 bp, Homo sapiens
tgaaggggtggcagtgtgctt

SEQ ID NO: 7229638 - DNA, 22 bp, Homo sapiens
tgaaggggttcagcatgggggt

SEQ ID NO: 7229639 - DNA, 22 bp, Homo sapiens
tgaaggggttcagcatgggggt

SEQ ID NO: 7229640 - DNA, 22 bp, Homo sapiens
tgaagggtggcatggcaggcag

SEQ ID NO: 7229641 - DNA, 22 bp, Homo sapiens
tgaaggtaaaggaaggaggctt

SEQ ID NO: 7229642 - DNA, 22 bp, Homo sapiens
tgaaggtaaaggaaggaggctt

SEQ ID NO: 7229643 - DNA, 22 bp, Homo sapiens
tgaagggcaaccccaggcccag

SEQ ID NO: 7229644 - DNA, 22 bp, Homo sapiens
tgaaggcttggtggcagcctct

SEQ ID NO: 7229645 - DNA, 22 bp, Homo sapiens
tgaaggcttgactgaggcagga

SEQ ID NO: 7229646 - DNA, 22 bp, Homo sapiens
tgaaggcatttgagttggtgag

SEQ ID NO: 7229647 - DNA, 22 bp, Homo sapiens
tgaaggcatttgagttggtgag

SEQ ID NO: 7229648 - DNA, 22 bp, Homo sapiens
tgaaggcattgatgaaggaatc

SEQ ID NO: 7229649 - DNA, 22 bp, Homo sapiens
tgaaggcattgatgaaggaatc

SEQ ID NO: 7229650 - DNA, 22 bp, Homo sapiens
tgaaggcattgatgaaggaatc

SEQ ID NO: 7229651 - DNA, 22 bp, Homo sapiens
tgaaggcataaatcttgggaac

SEQ ID NO: 7229652 - DNA, 22 bp, Homo sapiens
tgaaggcagcatgcacactagt

SEQ ID NO: 7229653 - DNA, 20 bp, Homo sapiens
tgaaggcaggtaagaaagat

SEQ ID NO: 7229654 - DNA, 20 bp, Homo sapiens
tgaaggcaggtaagaaagat

SEQ ID NO: 7229655 - DNA, 22 bp, Homo sapiens
tgaaggcagtgagtttgtgttt

SEQ ID NO: 7229656 - DNA, 22 bp, Homo sapiens
tgaaggcagtgattttgtttgg

SEQ ID NO: 7229657 - DNA, 22 bp, Homo sapiens
tgaaggcatttgagttggtgag

SEQ ID NO: 7229658 - DNA, 20 bp, Homo sapiens
tgaaggccagcagcataggg

SEQ ID NO: 7229659 - DNA, 22 bp, Homo sapiens
tgaaggccagggatttgcagcc

SEQ ID NO: 7229660 - DNA, 22 bp, Homo sapiens
tgaataatcttgggtattaata

SEQ ID NO: 7229661 - DNA, 22 bp, Homo sapiens
tgaataatcttgggtattaata

SEQ ID NO: 7229662 - DNA, 22 bp, Homo sapiens
tgaataatccacagtcattcat

SEQ ID NO: 7229663 - DNA, 22 bp, Homo sapiens
tgaataatccacagtcattcat

SEQ ID NO: 7229664 - DNA, 22 bp, Homo sapiens
tgaataatcttgggtattaata

SEQ ID NO: 7229665 - DNA, 22 bp, Homo sapiens
tgaataagtgatgtcatatata

SEQ ID NO: 7229666 - DNA, 22 bp, Homo sapiens
tgaataatcatgtccatagtgt

SEQ ID NO: 7229667 - DNA, 22 bp, Homo sapiens
tgaataagaattattataatga

SEQ ID NO: 7229668 - DNA, 22 bp, Homo sapiens
tgaataaattgagagcgaatgt

SEQ ID NO: 7229669 - DNA, 22 bp, Homo sapiens
tgaataaattgagagcgaatgt

SEQ ID NO: 7229670 - DNA, 22 bp, Homo sapiens
tgaataaactatgaggaggaat

SEQ ID NO: 7229671 - DNA, 22 bp, Homo sapiens
tgaataaactatgaggaggaat

SEQ ID NO: 7229672 - DNA, 22 bp, Homo sapiens
tgaagttttctggttgattaag

SEQ ID NO: 7229673 - DNA, 22 bp, Homo sapiens
tgaagtttttccagacaagtcc

SEQ ID NO: 7229674 - DNA, 22 bp, Homo sapiens
tgaagtttttccagacaagtcc

SEQ ID NO: 7229675 - DNA, 22 bp, Homo sapiens
tgaagtttggtggaaatttcct

SEQ ID NO: 7229676 - DNA, 22 bp, Homo sapiens
tgaagtttggtggaaatttcct

SEQ ID NO: 7229677 - DNA, 22 bp, Homo sapiens
tgaagttttacatcctctccaa

SEQ ID NO: 7229678 - DNA, 22 bp, Homo sapiens
tgaagttttactaggtgaattt

SEQ ID NO: 7229679 - DNA, 22 bp, Homo sapiens
tgaagttttactaggtgaattt

SEQ ID NO: 7229680 - DNA, 22 bp, Homo sapiens
tgaagttttctggttgattaag

SEQ ID NO: 7229681 - DNA, 22 bp, Homo sapiens
tgaagttgttaaggttgccatt

SEQ ID NO: 7229682 - DNA, 22 bp, Homo sapiens
tgaagtttaaggttagataagt

SEQ ID NO: 7229683 - DNA, 22 bp, Homo sapiens
tgaagtttaattttggacatga

SEQ ID NO: 7229684 - DNA, 22 bp, Homo sapiens
tgaagtttataacatagcctcc

SEQ ID NO: 7229685 - DNA, 22 bp, Homo sapiens
tgaagtttcacgcgtcattcaa

SEQ ID NO: 7229686 - DNA, 22 bp, Homo sapiens
tgaagtttcctctgaggccagt

SEQ ID NO: 7229687 - DNA, 22 bp, Homo sapiens
tgaagtttcttgaatcttggag

SEQ ID NO: 7229688 - DNA, 22 bp, Homo sapiens
tgaagtttgaactgtgttgctg

SEQ ID NO: 7229689 - DNA, 22 bp, Homo sapiens
tgaaggtgaatgtctatgggga

SEQ ID NO: 7229690 - DNA, 22 bp, Homo sapiens
tgaaggtgaaagattgaagcca

SEQ ID NO: 7229691 - DNA, 22 bp, Homo sapiens
tgaaggtgacctgacagtggct

SEQ ID NO: 7229692 - DNA, 22 bp, Homo sapiens
tgacacaaaggaaagcataatc

SEQ ID NO: 7229693 - DNA, 22 bp, Homo sapiens
tgacacaaaggaaagcataatc

SEQ ID NO: 7229694 - DNA, 22 bp, Homo sapiens
tgacacaattttctgaccttca

SEQ ID NO: 7229695 - DNA, 22 bp, Homo sapiens
tgacaaattcatatttcagagg

SEQ ID NO: 7229696 - DNA, 23 bp, Homo sapiens
tgacaaagtcatctctccttctt

SEQ ID NO: 7229697 - DNA, 20 bp, Homo sapiens
tgacaaagtcccttcttttc

SEQ ID NO: 7229698 - DNA, 22 bp, Homo sapiens
tgacaaagtgaggtcttcagta

SEQ ID NO: 7229699 - DNA, 22 bp, Homo sapiens
tgacaaagtgctagtcggtgaa

SEQ ID NO: 7229700 - DNA, 23 bp, Homo sapiens
tgacaaagtggtcgttcaaggtg

SEQ ID NO: 7229701 - DNA, 23 bp, Homo sapiens
tgacaaagtggtcgttcaaggtg

SEQ ID NO: 7229702 - DNA, 22 bp, Homo sapiens
tgacaaagtggttgtttggttg

SEQ ID NO: 7229703 - DNA, 22 bp, Homo sapiens
tgacaaatacaataagatctgt

SEQ ID NO: 7229704 - DNA, 22 bp, Homo sapiens
tgacaaatacaataagatctgt

SEQ ID NO: 7229705 - DNA, 22 bp, Homo sapiens
tgacaaagacaaagatatgtcc

SEQ ID NO: 7229706 - DNA, 22 bp, Homo sapiens
tgacaaaactgcaattactttt

SEQ ID NO: 7229707 - DNA, 22 bp, Homo sapiens
tgacaaaactgcaattactttt

SEQ ID NO: 7229708 - DNA, 22 bp, Homo sapiens
tgacaaagaccttcaacaagat

SEQ ID NO: 7229709 - DNA, 22 bp, Homo sapiens
tgacaaagaggaacagcagggg

SEQ ID NO: 7229710 - DNA, 20 bp, Homo sapiens
tgacaaagagtaagaggagg

SEQ ID NO: 7229711 - DNA, 22 bp, Homo sapiens
tgacaaagcatgatggtgacag

SEQ ID NO: 7229712 - DNA, 22 bp, Homo sapiens
tgacaaagcatgatggtgacag

SEQ ID NO: 7229713 - DNA, 22 bp, Homo sapiens
tgacaaagcctcatccttcaga

SEQ ID NO: 7229714 - DNA, 23 bp, Homo sapiens
tgacaaagcgagactccagctca

SEQ ID NO: 7229715 - DNA, 23 bp, Homo sapiens
tgacaaagcgagactccagctca

SEQ ID NO: 7229716 - DNA, 22 bp, Homo sapiens
tgacaaaggcaggccagaagag

SEQ ID NO: 7229717 - DNA, 22 bp, Homo sapiens
tgacaaaggtgttgccagaggg

SEQ ID NO: 7229718 - DNA, 17 bp, Homo sapiens
tgaattcaatctgcact

SEQ ID NO: 7229719 - DNA, 22 bp, Homo sapiens
tgaattcatccatttatgcaag

SEQ ID NO: 7229720 - DNA, 22 bp, Homo sapiens
tgaattccttgcatttttacct

SEQ ID NO: 7229721 - DNA, 22 bp, Homo sapiens
tgaattctaatgggtgagatcc

SEQ ID NO: 7229722 - DNA, 20 bp, Homo sapiens
tgaattctagatgactggag

SEQ ID NO: 7229723 - DNA, 22 bp, Homo sapiens
tgaattctggctcttctgttta

SEQ ID NO: 7229724 - DNA, 22 bp, Homo sapiens
tgaattcttaatgaaatctact

SEQ ID NO: 7229725 - DNA, 21 bp, Homo sapiens
tgaatttcggtatggctataa

SEQ ID NO: 7229726 - DNA, 23 bp, Homo sapiens
tgaatttcattattgcagagatt

SEQ ID NO: 7229727 - DNA, 23 bp, Homo sapiens
tgaattttggcatattctgaaat

SEQ ID NO: 7229728 - DNA, 22 bp, Homo sapiens
tgaatttatcaaagattcttaa

SEQ ID NO: 7229729 - DNA, 22 bp, Homo sapiens
tgaatttatattgctgagagtt

SEQ ID NO: 7229730 - DNA, 22 bp, Homo sapiens
tgaatttaaaataaatgtagtt

SEQ ID NO: 7229731 - DNA, 22 bp, Homo sapiens
tgaatttaagcactgatgttaa

SEQ ID NO: 7229732 - DNA, 22 bp, Homo sapiens
tgaatgagaacactgaaagagg

SEQ ID NO: 7229733 - DNA, 22 bp, Homo sapiens
tgaatggatataacaacagtgt

SEQ ID NO: 7229734 - DNA, 22 bp, Homo sapiens
tgaatggattcagaaaatgtgt

SEQ ID NO: 7229735 - DNA, 22 bp, Homo sapiens
tgaatccttcgcacttagacat

SEQ ID NO: 7229736 - DNA, 22 bp, Homo sapiens
tgaatctatgttgccccataat

SEQ ID NO: 7229737 - DNA, 22 bp, Homo sapiens
tgaatctcagttctgtgtaacc

SEQ ID NO: 7229738 - DNA, 22 bp, Homo sapiens
tgaatctcgaggctatagaagt

SEQ ID NO: 7229739 - DNA, 22 bp, Homo sapiens
tgaatctggatctatgatcaat

SEQ ID NO: 7229740 - DNA, 22 bp, Homo sapiens
tgaatctttttggaaataaaga

SEQ ID NO: 7229741 - DNA, 22 bp, Homo sapiens
tgaatgaactaaatcatagttc

SEQ ID NO: 7229742 - DNA, 22 bp, Homo sapiens
tgaatgaatgaattaatagagt

SEQ ID NO: 7229743 - DNA, 22 bp, Homo sapiens
tgaatgaatgaattaatagagt

SEQ ID NO: 7229744 - DNA, 19 bp, Homo sapiens
tgaatgacgggcatgagca

SEQ ID NO: 7229745 - DNA, 22 bp, Homo sapiens
tgaatgagaacactgaaagagg

SEQ ID NO: 7229746 - DNA, 22 bp, Homo sapiens
tgaatgtaggcacatgcaaatg

SEQ ID NO: 7229747 - DNA, 22 bp, Homo sapiens
tgaatgtgatgctaaacatatg

SEQ ID NO: 7229748 - DNA, 22 bp, Homo sapiens
tgaatgtgatgctaaacatatg

SEQ ID NO: 7229749 - DNA, 22 bp, Homo sapiens
tgaatgtaccttgaaggtgtaa

SEQ ID NO: 7229750 - DNA, 22 bp, Homo sapiens
tgaatgtaggcacatgcaaatg

SEQ ID NO: 7229751 - DNA, 22 bp, Homo sapiens
tgaatgtgatgctaaacatatg

SEQ ID NO: 7229752 - DNA, 22 bp, Homo sapiens
tgaatgtgatgctaaacatatg

SEQ ID NO: 7229753 - DNA, 22 bp, Homo sapiens
tgaatgttctctaaatactcct

SEQ ID NO: 7229754 - DNA, 22 bp, Homo sapiens
tgaatgttctctaaatactcct

SEQ ID NO: 7229755 - DNA, 22 bp, Homo sapiens
tgaatgttgatatgagtacaga

SEQ ID NO: 7229756 - DNA, 18 bp, Homo sapiens
tgaatgttttctggaccc

SEQ ID NO: 7229757 - DNA, 22 bp, Homo sapiens
tgaatgtttgatgagaaataga

SEQ ID NO: 7229758 - DNA, 19 bp, Homo sapiens
tgaattaaagattaaagtc

SEQ ID NO: 7229759 - DNA, 19 bp, Homo sapiens
tgaattaaagattaaagtc

SEQ ID NO: 7229760 - DNA, 19 bp, Homo sapiens
tgaattaaagattaaagtc

SEQ ID NO: 7229761 - DNA, 23 bp, Homo sapiens
tgaatgtttattctcggtgcaga

SEQ ID NO: 7229762 - DNA, 23 bp, Homo sapiens
tgaatgtttattctcggtgcaga

SEQ ID NO: 7229763 - DNA, 23 bp, Homo sapiens
tgaatgtttattctcggtgcaga

SEQ ID NO: 7229764 - DNA, 22 bp, Homo sapiens
tgaatgtttgatgagaaataga

SEQ ID NO: 7229765 - DNA, 22 bp, Homo sapiens
tgaatcctaattctatcactta

SEQ ID NO: 7229766 - DNA, 22 bp, Homo sapiens
tgaatcctagttgaagataagg

SEQ ID NO: 7229767 - DNA, 22 bp, Homo sapiens
tgaatcatggataaatagctta

SEQ ID NO: 7229768 - DNA, 22 bp, Homo sapiens
tgaatccagagctatttcgtcc

SEQ ID NO: 7229769 - DNA, 22 bp, Homo sapiens
tgaatcatgccactgagctccc

SEQ ID NO: 7229770 - DNA, 23 bp, Homo sapiens
tgaatcaattatgggattcaatg

SEQ ID NO: 7229771 - DNA, 22 bp, Homo sapiens
tgaatcaattgtcttaagacat

SEQ ID NO: 7229772 - DNA, 22 bp, Homo sapiens
tgaatcagtataaattctcaaa

SEQ ID NO: 7229773 - DNA, 22 bp, Homo sapiens
tgaatagtgttctataatatgg

SEQ ID NO: 7229774 - DNA, 22 bp, Homo sapiens
tgaatagttctactacttgaca

SEQ ID NO: 7229775 - DNA, 22 bp, Homo sapiens
tgaatatggcaactcttgtaac

SEQ ID NO: 7229776 - DNA, 22 bp, Homo sapiens
tgaatcaaagctgaagttttca

SEQ ID NO: 7229777 - DNA, 22 bp, Homo sapiens
tgaatagatggtgacagtatga

SEQ ID NO: 7229778 - DNA, 22 bp, Homo sapiens
tgaatagatttttaacatataa

SEQ ID NO: 7229779 - DNA, 22 bp, Homo sapiens
tgaatactatttcataatgtgg

SEQ ID NO: 7229780 - DNA, 22 bp, Homo sapiens
tgaatactatttcataatgtgg

SEQ ID NO: 7229781 - DNA, 20 bp, Homo sapiens
tgaatagagagcacatatgc

SEQ ID NO: 7229782 - DNA, 22 bp, Homo sapiens
tgaatacactaaaaatcacttt

SEQ ID NO: 7229783 - DNA, 22 bp, Homo sapiens
tgaataattatgggagtcctaa

SEQ ID NO: 7229784 - DNA, 22 bp, Homo sapiens
tgaataattatgggagtcctaa

SEQ ID NO: 7229785 - DNA, 22 bp, Homo sapiens
tgaataattcctttttgtcaag

SEQ ID NO: 7229786 - DNA, 22 bp, Homo sapiens
tgaatacaggaaaatatactga

SEQ ID NO: 7229787 - DNA, 19 bp, Homo sapiens
tgaatacagagatacagaa

SEQ ID NO: 7229788 - DNA, 19 bp, Homo sapiens
tgaatacagagatacagaa

SEQ ID NO: 7229789 - DNA, 22 bp, Homo sapiens
tgactaattatgttactaatca

SEQ ID NO: 7229790 - DNA, 22 bp, Homo sapiens
tgactagaattgtatttagtgt

SEQ ID NO: 7229791 - DNA, 22 bp, Homo sapiens
tgactagacctatatctttttg

SEQ ID NO: 7229792 - DNA, 22 bp, Homo sapiens
tgacctattagatttccttgcc

SEQ ID NO: 7229793 - DNA, 22 bp, Homo sapiens
tgacctctgtcctgcagtctgg

SEQ ID NO: 7229794 - DNA, 22 bp, Homo sapiens
tgacctttcaacccttcttggc

SEQ ID NO: 7229795 - DNA, 22 bp, Homo sapiens
tgacctttgtgctagaaacata

SEQ ID NO: 7229796 - DNA, 22 bp, Homo sapiens
tgactattcacaattacaatag

SEQ ID NO: 7229797 - DNA, 20 bp, Homo sapiens
tgactattcccacatgagag

SEQ ID NO: 7229798 - DNA, 20 bp, Homo sapiens
tgactattcccacatgagag

SEQ ID NO: 7229799 - DNA, 22 bp, Homo sapiens
tgactattacggccacgaattt

SEQ ID NO: 7229800 - DNA, 22 bp, Homo sapiens
tgactattacggccacgaattt

SEQ ID NO: 7229801 - DNA, 22 bp, Homo sapiens
tgactattcacaattacaatag

SEQ ID NO: 7229802 - DNA, 21 bp, Homo sapiens
tgactccattctccatctgct

SEQ ID NO: 7229803 - DNA, 22 bp, Homo sapiens
tgactctgaatttatgaaatgg

SEQ ID NO: 7229804 - DNA, 22 bp, Homo sapiens
tgactctgctgtgaaagcattt

SEQ ID NO: 7229805 - DNA, 22 bp, Homo sapiens
tgactcttaaatatactgttga

SEQ ID NO: 7229806 - DNA, 22 bp, Homo sapiens
tgactgccatgagggtgagggc

SEQ ID NO: 7229807 - DNA, 22 bp, Homo sapiens
tgactgccatgagggtgagggc

SEQ ID NO: 7229808 - DNA, 21 bp, Homo sapiens
tgactgaggcttcttcacaca

SEQ ID NO: 7229809 - DNA, 21 bp, Homo sapiens
tgactgaggcttcttcacaca

SEQ ID NO: 7229810 - DNA, 21 bp, Homo sapiens
tgactgaggcttcttcacaca

SEQ ID NO: 7229811 - DNA, 21 bp, Homo sapiens
tgactgaggcttcttcacaca

SEQ ID NO: 7229812 - DNA, 22 bp, Homo sapiens
tgactgaaattgcattttaaaa

SEQ ID NO: 7229813 - DNA, 22 bp, Homo sapiens
tgactgaaattgcattttaaaa

SEQ ID NO: 7229814 - DNA, 22 bp, Homo sapiens
tgactgagagagaactcagctt

SEQ ID NO: 7229815 - DNA, 22 bp, Homo sapiens
tgactgcccccaccgcacaggc

SEQ ID NO: 7229816 - DNA, 19 bp, Homo sapiens
tgactgcctcaggggtgga

SEQ ID NO: 7229817 - DNA, 22 bp, Homo sapiens
tgactggattgtcattacgacg

SEQ ID NO: 7229818 - DNA, 22 bp, Homo sapiens
tgactggattgtcattacgacg

SEQ ID NO: 7229819 - DNA, 22 bp, Homo sapiens
tgactgtacctctaacacctga

SEQ ID NO: 7229820 - DNA, 22 bp, Homo sapiens
tgactgtgcctgttgaatgaat

SEQ ID NO: 7229821 - DNA, 22 bp, Homo sapiens
tgactgtgtgattaaggcttca

SEQ ID NO: 7229822 - DNA, 22 bp, Homo sapiens
tgacttctagcatttagcaacc

SEQ ID NO: 7229823 - DNA, 17 bp, Homo sapiens
tgacttaacagcaaggc

SEQ ID NO: 7229824 - DNA, 22 bp, Homo sapiens
tgacttcaaggttcagcacctt

SEQ ID NO: 7229825 - DNA, 22 bp, Homo sapiens
tgacttccagcaacttcctcca

SEQ ID NO: 7229826 - DNA, 22 bp, Homo sapiens
tgacttccctgaatgacctagt

SEQ ID NO: 7229827 - DNA, 22 bp, Homo sapiens
tgacttgtctctttgggagaca

SEQ ID NO: 7229828 - DNA, 22 bp, Homo sapiens
tgacttgtctctttgggagaca

SEQ ID NO: 7229829 - DNA, 22 bp, Homo sapiens
tgacttctctggcctggtgcag

SEQ ID NO: 7229830 - DNA, 22 bp, Homo sapiens
tgacttctgattgcttctattt

SEQ ID NO: 7229831 - DNA, 20 bp, Homo sapiens
tgacttctgggatttgtggt

SEQ ID NO: 7229832 - DNA, 20 bp, Homo sapiens
tgacttcttcatgctgtact

SEQ ID NO: 7229833 - DNA, 22 bp, Homo sapiens
tgacttgaaacgtgaacagatc

SEQ ID NO: 7229834 - DNA, 22 bp, Homo sapiens
tgacatttcctagtgctttgtg

SEQ ID NO: 7229835 - DNA, 22 bp, Homo sapiens
tgacatttcggtgtatgtgatg

SEQ ID NO: 7229836 - DNA, 22 bp, Homo sapiens
tgacatttcggtgtatgtgatg

SEQ ID NO: 7229837 - DNA, 18 bp, Homo sapiens
tgacatttccagagtgta

SEQ ID NO: 7229838 - DNA, 22 bp, Homo sapiens
tgacatttcctagtgctttgtg

SEQ ID NO: 7229839 - DNA, 22 bp, Homo sapiens
tgacatttcctagtgctttgtg

SEQ ID NO: 7229840 - DNA, 22 bp, Homo sapiens
tgacatttcctagtgctttgtg

SEQ ID NO: 7229841 - DNA, 22 bp, Homo sapiens
tgacatttcggtgtatgtgatg

SEQ ID NO: 7229842 - DNA, 22 bp, Homo sapiens
tgacatttcttgttgatataaa

SEQ ID NO: 7229843 - DNA, 22 bp, Homo sapiens
tgacatttcttgttgatataaa

SEQ ID NO: 7229844 - DNA, 22 bp, Homo sapiens
tgacatttcttgttgatataaa

SEQ ID NO: 7229845 - DNA, 22 bp, Homo sapiens
tgacatttgagagagatataca

SEQ ID NO: 7229846 - DNA, 22 bp, Homo sapiens
tgacatttgagagagatataca

SEQ ID NO: 7229847 - DNA, 22 bp, Homo sapiens
tgacatttgagagagatataca

SEQ ID NO: 7229848 - DNA, 22 bp, Homo sapiens
tgacatttgagcatacatgtaa

SEQ ID NO: 7229849 - DNA, 22 bp, Homo sapiens
tgacatttgagcatacatgtaa

SEQ ID NO: 7229850 - DNA, 22 bp, Homo sapiens
tgacatttgagcatacatgtaa

SEQ ID NO: 7229851 - DNA, 22 bp, Homo sapiens
tgacatttgagcatacatgtaa

SEQ ID NO: 7229852 - DNA, 21 bp, Homo sapiens
tgacatttggattcatagtaa

SEQ ID NO: 7229853 - DNA, 21 bp, Homo sapiens
tgacatttggattcatagtaa

SEQ ID NO: 7229854 - DNA, 18 bp, Homo sapiens
tgaccctttctccctgtg

SEQ ID NO: 7229855 - DNA, 22 bp, Homo sapiens
tgaccctggcctggtggcggaa

SEQ ID NO: 7229856 - DNA, 17 bp, Homo sapiens
tgaccctgttgggtgtt

SEQ ID NO: 7229857 - DNA, 21 bp, Homo sapiens
tgacatttggattcatagtaa

SEQ ID NO: 7229858 - DNA, 22 bp, Homo sapiens
tgacattttatcaatatcacag

SEQ ID NO: 7229859 - DNA, 22 bp, Homo sapiens
tgacattttatcaatatcacag

SEQ ID NO: 7229860 - DNA, 22 bp, Homo sapiens
tgacatttttaaaaccactagt

SEQ ID NO: 7229861 - DNA, 22 bp, Homo sapiens
tgacatttttaaaaccactagt

SEQ ID NO: 7229862 - DNA, 22 bp, Homo sapiens
tgacatttttataagagtcaaa

SEQ ID NO: 7229863 - DNA, 22 bp, Homo sapiens
tgacatttttataagagtcaaa

SEQ ID NO: 7229864 - DNA, 22 bp, Homo sapiens
tgacatttttataagagtcaaa

SEQ ID NO: 7229865 - DNA, 22 bp, Homo sapiens
tgacatttttataagagtcaaa

SEQ ID NO: 7229866 - DNA, 22 bp, Homo sapiens
tgaccctggcagcccactggcc

SEQ ID NO: 7229867 - DNA, 22 bp, Homo sapiens
tgacattccgcagtaaggttaa

SEQ ID NO: 7229868 - DNA, 22 bp, Homo sapiens
tgacatttaagcctctgatttc

SEQ ID NO: 7229869 - DNA, 22 bp, Homo sapiens
tgacatttaagcctctgatttc

SEQ ID NO: 7229870 - DNA, 22 bp, Homo sapiens
tgacatttaatccctaaatatt

SEQ ID NO: 7229871 - DNA, 22 bp, Homo sapiens
tgacatttaatccctaaatatt

SEQ ID NO: 7229872 - DNA, 22 bp, Homo sapiens
tgacatttaatccctaaatatt

SEQ ID NO: 7229873 - DNA, 22 bp, Homo sapiens
tgacatttaattaacgaatgct

SEQ ID NO: 7229874 - DNA, 22 bp, Homo sapiens
tgacatttaattaacgaatgct

SEQ ID NO: 7229875 - DNA, 22 bp, Homo sapiens
tgacatttaattaacgaatgct

SEQ ID NO: 7229876 - DNA, 22 bp, Homo sapiens
tgacatgtatgttgttggcatg

SEQ ID NO: 7229877 - DNA, 22 bp, Homo sapiens
tgacatgtatgttgttggcatg

SEQ ID NO: 7229878 - DNA, 22 bp, Homo sapiens
tgacagtgcgggtacatcatag

SEQ ID NO: 7229879 - DNA, 22 bp, Homo sapiens
tgacatgtccaggtggtcctgt

SEQ ID NO: 7229880 - DNA, 22 bp, Homo sapiens
tgacatgtcctgagaagatggc

SEQ ID NO: 7229881 - DNA, 22 bp, Homo sapiens
tgacatgtccaggtggtcctgt

SEQ ID NO: 7229882 - DNA, 22 bp, Homo sapiens
tgacatgtcctgagaagatggc

SEQ ID NO: 7229883 - DNA, 22 bp, Homo sapiens
tgacatgtcctgagaagatggc

SEQ ID NO: 7229884 - DNA, 22 bp, Homo sapiens
tgacatgtgctcatcttggcta

SEQ ID NO: 7229885 - DNA, 22 bp, Homo sapiens
tgacatgtggctttgacccagg

SEQ ID NO: 7229886 - DNA, 22 bp, Homo sapiens
tgacatgtgctcatcttggcta

SEQ ID NO: 7229887 - DNA, 22 bp, Homo sapiens
tgacatgtggctttgacccagg

SEQ ID NO: 7229888 - DNA, 22 bp, Homo sapiens
tgacatgtgtaatcagctccgt

SEQ ID NO: 7229889 - DNA, 22 bp, Homo sapiens
tgacatgtgtctccttccgtct

SEQ ID NO: 7229890 - DNA, 22 bp, Homo sapiens
tgacatgtgtaatcagctccgt

SEQ ID NO: 7229891 - DNA, 22 bp, Homo sapiens
tgacatgtgtctccttccgtct

SEQ ID NO: 7229892 - DNA, 22 bp, Homo sapiens
tgacatgttagggaaatgtgat

SEQ ID NO: 7229893 - DNA, 22 bp, Homo sapiens
tgacatgttagggaaatgtgat

SEQ ID NO: 7229894 - DNA, 22 bp, Homo sapiens
tgacattagaacccaggtgtct

SEQ ID NO: 7229895 - DNA, 22 bp, Homo sapiens
tgacattagaacccaggtgtct

SEQ ID NO: 7229896 - DNA, 22 bp, Homo sapiens
tgacattattatcatgtcacca

SEQ ID NO: 7229897 - DNA, 22 bp, Homo sapiens
tgacatttactattcctggtta

SEQ ID NO: 7229898 - DNA, 22 bp, Homo sapiens
tgacatttactattcctggtta

SEQ ID NO: 7229899 - DNA, 22 bp, Homo sapiens
tgacatttactattcctggtta

SEQ ID NO: 7229900 - DNA, 21 bp, Homo sapiens
tgacatttagtagcattgtca

SEQ ID NO: 7229901 - DNA, 21 bp, Homo sapiens
tgacatttagtagcattgtca

SEQ ID NO: 7229902 - DNA, 21 bp, Homo sapiens
tgacatttagtagcattgtca

SEQ ID NO: 7229903 - DNA, 22 bp, Homo sapiens
tgacatttatcaaagaaatggt

SEQ ID NO: 7229904 - DNA, 22 bp, Homo sapiens
tgacatttatcaaagaaatggt

SEQ ID NO: 7229905 - DNA, 22 bp, Homo sapiens
tgacatttatcaaagaaatggt

SEQ ID NO: 7229906 - DNA, 22 bp, Homo sapiens
tgacatttatcaaagaaatggt

SEQ ID NO: 7229907 - DNA, 22 bp, Homo sapiens
tgacatttatcttctacaatga

SEQ ID NO: 7229908 - DNA, 22 bp, Homo sapiens
tgacatttatcttctacaatga

SEQ ID NO: 7229909 - DNA, 22 bp, Homo sapiens
tgacatttatcttctacaatga

SEQ ID NO: 7229910 - DNA, 22 bp, Homo sapiens
tgacatttatcttctacaatga

SEQ ID NO: 7229911 - DNA, 22 bp, Homo sapiens
tgacatttcagatatggtattt

SEQ ID NO: 7229912 - DNA, 22 bp, Homo sapiens
tgacatttcagatatggtattt

SEQ ID NO: 7229913 - DNA, 22 bp, Homo sapiens
tgacatttcagatatggtattt

SEQ ID NO: 7229914 - DNA, 21 bp, Homo sapiens
tgacatttccaatataaagcc

SEQ ID NO: 7229915 - DNA, 21 bp, Homo sapiens
tgacatttccaatataaagcc

SEQ ID NO: 7229916 - DNA, 21 bp, Homo sapiens
tgacatttccaatataaagcc

SEQ ID NO: 7229917 - DNA, 18 bp, Homo sapiens
tgacatttccagagtgta

SEQ ID NO: 7229918 - DNA, 18 bp, Homo sapiens
tgacatttccagagtgta

SEQ ID NO: 7229919 - DNA, 22 bp, Homo sapiens
tgacagtgacagccaaaggctt

SEQ ID NO: 7229920 - DNA, 22 bp, Homo sapiens
tgacagtgcatgtgacaaagga

SEQ ID NO: 7229921 - DNA, 22 bp, Homo sapiens
tgacatgtaagatggaaaagcg

SEQ ID NO: 7229922 - DNA, 22 bp, Homo sapiens
tgacagtgcgggtacatcatag

SEQ ID NO: 7229923 - DNA, 22 bp, Homo sapiens
tgacatgtaagatggaaaagcg

SEQ ID NO: 7229924 - DNA, 22 bp, Homo sapiens
tgacatgtatatcttacgctat

SEQ ID NO: 7229925 - DNA, 22 bp, Homo sapiens
tgacatgtatgtatttgtttat

SEQ ID NO: 7229926 - DNA, 22 bp, Homo sapiens
tgacatgtatatcttacgctat

SEQ ID NO: 7229927 - DNA, 22 bp, Homo sapiens
tgacatgtatgtatttgtttat

SEQ ID NO: 7229928 - DNA, 22 bp, Homo sapiens
tgacagtctgcagttttaaaaa

SEQ ID NO: 7229929 - DNA, 22 bp, Homo sapiens
tgacagtagtgttagaactgat

SEQ ID NO: 7229930 - DNA, 22 bp, Homo sapiens
tgacaggtgattgtgaactaag

SEQ ID NO: 7229931 - DNA, 22 bp, Homo sapiens
tgacaggtgattgtgaactaag

SEQ ID NO: 7229932 - DNA, 22 bp, Homo sapiens
tgacaggtgattgtgaactaag

SEQ ID NO: 7229933 - DNA, 22 bp, Homo sapiens
tgacaggtgctgggggcagtgt

SEQ ID NO: 7229934 - DNA, 22 bp, Homo sapiens
tgacaggtgctgggggcagtgt

SEQ ID NO: 7229935 - DNA, 22 bp, Homo sapiens
tgacaggttcgttagtcatgtt

SEQ ID NO: 7229936 - DNA, 22 bp, Homo sapiens
tgacaggttcgttagtcatgtt

SEQ ID NO: 7229937 - DNA, 22 bp, Homo sapiens
tgacaggttgtgtaggtggcca

SEQ ID NO: 7229938 - DNA, 21 bp, Homo sapiens
tgacaggtttaggattaaaat

SEQ ID NO: 7229939 - DNA, 22 bp, Homo sapiens
tgacaggttgtgtaggtggcca

SEQ ID NO: 7229940 - DNA, 19 bp, Homo sapiens
tgacaggttttatgtgttt

SEQ ID NO: 7229941 - DNA, 21 bp, Homo sapiens
tgacaggtttaggattaaaat

SEQ ID NO: 7229942 - DNA, 19 bp, Homo sapiens
tgacaggttttatgtgttt

SEQ ID NO: 7229943 - DNA, 19 bp, Homo sapiens
tgacaggttttatgtgttt

SEQ ID NO: 7229944 - DNA, 22 bp, Homo sapiens
tgacagtaattcactgggaccc

SEQ ID NO: 7229945 - DNA, 22 bp, Homo sapiens
tgacagtaccaccaaatctgat

SEQ ID NO: 7229946 - DNA, 22 bp, Homo sapiens
tgacaggtgattgtgaactaag

SEQ ID NO: 7229947 - DNA, 22 bp, Homo sapiens
tgacaggtcatataagcttgca

SEQ ID NO: 7229948 - DNA, 22 bp, Homo sapiens
tgacaggtgaaatgtccttatt

SEQ ID NO: 7229949 - DNA, 22 bp, Homo sapiens
tgacaggtcatataagcttgca

SEQ ID NO: 7229950 - DNA, 22 bp, Homo sapiens
tgacaggtgaaatgtccttatt

SEQ ID NO: 7229951 - DNA, 22 bp, Homo sapiens
tgacagggtgtttgtgagacta

SEQ ID NO: 7229952 - DNA, 21 bp, Homo sapiens
tgacaggtatttatctggaaa

SEQ ID NO: 7229953 - DNA, 21 bp, Homo sapiens
tgacaggtatttatctggaaa

SEQ ID NO: 7229954 - DNA, 22 bp, Homo sapiens
tgacagggtgtttgtgagacta

SEQ ID NO: 7229955 - DNA, 22 bp, Homo sapiens
tgacagggtgattatgagagct

SEQ ID NO: 7229956 - DNA, 22 bp, Homo sapiens
tgacagggtgattatgagagct

SEQ ID NO: 7229957 - DNA, 22 bp, Homo sapiens
tgacagggtgattatgagagct

SEQ ID NO: 7229958 - DNA, 22 bp, Homo sapiens
tgacagggtcagagctgagctg

SEQ ID NO: 7229959 - DNA, 22 bp, Homo sapiens
tgacagggtcagagctgagctg

SEQ ID NO: 7229960 - DNA, 22 bp, Homo sapiens
tgacagggggcagaggtggctg

SEQ ID NO: 7229961 - DNA, 22 bp, Homo sapiens
tgacagggggcagaggtggctg

SEQ ID NO: 7229962 - DNA, 22 bp, Homo sapiens
tgacagggtcagagctgagctg

SEQ ID NO: 7229963 - DNA, 22 bp, Homo sapiens
tgacagggtcagagctgagctg

SEQ ID NO: 7229964 - DNA, 22 bp, Homo sapiens
tgacaggggctggtggataaat

SEQ ID NO: 7229965 - DNA, 22 bp, Homo sapiens
tgacagggggcagaggtggctg

SEQ ID NO: 7229966 - DNA, 22 bp, Homo sapiens
tgacaggggctggtggataaat

SEQ ID NO: 7229967 - DNA, 22 bp, Homo sapiens
tgacagggggcagaggtggctg

SEQ ID NO: 7229968 - DNA, 22 bp, Homo sapiens
tgacagggggcagaggtggctg

SEQ ID NO: 7229969 - DNA, 22 bp, Homo sapiens
tgacagggctgttctgttttag

SEQ ID NO: 7229970 - DNA, 22 bp, Homo sapiens
tgacagggctagaggcaatgca

SEQ ID NO: 7229971 - DNA, 22 bp, Homo sapiens
tgacagggctgttctgttttag

SEQ ID NO: 7229972 - DNA, 22 bp, Homo sapiens
tgacagggcttccctttaatca

SEQ ID NO: 7229973 - DNA, 22 bp, Homo sapiens
tgacagggcttccctttaatca

SEQ ID NO: 7229974 - DNA, 22 bp, Homo sapiens
tgacagggctagaggcaatgca

SEQ ID NO: 7229975 - DNA, 22 bp, Homo sapiens
tgacagggcaggcttactggtt

SEQ ID NO: 7229976 - DNA, 22 bp, Homo sapiens
tgacagggccatgctgcactgc

SEQ ID NO: 7229977 - DNA, 22 bp, Homo sapiens
tgacagggcaggcttactggtt

SEQ ID NO: 7229978 - DNA, 22 bp, Homo sapiens
tgacagggaggtggaataagta

SEQ ID NO: 7229979 - DNA, 22 bp, Homo sapiens
tgacagggcaggcttactggtt

SEQ ID NO: 7229980 - DNA, 22 bp, Homo sapiens
tgacagggacagtggagatgga

SEQ ID NO: 7229981 - DNA, 22 bp, Homo sapiens
tgacagggacagtggagatgga

SEQ ID NO: 7229982 - DNA, 22 bp, Homo sapiens
tgacagcataacactggtcttg

SEQ ID NO: 7229983 - DNA, 22 bp, Homo sapiens
tgacagcataacactggtcttg

SEQ ID NO: 7229984 - DNA, 22 bp, Homo sapiens
tgacagcataacactggtcttg

SEQ ID NO: 7229985 - DNA, 21 bp, Homo sapiens
tgacagcatagagcagggagg

SEQ ID NO: 7229986 - DNA, 21 bp, Homo sapiens
tgacagcatagagcagggagg

SEQ ID NO: 7229987 - DNA, 19 bp, Homo sapiens
tgacagcatgaattaggac

SEQ ID NO: 7229988 - DNA, 22 bp, Homo sapiens
tgacagcatgaccacagggtct

SEQ ID NO: 7229989 - DNA, 22 bp, Homo sapiens
tgacagcatgaccacagggtct

SEQ ID NO: 7229990 - DNA, 22 bp, Homo sapiens
tgacagcagcatagtgagcaat

SEQ ID NO: 7229991 - DNA, 22 bp, Homo sapiens
tgacagcagcatagtgagcaat

SEQ ID NO: 7229992 - DNA, 22 bp, Homo sapiens
tgacagcagccacctctcaccc

SEQ ID NO: 7229993 - DNA, 22 bp, Homo sapiens
tgacagcagccacctctcaccc

SEQ ID NO: 7229994 - DNA, 22 bp, Homo sapiens
tgacagcattactaatacatgt

SEQ ID NO: 7229995 - DNA, 22 bp, Homo sapiens
tgacagcattactaatacatgt

SEQ ID NO: 7229996 - DNA, 22 bp, Homo sapiens
tgacaggaaacatgcagtgatt

SEQ ID NO: 7229997 - DNA, 22 bp, Homo sapiens
tgacaggacagagaaatgacct

SEQ ID NO: 7229998 - DNA, 22 bp, Homo sapiens
tgacaggatgatgagcaggggg

SEQ ID NO: 7229999 - DNA, 22 bp, Homo sapiens
tgacaggatgatgagcaggggg

SEQ ID NO: 7230000 - DNA, 22 bp, Homo sapiens
tgacaggatagtaggaagatct

SEQ ID NO: 7230001 - DNA, 22 bp, Homo sapiens
tgacaggagggttgtggcaggg

SEQ ID NO: 7230002 - DNA, 22 bp, Homo sapiens
tgacaggagtggctagtgggag

SEQ ID NO: 7230003 - DNA, 22 bp, Homo sapiens
tgacaggatgatgagcaggggg

SEQ ID NO: 7230004 - DNA, 22 bp, Homo sapiens
tgacaggattggttgcttctga

SEQ ID NO: 7230005 - DNA, 22 bp, Homo sapiens
tgacaggattggttgcttctga

SEQ ID NO: 7230006 - DNA, 22 bp, Homo sapiens
tgacaggattggttgcttctga

SEQ ID NO: 7230007 - DNA, 21 bp, Homo sapiens
tgacaggcaccctggctgtga

SEQ ID NO: 7230008 - DNA, 21 bp, Homo sapiens
tgacaggcaccctggctgtga

SEQ ID NO: 7230009 - DNA, 22 bp, Homo sapiens
tgacaggcactgctgtagtgct

SEQ ID NO: 7230010 - DNA, 22 bp, Homo sapiens
tgacaggcaggacagaggtgtg

SEQ ID NO: 7230011 - DNA, 22 bp, Homo sapiens
tgacagggacagtggagatgga

SEQ ID NO: 7230012 - DNA, 22 bp, Homo sapiens
tgacagggaaaggtcctctttt

SEQ ID NO: 7230013 - DNA, 22 bp, Homo sapiens
tgacagggacagtggagatgga

SEQ ID NO: 7230014 - DNA, 22 bp, Homo sapiens
tgacagggacagtggagatgga

SEQ ID NO: 7230015 - DNA, 19 bp, Homo sapiens
tgacaggctgttgccttga

SEQ ID NO: 7230016 - DNA, 22 bp, Homo sapiens
tgacaggcttgctaagacatag

SEQ ID NO: 7230017 - DNA, 22 bp, Homo sapiens
tgacaggcttgctaagacatag

SEQ ID NO: 7230018 - DNA, 22 bp, Homo sapiens
tgacaggcagtgctgggcatgt

SEQ ID NO: 7230019 - DNA, 23 bp, Homo sapiens
tgacaggccagaagagcagctgg

SEQ ID NO: 7230020 - DNA, 23 bp, Homo sapiens
tgacaggccagaagagcagctgg

SEQ ID NO: 7230021 - DNA, 23 bp, Homo sapiens
tgacaggctgcttctggctgagg

SEQ ID NO: 7230022 - DNA, 22 bp, Homo sapiens
tgacacatgtgcttgtgggtag

SEQ ID NO: 7230023 - DNA, 22 bp, Homo sapiens
tgacacattaaatgctcacaaa

SEQ ID NO: 7230024 - DNA, 22 bp, Homo sapiens
tgacacattaaatgctcacaaa

SEQ ID NO: 7230025 - DNA, 22 bp, Homo sapiens
tgacacccatctgtgccagtcc

SEQ ID NO: 7230026 - DNA, 22 bp, Homo sapiens
tgacacagtgggggatcctttt

SEQ ID NO: 7230027 - DNA, 22 bp, Homo sapiens
tgacacagtatcaaacatgatt

SEQ ID NO: 7230028 - DNA, 22 bp, Homo sapiens
tgacacagtatcaaacatgatt

SEQ ID NO: 7230029 - DNA, 22 bp, Homo sapiens
tgacacagttgtcgactctaca

SEQ ID NO: 7230030 - DNA, 22 bp, Homo sapiens
tgacacataccgaaaatatttg

SEQ ID NO: 7230031 - DNA, 22 bp, Homo sapiens
tgacacataccgaaaatatttg

SEQ ID NO: 7230032 - DNA, 22 bp, Homo sapiens
tgacacataccgaaaatatttg

SEQ ID NO: 7230033 - DNA, 22 bp, Homo sapiens
tgacacatgcaccagtctttaa

SEQ ID NO: 7230034 - DNA, 22 bp, Homo sapiens
tgacacatgcaccagtctttaa

SEQ ID NO: 7230035 - DNA, 22 bp, Homo sapiens
tgacacaggtcaaatctacttt

SEQ ID NO: 7230036 - DNA, 22 bp, Homo sapiens
tgacacagggcatgcagcagaa

SEQ ID NO: 7230037 - DNA, 22 bp, Homo sapiens
tgacacaggggaaggagtctgg

SEQ ID NO: 7230038 - DNA, 22 bp, Homo sapiens
tgacacagggcatgcagcagaa

SEQ ID NO: 7230039 - DNA, 22 bp, Homo sapiens
tgacacagggcatgcagcagaa

SEQ ID NO: 7230040 - DNA, 22 bp, Homo sapiens
tgacacagattagagacatacc

SEQ ID NO: 7230041 - DNA, 22 bp, Homo sapiens
tgacacagattagagacatacc

SEQ ID NO: 7230042 - DNA, 22 bp, Homo sapiens
tgacacagattagagacatacc

SEQ ID NO: 7230043 - DNA, 22 bp, Homo sapiens
tgacacacagggggatggagtt

SEQ ID NO: 7230044 - DNA, 22 bp, Homo sapiens
tgacacacagggggatggagtt

SEQ ID NO: 7230045 - DNA, 23 bp, Homo sapiens
tgacagaccttcccagacagtca

SEQ ID NO: 7230046 - DNA, 22 bp, Homo sapiens
tgacagaccactgcaactctgt

SEQ ID NO: 7230047 - DNA, 23 bp, Homo sapiens
tgacagaccttcccagacagtca

SEQ ID NO: 7230048 - DNA, 23 bp, Homo sapiens
tgacagaccttcccagacagtca

SEQ ID NO: 7230049 - DNA, 22 bp, Homo sapiens
tgacagactactgcctctattg

SEQ ID NO: 7230050 - DNA, 22 bp, Homo sapiens
tgacagagttcggattgagttt

SEQ ID NO: 7230051 - DNA, 22 bp, Homo sapiens
tgacagattttgatggctaata

SEQ ID NO: 7230052 - DNA, 22 bp, Homo sapiens
tgacagattttttctgagctaa

SEQ ID NO: 7230053 - DNA, 21 bp, Homo sapiens
tgacagcacatgcaatcggag

SEQ ID NO: 7230054 - DNA, 22 bp, Homo sapiens
tgacagcagcatagtgagcaat

SEQ ID NO: 7230055 - DNA, 17 bp, Homo sapiens
tgacagacatcatgagc

SEQ ID NO: 7230056 - DNA, 22 bp, Homo sapiens
tgacagacatggaagccagagt

SEQ ID NO: 7230057 - DNA, 22 bp, Homo sapiens
tgacagaatgtgactctcagat

SEQ ID NO: 7230058 - DNA, 22 bp, Homo sapiens
tgacagacacaccttaggaaag

SEQ ID NO: 7230059 - DNA, 22 bp, Homo sapiens
tgacagacagcttctcatttta

SEQ ID NO: 7230060 - DNA, 22 bp, Homo sapiens
tgacagacagcttctcatttta

SEQ ID NO: 7230061 - DNA, 18 bp, Homo sapiens
tgacagaacctggagcct

SEQ ID NO: 7230062 - DNA, 18 bp, Homo sapiens
tgacagaacctggagcct

SEQ ID NO: 7230063 - DNA, 22 bp, Homo sapiens
tgacagaactcattctcaccaa

SEQ ID NO: 7230064 - DNA, 22 bp, Homo sapiens
tgacagaactcattctcaccaa

SEQ ID NO: 7230065 - DNA, 22 bp, Homo sapiens
tgacagaactttttcacatctc

SEQ ID NO: 7230066 - DNA, 22 bp, Homo sapiens
tgacagaactttttcacatctc

SEQ ID NO: 7230067 - DNA, 22 bp, Homo sapiens
tgacagaatgtgactctcagat

SEQ ID NO: 7230068 - DNA, 22 bp, Homo sapiens
tgacagaatgtgactctcagat

SEQ ID NO: 7230069 - DNA, 22 bp, Homo sapiens
tgacagaaagagtattaaagat

SEQ ID NO: 7230070 - DNA, 16 bp, Homo sapiens
tgacagaaagatctat

SEQ ID NO: 7230071 - DNA, 22 bp, Homo sapiens
tgacagaaatagttcttaattt

SEQ ID NO: 7230072 - DNA, 22 bp, Homo sapiens
tgacacttgggctttgagaggt

SEQ ID NO: 7230073 - DNA, 22 bp, Homo sapiens
tgacagaaaaatgtagctccat

SEQ ID NO: 7230074 - DNA, 22 bp, Homo sapiens
tgacagaaaaatgtagctccat

SEQ ID NO: 7230075 - DNA, 22 bp, Homo sapiens
tgacagaaagaatatgtcaatc

SEQ ID NO: 7230076 - DNA, 22 bp, Homo sapiens
tgacagaaagaatatgtcaatc

SEQ ID NO: 7230077 - DNA, 22 bp, Homo sapiens
tgacactgacctaaagacctgg

SEQ ID NO: 7230078 - DNA, 22 bp, Homo sapiens
tgacactgcaaatataaatatt

SEQ ID NO: 7230079 - DNA, 22 bp, Homo sapiens
tgacactgcatatattgaagtt

SEQ ID NO: 7230080 - DNA, 22 bp, Homo sapiens
tgacactgccgaaactgtagag

SEQ ID NO: 7230081 - DNA, 22 bp, Homo sapiens
tgacactgccgaaactgtagag

SEQ ID NO: 7230082 - DNA, 22 bp, Homo sapiens
tgacactgccgaaactgtagag

SEQ ID NO: 7230083 - DNA, 22 bp, Homo sapiens
tgacacttccggtaaaaaatgc

SEQ ID NO: 7230084 - DNA, 20 bp, Homo sapiens
tgacacttgatattgtcagt

SEQ ID NO: 7230085 - DNA, 22 bp, Homo sapiens
tgacacttgggctttgagaggt

SEQ ID NO: 7230086 - DNA, 22 bp, Homo sapiens
tgaagcagttctcagaagtggg

SEQ ID NO: 7230087 - DNA, 22 bp, Homo sapiens
tgaagcagttactgggtgttaa

SEQ ID NO: 7230088 - DNA, 22 bp, Homo sapiens
tgaagcagttctcagaagtggg

SEQ ID NO: 7230089 - DNA, 22 bp, Homo sapiens
tgaagcagttactgggtgttaa

SEQ ID NO: 7230090 - DNA, 22 bp, Homo sapiens
tgaagcagggtggccagattgt

SEQ ID NO: 7230091 - DNA, 22 bp, Homo sapiens
tgaagcaggtgaatggatgtcg

SEQ ID NO: 7230092 - DNA, 22 bp, Homo sapiens
tgaagcaggtgaatggatgtcg

SEQ ID NO: 7230093 - DNA, 19 bp, Homo sapiens
tgaagcaggcagagaagat

SEQ ID NO: 7230094 - DNA, 22 bp, Homo sapiens
tgaagcaggatcgtttgcttca

SEQ ID NO: 7230095 - DNA, 22 bp, Homo sapiens
tgaagcaggaaccagcagcatt

SEQ ID NO: 7230096 - DNA, 22 bp, Homo sapiens
tgaagcaggaaccagcagcatt

SEQ ID NO: 7230097 - DNA, 19 bp, Homo sapiens
tgaagcaggcagagaagat

SEQ ID NO: 7230098 - DNA, 19 bp, Homo sapiens
tgaagcaggcagagaagat

SEQ ID NO: 7230099 - DNA, 19 bp, Homo sapiens
tgaagcaggcagagaagat

SEQ ID NO: 7230100 - DNA, 22 bp, Homo sapiens
tgaagcaggcattgactgatga

SEQ ID NO: 7230101 - DNA, 22 bp, Homo sapiens
tgaagcaggcattgactgatga

SEQ ID NO: 7230102 - DNA, 22 bp, Homo sapiens
tgaagcaggcattgactgatga

SEQ ID NO: 7230103 - DNA, 22 bp, Homo sapiens
tgaagcagatggtctggtcatt

SEQ ID NO: 7230104 - DNA, 22 bp, Homo sapiens
tgaagcagatggtctggtcatt

SEQ ID NO: 7230105 - DNA, 22 bp, Homo sapiens
tgaagcagcaaatgatgggaga

SEQ ID NO: 7230106 - DNA, 22 bp, Homo sapiens
tgaagcagcaaatgatgggaga

SEQ ID NO: 7230107 - DNA, 22 bp, Homo sapiens
tgaagcagcaaatgatgggaga

SEQ ID NO: 7230108 - DNA, 22 bp, Homo sapiens
tgaagcagcaccattttagagc

SEQ ID NO: 7230109 - DNA, 22 bp, Homo sapiens
tgaagcagcaccattttagagc

SEQ ID NO: 7230110 - DNA, 20 bp, Homo sapiens
tgaagcagccttgattctgt

SEQ ID NO: 7230111 - DNA, 20 bp, Homo sapiens
tgaagcagccttgattctgt

SEQ ID NO: 7230112 - DNA, 20 bp, Homo sapiens
tgaagcagccttgattctgt

SEQ ID NO: 7230113 - DNA, 22 bp, Homo sapiens
tgaagcagcttctttctgtcaa

SEQ ID NO: 7230114 - DNA, 22 bp, Homo sapiens
tgaagcagcttctttctgtcaa

SEQ ID NO: 7230115 - DNA, 22 bp, Homo sapiens
tgaagcaggaaacttcttgttt

SEQ ID NO: 7230116 - DNA, 22 bp, Homo sapiens
tgaagcaggaaacttcttgttt

SEQ ID NO: 7230117 - DNA, 22 bp, Homo sapiens
tgaagcaggaaacttcttgttt

SEQ ID NO: 7230118 - DNA, 22 bp, Homo sapiens
tgaagagaagaaaattatcttt

SEQ ID NO: 7230119 - DNA, 20 bp, Homo sapiens
tgaagattttgtgtttagaa

SEQ ID NO: 7230120 - DNA, 20 bp, Homo sapiens
tgaagattttgtgtttagaa

SEQ ID NO: 7230121 - DNA, 22 bp, Homo sapiens
tgaagcaaacgcttctgttcct

SEQ ID NO: 7230122 - DNA, 22 bp, Homo sapiens
tgaagcaaattgtttagcctga

SEQ ID NO: 7230123 - DNA, 22 bp, Homo sapiens
tgaagcaactggacaagttggc

SEQ ID NO: 7230124 - DNA, 22 bp, Homo sapiens
tgaagcaatagagacaagacca

SEQ ID NO: 7230125 - DNA, 22 bp, Homo sapiens
tgaagcaatagagacaagacca

SEQ ID NO: 7230126 - DNA, 22 bp, Homo sapiens
tgaagcaatgatagcagaatga

SEQ ID NO: 7230127 - DNA, 22 bp, Homo sapiens
tgaagcaatgatcttttggtgg

SEQ ID NO: 7230128 - DNA, 22 bp, Homo sapiens
tgaagcacaggcatacacaacc

SEQ ID NO: 7230129 - DNA, 22 bp, Homo sapiens
tgaagcagagaatttgacagtc

SEQ ID NO: 7230130 - DNA, 22 bp, Homo sapiens
tgaagcagaggggtcttgagct

SEQ ID NO: 7230131 - DNA, 22 bp, Homo sapiens
tgaagcagaggggtcttgagct

SEQ ID NO: 7230132 - DNA, 22 bp, Homo sapiens
tgaagcagagtgaaggtgaatt

SEQ ID NO: 7230133 - DNA, 22 bp, Homo sapiens
tgaagcagagtgaaggtgaatt

SEQ ID NO: 7230134 - DNA, 22 bp, Homo sapiens
tgaagactcagaagctaagata

SEQ ID NO: 7230135 - DNA, 22 bp, Homo sapiens
tgaagactcagaagctaagata

SEQ ID NO: 7230136 - DNA, 22 bp, Homo sapiens
tgaagactcagaagctaagata

SEQ ID NO: 7230137 - DNA, 22 bp, Homo sapiens
tgaagactcagaagctaagata

SEQ ID NO: 7230138 - DNA, 22 bp, Homo sapiens
tgaagactcagaagctaagata

SEQ ID NO: 7230139 - DNA, 22 bp, Homo sapiens
tgaagactcagaagctaagata

SEQ ID NO: 7230140 - DNA, 22 bp, Homo sapiens
tgaagacagaccaaggagaatg

SEQ ID NO: 7230141 - DNA, 22 bp, Homo sapiens
tgaagacagaccaaggagaatg

SEQ ID NO: 7230142 - DNA, 22 bp, Homo sapiens
tgaagacagggtctttaacgag

SEQ ID NO: 7230143 - DNA, 22 bp, Homo sapiens
tgaagacagggtctttaacgag

SEQ ID NO: 7230144 - DNA, 22 bp, Homo sapiens
tgaagacagttttactcatgag

SEQ ID NO: 7230145 - DNA, 22 bp, Homo sapiens
tgaagacagttttactcatgag

SEQ ID NO: 7230146 - DNA, 15 bp, Homo sapiens
tgaagacataaggtg

SEQ ID NO: 7230147 - DNA, 18 bp, Homo sapiens
tgaagacatgaggttagt

SEQ ID NO: 7230148 - DNA, 22 bp, Homo sapiens
tgaagacaagtgtgctggtgtt

SEQ ID NO: 7230149 - DNA, 22 bp, Homo sapiens
tgaagacaagtgtgctggtgtt

SEQ ID NO: 7230150 - DNA, 22 bp, Homo sapiens
tgaagacacatacaagggaatg

SEQ ID NO: 7230151 - DNA, 22 bp, Homo sapiens
tgaagacacatacaagggaatg

SEQ ID NO: 7230152 - DNA, 22 bp, Homo sapiens
tgaagacacatacaagggaatg

SEQ ID NO: 7230153 - DNA, 22 bp, Homo sapiens
tgaagacacatacaagggaatg

SEQ ID NO: 7230154 - DNA, 22 bp, Homo sapiens
tgaagacacatacaagggaatg

SEQ ID NO: 7230155 - DNA, 22 bp, Homo sapiens
tgaagacagaccaaggagaatg

SEQ ID NO: 7230156 - DNA, 22 bp, Homo sapiens
tgaagacagaccaaggagaatg

SEQ ID NO: 7230157 - DNA, 22 bp, Homo sapiens
tgaagaatgttgcagtgagcat

SEQ ID NO: 7230158 - DNA, 22 bp, Homo sapiens
tgaagacaaagtcaggcccaga

SEQ ID NO: 7230159 - DNA, 22 bp, Homo sapiens
tgaagacaaagtcaggcccaga

SEQ ID NO: 7230160 - DNA, 22 bp, Homo sapiens
tgaagacaaagtcaggcccaga

SEQ ID NO: 7230161 - DNA, 22 bp, Homo sapiens
tgaagacaaagtcaggcccaga

SEQ ID NO: 7230162 - DNA, 22 bp, Homo sapiens
tgaagacaagaaaacactgggg

SEQ ID NO: 7230163 - DNA, 22 bp, Homo sapiens
tgaagacaagaaaacactgggg

SEQ ID NO: 7230164 - DNA, 22 bp, Homo sapiens
tgaagaagccaattggtaggct

SEQ ID NO: 7230165 - DNA, 22 bp, Homo sapiens
tgaagaagccaattggtaggct

SEQ ID NO: 7230166 - DNA, 22 bp, Homo sapiens
tgaagaacctgatgagctgtgt

SEQ ID NO: 7230167 - DNA, 22 bp, Homo sapiens
tgaagaacgtgagatccagaaa

SEQ ID NO: 7230168 - DNA, 22 bp, Homo sapiens
tgaagaaacgcagagaggtagg

SEQ ID NO: 7230169 - DNA, 22 bp, Homo sapiens
tgaagaaacgcagagaggtagg

SEQ ID NO: 7230170 - DNA, 22 bp, Homo sapiens
tgaagaaacgcagagaggtagg

SEQ ID NO: 7230171 - DNA, 22 bp, Homo sapiens
tgaagaaaggtgtgggatactc

SEQ ID NO: 7230172 - DNA, 22 bp, Homo sapiens
tgaagaaaggtgtgggatactc

SEQ ID NO: 7230173 - DNA, 22 bp, Homo sapiens
tgaacttttgcacagaggattt

SEQ ID NO: 7230174 - DNA, 22 bp, Homo sapiens
tgaagaaaatatgattacccca

SEQ ID NO: 7230175 - DNA, 22 bp, Homo sapiens
tgaagaaacagaccaagaggat

SEQ ID NO: 7230176 - DNA, 22 bp, Homo sapiens
tgaagaaacagaccaagaggat

SEQ ID NO: 7230177 - DNA, 22 bp, Homo sapiens
tgaagaaacagaccaagaggat

SEQ ID NO: 7230178 - DNA, 22 bp, Homo sapiens
tgaagaaacagaccaagaggat

SEQ ID NO: 7230179 - DNA, 22 bp, Homo sapiens
tgaagaaacgcagagaggtagg

SEQ ID NO: 7230180 - DNA, 22 bp, Homo sapiens
tgaagaaacgcagagaggtagg

SEQ ID NO: 7230181 - DNA, 22 bp, Homo sapiens
tgaagaaacgcagagaggtagg

SEQ ID NO: 7230182 - DNA, 22 bp, Homo sapiens
tgaactctccaggcaaatgatc

SEQ ID NO: 7230183 - DNA, 22 bp, Homo sapiens
tgaactctcccccattgccctc

SEQ ID NO: 7230184 - DNA, 22 bp, Homo sapiens
tgaactctccaggcaaatgatc

SEQ ID NO: 7230185 - DNA, 22 bp, Homo sapiens
tgaactctctcaagtgacagaa

SEQ ID NO: 7230186 - DNA, 22 bp, Homo sapiens
tgaactcctgacctcatgatcc

SEQ ID NO: 7230187 - DNA, 22 bp, Homo sapiens
tgaactctaatggtgcttttct

SEQ ID NO: 7230188 - DNA, 22 bp, Homo sapiens
tgaacgcaggtccacatggctc

SEQ ID NO: 7230189 - DNA, 22 bp, Homo sapiens
tgaactaatgaggaaatggtct

SEQ ID NO: 7230190 - DNA, 22 bp, Homo sapiens
tgaactcatactaaaaaatatt

SEQ ID NO: 7230191 - DNA, 22 bp, Homo sapiens
tgaactcctgacctcatgatcc

SEQ ID NO: 7230192 - DNA, 22 bp, Homo sapiens
tgaactccaaatactgctgatt

SEQ ID NO: 7230193 - DNA, 21 bp, Homo sapiens
tgaactctggtcatcttcatt

SEQ ID NO: 7230194 - DNA, 22 bp, Homo sapiens
tgaactgcaggaatctcagtgg

SEQ ID NO: 7230195 - DNA, 22 bp, Homo sapiens
tgaactgcaggaatctcagtgg

SEQ ID NO: 7230196 - DNA, 22 bp, Homo sapiens
tgaactgtacatccctaaccta

SEQ ID NO: 7230197 - DNA, 18 bp, Homo sapiens
tgaactggcatcagaatc

SEQ ID NO: 7230198 - DNA, 22 bp, Homo sapiens
tgaactgtggccagtaattaat

SEQ ID NO: 7230199 - DNA, 22 bp, Homo sapiens
tgaacttacaaattaaaagact

SEQ ID NO: 7230200 - DNA, 22 bp, Homo sapiens
tgaacttgaattttggaaatac

SEQ ID NO: 7230201 - DNA, 17 bp, Homo sapiens
tgaactttaggtggagc

SEQ ID NO: 7230202 - DNA, 18 bp, Homo sapiens
tgaactttggtgtctctc

SEQ ID NO: 7230203 - DNA, 22 bp, Homo sapiens
tgaacatattcacctctaaata

SEQ ID NO: 7230204 - DNA, 22 bp, Homo sapiens
tgaacatgctgttgatggcctg

SEQ ID NO: 7230205 - DNA, 22 bp, Homo sapiens
tgaacattagttgagtaaagtc

SEQ ID NO: 7230206 - DNA, 22 bp, Homo sapiens
tgaacattagttgagtaaagtc

SEQ ID NO: 7230207 - DNA, 22 bp, Homo sapiens
tgaacattcctgaatgaagcat

SEQ ID NO: 7230208 - DNA, 22 bp, Homo sapiens
tgaacattggcacaaggcagca

SEQ ID NO: 7230209 - DNA, 22 bp, Homo sapiens
tgaacattgtcacattcctagc

SEQ ID NO: 7230210 - DNA, 22 bp, Homo sapiens
tgaaccagagtctccagtggtt

SEQ ID NO: 7230211 - DNA, 22 bp, Homo sapiens
tgaaccaggaggcagccagcac

SEQ ID NO: 7230212 - DNA, 22 bp, Homo sapiens
tgaaccaggcacatttcctaca

SEQ ID NO: 7230213 - DNA, 21 bp, Homo sapiens
tgaacccagagctcatgacca

SEQ ID NO: 7230214 - DNA, 22 bp, Homo sapiens
tgaaccctgacctctggaagga

SEQ ID NO: 7230215 - DNA, 22 bp, Homo sapiens
tgaaccttttgaataaggacca

SEQ ID NO: 7230216 - DNA, 22 bp, Homo sapiens
tgaacatacaattattaagaac

SEQ ID NO: 7230217 - DNA, 22 bp, Homo sapiens
tgaacatacaattattaagaac

SEQ ID NO: 7230218 - DNA, 22 bp, Homo sapiens
tgaacagtttcaagaaaacttt

SEQ ID NO: 7230219 - DNA, 22 bp, Homo sapiens
tgaacagtgtatctagatcatg

SEQ ID NO: 7230220 - DNA, 22 bp, Homo sapiens
tgaacagtgtgagggtgtgacc

SEQ ID NO: 7230221 - DNA, 22 bp, Homo sapiens
tgaacagttactttgtagaaga

SEQ ID NO: 7230222 - DNA, 22 bp, Homo sapiens
tgaacacacacctatgtacaaa

SEQ ID NO: 7230223 - DNA, 22 bp, Homo sapiens
tgaacagtgatctacatgtggc

SEQ ID NO: 7230224 - DNA, 22 bp, Homo sapiens
tgaacagtgggcatgtgaagac

SEQ ID NO: 7230225 - DNA, 22 bp, Homo sapiens
tgaacagtggttcatgtcacgg

SEQ ID NO: 7230226 - DNA, 22 bp, Homo sapiens
tgaacacaaatattttggggtt

SEQ ID NO: 7230227 - DNA, 22 bp, Homo sapiens
tgaacacacacatcttaataat

SEQ ID NO: 7230228 - DNA, 22 bp, Homo sapiens
tgaacacacacatcttaataat

SEQ ID NO: 7230229 - DNA, 22 bp, Homo sapiens
tgaacacacacatcttaataat

SEQ ID NO: 7230230 - DNA, 22 bp, Homo sapiens
tgaacaactgcaaaaatctcca

SEQ ID NO: 7230231 - DNA, 21 bp, Homo sapiens
tgaacaaagttcttatcgtga

SEQ ID NO: 7230232 - DNA, 22 bp, Homo sapiens
tgaacaaatgaatcagtgtagc

SEQ ID NO: 7230233 - DNA, 22 bp, Homo sapiens
tgaacaaatgaatcagtgtagc

SEQ ID NO: 7230234 - DNA, 22 bp, Homo sapiens
tgaacaaatggaaataaccagt

SEQ ID NO: 7230235 - DNA, 23 bp, Homo sapiens
tgaacaaaggcaggagaaggcgg

SEQ ID NO: 7230236 - DNA, 23 bp, Homo sapiens
tgaacaaaggcaggagaaggcgg

SEQ ID NO: 7230237 - DNA, 22 bp, Homo sapiens
tgaacaaactgcattcttcact

SEQ ID NO: 7230238 - DNA, 22 bp, Homo sapiens
tgaaattcattgttttatgtgt

SEQ ID NO: 7230239 - DNA, 22 bp, Homo sapiens
tgaaattcattgttttatgtgt

SEQ ID NO: 7230240 - DNA, 22 bp, Homo sapiens
tgaaattccaggagagttaaaa

SEQ ID NO: 7230241 - DNA, 18 bp, Homo sapiens
tgaaattgcatccatgag

SEQ ID NO: 7230242 - DNA, 23 bp, Homo sapiens
tgaaattgtagagattttgtgtg

SEQ ID NO: 7230243 - DNA, 22 bp, Homo sapiens
tgaaattatgcattgttgtacc

SEQ ID NO: 7230244 - DNA, 22 bp, Homo sapiens
tgaaattattcttaccaaggtg

SEQ ID NO: 7230245 - DNA, 22 bp, Homo sapiens
tgaaattattcttaccaaggtg

SEQ ID NO: 7230246 - DNA, 22 bp, Homo sapiens
tgaaattcaaaacacatttgtc

SEQ ID NO: 7230247 - DNA, 22 bp, Homo sapiens
tgaaattatgcattgttgtacc

SEQ ID NO: 7230248 - DNA, 22 bp, Homo sapiens
tgaaattatgcattgttgtacc

SEQ ID NO: 7230249 - DNA, 22 bp, Homo sapiens
tgaaattagtgaagttacagtt

SEQ ID NO: 7230250 - DNA, 22 bp, Homo sapiens
tgaaattagaaatatgtatggg

SEQ ID NO: 7230251 - DNA, 22 bp, Homo sapiens
tgaaattagtgaagttacagtt

SEQ ID NO: 7230252 - DNA, 22 bp, Homo sapiens
tgaaattatgcattgttgtacc

SEQ ID NO: 7230253 - DNA, 22 bp, Homo sapiens
tgaaatgttggtaattttatat

SEQ ID NO: 7230254 - DNA, 22 bp, Homo sapiens
tgaaatgttggtaattttatat

SEQ ID NO: 7230255 - DNA, 22 bp, Homo sapiens
tgaaatgttggtaattttatat

SEQ ID NO: 7230256 - DNA, 22 bp, Homo sapiens
tgaaatgttggtaattttatat

SEQ ID NO: 7230257 - DNA, 22 bp, Homo sapiens
tgaaatgtttaggaccactaga

SEQ ID NO: 7230258 - DNA, 22 bp, Homo sapiens
tgaaatgtttatctctcctgct

SEQ ID NO: 7230259 - DNA, 22 bp, Homo sapiens
tgaaatgtttgaagaccactga

SEQ ID NO: 7230260 - DNA, 22 bp, Homo sapiens
tgaaatgtttgtatataaggtc

SEQ ID NO: 7230261 - DNA, 22 bp, Homo sapiens
tgaaattagaaatatgtatggg

SEQ ID NO: 7230262 - DNA, 22 bp, Homo sapiens
tgaaattagaaatatgtatggg

SEQ ID NO: 7230263 - DNA, 22 bp, Homo sapiens
tgaaatgtgttctagtgttttg

SEQ ID NO: 7230264 - DNA, 22 bp, Homo sapiens
tgaaatgtgttctagtgttttg

SEQ ID NO: 7230265 - DNA, 22 bp, Homo sapiens
tgaaatgtgttctagtgttttg

SEQ ID NO: 7230266 - DNA, 22 bp, Homo sapiens
tgaaatgtgttctagtgttttg

SEQ ID NO: 7230267 - DNA, 22 bp, Homo sapiens
tgaaatgttaatcacacaaagg

SEQ ID NO: 7230268 - DNA, 22 bp, Homo sapiens
tgaaatgttctggagtttctgt

SEQ ID NO: 7230269 - DNA, 22 bp, Homo sapiens
tgaaatgttctggagtttctgt

SEQ ID NO: 7230270 - DNA, 22 bp, Homo sapiens
tgaaatgttctggagtttctgt

SEQ ID NO: 7230271 - DNA, 22 bp, Homo sapiens
tgaaatgttgccatgaggtctc

SEQ ID NO: 7230272 - DNA, 22 bp, Homo sapiens
tgaaatgttggcatcggtacct

SEQ ID NO: 7230273 - DNA, 22 bp, Homo sapiens
tgaaatgtgtccatgttatttc

SEQ ID NO: 7230274 - DNA, 22 bp, Homo sapiens
tgaaatgtgtccatgttatttc

SEQ ID NO: 7230275 - DNA, 22 bp, Homo sapiens
tgaaatgtctttgcaattgaaa

SEQ ID NO: 7230276 - DNA, 22 bp, Homo sapiens
tgaaatgtctttgcaattgaaa

SEQ ID NO: 7230277 - DNA, 22 bp, Homo sapiens
tgaaatgtctttgcaattgaaa

SEQ ID NO: 7230278 - DNA, 22 bp, Homo sapiens
tgaaatgtgatctgagcttggc

SEQ ID NO: 7230279 - DNA, 22 bp, Homo sapiens
tgaaatgtcagtgttttataag

SEQ ID NO: 7230280 - DNA, 22 bp, Homo sapiens
tgaaatgtcagtgttttataag

SEQ ID NO: 7230281 - DNA, 22 bp, Homo sapiens
tgaaatgtcagtgttttataag

SEQ ID NO: 7230282 - DNA, 22 bp, Homo sapiens
tgaaatgtcatcctttagccat

SEQ ID NO: 7230283 - DNA, 22 bp, Homo sapiens
tgaaatgtctcacttagacttt

SEQ ID NO: 7230284 - DNA, 22 bp, Homo sapiens
tgaaatgtctcacttagacttt

SEQ ID NO: 7230285 - DNA, 23 bp, Homo sapiens
tgaaatgtagaggaattccacct

SEQ ID NO: 7230286 - DNA, 22 bp, Homo sapiens
tgaaatgtagattaggcattct

SEQ ID NO: 7230287 - DNA, 22 bp, Homo sapiens
tgaaatgctgtagagactgtat

SEQ ID NO: 7230288 - DNA, 22 bp, Homo sapiens
tgaaatgcctatgaagtcagga

SEQ ID NO: 7230289 - DNA, 22 bp, Homo sapiens
tgaaatgcttaggaccagaagg

SEQ ID NO: 7230290 - DNA, 22 bp, Homo sapiens
tgaaatgcttctctgaaaatac

SEQ ID NO: 7230291 - DNA, 22 bp, Homo sapiens
tgaaatgcttctctgaaaatac

SEQ ID NO: 7230292 - DNA, 22 bp, Homo sapiens
tgaaatcttcactaagtctctt

SEQ ID NO: 7230293 - DNA, 22 bp, Homo sapiens
tgaaatctttagtttctgtccc

SEQ ID NO: 7230294 - DNA, 22 bp, Homo sapiens
tgaaatgaaacagaacatatca

SEQ ID NO: 7230295 - DNA, 22 bp, Homo sapiens
tgaaatgcttgggaccagaagt

SEQ ID NO: 7230296 - DNA, 22 bp, Homo sapiens
tgaaatggaattaatttgtatt

SEQ ID NO: 7230297 - DNA, 22 bp, Homo sapiens
tgaaatggaattaatttgtatt

SEQ ID NO: 7230298 - DNA, 22 bp, Homo sapiens
tgaaatggatgagagcagaggt

SEQ ID NO: 7230299 - DNA, 22 bp, Homo sapiens
tgaaatggaggttttttctctc

SEQ ID NO: 7230300 - DNA, 22 bp, Homo sapiens
tgaaatggattgaagtggctta

SEQ ID NO: 7230301 - DNA, 22 bp, Homo sapiens
tgaaatggcaaggcagagcttt

SEQ ID NO: 7230302 - DNA, 19 bp, Homo sapiens
tgaaatggcagttgctaaa

SEQ ID NO: 7230303 - DNA, 22 bp, Homo sapiens
tgaaatggcccaaacacccagt

SEQ ID NO: 7230304 - DNA, 22 bp, Homo sapiens
tgaaatggtattctttttcaat

SEQ ID NO: 7230305 - DNA, 22 bp, Homo sapiens
tgaaatggtattctttttcaat

SEQ ID NO: 7230306 - DNA, 22 bp, Homo sapiens
tgaaatggtattctttttcaat

SEQ ID NO: 7230307 - DNA, 22 bp, Homo sapiens
tgaaatgtaagcatagaggttg

SEQ ID NO: 7230308 - DNA, 22 bp, Homo sapiens
tgaaatgtacaagtgctttttt

SEQ ID NO: 7230309 - DNA, 22 bp, Homo sapiens
tgaaatgtacaagtgctttttt

SEQ ID NO: 7230310 - DNA, 22 bp, Homo sapiens
tgaaatgtacaagtgctttttt

SEQ ID NO: 7230311 - DNA, 22 bp, Homo sapiens
tgaaatgtacataaaaacgcac

SEQ ID NO: 7230312 - DNA, 22 bp, Homo sapiens
tgaaatcttagccattctgcct

SEQ ID NO: 7230313 - DNA, 22 bp, Homo sapiens
tgaaatctgcatgcaaagtcct

SEQ ID NO: 7230314 - DNA, 22 bp, Homo sapiens
tgaaatcattggggttgaataa

SEQ ID NO: 7230315 - DNA, 22 bp, Homo sapiens
tgaaatcattgccaagtattga

SEQ ID NO: 7230316 - DNA, 22 bp, Homo sapiens
tgaaatctaccctattcagggt

SEQ ID NO: 7230317 - DNA, 22 bp, Homo sapiens
tgaaatctcctctttatatatc

SEQ ID NO: 7230318 - DNA, 22 bp, Homo sapiens
tgaaatcatgtagttattgcaa

SEQ ID NO: 7230319 - DNA, 22 bp, Homo sapiens
tgaaatcatgtagttattgcaa

SEQ ID NO: 7230320 - DNA, 22 bp, Homo sapiens
tgaaatcatgtagttattgcaa

SEQ ID NO: 7230321 - DNA, 22 bp, Homo sapiens
tgaaatcatgagatagtgtcac

SEQ ID NO: 7230322 - DNA, 22 bp, Homo sapiens
tgaaatcatgagatagtgtcac

SEQ ID NO: 7230323 - DNA, 22 bp, Homo sapiens
tgaaatcatgaacaaggtaggt

SEQ ID NO: 7230324 - DNA, 22 bp, Homo sapiens
tgaaatcatgaacaaggtaggt

SEQ ID NO: 7230325 - DNA, 22 bp, Homo sapiens
tgaaaggtagctggcctcatag

SEQ ID NO: 7230326 - DNA, 22 bp, Homo sapiens
tgaaagcactgattctcaactc

SEQ ID NO: 7230327 - DNA, 22 bp, Homo sapiens
tgaaagcacaagttctaacagg

SEQ ID NO: 7230328 - DNA, 22 bp, Homo sapiens
tgaaagcacaagttctaacagg

SEQ ID NO: 7230329 - DNA, 23 bp, Homo sapiens
tgaaagcaatgggtctatagtat

SEQ ID NO: 7230330 - DNA, 22 bp, Homo sapiens
tgaaagagtgcaagtcaaggag

SEQ ID NO: 7230331 - DNA, 22 bp, Homo sapiens
tgaaagagtttgacatgattct

SEQ ID NO: 7230332 - DNA, 22 bp, Homo sapiens
tgaaagataagttattatgtac

SEQ ID NO: 7230333 - DNA, 22 bp, Homo sapiens
tgaaagatgaaagcaggctggt

SEQ ID NO: 7230334 - DNA, 22 bp, Homo sapiens
tgaaagattgtgattcaatatg

SEQ ID NO: 7230335 - DNA, 22 bp, Homo sapiens
tgaaagattgtgattcaatatg

SEQ ID NO: 7230336 - DNA, 22 bp, Homo sapiens
tgaaagcaacctgtaacagtga

SEQ ID NO: 7230337 - DNA, 22 bp, Homo sapiens
tgaaagtgaatgtcactgttga

SEQ ID NO: 7230338 - DNA, 22 bp, Homo sapiens
tgaaaggttatttaggtctgct

SEQ ID NO: 7230339 - DNA, 22 bp, Homo sapiens
tgaaaggttaaaagtagtattg

SEQ ID NO: 7230340 - DNA, 22 bp, Homo sapiens
tgaaaggtgtccaatatttctc

SEQ ID NO: 7230341 - DNA, 20 bp, Homo sapiens
tgaaaggtgggaattgtggg

SEQ ID NO: 7230342 - DNA, 22 bp, Homo sapiens
tgaaaggtgacatttcttggat

SEQ ID NO: 7230343 - DNA, 22 bp, Homo sapiens
tgaaagttattactgatgatgt

SEQ ID NO: 7230344 - DNA, 22 bp, Homo sapiens
tgaaagttaggatgtagtaatt

SEQ ID NO: 7230345 - DNA, 21 bp, Homo sapiens
tgaaagttggagtcaaatgta

SEQ ID NO: 7230346 - DNA, 22 bp, Homo sapiens
tgaaataacttttgggtgagtt

SEQ ID NO: 7230347 - DNA, 22 bp, Homo sapiens
tgaaagttgcacataagagaat

SEQ ID NO: 7230348 - DNA, 22 bp, Homo sapiens
tgaaagttgcacataagagaat

SEQ ID NO: 7230349 - DNA, 22 bp, Homo sapiens
tgaaatcagtatgtctttctca

SEQ ID NO: 7230350 - DNA, 22 bp, Homo sapiens
tgaaatcagtatgtctttctca

SEQ ID NO: 7230351 - DNA, 22 bp, Homo sapiens
tgaaatcaattgcaatgtttat

SEQ ID NO: 7230352 - DNA, 22 bp, Homo sapiens
tgaaatcagtatgtctttctca

SEQ ID NO: 7230353 - DNA, 22 bp, Homo sapiens
tgaaatcagtggtataatcggg

SEQ ID NO: 7230354 - DNA, 22 bp, Homo sapiens
tgaaatcatctgccaataagtt

SEQ ID NO: 7230355 - DNA, 22 bp, Homo sapiens
tgaaatcatctgccaataagtt

SEQ ID NO: 7230356 - DNA, 22 bp, Homo sapiens
tgaaatcaatgtcttctgtctc

SEQ ID NO: 7230357 - DNA, 22 bp, Homo sapiens
tgaaatcaactaggagacacca

SEQ ID NO: 7230358 - DNA, 22 bp, Homo sapiens
tgaaatactttggctctttgtt

SEQ ID NO: 7230359 - DNA, 22 bp, Homo sapiens
tgaaatactttttgtacctgtc

SEQ ID NO: 7230360 - DNA, 22 bp, Homo sapiens
tgaaatactgagtgaaagaatt

SEQ ID NO: 7230361 - DNA, 22 bp, Homo sapiens
tgaaatactgagtgaaagaatt

SEQ ID NO: 7230362 - DNA, 22 bp, Homo sapiens
tgaaatacacaaatttagtaag

SEQ ID NO: 7230363 - DNA, 22 bp, Homo sapiens
tgaaatacacaaatttagtaag

SEQ ID NO: 7230364 - DNA, 22 bp, Homo sapiens
tgaaatacacaaatttagtaag

SEQ ID NO: 7230365 - DNA, 22 bp, Homo sapiens
tgaaatacacaaatttagtaag

SEQ ID NO: 7230366 - DNA, 22 bp, Homo sapiens
tgaaataatatctggatcaatc

SEQ ID NO: 7230367 - DNA, 22 bp, Homo sapiens
tgaaataggaaacagatgtttc

SEQ ID NO: 7230368 - DNA, 22 bp, Homo sapiens
tgaaatagacttgcactatatg

SEQ ID NO: 7230369 - DNA, 22 bp, Homo sapiens
tgaaatatcattttcatctccc

SEQ ID NO: 7230370 - DNA, 22 bp, Homo sapiens
tgaaatatgctcccattcactt

SEQ ID NO: 7230371 - DNA, 22 bp, Homo sapiens
tctttgtaactgtctattgaga

SEQ ID NO: 7230372 - DNA, 22 bp, Homo sapiens
tctttgtaagaaattcttccgt

SEQ ID NO: 7230373 - DNA, 19 bp, Homo sapiens
tctttgtacaagtctctgc

SEQ ID NO: 7230374 - DNA, 19 bp, Homo sapiens
tctttgtacaagtctctgc

SEQ ID NO: 7230375 - DNA, 22 bp, Homo sapiens
tctttgtacaggaaggcactgt

SEQ ID NO: 7230376 - DNA, 22 bp, Homo sapiens
tctttgtcattaaactagtaac

SEQ ID NO: 7230377 - DNA, 22 bp, Homo sapiens
tctttgtcattaaactagtaac

SEQ ID NO: 7230378 - DNA, 22 bp, Homo sapiens
tctttgtctgaacagggacatt

SEQ ID NO: 7230379 - DNA, 22 bp, Homo sapiens
tctttggactttccaatttgtt

SEQ ID NO: 7230380 - DNA, 22 bp, Homo sapiens
tctttggaatgctagcattcta

SEQ ID NO: 7230381 - DNA, 22 bp, Homo sapiens
tctttggaatgctagcattcta

SEQ ID NO: 7230382 - DNA, 22 bp, Homo sapiens
tctttggaagctttcagagaag

SEQ ID NO: 7230383 - DNA, 22 bp, Homo sapiens
tctttggaaggagcagtttttg

SEQ ID NO: 7230384 - DNA, 22 bp, Homo sapiens
tctttgctcttacacagttagt

SEQ ID NO: 7230385 - DNA, 22 bp, Homo sapiens
tctttgctgagtacatctccaa

SEQ ID NO: 7230386 - DNA, 22 bp, Homo sapiens
tctttggaaatgctttgagaat

SEQ ID NO: 7230387 - DNA, 22 bp, Homo sapiens
tctttgctccacactctagaga

SEQ ID NO: 7230388 - DNA, 22 bp, Homo sapiens
tctttgctattgtgaatagtgc

SEQ ID NO: 7230389 - DNA, 21 bp, Homo sapiens
tctttgcatcagttgttttct

SEQ ID NO: 7230390 - DNA, 22 bp, Homo sapiens
tctttgcatcccttccatagtt

SEQ ID NO: 7230391 - DNA, 22 bp, Homo sapiens
tctttgcatcccttccatagtt

SEQ ID NO: 7230392 - DNA, 22 bp, Homo sapiens
tctttgcatgagttccctctgt

SEQ ID NO: 7230393 - DNA, 22 bp, Homo sapiens
tctttgcagtggtgaataaaga

SEQ ID NO: 7230394 - DNA, 22 bp, Homo sapiens
tctttgcagttctgattaaata

SEQ ID NO: 7230395 - DNA, 22 bp, Homo sapiens
tctttgcagaacgatgaagatg

SEQ ID NO: 7230396 - DNA, 22 bp, Homo sapiens
tctttgcagaatttaactttgc

SEQ ID NO: 7230397 - DNA, 17 bp, Homo sapiens
tctttgcaatgagactg

SEQ ID NO: 7230398 - DNA, 22 bp, Homo sapiens
tctttgcacacagcgattcttc

SEQ ID NO: 7230399 - DNA, 22 bp, Homo sapiens
tctttgatttgacaatatcttg

SEQ ID NO: 7230400 - DNA, 22 bp, Homo sapiens
tctttgatttgacaatatcttg

SEQ ID NO: 7230401 - DNA, 22 bp, Homo sapiens
tcttttaaaagccctgctgtct

SEQ ID NO: 7230402 - DNA, 21 bp, Homo sapiens
tcttttaacaccaggaattcc

SEQ ID NO: 7230403 - DNA, 21 bp, Homo sapiens
tcttttaacaccaggaattcc

SEQ ID NO: 7230404 - DNA, 22 bp, Homo sapiens
tcttttaaaagccctgctgtct

SEQ ID NO: 7230405 - DNA, 18 bp, Homo sapiens
tctttgtttccttcttgc

SEQ ID NO: 7230406 - DNA, 22 bp, Homo sapiens
tctttgtttgcctttatcaaga

SEQ ID NO: 7230407 - DNA, 22 bp, Homo sapiens
tctttgtttgcctttatcaaga

SEQ ID NO: 7230408 - DNA, 22 bp, Homo sapiens
tctttgtttgtactgttagaat

SEQ ID NO: 7230409 - DNA, 22 bp, Homo sapiens
tctttgtttgtactgttagaat

SEQ ID NO: 7230410 - DNA, 22 bp, Homo sapiens
tctttgttggagtccaaggata

SEQ ID NO: 7230411 - DNA, 22 bp, Homo sapiens
tctttgttggagtccaaggata

SEQ ID NO: 7230412 - DNA, 22 bp, Homo sapiens
tctttgttattgctttatctat

SEQ ID NO: 7230413 - DNA, 22 bp, Homo sapiens
tctttgttattgtgaatagggt

SEQ ID NO: 7230414 - DNA, 22 bp, Homo sapiens
tctttgttattgctttatctat

SEQ ID NO: 7230415 - DNA, 22 bp, Homo sapiens
tctttgttattgctttatctat

SEQ ID NO: 7230416 - DNA, 22 bp, Homo sapiens
tctttgttattgctttatctat

SEQ ID NO: 7230417 - DNA, 22 bp, Homo sapiens
tctttgtgttcaggagccacgt

SEQ ID NO: 7230418 - DNA, 20 bp, Homo sapiens
tctttgttaattttatctcc

SEQ ID NO: 7230419 - DNA, 20 bp, Homo sapiens
tctttgttaattttatctcc

SEQ ID NO: 7230420 - DNA, 20 bp, Homo sapiens
tctttgttaattttatctcc

SEQ ID NO: 7230421 - DNA, 20 bp, Homo sapiens
tctttgttaattttatctcc

SEQ ID NO: 7230422 - DNA, 22 bp, Homo sapiens
tcttttaacctaactagcttgg

SEQ ID NO: 7230423 - DNA, 22 bp, Homo sapiens
tcttttaagcctctggcatagg

SEQ ID NO: 7230424 - DNA, 22 bp, Homo sapiens
tcttttaagcctctggcatagg

SEQ ID NO: 7230425 - DNA, 22 bp, Homo sapiens
tcttttaacctaactagcttgg

SEQ ID NO: 7230426 - DNA, 22 bp, Homo sapiens
tcttttaacctaactagcttgg

SEQ ID NO: 7230427 - DNA, 22 bp, Homo sapiens
tcttttaacctaactagcttgg

SEQ ID NO: 7230428 - DNA, 22 bp, Homo sapiens
tcttttatagtgaattttcttg

SEQ ID NO: 7230429 - DNA, 22 bp, Homo sapiens
tcttttagagcatttctgattc

SEQ ID NO: 7230430 - DNA, 22 bp, Homo sapiens
tcttttagctctgcaaggaaag

SEQ ID NO: 7230431 - DNA, 22 bp, Homo sapiens
tcttttagagcatttctgattc

SEQ ID NO: 7230432 - DNA, 22 bp, Homo sapiens
tcttttatagtgaattttcttg

SEQ ID NO: 7230433 - DNA, 22 bp, Homo sapiens
tcttttatagtgaattttcttg

SEQ ID NO: 7230434 - DNA, 22 bp, Homo sapiens
tcttttatcctacatttagctc

SEQ ID NO: 7230435 - DNA, 22 bp, Homo sapiens
tcttttatcctacatttagctc

SEQ ID NO: 7230436 - DNA, 22 bp, Homo sapiens
tcttttatcctacatttagctc

SEQ ID NO: 7230437 - DNA, 22 bp, Homo sapiens
tcttttctgccacagcctgagc

SEQ ID NO: 7230438 - DNA, 22 bp, Homo sapiens
tcttttctgccacagcctgagc

SEQ ID NO: 7230439 - DNA, 21 bp, Homo sapiens
tcttttctctgcaggattcct

SEQ ID NO: 7230440 - DNA, 21 bp, Homo sapiens
tcttttctctgcaggattcct

SEQ ID NO: 7230441 - DNA, 22 bp, Homo sapiens
tcttttctccagacctgggatc

SEQ ID NO: 7230442 - DNA, 22 bp, Homo sapiens
tcttttctagcaaatccaggag

SEQ ID NO: 7230443 - DNA, 22 bp, Homo sapiens
tcttttctagcaaatccaggag

SEQ ID NO: 7230444 - DNA, 22 bp, Homo sapiens
tcttttctagcaaatccaggag

SEQ ID NO: 7230445 - DNA, 21 bp, Homo sapiens
tcttttctcagctttgtggtt

SEQ ID NO: 7230446 - DNA, 22 bp, Homo sapiens
tcttttcctcctcttgttggcc

SEQ ID NO: 7230447 - DNA, 22 bp, Homo sapiens
tcttttccttccctacagatct

SEQ ID NO: 7230448 - DNA, 22 bp, Homo sapiens
tcttttcattgagaacacactg

SEQ ID NO: 7230449 - DNA, 22 bp, Homo sapiens
tcttttcatcatttaataggta

SEQ ID NO: 7230450 - DNA, 22 bp, Homo sapiens
tcttttcatcatttaataggta

SEQ ID NO: 7230451 - DNA, 19 bp, Homo sapiens
tcttttcacgcattttgaa

SEQ ID NO: 7230452 - DNA, 19 bp, Homo sapiens
tcttttcacgcattttgaa

SEQ ID NO: 7230453 - DNA, 19 bp, Homo sapiens
tcttttcacgcattttgaa

SEQ ID NO: 7230454 - DNA, 22 bp, Homo sapiens
tcttttcaggaatggctctagt

SEQ ID NO: 7230455 - DNA, 23 bp, Homo sapiens
tcttttcaatggttctttatgtg

SEQ ID NO: 7230456 - DNA, 23 bp, Homo sapiens
tcttttcaatggttctttatgtg

SEQ ID NO: 7230457 - DNA, 22 bp, Homo sapiens
tcttttcacaaaggagctggag

SEQ ID NO: 7230458 - DNA, 22 bp, Homo sapiens
tcttttcacagacaaatggaga

SEQ ID NO: 7230459 - DNA, 22 bp, Homo sapiens
tcttttcacagacaaatggaga

SEQ ID NO: 7230460 - DNA, 22 bp, Homo sapiens
tcttttcacagacaaatggaga

SEQ ID NO: 7230461 - DNA, 22 bp, Homo sapiens
tcttttattaggctgaaatggg

SEQ ID NO: 7230462 - DNA, 20 bp, Homo sapiens
tcttttattggcagatcctg

SEQ ID NO: 7230463 - DNA, 20 bp, Homo sapiens
tcttttattggcagatcctg

SEQ ID NO: 7230464 - DNA, 22 bp, Homo sapiens
tcttttattaggctgaaatggg

SEQ ID NO: 7230465 - DNA, 22 bp, Homo sapiens
tcttttatcctacatttagctc

SEQ ID NO: 7230466 - DNA, 22 bp, Homo sapiens
tcttttatctgttgtgtaacaa

SEQ ID NO: 7230467 - DNA, 22 bp, Homo sapiens
tcttttatctgttgtgtaacaa

SEQ ID NO: 7230468 - DNA, 22 bp, Homo sapiens
tcttttattaggctgaaatggg

SEQ ID NO: 7230469 - DNA, 22 bp, Homo sapiens
tcttttattaggctgaaatggg

SEQ ID NO: 7230470 - DNA, 22 bp, Homo sapiens
tgaaaccactgatggtaccaag

SEQ ID NO: 7230471 - DNA, 22 bp, Homo sapiens
tgaaaccattctcaggtacact

SEQ ID NO: 7230472 - DNA, 22 bp, Homo sapiens
tgaaaccccagattaccacaaa

SEQ ID NO: 7230473 - DNA, 22 bp, Homo sapiens
tgaaacggaatgttctttatcg

SEQ ID NO: 7230474 - DNA, 22 bp, Homo sapiens
tgaaacgtgcagggtaatttta

SEQ ID NO: 7230475 - DNA, 22 bp, Homo sapiens
tgaaaccccagattaccacaaa

SEQ ID NO: 7230476 - DNA, 22 bp, Homo sapiens
tgaaacttataagaatatgaat

SEQ ID NO: 7230477 - DNA, 22 bp, Homo sapiens
tgaaacttataagaatatgaat

SEQ ID NO: 7230478 - DNA, 22 bp, Homo sapiens
tgaaacttataagaatatgaat

SEQ ID NO: 7230479 - DNA, 22 bp, Homo sapiens
tgaaactgaaaggtatttatag

SEQ ID NO: 7230480 - DNA, 22 bp, Homo sapiens
tgaaactgaaaggtatttatag

SEQ ID NO: 7230481 - DNA, 21 bp, Homo sapiens
tgaaactacctacaagctacc

SEQ ID NO: 7230482 - DNA, 22 bp, Homo sapiens
tgaaacttttgaggttcttcca

SEQ ID NO: 7230483 - DNA, 22 bp, Homo sapiens
tgaaacttgagtatatatggat

SEQ ID NO: 7230484 - DNA, 22 bp, Homo sapiens
tgaaacttgctaattgcacgta

SEQ ID NO: 7230485 - DNA, 22 bp, Homo sapiens
tgaaacttgctaattgcacgta

SEQ ID NO: 7230486 - DNA, 22 bp, Homo sapiens
tgaaacttttgaggttcttcca

SEQ ID NO: 7230487 - DNA, 22 bp, Homo sapiens
tgaaacttttgaggttcttcca

SEQ ID NO: 7230488 - DNA, 22 bp, Homo sapiens
tgaaacttttgaggttcttcca

SEQ ID NO: 7230489 - DNA, 22 bp, Homo sapiens
tgaaacttctaatatgaatagt

SEQ ID NO: 7230490 - DNA, 22 bp, Homo sapiens
tgaaacttatatatcccaggtt

SEQ ID NO: 7230491 - DNA, 22 bp, Homo sapiens
tgaaacttattcagtttctacc

SEQ ID NO: 7230492 - DNA, 22 bp, Homo sapiens
tgaaacttattcagtttctacc

SEQ ID NO: 7230493 - DNA, 22 bp, Homo sapiens
tgaaacttattcagtttctacc

SEQ ID NO: 7230494 - DNA, 22 bp, Homo sapiens
tgaaagaaacaggtatattggg

SEQ ID NO: 7230495 - DNA, 22 bp, Homo sapiens
tgaaagaaacaggtatattggg

SEQ ID NO: 7230496 - DNA, 22 bp, Homo sapiens
tgaaagaactagcatcttcaag

SEQ ID NO: 7230497 - DNA, 22 bp, Homo sapiens
tgaaagaactagcatcttcaag

SEQ ID NO: 7230498 - DNA, 22 bp, Homo sapiens
tgaaagaactagcatcttcaag

SEQ ID NO: 7230499 - DNA, 22 bp, Homo sapiens
tgaaagaactagcatcttcaag

SEQ ID NO: 7230500 - DNA, 21 bp, Homo sapiens
tgaaagaggatgtggtcattc

SEQ ID NO: 7230501 - DNA, 17 bp, Homo sapiens
tgaaagaatcagggaga

SEQ ID NO: 7230502 - DNA, 17 bp, Homo sapiens
tgaaagaatcagggaga

SEQ ID NO: 7230503 - DNA, 17 bp, Homo sapiens
tgaaagaatcagggaga

SEQ ID NO: 7230504 - DNA, 17 bp, Homo sapiens
tgaaagaatcagggaga

SEQ ID NO: 7230505 - DNA, 21 bp, Homo sapiens
tgaaagaaggtgcagtctgaa

SEQ ID NO: 7230506 - DNA, 22 bp, Homo sapiens
tgaaagaagtgtcacattgcca

SEQ ID NO: 7230507 - DNA, 22 bp, Homo sapiens
tgaaagaagtgtcacattgcca

SEQ ID NO: 7230508 - DNA, 22 bp, Homo sapiens
tgaaagaagtgtcacattgcca

SEQ ID NO: 7230509 - DNA, 22 bp, Homo sapiens
tgaaagaagtgtcacattgcca

SEQ ID NO: 7230510 - DNA, 22 bp, Homo sapiens
tgaaagaactagcatcttcaag

SEQ ID NO: 7230511 - DNA, 22 bp, Homo sapiens
tgaaagaactagcatcttcaag

SEQ ID NO: 7230512 - DNA, 22 bp, Homo sapiens
tgaaagaactagcatcttcaag

SEQ ID NO: 7230513 - DNA, 22 bp, Homo sapiens
tgaaagaagcctccctttggag

SEQ ID NO: 7230514 - DNA, 22 bp, Homo sapiens
tgaaagaagccttcgaggctcg

SEQ ID NO: 7230515 - DNA, 22 bp, Homo sapiens
tgaaagaagccttcgaggctcg

SEQ ID NO: 7230516 - DNA, 22 bp, Homo sapiens
tgaaagaagggtggaaaatgta

SEQ ID NO: 7230517 - DNA, 22 bp, Homo sapiens
tgaaagaagggtggaaaatgta

SEQ ID NO: 7230518 - DNA, 22 bp, Homo sapiens
tgaaagaagggtggaaaatgta

SEQ ID NO: 7230519 - DNA, 22 bp, Homo sapiens
tgaaagaagggtggaaaatgta

SEQ ID NO: 7230520 - DNA, 21 bp, Homo sapiens
tgaaagaaggtgcagtctgaa

SEQ ID NO: 7230521 - DNA, 21 bp, Homo sapiens
tgaaacatttgatcaaagcac

SEQ ID NO: 7230522 - DNA, 21 bp, Homo sapiens
tgaaacatttgatcaaagcac

SEQ ID NO: 7230523 - DNA, 21 bp, Homo sapiens
tgaaacatttgatcaaagcac

SEQ ID NO: 7230524 - DNA, 22 bp, Homo sapiens
tgaaacatttgatgatctttgg

SEQ ID NO: 7230525 - DNA, 23 bp, Homo sapiens
tgaaacatttagggtagaatttc

SEQ ID NO: 7230526 - DNA, 23 bp, Homo sapiens
tgaaacatttagggtagaatttc

SEQ ID NO: 7230527 - DNA, 22 bp, Homo sapiens
tgaaacattgcactgtatgaat

SEQ ID NO: 7230528 - DNA, 22 bp, Homo sapiens
tgaaacattgcactgtatgaat

SEQ ID NO: 7230529 - DNA, 22 bp, Homo sapiens
tgaaacattgcactgtatgaat

SEQ ID NO: 7230530 - DNA, 22 bp, Homo sapiens
tgaaacataaagttatcttcag

SEQ ID NO: 7230531 - DNA, 22 bp, Homo sapiens
tgaaacattaggaaatcattat

SEQ ID NO: 7230532 - DNA, 22 bp, Homo sapiens
tgaaacattaggaaatcattat

SEQ ID NO: 7230533 - DNA, 22 bp, Homo sapiens
tgaaacattatagaatatttat

SEQ ID NO: 7230534 - DNA, 22 bp, Homo sapiens
tgaaacattatagaatatttat

SEQ ID NO: 7230535 - DNA, 22 bp, Homo sapiens
tgaaacagtctccagacttgga

SEQ ID NO: 7230536 - DNA, 22 bp, Homo sapiens
tgaaacagtctccagacttgga

SEQ ID NO: 7230537 - DNA, 22 bp, Homo sapiens
tgaaacagtctccagacttgga

SEQ ID NO: 7230538 - DNA, 22 bp, Homo sapiens
tgaaacagtctccagacttgga

SEQ ID NO: 7230539 - DNA, 19 bp, Homo sapiens
tgaaacaaacttaaaagga

SEQ ID NO: 7230540 - DNA, 19 bp, Homo sapiens
tgaaacaaacttaaaagga

SEQ ID NO: 7230541 - DNA, 22 bp, Homo sapiens
tgaaacaggaagtaaacagaca

SEQ ID NO: 7230542 - DNA, 22 bp, Homo sapiens
tgaaacaggcaaaactgcagat

SEQ ID NO: 7230543 - DNA, 22 bp, Homo sapiens
tgaaacaaaagtatgtagcttg

SEQ ID NO: 7230544 - DNA, 22 bp, Homo sapiens
tgaaacaaaagtatgtagcttg

SEQ ID NO: 7230545 - DNA, 22 bp, Homo sapiens
tgaaacaaaattaagattctcg

SEQ ID NO: 7230546 - DNA, 22 bp, Homo sapiens
tgaaacaaaattaagattctcg

SEQ ID NO: 7230547 - DNA, 22 bp, Homo sapiens
tgaaacaaaccagtaattttgt

SEQ ID NO: 7230548 - DNA, 22 bp, Homo sapiens
tgaaacaaaccagtaattttgt

SEQ ID NO: 7230549 - DNA, 19 bp, Homo sapiens
tgaaacaaacttaaaagga

SEQ ID NO: 7230550 - DNA, 22 bp, Homo sapiens
tgaaaaaacaagttggcccatt

SEQ ID NO: 7230551 - DNA, 22 bp, Homo sapiens
tgaaaaaacaagttggcccatt

SEQ ID NO: 7230552 - DNA, 22 bp, Homo sapiens
tgaaaaacactaattggaaagc

SEQ ID NO: 7230553 - DNA, 22 bp, Homo sapiens
tgaaaaacctcagtccgcttta

SEQ ID NO: 7230554 - DNA, 22 bp, Homo sapiens
tgaaaaactgaatagttgagta

SEQ ID NO: 7230555 - DNA, 22 bp, Homo sapiens
tgaaaaactttaatccataaag

SEQ ID NO: 7230556 - DNA, 22 bp, Homo sapiens
tgaaaaactttaatccataaag

SEQ ID NO: 7230557 - DNA, 22 bp, Homo sapiens
tgaaaacactttagtttaggtc

SEQ ID NO: 7230558 - DNA, 22 bp, Homo sapiens
tgaaaacactttagtttaggtc

SEQ ID NO: 7230559 - DNA, 22 bp, Homo sapiens
tgaaaacactttagtttaggtc

SEQ ID NO: 7230560 - DNA, 23 bp, Homo sapiens
tctttttaagagatctagtgacg

SEQ ID NO: 7230561 - DNA, 23 bp, Homo sapiens
tctttttaagagatctagtgacg

SEQ ID NO: 7230562 - DNA, 22 bp, Homo sapiens
tctttttatattgacaaaaggt

SEQ ID NO: 7230563 - DNA, 22 bp, Homo sapiens
tctttttatattgacaaaaggt

SEQ ID NO: 7230564 - DNA, 22 bp, Homo sapiens
tctttttcttattcccacactg

SEQ ID NO: 7230565 - DNA, 22 bp, Homo sapiens
tctttttttcctgtgcagagct

SEQ ID NO: 7230566 - DNA, 22 bp, Homo sapiens
tctttttttcctgtgcagagct

SEQ ID NO: 7230567 - DNA, 22 bp, Homo sapiens
tctttttttcctgtgcagagct

SEQ ID NO: 7230568 - DNA, 22 bp, Homo sapiens
tctttttttcctgtgcagagct

SEQ ID NO: 7230569 - DNA, 22 bp, Homo sapiens
tctttttttcctgtgcagagct

SEQ ID NO: 7230570 - DNA, 22 bp, Homo sapiens
tgaaaattctcaggctcacccc

SEQ ID NO: 7230571 - DNA, 22 bp, Homo sapiens
tgaaaatgccctctatgtctca

SEQ ID NO: 7230572 - DNA, 22 bp, Homo sapiens
tgaaaatggcctgaagaagcaa

SEQ ID NO: 7230573 - DNA, 22 bp, Homo sapiens
tgaaaatggcctgaagaagcaa

SEQ ID NO: 7230574 - DNA, 22 bp, Homo sapiens
tgaaaattaagcagatgaatga

SEQ ID NO: 7230575 - DNA, 22 bp, Homo sapiens
tgaaaattaagcagatgaatga

SEQ ID NO: 7230576 - DNA, 22 bp, Homo sapiens
tgaaaattgttgtacttgataa

SEQ ID NO: 7230577 - DNA, 22 bp, Homo sapiens
tgaaaattgttgtacttgataa

SEQ ID NO: 7230578 - DNA, 22 bp, Homo sapiens
tgaaacaaaagtatgtagcttg

SEQ ID NO: 7230579 - DNA, 22 bp, Homo sapiens
tgaaaatatagttttccagact

SEQ ID NO: 7230580 - DNA, 22 bp, Homo sapiens
tgaaaatgccctctatgtctca

SEQ ID NO: 7230581 - DNA, 22 bp, Homo sapiens
tgaaaatgccctctatgtctca

SEQ ID NO: 7230582 - DNA, 22 bp, Homo sapiens
tgaaaatatagttttccagact

SEQ ID NO: 7230583 - DNA, 22 bp, Homo sapiens
tgaaaatatagttttccagact

SEQ ID NO: 7230584 - DNA, 22 bp, Homo sapiens
tgaaaaggagccttaggtaggt

SEQ ID NO: 7230585 - DNA, 22 bp, Homo sapiens
tgaaaaggagccttaggtaggt

SEQ ID NO: 7230586 - DNA, 22 bp, Homo sapiens
tgaaaaggagtccttgttttca

SEQ ID NO: 7230587 - DNA, 22 bp, Homo sapiens
tgaaaagactgcaagagagcat

SEQ ID NO: 7230588 - DNA, 22 bp, Homo sapiens
tgaaaagggtagatccctaagt

SEQ ID NO: 7230589 - DNA, 22 bp, Homo sapiens
tgaaaagggtagatccctaagt

SEQ ID NO: 7230590 - DNA, 20 bp, Homo sapiens
tgaaaaggtcaggagacatg

SEQ ID NO: 7230591 - DNA, 22 bp, Homo sapiens
tgccgcagtgcggggagggccc

SEQ ID NO: 7230592 - DNA, 22 bp, Homo sapiens
tgccgtggggctgaggctggag

SEQ ID NO: 7230593 - DNA, 22 bp, Homo sapiens
tgccgtggggctgaggctggag

SEQ ID NO: 7230594 - DNA, 22 bp, Homo sapiens
tgccgtgcccatattgtgggtg

SEQ ID NO: 7230595 - DNA, 22 bp, Homo sapiens
tgccgctgtcgccaccatggct

SEQ ID NO: 7230596 - DNA, 22 bp, Homo sapiens
tgccgctccaggtctcgcggtg

SEQ ID NO: 7230597 - DNA, 22 bp, Homo sapiens
tgccgctccaggtctcgcggtg

SEQ ID NO: 7230598 - DNA, 22 bp, Homo sapiens
tgcctaactccaccaggcaggt

SEQ ID NO: 7230599 - DNA, 22 bp, Homo sapiens
tgcctaagtctgcagtcacttg

SEQ ID NO: 7230600 - DNA, 22 bp, Homo sapiens
tgccgtggggctgaggctggag

SEQ ID NO: 7230601 - DNA, 22 bp, Homo sapiens
tgcctaccagtgttctcccttc

SEQ ID NO: 7230602 - DNA, 22 bp, Homo sapiens
tgccgtggggctgaggctggag

SEQ ID NO: 7230603 - DNA, 22 bp, Homo sapiens
tgccgtggggctgaggctggag

SEQ ID NO: 7230604 - DNA, 22 bp, Homo sapiens
tgccgtgtcccattgtgctctg

SEQ ID NO: 7230605 - DNA, 22 bp, Homo sapiens
tgcctcagagacctgacagtac

SEQ ID NO: 7230606 - DNA, 22 bp, Homo sapiens
tgcctcagagacctgacagtac

SEQ ID NO: 7230607 - DNA, 22 bp, Homo sapiens
tgcctaggtcacacctcatacc

SEQ ID NO: 7230608 - DNA, 22 bp, Homo sapiens
tgcctcaagccctccactgcac

SEQ ID NO: 7230609 - DNA, 22 bp, Homo sapiens
tgcctcaagccctccactgcac

SEQ ID NO: 7230610 - DNA, 22 bp, Homo sapiens
tgcctatttacttcacagttga

SEQ ID NO: 7230611 - DNA, 22 bp, Homo sapiens
tgcctcaagccctccactgcac

SEQ ID NO: 7230612 - DNA, 22 bp, Homo sapiens
tgcctcaagccctccactgcac

SEQ ID NO: 7230613 - DNA, 22 bp, Homo sapiens
tgcctagaactttattctttat

SEQ ID NO: 7230614 - DNA, 22 bp, Homo sapiens
tgcctaggaaacctcatgcttc

SEQ ID NO: 7230615 - DNA, 22 bp, Homo sapiens
tgcctaggctggagtgcagtga

SEQ ID NO: 7230616 - DNA, 22 bp, Homo sapiens
tgcctaggctggagtgtagtgg

SEQ ID NO: 7230617 - DNA, 22 bp, Homo sapiens
tgcctaggctggagtgtagtgg

SEQ ID NO: 7230618 - DNA, 22 bp, Homo sapiens
tgcctaggctggagtgtagtgg

SEQ ID NO: 7230619 - DNA, 22 bp, Homo sapiens
tgcctaggctggagtgtagtgg

SEQ ID NO: 7230620 - DNA, 22 bp, Homo sapiens
tgcctagggcctaaccagagcc

SEQ ID NO: 7230621 - DNA, 22 bp, Homo sapiens
tgccctggcttcagctttggct

SEQ ID NO: 7230622 - DNA, 22 bp, Homo sapiens
tgccctgggaacacagatgcca

SEQ ID NO: 7230623 - DNA, 22 bp, Homo sapiens
tgccctgggaacacagatgcca

SEQ ID NO: 7230624 - DNA, 22 bp, Homo sapiens
tgccctgggagttggagctgct

SEQ ID NO: 7230625 - DNA, 22 bp, Homo sapiens
tgccctgggacatgcagcggag

SEQ ID NO: 7230626 - DNA, 22 bp, Homo sapiens
tgccctgttcctgcctccagct

SEQ ID NO: 7230627 - DNA, 22 bp, Homo sapiens
tgccctgtgtgtgcaagcactg

SEQ ID NO: 7230628 - DNA, 22 bp, Homo sapiens
tgccctgtgctggaatcttccc

SEQ ID NO: 7230629 - DNA, 22 bp, Homo sapiens
tgccctgtgctggaatcttccc

SEQ ID NO: 7230630 - DNA, 22 bp, Homo sapiens
tgccctgtgctggaatcttccc

SEQ ID NO: 7230631 - DNA, 22 bp, Homo sapiens
tgccctgtgggtatctgatggc

SEQ ID NO: 7230632 - DNA, 22 bp, Homo sapiens
tgccctgtgccagacttcctgg

SEQ ID NO: 7230633 - DNA, 22 bp, Homo sapiens
tgcccttacacatggaaaggga

SEQ ID NO: 7230634 - DNA, 22 bp, Homo sapiens
tgcccttaggaaggctcaccaa

SEQ ID NO: 7230635 - DNA, 22 bp, Homo sapiens
tgcccttataaaggaggcctga

SEQ ID NO: 7230636 - DNA, 22 bp, Homo sapiens
tgcccttatgaaagaggcccaa

SEQ ID NO: 7230637 - DNA, 22 bp, Homo sapiens
tgccgcagtgcggggagggccc

SEQ ID NO: 7230638 - DNA, 22 bp, Homo sapiens
tgccgcactcggccaccagctg

SEQ ID NO: 7230639 - DNA, 22 bp, Homo sapiens
tgccgcactcggctcctgattt

SEQ ID NO: 7230640 - DNA, 22 bp, Homo sapiens
tgcccttggtgggcccaatagg

SEQ ID NO: 7230641 - DNA, 22 bp, Homo sapiens
tgcccttgggtaacttgctgat

SEQ ID NO: 7230642 - DNA, 22 bp, Homo sapiens
tgccctggaaccatctacagtc

SEQ ID NO: 7230643 - DNA, 22 bp, Homo sapiens
tgccctggaaatgagaggtgtg

SEQ ID NO: 7230644 - DNA, 22 bp, Homo sapiens
tgccctgcttctcttgggacag

SEQ ID NO: 7230645 - DNA, 22 bp, Homo sapiens
tgccctgcttggtttattttca

SEQ ID NO: 7230646 - DNA, 22 bp, Homo sapiens
tgccctgctgtgcctggagcca

SEQ ID NO: 7230647 - DNA, 22 bp, Homo sapiens
tgccctgctgtggctctgccca

SEQ ID NO: 7230648 - DNA, 22 bp, Homo sapiens
tgccctgctgtggctctgccca

SEQ ID NO: 7230649 - DNA, 22 bp, Homo sapiens
tgccctggaaccatctacagtc

SEQ ID NO: 7230650 - DNA, 22 bp, Homo sapiens
tgccctggaaccatctacagtc

SEQ ID NO: 7230651 - DNA, 22 bp, Homo sapiens
tgccctggagtcagtggctatt

SEQ ID NO: 7230652 - DNA, 22 bp, Homo sapiens
tgccctggaggggcttacagtc

SEQ ID NO: 7230653 - DNA, 22 bp, Homo sapiens
tgccctggctcttcttgttcca

SEQ ID NO: 7230654 - DNA, 22 bp, Homo sapiens
tgccctggctctccactagttt

SEQ ID NO: 7230655 - DNA, 22 bp, Homo sapiens
tgccctggctcctcccacgctg

SEQ ID NO: 7230656 - DNA, 22 bp, Homo sapiens
tgccctggctcctcccacgctg

SEQ ID NO: 7230657 - DNA, 22 bp, Homo sapiens
tgccctggcgctgtctctatgg

SEQ ID NO: 7230658 - DNA, 22 bp, Homo sapiens
tgccctggcattgggttggata

SEQ ID NO: 7230659 - DNA, 22 bp, Homo sapiens
tgccctggcattgggttggata

SEQ ID NO: 7230660 - DNA, 22 bp, Homo sapiens
tgccctggcattgggttggata

SEQ ID NO: 7230661 - DNA, 22 bp, Homo sapiens
tgccctggcattgggttggata

SEQ ID NO: 7230662 - DNA, 22 bp, Homo sapiens
tgccctggatgctgcaggtgtg

SEQ ID NO: 7230663 - DNA, 22 bp, Homo sapiens
tgccctggatgctgcaggtgtg

SEQ ID NO: 7230664 - DNA, 22 bp, Homo sapiens
tgccctggcacacacacagctg

SEQ ID NO: 7230665 - DNA, 22 bp, Homo sapiens
tgccctggatgctgcaggtgtg

SEQ ID NO: 7230666 - DNA, 22 bp, Homo sapiens
tgcccgctgctgctcagtctgt

SEQ ID NO: 7230667 - DNA, 22 bp, Homo sapiens
tgccccttctacccgtctctgt

SEQ ID NO: 7230668 - DNA, 19 bp, Homo sapiens
tgccccttaagagtttctc

SEQ ID NO: 7230669 - DNA, 22 bp, Homo sapiens
tgcccctgacctcaggcgaagg

SEQ ID NO: 7230670 - DNA, 22 bp, Homo sapiens
tgcccctcttgctggccctgtc

SEQ ID NO: 7230671 - DNA, 19 bp, Homo sapiens
tgccctaggggatgcgggg

SEQ ID NO: 7230672 - DNA, 22 bp, Homo sapiens
tgccctcaagcaacagagagga

SEQ ID NO: 7230673 - DNA, 19 bp, Homo sapiens
tgccctgcacgctgtcctg

SEQ ID NO: 7230674 - DNA, 22 bp, Homo sapiens
tgccctgcagaccctgcagtgt

SEQ ID NO: 7230675 - DNA, 22 bp, Homo sapiens
tgccctgcagaccctgcagtgt

SEQ ID NO: 7230676 - DNA, 22 bp, Homo sapiens
tgccctgcagtgagtgcgtctg

SEQ ID NO: 7230677 - DNA, 22 bp, Homo sapiens
tgccctgccaagactcagtggt

SEQ ID NO: 7230678 - DNA, 22 bp, Homo sapiens
tgccctgccaagaccaagtggt

SEQ ID NO: 7230679 - DNA, 22 bp, Homo sapiens
tgccctgccaagactcagtggt

SEQ ID NO: 7230680 - DNA, 22 bp, Homo sapiens
tgccctgccaagaccaagtggt

SEQ ID NO: 7230681 - DNA, 22 bp, Homo sapiens
tgccctgcatgcagggagctgt

SEQ ID NO: 7230682 - DNA, 22 bp, Homo sapiens
tgccctgccaagactgagtggt

SEQ ID NO: 7230683 - DNA, 22 bp, Homo sapiens
tgccctgccaagactgagtggt

SEQ ID NO: 7230684 - DNA, 22 bp, Homo sapiens
tgccctgccaagactgagtggt

SEQ ID NO: 7230685 - DNA, 22 bp, Homo sapiens
tgccctgccaagactgagtggt

SEQ ID NO: 7230686 - DNA, 22 bp, Homo sapiens
tgccctgcccatctaccctgtc

SEQ ID NO: 7230687 - DNA, 22 bp, Homo sapiens
tgccctgcccatctaccctgtc

SEQ ID NO: 7230688 - DNA, 19 bp, Homo sapiens
tgccctgcccgcagccttg

SEQ ID NO: 7230689 - DNA, 19 bp, Homo sapiens
tgccctgcccgcagccttg

SEQ ID NO: 7230690 - DNA, 19 bp, Homo sapiens
tgccctgcccgcagccttg

SEQ ID NO: 7230691 - DNA, 22 bp, Homo sapiens
tgccctgcccttgctatttcta

SEQ ID NO: 7230692 - DNA, 22 bp, Homo sapiens
tgccctgcctgagagacagtaa

SEQ ID NO: 7230693 - DNA, 22 bp, Homo sapiens
tgccctgcctgagagacagtaa

SEQ ID NO: 7230694 - DNA, 22 bp, Homo sapiens
tgccctgcctgagagacagtaa

SEQ ID NO: 7230695 - DNA, 22 bp, Homo sapiens
tgccctgcggctatctagatga

SEQ ID NO: 7230696 - DNA, 22 bp, Homo sapiens
tgccctgctaaatataggtagc

SEQ ID NO: 7230697 - DNA, 22 bp, Homo sapiens
tgccctgctgtgcctggagcca

SEQ ID NO: 7230698 - DNA, 22 bp, Homo sapiens
tgccctgctgtgcctggagcca

SEQ ID NO: 7230699 - DNA, 22 bp, Homo sapiens
tgccctgctaaccttggttcca

SEQ ID NO: 7230700 - DNA, 22 bp, Homo sapiens
tgccctgctgtgcctggagcca

SEQ ID NO: 7230701 - DNA, 22 bp, Homo sapiens
tgcctggcactcctggagctca

SEQ ID NO: 7230702 - DNA, 22 bp, Homo sapiens
tgcctggcactcctggagctca

SEQ ID NO: 7230703 - DNA, 22 bp, Homo sapiens
tgcctggcactcctggagctca

SEQ ID NO: 7230704 - DNA, 22 bp, Homo sapiens
tgcctggcagcttgaaagaaat

SEQ ID NO: 7230705 - DNA, 22 bp, Homo sapiens
tgcctggcagcttgaaagaaat

SEQ ID NO: 7230706 - DNA, 22 bp, Homo sapiens
tgcctggcatctagccctggga

SEQ ID NO: 7230707 - DNA, 22 bp, Homo sapiens
tgcctggcatctagccctggga

SEQ ID NO: 7230708 - DNA, 22 bp, Homo sapiens
tgcctggcatctagccctggga

SEQ ID NO: 7230709 - DNA, 22 bp, Homo sapiens
tgcctggcatctagccctggga

SEQ ID NO: 7230710 - DNA, 22 bp, Homo sapiens
tgcctggcatgttatagacaca

SEQ ID NO: 7230711 - DNA, 22 bp, Homo sapiens
tgcctggcatgttatagacaca

SEQ ID NO: 7230712 - DNA, 22 bp, Homo sapiens
tgcctggcacagagcaggtggc

SEQ ID NO: 7230713 - DNA, 22 bp, Homo sapiens
tgcctggcacagagcaggtggc

SEQ ID NO: 7230714 - DNA, 22 bp, Homo sapiens
tgcctggcacagagcaggtggc

SEQ ID NO: 7230715 - DNA, 19 bp, Homo sapiens
tgcctggcaccagctccac

SEQ ID NO: 7230716 - DNA, 19 bp, Homo sapiens
tgcctggcaccagctccac

SEQ ID NO: 7230717 - DNA, 19 bp, Homo sapiens
tgcctggcaccagctccac

SEQ ID NO: 7230718 - DNA, 22 bp, Homo sapiens
tgcctggcaccccagtctgcac

SEQ ID NO: 7230719 - DNA, 22 bp, Homo sapiens
tgcctggcaccccagtctgcac

SEQ ID NO: 7230720 - DNA, 22 bp, Homo sapiens
tgcctggagaaggcaccatctg

SEQ ID NO: 7230721 - DNA, 19 bp, Homo sapiens
tgcctggagcataacaggc

SEQ ID NO: 7230722 - DNA, 19 bp, Homo sapiens
tgcctggagcataacaggc

SEQ ID NO: 7230723 - DNA, 22 bp, Homo sapiens
tgcctggagtccccaagtccat

SEQ ID NO: 7230724 - DNA, 22 bp, Homo sapiens
tgcctggagtccccaagtccat

SEQ ID NO: 7230725 - DNA, 22 bp, Homo sapiens
tgcctggagtgtgttcaggatt

SEQ ID NO: 7230726 - DNA, 22 bp, Homo sapiens
tgcctggagtgtgttcaggatt

SEQ ID NO: 7230727 - DNA, 22 bp, Homo sapiens
tgcctggagtgtgttcaggatt

SEQ ID NO: 7230728 - DNA, 22 bp, Homo sapiens
tgcctggatactcattaatttc

SEQ ID NO: 7230729 - DNA, 22 bp, Homo sapiens
tgcctggatctgaggacccatt

SEQ ID NO: 7230730 - DNA, 22 bp, Homo sapiens
tgcctggatctgaggacccatt

SEQ ID NO: 7230731 - DNA, 22 bp, Homo sapiens
tgcctggatctgaggacccatt

SEQ ID NO: 7230732 - DNA, 22 bp, Homo sapiens
tgcctggatggctctgagcagg

SEQ ID NO: 7230733 - DNA, 22 bp, Homo sapiens
tgcctggatggctctgagcagg

SEQ ID NO: 7230734 - DNA, 22 bp, Homo sapiens
tgcctggatggctctgagcagg

SEQ ID NO: 7230735 - DNA, 22 bp, Homo sapiens
tgcctggatgtgctggcctcac

SEQ ID NO: 7230736 - DNA, 22 bp, Homo sapiens
tgcctggatgtgctggcctcac

SEQ ID NO: 7230737 - DNA, 22 bp, Homo sapiens
tgcctggatgtgctggcctcac

SEQ ID NO: 7230738 - DNA, 22 bp, Homo sapiens
tgcctggattcaaagctcatgt

SEQ ID NO: 7230739 - DNA, 22 bp, Homo sapiens
tgcctggattcaaagctcatgt

SEQ ID NO: 7230740 - DNA, 22 bp, Homo sapiens
tgcctggattcaaagctcatgt

SEQ ID NO: 7230741 - DNA, 22 bp, Homo sapiens
tgcctggattcggttgttgtca

SEQ ID NO: 7230742 - DNA, 22 bp, Homo sapiens
tgcctggattcggttgttgtca

SEQ ID NO: 7230743 - DNA, 22 bp, Homo sapiens
tgcctggcaactgtggtgggct

SEQ ID NO: 7230744 - DNA, 22 bp, Homo sapiens
tgcctggcaagaggggctggct

SEQ ID NO: 7230745 - DNA, 22 bp, Homo sapiens
tgcctggcaagaggggctggct

SEQ ID NO: 7230746 - DNA, 22 bp, Homo sapiens
tgcctggcaatgccagaagcca

SEQ ID NO: 7230747 - DNA, 22 bp, Homo sapiens
tgcctggcaatgccagaagcca

SEQ ID NO: 7230748 - DNA, 22 bp, Homo sapiens
tgcctgcttgtttacctactcc

SEQ ID NO: 7230749 - DNA, 22 bp, Homo sapiens
tgcctgcttgtgtacctggtga

SEQ ID NO: 7230750 - DNA, 22 bp, Homo sapiens
tgcctgctgcctttcatcccaa

SEQ ID NO: 7230751 - DNA, 20 bp, Homo sapiens
tgcctgcccaggtcctgcac

SEQ ID NO: 7230752 - DNA, 20 bp, Homo sapiens
tgcctgcccaggtcctgcac

SEQ ID NO: 7230753 - DNA, 22 bp, Homo sapiens
tgcctgctttctcctcaactca

SEQ ID NO: 7230754 - DNA, 22 bp, Homo sapiens
tgcctgctttctgggctgccat

SEQ ID NO: 7230755 - DNA, 18 bp, Homo sapiens
tgcctggaaggaacagga

SEQ ID NO: 7230756 - DNA, 18 bp, Homo sapiens
tgcctggaaggaacagga

SEQ ID NO: 7230757 - DNA, 18 bp, Homo sapiens
tgcctggaaggaacagga

SEQ ID NO: 7230758 - DNA, 22 bp, Homo sapiens
tgcctggaaggcccatgggaag

SEQ ID NO: 7230759 - DNA, 22 bp, Homo sapiens
tgcctggaaggcccatgggaag

SEQ ID NO: 7230760 - DNA, 22 bp, Homo sapiens
tgcctggaaggcccatgggaag

SEQ ID NO: 7230761 - DNA, 22 bp, Homo sapiens
tgcctggaaggcccatgggaag

SEQ ID NO: 7230762 - DNA, 19 bp, Homo sapiens
tgcctggacaaatgtgggg

SEQ ID NO: 7230763 - DNA, 19 bp, Homo sapiens
tgcctggacaaatgtgggg

SEQ ID NO: 7230764 - DNA, 22 bp, Homo sapiens
tgcctggaccccacctccggaa

SEQ ID NO: 7230765 - DNA, 22 bp, Homo sapiens
tgcctggaccccacctccggaa

SEQ ID NO: 7230766 - DNA, 22 bp, Homo sapiens
tgcctggaccccacctccggaa

SEQ ID NO: 7230767 - DNA, 23 bp, Homo sapiens
tgcctggagaagcatgaaatgta

SEQ ID NO: 7230768 - DNA, 23 bp, Homo sapiens
tgcctggagaagcatgaaatgta

SEQ ID NO: 7230769 - DNA, 22 bp, Homo sapiens
tgcctggagaaggcaccatctg

SEQ ID NO: 7230770 - DNA, 22 bp, Homo sapiens
tgcctggagaaggcaccatctg

SEQ ID NO: 7230771 - DNA, 22 bp, Homo sapiens
tgcctgccatgcagaaagctga

SEQ ID NO: 7230772 - DNA, 22 bp, Homo sapiens
tgcctgccaggcaacctgggag

SEQ ID NO: 7230773 - DNA, 22 bp, Homo sapiens
tgcctgccaggcaacctgggag

SEQ ID NO: 7230774 - DNA, 22 bp, Homo sapiens
tgcctgatgcaggagtatcaga

SEQ ID NO: 7230775 - DNA, 22 bp, Homo sapiens
tgcctgcaagagttggggctac

SEQ ID NO: 7230776 - DNA, 22 bp, Homo sapiens
tgcctgcagcgtctccagcagg

SEQ ID NO: 7230777 - DNA, 22 bp, Homo sapiens
tgcctgcatcttggaggcccca

SEQ ID NO: 7230778 - DNA, 22 bp, Homo sapiens
tgcctgcatcttggaggcccca

SEQ ID NO: 7230779 - DNA, 21 bp, Homo sapiens
tgcctgcattctatcagacca

SEQ ID NO: 7230780 - DNA, 21 bp, Homo sapiens
tgcctgcattctatcagacca

SEQ ID NO: 7230781 - DNA, 22 bp, Homo sapiens
tgcctctgctgctgtggcatca

SEQ ID NO: 7230782 - DNA, 22 bp, Homo sapiens
tgcctctgctgctgtggcatca

SEQ ID NO: 7230783 - DNA, 23 bp, Homo sapiens
tgcctctgcctccctagtctgca

SEQ ID NO: 7230784 - DNA, 22 bp, Homo sapiens
tgcctctgcctccattgttagt

SEQ ID NO: 7230785 - DNA, 23 bp, Homo sapiens
tgcctctgcctccctagtctgca

SEQ ID NO: 7230786 - DNA, 22 bp, Homo sapiens
tgcctctgaggaagattgtgtt

SEQ ID NO: 7230787 - DNA, 22 bp, Homo sapiens
tgcctctgaggaagattgtgtt

SEQ ID NO: 7230788 - DNA, 22 bp, Homo sapiens
tgcctctgaggaagattgtgtt

SEQ ID NO: 7230789 - DNA, 22 bp, Homo sapiens
tgcctcctctttgccaaggtca

SEQ ID NO: 7230790 - DNA, 22 bp, Homo sapiens
tgcctcctctttgccaaggtca

SEQ ID NO: 7230791 - DNA, 22 bp, Homo sapiens
tgcctccctggcaagtctctcc

SEQ ID NO: 7230792 - DNA, 22 bp, Homo sapiens
tgcctccctctctgccactgga

SEQ ID NO: 7230793 - DNA, 22 bp, Homo sapiens
tgcctccctggcaagtctctcc

SEQ ID NO: 7230794 - DNA, 22 bp, Homo sapiens
tgcctccattcctgggtcattg

SEQ ID NO: 7230795 - DNA, 22 bp, Homo sapiens
tgcctcagctgaggccgctcca

SEQ ID NO: 7230796 - DNA, 22 bp, Homo sapiens
tgcctcagctgaggccgctcca

SEQ ID NO: 7230797 - DNA, 22 bp, Homo sapiens
tgcctcagctgaggccgctcca

SEQ ID NO: 7230798 - DNA, 22 bp, Homo sapiens
tgcctcaggcacctggcaggtt

SEQ ID NO: 7230799 - DNA, 22 bp, Homo sapiens
tgcctcagagtgggcttgctat

SEQ ID NO: 7230800 - DNA, 22 bp, Homo sapiens
tgcctcagagtgggcttgctat

SEQ ID NO: 7230801 - DNA, 22 bp, Homo sapiens
tgcctcagagttgtccctacca

SEQ ID NO: 7230802 - DNA, 22 bp, Homo sapiens
tgcctcagctgaggccgctcca

SEQ ID NO: 7230803 - DNA, 19 bp, Homo sapiens
tgcctcagggctttgagga

SEQ ID NO: 7230804 - DNA, 22 bp, Homo sapiens
tgcctcaggcacctggcaggtt

SEQ ID NO: 7230805 - DNA, 22 bp, Homo sapiens
tgcctcaggcacctggcaggtt

SEQ ID NO: 7230806 - DNA, 22 bp, Homo sapiens
tgcctcaggcacctggcaggtt

SEQ ID NO: 7230807 - DNA, 19 bp, Homo sapiens
tgcctcagggctttgagga

SEQ ID NO: 7230808 - DNA, 22 bp, Homo sapiens
tgcctcagtctaaagtctctca

SEQ ID NO: 7230809 - DNA, 22 bp, Homo sapiens
tgcctcagtcagcttccctggg

SEQ ID NO: 7230810 - DNA, 22 bp, Homo sapiens
tgcctcagtctaaagtctctca

SEQ ID NO: 7230811 - DNA, 22 bp, Homo sapiens
tgcctccattcctgggtcattg

SEQ ID NO: 7230812 - DNA, 22 bp, Homo sapiens
tgcctccctctctgccactgga

SEQ ID NO: 7230813 - DNA, 22 bp, Homo sapiens
tgcctctgtgggccttcctggc

SEQ ID NO: 7230814 - DNA, 22 bp, Homo sapiens
tgcctctgtgtgcaggtgagca

SEQ ID NO: 7230815 - DNA, 22 bp, Homo sapiens
tgcctctgtgtgcaggtgagca

SEQ ID NO: 7230816 - DNA, 22 bp, Homo sapiens
tgcctctgtgggcagagctgcc

SEQ ID NO: 7230817 - DNA, 22 bp, Homo sapiens
tgcctctgtgggccttcctggc

SEQ ID NO: 7230818 - DNA, 22 bp, Homo sapiens
tgcctctgtgggccttcctggc

SEQ ID NO: 7230819 - DNA, 22 bp, Homo sapiens
tgcctctgtgggccttcctggc

SEQ ID NO: 7230820 - DNA, 22 bp, Homo sapiens
tgcctctgtgggccttcctggc

SEQ ID NO: 7230821 - DNA, 22 bp, Homo sapiens
tgcctctgtgggcagagctgcc

SEQ ID NO: 7230822 - DNA, 22 bp, Homo sapiens
tgcctctgtgggcagagctgcc

SEQ ID NO: 7230823 - DNA, 22 bp, Homo sapiens
tgcctctggttatctggtacct

SEQ ID NO: 7230824 - DNA, 22 bp, Homo sapiens
tgcctctgggtgaccaaggagc

SEQ ID NO: 7230825 - DNA, 22 bp, Homo sapiens
tgcctctggttatctggtacct

SEQ ID NO: 7230826 - DNA, 22 bp, Homo sapiens
tgcctctgggtgaccaaggagc

SEQ ID NO: 7230827 - DNA, 22 bp, Homo sapiens
tgcctctgggtgaccaaggagc

SEQ ID NO: 7230828 - DNA, 22 bp, Homo sapiens
tgcctctgctgctgtggcatca

SEQ ID NO: 7230829 - DNA, 22 bp, Homo sapiens
tgcctctggcctttggtgccca

SEQ ID NO: 7230830 - DNA, 22 bp, Homo sapiens
tgcctgaacatgaatagtttat

SEQ ID NO: 7230831 - DNA, 22 bp, Homo sapiens
tgcctgaacatgaatagtttat

SEQ ID NO: 7230832 - DNA, 22 bp, Homo sapiens
tgcctgaatgatcagtcagatt

SEQ ID NO: 7230833 - DNA, 22 bp, Homo sapiens
tgcctgaattcaattcctggct

SEQ ID NO: 7230834 - DNA, 22 bp, Homo sapiens
tgcctctgttgagccttggctg

SEQ ID NO: 7230835 - DNA, 22 bp, Homo sapiens
tgcctctgttgagccttggctg

SEQ ID NO: 7230836 - DNA, 22 bp, Homo sapiens
tgcctctgttgagccttggctg

SEQ ID NO: 7230837 - DNA, 22 bp, Homo sapiens
tgcctctgttgagccttggctg

SEQ ID NO: 7230838 - DNA, 22 bp, Homo sapiens
tgcctgagtgatgtggcagcca

SEQ ID NO: 7230839 - DNA, 22 bp, Homo sapiens
tgcctgaggtggtctgcaaatg

SEQ ID NO: 7230840 - DNA, 22 bp, Homo sapiens
tgcctgagtgatgtggcagcca

SEQ ID NO: 7230841 - DNA, 22 bp, Homo sapiens
tgcctgaggagtcagggcaggt

SEQ ID NO: 7230842 - DNA, 22 bp, Homo sapiens
tgcctgaggagtcagggcaggt

SEQ ID NO: 7230843 - DNA, 22 bp, Homo sapiens
tgcctgaggagtcagggcaggt

SEQ ID NO: 7230844 - DNA, 22 bp, Homo sapiens
tgcctgagggagtaagagtcct

SEQ ID NO: 7230845 - DNA, 22 bp, Homo sapiens
tgcctgagggagtaagagtcct

SEQ ID NO: 7230846 - DNA, 22 bp, Homo sapiens
tgcctgagggagtaagagtcct

SEQ ID NO: 7230847 - DNA, 22 bp, Homo sapiens
tgcccagggataagcctagaga

SEQ ID NO: 7230848 - DNA, 22 bp, Homo sapiens
tgcccagggataagcctagaga

SEQ ID NO: 7230849 - DNA, 22 bp, Homo sapiens
tgcccaggcttcaccctcagag

SEQ ID NO: 7230850 - DNA, 22 bp, Homo sapiens
tgcccagggataagcctagaga

SEQ ID NO: 7230851 - DNA, 21 bp, Homo sapiens
tgcccaggggccaaccgctgc

SEQ ID NO: 7230852 - DNA, 22 bp, Homo sapiens
tgcccagggtggagtgcagcgg

SEQ ID NO: 7230853 - DNA, 22 bp, Homo sapiens
tgcccagggtggagtgcagcgg

SEQ ID NO: 7230854 - DNA, 22 bp, Homo sapiens
tgcccagggtggagtgcagcgg

SEQ ID NO: 7230855 - DNA, 22 bp, Homo sapiens
tgcccagggtggagtgcagcgg

SEQ ID NO: 7230856 - DNA, 22 bp, Homo sapiens
tgcccaggctggagtgcagtgg

SEQ ID NO: 7230857 - DNA, 22 bp, Homo sapiens
tgcccaggctggagtgcagtgg

SEQ ID NO: 7230858 - DNA, 22 bp, Homo sapiens
tgcccaggctggagtgcagtgg

SEQ ID NO: 7230859 - DNA, 22 bp, Homo sapiens
tgcccaggcttcaccctcagag

SEQ ID NO: 7230860 - DNA, 22 bp, Homo sapiens
tgcccaggcttcaccctcagag

SEQ ID NO: 7230861 - DNA, 22 bp, Homo sapiens
tgcccaggctggagtgcagagg

SEQ ID NO: 7230862 - DNA, 22 bp, Homo sapiens
tgcccaggctggagtgcagagg

SEQ ID NO: 7230863 - DNA, 22 bp, Homo sapiens
tgcccaggctggagtgcagtgg

SEQ ID NO: 7230864 - DNA, 22 bp, Homo sapiens
tgcccaggctggagtgcagagg

SEQ ID NO: 7230865 - DNA, 22 bp, Homo sapiens
tgcccaggctggagtacagtgg

SEQ ID NO: 7230866 - DNA, 22 bp, Homo sapiens
tgcccaggctggagtacagtgg

SEQ ID NO: 7230867 - DNA, 22 bp, Homo sapiens
tgcccaggctggagtacagtgg

SEQ ID NO: 7230868 - DNA, 22 bp, Homo sapiens
tgcccaggctggagtgcagagg

SEQ ID NO: 7230869 - DNA, 22 bp, Homo sapiens
tgcccaggctggagtacagtgg

SEQ ID NO: 7230870 - DNA, 22 bp, Homo sapiens
tgcccaggctggaatgcagtgg

SEQ ID NO: 7230871 - DNA, 22 bp, Homo sapiens
tgcccaggctggaatgcagtgg

SEQ ID NO: 7230872 - DNA, 22 bp, Homo sapiens
tgcccaggctggaatgcagtgg

SEQ ID NO: 7230873 - DNA, 22 bp, Homo sapiens
tgcccaggctggagtacagtgg

SEQ ID NO: 7230874 - DNA, 19 bp, Homo sapiens
tgcccaggcctcccaaaag

SEQ ID NO: 7230875 - DNA, 22 bp, Homo sapiens
tgcccaggctcctcgcagcctt

SEQ ID NO: 7230876 - DNA, 22 bp, Homo sapiens
tgcccaggctcctcgcagcctt

SEQ ID NO: 7230877 - DNA, 22 bp, Homo sapiens
tgcccaggctcctcgcagcctt

SEQ ID NO: 7230878 - DNA, 22 bp, Homo sapiens
tgcccaggctggaatgcagtgg

SEQ ID NO: 7230879 - DNA, 22 bp, Homo sapiens
tgcccaggctggaatgcagtgg

SEQ ID NO: 7230880 - DNA, 19 bp, Homo sapiens
tgcccaggccaggttgggc

SEQ ID NO: 7230881 - DNA, 19 bp, Homo sapiens
tgcccaggccaggttgggc

SEQ ID NO: 7230882 - DNA, 19 bp, Homo sapiens
tgcccaggccaggttgggc

SEQ ID NO: 7230883 - DNA, 19 bp, Homo sapiens
tgcccaggccaggttgggc

SEQ ID NO: 7230884 - DNA, 19 bp, Homo sapiens
tgcccaggccaggttgggc

SEQ ID NO: 7230885 - DNA, 19 bp, Homo sapiens
tgcccaggcctcccaaaag

SEQ ID NO: 7230886 - DNA, 22 bp, Homo sapiens
tgcccaggattgtgaggtcagg

SEQ ID NO: 7230887 - DNA, 22 bp, Homo sapiens
tgcccaggattgtgaggtcagg

SEQ ID NO: 7230888 - DNA, 22 bp, Homo sapiens
tgcccaggattgtgaggtcagg

SEQ ID NO: 7230889 - DNA, 22 bp, Homo sapiens
tgcccaggattgtgaggtcagg

SEQ ID NO: 7230890 - DNA, 22 bp, Homo sapiens
tgcccatgtttctctgtatccc

SEQ ID NO: 7230891 - DNA, 22 bp, Homo sapiens
tgcccatggaccaagcaagggg

SEQ ID NO: 7230892 - DNA, 22 bp, Homo sapiens
tgcccatgcatgacagatggct

SEQ ID NO: 7230893 - DNA, 22 bp, Homo sapiens
tgcccaggtttgagtgcccaag

SEQ ID NO: 7230894 - DNA, 22 bp, Homo sapiens
tgcccagggtggagtgcagtgg

SEQ ID NO: 7230895 - DNA, 22 bp, Homo sapiens
tgcccagggtggagtgcagtgg

SEQ ID NO: 7230896 - DNA, 22 bp, Homo sapiens
tgcccagggtggagtgcagtgg

SEQ ID NO: 7230897 - DNA, 22 bp, Homo sapiens
tgcccagggtggagtgcagcgg

SEQ ID NO: 7230898 - DNA, 22 bp, Homo sapiens
tgcccagggtggagtgcagcgg

SEQ ID NO: 7230899 - DNA, 22 bp, Homo sapiens
tgcccagggtggagtgcagcgg

SEQ ID NO: 7230900 - DNA, 22 bp, Homo sapiens
tgcccagggtggagtgcagtgg

SEQ ID NO: 7230901 - DNA, 22 bp, Homo sapiens
tgcccagggtttctaagagcag

SEQ ID NO: 7230902 - DNA, 22 bp, Homo sapiens
tgcccaggtttgagtgcccaag

SEQ ID NO: 7230903 - DNA, 22 bp, Homo sapiens
tgccccaggtgctgaggttgga

SEQ ID NO: 7230904 - DNA, 22 bp, Homo sapiens
tgccccaggtgctgaggttgga

SEQ ID NO: 7230905 - DNA, 22 bp, Homo sapiens
tgccccagactctgctcacctc

SEQ ID NO: 7230906 - DNA, 20 bp, Homo sapiens
tgccccaggcctgcacctgc

SEQ ID NO: 7230907 - DNA, 20 bp, Homo sapiens
tgccccaggcctgcacctgc

SEQ ID NO: 7230908 - DNA, 22 bp, Homo sapiens
tgccccagacctactgaatggg

SEQ ID NO: 7230909 - DNA, 22 bp, Homo sapiens
tgccccagacctactgaatggg

SEQ ID NO: 7230910 - DNA, 22 bp, Homo sapiens
tgccccagactctgctcacctc

SEQ ID NO: 7230911 - DNA, 22 bp, Homo sapiens
tgccccagactctgctcacctc

SEQ ID NO: 7230912 - DNA, 22 bp, Homo sapiens
tgccccagactctgctcacctc

SEQ ID NO: 7230913 - DNA, 22 bp, Homo sapiens
tgccccagactctgctcacctc

SEQ ID NO: 7230914 - DNA, 22 bp, Homo sapiens
tgcccctctcctgtgatccaag

SEQ ID NO: 7230915 - DNA, 19 bp, Homo sapiens
tgcccccagcacctccctg

SEQ ID NO: 7230916 - DNA, 22 bp, Homo sapiens
tgccccctggtggccagagccg

SEQ ID NO: 7230917 - DNA, 22 bp, Homo sapiens
tgccccctggtggccagagccg

SEQ ID NO: 7230918 - DNA, 22 bp, Homo sapiens
tgcccacattctgaagctccct

SEQ ID NO: 7230919 - DNA, 21 bp, Homo sapiens
tgcccaccaagctccacactg

SEQ ID NO: 7230920 - DNA, 18 bp, Homo sapiens
tgcccaccagaagaggga

SEQ ID NO: 7230921 - DNA, 22 bp, Homo sapiens
tgcccacctaacagtgtttgga

SEQ ID NO: 7230922 - DNA, 22 bp, Homo sapiens
tgcccacctaacagtgtttgga

SEQ ID NO: 7230923 - DNA, 22 bp, Homo sapiens
tgcccacctttactgtgattta

SEQ ID NO: 7230924 - DNA, 22 bp, Homo sapiens
tgcccacctttactgtgattta

SEQ ID NO: 7230925 - DNA, 22 bp, Homo sapiens
tgcccacatggtgccatggcca

SEQ ID NO: 7230926 - DNA, 20 bp, Homo sapiens
tgcccagcaagagtgcagtt

SEQ ID NO: 7230927 - DNA, 20 bp, Homo sapiens
tgcccagcaagagtgcagtt

SEQ ID NO: 7230928 - DNA, 20 bp, Homo sapiens
tgcccagcaagagtgcagtt

SEQ ID NO: 7230929 - DNA, 22 bp, Homo sapiens
tgcccagagcctgagaggatta

SEQ ID NO: 7230930 - DNA, 19 bp, Homo sapiens
tgcccagagtgtatgcgca

SEQ ID NO: 7230931 - DNA, 20 bp, Homo sapiens
tgcccagcaagagtgcagtt

SEQ ID NO: 7230932 - DNA, 20 bp, Homo sapiens
tgcccagcaagagtgcagtt

SEQ ID NO: 7230933 - DNA, 20 bp, Homo sapiens
tgcccagcaagagtgcagtt

SEQ ID NO: 7230934 - DNA, 22 bp, Homo sapiens
tgcccactcttttgatttgtgt

SEQ ID NO: 7230935 - DNA, 22 bp, Homo sapiens
tgcccactggataatgcaaact

SEQ ID NO: 7230936 - DNA, 22 bp, Homo sapiens
tgcccactgtgtcaaagaaata

SEQ ID NO: 7230937 - DNA, 22 bp, Homo sapiens
tgcccacttcaaaatcttcatt

SEQ ID NO: 7230938 - DNA, 18 bp, Homo sapiens
tgcccagaaaagcaggga

SEQ ID NO: 7230939 - DNA, 18 bp, Homo sapiens
tgcccagaaaagcaggga

SEQ ID NO: 7230940 - DNA, 18 bp, Homo sapiens
tgcccagaaaagcaggga

SEQ ID NO: 7230941 - DNA, 22 bp, Homo sapiens
tgcccagaatagatgggctgtg

SEQ ID NO: 7230942 - DNA, 22 bp, Homo sapiens
tgcccagaatagatgggctgtg

SEQ ID NO: 7230943 - DNA, 22 bp, Homo sapiens
tgcccagagcctcttacctcca

SEQ ID NO: 7230944 - DNA, 22 bp, Homo sapiens
tgcccagccaatttgttatgtt

SEQ ID NO: 7230945 - DNA, 22 bp, Homo sapiens
tgcccagcagggagctacctgg

SEQ ID NO: 7230946 - DNA, 22 bp, Homo sapiens
tgcccagcagggagctacctgg

SEQ ID NO: 7230947 - DNA, 22 bp, Homo sapiens
tgcccagcagggagctacctgg

SEQ ID NO: 7230948 - DNA, 22 bp, Homo sapiens
tgcccagcactgtgccagtcac

SEQ ID NO: 7230949 - DNA, 22 bp, Homo sapiens
tgcccagcactgtgccagtcac

SEQ ID NO: 7230950 - DNA, 22 bp, Homo sapiens
tgcccagcactgtgccagtcac

SEQ ID NO: 7230951 - DNA, 22 bp, Homo sapiens
tgcccagcaataaaccagaaga

SEQ ID NO: 7230952 - DNA, 22 bp, Homo sapiens
tgcccagcaataaaccagaaga

SEQ ID NO: 7230953 - DNA, 22 bp, Homo sapiens
tgcccagcaataaaccagaaga

SEQ ID NO: 7230954 - DNA, 20 bp, Homo sapiens
tgcccagcaagagtgcagtt

SEQ ID NO: 7230955 - DNA, 20 bp, Homo sapiens
tgcccagcaagagtgcagtt

SEQ ID NO: 7230956 - DNA, 22 bp, Homo sapiens
tgcccagcaataaaccagaaga

SEQ ID NO: 7230957 - DNA, 22 bp, Homo sapiens
tgcccagcacccagcatgatgc

SEQ ID NO: 7230958 - DNA, 22 bp, Homo sapiens
tgcccagcacccagcatgatgc

SEQ ID NO: 7230959 - DNA, 22 bp, Homo sapiens
tgcccagcactgtgccagtcac

SEQ ID NO: 7230960 - DNA, 22 bp, Homo sapiens
tgcccagcactgtgccagtcac

SEQ ID NO: 7230961 - DNA, 22 bp, Homo sapiens
tgcccagcactgtgccagtcac

SEQ ID NO: 7230962 - DNA, 23 bp, Homo sapiens
tgccatttggaagttgggggtct

SEQ ID NO: 7230963 - DNA, 22 bp, Homo sapiens
tgccatttggacctaactgggc

SEQ ID NO: 7230964 - DNA, 22 bp, Homo sapiens
tgccatttgtaactatcattct

SEQ ID NO: 7230965 - DNA, 22 bp, Homo sapiens
tgccatttgtaactatcattct

SEQ ID NO: 7230966 - DNA, 22 bp, Homo sapiens
tgccatttgttactatcaggac

SEQ ID NO: 7230967 - DNA, 21 bp, Homo sapiens
tgccattttaaccaagtgtgc

SEQ ID NO: 7230968 - DNA, 21 bp, Homo sapiens
tgccattttaaccaagtgtgc

SEQ ID NO: 7230969 - DNA, 23 bp, Homo sapiens
tgccattttccatctcatgcaga

SEQ ID NO: 7230970 - DNA, 23 bp, Homo sapiens
tgccattttccatctcatgcaga

SEQ ID NO: 7230971 - DNA, 23 bp, Homo sapiens
tgccattttccatctcatgcaga

SEQ ID NO: 7230972 - DNA, 22 bp, Homo sapiens
tgccattttgagatgttaatga

SEQ ID NO: 7230973 - DNA, 22 bp, Homo sapiens
tgccatttttgagtggggcctc

SEQ ID NO: 7230974 - DNA, 22 bp, Homo sapiens
tgccatttctttcaatattctt

SEQ ID NO: 7230975 - DNA, 19 bp, Homo sapiens
tgccatttgactgaatgta

SEQ ID NO: 7230976 - DNA, 22 bp, Homo sapiens
tgccatttgccccagcactgtc

SEQ ID NO: 7230977 - DNA, 22 bp, Homo sapiens
tgccatttgctggttttctgat

SEQ ID NO: 7230978 - DNA, 22 bp, Homo sapiens
tgccatttctcaaatatgacta

SEQ ID NO: 7230979 - DNA, 22 bp, Homo sapiens
tgccatttctcacatatgtatg

SEQ ID NO: 7230980 - DNA, 22 bp, Homo sapiens
tgccatttctcacatatgtatg

SEQ ID NO: 7230981 - DNA, 22 bp, Homo sapiens
tgccatttctcaggctatttca

SEQ ID NO: 7230982 - DNA, 22 bp, Homo sapiens
tgccatttctttcaatattctt

SEQ ID NO: 7230983 - DNA, 22 bp, Homo sapiens
tgccatttctttcaatattctt

SEQ ID NO: 7230984 - DNA, 22 bp, Homo sapiens
tgccatggagtgggtcaactat

SEQ ID NO: 7230985 - DNA, 22 bp, Homo sapiens
tgccatggattaagtgggtggc

SEQ ID NO: 7230986 - DNA, 22 bp, Homo sapiens
tgccatggattaagtgggtggc

SEQ ID NO: 7230987 - DNA, 22 bp, Homo sapiens
tgccatggagtgggtcaactat

SEQ ID NO: 7230988 - DNA, 20 bp, Homo sapiens
tgccatggtaacagagtgtg

SEQ ID NO: 7230989 - DNA, 20 bp, Homo sapiens
tgccatggtaacagagtgtg

SEQ ID NO: 7230990 - DNA, 22 bp, Homo sapiens
tgccatggtgactgcaggaggt

SEQ ID NO: 7230991 - DNA, 22 bp, Homo sapiens
tgccatggtgactgcaggaggt

SEQ ID NO: 7230992 - DNA, 22 bp, Homo sapiens
tgccatgtttaaagttgaaggg

SEQ ID NO: 7230993 - DNA, 22 bp, Homo sapiens
tgccattgggcagtcattgaag

SEQ ID NO: 7230994 - DNA, 22 bp, Homo sapiens
tgccatttaaaaatgaccaaat

SEQ ID NO: 7230995 - DNA, 22 bp, Homo sapiens
tgccatttaaaaatgaccaaat

SEQ ID NO: 7230996 - DNA, 22 bp, Homo sapiens
tgccatttacgagcagtatgac

SEQ ID NO: 7230997 - DNA, 22 bp, Homo sapiens
tgccatttacgagcagtatgac

SEQ ID NO: 7230998 - DNA, 22 bp, Homo sapiens
tgccatttactgagattagaag

SEQ ID NO: 7230999 - DNA, 22 bp, Homo sapiens
tgccatttagtgcatcattagt

SEQ ID NO: 7231000 - DNA, 22 bp, Homo sapiens
tgccatttataaccagtggcct

SEQ ID NO: 7231001 - DNA, 22 bp, Homo sapiens
tgccatttttgctgggaattta

SEQ ID NO: 7231002 - DNA, 22 bp, Homo sapiens
tgcccaagatcctacatcctga

SEQ ID NO: 7231003 - DNA, 22 bp, Homo sapiens
tgcccaagcagaggagtgattc

SEQ ID NO: 7231004 - DNA, 22 bp, Homo sapiens
tgcccaagccgagctctctgtt

SEQ ID NO: 7231005 - DNA, 22 bp, Homo sapiens
tgcccaagccgagctctctgtt

SEQ ID NO: 7231006 - DNA, 22 bp, Homo sapiens
tgcccaaggatccattggctgg

SEQ ID NO: 7231007 - DNA, 22 bp, Homo sapiens
tgcccaagtgtttggctgagtc

SEQ ID NO: 7231008 - DNA, 22 bp, Homo sapiens
tgcccaagtgtttggctgagtc

SEQ ID NO: 7231009 - DNA, 22 bp, Homo sapiens
tgcccaagtgtttggctgagtc

SEQ ID NO: 7231010 - DNA, 20 bp, Homo sapiens
tgcccacaattcacaatgcc

SEQ ID NO: 7231011 - DNA, 22 bp, Homo sapiens
tgcccacacctgggggaggctg

SEQ ID NO: 7231012 - DNA, 22 bp, Homo sapiens
tgcccacacctgggggaggctg

SEQ ID NO: 7231013 - DNA, 22 bp, Homo sapiens
tgcccacagatatgtgcagtct

SEQ ID NO: 7231014 - DNA, 21 bp, Homo sapiens
tgcccacagcaaatgcagagg

SEQ ID NO: 7231015 - DNA, 22 bp, Homo sapiens
tgcccacagctcagggctgctc

SEQ ID NO: 7231016 - DNA, 22 bp, Homo sapiens
tgcccacagctcagggctgctc

SEQ ID NO: 7231017 - DNA, 22 bp, Homo sapiens
tgcccacaggaagacaccagcg

SEQ ID NO: 7231018 - DNA, 22 bp, Homo sapiens
tgccaggctcaggatgtccctg

SEQ ID NO: 7231019 - DNA, 22 bp, Homo sapiens
tgccaggctcaggatgtccctg

SEQ ID NO: 7231020 - DNA, 22 bp, Homo sapiens
tgccaggctcagcccctatctt

SEQ ID NO: 7231021 - DNA, 22 bp, Homo sapiens
tgccaggctcagcccctatctt

SEQ ID NO: 7231022 - DNA, 22 bp, Homo sapiens
tgccaggctcagcccctatctt

SEQ ID NO: 7231023 - DNA, 22 bp, Homo sapiens
tgccaggctaagtggaggactt

SEQ ID NO: 7231024 - DNA, 22 bp, Homo sapiens
tgccaggctaagtggaggactt

SEQ ID NO: 7231025 - DNA, 22 bp, Homo sapiens
tgccaggctaagtggaggactt

SEQ ID NO: 7231026 - DNA, 22 bp, Homo sapiens
tgccaggccctgtgctggatgc

SEQ ID NO: 7231027 - DNA, 22 bp, Homo sapiens
tgccaggcctcaggagtctcca

SEQ ID NO: 7231028 - DNA, 22 bp, Homo sapiens
tgccaggccctgtgctggatgc

SEQ ID NO: 7231029 - DNA, 22 bp, Homo sapiens
tgccaggccctgcggggtccca

SEQ ID NO: 7231030 - DNA, 22 bp, Homo sapiens
tgccaggccctgtgctggatgc

SEQ ID NO: 7231031 - DNA, 22 bp, Homo sapiens
tgccaggccctcccacagatta

SEQ ID NO: 7231032 - DNA, 22 bp, Homo sapiens
tgccaggccctgcggggtccca

SEQ ID NO: 7231033 - DNA, 22 bp, Homo sapiens
tgccaggccctgcggggtccca

SEQ ID NO: 7231034 - DNA, 22 bp, Homo sapiens
tgccaggccctcccacagatta

SEQ ID NO: 7231035 - DNA, 22 bp, Homo sapiens
tgccaggccctcccacagatta

SEQ ID NO: 7231036 - DNA, 22 bp, Homo sapiens
tgccaggcccagctccagagct

SEQ ID NO: 7231037 - DNA, 22 bp, Homo sapiens
tgccaggccctcccacagatta

SEQ ID NO: 7231038 - DNA, 22 bp, Homo sapiens
tgccaggcccagctccagagct

SEQ ID NO: 7231039 - DNA, 22 bp, Homo sapiens
tgccaggcccagctccagagct

SEQ ID NO: 7231040 - DNA, 22 bp, Homo sapiens
tgccaggcccagcagggcggcc

SEQ ID NO: 7231041 - DNA, 22 bp, Homo sapiens
tgccaggcccagctccagagct

SEQ ID NO: 7231042 - DNA, 22 bp, Homo sapiens
tgccaggcccagctccagagct

SEQ ID NO: 7231043 - DNA, 22 bp, Homo sapiens
tgccaggcccagcagggcggcc

SEQ ID NO: 7231044 - DNA, 22 bp, Homo sapiens
tgccaggcccagcagggcggcc

SEQ ID NO: 7231045 - DNA, 22 bp, Homo sapiens
tgccaggcccagcagggcggcc

SEQ ID NO: 7231046 - DNA, 22 bp, Homo sapiens
tgccaggcccagcagggcggcc

SEQ ID NO: 7231047 - DNA, 22 bp, Homo sapiens
tgccaggccacgtagcttcaag

SEQ ID NO: 7231048 - DNA, 22 bp, Homo sapiens
tgccaggcccagcagggcggcc

SEQ ID NO: 7231049 - DNA, 22 bp, Homo sapiens
tgccaggcccagcagggcggcc

SEQ ID NO: 7231050 - DNA, 22 bp, Homo sapiens
tgccaggccacgtagcttcaag

SEQ ID NO: 7231051 - DNA, 22 bp, Homo sapiens
tgccaggccaattctatttgac

SEQ ID NO: 7231052 - DNA, 22 bp, Homo sapiens
tgccaggccacgtagcttcaag

SEQ ID NO: 7231053 - DNA, 22 bp, Homo sapiens
tgccaggccacgtagcttcaag

SEQ ID NO: 7231054 - DNA, 22 bp, Homo sapiens
tgccaggccacgtagcttcaag

SEQ ID NO: 7231055 - DNA, 22 bp, Homo sapiens
tgccaggccaattctatttgac

SEQ ID NO: 7231056 - DNA, 22 bp, Homo sapiens
tgccaggccaatgaaggcaggg

SEQ ID NO: 7231057 - DNA, 22 bp, Homo sapiens
tgccaggccaatgaaggcaggg

SEQ ID NO: 7231058 - DNA, 22 bp, Homo sapiens
tgccaggccaattctatttgac

SEQ ID NO: 7231059 - DNA, 22 bp, Homo sapiens
tgccaggccaatgaaggcaggg

SEQ ID NO: 7231060 - DNA, 22 bp, Homo sapiens
tgccaggccaatgaaggcaggg

SEQ ID NO: 7231061 - DNA, 22 bp, Homo sapiens
tgccaggccaatgaaggcaggg

SEQ ID NO: 7231062 - DNA, 22 bp, Homo sapiens
tgccaggcatttgacagacact

SEQ ID NO: 7231063 - DNA, 22 bp, Homo sapiens
tgccaggcatttgacagacact

SEQ ID NO: 7231064 - DNA, 22 bp, Homo sapiens
tgccaggcatttgacagacact

SEQ ID NO: 7231065 - DNA, 22 bp, Homo sapiens
tgccaggcatgtagtagacttg

SEQ ID NO: 7231066 - DNA, 22 bp, Homo sapiens
tgccaggcatttgacagacact

SEQ ID NO: 7231067 - DNA, 22 bp, Homo sapiens
tgccaggcatttgacagacact

SEQ ID NO: 7231068 - DNA, 22 bp, Homo sapiens
tgccaggcatgtagtagacttg

SEQ ID NO: 7231069 - DNA, 22 bp, Homo sapiens
tgccaggcatatggcctctttg

SEQ ID NO: 7231070 - DNA, 22 bp, Homo sapiens
tgccaggcatgtagtagacttg

SEQ ID NO: 7231071 - DNA, 22 bp, Homo sapiens
tgccaggcatgtagtagacttg

SEQ ID NO: 7231072 - DNA, 22 bp, Homo sapiens
tgccaggcatatggcctctttg

SEQ ID NO: 7231073 - DNA, 22 bp, Homo sapiens
tgccaggcatatggcctctttg

SEQ ID NO: 7231074 - DNA, 22 bp, Homo sapiens
tgccaggcagtgtcagattgag

SEQ ID NO: 7231075 - DNA, 22 bp, Homo sapiens
tgccaggcatatggcctctttg

SEQ ID NO: 7231076 - DNA, 22 bp, Homo sapiens
tgccaggcatatggcctctttg

SEQ ID NO: 7231077 - DNA, 22 bp, Homo sapiens
tgccaggcagtgtcagattgag

SEQ ID NO: 7231078 - DNA, 22 bp, Homo sapiens
tgccaggcagtgtcagattgag

SEQ ID NO: 7231079 - DNA, 22 bp, Homo sapiens
tgccaggcaggaccctagaacc

SEQ ID NO: 7231080 - DNA, 22 bp, Homo sapiens
tgccaggcacgtgagagtggcc

SEQ ID NO: 7231081 - DNA, 22 bp, Homo sapiens
tgccaggcacgtgagagtggcc

SEQ ID NO: 7231082 - DNA, 22 bp, Homo sapiens
tgccaggcaggaccctagaacc

SEQ ID NO: 7231083 - DNA, 22 bp, Homo sapiens
tgccaggcaggaccctagaacc

SEQ ID NO: 7231084 - DNA, 22 bp, Homo sapiens
tgccaggcaggaccctagaacc

SEQ ID NO: 7231085 - DNA, 22 bp, Homo sapiens
tgccaggcacgtgagagtggcc

SEQ ID NO: 7231086 - DNA, 22 bp, Homo sapiens
tgccaggcacgtgagagtggcc

SEQ ID NO: 7231087 - DNA, 22 bp, Homo sapiens
tgccaggcacgtgagagtggcc

SEQ ID NO: 7231088 - DNA, 20 bp, Homo sapiens
tgccaggcacggagtgcatg

SEQ ID NO: 7231089 - DNA, 20 bp, Homo sapiens
tgccaggcacggagtgcatg

SEQ ID NO: 7231090 - DNA, 20 bp, Homo sapiens
tgccaggcacggagtgcatg

SEQ ID NO: 7231091 - DNA, 22 bp, Homo sapiens
tgccaggcaactgcccagccat

SEQ ID NO: 7231092 - DNA, 20 bp, Homo sapiens
tgccaggcacggagtgcatg

SEQ ID NO: 7231093 - DNA, 22 bp, Homo sapiens
tgccaggcaactgcccagccat

SEQ ID NO: 7231094 - DNA, 22 bp, Homo sapiens
tgccaggcaactgcccagccat

SEQ ID NO: 7231095 - DNA, 22 bp, Homo sapiens
tgccaggcaactgcccagccat

SEQ ID NO: 7231096 - DNA, 19 bp, Homo sapiens
tgccagctcacaggagctc

SEQ ID NO: 7231097 - DNA, 19 bp, Homo sapiens
tgccagctcacaggagctc

SEQ ID NO: 7231098 - DNA, 22 bp, Homo sapiens
tgccagctcccttttctcctcc

SEQ ID NO: 7231099 - DNA, 22 bp, Homo sapiens
tgccagctcccttttctcctcc

SEQ ID NO: 7231100 - DNA, 18 bp, Homo sapiens
tgccagccgactggcctg

SEQ ID NO: 7231101 - DNA, 18 bp, Homo sapiens
tgccagccgactggcctg

SEQ ID NO: 7231102 - DNA, 22 bp, Homo sapiens
tgccagcctggcctgagtcttt

SEQ ID NO: 7231103 - DNA, 17 bp, Homo sapiens
tgccagcctgtcccagg

SEQ ID NO: 7231104 - DNA, 19 bp, Homo sapiens
tgccagctcacaggagctc

SEQ ID NO: 7231105 - DNA, 22 bp, Homo sapiens
tgccatggaagtggccagacct

SEQ ID NO: 7231106 - DNA, 22 bp, Homo sapiens
tgccatggaagtggccagacct

SEQ ID NO: 7231107 - DNA, 22 bp, Homo sapiens
tgccatctgcacccacctgccc

SEQ ID NO: 7231108 - DNA, 22 bp, Homo sapiens
tgccatccccatgtggtggaga

SEQ ID NO: 7231109 - DNA, 22 bp, Homo sapiens
tgccatcctgtgtcatgctcat

SEQ ID NO: 7231110 - DNA, 22 bp, Homo sapiens
tgccatcactgaacttctgaaa

SEQ ID NO: 7231111 - DNA, 22 bp, Homo sapiens
tgccagtctcaccctgggtcct

SEQ ID NO: 7231112 - DNA, 22 bp, Homo sapiens
tgccagtcagtggtttaaaagt

SEQ ID NO: 7231113 - DNA, 22 bp, Homo sapiens
tgccagtcagttggtgtgggac

SEQ ID NO: 7231114 - DNA, 22 bp, Homo sapiens
tgccatcactgaacttctgaaa

SEQ ID NO: 7231115 - DNA, 22 bp, Homo sapiens
tgccatcactgaacttctgaaa

SEQ ID NO: 7231116 - DNA, 22 bp, Homo sapiens
tgccatcagctgactccaaggt

SEQ ID NO: 7231117 - DNA, 22 bp, Homo sapiens
tgccagggtgtcaggagagcta

SEQ ID NO: 7231118 - DNA, 22 bp, Homo sapiens
tgccaggtacacaagtagccag

SEQ ID NO: 7231119 - DNA, 23 bp, Homo sapiens
tgccagggccctgtgtgcaatgc

SEQ ID NO: 7231120 - DNA, 22 bp, Homo sapiens
tgccagggctgctactggctga

SEQ ID NO: 7231121 - DNA, 22 bp, Homo sapiens
tgccagggccatagggagtcta

SEQ ID NO: 7231122 - DNA, 22 bp, Homo sapiens
tgccagggccatagggagtcta

SEQ ID NO: 7231123 - DNA, 22 bp, Homo sapiens
tgccagggccatagggagtcta

SEQ ID NO: 7231124 - DNA, 22 bp, Homo sapiens
tgccagggccatagggagtcta

SEQ ID NO: 7231125 - DNA, 22 bp, Homo sapiens
tgccagggtcctgagggccttg

SEQ ID NO: 7231126 - DNA, 22 bp, Homo sapiens
tgccagggtgtcaggagagcta

SEQ ID NO: 7231127 - DNA, 22 bp, Homo sapiens
tgccagggtgtcaggagagcta

SEQ ID NO: 7231128 - DNA, 22 bp, Homo sapiens
tgccagggtcctgagggccttg

SEQ ID NO: 7231129 - DNA, 22 bp, Homo sapiens
tgccagggtcagctgcagctct

SEQ ID NO: 7231130 - DNA, 22 bp, Homo sapiens
tgccagggtcctgagggccttg

SEQ ID NO: 7231131 - DNA, 22 bp, Homo sapiens
tgccaggggacctagggatgtc

SEQ ID NO: 7231132 - DNA, 22 bp, Homo sapiens
tgccagggtcagctgcagctct

SEQ ID NO: 7231133 - DNA, 22 bp, Homo sapiens
tgccagggtcagctgcagctct

SEQ ID NO: 7231134 - DNA, 22 bp, Homo sapiens
tgccagggtcagctgcagctct

SEQ ID NO: 7231135 - DNA, 22 bp, Homo sapiens
tgccaggggacctagggatgtc

SEQ ID NO: 7231136 - DNA, 22 bp, Homo sapiens
tgccaggctgtcctgggcctgg

SEQ ID NO: 7231137 - DNA, 22 bp, Homo sapiens
tgccaggctgtcaattcaccca

SEQ ID NO: 7231138 - DNA, 22 bp, Homo sapiens
tgccaggctgtcctgggcctgg

SEQ ID NO: 7231139 - DNA, 22 bp, Homo sapiens
tgccaggctgtcctgggcctgg

SEQ ID NO: 7231140 - DNA, 22 bp, Homo sapiens
tgccaggctgtcctgggcctgg

SEQ ID NO: 7231141 - DNA, 22 bp, Homo sapiens
tgccaggctgtcctgggcctgg

SEQ ID NO: 7231142 - DNA, 22 bp, Homo sapiens
tgccaggctgtcaattcaccca

SEQ ID NO: 7231143 - DNA, 22 bp, Homo sapiens
tgccaggctgccctccagtctg

SEQ ID NO: 7231144 - DNA, 22 bp, Homo sapiens
tgccaggctgccctccagtctg

SEQ ID NO: 7231145 - DNA, 22 bp, Homo sapiens
tgccaggctgccctccagtctg

SEQ ID NO: 7231146 - DNA, 20 bp, Homo sapiens
tgccaggctgcacgcctgcc

SEQ ID NO: 7231147 - DNA, 20 bp, Homo sapiens
tgccaggctgcacgcctgcc

SEQ ID NO: 7231148 - DNA, 20 bp, Homo sapiens
tgccaggctgcacgcctgcc

SEQ ID NO: 7231149 - DNA, 22 bp, Homo sapiens
tgccaggctgaacagggtctta

SEQ ID NO: 7231150 - DNA, 20 bp, Homo sapiens
tgccaggctgcacgcctgcc

SEQ ID NO: 7231151 - DNA, 22 bp, Homo sapiens
tgccaggctgaacagggtctta

SEQ ID NO: 7231152 - DNA, 22 bp, Homo sapiens
tgccaggctgaacagggtctta

SEQ ID NO: 7231153 - DNA, 22 bp, Homo sapiens
tgccaggctgaacagggtctta

SEQ ID NO: 7231154 - DNA, 22 bp, Homo sapiens
tgccaggctgaacagggtctta

SEQ ID NO: 7231155 - DNA, 22 bp, Homo sapiens
tgccaggctccggaacgacagt

SEQ ID NO: 7231156 - DNA, 22 bp, Homo sapiens
tgccaggctccggaacgacagt

SEQ ID NO: 7231157 - DNA, 22 bp, Homo sapiens
tgccaggctcaggatgtccctg

SEQ ID NO: 7231158 - DNA, 22 bp, Homo sapiens
tgccaggctccggaacgacagt

SEQ ID NO: 7231159 - DNA, 22 bp, Homo sapiens
tgccaggctccggaacgacagt

SEQ ID NO: 7231160 - DNA, 22 bp, Homo sapiens
tgccaggctttggtcaaaggct

SEQ ID NO: 7231161 - DNA, 22 bp, Homo sapiens
tgccaggcttagagcaggggct

SEQ ID NO: 7231162 - DNA, 22 bp, Homo sapiens
tgccaggcttagagcaggggct

SEQ ID NO: 7231163 - DNA, 22 bp, Homo sapiens
tgccaggctttggtcaaaggct

SEQ ID NO: 7231164 - DNA, 22 bp, Homo sapiens
tgccaggcttagagcaggggct

SEQ ID NO: 7231165 - DNA, 22 bp, Homo sapiens
tgccaggcttagagcaggggct

SEQ ID NO: 7231166 - DNA, 22 bp, Homo sapiens
tgccaggcttagagcaggggct

SEQ ID NO: 7231167 - DNA, 22 bp, Homo sapiens
tgccagggaccctgtcggccct

SEQ ID NO: 7231168 - DNA, 22 bp, Homo sapiens
tgccagggagccctgctgacca

SEQ ID NO: 7231169 - DNA, 22 bp, Homo sapiens
tgccagggagccctgctgacca

SEQ ID NO: 7231170 - DNA, 22 bp, Homo sapiens
tgccaggctttggtcaaaggct

SEQ ID NO: 7231171 - DNA, 22 bp, Homo sapiens
tgccaggctttggtcaaaggct

SEQ ID NO: 7231172 - DNA, 20 bp, Homo sapiens
tgccagggccagcagaggct

SEQ ID NO: 7231173 - DNA, 20 bp, Homo sapiens
tgccagggccagcagaggct

SEQ ID NO: 7231174 - DNA, 20 bp, Homo sapiens
tgccagggccagcagaggct

SEQ ID NO: 7231175 - DNA, 20 bp, Homo sapiens
tgccagggccagcagaggct

SEQ ID NO: 7231176 - DNA, 22 bp, Homo sapiens
tgccagggagccctgctgacca

SEQ ID NO: 7231177 - DNA, 22 bp, Homo sapiens
tgccagggagccctgctgacca

SEQ ID NO: 7231178 - DNA, 21 bp, Homo sapiens
tgccagggatttacagagcct

SEQ ID NO: 7231179 - DNA, 22 bp, Homo sapiens
tgcagggattagaggccgggga

SEQ ID NO: 7231180 - DNA, 22 bp, Homo sapiens
tgcagggatgctagaggtaaga

SEQ ID NO: 7231181 - DNA, 22 bp, Homo sapiens
tgcagggatgctagaggtaaga

SEQ ID NO: 7231182 - DNA, 22 bp, Homo sapiens
tgcagggattagaggccgggga

SEQ ID NO: 7231183 - DNA, 22 bp, Homo sapiens
tgcagggatgctagaggtaaga

SEQ ID NO: 7231184 - DNA, 22 bp, Homo sapiens
tgcagggatgctagaggtaaga

SEQ ID NO: 7231185 - DNA, 22 bp, Homo sapiens
tgcagggatcctagctgaagag

SEQ ID NO: 7231186 - DNA, 22 bp, Homo sapiens
tgcagggatcctagctgaagag

SEQ ID NO: 7231187 - DNA, 21 bp, Homo sapiens
tgcagggatctttctgcctga

SEQ ID NO: 7231188 - DNA, 23 bp, Homo sapiens
tgcagggcaagttagagacccca

SEQ ID NO: 7231189 - DNA, 22 bp, Homo sapiens
tgcagggcacacgcacgggtgt

SEQ ID NO: 7231190 - DNA, 22 bp, Homo sapiens
tgcagggcacacgcacgggtgt

SEQ ID NO: 7231191 - DNA, 22 bp, Homo sapiens
tgcagggcacacgcacgggtgt

SEQ ID NO: 7231192 - DNA, 22 bp, Homo sapiens
tgcagggcacacgcacgggtgt

SEQ ID NO: 7231193 - DNA, 22 bp, Homo sapiens
tgcagggattatgtaggggttg

SEQ ID NO: 7231194 - DNA, 22 bp, Homo sapiens
tgcagggattatgtaggggttg

SEQ ID NO: 7231195 - DNA, 22 bp, Homo sapiens
tgcagggattatgtaggggttg

SEQ ID NO: 7231196 - DNA, 22 bp, Homo sapiens
tgcagggattgttggcatccat

SEQ ID NO: 7231197 - DNA, 22 bp, Homo sapiens
tgcagggattgttggcatccat

SEQ ID NO: 7231198 - DNA, 22 bp, Homo sapiens
tgcagggattgttggcatccat

SEQ ID NO: 7231199 - DNA, 22 bp, Homo sapiens
tgcagggcagctagggagcttt

SEQ ID NO: 7231200 - DNA, 22 bp, Homo sapiens
tgcagggcagctagggagcttt

SEQ ID NO: 7231201 - DNA, 22 bp, Homo sapiens
tgcagggcagctagggagcttt

SEQ ID NO: 7231202 - DNA, 22 bp, Homo sapiens
tgcagggcagctagggagcttt

SEQ ID NO: 7231203 - DNA, 22 bp, Homo sapiens
tgcagggcagctagggagcttt

SEQ ID NO: 7231204 - DNA, 22 bp, Homo sapiens
tgcagggcagatatgactgtag

SEQ ID NO: 7231205 - DNA, 22 bp, Homo sapiens
tgcagggcagatatgactgtag

SEQ ID NO: 7231206 - DNA, 22 bp, Homo sapiens
tgcagggcagtggaggttgagt

SEQ ID NO: 7231207 - DNA, 22 bp, Homo sapiens
tgcagggcagtggaggttgagt

SEQ ID NO: 7231208 - DNA, 22 bp, Homo sapiens
tgcagggcagtggaggttgagt

SEQ ID NO: 7231209 - DNA, 22 bp, Homo sapiens
tgcagggcagtggaggttgagt

SEQ ID NO: 7231210 - DNA, 22 bp, Homo sapiens
tgcagggcagtggaggttgagt

SEQ ID NO: 7231211 - DNA, 22 bp, Homo sapiens
tgcagggcagtttgtttcggca

SEQ ID NO: 7231212 - DNA, 22 bp, Homo sapiens
tgcagggcagatatgactgtag

SEQ ID NO: 7231213 - DNA, 22 bp, Homo sapiens
tgcagggcagatatgactgtag

SEQ ID NO: 7231214 - DNA, 22 bp, Homo sapiens
tgcagggcagatatgactgtag

SEQ ID NO: 7231215 - DNA, 22 bp, Homo sapiens
tgcagggcacggtgcgcgtggg

SEQ ID NO: 7231216 - DNA, 22 bp, Homo sapiens
tgcagggcacacgcacgggtgt

SEQ ID NO: 7231217 - DNA, 22 bp, Homo sapiens
tgcagggcacggtgcgcgtggg

SEQ ID NO: 7231218 - DNA, 22 bp, Homo sapiens
tgcagggcacggtgcgcgtggg

SEQ ID NO: 7231219 - DNA, 22 bp, Homo sapiens
tgcagggcacggtgcgcgtggg

SEQ ID NO: 7231220 - DNA, 22 bp, Homo sapiens
tgcagggcacggtgcgcgtggg

SEQ ID NO: 7231221 - DNA, 22 bp, Homo sapiens
tgcagggcacggtgcgcgtggg

SEQ ID NO: 7231222 - DNA, 22 bp, Homo sapiens
tgcagggcacacgcacgggtgt

SEQ ID NO: 7231223 - DNA, 22 bp, Homo sapiens
tgcagggcatctttgaagtgtg

SEQ ID NO: 7231224 - DNA, 22 bp, Homo sapiens
tgcagggcatagggtccagttt

SEQ ID NO: 7231225 - DNA, 22 bp, Homo sapiens
tgcagggcagtttgtttcggca

SEQ ID NO: 7231226 - DNA, 22 bp, Homo sapiens
tgcagggcagtttgtttcggca

SEQ ID NO: 7231227 - DNA, 22 bp, Homo sapiens
tgcagggcatagggtccagttt

SEQ ID NO: 7231228 - DNA, 22 bp, Homo sapiens
tgcagggcatagggtccagttt

SEQ ID NO: 7231229 - DNA, 22 bp, Homo sapiens
tgcagggcatctttgaagtgtg

SEQ ID NO: 7231230 - DNA, 22 bp, Homo sapiens
tgcagggcatctttgaagtgtg

SEQ ID NO: 7231231 - DNA, 22 bp, Homo sapiens
tgcagggcatctttgaagtgtg

SEQ ID NO: 7231232 - DNA, 22 bp, Homo sapiens
tgcagggcatctttgaagtgtg

SEQ ID NO: 7231233 - DNA, 22 bp, Homo sapiens
tgcagggccagactgggttgga

SEQ ID NO: 7231234 - DNA, 22 bp, Homo sapiens
tgcagggccagactgggttgga

SEQ ID NO: 7231235 - DNA, 22 bp, Homo sapiens
tgcagggccagactgggttgga

SEQ ID NO: 7231236 - DNA, 22 bp, Homo sapiens
tgcagggcatctttgaagtgtg

SEQ ID NO: 7231237 - DNA, 22 bp, Homo sapiens
tgcagggccatggtggcggctg

SEQ ID NO: 7231238 - DNA, 22 bp, Homo sapiens
tgcagggccatggtggcggctg

SEQ ID NO: 7231239 - DNA, 22 bp, Homo sapiens
tgcagggcccctctgcatgagt

SEQ ID NO: 7231240 - DNA, 22 bp, Homo sapiens
tgcagggcccctctgcatgagt

SEQ ID NO: 7231241 - DNA, 22 bp, Homo sapiens
tgcagggccagactgggttgga

SEQ ID NO: 7231242 - DNA, 22 bp, Homo sapiens
tgcagggccatggtggcggctg

SEQ ID NO: 7231243 - DNA, 22 bp, Homo sapiens
tgcagggccagactgggttgga

SEQ ID NO: 7231244 - DNA, 22 bp, Homo sapiens
tgcagggccatggtggcggctg

SEQ ID NO: 7231245 - DNA, 22 bp, Homo sapiens
tgcagggccatggtggcggctg

SEQ ID NO: 7231246 - DNA, 22 bp, Homo sapiens
tgcagggccatggtggcggctg

SEQ ID NO: 7231247 - DNA, 22 bp, Homo sapiens
tgcagggccgctggaggtcatg

SEQ ID NO: 7231248 - DNA, 22 bp, Homo sapiens
tgcagggccgctggaggtcatg

SEQ ID NO: 7231249 - DNA, 22 bp, Homo sapiens
tgcagggccgctggaggtcatg

SEQ ID NO: 7231250 - DNA, 22 bp, Homo sapiens
tgcagggctacaggactacaac

SEQ ID NO: 7231251 - DNA, 22 bp, Homo sapiens
tgcagggctataactccattct

SEQ ID NO: 7231252 - DNA, 22 bp, Homo sapiens
tgcagggctataactccattct

SEQ ID NO: 7231253 - DNA, 22 bp, Homo sapiens
tgcagggctataactccattct

SEQ ID NO: 7231254 - DNA, 22 bp, Homo sapiens
tgcagggctataactccattct

SEQ ID NO: 7231255 - DNA, 22 bp, Homo sapiens
tgcagggctcctggctccaatc

SEQ ID NO: 7231256 - DNA, 22 bp, Homo sapiens
tgcagggctcctggctccaatc

SEQ ID NO: 7231257 - DNA, 22 bp, Homo sapiens
tgcagggctcctggctccaatc

SEQ ID NO: 7231258 - DNA, 22 bp, Homo sapiens
tgcagggctcctggctccaatc

SEQ ID NO: 7231259 - DNA, 22 bp, Homo sapiens
tgcagggcccctctgcatgagt

SEQ ID NO: 7231260 - DNA, 22 bp, Homo sapiens
tgcagggccctcattcctgtcc

SEQ ID NO: 7231261 - DNA, 22 bp, Homo sapiens
tgcagggccctcattcctgtcc

SEQ ID NO: 7231262 - DNA, 22 bp, Homo sapiens
tgcagggccctcattcctgtcc

SEQ ID NO: 7231263 - DNA, 22 bp, Homo sapiens
tgcagggccctcattcctgtcc

SEQ ID NO: 7231264 - DNA, 22 bp, Homo sapiens
tgcagggcccttggggttgaac

SEQ ID NO: 7231265 - DNA, 22 bp, Homo sapiens
tgcagggcccttggggttgaac

SEQ ID NO: 7231266 - DNA, 22 bp, Homo sapiens
tgcagggcccttggggttgaac

SEQ ID NO: 7231267 - DNA, 22 bp, Homo sapiens
tgcagggcccttggggttgaac

SEQ ID NO: 7231268 - DNA, 22 bp, Homo sapiens
tgcagggcccttggggttgaac

SEQ ID NO: 7231269 - DNA, 22 bp, Homo sapiens
tgcagggcccttggggttgaac

SEQ ID NO: 7231270 - DNA, 22 bp, Homo sapiens
tgcagggccgctggaggtcatg

SEQ ID NO: 7231271 - DNA, 22 bp, Homo sapiens
tgcagggccgctggaggtcatg

SEQ ID NO: 7231272 - DNA, 22 bp, Homo sapiens
tgcagggccgctggaggtcatg

SEQ ID NO: 7231273 - DNA, 22 bp, Homo sapiens
tgcagggaagcaagggtggctc

SEQ ID NO: 7231274 - DNA, 22 bp, Homo sapiens
tgcagggaagcaagggtggctc

SEQ ID NO: 7231275 - DNA, 22 bp, Homo sapiens
tgcagggaagtcccagctcctg

SEQ ID NO: 7231276 - DNA, 22 bp, Homo sapiens
tgcagggaagtcccagctcctg

SEQ ID NO: 7231277 - DNA, 22 bp, Homo sapiens
tgcagggaacttggacagctag

SEQ ID NO: 7231278 - DNA, 22 bp, Homo sapiens
tgcagggaagcaagggtggctc

SEQ ID NO: 7231279 - DNA, 22 bp, Homo sapiens
tgcagggaagcaagggtggctc

SEQ ID NO: 7231280 - DNA, 22 bp, Homo sapiens
tgcagggaagtcccagctcctg

SEQ ID NO: 7231281 - DNA, 22 bp, Homo sapiens
tgcagggaatccagtctagggt

SEQ ID NO: 7231282 - DNA, 22 bp, Homo sapiens
tgcagggaatccagtctagggt

SEQ ID NO: 7231283 - DNA, 22 bp, Homo sapiens
tgcagggaatccagtctagggt

SEQ ID NO: 7231284 - DNA, 22 bp, Homo sapiens
tgcagggaacttggacagctag

SEQ ID NO: 7231285 - DNA, 22 bp, Homo sapiens
tgcagggaacttggacagctag

SEQ ID NO: 7231286 - DNA, 22 bp, Homo sapiens
tgcagggaacttggacagctag

SEQ ID NO: 7231287 - DNA, 22 bp, Homo sapiens
tgcagggaaagtgttggcagca

SEQ ID NO: 7231288 - DNA, 22 bp, Homo sapiens
tgcagggaacttggacagctag

SEQ ID NO: 7231289 - DNA, 22 bp, Homo sapiens
tgcagggaaagtgttggcagca

SEQ ID NO: 7231290 - DNA, 22 bp, Homo sapiens
tgcagggaaagtgttggcagca

SEQ ID NO: 7231291 - DNA, 22 bp, Homo sapiens
tgcagggaaagtgttggcagca

SEQ ID NO: 7231292 - DNA, 22 bp, Homo sapiens
tgcagggaaaacccaggatgct

SEQ ID NO: 7231293 - DNA, 22 bp, Homo sapiens
tgcagggaaagggcactgggct

SEQ ID NO: 7231294 - DNA, 22 bp, Homo sapiens
tgcagggaaagggcactgggct

SEQ ID NO: 7231295 - DNA, 22 bp, Homo sapiens
tgcagggaaaacccaggatgct

SEQ ID NO: 7231296 - DNA, 22 bp, Homo sapiens
tgcagggaaaacccaggatgct

SEQ ID NO: 7231297 - DNA, 22 bp, Homo sapiens
tgcagggaaaacccaggatgct

SEQ ID NO: 7231298 - DNA, 22 bp, Homo sapiens
tgcagggaaaacccaggatgct

SEQ ID NO: 7231299 - DNA, 22 bp, Homo sapiens
tgcagggaaaacccaggatgct

SEQ ID NO: 7231300 - DNA, 22 bp, Homo sapiens
tgcagggaaaacccaggatgct

SEQ ID NO: 7231301 - DNA, 22 bp, Homo sapiens
tgcagggaaaacccaggatgct

SEQ ID NO: 7231302 - DNA, 22 bp, Homo sapiens
tgcaggcttggatcacatctcc

SEQ ID NO: 7231303 - DNA, 22 bp, Homo sapiens
tgcaggcttggatcacatctcc

SEQ ID NO: 7231304 - DNA, 22 bp, Homo sapiens
tgcaggctgtttggtggatctc

SEQ ID NO: 7231305 - DNA, 22 bp, Homo sapiens
tgcaggcttggatcacatctcc

SEQ ID NO: 7231306 - DNA, 21 bp, Homo sapiens
tgcaggctgtgcgctcctgcc

SEQ ID NO: 7231307 - DNA, 21 bp, Homo sapiens
tgcaggctgtgcgctcctgcc

SEQ ID NO: 7231308 - DNA, 17 bp, Homo sapiens
tgcaggctgttatagcc

SEQ ID NO: 7231309 - DNA, 21 bp, Homo sapiens
tgcaggctgtttaagaggcaa

SEQ ID NO: 7231310 - DNA, 22 bp, Homo sapiens
tgcaggctgtttggtggatctc

SEQ ID NO: 7231311 - DNA, 22 bp, Homo sapiens
tgcaggctgtaatctgaggcta

SEQ ID NO: 7231312 - DNA, 22 bp, Homo sapiens
tgcaggctgtaatctgaggcta

SEQ ID NO: 7231313 - DNA, 18 bp, Homo sapiens
tgcaggctggggttcctc

SEQ ID NO: 7231314 - DNA, 22 bp, Homo sapiens
tgcaggctggggaggcagactt

SEQ ID NO: 7231315 - DNA, 22 bp, Homo sapiens
tgcaggctgggaagagggacaa

SEQ ID NO: 7231316 - DNA, 22 bp, Homo sapiens
tgcaggctgggaagagggacaa

SEQ ID NO: 7231317 - DNA, 22 bp, Homo sapiens
tgcaggctgctggcagtagctt

SEQ ID NO: 7231318 - DNA, 22 bp, Homo sapiens
tgcaggctggaggagggactaa

SEQ ID NO: 7231319 - DNA, 22 bp, Homo sapiens
tgcaggctggaggagggactaa

SEQ ID NO: 7231320 - DNA, 22 bp, Homo sapiens
tgcaggctggaggagggactaa

SEQ ID NO: 7231321 - DNA, 22 bp, Homo sapiens
tgcaggctggcagatatctcat

SEQ ID NO: 7231322 - DNA, 22 bp, Homo sapiens
tgcaggctggcagtgctgaaat

SEQ ID NO: 7231323 - DNA, 22 bp, Homo sapiens
tgcaggctctgtgtgtgcctgg

SEQ ID NO: 7231324 - DNA, 22 bp, Homo sapiens
tgcaggctcttggtgacgtggg

SEQ ID NO: 7231325 - DNA, 22 bp, Homo sapiens
tgcaggctgaggctggctcaac

SEQ ID NO: 7231326 - DNA, 22 bp, Homo sapiens
tgcaggctgaggctggctcaac

SEQ ID NO: 7231327 - DNA, 22 bp, Homo sapiens
tgcaggctgcacccctgccctg

SEQ ID NO: 7231328 - DNA, 22 bp, Homo sapiens
tgcaggctgcacccctgccctg

SEQ ID NO: 7231329 - DNA, 22 bp, Homo sapiens
tgcaggctgcagtctcaggtgg

SEQ ID NO: 7231330 - DNA, 22 bp, Homo sapiens
tgcaggctgcagtctcaggtgg

SEQ ID NO: 7231331 - DNA, 22 bp, Homo sapiens
tgcaggctctctgctgccagat

SEQ ID NO: 7231332 - DNA, 22 bp, Homo sapiens
tgcaggctctggtttatagtgc

SEQ ID NO: 7231333 - DNA, 22 bp, Homo sapiens
tgcaggctctctgctgccagat

SEQ ID NO: 7231334 - DNA, 22 bp, Homo sapiens
tgcaggctctctgctgccagat

SEQ ID NO: 7231335 - DNA, 17 bp, Homo sapiens
tgcaggctcctgtccct

SEQ ID NO: 7231336 - DNA, 22 bp, Homo sapiens
tgcaggctccatgaggacaggc

SEQ ID NO: 7231337 - DNA, 22 bp, Homo sapiens
tgcaggctccatgaggacaggc

SEQ ID NO: 7231338 - DNA, 22 bp, Homo sapiens
tgcaggctccatgaggacaggc

SEQ ID NO: 7231339 - DNA, 22 bp, Homo sapiens
tgcaggtgtctccagggcaggt

SEQ ID NO: 7231340 - DNA, 22 bp, Homo sapiens
tgcaggtgtctccagggcaggt

SEQ ID NO: 7231341 - DNA, 22 bp, Homo sapiens
tgcaggtgtctccagggcaggt

SEQ ID NO: 7231342 - DNA, 22 bp, Homo sapiens
tgcaggtggtttggacactgct

SEQ ID NO: 7231343 - DNA, 22 bp, Homo sapiens
tgcaggtggtttggacactgct

SEQ ID NO: 7231344 - DNA, 22 bp, Homo sapiens
tgcaggtgtaaattttcaagag

SEQ ID NO: 7231345 - DNA, 22 bp, Homo sapiens
tgcaggtgtagagttgggctcc

SEQ ID NO: 7231346 - DNA, 22 bp, Homo sapiens
tgcaggtgtagagttgggctcc

SEQ ID NO: 7231347 - DNA, 22 bp, Homo sapiens
tgcaggtggtccttcctctgct

SEQ ID NO: 7231348 - DNA, 22 bp, Homo sapiens
tgcaggtggtccttcctctgct

SEQ ID NO: 7231349 - DNA, 22 bp, Homo sapiens
tgcaggtggtccttcctctgct

SEQ ID NO: 7231350 - DNA, 22 bp, Homo sapiens
tgcaggtggtttggacactgct

SEQ ID NO: 7231351 - DNA, 20 bp, Homo sapiens
tgcaggtgggcccttctggg

SEQ ID NO: 7231352 - DNA, 20 bp, Homo sapiens
tgcaggtgggcccttctggg

SEQ ID NO: 7231353 - DNA, 20 bp, Homo sapiens
tgcaggtgggcccttctggg

SEQ ID NO: 7231354 - DNA, 22 bp, Homo sapiens
tgcaggtggtacttctttttct

SEQ ID NO: 7231355 - DNA, 22 bp, Homo sapiens
tgcaggtggtccatttgggaac

SEQ ID NO: 7231356 - DNA, 22 bp, Homo sapiens
tgcaggtgtgtgcaagggaggg

SEQ ID NO: 7231357 - DNA, 22 bp, Homo sapiens
tgcaggtgtgtgcaagggaggg

SEQ ID NO: 7231358 - DNA, 22 bp, Homo sapiens
tgcaggtgtgtgcaagggaggg

SEQ ID NO: 7231359 - DNA, 20 bp, Homo sapiens
tgcaggtgttggagaaggta

SEQ ID NO: 7231360 - DNA, 20 bp, Homo sapiens
tgcaggtgtgtccaagcact

SEQ ID NO: 7231361 - DNA, 22 bp, Homo sapiens
tgcaggtgtggttcctcagcca

SEQ ID NO: 7231362 - DNA, 22 bp, Homo sapiens
tgcaggtgtctgggggcaacag

SEQ ID NO: 7231363 - DNA, 23 bp, Homo sapiens
tgcaggtgtgcagagggctcttg

SEQ ID NO: 7231364 - DNA, 22 bp, Homo sapiens
tgcaggtgtctctgtctagcgt

SEQ ID NO: 7231365 - DNA, 22 bp, Homo sapiens
tgcaggtgtctctgtctagcgt

SEQ ID NO: 7231366 - DNA, 22 bp, Homo sapiens
tgcaggtgtctgggggcaacag

SEQ ID NO: 7231367 - DNA, 22 bp, Homo sapiens
tgcaggtgtgggcaggggagca

SEQ ID NO: 7231368 - DNA, 22 bp, Homo sapiens
tgcaggtgtgggcaggggagca

SEQ ID NO: 7231369 - DNA, 22 bp, Homo sapiens
tgcaggtgtgggcaggggagca

SEQ ID NO: 7231370 - DNA, 22 bp, Homo sapiens
tgcaggtgtgggcaggggagca

SEQ ID NO: 7231371 - DNA, 22 bp, Homo sapiens
tgcagtggtggtaaagatgctc

SEQ ID NO: 7231372 - DNA, 22 bp, Homo sapiens
tgcagtgggccggaggccaggg

SEQ ID NO: 7231373 - DNA, 22 bp, Homo sapiens
tgcagtgggccggaggccaggg

SEQ ID NO: 7231374 - DNA, 22 bp, Homo sapiens
tgcagtggtggtaaagatgctc

SEQ ID NO: 7231375 - DNA, 22 bp, Homo sapiens
tgcagtggtacaatttcggctc

SEQ ID NO: 7231376 - DNA, 22 bp, Homo sapiens
tgcagtggtggtaaagatgctc

SEQ ID NO: 7231377 - DNA, 22 bp, Homo sapiens
tgcagtggtgtccaggtgtact

SEQ ID NO: 7231378 - DNA, 22 bp, Homo sapiens
tgcagtggtgtccaggtgtact

SEQ ID NO: 7231379 - DNA, 22 bp, Homo sapiens
tgcagtgggccggaggccaggg

SEQ ID NO: 7231380 - DNA, 22 bp, Homo sapiens
tgcagtgggccggaggccaggg

SEQ ID NO: 7231381 - DNA, 22 bp, Homo sapiens
tgcagtgggccggaggccaggg

SEQ ID NO: 7231382 - DNA, 21 bp, Homo sapiens
tgcagtatgtatttgtatcca

SEQ ID NO: 7231383 - DNA, 22 bp, Homo sapiens
tgcagtaggcacgtggctgtga

SEQ ID NO: 7231384 - DNA, 23 bp, Homo sapiens
tgcagtaggatggggctgggcct

SEQ ID NO: 7231385 - DNA, 20 bp, Homo sapiens
tgcaggtgttggagaaggta

SEQ ID NO: 7231386 - DNA, 22 bp, Homo sapiens
tgcagtccaagagtctcctggt

SEQ ID NO: 7231387 - DNA, 22 bp, Homo sapiens
tgcagtccaagagtctcctggt

SEQ ID NO: 7231388 - DNA, 22 bp, Homo sapiens
tgcagtccctggcccactttaa

SEQ ID NO: 7231389 - DNA, 22 bp, Homo sapiens
tgcagtcctaaatatatagctg

SEQ ID NO: 7231390 - DNA, 22 bp, Homo sapiens
tgcagtcctaaatatatagctg

SEQ ID NO: 7231391 - DNA, 22 bp, Homo sapiens
tgcagtcctggtgaggggacat

SEQ ID NO: 7231392 - DNA, 21 bp, Homo sapiens
tgcagtcctttgacatgattc

SEQ ID NO: 7231393 - DNA, 21 bp, Homo sapiens
tgcagtcctttgacatgattc

SEQ ID NO: 7231394 - DNA, 21 bp, Homo sapiens
tgcagtcctttgacatgattc

SEQ ID NO: 7231395 - DNA, 22 bp, Homo sapiens
tgcagtctcaccagacctattt

SEQ ID NO: 7231396 - DNA, 22 bp, Homo sapiens
tgcagtctcaccagacctattt

SEQ ID NO: 7231397 - DNA, 22 bp, Homo sapiens
tgcagtgtgacctgtagcgagc

SEQ ID NO: 7231398 - DNA, 22 bp, Homo sapiens
tgcagtgtgacctgtagcgagc

SEQ ID NO: 7231399 - DNA, 22 bp, Homo sapiens
tgcagtgtgaggtccacatctg

SEQ ID NO: 7231400 - DNA, 22 bp, Homo sapiens
tgcagtgtgattttctggctga

SEQ ID NO: 7231401 - DNA, 22 bp, Homo sapiens
tgcagtgtgattttctggctga

SEQ ID NO: 7231402 - DNA, 22 bp, Homo sapiens
tgcagtgtgctagatttggact

SEQ ID NO: 7231403 - DNA, 22 bp, Homo sapiens
tgcagtgtcttgtggacttgag

SEQ ID NO: 7231404 - DNA, 23 bp, Homo sapiens
tgcagtgtcgctgcgagcccggc

SEQ ID NO: 7231405 - DNA, 20 bp, Homo sapiens
tgcagtgtcctcacttgtca

SEQ ID NO: 7231406 - DNA, 20 bp, Homo sapiens
tgcagtgtcctcacttgtca

SEQ ID NO: 7231407 - DNA, 22 bp, Homo sapiens
tgcagtggttgagagcccagac

SEQ ID NO: 7231408 - DNA, 22 bp, Homo sapiens
tgcagtggttgagagcccagac

SEQ ID NO: 7231409 - DNA, 22 bp, Homo sapiens
tgcagtggttgagagcccagac

SEQ ID NO: 7231410 - DNA, 22 bp, Homo sapiens
tgcagtgtagaaaaagagtgag

SEQ ID NO: 7231411 - DNA, 23 bp, Homo sapiens
tgcagtgtagcatctacgaagct

SEQ ID NO: 7231412 - DNA, 21 bp, Homo sapiens
tgcagtgtccctaacagtggt

SEQ ID NO: 7231413 - DNA, 22 bp, Homo sapiens
tgcagtgtttggatgctgagtc

SEQ ID NO: 7231414 - DNA, 22 bp, Homo sapiens
tgcagtgtttggatgctgagtc

SEQ ID NO: 7231415 - DNA, 22 bp, Homo sapiens
tgcagtgtttggatgctgagtc

SEQ ID NO: 7231416 - DNA, 22 bp, Homo sapiens
tgcagtgttcctgtgggtttat

SEQ ID NO: 7231417 - DNA, 22 bp, Homo sapiens
tgcagtgttcctgtgggtttat

SEQ ID NO: 7231418 - DNA, 23 bp, Homo sapiens
tgcagtgtttaacaatgacttga

SEQ ID NO: 7231419 - DNA, 22 bp, Homo sapiens
tgcagtgtttccagatattgtc

SEQ ID NO: 7231420 - DNA, 22 bp, Homo sapiens
tgcagtgtgctagatttggact

SEQ ID NO: 7231421 - DNA, 20 bp, Homo sapiens
tgcagtgtggaagactgaga

SEQ ID NO: 7231422 - DNA, 22 bp, Homo sapiens
tgcagtgtggccatgtcagcta

SEQ ID NO: 7231423 - DNA, 22 bp, Homo sapiens
tgcagtgtggccatgtcagcta

SEQ ID NO: 7231424 - DNA, 22 bp, Homo sapiens
tgcagtgttcagtgatctctcc

SEQ ID NO: 7231425 - DNA, 22 bp, Homo sapiens
tgcagtgttcctgtagcctgcc

SEQ ID NO: 7231426 - DNA, 22 bp, Homo sapiens
tgcagtgttcctgtagcctgcc

SEQ ID NO: 7231427 - DNA, 22 bp, Homo sapiens
tgcagtgttcctgtgggtttat

SEQ ID NO: 7231428 - DNA, 22 bp, Homo sapiens
tgcaggtggctccagggactgc

SEQ ID NO: 7231429 - DNA, 22 bp, Homo sapiens
tgcaggtggctccagggactgc

SEQ ID NO: 7231430 - DNA, 22 bp, Homo sapiens
tgcaggtggccatcttcgttct

SEQ ID NO: 7231431 - DNA, 22 bp, Homo sapiens
tgcaggtggattcaatgtggga

SEQ ID NO: 7231432 - DNA, 22 bp, Homo sapiens
tgcaggtggcagcggggcacca

SEQ ID NO: 7231433 - DNA, 22 bp, Homo sapiens
tgcaggtggcagcggggcacca

SEQ ID NO: 7231434 - DNA, 22 bp, Homo sapiens
tgcaggtgattctgatgcagtt

SEQ ID NO: 7231435 - DNA, 23 bp, Homo sapiens
tgcaggtgattaatccagtttca

SEQ ID NO: 7231436 - DNA, 22 bp, Homo sapiens
tgcaggtgcagcgatactgtga

SEQ ID NO: 7231437 - DNA, 22 bp, Homo sapiens
tgcaggtggacacgggagacgg

SEQ ID NO: 7231438 - DNA, 22 bp, Homo sapiens
tgcaggtggatatctcatcaga

SEQ ID NO: 7231439 - DNA, 22 bp, Homo sapiens
tgcaggtggatatctcatcaga

SEQ ID NO: 7231440 - DNA, 22 bp, Homo sapiens
tgcagggtggtttgaagggtct

SEQ ID NO: 7231441 - DNA, 22 bp, Homo sapiens
tgcagggtgtccggaggatcac

SEQ ID NO: 7231442 - DNA, 22 bp, Homo sapiens
tgcagggtgtccggaggatcac

SEQ ID NO: 7231443 - DNA, 22 bp, Homo sapiens
tgcagggtgtccggaggatcac

SEQ ID NO: 7231444 - DNA, 22 bp, Homo sapiens
tgcagggtgtccggaggatcac

SEQ ID NO: 7231445 - DNA, 23 bp, Homo sapiens
tgcagggtgttcctgcctttgct

SEQ ID NO: 7231446 - DNA, 23 bp, Homo sapiens
tgcagggtgttcctgcctttgct

SEQ ID NO: 7231447 - DNA, 23 bp, Homo sapiens
tgcagggtgttcctgcctttgct

SEQ ID NO: 7231448 - DNA, 22 bp, Homo sapiens
tgcaggtaaatttgtggaggat

SEQ ID NO: 7231449 - DNA, 22 bp, Homo sapiens
tgcaggtaaatttgtggaggat

SEQ ID NO: 7231450 - DNA, 22 bp, Homo sapiens
tgcaggtacttgacaacttggg

SEQ ID NO: 7231451 - DNA, 22 bp, Homo sapiens
tgcaggtcaatcttcaggttcc

SEQ ID NO: 7231452 - DNA, 22 bp, Homo sapiens
tgcaggtctccattggcagact

SEQ ID NO: 7231453 - DNA, 22 bp, Homo sapiens
tgcaggtgaaaattatgaggat

SEQ ID NO: 7231454 - DNA, 22 bp, Homo sapiens
tgcaggtctctgcaaggcctat

SEQ ID NO: 7231455 - DNA, 22 bp, Homo sapiens
tgcaggtctctgcaaggcctat

SEQ ID NO: 7231456 - DNA, 22 bp, Homo sapiens
tgcaggtgagtgcaggggctca

SEQ ID NO: 7231457 - DNA, 22 bp, Homo sapiens
tgcaggtgacaccactcttcct

SEQ ID NO: 7231458 - DNA, 19 bp, Homo sapiens
tgcagggctgcgcctgggg

SEQ ID NO: 7231459 - DNA, 22 bp, Homo sapiens
tgcagggcttcctcttggagtt

SEQ ID NO: 7231460 - DNA, 22 bp, Homo sapiens
tgcagggcttcctcttggagtt

SEQ ID NO: 7231461 - DNA, 23 bp, Homo sapiens
tgcaggggaggcttaaagcaggt

SEQ ID NO: 7231462 - DNA, 23 bp, Homo sapiens
tgcaggggaggcttaaagcaggt

SEQ ID NO: 7231463 - DNA, 22 bp, Homo sapiens
tgcagggcttcctcttggagtt

SEQ ID NO: 7231464 - DNA, 19 bp, Homo sapiens
tgcagggctgcgcctgggg

SEQ ID NO: 7231465 - DNA, 22 bp, Homo sapiens
tgcagggcttcctcttggagtt

SEQ ID NO: 7231466 - DNA, 22 bp, Homo sapiens
tgcagggcttcctcttggagtt

SEQ ID NO: 7231467 - DNA, 22 bp, Homo sapiens
tgcagggcttcctcttggagtt

SEQ ID NO: 7231468 - DNA, 19 bp, Homo sapiens
tgcagggctgcgcctgggg

SEQ ID NO: 7231469 - DNA, 19 bp, Homo sapiens
tgcagggctgcgcctgggg

SEQ ID NO: 7231470 - DNA, 20 bp, Homo sapiens
tgcagggctgcctcccagct

SEQ ID NO: 7231471 - DNA, 19 bp, Homo sapiens
tgcagggctgcgcctgggg

SEQ ID NO: 7231472 - DNA, 19 bp, Homo sapiens
tgcagggctgcgcctgggg

SEQ ID NO: 7231473 - DNA, 19 bp, Homo sapiens
tgcagggctgcgcctgggg

SEQ ID NO: 7231474 - DNA, 20 bp, Homo sapiens
tgcagggctgcctcccagct

SEQ ID NO: 7231475 - DNA, 22 bp, Homo sapiens
tgcagggctcctggctccaatc

SEQ ID NO: 7231476 - DNA, 20 bp, Homo sapiens
tgcagggctctgcttctctc

SEQ ID NO: 7231477 - DNA, 20 bp, Homo sapiens
tgcagggctctgcttctctc

SEQ ID NO: 7231478 - DNA, 20 bp, Homo sapiens
tgcagggctctgcttctctc

SEQ ID NO: 7231479 - DNA, 20 bp, Homo sapiens
tgcagggctctgcttctctc

SEQ ID NO: 7231480 - DNA, 20 bp, Homo sapiens
tgcagggctgcctcccagct

SEQ ID NO: 7231481 - DNA, 20 bp, Homo sapiens
tgcagggctgcctcccagct

SEQ ID NO: 7231482 - DNA, 22 bp, Homo sapiens
tgcaggggcttgtctgggcctg

SEQ ID NO: 7231483 - DNA, 23 bp, Homo sapiens
tgcaggggaggcttaaagcaggt

SEQ ID NO: 7231484 - DNA, 22 bp, Homo sapiens
tgcaggggcttgtctgggcctg

SEQ ID NO: 7231485 - DNA, 22 bp, Homo sapiens
tgcaggggcttgtctgggcctg

SEQ ID NO: 7231486 - DNA, 22 bp, Homo sapiens
tgcaggggcttgtctgggcctg

SEQ ID NO: 7231487 - DNA, 22 bp, Homo sapiens
tgcaggggcttgtctgggcctg

SEQ ID NO: 7231488 - DNA, 22 bp, Homo sapiens
tgcaggggcttgtctgggcctg

SEQ ID NO: 7231489 - DNA, 22 bp, Homo sapiens
tgcaggggcttgtctgggcctg

SEQ ID NO: 7231490 - DNA, 22 bp, Homo sapiens
tgcagggtagacaggtgaggtc

SEQ ID NO: 7231491 - DNA, 22 bp, Homo sapiens
tgcagggtagacaggtgaggtc

SEQ ID NO: 7231492 - DNA, 22 bp, Homo sapiens
tgcagggtagacaggtgaggtc

SEQ ID NO: 7231493 - DNA, 22 bp, Homo sapiens
tgcagggtagatgcaggctgtg

SEQ ID NO: 7231494 - DNA, 22 bp, Homo sapiens
tgcagggtagatgcaggctgtg

SEQ ID NO: 7231495 - DNA, 22 bp, Homo sapiens
tgcagggtagatgcaggctgtg

SEQ ID NO: 7231496 - DNA, 22 bp, Homo sapiens
tgcagggtagatgcaggctgtg

SEQ ID NO: 7231497 - DNA, 22 bp, Homo sapiens
tgcagggtagatgcaggctgtg

SEQ ID NO: 7231498 - DNA, 22 bp, Homo sapiens
tgcagggtatccttgtctctgc

SEQ ID NO: 7231499 - DNA, 22 bp, Homo sapiens
tgcagggtatccttgtctctgc

SEQ ID NO: 7231500 - DNA, 22 bp, Homo sapiens
tgcagggtcccgaagggaagac

SEQ ID NO: 7231501 - DNA, 22 bp, Homo sapiens
tgcagggtcccgaagggaagac

SEQ ID NO: 7231502 - DNA, 22 bp, Homo sapiens
tgcagggtggtttgaagggtct

SEQ ID NO: 7231503 - DNA, 22 bp, Homo sapiens
tgcagggtggtttgaagggtct

SEQ ID NO: 7231504 - DNA, 22 bp, Homo sapiens
tgcagggtggagcggaagcgga

SEQ ID NO: 7231505 - DNA, 22 bp, Homo sapiens
tgcagggtggagcggaagcgga

SEQ ID NO: 7231506 - DNA, 22 bp, Homo sapiens
tgcagggtggagcggaagcgga

SEQ ID NO: 7231507 - DNA, 22 bp, Homo sapiens
tgcagggtggagcggaagcgga

SEQ ID NO: 7231508 - DNA, 22 bp, Homo sapiens
tgcagggtcccgaagggaagac

SEQ ID NO: 7231509 - DNA, 22 bp, Homo sapiens
tgcagggtctctgcaaatgagg

SEQ ID NO: 7231510 - DNA, 22 bp, Homo sapiens
tgcagggtgcacagtggggtgc

SEQ ID NO: 7231511 - DNA, 22 bp, Homo sapiens
tgcagggtgcacagtggggtgc

SEQ ID NO: 7231512 - DNA, 22 bp, Homo sapiens
tgcagggtgcacagtggggtgc

SEQ ID NO: 7231513 - DNA, 20 bp, Homo sapiens
tgcatggcgcacatctgtgg

SEQ ID NO: 7231514 - DNA, 22 bp, Homo sapiens
tgcatggatttgacatgtgtac

SEQ ID NO: 7231515 - DNA, 22 bp, Homo sapiens
tgcatggatttgacatgtgtac

SEQ ID NO: 7231516 - DNA, 22 bp, Homo sapiens
tgcatggtaaccaggatgtcta

SEQ ID NO: 7231517 - DNA, 22 bp, Homo sapiens
tgcatggagctgtctgcatggt

SEQ ID NO: 7231518 - DNA, 22 bp, Homo sapiens
tgcatggagctgtctgcatggt

SEQ ID NO: 7231519 - DNA, 21 bp, Homo sapiens
tgcatggaggaaagttataga

SEQ ID NO: 7231520 - DNA, 21 bp, Homo sapiens
tgcatggaggaaagttataga

SEQ ID NO: 7231521 - DNA, 22 bp, Homo sapiens
tgcatggagctgtctgcatggt

SEQ ID NO: 7231522 - DNA, 22 bp, Homo sapiens
tgcatggaggaagatgaatgca

SEQ ID NO: 7231523 - DNA, 22 bp, Homo sapiens
tgcatggaggaagatgaatgca

SEQ ID NO: 7231524 - DNA, 22 bp, Homo sapiens
tgcatggaggataataattgag

SEQ ID NO: 7231525 - DNA, 22 bp, Homo sapiens
tgcatggaggataataattgag

SEQ ID NO: 7231526 - DNA, 22 bp, Homo sapiens
tgcatggagtaattgatgcttg

SEQ ID NO: 7231527 - DNA, 22 bp, Homo sapiens
tgcatggagtaattgatgcttg

SEQ ID NO: 7231528 - DNA, 22 bp, Homo sapiens
tgcatggataaaagtatattat

SEQ ID NO: 7231529 - DNA, 22 bp, Homo sapiens
tgcatggataaaagtatattat

SEQ ID NO: 7231530 - DNA, 22 bp, Homo sapiens
tgcatggataaaagtatattat

SEQ ID NO: 7231531 - DNA, 22 bp, Homo sapiens
tgcatggatatataccctaggc

SEQ ID NO: 7231532 - DNA, 23 bp, Homo sapiens
tgcatgtgaattcatacttgttt

SEQ ID NO: 7231533 - DNA, 22 bp, Homo sapiens
tgcatgtgcccactctggctta

SEQ ID NO: 7231534 - DNA, 23 bp, Homo sapiens
tgcatgtgattcatagagtccag

SEQ ID NO: 7231535 - DNA, 22 bp, Homo sapiens
tgcatgtggacccctggtgcct

SEQ ID NO: 7231536 - DNA, 22 bp, Homo sapiens
tgcatgtggacccctggtgcct

SEQ ID NO: 7231537 - DNA, 22 bp, Homo sapiens
tgcatgtatttaaagttgcaat

SEQ ID NO: 7231538 - DNA, 22 bp, Homo sapiens
tgcatgtcaaggcactcaggat

SEQ ID NO: 7231539 - DNA, 17 bp, Homo sapiens
tgcatgtcctttgttcc

SEQ ID NO: 7231540 - DNA, 23 bp, Homo sapiens
tgcatgtgaattcatacttgttt

SEQ ID NO: 7231541 - DNA, 22 bp, Homo sapiens
tgcatgtgtgttaagatgcttt

SEQ ID NO: 7231542 - DNA, 22 bp, Homo sapiens
tgcatgtgtgtgtatttataaa

SEQ ID NO: 7231543 - DNA, 19 bp, Homo sapiens
tgcatgtgttctcccattg

SEQ ID NO: 7231544 - DNA, 22 bp, Homo sapiens
tgcatgtgtttcccagcaagct

SEQ ID NO: 7231545 - DNA, 22 bp, Homo sapiens
tgcatgtgtttcccagcaagct

SEQ ID NO: 7231546 - DNA, 22 bp, Homo sapiens
tgcatgtggatcatatgtccta

SEQ ID NO: 7231547 - DNA, 22 bp, Homo sapiens
tgcatgtggacccctggtgcct

SEQ ID NO: 7231548 - DNA, 22 bp, Homo sapiens
tgcatgtgtcgggcctgtgcta

SEQ ID NO: 7231549 - DNA, 22 bp, Homo sapiens
tgcatgtggatcatatgtccta

SEQ ID NO: 7231550 - DNA, 22 bp, Homo sapiens
tgcatgtgtcgggcctgtgcta

SEQ ID NO: 7231551 - DNA, 22 bp, Homo sapiens
tgcatgtgtcgggcctgtgcta

SEQ ID NO: 7231552 - DNA, 22 bp, Homo sapiens
tgcatgtgtgacaaggacagtt

SEQ ID NO: 7231553 - DNA, 22 bp, Homo sapiens
tgcatgtgtttgccacagtgag

SEQ ID NO: 7231554 - DNA, 22 bp, Homo sapiens
tgcatgttaagaaaatattgag

SEQ ID NO: 7231555 - DNA, 22 bp, Homo sapiens
tgcatgttatagaattttaact

SEQ ID NO: 7231556 - DNA, 22 bp, Homo sapiens
tgcatgttattgtggcaagaat

SEQ ID NO: 7231557 - DNA, 22 bp, Homo sapiens
tgcatgttccaactccatcact

SEQ ID NO: 7231558 - DNA, 22 bp, Homo sapiens
tgcatgttccaactccatcact

SEQ ID NO: 7231559 - DNA, 22 bp, Homo sapiens
tgcatgtttataacagatgagg

SEQ ID NO: 7231560 - DNA, 22 bp, Homo sapiens
tgcatgtttataacagatgagg

SEQ ID NO: 7231561 - DNA, 22 bp, Homo sapiens
tgcatgtttctgtatgttaatg

SEQ ID NO: 7231562 - DNA, 22 bp, Homo sapiens
tgcattccatgtgtttcctgag

SEQ ID NO: 7231563 - DNA, 22 bp, Homo sapiens
tgcatgatagagatggtattag

SEQ ID NO: 7231564 - DNA, 22 bp, Homo sapiens
tgcatgatagagatggtattag

SEQ ID NO: 7231565 - DNA, 22 bp, Homo sapiens
tgcatgatgactaaggtggtga

SEQ ID NO: 7231566 - DNA, 22 bp, Homo sapiens
tgcatgatggtttagatggggt

SEQ ID NO: 7231567 - DNA, 22 bp, Homo sapiens
tgcatgatgttaaacatcaggt

SEQ ID NO: 7231568 - DNA, 22 bp, Homo sapiens
tgcatgcaaaaaaatctgcatt

SEQ ID NO: 7231569 - DNA, 22 bp, Homo sapiens
tgcatgcaaagtgtctgctttg

SEQ ID NO: 7231570 - DNA, 22 bp, Homo sapiens
tgcatgcaacaattcttctata

SEQ ID NO: 7231571 - DNA, 22 bp, Homo sapiens
tgcatgcaacaattcttctata

SEQ ID NO: 7231572 - DNA, 22 bp, Homo sapiens
tgcatgcaatgtgaagaaagct

SEQ ID NO: 7231573 - DNA, 22 bp, Homo sapiens
tgcatgcacatgtaggtatggt

SEQ ID NO: 7231574 - DNA, 22 bp, Homo sapiens
tgcatgcacccagccgggtatt

SEQ ID NO: 7231575 - DNA, 22 bp, Homo sapiens
tgcatgcacgtatctgcgtgtg

SEQ ID NO: 7231576 - DNA, 22 bp, Homo sapiens
tgcatgcacgtatctgcgtgtg

SEQ ID NO: 7231577 - DNA, 22 bp, Homo sapiens
tgcatgcacgtgctatgtatga

SEQ ID NO: 7231578 - DNA, 22 bp, Homo sapiens
tgcatgcacgtgctatgtatga

SEQ ID NO: 7231579 - DNA, 22 bp, Homo sapiens
tgcatgcactatctagatgatg

SEQ ID NO: 7231580 - DNA, 22 bp, Homo sapiens
tgcatgcacttggctggcacgt

SEQ ID NO: 7231581 - DNA, 22 bp, Homo sapiens
tgcatgcacttggctggcacgt

SEQ ID NO: 7231582 - DNA, 22 bp, Homo sapiens
tgcatgcagcatatgaggcctc

SEQ ID NO: 7231583 - DNA, 22 bp, Homo sapiens
tgcatgcagcatatgaggcctc

SEQ ID NO: 7231584 - DNA, 22 bp, Homo sapiens
tgcatgacactgctgattagat

SEQ ID NO: 7231585 - DNA, 22 bp, Homo sapiens
tgcatctttttccaagtttatt

SEQ ID NO: 7231586 - DNA, 22 bp, Homo sapiens
tgcatctgttcattcgttccca

SEQ ID NO: 7231587 - DNA, 22 bp, Homo sapiens
tgcatcttagcaatgaccgagt

SEQ ID NO: 7231588 - DNA, 22 bp, Homo sapiens
tgcatcttcagccctcagccag

SEQ ID NO: 7231589 - DNA, 22 bp, Homo sapiens
tgcatgcacttggctggcacgt

SEQ ID NO: 7231590 - DNA, 22 bp, Homo sapiens
tgcatgcagctggtcgggcgcc

SEQ ID NO: 7231591 - DNA, 22 bp, Homo sapiens
tgcatgcataaatgtacacaca

SEQ ID NO: 7231592 - DNA, 22 bp, Homo sapiens
tgcatgcataaatgtacacaca

SEQ ID NO: 7231593 - DNA, 22 bp, Homo sapiens
tgcatgcatgatgtttggtagc

SEQ ID NO: 7231594 - DNA, 22 bp, Homo sapiens
tgcatgcatgatgtttggtagc

SEQ ID NO: 7231595 - DNA, 22 bp, Homo sapiens
tgcatgcatgctactgggaggt

SEQ ID NO: 7231596 - DNA, 22 bp, Homo sapiens
tgcatgcatgctactgggaggt

SEQ ID NO: 7231597 - DNA, 22 bp, Homo sapiens
tgcatgcatgtgagcatgcata

SEQ ID NO: 7231598 - DNA, 22 bp, Homo sapiens
tgcatgcatgtttttacccaca

SEQ ID NO: 7231599 - DNA, 17 bp, Homo sapiens
tgcatgcgtctgtgata

SEQ ID NO: 7231600 - DNA, 22 bp, Homo sapiens
tgcatgcgttagttggcgtgtt

SEQ ID NO: 7231601 - DNA, 22 bp, Homo sapiens
tgcatgctaagaaatagcagct

SEQ ID NO: 7231602 - DNA, 21 bp, Homo sapiens
tgcatgctatgtttttatttc

SEQ ID NO: 7231603 - DNA, 21 bp, Homo sapiens
tgcatgctatgtttttatttc

SEQ ID NO: 7231604 - DNA, 22 bp, Homo sapiens
tgcatgctctgtagaaagcagg

SEQ ID NO: 7231605 - DNA, 22 bp, Homo sapiens
tgcatgctttattttcatgtgt

SEQ ID NO: 7231606 - DNA, 22 bp, Homo sapiens
tgcatggaaaagctaggcagcc

SEQ ID NO: 7231607 - DNA, 22 bp, Homo sapiens
tgcatggaaaagctaggcagcc

SEQ ID NO: 7231608 - DNA, 22 bp, Homo sapiens
tgcatggaacggtctcctggtc

SEQ ID NO: 7231609 - DNA, 22 bp, Homo sapiens
tgcatggaacggtctcctggtc

SEQ ID NO: 7231610 - DNA, 22 bp, Homo sapiens
tgcatggaacggtctcctggtc

SEQ ID NO: 7231611 - DNA, 22 bp, Homo sapiens
tgcatggaattatgggagtggt

SEQ ID NO: 7231612 - DNA, 22 bp, Homo sapiens
tgcatggacgtgacttggccaa

SEQ ID NO: 7231613 - DNA, 22 bp, Homo sapiens
tgcatggacgtgacttggccaa

SEQ ID NO: 7231614 - DNA, 22 bp, Homo sapiens
tgcatggactcatcagacaaga

SEQ ID NO: 7231615 - DNA, 22 bp, Homo sapiens
tgcatggactcatcagacaaga

SEQ ID NO: 7231616 - DNA, 22 bp, Homo sapiens
tgcatggagatatactatttga

SEQ ID NO: 7231617 - DNA, 22 bp, Homo sapiens
tgcatggagatatactatttga

SEQ ID NO: 7231618 - DNA, 22 bp, Homo sapiens
tgcatggagatatactatttga

SEQ ID NO: 7231619 - DNA, 19 bp, Homo sapiens
tgcataaattatatacttt

SEQ ID NO: 7231620 - DNA, 19 bp, Homo sapiens
tgcataaattatatacttt

SEQ ID NO: 7231621 - DNA, 22 bp, Homo sapiens
tgcataaagtgccatagtatta

SEQ ID NO: 7231622 - DNA, 22 bp, Homo sapiens
tgcataaagtgccatagtatta

SEQ ID NO: 7231623 - DNA, 22 bp, Homo sapiens
tgcataaagtgccatagtatta

SEQ ID NO: 7231624 - DNA, 22 bp, Homo sapiens
tgcataaagtgccatagtatta

SEQ ID NO: 7231625 - DNA, 22 bp, Homo sapiens
tgcataaagtgccatagtatta

SEQ ID NO: 7231626 - DNA, 21 bp, Homo sapiens
tgcataaagaaatacaaatac

SEQ ID NO: 7231627 - DNA, 21 bp, Homo sapiens
tgcataaagaaatacaaatac

SEQ ID NO: 7231628 - DNA, 21 bp, Homo sapiens
tgcataaagaaatacaaatac

SEQ ID NO: 7231629 - DNA, 22 bp, Homo sapiens
tgcataaaatatgagaaatgta

SEQ ID NO: 7231630 - DNA, 22 bp, Homo sapiens
tgcataaaatatgagaaatgta

SEQ ID NO: 7231631 - DNA, 22 bp, Homo sapiens
tgcataaacagatacttcatgt

SEQ ID NO: 7231632 - DNA, 21 bp, Homo sapiens
tgcagttttgcttgatctctg

SEQ ID NO: 7231633 - DNA, 22 bp, Homo sapiens
tgcagttttgccaggcaatgga

SEQ ID NO: 7231634 - DNA, 22 bp, Homo sapiens
tgcagttttatcacatatatag

SEQ ID NO: 7231635 - DNA, 22 bp, Homo sapiens
tgcagttttcaaaagtttacag

SEQ ID NO: 7231636 - DNA, 22 bp, Homo sapiens
tgcagttttccttcaacattgt

SEQ ID NO: 7231637 - DNA, 22 bp, Homo sapiens
tgcagttttctcacccccacaa

SEQ ID NO: 7231638 - DNA, 22 bp, Homo sapiens
tgcagttttggccattgaaggc

SEQ ID NO: 7231639 - DNA, 22 bp, Homo sapiens
tgcataaaaaccacatacaagg

SEQ ID NO: 7231640 - DNA, 22 bp, Homo sapiens
tgcataaaacatgatttctgct

SEQ ID NO: 7231641 - DNA, 22 bp, Homo sapiens
tgcagtgtttttcagggcatat

SEQ ID NO: 7231642 - DNA, 22 bp, Homo sapiens
tgcagttagcctaggattgagc

SEQ ID NO: 7231643 - DNA, 22 bp, Homo sapiens
tgcagttctatcacccaccccg

SEQ ID NO: 7231644 - DNA, 22 bp, Homo sapiens
tgcagtttaaacttggcaactt

SEQ ID NO: 7231645 - DNA, 22 bp, Homo sapiens
tgcagtttcctttctagtcttt

SEQ ID NO: 7231646 - DNA, 22 bp, Homo sapiens
tgcagtttcctttctagtcttt

SEQ ID NO: 7231647 - DNA, 22 bp, Homo sapiens
tgcagtttgccctttgctcact

SEQ ID NO: 7231648 - DNA, 20 bp, Homo sapiens
tgcagtttgtcaaggttcct

SEQ ID NO: 7231649 - DNA, 22 bp, Homo sapiens
tgcatcatttataatgtctttg

SEQ ID NO: 7231650 - DNA, 23 bp, Homo sapiens
tgcatcctcatttttcacacgag

SEQ ID NO: 7231651 - DNA, 22 bp, Homo sapiens
tgcatcatataatgtctatgga

SEQ ID NO: 7231652 - DNA, 23 bp, Homo sapiens
tgcatcctcatttttcacacgag

SEQ ID NO: 7231653 - DNA, 22 bp, Homo sapiens
tgcatcctcctttgtcctcttg

SEQ ID NO: 7231654 - DNA, 22 bp, Homo sapiens
tgcatcctcctttgtcctcttg

SEQ ID NO: 7231655 - DNA, 22 bp, Homo sapiens
tgcatcctgttctaggtttggg

SEQ ID NO: 7231656 - DNA, 22 bp, Homo sapiens
tgcatccttcccatttaaacca

SEQ ID NO: 7231657 - DNA, 22 bp, Homo sapiens
tgcatcgaacagtggagacaat

SEQ ID NO: 7231658 - DNA, 22 bp, Homo sapiens
tgcatcgagggtattttatttg

SEQ ID NO: 7231659 - DNA, 22 bp, Homo sapiens
tgcatctgattctcaggcagaa

SEQ ID NO: 7231660 - DNA, 22 bp, Homo sapiens
tgcatctgtgctccctcttcta

SEQ ID NO: 7231661 - DNA, 22 bp, Homo sapiens
tgcatacataaagtgctatcat

SEQ ID NO: 7231662 - DNA, 22 bp, Homo sapiens
tgcatacacatgtgcacatacg

SEQ ID NO: 7231663 - DNA, 22 bp, Homo sapiens
tgcatacacttcaaatgagcat

SEQ ID NO: 7231664 - DNA, 19 bp, Homo sapiens
tgcataaattatatacttt

SEQ ID NO: 7231665 - DNA, 22 bp, Homo sapiens
tgcataatacgtttcctataac

SEQ ID NO: 7231666 - DNA, 22 bp, Homo sapiens
tgcataatgctggacttttcaa

SEQ ID NO: 7231667 - DNA, 22 bp, Homo sapiens
tgcataatggatgatttcacaa

SEQ ID NO: 7231668 - DNA, 22 bp, Homo sapiens
tgcataattggtcctccacatt

SEQ ID NO: 7231669 - DNA, 22 bp, Homo sapiens
tgcataattggtcctccacatt

SEQ ID NO: 7231670 - DNA, 22 bp, Homo sapiens
tgcatacacaagcatacatgta

SEQ ID NO: 7231671 - DNA, 22 bp, Homo sapiens
tgcatagaggatccagtgtggt

SEQ ID NO: 7231672 - DNA, 22 bp, Homo sapiens
tgcataggtgccaagtgggctt

SEQ ID NO: 7231673 - DNA, 22 bp, Homo sapiens
tgcatagggaacctcatgcatt

SEQ ID NO: 7231674 - DNA, 22 bp, Homo sapiens
tgcatatacccgcatttacata

SEQ ID NO: 7231675 - DNA, 19 bp, Homo sapiens
tgccagcattaggctgaag

SEQ ID NO: 7231676 - DNA, 21 bp, Homo sapiens
tgccagcattaaacagtcatt

SEQ ID NO: 7231677 - DNA, 19 bp, Homo sapiens
tgccagcattaggctgaag

SEQ ID NO: 7231678 - DNA, 22 bp, Homo sapiens
tgccagcagaaataaatacttg

SEQ ID NO: 7231679 - DNA, 23 bp, Homo sapiens
tgccagcagggaatgggaaggac

SEQ ID NO: 7231680 - DNA, 22 bp, Homo sapiens
tgccagcagtagcagtaggcca

SEQ ID NO: 7231681 - DNA, 21 bp, Homo sapiens
tgccagcatgtaggctagttg

SEQ ID NO: 7231682 - DNA, 21 bp, Homo sapiens
tgccagcatgtaggctagttg

SEQ ID NO: 7231683 - DNA, 22 bp, Homo sapiens
tgccagccagggaagctcaccc

SEQ ID NO: 7231684 - DNA, 22 bp, Homo sapiens
tgccagccagggaagctcaccc

SEQ ID NO: 7231685 - DNA, 22 bp, Homo sapiens
tgccagccagggaagctcaccc

SEQ ID NO: 7231686 - DNA, 22 bp, Homo sapiens
tgccagccaggttctgaggcta

SEQ ID NO: 7231687 - DNA, 22 bp, Homo sapiens
tgccagccaggttctgaggcta

SEQ ID NO: 7231688 - DNA, 22 bp, Homo sapiens
tgccagcccaccttggggcctc

SEQ ID NO: 7231689 - DNA, 23 bp, Homo sapiens
tgccagaggcagtcacagtggtg

SEQ ID NO: 7231690 - DNA, 22 bp, Homo sapiens
tgccagagttacatgagggtca

SEQ ID NO: 7231691 - DNA, 22 bp, Homo sapiens
tgccagcaagaatagacagtaa

SEQ ID NO: 7231692 - DNA, 22 bp, Homo sapiens
tgccagcacaagttaagagatc

SEQ ID NO: 7231693 - DNA, 22 bp, Homo sapiens
tgccagcaccttcctgctccct

SEQ ID NO: 7231694 - DNA, 22 bp, Homo sapiens
tgccagcaccttcctgctccct

SEQ ID NO: 7231695 - DNA, 22 bp, Homo sapiens
tgccagcacttctggctgtctg

SEQ ID NO: 7231696 - DNA, 22 bp, Homo sapiens
tgccagcacttctggctgtctg

SEQ ID NO: 7231697 - DNA, 22 bp, Homo sapiens
tgccagcacttctggctgtctg

SEQ ID NO: 7231698 - DNA, 22 bp, Homo sapiens
tgccagagagtggctgggtgtc

SEQ ID NO: 7231699 - DNA, 22 bp, Homo sapiens
tgccagagaagacccagtcact

SEQ ID NO: 7231700 - DNA, 22 bp, Homo sapiens
tgccagagaggagaaagcattt

SEQ ID NO: 7231701 - DNA, 22 bp, Homo sapiens
tgccagagaagacccagtcact

SEQ ID NO: 7231702 - DNA, 22 bp, Homo sapiens
tgccagagagtggctgggtgtc

SEQ ID NO: 7231703 - DNA, 23 bp, Homo sapiens
tgccagaggcagtcacagtggtg

SEQ ID NO: 7231704 - DNA, 22 bp, Homo sapiens
tgccagagatttcacactgcta

SEQ ID NO: 7231705 - DNA, 22 bp, Homo sapiens
tgccacctcctctaacaagtgg

SEQ ID NO: 7231706 - DNA, 22 bp, Homo sapiens
tgccacctggacaaccttatgc

SEQ ID NO: 7231707 - DNA, 20 bp, Homo sapiens
tgccacctggtttaagtgtg

SEQ ID NO: 7231708 - DNA, 22 bp, Homo sapiens
tgccaccttgtgcagcaggagg

SEQ ID NO: 7231709 - DNA, 22 bp, Homo sapiens
tgccagagaagacccagtcact

SEQ ID NO: 7231710 - DNA, 22 bp, Homo sapiens
tgccagaaccattcaatgtgaa

SEQ ID NO: 7231711 - DNA, 22 bp, Homo sapiens
tgccagaagattctctatcaga

SEQ ID NO: 7231712 - DNA, 22 bp, Homo sapiens
tgccagactctggggtgctaga

SEQ ID NO: 7231713 - DNA, 22 bp, Homo sapiens
tgccactggacccagaactctt

SEQ ID NO: 7231714 - DNA, 22 bp, Homo sapiens
tgccactggacccagaactctt

SEQ ID NO: 7231715 - DNA, 22 bp, Homo sapiens
tgccactggctcaatggtgcag

SEQ ID NO: 7231716 - DNA, 22 bp, Homo sapiens
tgccactggctcaatggtgcag

SEQ ID NO: 7231717 - DNA, 22 bp, Homo sapiens
tgccactggctcaatggtgcag

SEQ ID NO: 7231718 - DNA, 22 bp, Homo sapiens
tgccactgggcatgcagatgtc

SEQ ID NO: 7231719 - DNA, 22 bp, Homo sapiens
tgccactgggcatgcagatgtc

SEQ ID NO: 7231720 - DNA, 22 bp, Homo sapiens
tgccactggggctaggactgtt

SEQ ID NO: 7231721 - DNA, 22 bp, Homo sapiens
tgccactggggctaggactgtt

SEQ ID NO: 7231722 - DNA, 22 bp, Homo sapiens
tgccactggggctaggactgtt

SEQ ID NO: 7231723 - DNA, 22 bp, Homo sapiens
tgccagaacagctcatctggcc

SEQ ID NO: 7231724 - DNA, 22 bp, Homo sapiens
tgccacagtttcatggattctg

SEQ ID NO: 7231725 - DNA, 22 bp, Homo sapiens
tgccacatggtgcatttcctag

SEQ ID NO: 7231726 - DNA, 22 bp, Homo sapiens
tgccacatggtgcatttcctag

SEQ ID NO: 7231727 - DNA, 22 bp, Homo sapiens
tgccacagttgtttgtgctcta

SEQ ID NO: 7231728 - DNA, 22 bp, Homo sapiens
tgccaaattgaattacataatt

SEQ ID NO: 7231729 - DNA, 22 bp, Homo sapiens
tgccaagagatgactgaaatgg

SEQ ID NO: 7231730 - DNA, 22 bp, Homo sapiens
tgccaagagatgactgaaatgg

SEQ ID NO: 7231731 - DNA, 22 bp, Homo sapiens
tgccacagggtcctcaggccag

SEQ ID NO: 7231732 - DNA, 22 bp, Homo sapiens
tgccacagggtcctcaggccag

SEQ ID NO: 7231733 - DNA, 22 bp, Homo sapiens
tgccacagttgtttgtgctcta

SEQ ID NO: 7231734 - DNA, 22 bp, Homo sapiens
tgccacagttgtttgtgctcta

SEQ ID NO: 7231735 - DNA, 22 bp, Homo sapiens
tgcattggtcatttgaaaatat

SEQ ID NO: 7231736 - DNA, 22 bp, Homo sapiens
tgcattggtcttaatcttcagg

SEQ ID NO: 7231737 - DNA, 22 bp, Homo sapiens
tgcattggtaaaatacatacac

SEQ ID NO: 7231738 - DNA, 22 bp, Homo sapiens
tgcattggtcatttagaaaata

SEQ ID NO: 7231739 - DNA, 22 bp, Homo sapiens
tgcattggaaactcagcagcac

SEQ ID NO: 7231740 - DNA, 22 bp, Homo sapiens
tgcattgggagagattagggca

SEQ ID NO: 7231741 - DNA, 22 bp, Homo sapiens
tgcattgggagtcagtgctgaa

SEQ ID NO: 7231742 - DNA, 22 bp, Homo sapiens
tgcattgggttgacatactaaa

SEQ ID NO: 7231743 - DNA, 22 bp, Homo sapiens
tgcattgggttgacatactaaa

SEQ ID NO: 7231744 - DNA, 22 bp, Homo sapiens
tgcattgaggggctctcttcct

SEQ ID NO: 7231745 - DNA, 22 bp, Homo sapiens
tgcattgagtcatttcagtatg

SEQ ID NO: 7231746 - DNA, 22 bp, Homo sapiens
tgcattgatcatatccttcctg

SEQ ID NO: 7231747 - DNA, 22 bp, Homo sapiens
tgcattggaaaactatggctca

SEQ ID NO: 7231748 - DNA, 22 bp, Homo sapiens
tgcattggaaactcagcagcac

SEQ ID NO: 7231749 - DNA, 19 bp, Homo sapiens
tgcattgagggctgtctca

SEQ ID NO: 7231750 - DNA, 22 bp, Homo sapiens
tgcattcctttctaggatagct

SEQ ID NO: 7231751 - DNA, 22 bp, Homo sapiens
tgcattgttgaccagttgtgca

SEQ ID NO: 7231752 - DNA, 17 bp, Homo sapiens
tgcattgttggaaattt

SEQ ID NO: 7231753 - DNA, 22 bp, Homo sapiens
tgcatttaactagaatattaat

SEQ ID NO: 7231754 - DNA, 22 bp, Homo sapiens
tgcatttaagaaaacatgagtc

SEQ ID NO: 7231755 - DNA, 22 bp, Homo sapiens
tgcatttacctggaggtcattt

SEQ ID NO: 7231756 - DNA, 22 bp, Homo sapiens
tgcatttacctggaggtcattt

SEQ ID NO: 7231757 - DNA, 22 bp, Homo sapiens
tgcatttacggtacaacagcag

SEQ ID NO: 7231758 - DNA, 18 bp, Homo sapiens
tgcatttagtacatctag

SEQ ID NO: 7231759 - DNA, 22 bp, Homo sapiens
tgcatttagttatgagaaaaac

SEQ ID NO: 7231760 - DNA, 22 bp, Homo sapiens
tgcatttgcaatgggtacacaa

SEQ ID NO: 7231761 - DNA, 23 bp, Homo sapiens
tgcatttgcaattgcagtaaggt

SEQ ID NO: 7231762 - DNA, 22 bp, Homo sapiens
tgcatttggggcagactagcag

SEQ ID NO: 7231763 - DNA, 22 bp, Homo sapiens
tgcatttggggcagactagcag

SEQ ID NO: 7231764 - DNA, 22 bp, Homo sapiens
tgcatttgacatttagtggggt

SEQ ID NO: 7231765 - DNA, 22 bp, Homo sapiens
tgcatttgacatttagtggggt

SEQ ID NO: 7231766 - DNA, 22 bp, Homo sapiens
tgcatttgagttgggagcaggc

SEQ ID NO: 7231767 - DNA, 21 bp, Homo sapiens
tgcatttctaactagttgacc

SEQ ID NO: 7231768 - DNA, 22 bp, Homo sapiens
tgcatttcagaagaaaattcgg

SEQ ID NO: 7231769 - DNA, 22 bp, Homo sapiens
tgcatttccagatttctggagt

SEQ ID NO: 7231770 - DNA, 22 bp, Homo sapiens
tgcatttatttgaattgatcta

SEQ ID NO: 7231771 - DNA, 22 bp, Homo sapiens
tgccaaaatggccaaaagctag

SEQ ID NO: 7231772 - DNA, 22 bp, Homo sapiens
tgccaaaatgggctttataccg

SEQ ID NO: 7231773 - DNA, 22 bp, Homo sapiens
tgcatttgtaacattcaagaat

SEQ ID NO: 7231774 - DNA, 22 bp, Homo sapiens
tgcatttgtcttgtctcatgaa

SEQ ID NO: 7231775 - DNA, 22 bp, Homo sapiens
tgcatttgtcttgtctcatgaa

SEQ ID NO: 7231776 - DNA, 22 bp, Homo sapiens
tgcatttgtcttgtctcatgaa

SEQ ID NO: 7231777 - DNA, 22 bp, Homo sapiens
tgcatttgttaccttattgcag

SEQ ID NO: 7231778 - DNA, 20 bp, Homo sapiens
tgcatttgttatttgtactc

SEQ ID NO: 7231779 - DNA, 20 bp, Homo sapiens
tgcatttgttatttgtactc

SEQ ID NO: 7231780 - DNA, 22 bp, Homo sapiens
tgcatttgttcagtgaaatgtt

SEQ ID NO: 7231781 - DNA, 22 bp, Homo sapiens
tgcatttgttcagtgaaatgtt

SEQ ID NO: 7231782 - DNA, 22 bp, Homo sapiens
tgcattttacttacctgttagt

SEQ ID NO: 7231783 - DNA, 22 bp, Homo sapiens
tgcattttcttccaccaatatc

SEQ ID NO: 7231784 - DNA, 22 bp, Homo sapiens
tgcactactgtgatacacagcc

SEQ ID NO: 7231785 - DNA, 22 bp, Homo sapiens
tgcactactgtgatacacagcc

SEQ ID NO: 7231786 - DNA, 18 bp, Homo sapiens
tgcactagatgctggcag

SEQ ID NO: 7231787 - DNA, 18 bp, Homo sapiens
tgcactagatgctggcag

SEQ ID NO: 7231788 - DNA, 22 bp, Homo sapiens
tgcacttttatatcactctggc

SEQ ID NO: 7231789 - DNA, 22 bp, Homo sapiens
tgcagaaacaagccatcattca

SEQ ID NO: 7231790 - DNA, 22 bp, Homo sapiens
tgcagaaacaagccatcattca

SEQ ID NO: 7231791 - DNA, 22 bp, Homo sapiens
tgcagaaacagagttttgccat

SEQ ID NO: 7231792 - DNA, 22 bp, Homo sapiens
tgcagaaacagtcattaatgta

SEQ ID NO: 7231793 - DNA, 22 bp, Homo sapiens
tgcacgtgtgagcattcacatg

SEQ ID NO: 7231794 - DNA, 22 bp, Homo sapiens
tgcacgtgtgagcattcacatg

SEQ ID NO: 7231795 - DNA, 22 bp, Homo sapiens
tgcacgtgtgagcattcacatg

SEQ ID NO: 7231796 - DNA, 22 bp, Homo sapiens
tgcacgtgggctctctgctctt

SEQ ID NO: 7231797 - DNA, 22 bp, Homo sapiens
tgcaccttttagaagtcatttt

SEQ ID NO: 7231798 - DNA, 22 bp, Homo sapiens
tgcaccttttagaagtcatttt

SEQ ID NO: 7231799 - DNA, 22 bp, Homo sapiens
tgcaccttcgatttggaagcct

SEQ ID NO: 7231800 - DNA, 22 bp, Homo sapiens
tgcaccttcgatttggaagcct

SEQ ID NO: 7231801 - DNA, 22 bp, Homo sapiens
tgcaccttgtccatttttggcc

SEQ ID NO: 7231802 - DNA, 22 bp, Homo sapiens
tgcaccttgtccatttttggcc

SEQ ID NO: 7231803 - DNA, 22 bp, Homo sapiens
tgcaccttccacaagaactacc

SEQ ID NO: 7231804 - DNA, 22 bp, Homo sapiens
tgcaccttccacaagaactacc

SEQ ID NO: 7231805 - DNA, 22 bp, Homo sapiens
tgcaccttgttgcttttacgaa

SEQ ID NO: 7231806 - DNA, 22 bp, Homo sapiens
tgcaccttgttgcttttacgaa

SEQ ID NO: 7231807 - DNA, 22 bp, Homo sapiens
tgcacctttaaattcagcagta

SEQ ID NO: 7231808 - DNA, 22 bp, Homo sapiens
tgcacctttaaattcagcagta

SEQ ID NO: 7231809 - DNA, 22 bp, Homo sapiens
tgcagaaacagtcattaatgta

SEQ ID NO: 7231810 - DNA, 22 bp, Homo sapiens
tgcagaaaccaattcaagtaag

SEQ ID NO: 7231811 - DNA, 22 bp, Homo sapiens
tgcagaaaccaattcaagtaag

SEQ ID NO: 7231812 - DNA, 22 bp, Homo sapiens
tgcagaaagcattgactcttcc

SEQ ID NO: 7231813 - DNA, 22 bp, Homo sapiens
tgcagaaagcattgactcttcc

SEQ ID NO: 7231814 - DNA, 21 bp, Homo sapiens
tgcagaaagcggcttgaagca

SEQ ID NO: 7231815 - DNA, 21 bp, Homo sapiens
tgcagaaagcggcttgaagca

SEQ ID NO: 7231816 - DNA, 22 bp, Homo sapiens
tgcagaaaggaggggtgggaat

SEQ ID NO: 7231817 - DNA, 22 bp, Homo sapiens
tgcagaaagtcacattcccttt

SEQ ID NO: 7231818 - DNA, 22 bp, Homo sapiens
tgcagaaataaagatattatca

SEQ ID NO: 7231819 - DNA, 22 bp, Homo sapiens
tgcagaaataactcatattgca

SEQ ID NO: 7231820 - DNA, 22 bp, Homo sapiens
tgcagaaataactcatattgca

SEQ ID NO: 7231821 - DNA, 22 bp, Homo sapiens
tgcagaaatcacatttaaccct

SEQ ID NO: 7231822 - DNA, 21 bp, Homo sapiens
tgcagaaatggtttttctaag

SEQ ID NO: 7231823 - DNA, 22 bp, Homo sapiens
tgcagaaattcagaaagcataa

SEQ ID NO: 7231824 - DNA, 22 bp, Homo sapiens
tgcagaaattcagaaagcataa

SEQ ID NO: 7231825 - DNA, 22 bp, Homo sapiens
tgcagaacagggccatgtcacc

SEQ ID NO: 7231826 - DNA, 22 bp, Homo sapiens
tgcagaagaatgtaggcataag

SEQ ID NO: 7231827 - DNA, 22 bp, Homo sapiens
tgcagaagaatgtaggcataag

SEQ ID NO: 7231828 - DNA, 19 bp, Homo sapiens
tgcagaagacacagtggtg

SEQ ID NO: 7231829 - DNA, 22 bp, Homo sapiens
tgcagaagacacaaggtaacgt

SEQ ID NO: 7231830 - DNA, 19 bp, Homo sapiens
tgcagaagacacagtggtg

SEQ ID NO: 7231831 - DNA, 22 bp, Homo sapiens
tgcagaacagggccatgtcacc

SEQ ID NO: 7231832 - DNA, 22 bp, Homo sapiens
tgcagaacagggccatgtcacc

SEQ ID NO: 7231833 - DNA, 22 bp, Homo sapiens
tgcagaaccagtcctcagaccc

SEQ ID NO: 7231834 - DNA, 22 bp, Homo sapiens
tgcagaaccccttcccaggccc

SEQ ID NO: 7231835 - DNA, 22 bp, Homo sapiens
tgcagaacgggtcttctagcac

SEQ ID NO: 7231836 - DNA, 22 bp, Homo sapiens
tgcagaagaaaacagctgtgtg

SEQ ID NO: 7231837 - DNA, 22 bp, Homo sapiens
tgcagaagaaaacagctgtgtg

SEQ ID NO: 7231838 - DNA, 22 bp, Homo sapiens
tgcagaagaaaacagctgtgtg

SEQ ID NO: 7231839 - DNA, 20 bp, Homo sapiens
tgcagaagaacgttctggtt

SEQ ID NO: 7231840 - DNA, 22 bp, Homo sapiens
tgcagaagaatgagcttggagt

SEQ ID NO: 7231841 - DNA, 22 bp, Homo sapiens
tgcagaagtattccaggcccca

SEQ ID NO: 7231842 - DNA, 22 bp, Homo sapiens
tgcagaagtgagtcatgaggaa

SEQ ID NO: 7231843 - DNA, 22 bp, Homo sapiens
tgcagaaggaggaggaaatcca

SEQ ID NO: 7231844 - DNA, 22 bp, Homo sapiens
tgcagaagatggtctgagcacc

SEQ ID NO: 7231845 - DNA, 22 bp, Homo sapiens
tgcagaagcagagagttgccaa

SEQ ID NO: 7231846 - DNA, 22 bp, Homo sapiens
tgcagaagctgcaggtcagtgg

SEQ ID NO: 7231847 - DNA, 22 bp, Homo sapiens
tgcaccagagcagggtgcccaa

SEQ ID NO: 7231848 - DNA, 22 bp, Homo sapiens
tgcaccagtttctcagagaatc

SEQ ID NO: 7231849 - DNA, 22 bp, Homo sapiens
tgcaccacccgtgggaggactg

SEQ ID NO: 7231850 - DNA, 22 bp, Homo sapiens
tgcaccctcatcagtcaaatgg

SEQ ID NO: 7231851 - DNA, 22 bp, Homo sapiens
tgcacccagggggatcaggaat

SEQ ID NO: 7231852 - DNA, 21 bp, Homo sapiens
tgcacctgtgccccatccttc

SEQ ID NO: 7231853 - DNA, 21 bp, Homo sapiens
tgcacctgtgccccatccttc

SEQ ID NO: 7231854 - DNA, 22 bp, Homo sapiens
tgcacctggactaactaactca

SEQ ID NO: 7231855 - DNA, 22 bp, Homo sapiens
tgcaccttcattttaggcagct

SEQ ID NO: 7231856 - DNA, 22 bp, Homo sapiens
tgcaccttcattttaggcagct

SEQ ID NO: 7231857 - DNA, 21 bp, Homo sapiens
tgcacctgttcactgcagttc

SEQ ID NO: 7231858 - DNA, 22 bp, Homo sapiens
tgcacctgagaggtctctgagg

SEQ ID NO: 7231859 - DNA, 22 bp, Homo sapiens
tgcacctgcaatacctgtacct

SEQ ID NO: 7231860 - DNA, 22 bp, Homo sapiens
tgcacctgctcagactcctgtc

SEQ ID NO: 7231861 - DNA, 22 bp, Homo sapiens
tgcacattgaaatgaccagctg

SEQ ID NO: 7231862 - DNA, 22 bp, Homo sapiens
tgcacattgaaatgaccagctg

SEQ ID NO: 7231863 - DNA, 22 bp, Homo sapiens
tgcacattgaaatgaccagctg

SEQ ID NO: 7231864 - DNA, 22 bp, Homo sapiens
tgcacattgaatgagcaaactg

SEQ ID NO: 7231865 - DNA, 22 bp, Homo sapiens
tgcacatttgttattttgaggt

SEQ ID NO: 7231866 - DNA, 22 bp, Homo sapiens
tgcacattcacttaggtattgt

SEQ ID NO: 7231867 - DNA, 22 bp, Homo sapiens
tgcacatgtgcctgtggcacat

SEQ ID NO: 7231868 - DNA, 22 bp, Homo sapiens
tgcacattagtgtttgagatgc

SEQ ID NO: 7231869 - DNA, 22 bp, Homo sapiens
tgcacagttggctacatcgtgg

SEQ ID NO: 7231870 - DNA, 22 bp, Homo sapiens
tgcacatctttcagcatcatac

SEQ ID NO: 7231871 - DNA, 22 bp, Homo sapiens
tgcacatggcaatgctgctccc

SEQ ID NO: 7231872 - DNA, 22 bp, Homo sapiens
tgcacatctttcagcatcatac

SEQ ID NO: 7231873 - DNA, 20 bp, Homo sapiens
tgcacatggcagccatctag

SEQ ID NO: 7231874 - DNA, 20 bp, Homo sapiens
tgcacatggcagccatctag

SEQ ID NO: 7231875 - DNA, 22 bp, Homo sapiens
tgcacatggcctgagtgcctga

SEQ ID NO: 7231876 - DNA, 22 bp, Homo sapiens
tgcacatggcctgagtgcctga

SEQ ID NO: 7231877 - DNA, 22 bp, Homo sapiens
tgcacatgtgcacatatatgtg

SEQ ID NO: 7231878 - DNA, 22 bp, Homo sapiens
tgcacagtgacccctggtgact

SEQ ID NO: 7231879 - DNA, 22 bp, Homo sapiens
tgcacagtgtaatgaatcagaa

SEQ ID NO: 7231880 - DNA, 22 bp, Homo sapiens
tgcacagtgtaatgaatcagaa

SEQ ID NO: 7231881 - DNA, 22 bp, Homo sapiens
tgcacagttaatatgtgacaga

SEQ ID NO: 7231882 - DNA, 22 bp, Homo sapiens
tgcacagttcgccttctccaag

SEQ ID NO: 7231883 - DNA, 22 bp, Homo sapiens
tgcacagttcgccttctccaag

SEQ ID NO: 7231884 - DNA, 22 bp, Homo sapiens
tgcacagttggctacatcgtgg

SEQ ID NO: 7231885 - DNA, 22 bp, Homo sapiens
tgcacaggtggtccatctgcac

SEQ ID NO: 7231886 - DNA, 22 bp, Homo sapiens
tgcacaggtgagactcaggaag

SEQ ID NO: 7231887 - DNA, 22 bp, Homo sapiens
tgcacaggtgagactcaggaag

SEQ ID NO: 7231888 - DNA, 22 bp, Homo sapiens
tgcacaggtatgcaaagcatgt

SEQ ID NO: 7231889 - DNA, 22 bp, Homo sapiens
tgcacaggtgagactcaggaag

SEQ ID NO: 7231890 - DNA, 22 bp, Homo sapiens
tgcacaggtgagactcaggaag

SEQ ID NO: 7231891 - DNA, 22 bp, Homo sapiens
tgcacaggtatgcaaagcatgt

SEQ ID NO: 7231892 - DNA, 20 bp, Homo sapiens
tgcacagggtgggaagcaac

SEQ ID NO: 7231893 - DNA, 20 bp, Homo sapiens
tgcacagggtgggaagcaac

SEQ ID NO: 7231894 - DNA, 20 bp, Homo sapiens
tgcacagggtgggaagcaac

SEQ ID NO: 7231895 - DNA, 21 bp, Homo sapiens
tgcacagggcccaggagagcc

SEQ ID NO: 7231896 - DNA, 21 bp, Homo sapiens
tgcacagggcccaggagagcc

SEQ ID NO: 7231897 - DNA, 22 bp, Homo sapiens
tgcacagggagggggccagctc

SEQ ID NO: 7231898 - DNA, 22 bp, Homo sapiens
tgcacaggccttgaagggagag

SEQ ID NO: 7231899 - DNA, 22 bp, Homo sapiens
tgcacaggccttgaagggagag

SEQ ID NO: 7231900 - DNA, 22 bp, Homo sapiens
tgcacacagttctcaggaaaga

SEQ ID NO: 7231901 - DNA, 22 bp, Homo sapiens
tgcacagcaaatattgactacc

SEQ ID NO: 7231902 - DNA, 22 bp, Homo sapiens
tgcacagcaaatattgactacc

SEQ ID NO: 7231903 - DNA, 21 bp, Homo sapiens
tgcacagccataccctccttg

SEQ ID NO: 7231904 - DNA, 21 bp, Homo sapiens
tgcacagccataccctccttg

SEQ ID NO: 7231905 - DNA, 22 bp, Homo sapiens
tgcacagcgcttgtcgggtgtg

SEQ ID NO: 7231906 - DNA, 22 bp, Homo sapiens
tgcacagcgcttgtcgggtgtg

SEQ ID NO: 7231907 - DNA, 22 bp, Homo sapiens
tgcacagcgggtgtctgtcagg

SEQ ID NO: 7231908 - DNA, 22 bp, Homo sapiens
tgcacagcgggtgtctgtcagg

SEQ ID NO: 7231909 - DNA, 22 bp, Homo sapiens
tgcacagcgggtgtctgtcagg

SEQ ID NO: 7231910 - DNA, 22 bp, Homo sapiens
tgcacagctgcctcctctctgc

SEQ ID NO: 7231911 - DNA, 22 bp, Homo sapiens
tgcacagctgcctcctctctgc

SEQ ID NO: 7231912 - DNA, 22 bp, Homo sapiens
tgcacagctggctctccttttc

SEQ ID NO: 7231913 - DNA, 22 bp, Homo sapiens
tgcacagctggctctccttttc

SEQ ID NO: 7231914 - DNA, 22 bp, Homo sapiens
tgcacagctggctctccttttc

SEQ ID NO: 7231915 - DNA, 20 bp, Homo sapiens
tgcacagctgtgaataggat

SEQ ID NO: 7231916 - DNA, 20 bp, Homo sapiens
tgcacagctgtgaataggat

SEQ ID NO: 7231917 - DNA, 18 bp, Homo sapiens
tgcacagctgtgggctgg

SEQ ID NO: 7231918 - DNA, 18 bp, Homo sapiens
tgcacagctgtgggctgg

SEQ ID NO: 7231919 - DNA, 23 bp, Homo sapiens
tgcacaggacggccttataagta

SEQ ID NO: 7231920 - DNA, 23 bp, Homo sapiens
tgcacaggacggccttataagta

SEQ ID NO: 7231921 - DNA, 22 bp, Homo sapiens
tgcagagatcctggactgagcg

SEQ ID NO: 7231922 - DNA, 21 bp, Homo sapiens
tgcagagatatctgaagcaga

SEQ ID NO: 7231923 - DNA, 22 bp, Homo sapiens
tgcagagatcctggactgagcg

SEQ ID NO: 7231924 - DNA, 22 bp, Homo sapiens
tgcagagaaaccagtggaggac

SEQ ID NO: 7231925 - DNA, 22 bp, Homo sapiens
tgcagagaaaactcctgggtac

SEQ ID NO: 7231926 - DNA, 22 bp, Homo sapiens
tgcagaccacagctaggctgga

SEQ ID NO: 7231927 - DNA, 22 bp, Homo sapiens
tgcagacttagaaaagtctaga

SEQ ID NO: 7231928 - DNA, 22 bp, Homo sapiens
tgcagacctcccatggctgcct

SEQ ID NO: 7231929 - DNA, 22 bp, Homo sapiens
tgcagacaagccaggctatggc

SEQ ID NO: 7231930 - DNA, 22 bp, Homo sapiens
tgcagacaagccaggctatggc

SEQ ID NO: 7231931 - DNA, 22 bp, Homo sapiens
tgcagacaagtcgtgggatctt

SEQ ID NO: 7231932 - DNA, 22 bp, Homo sapiens
tgcagacaagtgcatctaaccc

SEQ ID NO: 7231933 - DNA, 22 bp, Homo sapiens
tgcagacagagaaatgaggccc

SEQ ID NO: 7231934 - DNA, 22 bp, Homo sapiens
tgcagacagagaaatgaggccc

SEQ ID NO: 7231935 - DNA, 22 bp, Homo sapiens
tgcagacaagaagaaccaagga

SEQ ID NO: 7231936 - DNA, 22 bp, Homo sapiens
tgcagacaagaagaaccaagga

SEQ ID NO: 7231937 - DNA, 22 bp, Homo sapiens
tgcagagatttggctcttaaag

SEQ ID NO: 7231938 - DNA, 22 bp, Homo sapiens
tgcagagatctgggcgtcggct

SEQ ID NO: 7231939 - DNA, 22 bp, Homo sapiens
tgcagagattgaacaagaagga

SEQ ID NO: 7231940 - DNA, 22 bp, Homo sapiens
tgcagagattgaacaagaagga

SEQ ID NO: 7231941 - DNA, 20 bp, Homo sapiens
tgcagagctgacattacctg

SEQ ID NO: 7231942 - DNA, 22 bp, Homo sapiens
tgcagagctcttggcacttcag

SEQ ID NO: 7231943 - DNA, 22 bp, Homo sapiens
tgcagagccccagattggagag

SEQ ID NO: 7231944 - DNA, 22 bp, Homo sapiens
tgcagagctcttggcacttcag

SEQ ID NO: 7231945 - DNA, 22 bp, Homo sapiens
tgcagagcagcaactgcgtgcg

SEQ ID NO: 7231946 - DNA, 22 bp, Homo sapiens
tgcagagcagcaactgcgtgcg

SEQ ID NO: 7231947 - DNA, 22 bp, Homo sapiens
tgcagagcagcaactgcgtgcg

SEQ ID NO: 7231948 - DNA, 22 bp, Homo sapiens
tgcagagcagcaactgcgtgcg

SEQ ID NO: 7231949 - DNA, 22 bp, Homo sapiens
tgcagagcagcaactgcgtgcg

SEQ ID NO: 7231950 - DNA, 22 bp, Homo sapiens
tgcagagcttcattgcataggc

SEQ ID NO: 7231951 - DNA, 22 bp, Homo sapiens
tgcagagcttcattgcataggc

SEQ ID NO: 7231952 - DNA, 22 bp, Homo sapiens
tgcagaggaccattgtcctgga

SEQ ID NO: 7231953 - DNA, 22 bp, Homo sapiens
tgcagaggaccattgtcctgga

SEQ ID NO: 7231954 - DNA, 22 bp, Homo sapiens
tgcagaggaccattgtcctgga

SEQ ID NO: 7231955 - DNA, 20 bp, Homo sapiens
tgcagagctggctggctcct

SEQ ID NO: 7231956 - DNA, 20 bp, Homo sapiens
tgcagagctggctggctcct

SEQ ID NO: 7231957 - DNA, 20 bp, Homo sapiens
tgcagagctggctggctcct

SEQ ID NO: 7231958 - DNA, 22 bp, Homo sapiens
tgcagaggaccattgtcctgga

SEQ ID NO: 7231959 - DNA, 22 bp, Homo sapiens
tgcagaggagctggaaggctgg

SEQ ID NO: 7231960 - DNA, 22 bp, Homo sapiens
tgcagaggcgccgtgggtgggg

SEQ ID NO: 7231961 - DNA, 22 bp, Homo sapiens
tgcagaggcgccgtgggtgggg

SEQ ID NO: 7231962 - DNA, 22 bp, Homo sapiens
tgcagaggcgccgtgggtgggg

SEQ ID NO: 7231963 - DNA, 22 bp, Homo sapiens
tgcagagggaaaaggtgctcct

SEQ ID NO: 7231964 - DNA, 22 bp, Homo sapiens
tgcagaggctggctcgccgggt

SEQ ID NO: 7231965 - DNA, 22 bp, Homo sapiens
tgcagaggctggctcgccgggt

SEQ ID NO: 7231966 - DNA, 22 bp, Homo sapiens
tgcagaggctggctcgccgggt

SEQ ID NO: 7231967 - DNA, 22 bp, Homo sapiens
tgcagaggcgccgtgggtgggg

SEQ ID NO: 7231968 - DNA, 22 bp, Homo sapiens
tgcagaggctggctcgccgggt

SEQ ID NO: 7231969 - DNA, 21 bp, Homo sapiens
tgcagaggcacaaacaagccc

SEQ ID NO: 7231970 - DNA, 23 bp, Homo sapiens
tgcagaggcatgatcactgctca

SEQ ID NO: 7231971 - DNA, 23 bp, Homo sapiens
tgcagaggcatgatcactgctca

SEQ ID NO: 7231972 - DNA, 23 bp, Homo sapiens
tgcagaggcatgatcactgctca

SEQ ID NO: 7231973 - DNA, 22 bp, Homo sapiens
tgcagaggcatttattgatgta

SEQ ID NO: 7231974 - DNA, 22 bp, Homo sapiens
tgcagaggcatttattgatgta

SEQ ID NO: 7231975 - DNA, 22 bp, Homo sapiens
tgcagaggcatttattgatgta

SEQ ID NO: 7231976 - DNA, 22 bp, Homo sapiens
tgcagaggcccagcggttcttc

SEQ ID NO: 7231977 - DNA, 22 bp, Homo sapiens
tgcagaggcgccgtgggtgggg

SEQ ID NO: 7231978 - DNA, 22 bp, Homo sapiens
tgcagaggagctggaaggctgg

SEQ ID NO: 7231979 - DNA, 22 bp, Homo sapiens
tgcagaggagctggaaggctgg

SEQ ID NO: 7231980 - DNA, 22 bp, Homo sapiens
tgcagaggagctggaaggctgg

SEQ ID NO: 7231981 - DNA, 22 bp, Homo sapiens
tgcagaggagctggaaggctgg

SEQ ID NO: 7231982 - DNA, 22 bp, Homo sapiens
tgcagaggagctggaaggctgg

SEQ ID NO: 7231983 - DNA, 21 bp, Homo sapiens
tgcagaggcacaaacaagccc

SEQ ID NO: 7231984 - DNA, 22 bp, Homo sapiens
tgcagaggagtcagcctgggca

SEQ ID NO: 7231985 - DNA, 21 bp, Homo sapiens
tgcagaggcacaaacaagccc

SEQ ID NO: 7231986 - DNA, 21 bp, Homo sapiens
tgcagaggcacaaacaagccc

SEQ ID NO: 7231987 - DNA, 22 bp, Homo sapiens
tgcagaggagtcagcctgggca

SEQ ID NO: 7231988 - DNA, 22 bp, Homo sapiens
tgcagaggagtcagcctgggca

SEQ ID NO: 7231989 - DNA, 22 bp, Homo sapiens
tgcagaggagtcagcctgggca

SEQ ID NO: 7231990 - DNA, 22 bp, Homo sapiens
tgcagaggagtcagcctgggca

SEQ ID NO: 7231991 - DNA, 22 bp, Homo sapiens
tgcagaggagctggaaggctgg

SEQ ID NO: 7231992 - DNA, 22 bp, Homo sapiens
tgcagaggagtcagcctgggca

SEQ ID NO: 7231993 - DNA, 22 bp, Homo sapiens
tgcagaggagtcagcctgggca

SEQ ID NO: 7231994 - DNA, 19 bp, Homo sapiens
tgcagagggtaggaaggcc

SEQ ID NO: 7231995 - DNA, 19 bp, Homo sapiens
tgcagagggtaggaaggcc

SEQ ID NO: 7231996 - DNA, 19 bp, Homo sapiens
tgcagagggtaggaaggcc

SEQ ID NO: 7231997 - DNA, 19 bp, Homo sapiens
tgcagagggtaggaaggcc

SEQ ID NO: 7231998 - DNA, 22 bp, Homo sapiens
tgcagagtaacgatcacatata

SEQ ID NO: 7231999 - DNA, 22 bp, Homo sapiens
tgcagagtaacgatcacatata

SEQ ID NO: 7232000 - DNA, 22 bp, Homo sapiens
tgcagagtagctataccatttt

SEQ ID NO: 7232001 - DNA, 22 bp, Homo sapiens
tgcagagtagctataccatttt

SEQ ID NO: 7232002 - DNA, 22 bp, Homo sapiens
tgcagagtagtgaggggacaga

SEQ ID NO: 7232003 - DNA, 22 bp, Homo sapiens
tgcagagtcacccagataatta

SEQ ID NO: 7232004 - DNA, 22 bp, Homo sapiens
tgcagagtcccaggacccagag

SEQ ID NO: 7232005 - DNA, 22 bp, Homo sapiens
tgcagagtcccaggacccagag

SEQ ID NO: 7232006 - DNA, 22 bp, Homo sapiens
tgcagagtcccaggacccagag

SEQ ID NO: 7232007 - DNA, 22 bp, Homo sapiens
tgcagagtcctctggagggact

SEQ ID NO: 7232008 - DNA, 22 bp, Homo sapiens
tgcagagtcctctggagggact

SEQ ID NO: 7232009 - DNA, 22 bp, Homo sapiens
tgcagagtgaagacatcacccc

SEQ ID NO: 7232010 - DNA, 22 bp, Homo sapiens
tgcagagtgaggaagaactgca

SEQ ID NO: 7232011 - DNA, 22 bp, Homo sapiens
tgcagagtgaggaagaactgca

SEQ ID NO: 7232012 - DNA, 22 bp, Homo sapiens
tgcagagtggattctgtatacc

SEQ ID NO: 7232013 - DNA, 22 bp, Homo sapiens
tgcagagtgggagaggtgcggg

SEQ ID NO: 7232014 - DNA, 23 bp, Homo sapiens
tgcagagtgtcacttgaaaacca

SEQ ID NO: 7232015 - DNA, 22 bp, Homo sapiens
tgcagataatactagaacttac

SEQ ID NO: 7232016 - DNA, 22 bp, Homo sapiens
tgcagagttgctttgatagtcc

SEQ ID NO: 7232017 - DNA, 22 bp, Homo sapiens
tgcagataatactagaacttac

SEQ ID NO: 7232018 - DNA, 21 bp, Homo sapiens
tgcagataattgaaagctgac

SEQ ID NO: 7232019 - DNA, 22 bp, Homo sapiens
tgcagatagcgtcattcttgct

SEQ ID NO: 7232020 - DNA, 22 bp, Homo sapiens
tgcagatgaatgctgagacact

SEQ ID NO: 7232021 - DNA, 22 bp, Homo sapiens
tgcagatattctcccaagtgtt

SEQ ID NO: 7232022 - DNA, 22 bp, Homo sapiens
tgcagagggacagccacagctc

SEQ ID NO: 7232023 - DNA, 22 bp, Homo sapiens
tgcagagggaaaaggtgctcct

SEQ ID NO: 7232024 - DNA, 22 bp, Homo sapiens
tgcagagggaaaaggtgctcct

SEQ ID NO: 7232025 - DNA, 22 bp, Homo sapiens
tgcagagggaaaaggtgctcct

SEQ ID NO: 7232026 - DNA, 22 bp, Homo sapiens
tgcagagggaaaaggtgctcct

SEQ ID NO: 7232027 - DNA, 22 bp, Homo sapiens
tgcagagggaaaaggtgctcct

SEQ ID NO: 7232028 - DNA, 22 bp, Homo sapiens
tgcagagggacagccacagctc

SEQ ID NO: 7232029 - DNA, 22 bp, Homo sapiens
tgcagagggacagccacagctc

SEQ ID NO: 7232030 - DNA, 22 bp, Homo sapiens
tgcagagggacagccacagctc

SEQ ID NO: 7232031 - DNA, 23 bp, Homo sapiens
tgcagagggactgaagccagctt

SEQ ID NO: 7232032 - DNA, 23 bp, Homo sapiens
tgcagagggactgaagccagctt

SEQ ID NO: 7232033 - DNA, 19 bp, Homo sapiens
tgcagagggtaggaaggcc

SEQ ID NO: 7232034 - DNA, 22 bp, Homo sapiens
tgcagagggagtgacggttcac

SEQ ID NO: 7232035 - DNA, 23 bp, Homo sapiens
tgcagagggactgaagccagctt

SEQ ID NO: 7232036 - DNA, 22 bp, Homo sapiens
tgcagagggagtgacggttcac

SEQ ID NO: 7232037 - DNA, 22 bp, Homo sapiens
tgcagagggagtgacggttcac

SEQ ID NO: 7232038 - DNA, 22 bp, Homo sapiens
tgcagatgagggatgaaaatga

SEQ ID NO: 7232039 - DNA, 22 bp, Homo sapiens
tgcagatgaatgctgagacact

SEQ ID NO: 7232040 - DNA, 22 bp, Homo sapiens
tgcagatgagggatgaaaatga

SEQ ID NO: 7232041 - DNA, 22 bp, Homo sapiens
tgcagatggggatcagtggctc

SEQ ID NO: 7232042 - DNA, 22 bp, Homo sapiens
tgcagatggggatcagtggctc

SEQ ID NO: 7232043 - DNA, 22 bp, Homo sapiens
tgcagatggggatcagtggctc

SEQ ID NO: 7232044 - DNA, 22 bp, Homo sapiens
tgcagattcaaatgaaatgcaa

SEQ ID NO: 7232045 - DNA, 22 bp, Homo sapiens
tgcagattcaaatgaaatgcaa

SEQ ID NO: 7232046 - DNA, 22 bp, Homo sapiens
tgcagcaacaagatagaatggc

SEQ ID NO: 7232047 - DNA, 22 bp, Homo sapiens
tgcagcaacaagatagaatggc

SEQ ID NO: 7232048 - DNA, 22 bp, Homo sapiens
tgcagcaacaagatagaatggc

SEQ ID NO: 7232049 - DNA, 22 bp, Homo sapiens
tgcagcaagaaggcactgtctg

SEQ ID NO: 7232050 - DNA, 22 bp, Homo sapiens
tgcagcaagaaggcactgtctg

SEQ ID NO: 7232051 - DNA, 22 bp, Homo sapiens
tgcagcaagcaagtatggttct

SEQ ID NO: 7232052 - DNA, 22 bp, Homo sapiens
tgcagcaagcaagtatggttct

SEQ ID NO: 7232053 - DNA, 22 bp, Homo sapiens
tgcagcaaggggccctgatagg

SEQ ID NO: 7232054 - DNA, 22 bp, Homo sapiens
tgcagcaagtaaccatcttcct

SEQ ID NO: 7232055 - DNA, 18 bp, Homo sapiens
tgcagcaagtgctaaata

SEQ ID NO: 7232056 - DNA, 18 bp, Homo sapiens
tgcagcaagtgctaaata

SEQ ID NO: 7232057 - DNA, 18 bp, Homo sapiens
tgcagcaagtgctaaata

SEQ ID NO: 7232058 - DNA, 22 bp, Homo sapiens
tgcagcaatttgcagtaattta

SEQ ID NO: 7232059 - DNA, 22 bp, Homo sapiens
tgcagcagaatatggctgcagg

SEQ ID NO: 7232060 - DNA, 22 bp, Homo sapiens
tgcagcagaatatggctgcagg

SEQ ID NO: 7232061 - DNA, 22 bp, Homo sapiens
tgcagcagaatatggctgcagg

SEQ ID NO: 7232062 - DNA, 22 bp, Homo sapiens
tgcagcagaatatggctgcagg

SEQ ID NO: 7232063 - DNA, 20 bp, Homo sapiens
tgcagcagaagcccatgctc

SEQ ID NO: 7232064 - DNA, 20 bp, Homo sapiens
tgcagcagaagcccatgctc

SEQ ID NO: 7232065 - DNA, 21 bp, Homo sapiens
tgcagcagaagtctctgtgtc

SEQ ID NO: 7232066 - DNA, 21 bp, Homo sapiens
tgcagcagaagtctctgtgtc

SEQ ID NO: 7232067 - DNA, 21 bp, Homo sapiens
tgcagcagaagtctctgtgtc

SEQ ID NO: 7232068 - DNA, 21 bp, Homo sapiens
tgcagcagaagtctctgtgtc

SEQ ID NO: 7232069 - DNA, 22 bp, Homo sapiens
tgcagcacaggtgtgattggtt

SEQ ID NO: 7232070 - DNA, 22 bp, Homo sapiens
tgcagcacaggtgtgattggtt

SEQ ID NO: 7232071 - DNA, 22 bp, Homo sapiens
tgcagcacatgtctggggctgg

SEQ ID NO: 7232072 - DNA, 22 bp, Homo sapiens
tgcagcaccacacctggctaat

SEQ ID NO: 7232073 - DNA, 22 bp, Homo sapiens
tgcagcaccacacctggctaat

SEQ ID NO: 7232074 - DNA, 20 bp, Homo sapiens
tgcagcacgggccctttcca

SEQ ID NO: 7232075 - DNA, 20 bp, Homo sapiens
tgcagcacgggccctttcca

SEQ ID NO: 7232076 - DNA, 20 bp, Homo sapiens
tgcagcacgggccctttcca

SEQ ID NO: 7232077 - DNA, 22 bp, Homo sapiens
tgcagcactgttcacaatagcc

SEQ ID NO: 7232078 - DNA, 22 bp, Homo sapiens
tgcaggagacataatagggact

SEQ ID NO: 7232079 - DNA, 22 bp, Homo sapiens
tgcaggagacataatagggact

SEQ ID NO: 7232080 - DNA, 21 bp, Homo sapiens
tgcaggaagtatggtgcctat

SEQ ID NO: 7232081 - DNA, 21 bp, Homo sapiens
tgcaggaaagtgctgcgaccc

SEQ ID NO: 7232082 - DNA, 22 bp, Homo sapiens
tgcaggaacagaactcactccc

SEQ ID NO: 7232083 - DNA, 22 bp, Homo sapiens
tgcaggaacataggttccttgg

SEQ ID NO: 7232084 - DNA, 22 bp, Homo sapiens
tgcaggagataatggtgcttag

SEQ ID NO: 7232085 - DNA, 22 bp, Homo sapiens
tgcaggagagtgagtcagtagg

SEQ ID NO: 7232086 - DNA, 22 bp, Homo sapiens
tgcaggagagtgagtcagtagg

SEQ ID NO: 7232087 - DNA, 22 bp, Homo sapiens
tgcaggagagctggtctggccc

SEQ ID NO: 7232088 - DNA, 22 bp, Homo sapiens
tgcaggagagctggtctggccc

SEQ ID NO: 7232089 - DNA, 22 bp, Homo sapiens
tgcaggagcccaggaatactat

SEQ ID NO: 7232090 - DNA, 22 bp, Homo sapiens
tgcaggagcagagatggctgga

SEQ ID NO: 7232091 - DNA, 22 bp, Homo sapiens
tgcaggagcaccagctcaccct

SEQ ID NO: 7232092 - DNA, 22 bp, Homo sapiens
tgcaggagcaccagctcaccct

SEQ ID NO: 7232093 - DNA, 22 bp, Homo sapiens
tgcagctgtaacagaggcctca

SEQ ID NO: 7232094 - DNA, 20 bp, Homo sapiens
tgcagctggtttcacaggga

SEQ ID NO: 7232095 - DNA, 19 bp, Homo sapiens
tgcagctgtatgagcttaa

SEQ ID NO: 7232096 - DNA, 22 bp, Homo sapiens
tgcagctgttacggaccctgtc

SEQ ID NO: 7232097 - DNA, 22 bp, Homo sapiens
tgcagctgtgcctgaaaagtac

SEQ ID NO: 7232098 - DNA, 22 bp, Homo sapiens
tgcagctgtgaaagggaaccaa

SEQ ID NO: 7232099 - DNA, 22 bp, Homo sapiens
tgcagctgtgaaagggaaccaa

SEQ ID NO: 7232100 - DNA, 22 bp, Homo sapiens
tgcagctgtgcctgaaaagtac

SEQ ID NO: 7232101 - DNA, 22 bp, Homo sapiens
tgcagctttaagctttcatcag

SEQ ID NO: 7232102 - DNA, 22 bp, Homo sapiens
tgcagctttgctctggtcccca

SEQ ID NO: 7232103 - DNA, 22 bp, Homo sapiens
tgcagctttgctctggtcccca

SEQ ID NO: 7232104 - DNA, 22 bp, Homo sapiens
tgcaggaaaaataaatagtgtt

SEQ ID NO: 7232105 - DNA, 22 bp, Homo sapiens
tgcaggaaaaccaacacgcctt

SEQ ID NO: 7232106 - DNA, 22 bp, Homo sapiens
tgcaggaaaaccaacacgcctt

SEQ ID NO: 7232107 - DNA, 22 bp, Homo sapiens
tgcaggaaaaccaacacgcctt

SEQ ID NO: 7232108 - DNA, 22 bp, Homo sapiens
tgcaggaaacagaggctcaaat

SEQ ID NO: 7232109 - DNA, 21 bp, Homo sapiens
tgcaggaaagtgctgcgaccc

SEQ ID NO: 7232110 - DNA, 22 bp, Homo sapiens
tgcagcttccacatccacactc

SEQ ID NO: 7232111 - DNA, 20 bp, Homo sapiens
tgcagcttctcatcttcaaa

SEQ ID NO: 7232112 - DNA, 22 bp, Homo sapiens
tgcagcttctccaaatattaca

SEQ ID NO: 7232113 - DNA, 22 bp, Homo sapiens
tgcagcttaaatcagggtttct

SEQ ID NO: 7232114 - DNA, 22 bp, Homo sapiens
tgcagcttcaaagaacctttcc

SEQ ID NO: 7232115 - DNA, 20 bp, Homo sapiens
tgcagcttcacctgtgtcat

SEQ ID NO: 7232116 - DNA, 22 bp, Homo sapiens
tgcaggcctggactgatgtggt

SEQ ID NO: 7232117 - DNA, 21 bp, Homo sapiens
tgcaggctacttctgactcta

SEQ ID NO: 7232118 - DNA, 21 bp, Homo sapiens
tgcaggctacttctgactcta

SEQ ID NO: 7232119 - DNA, 21 bp, Homo sapiens
tgcaggctacttctgactcta

SEQ ID NO: 7232120 - DNA, 22 bp, Homo sapiens
tgcaggcagctgaaaggtgcct

SEQ ID NO: 7232121 - DNA, 21 bp, Homo sapiens
tgcaggcaggcagagatgctg

SEQ ID NO: 7232122 - DNA, 23 bp, Homo sapiens
tgcaggctaggaagagagccttc

SEQ ID NO: 7232123 - DNA, 23 bp, Homo sapiens
tgcaggctaggaagagagccttc

SEQ ID NO: 7232124 - DNA, 23 bp, Homo sapiens
tgcaggctaggaagagagccttc

SEQ ID NO: 7232125 - DNA, 23 bp, Homo sapiens
tgcaggctaggaagagagccttc

SEQ ID NO: 7232126 - DNA, 22 bp, Homo sapiens
tgcaggctatcctttgctgcaa

SEQ ID NO: 7232127 - DNA, 22 bp, Homo sapiens
tgcaggctcaccctggagctga

SEQ ID NO: 7232128 - DNA, 22 bp, Homo sapiens
tgcaggctcaccctggagctga

SEQ ID NO: 7232129 - DNA, 22 bp, Homo sapiens
tgcaggctcacctgccagggcc

SEQ ID NO: 7232130 - DNA, 22 bp, Homo sapiens
tgcaggctcacctgccagggcc

SEQ ID NO: 7232131 - DNA, 22 bp, Homo sapiens
tgcaggctcatctcaagagtag

SEQ ID NO: 7232132 - DNA, 22 bp, Homo sapiens
tgcaggctccaggtgcacatat

SEQ ID NO: 7232133 - DNA, 22 bp, Homo sapiens
tgcaggctccaggtgcacatat

SEQ ID NO: 7232134 - DNA, 22 bp, Homo sapiens
tgcaggcagctgaaaggtgcct

SEQ ID NO: 7232135 - DNA, 22 bp, Homo sapiens
tgcaggcagctgaaaggtgcct

SEQ ID NO: 7232136 - DNA, 21 bp, Homo sapiens
tgcaggattccaggtcagtat

SEQ ID NO: 7232137 - DNA, 22 bp, Homo sapiens
tgcaggcaccattctgcctctc

SEQ ID NO: 7232138 - DNA, 22 bp, Homo sapiens
tgcaggcaccattctgcctctc

SEQ ID NO: 7232139 - DNA, 22 bp, Homo sapiens
tgcaggcagctaaaccatgtaa

SEQ ID NO: 7232140 - DNA, 22 bp, Homo sapiens
tgcaggcagctaaaccatgtaa

SEQ ID NO: 7232141 - DNA, 22 bp, Homo sapiens
tgcaggagttcccctctgcctg

SEQ ID NO: 7232142 - DNA, 22 bp, Homo sapiens
tgcaggagttaagtgctctcct

SEQ ID NO: 7232143 - DNA, 21 bp, Homo sapiens
tgcaggagtgtaatgtgaccc

SEQ ID NO: 7232144 - DNA, 18 bp, Homo sapiens
tgcaggagtgaccccggc

SEQ ID NO: 7232145 - DNA, 21 bp, Homo sapiens
tgcaggagtctgtgagtcagg

SEQ ID NO: 7232146 - DNA, 22 bp, Homo sapiens
tgcaggagcttggctctgtccc

SEQ ID NO: 7232147 - DNA, 22 bp, Homo sapiens
tgcaggagcttggctctgtccc

SEQ ID NO: 7232148 - DNA, 22 bp, Homo sapiens
tgcaggagctgctgtcctgctc

SEQ ID NO: 7232149 - DNA, 22 bp, Homo sapiens
tgcaggagcccttgggctctgg

SEQ ID NO: 7232150 - DNA, 22 bp, Homo sapiens
tgcaggaggctttattcaggat

SEQ ID NO: 7232151 - DNA, 22 bp, Homo sapiens
tgcaggaggattttgtggagct

SEQ ID NO: 7232152 - DNA, 19 bp, Homo sapiens
tgcaggaggactgagcaga

SEQ ID NO: 7232153 - DNA, 22 bp, Homo sapiens
tgcaggaggattttgtggagct

SEQ ID NO: 7232154 - DNA, 22 bp, Homo sapiens
tgcaggagggagggttacagtt

SEQ ID NO: 7232155 - DNA, 22 bp, Homo sapiens
tgcaggagtccaatcaggagac

SEQ ID NO: 7232156 - DNA, 22 bp, Homo sapiens
tgcagctgacccactccagtcc

SEQ ID NO: 7232157 - DNA, 22 bp, Homo sapiens
tgcagctgacccactccagtcc

SEQ ID NO: 7232158 - DNA, 22 bp, Homo sapiens
tgcagctgacccactccagtcc

SEQ ID NO: 7232159 - DNA, 22 bp, Homo sapiens
tgcagctgacccactccagtcc

SEQ ID NO: 7232160 - DNA, 22 bp, Homo sapiens
tgcagctgaggccagctatgcc

SEQ ID NO: 7232161 - DNA, 21 bp, Homo sapiens
tgcagctgacactggtatgcc

SEQ ID NO: 7232162 - DNA, 22 bp, Homo sapiens
tgcagctgaccagcaagtcctg

SEQ ID NO: 7232163 - DNA, 22 bp, Homo sapiens
tgcagctgaccagcaagtcctg

SEQ ID NO: 7232164 - DNA, 22 bp, Homo sapiens
tgcagctgaacctagagtctgt

SEQ ID NO: 7232165 - DNA, 22 bp, Homo sapiens
tgcagctctgtatgctgattat

SEQ ID NO: 7232166 - DNA, 18 bp, Homo sapiens
tgcagcctgtagtcttgt

SEQ ID NO: 7232167 - DNA, 22 bp, Homo sapiens
tgcagccttggcaaccagggac

SEQ ID NO: 7232168 - DNA, 22 bp, Homo sapiens
tgcagccttggcaaccagggac

SEQ ID NO: 7232169 - DNA, 22 bp, Homo sapiens
tgcagcctttagaagttcagat

SEQ ID NO: 7232170 - DNA, 22 bp, Homo sapiens
tgcagctcattggtgtcctggt

SEQ ID NO: 7232171 - DNA, 22 bp, Homo sapiens
tgcagctcctctggctgcctga

SEQ ID NO: 7232172 - DNA, 22 bp, Homo sapiens
tgcagctcctctggctgcctga

SEQ ID NO: 7232173 - DNA, 22 bp, Homo sapiens
tgcagctcgggcttagggtggg

SEQ ID NO: 7232174 - DNA, 22 bp, Homo sapiens
tgcagctctgaacagtcatgaa

SEQ ID NO: 7232175 - DNA, 22 bp, Homo sapiens
tgcagctctgcatggctggttc

SEQ ID NO: 7232176 - DNA, 22 bp, Homo sapiens
tgcagctgctggtggctgaaag

SEQ ID NO: 7232177 - DNA, 22 bp, Homo sapiens
tgcagctgctggtggctgaaag

SEQ ID NO: 7232178 - DNA, 22 bp, Homo sapiens
tgcagctgctggcccaggtgct

SEQ ID NO: 7232179 - DNA, 22 bp, Homo sapiens
tgcagctgctggcccaggtgct

SEQ ID NO: 7232180 - DNA, 22 bp, Homo sapiens
tgcagctgctggcccaggtgct

SEQ ID NO: 7232181 - DNA, 22 bp, Homo sapiens
tgcagctgctcttcatttcccc

SEQ ID NO: 7232182 - DNA, 17 bp, Homo sapiens
tgcagctgctcccaggc

SEQ ID NO: 7232183 - DNA, 17 bp, Homo sapiens
tgcagctgctcccaggc

SEQ ID NO: 7232184 - DNA, 22 bp, Homo sapiens
tgcagctgatgatacccccatg

SEQ ID NO: 7232185 - DNA, 22 bp, Homo sapiens
tgcagctgatgatacccccatg

SEQ ID NO: 7232186 - DNA, 22 bp, Homo sapiens
tgcagctgagtcacccagccat

SEQ ID NO: 7232187 - DNA, 22 bp, Homo sapiens
tgcagctgaggccagctatgcc

SEQ ID NO: 7232188 - DNA, 22 bp, Homo sapiens
tgcagctgaggccagctatgcc

SEQ ID NO: 7232189 - DNA, 22 bp, Homo sapiens
tgcagctgagtcacccagccat

SEQ ID NO: 7232190 - DNA, 22 bp, Homo sapiens
tgcagctgagtcacccagccat

SEQ ID NO: 7232191 - DNA, 22 bp, Homo sapiens
tgcagctgataattacatgttc

SEQ ID NO: 7232192 - DNA, 20 bp, Homo sapiens
tgcagctggtttcacaggga

SEQ ID NO: 7232193 - DNA, 22 bp, Homo sapiens
tgcagctggtttagaactagat

SEQ ID NO: 7232194 - DNA, 22 bp, Homo sapiens
tgcagctggtttagaactagat

SEQ ID NO: 7232195 - DNA, 22 bp, Homo sapiens
tgcagctggtatcccatggatt

SEQ ID NO: 7232196 - DNA, 22 bp, Homo sapiens
tgcagctggtatcccatggatt

SEQ ID NO: 7232197 - DNA, 22 bp, Homo sapiens
tgcagctggtatcccatggatt

SEQ ID NO: 7232198 - DNA, 22 bp, Homo sapiens
tgcagctggtatcccatggatt

SEQ ID NO: 7232199 - DNA, 22 bp, Homo sapiens
tgcagctggaacttagaggaga

SEQ ID NO: 7232200 - DNA, 22 bp, Homo sapiens
tgcagctgggtctgccctggct

SEQ ID NO: 7232201 - DNA, 22 bp, Homo sapiens
tgcagctgggtctgccctggct

SEQ ID NO: 7232202 - DNA, 22 bp, Homo sapiens
tgcagcctagacattctggtca

SEQ ID NO: 7232203 - DNA, 22 bp, Homo sapiens
tgcagcctagacattctggtca

SEQ ID NO: 7232204 - DNA, 22 bp, Homo sapiens
tgcagcccctgaaaatggcagc

SEQ ID NO: 7232205 - DNA, 22 bp, Homo sapiens
tgcagcccctgaaaatggcagc

SEQ ID NO: 7232206 - DNA, 22 bp, Homo sapiens
tgcagccctgtgcacatcccct

SEQ ID NO: 7232207 - DNA, 22 bp, Homo sapiens
tgcagcctctctgcttcaggaa

SEQ ID NO: 7232208 - DNA, 21 bp, Homo sapiens
tgcagcctctgcccagcagtg

SEQ ID NO: 7232209 - DNA, 21 bp, Homo sapiens
tgcagcctctgcccagcagtg

SEQ ID NO: 7232210 - DNA, 21 bp, Homo sapiens
tgcagcctctgcccagcagtg

SEQ ID NO: 7232211 - DNA, 22 bp, Homo sapiens
tgcagcctggcttcgcgcctcc

SEQ ID NO: 7232212 - DNA, 22 bp, Homo sapiens
tgcagcctggtggtcactggag

SEQ ID NO: 7232213 - DNA, 22 bp, Homo sapiens
tgcagcctggtggtcactggag

SEQ ID NO: 7232214 - DNA, 18 bp, Homo sapiens
tgcagcctgtagtcttgt

SEQ ID NO: 7232215 - DNA, 22 bp, Homo sapiens
tgcagccatcgcagagtctgta

SEQ ID NO: 7232216 - DNA, 22 bp, Homo sapiens
tgcagccatcgcagagtctgta

SEQ ID NO: 7232217 - DNA, 22 bp, Homo sapiens
tgcagccatctttcttggagga

SEQ ID NO: 7232218 - DNA, 22 bp, Homo sapiens
tgcagccatctttcttggagga

SEQ ID NO: 7232219 - DNA, 22 bp, Homo sapiens
tgcagccatttgaaaagcagtt

SEQ ID NO: 7232220 - DNA, 22 bp, Homo sapiens
tgcagcccagccccagaacctt

SEQ ID NO: 7232221 - DNA, 22 bp, Homo sapiens
tgcagcccagccccagaacctt

SEQ ID NO: 7232222 - DNA, 22 bp, Homo sapiens
tgcagcagggcccaggcacaga

SEQ ID NO: 7232223 - DNA, 23 bp, Homo sapiens
tgcagcagggtggtctacttctc

SEQ ID NO: 7232224 - DNA, 23 bp, Homo sapiens
tgcagcagggtggtctacttctc

SEQ ID NO: 7232225 - DNA, 23 bp, Homo sapiens
tgcagccactcaggagctcagtg

SEQ ID NO: 7232226 - DNA, 22 bp, Homo sapiens
tgcagccagcaagtgaatacat

SEQ ID NO: 7232227 - DNA, 22 bp, Homo sapiens
tgcagcagggcccaggcacaga

SEQ ID NO: 7232228 - DNA, 22 bp, Homo sapiens
tgcagcagggcccaggcacaga

SEQ ID NO: 7232229 - DNA, 22 bp, Homo sapiens
tgcagcagggcccaggcacaga

SEQ ID NO: 7232230 - DNA, 22 bp, Homo sapiens
tgcagcaggagccaggcctggt

SEQ ID NO: 7232231 - DNA, 22 bp, Homo sapiens
tgcagcaggcacaggacggaag

SEQ ID NO: 7232232 - DNA, 22 bp, Homo sapiens
tgcagcaggcacaggacggaag

SEQ ID NO: 7232233 - DNA, 22 bp, Homo sapiens
tgcagcaggagccaggcctggt

SEQ ID NO: 7232234 - DNA, 22 bp, Homo sapiens
tgcagcaggagccaggcctggt

SEQ ID NO: 7232235 - DNA, 22 bp, Homo sapiens
tgcagcagcctcatctggtttc

SEQ ID NO: 7232236 - DNA, 22 bp, Homo sapiens
tgcagcagctccaggttaccct

SEQ ID NO: 7232237 - DNA, 22 bp, Homo sapiens
tgcagcagcagggaggaggctc

SEQ ID NO: 7232238 - DNA, 22 bp, Homo sapiens
tgcagcagcagggaggaggctc

SEQ ID NO: 7232239 - DNA, 22 bp, Homo sapiens
tgcagcagcagggaggaggctc

SEQ ID NO: 7232240 - DNA, 22 bp, Homo sapiens
tgcagcagcagggaggaggctc

SEQ ID NO: 7232241 - DNA, 22 bp, Homo sapiens
tgcagcagcagggaggaggctc

SEQ ID NO: 7232242 - DNA, 22 bp, Homo sapiens
tgcagcagagtgggcctgggtg

SEQ ID NO: 7232243 - DNA, 21 bp, Homo sapiens
tgcagcagatttgggggaaga

SEQ ID NO: 7232244 - DNA, 21 bp, Homo sapiens
tgcagcagagtaagcagggga

SEQ ID NO: 7232245 - DNA, 22 bp, Homo sapiens
tgcagcagactgagtatgagaa

SEQ ID NO: 7232246 - DNA, 21 bp, Homo sapiens
tgcagcagagtaagcagggga

SEQ ID NO: 7232247 - DNA, 21 bp, Homo sapiens
tgcagcagagtaagcagggga

SEQ ID NO: 7232248 - DNA, 22 bp, Homo sapiens
tgcagcagaatatggctgcagg

SEQ ID NO: 7232249 - DNA, 22 bp, Homo sapiens
tgcagcagacataatgtggatt

SEQ ID NO: 7232250 - DNA, 22 bp, Homo sapiens
tgcagcagacataatgtggatt

SEQ ID NO: 7232251 - DNA, 22 bp, Homo sapiens
tgcaaggaagggacagctgaga

SEQ ID NO: 7232252 - DNA, 22 bp, Homo sapiens
tgcaaggatatttagtctagtg

SEQ ID NO: 7232253 - DNA, 22 bp, Homo sapiens
tgcaagattttgacactcgtct

SEQ ID NO: 7232254 - DNA, 22 bp, Homo sapiens
tgcaagattttgacactcgtct

SEQ ID NO: 7232255 - DNA, 22 bp, Homo sapiens
tgcaagggcttagggggctgtg

SEQ ID NO: 7232256 - DNA, 22 bp, Homo sapiens
tgcaagggcttagggggctgtg

SEQ ID NO: 7232257 - DNA, 22 bp, Homo sapiens
tgcaaggctgcctctgaggacc

SEQ ID NO: 7232258 - DNA, 22 bp, Homo sapiens
tgcaaggctgcctctgaggacc

SEQ ID NO: 7232259 - DNA, 20 bp, Homo sapiens
tgcaaggccagggtcaggag

SEQ ID NO: 7232260 - DNA, 22 bp, Homo sapiens
tgcaaggcccagacaagagctc

SEQ ID NO: 7232261 - DNA, 22 bp, Homo sapiens
tgcaaggctgcagagggtgcta

SEQ ID NO: 7232262 - DNA, 22 bp, Homo sapiens
tgcaaggctgcagagggtgcta

SEQ ID NO: 7232263 - DNA, 22 bp, Homo sapiens
tgcaaggggtttatgcagatga

SEQ ID NO: 7232264 - DNA, 22 bp, Homo sapiens
tgcaagggcttagggggctgtg

SEQ ID NO: 7232265 - DNA, 22 bp, Homo sapiens
tgcaagggcttagggggctgtg

SEQ ID NO: 7232266 - DNA, 22 bp, Homo sapiens
tgcaagggcttagggggctgtg

SEQ ID NO: 7232267 - DNA, 22 bp, Homo sapiens
tgcaagggtagaagtgatggca

SEQ ID NO: 7232268 - DNA, 22 bp, Homo sapiens
tgcaagggtagaagtgatggca

SEQ ID NO: 7232269 - DNA, 22 bp, Homo sapiens
tgcaagggtagaagtgatggca

SEQ ID NO: 7232270 - DNA, 22 bp, Homo sapiens
tgcaagggtgacaggttgctct

SEQ ID NO: 7232271 - DNA, 19 bp, Homo sapiens
tgcaagggtggtctcctgg

SEQ ID NO: 7232272 - DNA, 19 bp, Homo sapiens
tgcaagggtggtctcctgg

SEQ ID NO: 7232273 - DNA, 22 bp, Homo sapiens
tgcaagggtgtttgagctgccc

SEQ ID NO: 7232274 - DNA, 22 bp, Homo sapiens
tgcaagggtgtttgagctgccc

SEQ ID NO: 7232275 - DNA, 22 bp, Homo sapiens
tgcaagggtgtttgagctgccc

SEQ ID NO: 7232276 - DNA, 21 bp, Homo sapiens
tgcaatccagcctgggcgaca

SEQ ID NO: 7232277 - DNA, 21 bp, Homo sapiens
tgcaatccagcctgggcgaca

SEQ ID NO: 7232278 - DNA, 21 bp, Homo sapiens
tgcaatccagcctgggcgaca

SEQ ID NO: 7232279 - DNA, 22 bp, Homo sapiens
tgcaagaggttggattttaaga

SEQ ID NO: 7232280 - DNA, 23 bp, Homo sapiens
tgcaagagttccaaactgttcaa

SEQ ID NO: 7232281 - DNA, 22 bp, Homo sapiens
tgcaagaggcatcttttaaaaa

SEQ ID NO: 7232282 - DNA, 21 bp, Homo sapiens
tgcaagaatcaggaagctgcc

SEQ ID NO: 7232283 - DNA, 21 bp, Homo sapiens
tgcaagaatcaggaagctgcc

SEQ ID NO: 7232284 - DNA, 22 bp, Homo sapiens
tgcaagactcctcactttctct

SEQ ID NO: 7232285 - DNA, 22 bp, Homo sapiens
tgcaagagcagaaagaactgag

SEQ ID NO: 7232286 - DNA, 22 bp, Homo sapiens
tgcaaatttctttagtacataa

SEQ ID NO: 7232287 - DNA, 22 bp, Homo sapiens
tgcaaatttgacttcacacatc

SEQ ID NO: 7232288 - DNA, 22 bp, Homo sapiens
tgcaaatttgacttcacacatc

SEQ ID NO: 7232289 - DNA, 23 bp, Homo sapiens
tgcaacaatgaggaaagctactg

SEQ ID NO: 7232290 - DNA, 22 bp, Homo sapiens
tgcaacagactttattaactct

SEQ ID NO: 7232291 - DNA, 22 bp, Homo sapiens
tgcaacagactttattaactct

SEQ ID NO: 7232292 - DNA, 22 bp, Homo sapiens
tgcaacaggctgtgacatggaa

SEQ ID NO: 7232293 - DNA, 22 bp, Homo sapiens
tgcaacattattaaactaagca

SEQ ID NO: 7232294 - DNA, 22 bp, Homo sapiens
tgcaacattattaaactaagca

SEQ ID NO: 7232295 - DNA, 22 bp, Homo sapiens
tgcaacctgacccagccagccc

SEQ ID NO: 7232296 - DNA, 22 bp, Homo sapiens
tgcaacctgacccagccagccc

SEQ ID NO: 7232297 - DNA, 22 bp, Homo sapiens
tgcaactctggatcttctggta

SEQ ID NO: 7232298 - DNA, 22 bp, Homo sapiens
tgcaactggaagggttatgtgg

SEQ ID NO: 7232299 - DNA, 23 bp, Homo sapiens
tgcaactgtgtcagaagttagaa

SEQ ID NO: 7232300 - DNA, 22 bp, Homo sapiens
tgcaagaaacatattccacaag

SEQ ID NO: 7232301 - DNA, 22 bp, Homo sapiens
tgcaagaaacatattccacaag

SEQ ID NO: 7232302 - DNA, 22 bp, Homo sapiens
tgcaagaaaggtggggccaggc

SEQ ID NO: 7232303 - DNA, 22 bp, Homo sapiens
tgcaagaaatgtgaagctacaa

SEQ ID NO: 7232304 - DNA, 17 bp, Homo sapiens
tgcaagaagattaggaa

SEQ ID NO: 7232305 - DNA, 17 bp, Homo sapiens
tgcaagaagattaggaa

SEQ ID NO: 7232306 - DNA, 22 bp, Homo sapiens
tgcacacagtggacaagtcttg

SEQ ID NO: 7232307 - DNA, 22 bp, Homo sapiens
tgcacacaggtctaggacatgg

SEQ ID NO: 7232308 - DNA, 22 bp, Homo sapiens
tgcacacagctgggcctggctg

SEQ ID NO: 7232309 - DNA, 22 bp, Homo sapiens
tgcacacaggtctaggacatgg

SEQ ID NO: 7232310 - DNA, 22 bp, Homo sapiens
tgcacacaggtctaggacatgg

SEQ ID NO: 7232311 - DNA, 22 bp, Homo sapiens
tgcacacagccagtgagtggca

SEQ ID NO: 7232312 - DNA, 22 bp, Homo sapiens
tgcacacactctgcatatactt

SEQ ID NO: 7232313 - DNA, 22 bp, Homo sapiens
tgcacacactctgcatatactt

SEQ ID NO: 7232314 - DNA, 20 bp, Homo sapiens
tgcacacagaaatttgcatt

SEQ ID NO: 7232315 - DNA, 19 bp, Homo sapiens
tgcacacagataagtatct

SEQ ID NO: 7232316 - DNA, 22 bp, Homo sapiens
tgcacacacaggagtctcctcc

SEQ ID NO: 7232317 - DNA, 22 bp, Homo sapiens
tgcacacacacgtagagaaaag

SEQ ID NO: 7232318 - DNA, 22 bp, Homo sapiens
tgcacacacatgaagtagcatg

SEQ ID NO: 7232319 - DNA, 22 bp, Homo sapiens
tgcacacacatgaagtagcatg

SEQ ID NO: 7232320 - DNA, 22 bp, Homo sapiens
tgcacacacatgcagagggaga

SEQ ID NO: 7232321 - DNA, 22 bp, Homo sapiens
tgcacacaccgtgcttcactga

SEQ ID NO: 7232322 - DNA, 22 bp, Homo sapiens
tgcacacacgcggcacatctgt

SEQ ID NO: 7232323 - DNA, 22 bp, Homo sapiens
tgcacacacgcggcacatctgt

SEQ ID NO: 7232324 - DNA, 22 bp, Homo sapiens
tgcacacacggagataggcttt

SEQ ID NO: 7232325 - DNA, 22 bp, Homo sapiens
tgcaatctcggcactttgggag

SEQ ID NO: 7232326 - DNA, 22 bp, Homo sapiens
tgcaatgaattacttcccaaac

SEQ ID NO: 7232327 - DNA, 22 bp, Homo sapiens
tgcaatgagaatatattaacca

SEQ ID NO: 7232328 - DNA, 20 bp, Homo sapiens
tgcaatgtccatgttccagg

SEQ ID NO: 7232329 - DNA, 22 bp, Homo sapiens
tgcaattaatttacatgcttaa

SEQ ID NO: 7232330 - DNA, 22 bp, Homo sapiens
tgcaatttatgtgcaagtggtt

SEQ ID NO: 7232331 - DNA, 22 bp, Homo sapiens
tgcaatttcaggcatatattgt

SEQ ID NO: 7232332 - DNA, 22 bp, Homo sapiens
tgcaatttcaggcatatattgt

SEQ ID NO: 7232333 - DNA, 22 bp, Homo sapiens
tgcaatttcaggcatatattgt

SEQ ID NO: 7232334 - DNA, 22 bp, Homo sapiens
tgcaatttgacgtcagcacagt

SEQ ID NO: 7232335 - DNA, 22 bp, Homo sapiens
tgcaatttggggaagaaagaga

SEQ ID NO: 7232336 - DNA, 22 bp, Homo sapiens
tgcaatttttatcaattcagca

SEQ ID NO: 7232337 - DNA, 22 bp, Homo sapiens
tgcacaaacacagagaatagat

SEQ ID NO: 7232338 - DNA, 22 bp, Homo sapiens
tgcacaaacacagagaatagat

SEQ ID NO: 7232339 - DNA, 22 bp, Homo sapiens
tgcacaaacacagagaatagat

SEQ ID NO: 7232340 - DNA, 22 bp, Homo sapiens
tgcacaaacttgtgtcccaggg

SEQ ID NO: 7232341 - DNA, 21 bp, Homo sapiens
tgcacaaactttctgtggctt

SEQ ID NO: 7232342 - DNA, 22 bp, Homo sapiens
tgcacaaagcattctagacgca

SEQ ID NO: 7232343 - DNA, 22 bp, Homo sapiens
tgcacaaaggctccctgctgag

SEQ ID NO: 7232344 - DNA, 22 bp, Homo sapiens
tgcacaaatttgtgtatgctca

SEQ ID NO: 7232345 - DNA, 22 bp, Homo sapiens
tgcacaaatttgtgtatgctca

SEQ ID NO: 7232346 - DNA, 22 bp, Homo sapiens
tgcacaaatttgtgtatgctca

SEQ ID NO: 7232347 - DNA, 17 bp, Homo sapiens
tgcacaagagacaatag

SEQ ID NO: 7232348 - DNA, 22 bp, Homo sapiens
tgcacaagtcagagtaacattt

SEQ ID NO: 7232349 - DNA, 22 bp, Homo sapiens
tgcacaagtcagagtaacattt

SEQ ID NO: 7232350 - DNA, 22 bp, Homo sapiens
tgcacacaagttggagaatgaa

SEQ ID NO: 7232351 - DNA, 22 bp, Homo sapiens
tgatttaggaaacagctacagg

SEQ ID NO: 7232352 - DNA, 22 bp, Homo sapiens
tgatttacttctggataaatcc

SEQ ID NO: 7232353 - DNA, 17 bp, Homo sapiens
tgatttagtaagctgcc

SEQ ID NO: 7232354 - DNA, 22 bp, Homo sapiens
tgatttatgaccaagttagaat

SEQ ID NO: 7232355 - DNA, 22 bp, Homo sapiens
tgatttatgcattatactgttg

SEQ ID NO: 7232356 - DNA, 22 bp, Homo sapiens
tgatttatgcattatactgttg

SEQ ID NO: 7232357 - DNA, 22 bp, Homo sapiens
tgatttaaaagaaacattgtct

SEQ ID NO: 7232358 - DNA, 22 bp, Homo sapiens
tgatttacaattgtaaaagttt

SEQ ID NO: 7232359 - DNA, 22 bp, Homo sapiens
tgatttacaattgtaaaagttt

SEQ ID NO: 7232360 - DNA, 22 bp, Homo sapiens
tgatttacacatcaaagcagca

SEQ ID NO: 7232361 - DNA, 22 bp, Homo sapiens
tgatttacagtagtgtctaaac

SEQ ID NO: 7232362 - DNA, 22 bp, Homo sapiens
tgatttccctcatcataacaga

SEQ ID NO: 7232363 - DNA, 21 bp, Homo sapiens
tgatttccagaaaattggccc

SEQ ID NO: 7232364 - DNA, 21 bp, Homo sapiens
tgatttccatcttaaaataaa

SEQ ID NO: 7232365 - DNA, 22 bp, Homo sapiens
tgatttatgcattatactgttg

SEQ ID NO: 7232366 - DNA, 21 bp, Homo sapiens
tgatttatgcccaagtccctg

SEQ ID NO: 7232367 - DNA, 22 bp, Homo sapiens
tgatttcaagtagtgacatgct

SEQ ID NO: 7232368 - DNA, 22 bp, Homo sapiens
tgatttccaaaaggcttctaag

SEQ ID NO: 7232369 - DNA, 22 bp, Homo sapiens
tgcaaaatgacttctgaaaaga

SEQ ID NO: 7232370 - DNA, 22 bp, Homo sapiens
tgcaaaataatgaacgattttt

SEQ ID NO: 7232371 - DNA, 22 bp, Homo sapiens
tgcaaaaattgctggaatcttt

SEQ ID NO: 7232372 - DNA, 22 bp, Homo sapiens
tgcaaaagaatatagatattgt

SEQ ID NO: 7232373 - DNA, 22 bp, Homo sapiens
tgcaaaaactgcaattgctttt

SEQ ID NO: 7232374 - DNA, 22 bp, Homo sapiens
tgcaaaaactgcaattgctttt

SEQ ID NO: 7232375 - DNA, 22 bp, Homo sapiens
tgcaaaaagagcgaggagccct

SEQ ID NO: 7232376 - DNA, 22 bp, Homo sapiens
tgcaaaaaggcagactggtgat

SEQ ID NO: 7232377 - DNA, 22 bp, Homo sapiens
tgatttttaaaattctccttgc

SEQ ID NO: 7232378 - DNA, 22 bp, Homo sapiens
tgatttttaaaattctccttgc

SEQ ID NO: 7232379 - DNA, 22 bp, Homo sapiens
tgatttttaaaattctccttgc

SEQ ID NO: 7232380 - DNA, 22 bp, Homo sapiens
tgatttttagctattctgaaga

SEQ ID NO: 7232381 - DNA, 22 bp, Homo sapiens
tgatttttagctattctgaaga

SEQ ID NO: 7232382 - DNA, 22 bp, Homo sapiens
tgcaaaaacagccttgaggcct

SEQ ID NO: 7232383 - DNA, 22 bp, Homo sapiens
tgattttattggtgaggaaatt

SEQ ID NO: 7232384 - DNA, 22 bp, Homo sapiens
tgatttcctctactagcaatta

SEQ ID NO: 7232385 - DNA, 22 bp, Homo sapiens
tgattttgtcatgtttctgata

SEQ ID NO: 7232386 - DNA, 22 bp, Homo sapiens
tgcaaagaagcctttgccttct

SEQ ID NO: 7232387 - DNA, 22 bp, Homo sapiens
tgcaaagaagcaacatccttgt

SEQ ID NO: 7232388 - DNA, 22 bp, Homo sapiens
tgcaaagaagccacagtcccag

SEQ ID NO: 7232389 - DNA, 22 bp, Homo sapiens
tgcaaagaagcctttgccttct

SEQ ID NO: 7232390 - DNA, 22 bp, Homo sapiens
tgcaaagaagggctgaggagca

SEQ ID NO: 7232391 - DNA, 22 bp, Homo sapiens
tgcaaagaagggctgaggagca

SEQ ID NO: 7232392 - DNA, 22 bp, Homo sapiens
tgcaaagaaggggaggaggatt

SEQ ID NO: 7232393 - DNA, 22 bp, Homo sapiens
tgcaaagaaggggaggaggatt

SEQ ID NO: 7232394 - DNA, 22 bp, Homo sapiens
tgcaaagatatgagaagctgta

SEQ ID NO: 7232395 - DNA, 22 bp, Homo sapiens
tgcaaagatatgagaagctgta

SEQ ID NO: 7232396 - DNA, 22 bp, Homo sapiens
tgcaaagatatgagaagctgta

SEQ ID NO: 7232397 - DNA, 22 bp, Homo sapiens
tgcaaagatgaaatattaaagg

SEQ ID NO: 7232398 - DNA, 22 bp, Homo sapiens
tgcaaagatgaaatattaaagg

SEQ ID NO: 7232399 - DNA, 23 bp, Homo sapiens
tgcaaagatttaatgcaggggca

SEQ ID NO: 7232400 - DNA, 22 bp, Homo sapiens
tgcaaagatttatctttctcca

SEQ ID NO: 7232401 - DNA, 22 bp, Homo sapiens
tgcaaatcatcctggattagag

SEQ ID NO: 7232402 - DNA, 22 bp, Homo sapiens
tgcaaatcctgtttggagtaag

SEQ ID NO: 7232403 - DNA, 22 bp, Homo sapiens
tgcaaatgagttgcagatcagg

SEQ ID NO: 7232404 - DNA, 22 bp, Homo sapiens
tgcaaatgcccatttattttct

SEQ ID NO: 7232405 - DNA, 19 bp, Homo sapiens
tgcaaatgctgttgagaat

SEQ ID NO: 7232406 - DNA, 22 bp, Homo sapiens
tgcaaatttatatggtgactgc

SEQ ID NO: 7232407 - DNA, 22 bp, Homo sapiens
tgcaaattgcatgatgtgtatc

SEQ ID NO: 7232408 - DNA, 22 bp, Homo sapiens
tgcaaattgcgatttttattag

SEQ ID NO: 7232409 - DNA, 23 bp, Homo sapiens
tgcaaattaggccgggactcagc

SEQ ID NO: 7232410 - DNA, 22 bp, Homo sapiens
tgcaaattcaaacattttcctg

SEQ ID NO: 7232411 - DNA, 19 bp, Homo sapiens
tgcaaattctaaaaactga

SEQ ID NO: 7232412 - DNA, 22 bp, Homo sapiens
tgcaaatgggcatctccaagtg

SEQ ID NO: 7232413 - DNA, 22 bp, Homo sapiens
tgcaaatgggtgagggttagga

SEQ ID NO: 7232414 - DNA, 19 bp, Homo sapiens
tgcaaatgtaggaagaata

SEQ ID NO: 7232415 - DNA, 19 bp, Homo sapiens
tgcaaatgtaggaagaata

SEQ ID NO: 7232416 - DNA, 22 bp, Homo sapiens
tgcaaatgtcaagggttagtgt

SEQ ID NO: 7232417 - DNA, 22 bp, Homo sapiens
tgcaaatgtgtaggtttacata

SEQ ID NO: 7232418 - DNA, 22 bp, Homo sapiens
tgcaaatgtgtaggtttacata

SEQ ID NO: 7232419 - DNA, 22 bp, Homo sapiens
tgcaaatgtgtggtgaggcatt

SEQ ID NO: 7232420 - DNA, 22 bp, Homo sapiens
tgcaaatgtgttttaaaccaaa

SEQ ID NO: 7232421 - DNA, 22 bp, Homo sapiens
tgcaaagaaaacactgcaagac

SEQ ID NO: 7232422 - DNA, 22 bp, Homo sapiens
tgcaaagaaaacactgcaagac

SEQ ID NO: 7232423 - DNA, 22 bp, Homo sapiens
tgcaaactattggtagagatgg

SEQ ID NO: 7232424 - DNA, 22 bp, Homo sapiens
tgcaaactattggtagagatgg

SEQ ID NO: 7232425 - DNA, 22 bp, Homo sapiens
tgcaaagaaaacactgcaagac

SEQ ID NO: 7232426 - DNA, 23 bp, Homo sapiens
tgcaaagaaatctgggtcattgt

SEQ ID NO: 7232427 - DNA, 22 bp, Homo sapiens
tgcaaagaactaagcagcctta

SEQ ID NO: 7232428 - DNA, 22 bp, Homo sapiens
tgcaaacatccgactgaaagcc

SEQ ID NO: 7232429 - DNA, 22 bp, Homo sapiens
tgcaaactagcatcaactagta

SEQ ID NO: 7232430 - DNA, 22 bp, Homo sapiens
tgcaaactattggtagagatgg

SEQ ID NO: 7232431 - DNA, 22 bp, Homo sapiens
tgcaaacaggagagtaagtata

SEQ ID NO: 7232432 - DNA, 22 bp, Homo sapiens
tgcaaacaggagagtaagtata

SEQ ID NO: 7232433 - DNA, 22 bp, Homo sapiens
tgcaaacaggcatttcacaaac

SEQ ID NO: 7232434 - DNA, 22 bp, Homo sapiens
tgcaaacagttaagatgcaggc

SEQ ID NO: 7232435 - DNA, 22 bp, Homo sapiens
tgcaaacagttaagatgcaggc

SEQ ID NO: 7232436 - DNA, 22 bp, Homo sapiens
tgcaaacacttcaacgtgcatc

SEQ ID NO: 7232437 - DNA, 22 bp, Homo sapiens
tgcaaacaccacagagacaatt

SEQ ID NO: 7232438 - DNA, 20 bp, Homo sapiens
tgcaaacacagagtgtatga

SEQ ID NO: 7232439 - DNA, 20 bp, Homo sapiens
tgcaaacacagagtgtatga

SEQ ID NO: 7232440 - DNA, 22 bp, Homo sapiens
tgcaaacaatttcctataaagt

SEQ ID NO: 7232441 - DNA, 20 bp, Homo sapiens
tgcaaacacagagtgtatga

SEQ ID NO: 7232442 - DNA, 20 bp, Homo sapiens
tgcaaacacagagtgtatga

SEQ ID NO: 7232443 - DNA, 22 bp, Homo sapiens
tgcaaacaccacagagacaatt

SEQ ID NO: 7232444 - DNA, 22 bp, Homo sapiens
tgcaaacaactgtttaatgctg

SEQ ID NO: 7232445 - DNA, 17 bp, Homo sapiens
tgcaaacaatcacatat

SEQ ID NO: 7232446 - DNA, 17 bp, Homo sapiens
tgcaaacaatcacatat

SEQ ID NO: 7232447 - DNA, 17 bp, Homo sapiens
tgcaaacaatcacatat

SEQ ID NO: 7232448 - DNA, 23 bp, Homo sapiens
tgcaaaatttgcagagttcgatg

SEQ ID NO: 7232449 - DNA, 17 bp, Homo sapiens
tgcaaacaatcacatat

SEQ ID NO: 7232450 - DNA, 22 bp, Homo sapiens
tgcaaacaatttcctataaagt

SEQ ID NO: 7232451 - DNA, 22 bp, Homo sapiens
tgcaaacaatttcctataaagt

SEQ ID NO: 7232452 - DNA, 22 bp, Homo sapiens
tgagtgggacctgcgtgtgtca

SEQ ID NO: 7232453 - DNA, 22 bp, Homo sapiens
tgagtgggacctgcgtgtgtca

SEQ ID NO: 7232454 - DNA, 22 bp, Homo sapiens
tgagtgggattaaatgaggtga

SEQ ID NO: 7232455 - DNA, 22 bp, Homo sapiens
tgagtgggattaaatgaggtga

SEQ ID NO: 7232456 - DNA, 22 bp, Homo sapiens
tgagtgggatgagttagaggtg

SEQ ID NO: 7232457 - DNA, 22 bp, Homo sapiens
tgagtgggatgagttagaggtg

SEQ ID NO: 7232458 - DNA, 19 bp, Homo sapiens
tgagtgggagcccaggtat

SEQ ID NO: 7232459 - DNA, 19 bp, Homo sapiens
tgagtgggagcccaggtat

SEQ ID NO: 7232460 - DNA, 19 bp, Homo sapiens
tgagtgggagcccaggtat

SEQ ID NO: 7232461 - DNA, 16 bp, Homo sapiens
tgagtgggagaagggg

SEQ ID NO: 7232462 - DNA, 16 bp, Homo sapiens
tgagtgggagaagggg

SEQ ID NO: 7232463 - DNA, 22 bp, Homo sapiens
tgagtggacgtgaggctgagta

SEQ ID NO: 7232464 - DNA, 22 bp, Homo sapiens
tgagtggacacctgcttcttta

SEQ ID NO: 7232465 - DNA, 22 bp, Homo sapiens
tgagtggagaacagaggctctc

SEQ ID NO: 7232466 - DNA, 22 bp, Homo sapiens
tgagtggagaacagaggctctc

SEQ ID NO: 7232467 - DNA, 22 bp, Homo sapiens
tgagtgctcccagggccttcgc

SEQ ID NO: 7232468 - DNA, 22 bp, Homo sapiens
tgagtgctgcattagcagatat

SEQ ID NO: 7232469 - DNA, 22 bp, Homo sapiens
tgagtgctggctaaatagaaaa

SEQ ID NO: 7232470 - DNA, 22 bp, Homo sapiens
tgagtgctgtctgtctagcctc

SEQ ID NO: 7232471 - DNA, 20 bp, Homo sapiens
tgagtgctccattctgccca

SEQ ID NO: 7232472 - DNA, 22 bp, Homo sapiens
tgagtggacacctgcttcttta

SEQ ID NO: 7232473 - DNA, 22 bp, Homo sapiens
tgagtggacacctgcttcttta

SEQ ID NO: 7232474 - DNA, 22 bp, Homo sapiens
tgagtggacacctgcttcttta

SEQ ID NO: 7232475 - DNA, 22 bp, Homo sapiens
tgagtgagctggggagccggtg

SEQ ID NO: 7232476 - DNA, 22 bp, Homo sapiens
tgagtgagacaccaaaggctgt

SEQ ID NO: 7232477 - DNA, 22 bp, Homo sapiens
tgagtgaggtgcttagggcaca

SEQ ID NO: 7232478 - DNA, 19 bp, Homo sapiens
tgagtgaaggccgtggtgg

SEQ ID NO: 7232479 - DNA, 22 bp, Homo sapiens
tgagtgagttttcacggtcagc

SEQ ID NO: 7232480 - DNA, 20 bp, Homo sapiens
tgagtgagtttgtggcagga

SEQ ID NO: 7232481 - DNA, 22 bp, Homo sapiens
tgagtgaggctgggcagtccct

SEQ ID NO: 7232482 - DNA, 22 bp, Homo sapiens
tgagtgaggtgcttagggcaca

SEQ ID NO: 7232483 - DNA, 20 bp, Homo sapiens
tgagtgagtttgtggcagga

SEQ ID NO: 7232484 - DNA, 22 bp, Homo sapiens
tgagttattgagaaataactgc

SEQ ID NO: 7232485 - DNA, 22 bp, Homo sapiens
tgagttatggagaataaagtca

SEQ ID NO: 7232486 - DNA, 22 bp, Homo sapiens
tgagttatctaaaatagtcaaa

SEQ ID NO: 7232487 - DNA, 22 bp, Homo sapiens
tgagttataatgaatatttgaa

SEQ ID NO: 7232488 - DNA, 22 bp, Homo sapiens
tgagttatatatactggctctg

SEQ ID NO: 7232489 - DNA, 22 bp, Homo sapiens
tgagttaaatgagaacatgaaa

SEQ ID NO: 7232490 - DNA, 22 bp, Homo sapiens
tgagttaagcaggtagcaagct

SEQ ID NO: 7232491 - DNA, 21 bp, Homo sapiens
tgagttaaggatccaattctg

SEQ ID NO: 7232492 - DNA, 22 bp, Homo sapiens
tgagttaatctctacgatagaa

SEQ ID NO: 7232493 - DNA, 23 bp, Homo sapiens
tgagtgtgttccctgtgagattt

SEQ ID NO: 7232494 - DNA, 23 bp, Homo sapiens
tgagtgtgttccctgtgagattt

SEQ ID NO: 7232495 - DNA, 23 bp, Homo sapiens
tgagtgtgttccctgtgagattt

SEQ ID NO: 7232496 - DNA, 23 bp, Homo sapiens
tgagtgtgttccctgtgagattt

SEQ ID NO: 7232497 - DNA, 21 bp, Homo sapiens
tgagttaaaatggagagtctt

SEQ ID NO: 7232498 - DNA, 21 bp, Homo sapiens
tgagttaaaatgtcagtgcca

SEQ ID NO: 7232499 - DNA, 22 bp, Homo sapiens
tgagttaaatgagaacatgaaa

SEQ ID NO: 7232500 - DNA, 22 bp, Homo sapiens
tgagtgtggggaatgtcatgag

SEQ ID NO: 7232501 - DNA, 22 bp, Homo sapiens
tgagtgtggggaatgtcatgag

SEQ ID NO: 7232502 - DNA, 22 bp, Homo sapiens
tgagtgtggggaatgtcatgag

SEQ ID NO: 7232503 - DNA, 22 bp, Homo sapiens
tgagtgtggggaatgtcatgag

SEQ ID NO: 7232504 - DNA, 22 bp, Homo sapiens
tgagtgtgctaggtgtctcggt

SEQ ID NO: 7232505 - DNA, 22 bp, Homo sapiens
tgagtgtgctaggtgtctcggt

SEQ ID NO: 7232506 - DNA, 22 bp, Homo sapiens
tgagtgtgctaggtgtctcggt

SEQ ID NO: 7232507 - DNA, 22 bp, Homo sapiens
tgagtgtgctaggtgtctcggt

SEQ ID NO: 7232508 - DNA, 22 bp, Homo sapiens
tgagtgtgaggtgggagcttgg

SEQ ID NO: 7232509 - DNA, 22 bp, Homo sapiens
tgagtgtggggaatgtcatgag

SEQ ID NO: 7232510 - DNA, 23 bp, Homo sapiens
tgagtgtggggacagtggtttgc

SEQ ID NO: 7232511 - DNA, 23 bp, Homo sapiens
tgagtgtggggacagtggtttgc

SEQ ID NO: 7232512 - DNA, 23 bp, Homo sapiens
tgagtgtggggacagtggtttgc

SEQ ID NO: 7232513 - DNA, 22 bp, Homo sapiens
tgagtgtgtattatgtatcagg

SEQ ID NO: 7232514 - DNA, 22 bp, Homo sapiens
tgagtgtgtattatgtatcagg

SEQ ID NO: 7232515 - DNA, 22 bp, Homo sapiens
tgagtgtgtattatgtatcagg

SEQ ID NO: 7232516 - DNA, 19 bp, Homo sapiens
tgagtgtgtgtttctctaa

SEQ ID NO: 7232517 - DNA, 22 bp, Homo sapiens
tgagtgggattaaatgaggtga

SEQ ID NO: 7232518 - DNA, 22 bp, Homo sapiens
tgagtgggattaaatgaggtga

SEQ ID NO: 7232519 - DNA, 22 bp, Homo sapiens
tgagtgggattaaatgaggtga

SEQ ID NO: 7232520 - DNA, 19 bp, Homo sapiens
tgagtgggcccctgcagac

SEQ ID NO: 7232521 - DNA, 19 bp, Homo sapiens
tgagtgggcccctgcagac

SEQ ID NO: 7232522 - DNA, 19 bp, Homo sapiens
tgagtgggcccctgcagac

SEQ ID NO: 7232523 - DNA, 22 bp, Homo sapiens
tgagtgggttatcaggaaaggt

SEQ ID NO: 7232524 - DNA, 22 bp, Homo sapiens
tgagtgtatatgaaggttgtaa

SEQ ID NO: 7232525 - DNA, 19 bp, Homo sapiens
tgagtgtcacgtcagtgcc

SEQ ID NO: 7232526 - DNA, 23 bp, Homo sapiens
tgagtgtgaaaatcctggagatg

SEQ ID NO: 7232527 - DNA, 22 bp, Homo sapiens
tgatcccatgggatggcatcag

SEQ ID NO: 7232528 - DNA, 22 bp, Homo sapiens
tgatccctcacttctctttggg

SEQ ID NO: 7232529 - DNA, 22 bp, Homo sapiens
tgatccctgattgccttgactc

SEQ ID NO: 7232530 - DNA, 20 bp, Homo sapiens
tgatccctggcggcctttcc

SEQ ID NO: 7232531 - DNA, 22 bp, Homo sapiens
tgatcccttctccttcccttgg

SEQ ID NO: 7232532 - DNA, 22 bp, Homo sapiens
tgatctaggttggcttcaactg

SEQ ID NO: 7232533 - DNA, 22 bp, Homo sapiens
tgatctaggttggcttcaactg

SEQ ID NO: 7232534 - DNA, 22 bp, Homo sapiens
tgatctaggttggcttcaactg

SEQ ID NO: 7232535 - DNA, 22 bp, Homo sapiens
tgatctttcctcttgtttgtct

SEQ ID NO: 7232536 - DNA, 18 bp, Homo sapiens
tgatctttcatgattcca

SEQ ID NO: 7232537 - DNA, 22 bp, Homo sapiens
tgatctttactgctgtttataa

SEQ ID NO: 7232538 - DNA, 22 bp, Homo sapiens
tgatcttcaccttgttctttgg

SEQ ID NO: 7232539 - DNA, 22 bp, Homo sapiens
tgatcttcaccttgttctttgg

SEQ ID NO: 7232540 - DNA, 22 bp, Homo sapiens
tgatctttactgctgtttataa

SEQ ID NO: 7232541 - DNA, 22 bp, Homo sapiens
tgatctgagagcagatcaccat

SEQ ID NO: 7232542 - DNA, 22 bp, Homo sapiens
tgatctggtcctactgtgggca

SEQ ID NO: 7232543 - DNA, 22 bp, Homo sapiens
tgatcaaaacattactccacca

SEQ ID NO: 7232544 - DNA, 22 bp, Homo sapiens
tgatcaaaacattactccacca

SEQ ID NO: 7232545 - DNA, 22 bp, Homo sapiens
tgatcaaagccaaagttgagat

SEQ ID NO: 7232546 - DNA, 22 bp, Homo sapiens
tgatcacaagtctgaagaatga

SEQ ID NO: 7232547 - DNA, 22 bp, Homo sapiens
tgatcacaagtctgaagaatga

SEQ ID NO: 7232548 - DNA, 22 bp, Homo sapiens
tgatcaaattcaggagtctgga

SEQ ID NO: 7232549 - DNA, 22 bp, Homo sapiens
tgatattttatgagctttcata

SEQ ID NO: 7232550 - DNA, 22 bp, Homo sapiens
tgatatttttcactggcctctg

SEQ ID NO: 7232551 - DNA, 22 bp, Homo sapiens
tgatcaaaacattactccacca

SEQ ID NO: 7232552 - DNA, 21 bp, Homo sapiens
tgatcatttgtgtaaaggaga

SEQ ID NO: 7232553 - DNA, 22 bp, Homo sapiens
tgatcattatcaaactggtcat

SEQ ID NO: 7232554 - DNA, 21 bp, Homo sapiens
tgatcatttgtgtaaaggaga

SEQ ID NO: 7232555 - DNA, 22 bp, Homo sapiens
tgatcagtaaccaatcacatca

SEQ ID NO: 7232556 - DNA, 22 bp, Homo sapiens
tgatcagtcccatgatcttcca

SEQ ID NO: 7232557 - DNA, 21 bp, Homo sapiens
tgatcacatgaaaaccatgca

SEQ ID NO: 7232558 - DNA, 22 bp, Homo sapiens
tgatcagacagttatgtgcatg

SEQ ID NO: 7232559 - DNA, 22 bp, Homo sapiens
tgatcagcatcttcccagctcg

SEQ ID NO: 7232560 - DNA, 22 bp, Homo sapiens
tgatcagcatcttcccagctcg

SEQ ID NO: 7232561 - DNA, 22 bp, Homo sapiens
tgatatgtaactactccttata

SEQ ID NO: 7232562 - DNA, 22 bp, Homo sapiens
tgatatgtccctcgacatcagg

SEQ ID NO: 7232563 - DNA, 22 bp, Homo sapiens
tgatatgggaaaagggctcgga

SEQ ID NO: 7232564 - DNA, 22 bp, Homo sapiens
tgatatgggaaaagggctcgga

SEQ ID NO: 7232565 - DNA, 20 bp, Homo sapiens
tgatatggtttggctgtgtt

SEQ ID NO: 7232566 - DNA, 22 bp, Homo sapiens
tgatatcagctggcagcagtgg

SEQ ID NO: 7232567 - DNA, 22 bp, Homo sapiens
tgatatcagctggcagcagtgg

SEQ ID NO: 7232568 - DNA, 22 bp, Homo sapiens
tgatatcagctggcagcagtgg

SEQ ID NO: 7232569 - DNA, 22 bp, Homo sapiens
tgatatgcatgtaagggagaca

SEQ ID NO: 7232570 - DNA, 22 bp, Homo sapiens
tgatatgcatgtaagggagaca

SEQ ID NO: 7232571 - DNA, 22 bp, Homo sapiens
tgatatgtgaagctattagttc

SEQ ID NO: 7232572 - DNA, 22 bp, Homo sapiens
tgatatgtgaagctattagttc

SEQ ID NO: 7232573 - DNA, 22 bp, Homo sapiens
tgatatgtgaagctattagttc

SEQ ID NO: 7232574 - DNA, 22 bp, Homo sapiens
tgatatgttggatctgttggtt

SEQ ID NO: 7232575 - DNA, 22 bp, Homo sapiens
tgatatttaagcaaaaatatgg

SEQ ID NO: 7232576 - DNA, 22 bp, Homo sapiens
tgatatttaagcaaaaatatgg

SEQ ID NO: 7232577 - DNA, 22 bp, Homo sapiens
tgatatttgctgactgcattgt

SEQ ID NO: 7232578 - DNA, 22 bp, Homo sapiens
tgatattttatgagctttcata

SEQ ID NO: 7232579 - DNA, 22 bp, Homo sapiens
tgatattttatgagctttcata

SEQ ID NO: 7232580 - DNA, 22 bp, Homo sapiens
tgatatttgctgactgcattgt

SEQ ID NO: 7232581 - DNA, 22 bp, Homo sapiens
tgatatttgctgactgcattgt

SEQ ID NO: 7232582 - DNA, 22 bp, Homo sapiens
tgatatttaagcaaaaatatgg

SEQ ID NO: 7232583 - DNA, 20 bp, Homo sapiens
tgatatttctggaagtggag

SEQ ID NO: 7232584 - DNA, 23 bp, Homo sapiens
tgagttctaggcttaaaactagc

SEQ ID NO: 7232585 - DNA, 23 bp, Homo sapiens
tgagttctaggcttaaaactagc

SEQ ID NO: 7232586 - DNA, 22 bp, Homo sapiens
tgagttctagtggctgcagatt

SEQ ID NO: 7232587 - DNA, 22 bp, Homo sapiens
tgagttctccaggaagcagact

SEQ ID NO: 7232588 - DNA, 22 bp, Homo sapiens
tgagttctccaggaagcagact

SEQ ID NO: 7232589 - DNA, 22 bp, Homo sapiens
tgatactagcagtattttttac

SEQ ID NO: 7232590 - DNA, 22 bp, Homo sapiens
tgatactttggagacttgagta

SEQ ID NO: 7232591 - DNA, 22 bp, Homo sapiens
tgatacttttcttttagactaa

SEQ ID NO: 7232592 - DNA, 22 bp, Homo sapiens
tgatacttttcttttagactaa

SEQ ID NO: 7232593 - DNA, 22 bp, Homo sapiens
tgatagaaaatgctgtcaagct

SEQ ID NO: 7232594 - DNA, 22 bp, Homo sapiens
tgatagaaaatgctgtcaagct

SEQ ID NO: 7232595 - DNA, 22 bp, Homo sapiens
tgatagaaaggaaattaattgg

SEQ ID NO: 7232596 - DNA, 22 bp, Homo sapiens
tgatagaaaggaaattaattgg

SEQ ID NO: 7232597 - DNA, 22 bp, Homo sapiens
tgatagaagcagaagcatacca

SEQ ID NO: 7232598 - DNA, 22 bp, Homo sapiens
tgatagaatcagataaaaggat

SEQ ID NO: 7232599 - DNA, 22 bp, Homo sapiens
tgatagagcactaagtagtgta

SEQ ID NO: 7232600 - DNA, 22 bp, Homo sapiens
tgatagagcactaagtagtgta

SEQ ID NO: 7232601 - DNA, 17 bp, Homo sapiens
tgatagttcattttaag

SEQ ID NO: 7232602 - DNA, 19 bp, Homo sapiens
tgatgccctgacctgagcc

SEQ ID NO: 7232603 - DNA, 22 bp, Homo sapiens
tgatgcccccaaatctggctca

SEQ ID NO: 7232604 - DNA, 22 bp, Homo sapiens
tgatgcagaatcctagagtgtc

SEQ ID NO: 7232605 - DNA, 22 bp, Homo sapiens
tgatgcaatgtttacatcttga

SEQ ID NO: 7232606 - DNA, 23 bp, Homo sapiens
tgatgcagtaaattggtctctaa

SEQ ID NO: 7232607 - DNA, 22 bp, Homo sapiens
tgatgcagtgtcctcccatgca

SEQ ID NO: 7232608 - DNA, 22 bp, Homo sapiens
tgatgcatcattttcataaatt

SEQ ID NO: 7232609 - DNA, 22 bp, Homo sapiens
tgatgatttcatttctagctgt

SEQ ID NO: 7232610 - DNA, 22 bp, Homo sapiens
tgatgatttgaaaccagtttct

SEQ ID NO: 7232611 - DNA, 18 bp, Homo sapiens
tgatgcaagagtgagcta

SEQ ID NO: 7232612 - DNA, 22 bp, Homo sapiens
tgatgcaatagagagatagata

SEQ ID NO: 7232613 - DNA, 22 bp, Homo sapiens
tgatgcacaaagtcagcatcct

SEQ ID NO: 7232614 - DNA, 22 bp, Homo sapiens
tgatgcctaatatacttcaatt

SEQ ID NO: 7232615 - DNA, 22 bp, Homo sapiens
tgatgctctcctaatatgaaaa

SEQ ID NO: 7232616 - DNA, 22 bp, Homo sapiens
tgatgctgagcctgggactgac

SEQ ID NO: 7232617 - DNA, 23 bp, Homo sapiens
tgatgctgctttcttgaagtatg

SEQ ID NO: 7232618 - DNA, 20 bp, Homo sapiens
tgatgctggtctgaattgca

SEQ ID NO: 7232619 - DNA, 18 bp, Homo sapiens
tgatctttgagtataatg

SEQ ID NO: 7232620 - DNA, 22 bp, Homo sapiens
tgatctttggtaatctggcaca

SEQ ID NO: 7232621 - DNA, 22 bp, Homo sapiens
tgatcttttctatttatggtag

SEQ ID NO: 7232622 - DNA, 22 bp, Homo sapiens
tgatgaaaaccagaactctcat

SEQ ID NO: 7232623 - DNA, 22 bp, Homo sapiens
tgatgaaaatatgattctgagg

SEQ ID NO: 7232624 - DNA, 22 bp, Homo sapiens
tgatgaaaatgttcagcaatta

SEQ ID NO: 7232625 - DNA, 22 bp, Homo sapiens
tgatgaatgtcatacataatga

SEQ ID NO: 7232626 - DNA, 22 bp, Homo sapiens
tgatgaataaccttgagcatat

SEQ ID NO: 7232627 - DNA, 22 bp, Homo sapiens
tgatgaatgtcatacataatga

SEQ ID NO: 7232628 - DNA, 22 bp, Homo sapiens
tgatgaatgtcatacataatga

SEQ ID NO: 7232629 - DNA, 22 bp, Homo sapiens
tgatgaaagttcagtagtgaat

SEQ ID NO: 7232630 - DNA, 22 bp, Homo sapiens
tgatgaaaatgttcagcaatta

SEQ ID NO: 7232631 - DNA, 22 bp, Homo sapiens
tgatgaaagtgtttactcacct

SEQ ID NO: 7232632 - DNA, 20 bp, Homo sapiens
tgatggtattaggaggtgtg

SEQ ID NO: 7232633 - DNA, 20 bp, Homo sapiens
tgatggtattaggaggtgtg

SEQ ID NO: 7232634 - DNA, 22 bp, Homo sapiens
tgatggtatgggattaccatgt

SEQ ID NO: 7232635 - DNA, 22 bp, Homo sapiens
tgatggtattaggaggtgaggc

SEQ ID NO: 7232636 - DNA, 22 bp, Homo sapiens
tgatgggaggtgctgcaggacc

SEQ ID NO: 7232637 - DNA, 22 bp, Homo sapiens
tgatggtaaacaaagacattta

SEQ ID NO: 7232638 - DNA, 22 bp, Homo sapiens
tgatggtaaatccatatacctt

SEQ ID NO: 7232639 - DNA, 22 bp, Homo sapiens
tgatggtagggatactacagga

SEQ ID NO: 7232640 - DNA, 22 bp, Homo sapiens
tgatggtagtttatcaaaaaga

SEQ ID NO: 7232641 - DNA, 22 bp, Homo sapiens
tgatgggactgccagctgctga

SEQ ID NO: 7232642 - DNA, 22 bp, Homo sapiens
tgatgggaaaatgaggcctggg

SEQ ID NO: 7232643 - DNA, 22 bp, Homo sapiens
tgatgggaaaatgaggcctggg

SEQ ID NO: 7232644 - DNA, 23 bp, Homo sapiens
tgatgggaaggaacgactaccac

SEQ ID NO: 7232645 - DNA, 18 bp, Homo sapiens
tgatggaggagggctggt

SEQ ID NO: 7232646 - DNA, 18 bp, Homo sapiens
tgatggaggagggctggt

SEQ ID NO: 7232647 - DNA, 22 bp, Homo sapiens
tgatggccagtcgcactggagg

SEQ ID NO: 7232648 - DNA, 22 bp, Homo sapiens
tgatggccctgtacaaggagtg

SEQ ID NO: 7232649 - DNA, 22 bp, Homo sapiens
tgatggcctttttcaccaggct

SEQ ID NO: 7232650 - DNA, 19 bp, Homo sapiens
tgatggaatttgacattcc

SEQ ID NO: 7232651 - DNA, 22 bp, Homo sapiens
tgatggagcatgtgtgcttcct

SEQ ID NO: 7232652 - DNA, 22 bp, Homo sapiens
tgatggagcatgtgtgcttcct

SEQ ID NO: 7232653 - DNA, 22 bp, Homo sapiens
tgatggaatggaggacatgtgg

SEQ ID NO: 7232654 - DNA, 22 bp, Homo sapiens
tgatggaagtgactgtcagttc

SEQ ID NO: 7232655 - DNA, 22 bp, Homo sapiens
tgatggaatataccttcgggag

SEQ ID NO: 7232656 - DNA, 22 bp, Homo sapiens
tgatggaagtgactgtcagttc

SEQ ID NO: 7232657 - DNA, 22 bp, Homo sapiens
tgatggaaggtttctcggtgat

SEQ ID NO: 7232658 - DNA, 22 bp, Homo sapiens
tgatggaagagctaacaatatc

SEQ ID NO: 7232659 - DNA, 22 bp, Homo sapiens
tgatggaagagctaacaatatc

SEQ ID NO: 7232660 - DNA, 22 bp, Homo sapiens
tgatggaagagctaacaatatc

SEQ ID NO: 7232661 - DNA, 22 bp, Homo sapiens
tgatggaacagcctttgccaaa

SEQ ID NO: 7232662 - DNA, 22 bp, Homo sapiens
tgatggaaatttgggaagcttt

SEQ ID NO: 7232663 - DNA, 22 bp, Homo sapiens
tgatggaaatgttctgtatctg

SEQ ID NO: 7232664 - DNA, 23 bp, Homo sapiens
tgatggaaatgatctgggtctgt

SEQ ID NO: 7232665 - DNA, 22 bp, Homo sapiens
tgatggaaatgttctgtatctg

SEQ ID NO: 7232666 - DNA, 22 bp, Homo sapiens
tgatggaaatattgacaccaca

SEQ ID NO: 7232667 - DNA, 22 bp, Homo sapiens
tgatggaaatattgacaccaca

SEQ ID NO: 7232668 - DNA, 22 bp, Homo sapiens
tgatggaaatatgtaatctggt

SEQ ID NO: 7232669 - DNA, 22 bp, Homo sapiens
tgatggaaataaaagcatagct

SEQ ID NO: 7232670 - DNA, 22 bp, Homo sapiens
tgatggaaataaaagcatagct

SEQ ID NO: 7232671 - DNA, 21 bp, Homo sapiens
tgatggaaaggattttgggtc

SEQ ID NO: 7232672 - DNA, 22 bp, Homo sapiens
tgatggaaacttgggtaagtca

SEQ ID NO: 7232673 - DNA, 22 bp, Homo sapiens
tgatggaaaataaatcttattc

SEQ ID NO: 7232674 - DNA, 22 bp, Homo sapiens
tgattctttctccaccaattca

SEQ ID NO: 7232675 - DNA, 22 bp, Homo sapiens
tgattctttggagagctatata

SEQ ID NO: 7232676 - DNA, 22 bp, Homo sapiens
tgattgaagtgttctgttccag

SEQ ID NO: 7232677 - DNA, 22 bp, Homo sapiens
tgattgttttagttccctgatg

SEQ ID NO: 7232678 - DNA, 22 bp, Homo sapiens
tgatttaaaagaaacattgtct

SEQ ID NO: 7232679 - DNA, 22 bp, Homo sapiens
tgattgtatgattgaaatattt

SEQ ID NO: 7232680 - DNA, 22 bp, Homo sapiens
tgattgtttcctatgtacacct

SEQ ID NO: 7232681 - DNA, 22 bp, Homo sapiens
tgattgtttcctatgtacacct

SEQ ID NO: 7232682 - DNA, 21 bp, Homo sapiens
tgattgatatttgcaaacaga

SEQ ID NO: 7232683 - DNA, 22 bp, Homo sapiens
tgattggtcaggctgtggtgac

SEQ ID NO: 7232684 - DNA, 22 bp, Homo sapiens
tgattggtcaggctgtggtgac

SEQ ID NO: 7232685 - DNA, 22 bp, Homo sapiens
tgattctaggtccattatttgc

SEQ ID NO: 7232686 - DNA, 22 bp, Homo sapiens
tgattcctgtgcttattccagt

SEQ ID NO: 7232687 - DNA, 22 bp, Homo sapiens
tgattctaggtccattatttgc

SEQ ID NO: 7232688 - DNA, 22 bp, Homo sapiens
tgattccagataatagtactga

SEQ ID NO: 7232689 - DNA, 22 bp, Homo sapiens
tgattccagcaacccaggaatt

SEQ ID NO: 7232690 - DNA, 22 bp, Homo sapiens
tgattccatgcagtaaaaggca

SEQ ID NO: 7232691 - DNA, 22 bp, Homo sapiens
tgattccatggtcaattccagg

SEQ ID NO: 7232692 - DNA, 22 bp, Homo sapiens
tgattcatcagaataggagttt

SEQ ID NO: 7232693 - DNA, 22 bp, Homo sapiens
tgattccaaagaatttaagttc

SEQ ID NO: 7232694 - DNA, 22 bp, Homo sapiens
tgattccaaattcacatgcttt

SEQ ID NO: 7232695 - DNA, 22 bp, Homo sapiens
tgattccaagacctattctatt

SEQ ID NO: 7232696 - DNA, 22 bp, Homo sapiens
tgattccaagacctattctatt

SEQ ID NO: 7232697 - DNA, 22 bp, Homo sapiens
tgattccactctgaggatcgta

SEQ ID NO: 7232698 - DNA, 22 bp, Homo sapiens
tgattctatattggaaaagggg

SEQ ID NO: 7232699 - DNA, 22 bp, Homo sapiens
tgattctatctaggtagaactg

SEQ ID NO: 7232700 - DNA, 22 bp, Homo sapiens
tgattctcaaaggtagactggg

SEQ ID NO: 7232701 - DNA, 22 bp, Homo sapiens
tgattctcttgtaagctatgtt

SEQ ID NO: 7232702 - DNA, 22 bp, Homo sapiens
tgattaaaatttaacttagtta

SEQ ID NO: 7232703 - DNA, 22 bp, Homo sapiens
tgatgtttaatactatgctttt

SEQ ID NO: 7232704 - DNA, 22 bp, Homo sapiens
tgatgtgtggcagttaaactgt

SEQ ID NO: 7232705 - DNA, 22 bp, Homo sapiens
tgatgtgtgggcatgcagacag

SEQ ID NO: 7232706 - DNA, 22 bp, Homo sapiens
tgatgtgtgggcatgcagacag

SEQ ID NO: 7232707 - DNA, 22 bp, Homo sapiens
tgatgtgtgggcatgcagacag

SEQ ID NO: 7232708 - DNA, 22 bp, Homo sapiens
tgatgttatggtactattcatt

SEQ ID NO: 7232709 - DNA, 22 bp, Homo sapiens
tgatgttcaacaagtacatatt

SEQ ID NO: 7232710 - DNA, 22 bp, Homo sapiens
tgatgttcagtgaagaggaccg

SEQ ID NO: 7232711 - DNA, 22 bp, Homo sapiens
tgatgttctgtatatcatatag

SEQ ID NO: 7232712 - DNA, 22 bp, Homo sapiens
tgatgtttaatactatgctttt

SEQ ID NO: 7232713 - DNA, 22 bp, Homo sapiens
tgatgtagctggtattcacgtg

SEQ ID NO: 7232714 - DNA, 22 bp, Homo sapiens
tgatgtcctcatgtcaagctcc

SEQ ID NO: 7232715 - DNA, 22 bp, Homo sapiens
tgatggtctagtcaaattgcca

SEQ ID NO: 7232716 - DNA, 22 bp, Homo sapiens
tgatggtgatggttgcacaatg

SEQ ID NO: 7232717 - DNA, 22 bp, Homo sapiens
tgatggtgggtctgatctcata

SEQ ID NO: 7232718 - DNA, 22 bp, Homo sapiens
tgatgtgaactcttgatatgat

SEQ ID NO: 7232719 - DNA, 22 bp, Homo sapiens
tgatgtgatagaaaggtagtgg

SEQ ID NO: 7232720 - DNA, 22 bp, Homo sapiens
tgatgtgtgattcattctcaaa

SEQ ID NO: 7232721 - DNA, 22 bp, Homo sapiens
tgatgtgtgattcattctcaaa

SEQ ID NO: 7232722 - DNA, 22 bp, Homo sapiens
tgattaactgtctattaatcat

SEQ ID NO: 7232723 - DNA, 22 bp, Homo sapiens
tgattaactgtctattaatcat

SEQ ID NO: 7232724 - DNA, 22 bp, Homo sapiens
tgattaagcaaagagcagtaaa

SEQ ID NO: 7232725 - DNA, 22 bp, Homo sapiens
tgattaagcaaagagcagtaaa

SEQ ID NO: 7232726 - DNA, 22 bp, Homo sapiens
tgattaagttcaaaatatagaa

SEQ ID NO: 7232727 - DNA, 22 bp, Homo sapiens
tgattaagttcaaaatatagaa

SEQ ID NO: 7232728 - DNA, 22 bp, Homo sapiens
tgattaagttcaaaatatagaa

SEQ ID NO: 7232729 - DNA, 22 bp, Homo sapiens
tgattaagttgcattttaatat

SEQ ID NO: 7232730 - DNA, 22 bp, Homo sapiens
tgattacaaaagattgtttgaa

SEQ ID NO: 7232731 - DNA, 22 bp, Homo sapiens
tgattacaacagagtcatccat

SEQ ID NO: 7232732 - DNA, 23 bp, Homo sapiens
tgattacaagggccaaagaaagg

SEQ ID NO: 7232733 - DNA, 22 bp, Homo sapiens
tgattcagtctcttcaggagaa

SEQ ID NO: 7232734 - DNA, 23 bp, Homo sapiens
tgattcagcaagtccacttctgg

SEQ ID NO: 7232735 - DNA, 23 bp, Homo sapiens
tgattcagcaagtccacttctgg

SEQ ID NO: 7232736 - DNA, 23 bp, Homo sapiens
tgattcagcaagtccacttctgg

SEQ ID NO: 7232737 - DNA, 22 bp, Homo sapiens
tgattcagaggctattctcctt

SEQ ID NO: 7232738 - DNA, 22 bp, Homo sapiens
tcttattggtaatgatggcatt

SEQ ID NO: 7232739 - DNA, 22 bp, Homo sapiens
tcttattggataaaaggaaacc

SEQ ID NO: 7232740 - DNA, 19 bp, Homo sapiens
tcttattgagcagctgagg

SEQ ID NO: 7232741 - DNA, 19 bp, Homo sapiens
tcttattgagcagctgagg

SEQ ID NO: 7232742 - DNA, 22 bp, Homo sapiens
tcttattggtaatgatggcatt

SEQ ID NO: 7232743 - DNA, 20 bp, Homo sapiens
tcttattgtcttgaggagtt

SEQ ID NO: 7232744 - DNA, 20 bp, Homo sapiens
tcttattgtcttgaggagtt

SEQ ID NO: 7232745 - DNA, 20 bp, Homo sapiens
tcttattgtcttgaggagtt

SEQ ID NO: 7232746 - DNA, 22 bp, Homo sapiens
tcttattgtttaaaagtacaca

SEQ ID NO: 7232747 - DNA, 22 bp, Homo sapiens
tcttattgtttaaaagtacaca

SEQ ID NO: 7232748 - DNA, 22 bp, Homo sapiens
tcttatttgcaactggctcaga

SEQ ID NO: 7232749 - DNA, 22 bp, Homo sapiens
tcttatttgcaactggctcaga

SEQ ID NO: 7232750 - DNA, 22 bp, Homo sapiens
tcttatttgcaactggctcaga

SEQ ID NO: 7232751 - DNA, 22 bp, Homo sapiens
tcttattttgttagatgctgta

SEQ ID NO: 7232752 - DNA, 22 bp, Homo sapiens
tcttattttttaatgacagaga

SEQ ID NO: 7232753 - DNA, 22 bp, Homo sapiens
tcttcaaaatattccatccatt

SEQ ID NO: 7232754 - DNA, 22 bp, Homo sapiens
tcttcaaaccctggctcttcct

SEQ ID NO: 7232755 - DNA, 22 bp, Homo sapiens
tcttcaaaccctggctcttcct

SEQ ID NO: 7232756 - DNA, 22 bp, Homo sapiens
tcttcaaactgaaaatttagaa

SEQ ID NO: 7232757 - DNA, 22 bp, Homo sapiens
tcttcaaactgaaaatttagaa

SEQ ID NO: 7232758 - DNA, 22 bp, Homo sapiens
tcttcaaaaaatatccatcagt

SEQ ID NO: 7232759 - DNA, 22 bp, Homo sapiens
tcttcaaaaaatatccatcagt

SEQ ID NO: 7232760 - DNA, 22 bp, Homo sapiens
tcttcaaaaaatatccatcagt

SEQ ID NO: 7232761 - DNA, 22 bp, Homo sapiens
tcttcaaactgaaaatttagaa

SEQ ID NO: 7232762 - DNA, 22 bp, Homo sapiens
tcttcaaagaagccttggatta

SEQ ID NO: 7232763 - DNA, 22 bp, Homo sapiens
tcttcaaagaagccttggatta

SEQ ID NO: 7232764 - DNA, 22 bp, Homo sapiens
tcttcaaagaattttagtaatt

SEQ ID NO: 7232765 - DNA, 22 bp, Homo sapiens
tcttcaaagaattttagtaatt

SEQ ID NO: 7232766 - DNA, 22 bp, Homo sapiens
tcttcaaatacagtcatattga

SEQ ID NO: 7232767 - DNA, 22 bp, Homo sapiens
tcttcaaatacagtcatattga

SEQ ID NO: 7232768 - DNA, 22 bp, Homo sapiens
tcttcacaccgggcagcaggaa

SEQ ID NO: 7232769 - DNA, 22 bp, Homo sapiens
tcttcacaccgggcagcaggaa

SEQ ID NO: 7232770 - DNA, 22 bp, Homo sapiens
tcttcaatttagaatggattta

SEQ ID NO: 7232771 - DNA, 22 bp, Homo sapiens
tcttcacaaagctgttgttaaa

SEQ ID NO: 7232772 - DNA, 22 bp, Homo sapiens
tcttcaatttagaatggattta

SEQ ID NO: 7232773 - DNA, 22 bp, Homo sapiens
tcttcacacacagtcctctttc

SEQ ID NO: 7232774 - DNA, 22 bp, Homo sapiens
tcttcacacacagtcctctttc

SEQ ID NO: 7232775 - DNA, 22 bp, Homo sapiens
tcttcaattagatttaccaatt

SEQ ID NO: 7232776 - DNA, 22 bp, Homo sapiens
tcttcaattagatttaccaatt

SEQ ID NO: 7232777 - DNA, 22 bp, Homo sapiens
tcttcaatttagaatggattta

SEQ ID NO: 7232778 - DNA, 22 bp, Homo sapiens
tcttcaatatgtgtttaatatt

SEQ ID NO: 7232779 - DNA, 22 bp, Homo sapiens
tcttcaatgcattctcttgttt

SEQ ID NO: 7232780 - DNA, 22 bp, Homo sapiens
tcttcaaatcctacagtgtctg

SEQ ID NO: 7232781 - DNA, 22 bp, Homo sapiens
tcttcaaatcctacagtgtctg

SEQ ID NO: 7232782 - DNA, 22 bp, Homo sapiens
tcttcaaatgctagtaatatca

SEQ ID NO: 7232783 - DNA, 22 bp, Homo sapiens
tcttcaaccttgttactatagc

SEQ ID NO: 7232784 - DNA, 22 bp, Homo sapiens
tcttcacagatgcatatacttc

SEQ ID NO: 7232785 - DNA, 22 bp, Homo sapiens
tcttcacagctttgtccagaag

SEQ ID NO: 7232786 - DNA, 23 bp, Homo sapiens
tcttcacagggcttcccatgtgc

SEQ ID NO: 7232787 - DNA, 22 bp, Homo sapiens
tcttcacagtcctggtcagtgg

SEQ ID NO: 7232788 - DNA, 22 bp, Homo sapiens
tcttcacagtcctggtcagtgg

SEQ ID NO: 7232789 - DNA, 22 bp, Homo sapiens
tcttcacatcatgttttttaat

SEQ ID NO: 7232790 - DNA, 22 bp, Homo sapiens
tcttcacatcatgttttttaat

SEQ ID NO: 7232791 - DNA, 22 bp, Homo sapiens
tcttcacatgaccttcatgtct

SEQ ID NO: 7232792 - DNA, 22 bp, Homo sapiens
tcttcacatgaccttcatgtct

SEQ ID NO: 7232793 - DNA, 22 bp, Homo sapiens
tcttcacatgaccttcatgtct

SEQ ID NO: 7232794 - DNA, 22 bp, Homo sapiens
tcttcacatgaccttcatgtct

SEQ ID NO: 7232795 - DNA, 22 bp, Homo sapiens
tcttcacatggaacatgaagct

SEQ ID NO: 7232796 - DNA, 22 bp, Homo sapiens
tcttcagatggccagttgtccc

SEQ ID NO: 7232797 - DNA, 22 bp, Homo sapiens
tcttcagatggccagttgtccc

SEQ ID NO: 7232798 - DNA, 22 bp, Homo sapiens
tcttcagattgcactgagcaag

SEQ ID NO: 7232799 - DNA, 22 bp, Homo sapiens
tcttcagcaactccccaatctg

SEQ ID NO: 7232800 - DNA, 22 bp, Homo sapiens
tcttccagatgcagatgcttct

SEQ ID NO: 7232801 - DNA, 22 bp, Homo sapiens
tcttccagatgcagatgcttct

SEQ ID NO: 7232802 - DNA, 20 bp, Homo sapiens
tcttccagagacattttccc

SEQ ID NO: 7232803 - DNA, 22 bp, Homo sapiens
tcttccagaatctcagagggct

SEQ ID NO: 7232804 - DNA, 22 bp, Homo sapiens
tcttccagcaatgtgaaatcac

SEQ ID NO: 7232805 - DNA, 19 bp, Homo sapiens
tcttccagcatctgggggc

SEQ ID NO: 7232806 - DNA, 22 bp, Homo sapiens
tcttccagccaatagcgtcctt

SEQ ID NO: 7232807 - DNA, 22 bp, Homo sapiens
tcttccagctccccacggtgtc

SEQ ID NO: 7232808 - DNA, 22 bp, Homo sapiens
tcttccaaaattagtctcagtt

SEQ ID NO: 7232809 - DNA, 22 bp, Homo sapiens
tcttccaaatgcagctaaagct

SEQ ID NO: 7232810 - DNA, 18 bp, Homo sapiens
tcttccaacactgacacc

SEQ ID NO: 7232811 - DNA, 22 bp, Homo sapiens
tcttcattccgtagatatttat

SEQ ID NO: 7232812 - DNA, 22 bp, Homo sapiens
tcttcatgttgcttattctggg

SEQ ID NO: 7232813 - DNA, 22 bp, Homo sapiens
tcttcatgttgcttattctggg

SEQ ID NO: 7232814 - DNA, 22 bp, Homo sapiens
tcttcattctcgcctttgtcgt

SEQ ID NO: 7232815 - DNA, 22 bp, Homo sapiens
tcttcattctcgcctttgtcgt

SEQ ID NO: 7232816 - DNA, 18 bp, Homo sapiens
tcttccaacactgacacc

SEQ ID NO: 7232817 - DNA, 21 bp, Homo sapiens
tcttccaagggctgctgagac

SEQ ID NO: 7232818 - DNA, 22 bp, Homo sapiens
tcttccaaggttgcacactatc

SEQ ID NO: 7232819 - DNA, 22 bp, Homo sapiens
tcttccaatggtttctagattt

SEQ ID NO: 7232820 - DNA, 22 bp, Homo sapiens
tcttccaattagaatatttggg

SEQ ID NO: 7232821 - DNA, 22 bp, Homo sapiens
tcttccacttgcaagtttatgg

SEQ ID NO: 7232822 - DNA, 22 bp, Homo sapiens
tcttcatgtatactcatggtac

SEQ ID NO: 7232823 - DNA, 22 bp, Homo sapiens
tcttcatgccaaatgagttttg

SEQ ID NO: 7232824 - DNA, 22 bp, Homo sapiens
tcttcatctcagattaacagga

SEQ ID NO: 7232825 - DNA, 22 bp, Homo sapiens
tcttcatgaaattgattgctta

SEQ ID NO: 7232826 - DNA, 22 bp, Homo sapiens
tcttcatacaatttcagacatc

SEQ ID NO: 7232827 - DNA, 22 bp, Homo sapiens
tcttcatacaatttcagacatc

SEQ ID NO: 7232828 - DNA, 22 bp, Homo sapiens
tcttcatactcatcacataggt

SEQ ID NO: 7232829 - DNA, 22 bp, Homo sapiens
tcttcatctcagattaacagga

SEQ ID NO: 7232830 - DNA, 22 bp, Homo sapiens
tcttcagttgtaaaagtgttgg

SEQ ID NO: 7232831 - DNA, 22 bp, Homo sapiens
tcttcagttgtcatactgcctt

SEQ ID NO: 7232832 - DNA, 22 bp, Homo sapiens
tcttcataacctagagatagca

SEQ ID NO: 7232833 - DNA, 22 bp, Homo sapiens
tcttcagtatttggataacatt

SEQ ID NO: 7232834 - DNA, 22 bp, Homo sapiens
tcttcagtcaatccagatgttt

SEQ ID NO: 7232835 - DNA, 20 bp, Homo sapiens
tcttcagcactccttaggta

SEQ ID NO: 7232836 - DNA, 22 bp, Homo sapiens
tcttcagcagggcctctctgag

SEQ ID NO: 7232837 - DNA, 22 bp, Homo sapiens
tcttcagcagagaattatgatg

SEQ ID NO: 7232838 - DNA, 21 bp, Homo sapiens
tcttcagcagtggtgaggtgg

SEQ ID NO: 7232839 - DNA, 21 bp, Homo sapiens
tcttcagcagtggtgaggtgg

SEQ ID NO: 7232840 - DNA, 22 bp, Homo sapiens
tcttcaggaagggaaatcatcc

SEQ ID NO: 7232841 - DNA, 22 bp, Homo sapiens
tcttctgtgagaattcaagcaa

SEQ ID NO: 7232842 - DNA, 22 bp, Homo sapiens
tcttctgtggctctcaccaccc

SEQ ID NO: 7232843 - DNA, 22 bp, Homo sapiens
tcttctgtattgttaactcagg

SEQ ID NO: 7232844 - DNA, 22 bp, Homo sapiens
tcttctctacaccagcagcccc

SEQ ID NO: 7232845 - DNA, 22 bp, Homo sapiens
tcttctctacaccagcagcccc

SEQ ID NO: 7232846 - DNA, 22 bp, Homo sapiens
tcttctcctttgccatgtgttt

SEQ ID NO: 7232847 - DNA, 22 bp, Homo sapiens
tcttctcctttgccatgtgttt

SEQ ID NO: 7232848 - DNA, 22 bp, Homo sapiens
tcttctctacaccagcagcccc

SEQ ID NO: 7232849 - DNA, 22 bp, Homo sapiens
tcttctctcatgtaggagggaa

SEQ ID NO: 7232850 - DNA, 22 bp, Homo sapiens
tcttctggatgagagcggaggc

SEQ ID NO: 7232851 - DNA, 20 bp, Homo sapiens
tcttctggatttcctttagg

SEQ ID NO: 7232852 - DNA, 22 bp, Homo sapiens
tcttctgtattgttaactcagg

SEQ ID NO: 7232853 - DNA, 22 bp, Homo sapiens
tcttctcccatcggccgcaggg

SEQ ID NO: 7232854 - DNA, 22 bp, Homo sapiens
tcttctcccatctccaggcagg

SEQ ID NO: 7232855 - DNA, 22 bp, Homo sapiens
tcttctcccatctccaggcagg

SEQ ID NO: 7232856 - DNA, 22 bp, Homo sapiens
tcttctcccatctccaggcagg

SEQ ID NO: 7232857 - DNA, 22 bp, Homo sapiens
tcttctcccagggtcgcccaag

SEQ ID NO: 7232858 - DNA, 22 bp, Homo sapiens
tcttctcccatcggccgcaggg

SEQ ID NO: 7232859 - DNA, 22 bp, Homo sapiens
tcttctcagtttctctaggatg

SEQ ID NO: 7232860 - DNA, 22 bp, Homo sapiens
tcttctcagtttctctaggatg

SEQ ID NO: 7232861 - DNA, 22 bp, Homo sapiens
tcttctccagtgcttctgcaca

SEQ ID NO: 7232862 - DNA, 22 bp, Homo sapiens
tcttctccagtgcttctgcaca

SEQ ID NO: 7232863 - DNA, 22 bp, Homo sapiens
tcttctttatgtcatatgccag

SEQ ID NO: 7232864 - DNA, 22 bp, Homo sapiens
tcttctttatgtcatatgccag

SEQ ID NO: 7232865 - DNA, 22 bp, Homo sapiens
tcttctttgaatcatagtgacc

SEQ ID NO: 7232866 - DNA, 22 bp, Homo sapiens
tcttctttgaatcatagtgacc

SEQ ID NO: 7232867 - DNA, 22 bp, Homo sapiens
tcttctttgaatcatagtgacc

SEQ ID NO: 7232868 - DNA, 22 bp, Homo sapiens
tcttcttatgtgccattatctc

SEQ ID NO: 7232869 - DNA, 22 bp, Homo sapiens
tcttcttcccatccctcaaatg

SEQ ID NO: 7232870 - DNA, 20 bp, Homo sapiens
tcttctgttgccttgttctg

SEQ ID NO: 7232871 - DNA, 20 bp, Homo sapiens
tcttctgttgccttgttctg

SEQ ID NO: 7232872 - DNA, 22 bp, Homo sapiens
tcttctgttttagattgcatac

SEQ ID NO: 7232873 - DNA, 22 bp, Homo sapiens
tcttctgttttagattgcatac

SEQ ID NO: 7232874 - DNA, 22 bp, Homo sapiens
tcttctttttgtcccacagaat

SEQ ID NO: 7232875 - DNA, 22 bp, Homo sapiens
tcttctttttgtcccacagaat

SEQ ID NO: 7232876 - DNA, 22 bp, Homo sapiens
tcttctttgaatcatagtgacc

SEQ ID NO: 7232877 - DNA, 22 bp, Homo sapiens
tcttctttggatgaaagaatat

SEQ ID NO: 7232878 - DNA, 22 bp, Homo sapiens
tcttctttggatgaaagaatat

SEQ ID NO: 7232879 - DNA, 22 bp, Homo sapiens
tcttctttggatgaaagaatat

SEQ ID NO: 7232880 - DNA, 22 bp, Homo sapiens
tcttgaaacatatgagtaagtg

SEQ ID NO: 7232881 - DNA, 21 bp, Homo sapiens
tcttcctccacagcgtgccac

SEQ ID NO: 7232882 - DNA, 20 bp, Homo sapiens
tcttccaggtacagtctgca

SEQ ID NO: 7232883 - DNA, 20 bp, Homo sapiens
tcttccaggtacagtctgca

SEQ ID NO: 7232884 - DNA, 22 bp, Homo sapiens
tcttccaggagggtgggcaaac

SEQ ID NO: 7232885 - DNA, 22 bp, Homo sapiens
tcttccagcttctggtggctgc

SEQ ID NO: 7232886 - DNA, 22 bp, Homo sapiens
tcttccaggacctggggctcca

SEQ ID NO: 7232887 - DNA, 22 bp, Homo sapiens
tcttccaggagggcatttcttt

SEQ ID NO: 7232888 - DNA, 22 bp, Homo sapiens
tcttccaggagggcatttcttt

SEQ ID NO: 7232889 - DNA, 22 bp, Homo sapiens
tcttccagctgtaggacctagg

SEQ ID NO: 7232890 - DNA, 22 bp, Homo sapiens
tcttccagcttctagaggatgc

SEQ ID NO: 7232891 - DNA, 18 bp, Homo sapiens
tcttccagcttctggagg

SEQ ID NO: 7232892 - DNA, 20 bp, Homo sapiens
tcttccagcttctggtagaa

SEQ ID NO: 7232893 - DNA, 21 bp, Homo sapiens
tcttcctgctccacactcccc

SEQ ID NO: 7232894 - DNA, 21 bp, Homo sapiens
tcttcctgctccacactcccc

SEQ ID NO: 7232895 - DNA, 21 bp, Homo sapiens
tcttcctgacatatgcaaggc

SEQ ID NO: 7232896 - DNA, 21 bp, Homo sapiens
tcttcctgacatatgcaaggc

SEQ ID NO: 7232897 - DNA, 21 bp, Homo sapiens
tcttcctgacatatgcaaggc

SEQ ID NO: 7232898 - DNA, 21 bp, Homo sapiens
tcttcctgctccacactcccc

SEQ ID NO: 7232899 - DNA, 21 bp, Homo sapiens
tcttcctgctccacactcccc

SEQ ID NO: 7232900 - DNA, 21 bp, Homo sapiens
tcttcctgacatatgcaaggc

SEQ ID NO: 7232901 - DNA, 21 bp, Homo sapiens
tcttcctgacatatgcaaggc

SEQ ID NO: 7232902 - DNA, 21 bp, Homo sapiens
tcttcctgacatatgcaaggc

SEQ ID NO: 7232903 - DNA, 23 bp, Homo sapiens
tcttcctgaactatcaggcacat

SEQ ID NO: 7232904 - DNA, 23 bp, Homo sapiens
tcttcctgaactatcaggcacat

SEQ ID NO: 7232905 - DNA, 22 bp, Homo sapiens
tcttcctgaaaccctgttccag

SEQ ID NO: 7232906 - DNA, 23 bp, Homo sapiens
tcttcctgaactatcaggcacat

SEQ ID NO: 7232907 - DNA, 22 bp, Homo sapiens
tcttcctgaaaccctgttccag

SEQ ID NO: 7232908 - DNA, 22 bp, Homo sapiens
tcttcctgaaaccctgttccag

SEQ ID NO: 7232909 - DNA, 22 bp, Homo sapiens
tcttcctgaaaccctgttccag

SEQ ID NO: 7232910 - DNA, 22 bp, Homo sapiens
tcttcctgaaaccctgttccag

SEQ ID NO: 7232911 - DNA, 22 bp, Homo sapiens
tcttcctccctacagagctcag

SEQ ID NO: 7232912 - DNA, 22 bp, Homo sapiens
tcttcctccctacagagctcag

SEQ ID NO: 7232913 - DNA, 22 bp, Homo sapiens
tcttcctcttctgctgagaagt

SEQ ID NO: 7232914 - DNA, 22 bp, Homo sapiens
tcttcctctctaattgatcaga

SEQ ID NO: 7232915 - DNA, 22 bp, Homo sapiens
tcttcctctctaattgatcaga

SEQ ID NO: 7232916 - DNA, 22 bp, Homo sapiens
tcttcctggcattgatgctgca

SEQ ID NO: 7232917 - DNA, 22 bp, Homo sapiens
tcttcctggtttctgggccatc

SEQ ID NO: 7232918 - DNA, 22 bp, Homo sapiens
tcttcctggtttctgggccatc

SEQ ID NO: 7232919 - DNA, 22 bp, Homo sapiens
tcttcctggatgggggttgatg

SEQ ID NO: 7232920 - DNA, 22 bp, Homo sapiens
tcttcctggcattgatgctgca

SEQ ID NO: 7232921 - DNA, 22 bp, Homo sapiens
tcttcctggcattgatgctgca

SEQ ID NO: 7232922 - DNA, 22 bp, Homo sapiens
tcttcctggcattgatgctgca

SEQ ID NO: 7232923 - DNA, 22 bp, Homo sapiens
tcttcctggatgggggttgatg

SEQ ID NO: 7232924 - DNA, 22 bp, Homo sapiens
tcttcctggatgggggttgatg

SEQ ID NO: 7232925 - DNA, 22 bp, Homo sapiens
tcttcctgctttggtgaggctt

SEQ ID NO: 7232926 - DNA, 22 bp, Homo sapiens
tcttcctgcttggtgtgtctgg

SEQ ID NO: 7232927 - DNA, 22 bp, Homo sapiens
tcttcctgctttggtgaggctt

SEQ ID NO: 7232928 - DNA, 22 bp, Homo sapiens
tcttcctgctttggtgaggctt

SEQ ID NO: 7232929 - DNA, 22 bp, Homo sapiens
tcttcctgctttggtgaggctt

SEQ ID NO: 7232930 - DNA, 22 bp, Homo sapiens
tcttcctgcttggtgtgtctgg

SEQ ID NO: 7232931 - DNA, 22 bp, Homo sapiens
tcttcctgcttggtgtgtctgg

SEQ ID NO: 7232932 - DNA, 22 bp, Homo sapiens
tcttccttctttgatgacaagg

SEQ ID NO: 7232933 - DNA, 22 bp, Homo sapiens
tcttccttcgcccttgctgttt

SEQ ID NO: 7232934 - DNA, 22 bp, Homo sapiens
tcttccttcgcccttgctgttt

SEQ ID NO: 7232935 - DNA, 22 bp, Homo sapiens
tcttccttaaatgtttggtaga

SEQ ID NO: 7232936 - DNA, 22 bp, Homo sapiens
tcttccttaaatgtttggtaga

SEQ ID NO: 7232937 - DNA, 22 bp, Homo sapiens
tcttccttaaatgtttggtaga

SEQ ID NO: 7232938 - DNA, 22 bp, Homo sapiens
tcttcctgtcaatgagaattaa

SEQ ID NO: 7232939 - DNA, 22 bp, Homo sapiens
tcttcctggtttctgggccatc

SEQ ID NO: 7232940 - DNA, 22 bp, Homo sapiens
tcttcctggtttctgggccatc

SEQ ID NO: 7232941 - DNA, 22 bp, Homo sapiens
tcttcctggtttctgggccatc

SEQ ID NO: 7232942 - DNA, 22 bp, Homo sapiens
tcttcctgtcaatgagaattaa

SEQ ID NO: 7232943 - DNA, 22 bp, Homo sapiens
tcttcctgtcaatgagaattaa

SEQ ID NO: 7232944 - DNA, 22 bp, Homo sapiens
tcttcctttcattcatgtgtta

SEQ ID NO: 7232945 - DNA, 22 bp, Homo sapiens
tcttccttgctccttgtcactt

SEQ ID NO: 7232946 - DNA, 22 bp, Homo sapiens
tcttccttgtaagggctttaga

SEQ ID NO: 7232947 - DNA, 22 bp, Homo sapiens
tcttccttgccttgcttcatca

SEQ ID NO: 7232948 - DNA, 22 bp, Homo sapiens
tcttccttgctccttgtcactt

SEQ ID NO: 7232949 - DNA, 16 bp, Homo sapiens
tcttccttttgatttt

SEQ ID NO: 7232950 - DNA, 22 bp, Homo sapiens
tcttccttttgtaccttctgaa

SEQ ID NO: 7232951 - DNA, 22 bp, Homo sapiens
tcttccttttgtaccttctgaa

SEQ ID NO: 7232952 - DNA, 22 bp, Homo sapiens
tcttccttttgtaccttctgaa

SEQ ID NO: 7232953 - DNA, 17 bp, Homo sapiens
tcttcgggcgctaggta

SEQ ID NO: 7232954 - DNA, 22 bp, Homo sapiens
tcttctaatggttcagatatat

SEQ ID NO: 7232955 - DNA, 23 bp, Homo sapiens
tcttcgggctcactatttcctcc

SEQ ID NO: 7232956 - DNA, 22 bp, Homo sapiens
tcttctagtaggccaagaagct

SEQ ID NO: 7232957 - DNA, 22 bp, Homo sapiens
tctttattgctactggtttgtc

SEQ ID NO: 7232958 - DNA, 22 bp, Homo sapiens
tctttatttaagtctgttgtaa

SEQ ID NO: 7232959 - DNA, 22 bp, Homo sapiens
tctttatttaagtctgttgtaa

SEQ ID NO: 7232960 - DNA, 22 bp, Homo sapiens
tctttatttaagtctgttgtaa

SEQ ID NO: 7232961 - DNA, 22 bp, Homo sapiens
tctttatttaagtctgttgtaa

SEQ ID NO: 7232962 - DNA, 22 bp, Homo sapiens
tctttatttaagtctgttgtaa

SEQ ID NO: 7232963 - DNA, 22 bp, Homo sapiens
tctttcaatgagcattctttcc

SEQ ID NO: 7232964 - DNA, 22 bp, Homo sapiens
tctttcaatgtgaaaccatgta

SEQ ID NO: 7232965 - DNA, 22 bp, Homo sapiens
tctttcaatgtgaaaccatgta

SEQ ID NO: 7232966 - DNA, 22 bp, Homo sapiens
tctttcagaaactttgtctgcg

SEQ ID NO: 7232967 - DNA, 22 bp, Homo sapiens
tctttcagctcttcaggaccca

SEQ ID NO: 7232968 - DNA, 19 bp, Homo sapiens
tctttcatttctagctctg

SEQ ID NO: 7232969 - DNA, 22 bp, Homo sapiens
tctttcccagtagctctcccag

SEQ ID NO: 7232970 - DNA, 22 bp, Homo sapiens
tctttcccctacatttggttaa

SEQ ID NO: 7232971 - DNA, 22 bp, Homo sapiens
tctttccagaggaatttttaga

SEQ ID NO: 7232972 - DNA, 22 bp, Homo sapiens
tctttccagaggaatttttaga

SEQ ID NO: 7232973 - DNA, 22 bp, Homo sapiens
tctttccatggccacacagtct

SEQ ID NO: 7232974 - DNA, 21 bp, Homo sapiens
tctttccaatattcatgtctc

SEQ ID NO: 7232975 - DNA, 22 bp, Homo sapiens
tctttccaagtaatacttccca

SEQ ID NO: 7232976 - DNA, 22 bp, Homo sapiens
tctttccacactgtatgcccat

SEQ ID NO: 7232977 - DNA, 22 bp, Homo sapiens
tctttccacagcatgtccatgc

SEQ ID NO: 7232978 - DNA, 22 bp, Homo sapiens
tctttccacattctctgtttag

SEQ ID NO: 7232979 - DNA, 22 bp, Homo sapiens
tctttccagaggaatttttaga

SEQ ID NO: 7232980 - DNA, 22 bp, Homo sapiens
tctttatcaagtctgttctttg

SEQ ID NO: 7232981 - DNA, 22 bp, Homo sapiens
tctttatctggctcagagacac

SEQ ID NO: 7232982 - DNA, 22 bp, Homo sapiens
tctttagttttctaggttctat

SEQ ID NO: 7232983 - DNA, 22 bp, Homo sapiens
tctttataaaagtcattatgtc

SEQ ID NO: 7232984 - DNA, 22 bp, Homo sapiens
tctttattgctactggtttgtc

SEQ ID NO: 7232985 - DNA, 22 bp, Homo sapiens
tctttattgctactggtttgtc

SEQ ID NO: 7232986 - DNA, 22 bp, Homo sapiens
tctttatgtttgaaagtacaat

SEQ ID NO: 7232987 - DNA, 22 bp, Homo sapiens
tctttattgctactggtttgtc

SEQ ID NO: 7232988 - DNA, 22 bp, Homo sapiens
tctttattgctactggtttgtc

SEQ ID NO: 7232989 - DNA, 22 bp, Homo sapiens
tctttagctagaaatactctaa

SEQ ID NO: 7232990 - DNA, 20 bp, Homo sapiens
tctttagatttatcttatgt

SEQ ID NO: 7232991 - DNA, 22 bp, Homo sapiens
tctttagtaatgtagcagttta

SEQ ID NO: 7232992 - DNA, 22 bp, Homo sapiens
tctttagtattgagttatggta

SEQ ID NO: 7232993 - DNA, 22 bp, Homo sapiens
tctttagtgaccatctcattct

SEQ ID NO: 7232994 - DNA, 22 bp, Homo sapiens
tctttagtgaccatctcattct

SEQ ID NO: 7232995 - DNA, 20 bp, Homo sapiens
tctttagttcctggcccttt

SEQ ID NO: 7232996 - DNA, 22 bp, Homo sapiens
tctttagacatccagtttctct

SEQ ID NO: 7232997 - DNA, 22 bp, Homo sapiens
tctttagagcacgggaaaaaca

SEQ ID NO: 7232998 - DNA, 22 bp, Homo sapiens
tctttagagcctttcctcccga

SEQ ID NO: 7232999 - DNA, 22 bp, Homo sapiens
tctttagagctcagaaatacag

SEQ ID NO: 7233000 - DNA, 22 bp, Homo sapiens
tctttagagttaacaataatga

SEQ ID NO: 7233001 - DNA, 22 bp, Homo sapiens
tctttagatgtttagaggaaga

SEQ ID NO: 7233002 - DNA, 22 bp, Homo sapiens
tctttcctagaggctgatgagt

SEQ ID NO: 7233003 - DNA, 23 bp, Homo sapiens
tctttcctaatgaaacagtgaaa

SEQ ID NO: 7233004 - DNA, 22 bp, Homo sapiens
tctttcctctgagctcctgtag

SEQ ID NO: 7233005 - DNA, 22 bp, Homo sapiens
tctttcctctgagctcctgtag

SEQ ID NO: 7233006 - DNA, 22 bp, Homo sapiens
tctttcctctgagctcctgtag

SEQ ID NO: 7233007 - DNA, 17 bp, Homo sapiens
tctttcctgccatgctc

SEQ ID NO: 7233008 - DNA, 21 bp, Homo sapiens
tctttcctgcccagttgccct

SEQ ID NO: 7233009 - DNA, 22 bp, Homo sapiens
tctttccttagaataattcttt

SEQ ID NO: 7233010 - DNA, 22 bp, Homo sapiens
tctttctacatcatttgcttct

SEQ ID NO: 7233011 - DNA, 22 bp, Homo sapiens
tctttctacattttatatgctt

SEQ ID NO: 7233012 - DNA, 22 bp, Homo sapiens
tctttctacattttatatgctt

SEQ ID NO: 7233013 - DNA, 21 bp, Homo sapiens
tctttcctgcccagttgccct

SEQ ID NO: 7233014 - DNA, 22 bp, Homo sapiens
tctttcctgtaactgctgttca

SEQ ID NO: 7233015 - DNA, 22 bp, Homo sapiens
tctttcctgtaactgctgttca

SEQ ID NO: 7233016 - DNA, 22 bp, Homo sapiens
tctttccttagaataattcttt

SEQ ID NO: 7233017 - DNA, 22 bp, Homo sapiens
tctttcctgtaactgctgttca

SEQ ID NO: 7233018 - DNA, 22 bp, Homo sapiens
tctttgaacttggctgatctct

SEQ ID NO: 7233019 - DNA, 22 bp, Homo sapiens
tctttgaacttggctgatctct

SEQ ID NO: 7233020 - DNA, 22 bp, Homo sapiens
tctttgaacttggctgatctct

SEQ ID NO: 7233021 - DNA, 22 bp, Homo sapiens
tctttgaacttggctgatctct

SEQ ID NO: 7233022 - DNA, 22 bp, Homo sapiens
tctttgaactctgtgtattaac

SEQ ID NO: 7233023 - DNA, 22 bp, Homo sapiens
tctttgaactctgtgtattaac

SEQ ID NO: 7233024 - DNA, 22 bp, Homo sapiens
tctttgaactctgtgtattaac

SEQ ID NO: 7233025 - DNA, 22 bp, Homo sapiens
tctttgaactctgtgtattaac

SEQ ID NO: 7233026 - DNA, 22 bp, Homo sapiens
tctttcttacaaagaaaacggt

SEQ ID NO: 7233027 - DNA, 22 bp, Homo sapiens
tctttcttattagccattgttc

SEQ ID NO: 7233028 - DNA, 22 bp, Homo sapiens
tctttctctctaatcaagcaca

SEQ ID NO: 7233029 - DNA, 22 bp, Homo sapiens
tctttctctctaatcaagcaca

SEQ ID NO: 7233030 - DNA, 22 bp, Homo sapiens
tctttctctctaatcaagcaca

SEQ ID NO: 7233031 - DNA, 21 bp, Homo sapiens
tctttctgaaatctcagtctg

SEQ ID NO: 7233032 - DNA, 22 bp, Homo sapiens
tctttctgaatatttgacctca

SEQ ID NO: 7233033 - DNA, 22 bp, Homo sapiens
tctttctggttatgtatagaga

SEQ ID NO: 7233034 - DNA, 22 bp, Homo sapiens
tctttgaattcaaactgttcaa

SEQ ID NO: 7233035 - DNA, 22 bp, Homo sapiens
tctttgaattcaaactgttcaa

SEQ ID NO: 7233036 - DNA, 22 bp, Homo sapiens
tctttgaatcctttacatctga

SEQ ID NO: 7233037 - DNA, 22 bp, Homo sapiens
tctttgaagtatcttaaatggt

SEQ ID NO: 7233038 - DNA, 22 bp, Homo sapiens
tctttgaagtatcttaaatggt

SEQ ID NO: 7233039 - DNA, 22 bp, Homo sapiens
tctttgatgtggttaattatga

SEQ ID NO: 7233040 - DNA, 22 bp, Homo sapiens
tctttgatgtctcttcctgtaa

SEQ ID NO: 7233041 - DNA, 22 bp, Homo sapiens
tctttgatgtggttaattatga

SEQ ID NO: 7233042 - DNA, 22 bp, Homo sapiens
tctttgatttaaaacagtcaaa

SEQ ID NO: 7233043 - DNA, 22 bp, Homo sapiens
tctttgatttagaaggaaatga

SEQ ID NO: 7233044 - DNA, 22 bp, Homo sapiens
tctttgatcagcctttcactga

SEQ ID NO: 7233045 - DNA, 22 bp, Homo sapiens
tctttgatcagcctttcactga

SEQ ID NO: 7233046 - DNA, 22 bp, Homo sapiens
tctttgatggagagatagatat

SEQ ID NO: 7233047 - DNA, 22 bp, Homo sapiens
tcttggcttctgtatttcctgt

SEQ ID NO: 7233048 - DNA, 22 bp, Homo sapiens
tcttggctttctcctagggatg

SEQ ID NO: 7233049 - DNA, 22 bp, Homo sapiens
tcttggctgtgcatgcatcttc

SEQ ID NO: 7233050 - DNA, 20 bp, Homo sapiens
tcttggctgtgtgaggacac

SEQ ID NO: 7233051 - DNA, 22 bp, Homo sapiens
tcttggctgtaccattgactag

SEQ ID NO: 7233052 - DNA, 22 bp, Homo sapiens
tcttggctgtctttgaagttag

SEQ ID NO: 7233053 - DNA, 22 bp, Homo sapiens
tcttggctgtctttgaagttag

SEQ ID NO: 7233054 - DNA, 22 bp, Homo sapiens
tcttggctggtttcacattacc

SEQ ID NO: 7233055 - DNA, 22 bp, Homo sapiens
tcttggctggtcatttaaaatc

SEQ ID NO: 7233056 - DNA, 23 bp, Homo sapiens
tcttggctggacaagtcactcac

SEQ ID NO: 7233057 - DNA, 22 bp, Homo sapiens
tcttggctgctgccaatttact

SEQ ID NO: 7233058 - DNA, 22 bp, Homo sapiens
tcttggctgctgccaatttact

SEQ ID NO: 7233059 - DNA, 22 bp, Homo sapiens
tcttggctgcgtcctggctgtg

SEQ ID NO: 7233060 - DNA, 22 bp, Homo sapiens
tcttggctgcgtcctggctgtg

SEQ ID NO: 7233061 - DNA, 21 bp, Homo sapiens
tcttggctctgccacttatta

SEQ ID NO: 7233062 - DNA, 22 bp, Homo sapiens
tcttggctgcagagccggcaag

SEQ ID NO: 7233063 - DNA, 22 bp, Homo sapiens
tcttggctgcagagccggcaag

SEQ ID NO: 7233064 - DNA, 22 bp, Homo sapiens
tcttggctgcgtcctggctgtg

SEQ ID NO: 7233065 - DNA, 22 bp, Homo sapiens
tcttggctatccaagttatcca

SEQ ID NO: 7233066 - DNA, 22 bp, Homo sapiens
tcttggctattcttgaattctg

SEQ ID NO: 7233067 - DNA, 22 bp, Homo sapiens
tcttggctcccttgtaggccct

SEQ ID NO: 7233068 - DNA, 22 bp, Homo sapiens
tcttggctcccttgtaggccct

SEQ ID NO: 7233069 - DNA, 22 bp, Homo sapiens
tcttggctcctcacagcatcag

SEQ ID NO: 7233070 - DNA, 22 bp, Homo sapiens
tcttggctcctgttgtcatcag

SEQ ID NO: 7233071 - DNA, 22 bp, Homo sapiens
tcttggctctgccactaattag

SEQ ID NO: 7233072 - DNA, 19 bp, Homo sapiens
tcttggctttgtctactgt

SEQ ID NO: 7233073 - DNA, 22 bp, Homo sapiens
tcttggcttttcccctatggtc

SEQ ID NO: 7233074 - DNA, 22 bp, Homo sapiens
tcttggcttttcccctatggtc

SEQ ID NO: 7233075 - DNA, 22 bp, Homo sapiens
tcttggctttctcctagggatg

SEQ ID NO: 7233076 - DNA, 22 bp, Homo sapiens
tcttggcttttcccctatggtc

SEQ ID NO: 7233077 - DNA, 22 bp, Homo sapiens
tcttgggaaataaacagattga

SEQ ID NO: 7233078 - DNA, 22 bp, Homo sapiens
tcttgggaccatttacacatac

SEQ ID NO: 7233079 - DNA, 22 bp, Homo sapiens
tcttgggaggagcacctgcctg

SEQ ID NO: 7233080 - DNA, 22 bp, Homo sapiens
tcttgggcatgcacagactgca

SEQ ID NO: 7233081 - DNA, 22 bp, Homo sapiens
tcttgggcatgtgtttgatttc

SEQ ID NO: 7233082 - DNA, 22 bp, Homo sapiens
tcttgggcatgtgtttgatttc

SEQ ID NO: 7233083 - DNA, 22 bp, Homo sapiens
tcttgggccaatattctgggta

SEQ ID NO: 7233084 - DNA, 22 bp, Homo sapiens
tcttgggatctcttcaccacct

SEQ ID NO: 7233085 - DNA, 22 bp, Homo sapiens
tcttgggcacgatgggaggctt

SEQ ID NO: 7233086 - DNA, 22 bp, Homo sapiens
tcttgggcacgatgggaggctt

SEQ ID NO: 7233087 - DNA, 22 bp, Homo sapiens
tcttgggcacgatgggaggctt

SEQ ID NO: 7233088 - DNA, 22 bp, Homo sapiens
tctttacttgtgtattgtatat

SEQ ID NO: 7233089 - DNA, 22 bp, Homo sapiens
tctttacatcacaattgtatgg

SEQ ID NO: 7233090 - DNA, 22 bp, Homo sapiens
tctttacatcacaattgtatgg

SEQ ID NO: 7233091 - DNA, 22 bp, Homo sapiens
tctttacatcacaattgtatgg

SEQ ID NO: 7233092 - DNA, 22 bp, Homo sapiens
tctttagaaacttttcttcatg

SEQ ID NO: 7233093 - DNA, 23 bp, Homo sapiens
tctttagaagaacatcagaaatg

SEQ ID NO: 7233094 - DNA, 22 bp, Homo sapiens
tctttagacatccagtttctct

SEQ ID NO: 7233095 - DNA, 22 bp, Homo sapiens
tctttagacatccagtttctct

SEQ ID NO: 7233096 - DNA, 22 bp, Homo sapiens
tctttacagtcctctgtcaatc

SEQ ID NO: 7233097 - DNA, 23 bp, Homo sapiens
tctttacatactgatgagttctc

SEQ ID NO: 7233098 - DNA, 22 bp, Homo sapiens
tctttacacaagacaagaataa

SEQ ID NO: 7233099 - DNA, 22 bp, Homo sapiens
tctttacagtcctctgtcaatc

SEQ ID NO: 7233100 - DNA, 22 bp, Homo sapiens
tctttaatgtactttctttcac

SEQ ID NO: 7233101 - DNA, 22 bp, Homo sapiens
tctttaatgtgattgtaattat

SEQ ID NO: 7233102 - DNA, 22 bp, Homo sapiens
tctttaatcataaccaagatgg

SEQ ID NO: 7233103 - DNA, 22 bp, Homo sapiens
tctttaatgtactttctttcac

SEQ ID NO: 7233104 - DNA, 22 bp, Homo sapiens
tcttgggcctttagacatgact

SEQ ID NO: 7233105 - DNA, 22 bp, Homo sapiens
tcttgggctagaatagcaggag

SEQ ID NO: 7233106 - DNA, 22 bp, Homo sapiens
tcttgggctagaatagcaggag

SEQ ID NO: 7233107 - DNA, 22 bp, Homo sapiens
tcttgggctgagagatggggta

SEQ ID NO: 7233108 - DNA, 22 bp, Homo sapiens
tcttgggctgagagatggggta

SEQ ID NO: 7233109 - DNA, 21 bp, Homo sapiens
tcttggggaggagggctgcac

SEQ ID NO: 7233110 - DNA, 22 bp, Homo sapiens
tctttaatgtgattgtaattat

SEQ ID NO: 7233111 - DNA, 22 bp, Homo sapiens
tctttaattgtggaagagcagc

SEQ ID NO: 7233112 - DNA, 22 bp, Homo sapiens
tctttacaagtcacattttctg

SEQ ID NO: 7233113 - DNA, 22 bp, Homo sapiens
tctttacaatctaagcatagtt

SEQ ID NO: 7233114 - DNA, 22 bp, Homo sapiens
tctttacaatctaagcatagtt

SEQ ID NO: 7233115 - DNA, 22 bp, Homo sapiens
tctttacacaagacaagaataa

SEQ ID NO: 7233116 - DNA, 22 bp, Homo sapiens
tctttacacaagacaagaataa

SEQ ID NO: 7233117 - DNA, 22 bp, Homo sapiens
tctttacacaagacaagaataa

SEQ ID NO: 7233118 - DNA, 22 bp, Homo sapiens
tcttggctagtaccttcctgcc

SEQ ID NO: 7233119 - DNA, 22 bp, Homo sapiens
tcttggctacttaggaggattc

SEQ ID NO: 7233120 - DNA, 22 bp, Homo sapiens
tcttggctactttcctgtctgc

SEQ ID NO: 7233121 - DNA, 22 bp, Homo sapiens
tcttggctactttcctgtctgc

SEQ ID NO: 7233122 - DNA, 22 bp, Homo sapiens
tcttggccccaaccctctattt

SEQ ID NO: 7233123 - DNA, 22 bp, Homo sapiens
tcttggccccacctgtgccagc

SEQ ID NO: 7233124 - DNA, 21 bp, Homo sapiens
tcttggcctaagttcactgaa

SEQ ID NO: 7233125 - DNA, 22 bp, Homo sapiens
tcttggctacttaggaggattc

SEQ ID NO: 7233126 - DNA, 22 bp, Homo sapiens
tcttggccagatgcacttcctc

SEQ ID NO: 7233127 - DNA, 22 bp, Homo sapiens
tcttggccaggtgtggtgcctc

SEQ ID NO: 7233128 - DNA, 22 bp, Homo sapiens
tcttggccaggtgtggtgcctc

SEQ ID NO: 7233129 - DNA, 18 bp, Homo sapiens
tcttggcagcatctggca

SEQ ID NO: 7233130 - DNA, 18 bp, Homo sapiens
tcttggcagcatctggca

SEQ ID NO: 7233131 - DNA, 22 bp, Homo sapiens
tcttggcaagtggcagattctt

SEQ ID NO: 7233132 - DNA, 22 bp, Homo sapiens
tcttggattttaatggatcaaa

SEQ ID NO: 7233133 - DNA, 20 bp, Homo sapiens
tcttggcaaatgggagtgtc

SEQ ID NO: 7233134 - DNA, 20 bp, Homo sapiens
tcttggcaaatgggagtgtc

SEQ ID NO: 7233135 - DNA, 22 bp, Homo sapiens
tcttggcagtggaataccagga

SEQ ID NO: 7233136 - DNA, 22 bp, Homo sapiens
tcttggcagttcttgtgctttt

SEQ ID NO: 7233137 - DNA, 22 bp, Homo sapiens
tcttggcatgcatgggcaatca

SEQ ID NO: 7233138 - DNA, 22 bp, Homo sapiens
tcttggccactaccacctggag

SEQ ID NO: 7233139 - DNA, 22 bp, Homo sapiens
tcttggccactaccacctggag

SEQ ID NO: 7233140 - DNA, 22 bp, Homo sapiens
tcttggaacttattattgtaga

SEQ ID NO: 7233141 - DNA, 22 bp, Homo sapiens
tcttggaagtagaacacagtct

SEQ ID NO: 7233142 - DNA, 22 bp, Homo sapiens
tcttggactagtcctaaatcca

SEQ ID NO: 7233143 - DNA, 22 bp, Homo sapiens
tcttggagaagggattgtgctc

SEQ ID NO: 7233144 - DNA, 22 bp, Homo sapiens
tcttggagagccacccagtggc

SEQ ID NO: 7233145 - DNA, 20 bp, Homo sapiens
tcttggagagggtggactta

SEQ ID NO: 7233146 - DNA, 22 bp, Homo sapiens
tcttggagatagggtcttaatg

SEQ ID NO: 7233147 - DNA, 22 bp, Homo sapiens
tcttggagatgaccaggcatgc

SEQ ID NO: 7233148 - DNA, 20 bp, Homo sapiens
tcttggagctctttgtcctc

SEQ ID NO: 7233149 - DNA, 22 bp, Homo sapiens
tcttggaggagagtaagtacct

SEQ ID NO: 7233150 - DNA, 22 bp, Homo sapiens
tcttggagtattgggcctcagg

SEQ ID NO: 7233151 - DNA, 22 bp, Homo sapiens
tcttggagtattgggcctcagg

SEQ ID NO: 7233152 - DNA, 18 bp, Homo sapiens
tcttggagtaatgatcaa

SEQ ID NO: 7233153 - DNA, 22 bp, Homo sapiens
tcttggattttaatggatcaaa

SEQ ID NO: 7233154 - DNA, 22 bp, Homo sapiens
tcttggattttaatggatcaaa

SEQ ID NO: 7233155 - DNA, 22 bp, Homo sapiens
tcttgaattgtactcccataag

SEQ ID NO: 7233156 - DNA, 22 bp, Homo sapiens
tcttgacaactatactacttac

SEQ ID NO: 7233157 - DNA, 22 bp, Homo sapiens
tcttgaataagtttcatgagct

SEQ ID NO: 7233158 - DNA, 22 bp, Homo sapiens
tcttgaattgtactcccataag

SEQ ID NO: 7233159 - DNA, 22 bp, Homo sapiens
tcttgaattgtactcccataag

SEQ ID NO: 7233160 - DNA, 22 bp, Homo sapiens
tcttgaattgtactcccataag

SEQ ID NO: 7233161 - DNA, 22 bp, Homo sapiens
tcttgacattcaatcatgtata

SEQ ID NO: 7233162 - DNA, 22 bp, Homo sapiens
tcttgacattgcaatcttcaga

SEQ ID NO: 7233163 - DNA, 22 bp, Homo sapiens
tcttgacattgttgttagcagg

SEQ ID NO: 7233164 - DNA, 22 bp, Homo sapiens
tcttgacattgttgttagcagg

SEQ ID NO: 7233165 - DNA, 22 bp, Homo sapiens
tcttgagaaataattaaacatg

SEQ ID NO: 7233166 - DNA, 22 bp, Homo sapiens
tcttgagaaataattaaacatg

SEQ ID NO: 7233167 - DNA, 22 bp, Homo sapiens
tcttgaaagtatcttattttgt

SEQ ID NO: 7233168 - DNA, 22 bp, Homo sapiens
tcttgaaaggagattggaggca

SEQ ID NO: 7233169 - DNA, 22 bp, Homo sapiens
tcttgaagaggaagtggagtag

SEQ ID NO: 7233170 - DNA, 22 bp, Homo sapiens
tcttgaagtccttacatttgat

SEQ ID NO: 7233171 - DNA, 22 bp, Homo sapiens
tcttgaataagtttcatgagct

SEQ ID NO: 7233172 - DNA, 22 bp, Homo sapiens
tcttgctgttacagaattaaca

SEQ ID NO: 7233173 - DNA, 22 bp, Homo sapiens
tcttgctgttacagaattaaca

SEQ ID NO: 7233174 - DNA, 22 bp, Homo sapiens
tcttgctgttacagaattaaca

SEQ ID NO: 7233175 - DNA, 22 bp, Homo sapiens
tcttgctgtgtattgcatctcc

SEQ ID NO: 7233176 - DNA, 22 bp, Homo sapiens
tcttgctgtgtattgcatctcc

SEQ ID NO: 7233177 - DNA, 20 bp, Homo sapiens
tcttggaaaaagttcagaat

SEQ ID NO: 7233178 - DNA, 22 bp, Homo sapiens
tcttggaaccctatgtgatttc

SEQ ID NO: 7233179 - DNA, 22 bp, Homo sapiens
tcttgctaaagaccaacacatt

SEQ ID NO: 7233180 - DNA, 22 bp, Homo sapiens
tcttgctgaaaacaaatctctt

SEQ ID NO: 7233181 - DNA, 22 bp, Homo sapiens
tcttgctgagactggcaagttt

SEQ ID NO: 7233182 - DNA, 22 bp, Homo sapiens
tcttgctgctgtccacacagta

SEQ ID NO: 7233183 - DNA, 22 bp, Homo sapiens
tcttgctgtacggctacttgca

SEQ ID NO: 7233184 - DNA, 22 bp, Homo sapiens
tcttgctgtacggctacttgca

SEQ ID NO: 7233185 - DNA, 22 bp, Homo sapiens
tcttgctgtgccccagcagggc

SEQ ID NO: 7233186 - DNA, 22 bp, Homo sapiens
tcttgatttactctaatagctt

SEQ ID NO: 7233187 - DNA, 22 bp, Homo sapiens
tcttgagatcaagacacaggga

SEQ ID NO: 7233188 - DNA, 22 bp, Homo sapiens
tcttgagagatatactactgaa

SEQ ID NO: 7233189 - DNA, 22 bp, Homo sapiens
tcttgagatcaagacacaggga

SEQ ID NO: 7233190 - DNA, 19 bp, Homo sapiens
tcttgaggaaagtaaggca

SEQ ID NO: 7233191 - DNA, 22 bp, Homo sapiens
tcttgagctgagtcagttcctg

SEQ ID NO: 7233192 - DNA, 22 bp, Homo sapiens
tcttgagctttatccagtttct

SEQ ID NO: 7233193 - DNA, 22 bp, Homo sapiens
tcttgaggtcatcatctgaaac

SEQ ID NO: 7233194 - DNA, 22 bp, Homo sapiens
tctgggggaggaggcatggccc

SEQ ID NO: 7233195 - DNA, 22 bp, Homo sapiens
tctggggcagttactggggcct

SEQ ID NO: 7233196 - DNA, 22 bp, Homo sapiens
tctggggcagttactggggcct

SEQ ID NO: 7233197 - DNA, 22 bp, Homo sapiens
tctggggatgagtgatgtcgta

SEQ ID NO: 7233198 - DNA, 22 bp, Homo sapiens
tctggggatgagtgatgtcgta

SEQ ID NO: 7233199 - DNA, 20 bp, Homo sapiens
tctggggatgaggtctagga

SEQ ID NO: 7233200 - DNA, 22 bp, Homo sapiens
tctggggatggtctactttctg

SEQ ID NO: 7233201 - DNA, 22 bp, Homo sapiens
tctggggcagttactggggcct

SEQ ID NO: 7233202 - DNA, 20 bp, Homo sapiens
tctggggatgaggtctagga

SEQ ID NO: 7233203 - DNA, 22 bp, Homo sapiens
tctgggcttttccatgcctgtg

SEQ ID NO: 7233204 - DNA, 20 bp, Homo sapiens
tctggggatgaggtctagga

SEQ ID NO: 7233205 - DNA, 22 bp, Homo sapiens
tctgggggaggaggcatggccc

SEQ ID NO: 7233206 - DNA, 22 bp, Homo sapiens
tctgggggaggaggcatggccc

SEQ ID NO: 7233207 - DNA, 22 bp, Homo sapiens
tctgggggaggaggcatggccc

SEQ ID NO: 7233208 - DNA, 22 bp, Homo sapiens
tctgggggcgaccagggactgc

SEQ ID NO: 7233209 - DNA, 22 bp, Homo sapiens
tctgggggcgaccagggactgc

SEQ ID NO: 7233210 - DNA, 22 bp, Homo sapiens
tctgggggcgaccagggactgc

SEQ ID NO: 7233211 - DNA, 21 bp, Homo sapiens
tctgggggtgagcctagaaat

SEQ ID NO: 7233212 - DNA, 21 bp, Homo sapiens
tctgggggtgagcctagaaat

SEQ ID NO: 7233213 - DNA, 22 bp, Homo sapiens
tctgggggttaagtgaggacaa

SEQ ID NO: 7233214 - DNA, 22 bp, Homo sapiens
tctgggctttacactgtgctta

SEQ ID NO: 7233215 - DNA, 21 bp, Homo sapiens
tctgggctttcttataaggca

SEQ ID NO: 7233216 - DNA, 22 bp, Homo sapiens
tctgggctttgtaatgggaggt

SEQ ID NO: 7233217 - DNA, 22 bp, Homo sapiens
tctgggctttgtaatgggaggt

SEQ ID NO: 7233218 - DNA, 22 bp, Homo sapiens
tctgggcttggttagggctgtt

SEQ ID NO: 7233219 - DNA, 22 bp, Homo sapiens
tctgggcttggttagggctgtt

SEQ ID NO: 7233220 - DNA, 22 bp, Homo sapiens
tctgggcttggttagggctgtt

SEQ ID NO: 7233221 - DNA, 22 bp, Homo sapiens
tctgggctgtggttccactccg

SEQ ID NO: 7233222 - DNA, 17 bp, Homo sapiens
tctgggcttcagtggtc

SEQ ID NO: 7233223 - DNA, 20 bp, Homo sapiens
tctgggcttcccccagctcc

SEQ ID NO: 7233224 - DNA, 20 bp, Homo sapiens
tctgggcttcccccagctcc

SEQ ID NO: 7233225 - DNA, 20 bp, Homo sapiens
tctgggcttcccccagctcc

SEQ ID NO: 7233226 - DNA, 20 bp, Homo sapiens
tctgggcttcccccagctcc

SEQ ID NO: 7233227 - DNA, 18 bp, Homo sapiens
tctgggcttcccgaggct

SEQ ID NO: 7233228 - DNA, 18 bp, Homo sapiens
tctgggcttcccgaggct

SEQ ID NO: 7233229 - DNA, 18 bp, Homo sapiens
tctgggcttcccgaggct

SEQ ID NO: 7233230 - DNA, 22 bp, Homo sapiens
tctgggcttgcctggttgtgca

SEQ ID NO: 7233231 - DNA, 22 bp, Homo sapiens
tctgggcttggattggctctgc

SEQ ID NO: 7233232 - DNA, 22 bp, Homo sapiens
tctgggcttggattggctctgc

SEQ ID NO: 7233233 - DNA, 22 bp, Homo sapiens
tctgggcttggattggctctgc

SEQ ID NO: 7233234 - DNA, 22 bp, Homo sapiens
tctgggctggttgtgcttgctt

SEQ ID NO: 7233235 - DNA, 22 bp, Homo sapiens
tctgggctggttgtgcttgctt

SEQ ID NO: 7233236 - DNA, 22 bp, Homo sapiens
tctgggctgtctacaggttggc

SEQ ID NO: 7233237 - DNA, 22 bp, Homo sapiens
tctgggctgcttcagccttcgc

SEQ ID NO: 7233238 - DNA, 22 bp, Homo sapiens
tctgggctgcttcagccttcgc

SEQ ID NO: 7233239 - DNA, 22 bp, Homo sapiens
tctgggctggctttatgctgac

SEQ ID NO: 7233240 - DNA, 22 bp, Homo sapiens
tctgggctgggagcgtgtggac

SEQ ID NO: 7233241 - DNA, 22 bp, Homo sapiens
tctgggctgggagcgtgtggac

SEQ ID NO: 7233242 - DNA, 22 bp, Homo sapiens
tctgggctgggcttaggaaccc

SEQ ID NO: 7233243 - DNA, 22 bp, Homo sapiens
tctgggctgggcttaggaaccc

SEQ ID NO: 7233244 - DNA, 22 bp, Homo sapiens
tctggggtggagccctggagtc

SEQ ID NO: 7233245 - DNA, 22 bp, Homo sapiens
tctggggtggagccctggagtc

SEQ ID NO: 7233246 - DNA, 22 bp, Homo sapiens
tctggggtgtgacctgagcatg

SEQ ID NO: 7233247 - DNA, 22 bp, Homo sapiens
tctggggtgtgacctgagcatg

SEQ ID NO: 7233248 - DNA, 18 bp, Homo sapiens
tctggggtgtgctgtgta

SEQ ID NO: 7233249 - DNA, 19 bp, Homo sapiens
tctggggtgtggcctggca

SEQ ID NO: 7233250 - DNA, 19 bp, Homo sapiens
tctggggtgtggcctggca

SEQ ID NO: 7233251 - DNA, 19 bp, Homo sapiens
tctggggtgtggcctggca

SEQ ID NO: 7233252 - DNA, 22 bp, Homo sapiens
tctggggttaagcccaggaatg

SEQ ID NO: 7233253 - DNA, 21 bp, Homo sapiens
tctgggggtgagcctagaaat

SEQ ID NO: 7233254 - DNA, 22 bp, Homo sapiens
tctgggggttaagtgaggacaa

SEQ ID NO: 7233255 - DNA, 22 bp, Homo sapiens
tctgggggttaagtgaggacaa

SEQ ID NO: 7233256 - DNA, 22 bp, Homo sapiens
tctgggggttaagtgaggacaa

SEQ ID NO: 7233257 - DNA, 22 bp, Homo sapiens
tctggggtcacctggggtgctt

SEQ ID NO: 7233258 - DNA, 22 bp, Homo sapiens
tctggggtcacctggggtgctt

SEQ ID NO: 7233259 - DNA, 22 bp, Homo sapiens
tctggggtcacctggggtgctt

SEQ ID NO: 7233260 - DNA, 22 bp, Homo sapiens
tctgggggttaagtgaggacaa

SEQ ID NO: 7233261 - DNA, 20 bp, Homo sapiens
tctggggtgaagcccaggaa

SEQ ID NO: 7233262 - DNA, 20 bp, Homo sapiens
tctggggtgaagcccaggaa

SEQ ID NO: 7233263 - DNA, 22 bp, Homo sapiens
tctggggtgaggcctggttatc

SEQ ID NO: 7233264 - DNA, 22 bp, Homo sapiens
tctggggtgcagcctaggcatc

SEQ ID NO: 7233265 - DNA, 22 bp, Homo sapiens
tctggggtgcagcctaggcatc

SEQ ID NO: 7233266 - DNA, 22 bp, Homo sapiens
tctggggtgcagcctggacata

SEQ ID NO: 7233267 - DNA, 22 bp, Homo sapiens
tctggggtgcagcctggacata

SEQ ID NO: 7233268 - DNA, 22 bp, Homo sapiens
tctgggtctttacccatggaat

SEQ ID NO: 7233269 - DNA, 22 bp, Homo sapiens
tctgggtctcagagtgaccatg

SEQ ID NO: 7233270 - DNA, 22 bp, Homo sapiens
tctgggtctatgatctcacttc

SEQ ID NO: 7233271 - DNA, 22 bp, Homo sapiens
tctggggttaagcccaggaatg

SEQ ID NO: 7233272 - DNA, 22 bp, Homo sapiens
tctggggttgagtctgggtcag

SEQ ID NO: 7233273 - DNA, 22 bp, Homo sapiens
tctggggttgagtctgggtcag

SEQ ID NO: 7233274 - DNA, 22 bp, Homo sapiens
tctgggtgccactgtctgtaca

SEQ ID NO: 7233275 - DNA, 22 bp, Homo sapiens
tctgggtgaccctgggcaaggc

SEQ ID NO: 7233276 - DNA, 22 bp, Homo sapiens
tctgggtgagctgcctcgggtc

SEQ ID NO: 7233277 - DNA, 22 bp, Homo sapiens
tctgggtgagctgcctcgggtc

SEQ ID NO: 7233278 - DNA, 22 bp, Homo sapiens
tctgggtgctacaaacagtatt

SEQ ID NO: 7233279 - DNA, 21 bp, Homo sapiens
tctgggtgctagtgtttgctt

SEQ ID NO: 7233280 - DNA, 22 bp, Homo sapiens
tctgggtggcagtgatggcgtg

SEQ ID NO: 7233281 - DNA, 22 bp, Homo sapiens
tctgggtggctgccaatctgcc

SEQ ID NO: 7233282 - DNA, 22 bp, Homo sapiens
tctgggtggcttcagaggccac

SEQ ID NO: 7233283 - DNA, 22 bp, Homo sapiens
tctgggtgggcccgagaaatct

SEQ ID NO: 7233284 - DNA, 22 bp, Homo sapiens
tctgggtggtgtcttccaagac

SEQ ID NO: 7233285 - DNA, 20 bp, Homo sapiens
tctgggttgaaatcaagatc

SEQ ID NO: 7233286 - DNA, 22 bp, Homo sapiens
tctgggtgtagggcctggcaac

SEQ ID NO: 7233287 - DNA, 22 bp, Homo sapiens
tctgggtgtagggcctggcaac

SEQ ID NO: 7233288 - DNA, 22 bp, Homo sapiens
tctgtaaaacttctttgtaaat

SEQ ID NO: 7233289 - DNA, 22 bp, Homo sapiens
tctgtaaaattagtataattgt

SEQ ID NO: 7233290 - DNA, 22 bp, Homo sapiens
tctgtaaacaccatgttagagt

SEQ ID NO: 7233291 - DNA, 22 bp, Homo sapiens
tctgtaaacaccatgttagagt

SEQ ID NO: 7233292 - DNA, 22 bp, Homo sapiens
tctgtaaaacaatattgtattc

SEQ ID NO: 7233293 - DNA, 22 bp, Homo sapiens
tctgtaaaacttctttgtaaat

SEQ ID NO: 7233294 - DNA, 22 bp, Homo sapiens
tctgtaaaacaatattgtattc

SEQ ID NO: 7233295 - DNA, 22 bp, Homo sapiens
tctgtaaaacaatattgtattc

SEQ ID NO: 7233296 - DNA, 22 bp, Homo sapiens
tctgtaaaacaatattgtattc

SEQ ID NO: 7233297 - DNA, 22 bp, Homo sapiens
tctgggttgggttcctggaatt

SEQ ID NO: 7233298 - DNA, 22 bp, Homo sapiens
tctggtttcccagttcctccgt

SEQ ID NO: 7233299 - DNA, 17 bp, Homo sapiens
tctgggtttaaatccca

SEQ ID NO: 7233300 - DNA, 22 bp, Homo sapiens
tctgtctctcaagggccgtcct

SEQ ID NO: 7233301 - DNA, 21 bp, Homo sapiens
tctgtctctccactgccctgc

SEQ ID NO: 7233302 - DNA, 21 bp, Homo sapiens
tctgtctctccactgccctgc

SEQ ID NO: 7233303 - DNA, 22 bp, Homo sapiens
tctgtctcctgccagtgcctct

SEQ ID NO: 7233304 - DNA, 22 bp, Homo sapiens
tctgtctcctgccagtgcctct

SEQ ID NO: 7233305 - DNA, 18 bp, Homo sapiens
tctgtctctgtccttgct

SEQ ID NO: 7233306 - DNA, 18 bp, Homo sapiens
tctgtctctgtccttgct

SEQ ID NO: 7233307 - DNA, 22 bp, Homo sapiens
tctgtctctttgttctgtgagt

SEQ ID NO: 7233308 - DNA, 23 bp, Homo sapiens
tctgtctgaataatttactcttt

SEQ ID NO: 7233309 - DNA, 23 bp, Homo sapiens
tctgtctgaataatttactcttt

SEQ ID NO: 7233310 - DNA, 23 bp, Homo sapiens
tctgtctgaataatttactcttt

SEQ ID NO: 7233311 - DNA, 22 bp, Homo sapiens
tctgtctgacagggtatgaact

SEQ ID NO: 7233312 - DNA, 22 bp, Homo sapiens
tctgtctgactaccatgaggca

SEQ ID NO: 7233313 - DNA, 22 bp, Homo sapiens
tctgtctcctcagatgactcca

SEQ ID NO: 7233314 - DNA, 22 bp, Homo sapiens
tctgtctcctctgaggtgccag

SEQ ID NO: 7233315 - DNA, 22 bp, Homo sapiens
tctgtctcctctgaggtgccag

SEQ ID NO: 7233316 - DNA, 18 bp, Homo sapiens
tctgtccttccattcttc

SEQ ID NO: 7233317 - DNA, 20 bp, Homo sapiens
tctgtcctttctgctaaggc

SEQ ID NO: 7233318 - DNA, 22 bp, Homo sapiens
tctgtcctgtttcctcctgaca

SEQ ID NO: 7233319 - DNA, 18 bp, Homo sapiens
tctgtccttccattcttc

SEQ ID NO: 7233320 - DNA, 22 bp, Homo sapiens
tctgtcctgtttcctcctgaca

SEQ ID NO: 7233321 - DNA, 22 bp, Homo sapiens
tctgtcctgtttcctcctgaca

SEQ ID NO: 7233322 - DNA, 22 bp, Homo sapiens
tctgtcctctccctgaccacaa

SEQ ID NO: 7233323 - DNA, 22 bp, Homo sapiens
tctgtcctccggagctcccagt

SEQ ID NO: 7233324 - DNA, 22 bp, Homo sapiens
tctgtcctccggagctcccagt

SEQ ID NO: 7233325 - DNA, 22 bp, Homo sapiens
tctgtcctccggagctcccagt

SEQ ID NO: 7233326 - DNA, 22 bp, Homo sapiens
tctgtcctccggagctcccagt

SEQ ID NO: 7233327 - DNA, 22 bp, Homo sapiens
tctgtcctccggagctcccagt

SEQ ID NO: 7233328 - DNA, 22 bp, Homo sapiens
tctgtccatttacagatatgca

SEQ ID NO: 7233329 - DNA, 22 bp, Homo sapiens
tctgtccatttacagatatgca

SEQ ID NO: 7233330 - DNA, 22 bp, Homo sapiens
tctgtccatttggagttggaag

SEQ ID NO: 7233331 - DNA, 22 bp, Homo sapiens
tctgtccatttggagttggaag

SEQ ID NO: 7233332 - DNA, 22 bp, Homo sapiens
tctgtccctgagagctcaggag

SEQ ID NO: 7233333 - DNA, 22 bp, Homo sapiens
tctgtccctgagagctcaggag

SEQ ID NO: 7233334 - DNA, 22 bp, Homo sapiens
tctgtccctgagagctcaggag

SEQ ID NO: 7233335 - DNA, 22 bp, Homo sapiens
tctgtccaggtcagcctacatt

SEQ ID NO: 7233336 - DNA, 22 bp, Homo sapiens
tctgtccaggtcagcctacatt

SEQ ID NO: 7233337 - DNA, 17 bp, Homo sapiens
tctgtccagggagtgtg

SEQ ID NO: 7233338 - DNA, 22 bp, Homo sapiens
tctgtccagtgccagtgaagac

SEQ ID NO: 7233339 - DNA, 22 bp, Homo sapiens
tctgtccagtgccagtgaagac

SEQ ID NO: 7233340 - DNA, 22 bp, Homo sapiens
tctgtccagtggctctcaggga

SEQ ID NO: 7233341 - DNA, 22 bp, Homo sapiens
tctgtccatctcttgggagtga

SEQ ID NO: 7233342 - DNA, 22 bp, Homo sapiens
tctgtccatctcttgggagtga

SEQ ID NO: 7233343 - DNA, 22 bp, Homo sapiens
tctgtccatgcctggaggagag

SEQ ID NO: 7233344 - DNA, 22 bp, Homo sapiens
tctgtccatgcctggaggagag

SEQ ID NO: 7233345 - DNA, 22 bp, Homo sapiens
tctgtccatgcttttctctcac

SEQ ID NO: 7233346 - DNA, 22 bp, Homo sapiens
tctgtccatgcttttctctcac

SEQ ID NO: 7233347 - DNA, 22 bp, Homo sapiens
tctgtccatgtgaggttctctg

SEQ ID NO: 7233348 - DNA, 22 bp, Homo sapiens
tctgtccattcagaatggccct

SEQ ID NO: 7233349 - DNA, 22 bp, Homo sapiens
tctgtccattcagccatccatc

SEQ ID NO: 7233350 - DNA, 22 bp, Homo sapiens
tctgtccattcagccatccatc

SEQ ID NO: 7233351 - DNA, 22 bp, Homo sapiens
tctgtccagaggtcctggagac

SEQ ID NO: 7233352 - DNA, 22 bp, Homo sapiens
tctgtccagctctcaggagaca

SEQ ID NO: 7233353 - DNA, 22 bp, Homo sapiens
tctgtccaagacaccatagtgg

SEQ ID NO: 7233354 - DNA, 22 bp, Homo sapiens
tctgtccacaagcacaggctct

SEQ ID NO: 7233355 - DNA, 20 bp, Homo sapiens
tctgtccaccagcctcgcct

SEQ ID NO: 7233356 - DNA, 18 bp, Homo sapiens
tctgtccaccctgtgctg

SEQ ID NO: 7233357 - DNA, 23 bp, Homo sapiens
tctgtccaccgcatgcagcggcc

SEQ ID NO: 7233358 - DNA, 22 bp, Homo sapiens
tctgtcatctctaaaatagaaa

SEQ ID NO: 7233359 - DNA, 22 bp, Homo sapiens
tctgtcacccaggctggagtgc

SEQ ID NO: 7233360 - DNA, 22 bp, Homo sapiens
tctgtcacccaggctggagtgc

SEQ ID NO: 7233361 - DNA, 22 bp, Homo sapiens
tctgtcacaatttgcttactct

SEQ ID NO: 7233362 - DNA, 22 bp, Homo sapiens
tctgtcaccattcagcttgaat

SEQ ID NO: 7233363 - DNA, 22 bp, Homo sapiens
tctgtcacaagtaatccttttc

SEQ ID NO: 7233364 - DNA, 22 bp, Homo sapiens
tctgtattgagaaagccggaca

SEQ ID NO: 7233365 - DNA, 22 bp, Homo sapiens
tctgtatatattaatgaaattc

SEQ ID NO: 7233366 - DNA, 22 bp, Homo sapiens
tctgtatctaattttacagtag

SEQ ID NO: 7233367 - DNA, 20 bp, Homo sapiens
tctgtagtctgtggcaagac

SEQ ID NO: 7233368 - DNA, 22 bp, Homo sapiens
tctgtagtttacagtatttcag

SEQ ID NO: 7233369 - DNA, 22 bp, Homo sapiens
tctgtagtttacagtatttcag

SEQ ID NO: 7233370 - DNA, 21 bp, Homo sapiens
tctgtagatctgagtctgtct

SEQ ID NO: 7233371 - DNA, 21 bp, Homo sapiens
tctgtactttgcttccatgct

SEQ ID NO: 7233372 - DNA, 21 bp, Homo sapiens
tctgtactttgcttccatgct

SEQ ID NO: 7233373 - DNA, 22 bp, Homo sapiens
tctgtacttttattttggcact

SEQ ID NO: 7233374 - DNA, 22 bp, Homo sapiens
tctgtacttacaacggagttca

SEQ ID NO: 7233375 - DNA, 22 bp, Homo sapiens
tctgtacttcctttaaacttta

SEQ ID NO: 7233376 - DNA, 22 bp, Homo sapiens
tctgtacttgttagtcttcatg

SEQ ID NO: 7233377 - DNA, 22 bp, Homo sapiens
tctgtactttacatgcagtgct

SEQ ID NO: 7233378 - DNA, 22 bp, Homo sapiens
tctgtacatttggggaccccag

SEQ ID NO: 7233379 - DNA, 22 bp, Homo sapiens
tctgtacatttgtgttgtgaat

SEQ ID NO: 7233380 - DNA, 22 bp, Homo sapiens
tctgtactgagcatggtgctta

SEQ ID NO: 7233381 - DNA, 22 bp, Homo sapiens
tctgtagcaagtgagaggcatt

SEQ ID NO: 7233382 - DNA, 22 bp, Homo sapiens
tctgtagcatcttaaatgtagt

SEQ ID NO: 7233383 - DNA, 22 bp, Homo sapiens
tctgtagcattcaccagccctg

SEQ ID NO: 7233384 - DNA, 22 bp, Homo sapiens
tctgtagcttcttgagaggcca

SEQ ID NO: 7233385 - DNA, 20 bp, Homo sapiens
tctgtaggcaagttagcagg

SEQ ID NO: 7233386 - DNA, 22 bp, Homo sapiens
tctgtaggggccggcggagccc

SEQ ID NO: 7233387 - DNA, 22 bp, Homo sapiens
tctgtaggttaaaagtagacaa

SEQ ID NO: 7233388 - DNA, 22 bp, Homo sapiens
tctgtagtaggttgtagttctt

SEQ ID NO: 7233389 - DNA, 22 bp, Homo sapiens
tctgtagtaggttgtagttctt

SEQ ID NO: 7233390 - DNA, 22 bp, Homo sapiens
tctgtagtaggttgtagttctt

SEQ ID NO: 7233391 - DNA, 22 bp, Homo sapiens
tctgtagtaggttgtagttctt

SEQ ID NO: 7233392 - DNA, 22 bp, Homo sapiens
tctgtagtaggttgtagttctt

SEQ ID NO: 7233393 - DNA, 22 bp, Homo sapiens
tctgtacagtaccagatagtaa

SEQ ID NO: 7233394 - DNA, 22 bp, Homo sapiens
tctgtacacttcagcatgcatc

SEQ ID NO: 7233395 - DNA, 22 bp, Homo sapiens
tctgtacagtaccagatagtaa

SEQ ID NO: 7233396 - DNA, 22 bp, Homo sapiens
tctgtacagtaccagatagtaa

SEQ ID NO: 7233397 - DNA, 21 bp, Homo sapiens
tctgtacatcattgagtcccc

SEQ ID NO: 7233398 - DNA, 21 bp, Homo sapiens
tctgtacatcattgagtcccc

SEQ ID NO: 7233399 - DNA, 22 bp, Homo sapiens
tctgtacatgagttgagaatca

SEQ ID NO: 7233400 - DNA, 22 bp, Homo sapiens
tctgtacatgagttgagaatca

SEQ ID NO: 7233401 - DNA, 23 bp, Homo sapiens
tctgtacaattgagaagagaaca

SEQ ID NO: 7233402 - DNA, 23 bp, Homo sapiens
tctgtacacatcagcatctccca

SEQ ID NO: 7233403 - DNA, 22 bp, Homo sapiens
tctgtacaccaggggccattct

SEQ ID NO: 7233404 - DNA, 20 bp, Homo sapiens
tctgtacactcatcttctgc

SEQ ID NO: 7233405 - DNA, 20 bp, Homo sapiens
tctgtacactcatcttctgc

SEQ ID NO: 7233406 - DNA, 22 bp, Homo sapiens
tctgtaaatctactaagagctc

SEQ ID NO: 7233407 - DNA, 22 bp, Homo sapiens
tctgtaatcaagatatttgaga

SEQ ID NO: 7233408 - DNA, 22 bp, Homo sapiens
tctgtaatcaagatatttgaga

SEQ ID NO: 7233409 - DNA, 22 bp, Homo sapiens
tctgtaatcttccccagctcag

SEQ ID NO: 7233410 - DNA, 22 bp, Homo sapiens
tctgtacaaaggctatttggag

SEQ ID NO: 7233411 - DNA, 22 bp, Homo sapiens
tctgtacaaaggctatttggag

SEQ ID NO: 7233412 - DNA, 22 bp, Homo sapiens
tctgtacaacaaagggatgaga

SEQ ID NO: 7233413 - DNA, 22 bp, Homo sapiens
tctgtaaagtctgtgtaaagtc

SEQ ID NO: 7233414 - DNA, 22 bp, Homo sapiens
tctgtaaagccctggtacctgg

SEQ ID NO: 7233415 - DNA, 20 bp, Homo sapiens
tctgtaaagactccagaagc

SEQ ID NO: 7233416 - DNA, 22 bp, Homo sapiens
tctgtaaagactccaaaagcca

SEQ ID NO: 7233417 - DNA, 22 bp, Homo sapiens
tctgtaaagactccaaaagcca

SEQ ID NO: 7233418 - DNA, 22 bp, Homo sapiens
tctgtaaacaccatgttagagt

SEQ ID NO: 7233419 - DNA, 22 bp, Homo sapiens
tctgtaaacacccgtaagcttt

SEQ ID NO: 7233420 - DNA, 22 bp, Homo sapiens
tctgttgtctgcaattctggga

SEQ ID NO: 7233421 - DNA, 22 bp, Homo sapiens
tctgtttaatgggaatgatact

SEQ ID NO: 7233422 - DNA, 22 bp, Homo sapiens
tctgttgcatatgctgctgggt

SEQ ID NO: 7233423 - DNA, 22 bp, Homo sapiens
tctgttgcaatgtgcatggtga

SEQ ID NO: 7233424 - DNA, 22 bp, Homo sapiens
tctgttgcaatgtgcatggtga

SEQ ID NO: 7233425 - DNA, 22 bp, Homo sapiens
tctgtttaatgggaatgatact

SEQ ID NO: 7233426 - DNA, 22 bp, Homo sapiens
tctgtttagactcagttgaaac

SEQ ID NO: 7233427 - DNA, 22 bp, Homo sapiens
tctgtttagatgctttatctgt

SEQ ID NO: 7233428 - DNA, 22 bp, Homo sapiens
tctgtttatatttcaaaccttc

SEQ ID NO: 7233429 - DNA, 22 bp, Homo sapiens
tctgtttatgcatatttaaaac

SEQ ID NO: 7233430 - DNA, 22 bp, Homo sapiens
tctgtttatgcatatttaaaac

SEQ ID NO: 7233431 - DNA, 22 bp, Homo sapiens
tctgtttatgtgtctaaataaa

SEQ ID NO: 7233432 - DNA, 22 bp, Homo sapiens
tctgttgcaatgtgcatggtga

SEQ ID NO: 7233433 - DNA, 22 bp, Homo sapiens
tctgttgcaatgtgcatggtga

SEQ ID NO: 7233434 - DNA, 23 bp, Homo sapiens
tctgttcttttagctgatcattt

SEQ ID NO: 7233435 - DNA, 22 bp, Homo sapiens
tctgttgactcctagcagccat

SEQ ID NO: 7233436 - DNA, 22 bp, Homo sapiens
tctgttctttagcctgcttgag

SEQ ID NO: 7233437 - DNA, 22 bp, Homo sapiens
tctgttctttccaacaagacag

SEQ ID NO: 7233438 - DNA, 22 bp, Homo sapiens
tctgttgactcctagcagccat

SEQ ID NO: 7233439 - DNA, 22 bp, Homo sapiens
tctgttgactcctagcagccat

SEQ ID NO: 7233440 - DNA, 22 bp, Homo sapiens
tctgttattctgtctattgcca

SEQ ID NO: 7233441 - DNA, 22 bp, Homo sapiens
tctgttcttggtgcagctggga

SEQ ID NO: 7233442 - DNA, 22 bp, Homo sapiens
tctgttcttgtccccacttcag

SEQ ID NO: 7233443 - DNA, 22 bp, Homo sapiens
tctgttatggaagtttcctttt

SEQ ID NO: 7233444 - DNA, 22 bp, Homo sapiens
tctgttatatagataatgtgtg

SEQ ID NO: 7233445 - DNA, 22 bp, Homo sapiens
tctgttataaatcacactgcat

SEQ ID NO: 7233446 - DNA, 22 bp, Homo sapiens
tctgttatatgttttttctaaa

SEQ ID NO: 7233447 - DNA, 22 bp, Homo sapiens
tctgttaacctggtcttggctt

SEQ ID NO: 7233448 - DNA, 22 bp, Homo sapiens
tctgttagagaggtagttcttg

SEQ ID NO: 7233449 - DNA, 22 bp, Homo sapiens
tctgttagctgtcaaagtgttt

SEQ ID NO: 7233450 - DNA, 22 bp, Homo sapiens
tctgtgtgttgtcaggaggatt

SEQ ID NO: 7233451 - DNA, 22 bp, Homo sapiens
tctgtgtgttgtcaggaggatt

SEQ ID NO: 7233452 - DNA, 18 bp, Homo sapiens
tctgtgttctgtcattgc

SEQ ID NO: 7233453 - DNA, 18 bp, Homo sapiens
tctgtgttctgtcattgc

SEQ ID NO: 7233454 - DNA, 18 bp, Homo sapiens
tctgtgttctgtcattgc

SEQ ID NO: 7233455 - DNA, 22 bp, Homo sapiens
tctgtgttgagaaggatcatga

SEQ ID NO: 7233456 - DNA, 22 bp, Homo sapiens
tctgtgtttaaaagatatgtcc

SEQ ID NO: 7233457 - DNA, 22 bp, Homo sapiens
tctgtgtttgccatccttgctc

SEQ ID NO: 7233458 - DNA, 22 bp, Homo sapiens
tctgtgttttaaacagtagaaa

SEQ ID NO: 7233459 - DNA, 22 bp, Homo sapiens
tctgtgttttaaacagtagaaa

SEQ ID NO: 7233460 - DNA, 22 bp, Homo sapiens
tctgtgttttactccaattata

SEQ ID NO: 7233461 - DNA, 22 bp, Homo sapiens
tctgttaaaagtggaataatag

SEQ ID NO: 7233462 - DNA, 22 bp, Homo sapiens
tctgttaaaagtggaataatag

SEQ ID NO: 7233463 - DNA, 22 bp, Homo sapiens
tctgtgtgaccataagccagct

SEQ ID NO: 7233464 - DNA, 22 bp, Homo sapiens
tctgtgtgatttcagggaagtc

SEQ ID NO: 7233465 - DNA, 22 bp, Homo sapiens
tctgtgtgatttcagggaagtc

SEQ ID NO: 7233466 - DNA, 22 bp, Homo sapiens
tctgtgtgatttcagggaagtc

SEQ ID NO: 7233467 - DNA, 20 bp, Homo sapiens
tctgtgtgccatcacctaac

SEQ ID NO: 7233468 - DNA, 22 bp, Homo sapiens
tctgtgtgcccacctgacacct

SEQ ID NO: 7233469 - DNA, 22 bp, Homo sapiens
tctgtgtgccctaaagcctgct

SEQ ID NO: 7233470 - DNA, 22 bp, Homo sapiens
tctgtgtgccctaaagcctgct

SEQ ID NO: 7233471 - DNA, 22 bp, Homo sapiens
tctgtgtgccctaaagcctgct

SEQ ID NO: 7233472 - DNA, 22 bp, Homo sapiens
tctgtgtgggatagtttgagga

SEQ ID NO: 7233473 - DNA, 22 bp, Homo sapiens
tctgtgtgggatagtttgagga

SEQ ID NO: 7233474 - DNA, 22 bp, Homo sapiens
tctgtgtgggatagtttgagga

SEQ ID NO: 7233475 - DNA, 22 bp, Homo sapiens
tctgtgtgggatagtttgagga

SEQ ID NO: 7233476 - DNA, 22 bp, Homo sapiens
tctgtgtggtagtttcagtgaa

SEQ ID NO: 7233477 - DNA, 22 bp, Homo sapiens
tctgtgtggtagtttcagtgaa

SEQ ID NO: 7233478 - DNA, 22 bp, Homo sapiens
tctgtgtggtagtttcagtgaa

SEQ ID NO: 7233479 - DNA, 22 bp, Homo sapiens
tctgtgtggtagtttcagtgaa

SEQ ID NO: 7233480 - DNA, 22 bp, Homo sapiens
tctgtgtgtgcctgttaatatt

SEQ ID NO: 7233481 - DNA, 22 bp, Homo sapiens
tctgtgtgtgcctgttaatatt

SEQ ID NO: 7233482 - DNA, 22 bp, Homo sapiens
tctgtttctccaacattgtgag

SEQ ID NO: 7233483 - DNA, 17 bp, Homo sapiens
tctgtttctcctttctt

SEQ ID NO: 7233484 - DNA, 17 bp, Homo sapiens
tctgtttctcctttctt

SEQ ID NO: 7233485 - DNA, 22 bp, Homo sapiens
tctgtttcttcctagccatgct

SEQ ID NO: 7233486 - DNA, 22 bp, Homo sapiens
tctgtttcttcttctgttatat

SEQ ID NO: 7233487 - DNA, 22 bp, Homo sapiens
tctgtttcttcttctgttatat

SEQ ID NO: 7233488 - DNA, 22 bp, Homo sapiens
tctgtttcacgtcctgaatctc

SEQ ID NO: 7233489 - DNA, 22 bp, Homo sapiens
tctgtttcaagtagggcttata

SEQ ID NO: 7233490 - DNA, 22 bp, Homo sapiens
tctgtttcctcttgtgtaaagt

SEQ ID NO: 7233491 - DNA, 22 bp, Homo sapiens
tctgtttcctcttgtgtaaagt

SEQ ID NO: 7233492 - DNA, 22 bp, Homo sapiens
tctgtttctataaagacaagag

SEQ ID NO: 7233493 - DNA, 22 bp, Homo sapiens
tctgtttattcaatttctatat

SEQ ID NO: 7233494 - DNA, 22 bp, Homo sapiens
tctgtttattcaatttctatat

SEQ ID NO: 7233495 - DNA, 22 bp, Homo sapiens
tctgttttgcataatgttcttt

SEQ ID NO: 7233496 - DNA, 22 bp, Homo sapiens
tctgttttgcataatgttcttt

SEQ ID NO: 7233497 - DNA, 22 bp, Homo sapiens
tctgttttgcataatgttcttt

SEQ ID NO: 7233498 - DNA, 22 bp, Homo sapiens
tctgttttctctgtattttgac

SEQ ID NO: 7233499 - DNA, 23 bp, Homo sapiens
tctgttttgcaacatgtgacaag

SEQ ID NO: 7233500 - DNA, 23 bp, Homo sapiens
tctgttttgcaacatgtgacaag

SEQ ID NO: 7233501 - DNA, 22 bp, Homo sapiens
tctgtttcttggctagcctctt

SEQ ID NO: 7233502 - DNA, 22 bp, Homo sapiens
tctgttttcatttgtcttgaga

SEQ ID NO: 7233503 - DNA, 22 bp, Homo sapiens
tctgttttctctgtattttgac

SEQ ID NO: 7233504 - DNA, 22 bp, Homo sapiens
tctgttttctctgtattttgac

SEQ ID NO: 7233505 - DNA, 22 bp, Homo sapiens
tctgttttctctgtattttgac

SEQ ID NO: 7233506 - DNA, 22 bp, Homo sapiens
tcttaaaagtatgccaattgga

SEQ ID NO: 7233507 - DNA, 22 bp, Homo sapiens
tcttaaaagtatgccaattgga

SEQ ID NO: 7233508 - DNA, 22 bp, Homo sapiens
tcttaaagagcgcaatttgagg

SEQ ID NO: 7233509 - DNA, 22 bp, Homo sapiens
tcttaaagagcgcaatttgagg

SEQ ID NO: 7233510 - DNA, 22 bp, Homo sapiens
tcttaaagcagcttgtaaaatg

SEQ ID NO: 7233511 - DNA, 22 bp, Homo sapiens
tcttaaagcttacttcaattgt

SEQ ID NO: 7233512 - DNA, 22 bp, Homo sapiens
tcttaaagcttacttcaattgt

SEQ ID NO: 7233513 - DNA, 22 bp, Homo sapiens
tcttaaaggcacatagtgtcta

SEQ ID NO: 7233514 - DNA, 22 bp, Homo sapiens
tcttaaaggcatgttagggtcc

SEQ ID NO: 7233515 - DNA, 22 bp, Homo sapiens
tctgtttttgaggctatcttct

SEQ ID NO: 7233516 - DNA, 22 bp, Homo sapiens
tctgtttttgaggctatcttct

SEQ ID NO: 7233517 - DNA, 22 bp, Homo sapiens
tctgttttgtgtctctctggtg

SEQ ID NO: 7233518 - DNA, 22 bp, Homo sapiens
tctgttttgtgtctctctggtg

SEQ ID NO: 7233519 - DNA, 22 bp, Homo sapiens
tctgttttgtgtctctctggtg

SEQ ID NO: 7233520 - DNA, 22 bp, Homo sapiens
tctgtttttgaggctatcttct

SEQ ID NO: 7233521 - DNA, 22 bp, Homo sapiens
tctgttttggtcacctttatat

SEQ ID NO: 7233522 - DNA, 22 bp, Homo sapiens
tctgttttgtaccagatacagc

SEQ ID NO: 7233523 - DNA, 22 bp, Homo sapiens
tctgttttgtaccagatacagc

SEQ ID NO: 7233524 - DNA, 22 bp, Homo sapiens
tcttatgaaaagcacttagaac

SEQ ID NO: 7233525 - DNA, 22 bp, Homo sapiens
tcttatcaataatgactgttga

SEQ ID NO: 7233526 - DNA, 22 bp, Homo sapiens
tcttatatgcacatacattggg

SEQ ID NO: 7233527 - DNA, 22 bp, Homo sapiens
tcttatatgcacatacattggg

SEQ ID NO: 7233528 - DNA, 22 bp, Homo sapiens
tcttataatctctattttaatg

SEQ ID NO: 7233529 - DNA, 22 bp, Homo sapiens
tcttataatctctattttaatg

SEQ ID NO: 7233530 - DNA, 22 bp, Homo sapiens
tcttataatctctattttaatg

SEQ ID NO: 7233531 - DNA, 21 bp, Homo sapiens
tcttatacagcaatagatctg

SEQ ID NO: 7233532 - DNA, 22 bp, Homo sapiens
tcttagcaaatactacttagaa

SEQ ID NO: 7233533 - DNA, 22 bp, Homo sapiens
tcttagcaaattttctttgcct

SEQ ID NO: 7233534 - DNA, 22 bp, Homo sapiens
tcttagcacagctatataagtt

SEQ ID NO: 7233535 - DNA, 22 bp, Homo sapiens
tcttagcatttcataacaactg

SEQ ID NO: 7233536 - DNA, 22 bp, Homo sapiens
tcttagcatttgttaataccca

SEQ ID NO: 7233537 - DNA, 22 bp, Homo sapiens
tcttaagtacctcctttatcac

SEQ ID NO: 7233538 - DNA, 22 bp, Homo sapiens
tcttaagtgcccagaaaccaaa

SEQ ID NO: 7233539 - DNA, 22 bp, Homo sapiens
tcttaatgaaagtgaaatatca

SEQ ID NO: 7233540 - DNA, 22 bp, Homo sapiens
tcttagatgaataaaaagttat

SEQ ID NO: 7233541 - DNA, 22 bp, Homo sapiens
tcttaactgacagtttaatggg

SEQ ID NO: 7233542 - DNA, 22 bp, Homo sapiens
tcttaactgacagtttaatggg

SEQ ID NO: 7233543 - DNA, 22 bp, Homo sapiens
tcttaagaaagtgacaaatagg

SEQ ID NO: 7233544 - DNA, 22 bp, Homo sapiens
tcttaaatgactgataagagga

SEQ ID NO: 7233545 - DNA, 22 bp, Homo sapiens
tcttaaatgactgataagagga

SEQ ID NO: 7233546 - DNA, 22 bp, Homo sapiens
tcttaaatgactgataagagga

SEQ ID NO: 7233547 - DNA, 20 bp, Homo sapiens
tcttaaatccccagggccat

SEQ ID NO: 7233548 - DNA, 22 bp, Homo sapiens
tcttaactatcatttgaacacc

SEQ ID NO: 7233549 - DNA, 22 bp, Homo sapiens
tcttaaatgactgataagagga

SEQ ID NO: 7233550 - DNA, 22 bp, Homo sapiens
tcttaacagtgctacagagcag

SEQ ID NO: 7233551 - DNA, 18 bp, Homo sapiens
tctgtgggatcagtgagg

SEQ ID NO: 7233552 - DNA, 22 bp, Homo sapiens
tctgtgggcatttataatctgg

SEQ ID NO: 7233553 - DNA, 22 bp, Homo sapiens
tctgtggggagcaggagccggg

SEQ ID NO: 7233554 - DNA, 22 bp, Homo sapiens
tctgtgggggtgtcttaaccta

SEQ ID NO: 7233555 - DNA, 22 bp, Homo sapiens
tctgtgggggtgtcttaaccta

SEQ ID NO: 7233556 - DNA, 22 bp, Homo sapiens
tctgtgggttttgcagagttgc

SEQ ID NO: 7233557 - DNA, 22 bp, Homo sapiens
tctgtgggtttcagggggctgt

SEQ ID NO: 7233558 - DNA, 21 bp, Homo sapiens
tctgtggtatggccatcttcc

SEQ ID NO: 7233559 - DNA, 22 bp, Homo sapiens
tctgtgggtagagtgagtactt

SEQ ID NO: 7233560 - DNA, 22 bp, Homo sapiens
tctgtgggtagagtgagtactt

SEQ ID NO: 7233561 - DNA, 22 bp, Homo sapiens
tctgtgggtagagtgagtactt

SEQ ID NO: 7233562 - DNA, 22 bp, Homo sapiens
tctgtgggtgcctccagcagtg

SEQ ID NO: 7233563 - DNA, 22 bp, Homo sapiens
tctgtgggtgcctccagcagtg

SEQ ID NO: 7233564 - DNA, 22 bp, Homo sapiens
tctgtgggtttcagggggctgt

SEQ ID NO: 7233565 - DNA, 22 bp, Homo sapiens
tctgtgggtttcagggggctgt

SEQ ID NO: 7233566 - DNA, 22 bp, Homo sapiens
tctgtgtcctgctagctgtctt

SEQ ID NO: 7233567 - DNA, 22 bp, Homo sapiens
tctgtgtcctgctagctgtctt

SEQ ID NO: 7233568 - DNA, 23 bp, Homo sapiens
tctgtgtcctcctggaccacaga

SEQ ID NO: 7233569 - DNA, 22 bp, Homo sapiens
tctgtgtcccttctaatttcag

SEQ ID NO: 7233570 - DNA, 22 bp, Homo sapiens
tctgtgtcctgctagctgtctt

SEQ ID NO: 7233571 - DNA, 22 bp, Homo sapiens
tctgtgtcgttctgtgctctgg

SEQ ID NO: 7233572 - DNA, 22 bp, Homo sapiens
tctgtgtcgttctgtgctctgg

SEQ ID NO: 7233573 - DNA, 22 bp, Homo sapiens
tctgtgtcagcagcactcagcc

SEQ ID NO: 7233574 - DNA, 22 bp, Homo sapiens
tctgtgtcactgaggcctgtgt

SEQ ID NO: 7233575 - DNA, 22 bp, Homo sapiens
tctgtgtcagaagatatcatgg

SEQ ID NO: 7233576 - DNA, 22 bp, Homo sapiens
tctgtgtctggttgggccagta

SEQ ID NO: 7233577 - DNA, 22 bp, Homo sapiens
tctgtgtctgttacttcactgc

SEQ ID NO: 7233578 - DNA, 22 bp, Homo sapiens
tctgtgtctgttacttcactgc

SEQ ID NO: 7233579 - DNA, 22 bp, Homo sapiens
tctgtgtctgcagaagttcagc

SEQ ID NO: 7233580 - DNA, 22 bp, Homo sapiens
tctgtgtctgggcctccgcctg

SEQ ID NO: 7233581 - DNA, 22 bp, Homo sapiens
tctgtgtctcaatcccatgctg

SEQ ID NO: 7233582 - DNA, 22 bp, Homo sapiens
tctgtgtctcaatcccatgctg

SEQ ID NO: 7233583 - DNA, 23 bp, Homo sapiens
tctgtgtctccacccaaatctca

SEQ ID NO: 7233584 - DNA, 23 bp, Homo sapiens
tctgtgtctccacccaaatctca

SEQ ID NO: 7233585 - DNA, 22 bp, Homo sapiens
tctgtgtctgcagaagttcagc

SEQ ID NO: 7233586 - DNA, 22 bp, Homo sapiens
tctgtggctgtgctgggccaga

SEQ ID NO: 7233587 - DNA, 22 bp, Homo sapiens
tctgtggctgtgctgggccaga

SEQ ID NO: 7233588 - DNA, 22 bp, Homo sapiens
tctgtggagttgaggaaggttg

SEQ ID NO: 7233589 - DNA, 23 bp, Homo sapiens
tctgtggctccttcaggctgctg

SEQ ID NO: 7233590 - DNA, 22 bp, Homo sapiens
tctgtgctttccctgccttctt

SEQ ID NO: 7233591 - DNA, 21 bp, Homo sapiens
tctgtgcttttttggctccta

SEQ ID NO: 7233592 - DNA, 22 bp, Homo sapiens
tctgtgcttaactactcacccc

SEQ ID NO: 7233593 - DNA, 22 bp, Homo sapiens
tctgtggagttagactggtatc

SEQ ID NO: 7233594 - DNA, 19 bp, Homo sapiens
tctgtggagctcagagtag

SEQ ID NO: 7233595 - DNA, 19 bp, Homo sapiens
tctgtgctgggaggcagca

SEQ ID NO: 7233596 - DNA, 22 bp, Homo sapiens
tctgtgctggactgatttcata

SEQ ID NO: 7233597 - DNA, 21 bp, Homo sapiens
tctgtgctgccgtcaacatcc

SEQ ID NO: 7233598 - DNA, 22 bp, Homo sapiens
tctgtgctgccatcctgtggcc

SEQ ID NO: 7233599 - DNA, 22 bp, Homo sapiens
tctgtgctgccatcctgtggcc

SEQ ID NO: 7233600 - DNA, 22 bp, Homo sapiens
tctgtgctgccatcctgtggcc

SEQ ID NO: 7233601 - DNA, 22 bp, Homo sapiens
tctgtgctgcaggagtctgcat

SEQ ID NO: 7233602 - DNA, 22 bp, Homo sapiens
tctgtgctcatgcatgtgaatt

SEQ ID NO: 7233603 - DNA, 22 bp, Homo sapiens
tctgtgctcattcagtcattca

SEQ ID NO: 7233604 - DNA, 22 bp, Homo sapiens
tctgtgctcaagttctgcctct

SEQ ID NO: 7233605 - DNA, 20 bp, Homo sapiens
tctgtgctcatcccacagta

SEQ ID NO: 7233606 - DNA, 20 bp, Homo sapiens
tctgtgctcatcccacagta

SEQ ID NO: 7233607 - DNA, 20 bp, Homo sapiens
tctgtgctacactccagatt

SEQ ID NO: 7233608 - DNA, 20 bp, Homo sapiens
tctgtgctacactccagatt

SEQ ID NO: 7233609 - DNA, 22 bp, Homo sapiens
tctgtgctagaggagttggcca

SEQ ID NO: 7233610 - DNA, 22 bp, Homo sapiens
tctgtgctagcacgcagcaagg

SEQ ID NO: 7233611 - DNA, 22 bp, Homo sapiens
tctgtgctaggcagcctggccc

SEQ ID NO: 7233612 - DNA, 22 bp, Homo sapiens
tctgtgaagctctgaacagcag

SEQ ID NO: 7233613 - DNA, 22 bp, Homo sapiens
tctgtgaaatcacccaggttta

SEQ ID NO: 7233614 - DNA, 22 bp, Homo sapiens
tctgtgagaaccagtgccaggg

SEQ ID NO: 7233615 - DNA, 22 bp, Homo sapiens
tctgtgataggaaaataaatgg

SEQ ID NO: 7233616 - DNA, 22 bp, Homo sapiens
tctgtgatagtttttcagctat

SEQ ID NO: 7233617 - DNA, 22 bp, Homo sapiens
tctgtgcacaataggcattttt

SEQ ID NO: 7233618 - DNA, 20 bp, Homo sapiens
tctgtgcacctgctacaagg

SEQ ID NO: 7233619 - DNA, 22 bp, Homo sapiens
tctgtgcaccttctaatgagta

SEQ ID NO: 7233620 - DNA, 22 bp, Homo sapiens
tctgtctgagggagtgacattt

SEQ ID NO: 7233621 - DNA, 22 bp, Homo sapiens
tctgtctgaggagtttttgacc

SEQ ID NO: 7233622 - DNA, 22 bp, Homo sapiens
tctgtctgagggagtgacattt

SEQ ID NO: 7233623 - DNA, 22 bp, Homo sapiens
tctgtctgagggagtgacattt

SEQ ID NO: 7233624 - DNA, 22 bp, Homo sapiens
tctgtctgagtggtgttagagt

SEQ ID NO: 7233625 - DNA, 22 bp, Homo sapiens
tctgtctgcacctaagcacagt

SEQ ID NO: 7233626 - DNA, 22 bp, Homo sapiens
tctgtctgcacctaagcacagt

SEQ ID NO: 7233627 - DNA, 22 bp, Homo sapiens
tctgtctgccccagcaagtcac

SEQ ID NO: 7233628 - DNA, 22 bp, Homo sapiens
tctgtctgccccagcaagtcac

SEQ ID NO: 7233629 - DNA, 22 bp, Homo sapiens
tctgtctgcctgtgtccccacc

SEQ ID NO: 7233630 - DNA, 22 bp, Homo sapiens
tctgtctgccttgtgagggcac

SEQ ID NO: 7233631 - DNA, 22 bp, Homo sapiens
tctgtctgccttgtgagggcac

SEQ ID NO: 7233632 - DNA, 22 bp, Homo sapiens
tctgtctgcgcttgccctggtg

SEQ ID NO: 7233633 - DNA, 22 bp, Homo sapiens
tctgtctgctcatttacctcag

SEQ ID NO: 7233634 - DNA, 22 bp, Homo sapiens
tctgtctgcttcacttgcattt

SEQ ID NO: 7233635 - DNA, 22 bp, Homo sapiens
tctgtctgcttcacttgcattt

SEQ ID NO: 7233636 - DNA, 22 bp, Homo sapiens
tctgtctgcttcacttgcattt

SEQ ID NO: 7233637 - DNA, 22 bp, Homo sapiens
tctgtctttagaggcctgtgct

SEQ ID NO: 7233638 - DNA, 22 bp, Homo sapiens
tctgtctttgagatctcagcct

SEQ ID NO: 7233639 - DNA, 22 bp, Homo sapiens
tctgtctttgagatctcagcct

SEQ ID NO: 7233640 - DNA, 22 bp, Homo sapiens
tctgtctttgtcaggaccagag

SEQ ID NO: 7233641 - DNA, 22 bp, Homo sapiens
tctgtgaaacagctctggcatg

SEQ ID NO: 7233642 - DNA, 22 bp, Homo sapiens
tctgtgcggtctgtgttatgaa

SEQ ID NO: 7233643 - DNA, 22 bp, Homo sapiens
tctgtgcctttaagaagctcat

SEQ ID NO: 7233644 - DNA, 22 bp, Homo sapiens
tctgtgctaatgcttcacaata

SEQ ID NO: 7233645 - DNA, 21 bp, Homo sapiens
tctgtgcctcaaccctcatct

SEQ ID NO: 7233646 - DNA, 21 bp, Homo sapiens
tctgtgcctcaaccctcatct

SEQ ID NO: 7233647 - DNA, 22 bp, Homo sapiens
tctgtgccagcagcctcctgga

SEQ ID NO: 7233648 - DNA, 22 bp, Homo sapiens
tctgtgccagcagcctcctgga

SEQ ID NO: 7233649 - DNA, 22 bp, Homo sapiens
tctgtgccctcggtgctgggcc

SEQ ID NO: 7233650 - DNA, 22 bp, Homo sapiens
tctgtgccgcgccggagaccct

SEQ ID NO: 7233651 - DNA, 22 bp, Homo sapiens
tctgtgcagtcagggctcagtc

SEQ ID NO: 7233652 - DNA, 22 bp, Homo sapiens
tctgtgcaggatttgaggaacc

SEQ ID NO: 7233653 - DNA, 22 bp, Homo sapiens
tctggcagtggatgagggcagc

SEQ ID NO: 7233654 - DNA, 22 bp, Homo sapiens
tctggcagtggatgagggcagc

SEQ ID NO: 7233655 - DNA, 22 bp, Homo sapiens
tctggcagtgatttctgtgatc

SEQ ID NO: 7233656 - DNA, 22 bp, Homo sapiens
tctggcagtggatgagggcagc

SEQ ID NO: 7233657 - DNA, 21 bp, Homo sapiens
tctggcagtggtctttcaaat

SEQ ID NO: 7233658 - DNA, 22 bp, Homo sapiens
tctggcagttgccgcttcagtc

SEQ ID NO: 7233659 - DNA, 22 bp, Homo sapiens
tctggcagtttgagaaaggcta

SEQ ID NO: 7233660 - DNA, 22 bp, Homo sapiens
tctggcagtttgagaaaggcta

SEQ ID NO: 7233661 - DNA, 22 bp, Homo sapiens
tctggcagttgccgcttcagtc

SEQ ID NO: 7233662 - DNA, 22 bp, Homo sapiens
tctggcagttccttgttgatat

SEQ ID NO: 7233663 - DNA, 22 bp, Homo sapiens
tctggccacccgaggcccctgc

SEQ ID NO: 7233664 - DNA, 22 bp, Homo sapiens
tctggccatggcaagccgagtg

SEQ ID NO: 7233665 - DNA, 22 bp, Homo sapiens
tctggcccaagttttcggtgag

SEQ ID NO: 7233666 - DNA, 22 bp, Homo sapiens
tctggccagtagatgtgggttg

SEQ ID NO: 7233667 - DNA, 22 bp, Homo sapiens
tctggccagtgaaatgcagaat

SEQ ID NO: 7233668 - DNA, 22 bp, Homo sapiens
tctggccaggatggcaagacca

SEQ ID NO: 7233669 - DNA, 22 bp, Homo sapiens
tctggccaggatggcaagacca

SEQ ID NO: 7233670 - DNA, 22 bp, Homo sapiens
tctggccagcatgagacctggt

SEQ ID NO: 7233671 - DNA, 22 bp, Homo sapiens
tctggccactaataggtctcac

SEQ ID NO: 7233672 - DNA, 22 bp, Homo sapiens
tctggcagaggaaggaggcctg

SEQ ID NO: 7233673 - DNA, 22 bp, Homo sapiens
tctggcagagtcagtgcacaca

SEQ ID NO: 7233674 - DNA, 22 bp, Homo sapiens
tctggcagagtcagtgcacaca

SEQ ID NO: 7233675 - DNA, 22 bp, Homo sapiens
tctggcagagtcagtgcacaca

SEQ ID NO: 7233676 - DNA, 22 bp, Homo sapiens
tctggcagagtgataggataag

SEQ ID NO: 7233677 - DNA, 22 bp, Homo sapiens
tctggcagaagtgctgtcagta

SEQ ID NO: 7233678 - DNA, 22 bp, Homo sapiens
tctggcagaagtgctgtcagta

SEQ ID NO: 7233679 - DNA, 22 bp, Homo sapiens
tctggcagagatatccatccca

SEQ ID NO: 7233680 - DNA, 22 bp, Homo sapiens
tctggcagagatatccatccca

SEQ ID NO: 7233681 - DNA, 22 bp, Homo sapiens
tctggcagaggaaggaggcctg

SEQ ID NO: 7233682 - DNA, 22 bp, Homo sapiens
tctggcagaggaaggaggcctg

SEQ ID NO: 7233683 - DNA, 22 bp, Homo sapiens
tctggcagagatatccatccca

SEQ ID NO: 7233684 - DNA, 22 bp, Homo sapiens
tctggcagagatatccatccca

SEQ ID NO: 7233685 - DNA, 22 bp, Homo sapiens
tctggcagaagtgctgtcagta

SEQ ID NO: 7233686 - DNA, 22 bp, Homo sapiens
tctggcacttgccagtttctat

SEQ ID NO: 7233687 - DNA, 22 bp, Homo sapiens
tctggcagaaggcagaaattca

SEQ ID NO: 7233688 - DNA, 22 bp, Homo sapiens
tctggcagaaggcagaaattca

SEQ ID NO: 7233689 - DNA, 22 bp, Homo sapiens
tctggcaccctgacttagtgtt

SEQ ID NO: 7233690 - DNA, 22 bp, Homo sapiens
tctggcactgggctgtgtgagc

SEQ ID NO: 7233691 - DNA, 22 bp, Homo sapiens
tctggcacttaaatgagaattt

SEQ ID NO: 7233692 - DNA, 22 bp, Homo sapiens
tctggcaaaggcaaccacagtt

SEQ ID NO: 7233693 - DNA, 22 bp, Homo sapiens
tctggcacatagcagggtctct

SEQ ID NO: 7233694 - DNA, 22 bp, Homo sapiens
tctggcagtgagcaacttgaca

SEQ ID NO: 7233695 - DNA, 22 bp, Homo sapiens
tctggcagtgagcaacttgaca

SEQ ID NO: 7233696 - DNA, 22 bp, Homo sapiens
tctggcagtgaagtcatgaggt

SEQ ID NO: 7233697 - DNA, 22 bp, Homo sapiens
tctggcagtgaagtcatgaggt

SEQ ID NO: 7233698 - DNA, 22 bp, Homo sapiens
tctggcagtgaagtcatgaggt

SEQ ID NO: 7233699 - DNA, 22 bp, Homo sapiens
tctggcaggttcccatgttatg

SEQ ID NO: 7233700 - DNA, 22 bp, Homo sapiens
tctggcaggttcccatgttatg

SEQ ID NO: 7233701 - DNA, 22 bp, Homo sapiens
tctggcagtaataggggagaga

SEQ ID NO: 7233702 - DNA, 22 bp, Homo sapiens
tctggcagtaataggggagaga

SEQ ID NO: 7233703 - DNA, 20 bp, Homo sapiens
tctggcaggtgaacgagctg

SEQ ID NO: 7233704 - DNA, 19 bp, Homo sapiens
tctggcaggtaattaggga

SEQ ID NO: 7233705 - DNA, 22 bp, Homo sapiens
tctggcaggtcaatcattcttt

SEQ ID NO: 7233706 - DNA, 22 bp, Homo sapiens
tctggcaggtcaatcattcttt

SEQ ID NO: 7233707 - DNA, 22 bp, Homo sapiens
tctggcagcaagtctgtttctc

SEQ ID NO: 7233708 - DNA, 22 bp, Homo sapiens
tctggcagggtgtgtatttaca

SEQ ID NO: 7233709 - DNA, 22 bp, Homo sapiens
tctggcagatcttcccacgttt

SEQ ID NO: 7233710 - DNA, 22 bp, Homo sapiens
tctggcagatcttcccacgttt

SEQ ID NO: 7233711 - DNA, 22 bp, Homo sapiens
tctggcagcaagataacaatgg

SEQ ID NO: 7233712 - DNA, 22 bp, Homo sapiens
tctggaggctctgagggtgagt

SEQ ID NO: 7233713 - DNA, 22 bp, Homo sapiens
tctggaggctctgagggtgagt

SEQ ID NO: 7233714 - DNA, 22 bp, Homo sapiens
tctggaggctctgagggtgagt

SEQ ID NO: 7233715 - DNA, 22 bp, Homo sapiens
tctggagatcatgtggggtgga

SEQ ID NO: 7233716 - DNA, 22 bp, Homo sapiens
tctggagatcatgtggggtgga

SEQ ID NO: 7233717 - DNA, 22 bp, Homo sapiens
tctggagcaacagagcaggaca

SEQ ID NO: 7233718 - DNA, 22 bp, Homo sapiens
tctggaggctctgagggtgagt

SEQ ID NO: 7233719 - DNA, 22 bp, Homo sapiens
tctggaggctctgagggtgagt

SEQ ID NO: 7233720 - DNA, 18 bp, Homo sapiens
tctggagggaagctttga

SEQ ID NO: 7233721 - DNA, 22 bp, Homo sapiens
tctggagggcccacatccacaa

SEQ ID NO: 7233722 - DNA, 22 bp, Homo sapiens
tctggagggcccacatccacaa

SEQ ID NO: 7233723 - DNA, 22 bp, Homo sapiens
tctggagggcccacatccacaa

SEQ ID NO: 7233724 - DNA, 22 bp, Homo sapiens
tctggagggcccacatccacaa

SEQ ID NO: 7233725 - DNA, 23 bp, Homo sapiens
tctggaggggacactgcagatgc

SEQ ID NO: 7233726 - DNA, 23 bp, Homo sapiens
tctggaggggacactgcagatgc

SEQ ID NO: 7233727 - DNA, 23 bp, Homo sapiens
tctggaggggacactgcagatgc

SEQ ID NO: 7233728 - DNA, 22 bp, Homo sapiens
tctggagggggatgcctcatcc

SEQ ID NO: 7233729 - DNA, 22 bp, Homo sapiens
tctggagggggatgcctcatcc

SEQ ID NO: 7233730 - DNA, 22 bp, Homo sapiens
tctggagggggatgcctcatcc

SEQ ID NO: 7233731 - DNA, 22 bp, Homo sapiens
tctggaggggtttagagggaca

SEQ ID NO: 7233732 - DNA, 22 bp, Homo sapiens
tctggaggggtttagagggaca

SEQ ID NO: 7233733 - DNA, 22 bp, Homo sapiens
tctggaggggtttagagggaca

SEQ ID NO: 7233734 - DNA, 22 bp, Homo sapiens
tctggaggggtttagagggaca

SEQ ID NO: 7233735 - DNA, 22 bp, Homo sapiens
tctggagtaggacctgaaaata

SEQ ID NO: 7233736 - DNA, 22 bp, Homo sapiens
tctggagtccagatccatttgg

SEQ ID NO: 7233737 - DNA, 22 bp, Homo sapiens
tctggagtccagatccatttgg

SEQ ID NO: 7233738 - DNA, 22 bp, Homo sapiens
tctggagtctaaagaaccaaaa

SEQ ID NO: 7233739 - DNA, 22 bp, Homo sapiens
tctggagtggacccagagcact

SEQ ID NO: 7233740 - DNA, 22 bp, Homo sapiens
tctggagtggagctgatcattt

SEQ ID NO: 7233741 - DNA, 22 bp, Homo sapiens
tctggagtggcagtcatctgaa

SEQ ID NO: 7233742 - DNA, 22 bp, Homo sapiens
tctggagtgtttctaattactg

SEQ ID NO: 7233743 - DNA, 22 bp, Homo sapiens
tctggagttcctgcaggctgtg

SEQ ID NO: 7233744 - DNA, 22 bp, Homo sapiens
tctggagtttgagcacttcaat

SEQ ID NO: 7233745 - DNA, 22 bp, Homo sapiens
tctggatcccaccgccacacac

SEQ ID NO: 7233746 - DNA, 22 bp, Homo sapiens
tctggatctccctcatcctggg

SEQ ID NO: 7233747 - DNA, 22 bp, Homo sapiens
tctggatctccctcatcctggg

SEQ ID NO: 7233748 - DNA, 22 bp, Homo sapiens
tctggatgagattaatggtgtg

SEQ ID NO: 7233749 - DNA, 22 bp, Homo sapiens
tctggatggtcagctcttcctg

SEQ ID NO: 7233750 - DNA, 22 bp, Homo sapiens
tctgctctgtggcttcagctaa

SEQ ID NO: 7233751 - DNA, 22 bp, Homo sapiens
tctgctctgtggcttcagctaa

SEQ ID NO: 7233752 - DNA, 22 bp, Homo sapiens
tctgctctgggccagctattaa

SEQ ID NO: 7233753 - DNA, 22 bp, Homo sapiens
tctgctctgtggcttcagctaa

SEQ ID NO: 7233754 - DNA, 22 bp, Homo sapiens
tctgctctgtactgcactggcc

SEQ ID NO: 7233755 - DNA, 22 bp, Homo sapiens
tctgctctgtactgcactggcc

SEQ ID NO: 7233756 - DNA, 22 bp, Homo sapiens
tctgctctgggccagctattaa

SEQ ID NO: 7233757 - DNA, 22 bp, Homo sapiens
tctgctctgggccagctattaa

SEQ ID NO: 7233758 - DNA, 17 bp, Homo sapiens
tctgctctgccaatcca

SEQ ID NO: 7233759 - DNA, 17 bp, Homo sapiens
tctgctctgccaatcca

SEQ ID NO: 7233760 - DNA, 22 bp, Homo sapiens
tctgctctgagagggccatcag

SEQ ID NO: 7233761 - DNA, 22 bp, Homo sapiens
tctgctctgagagggccatcag

SEQ ID NO: 7233762 - DNA, 22 bp, Homo sapiens
tctgctctgagagggccatcag

SEQ ID NO: 7233763 - DNA, 23 bp, Homo sapiens
tctgctctgaagttcggctgagc

SEQ ID NO: 7233764 - DNA, 22 bp, Homo sapiens
tctgctctccatacttccgcac

SEQ ID NO: 7233765 - DNA, 22 bp, Homo sapiens
tctgctctccatacttccgcac

SEQ ID NO: 7233766 - DNA, 22 bp, Homo sapiens
tctgctctagttgcttcctgcc

SEQ ID NO: 7233767 - DNA, 22 bp, Homo sapiens
tctgctctagttgcttcctgcc

SEQ ID NO: 7233768 - DNA, 22 bp, Homo sapiens
tctgctgagtaccgccatgtct

SEQ ID NO: 7233769 - DNA, 22 bp, Homo sapiens
tctgctgatgtgtggtgcttca

SEQ ID NO: 7233770 - DNA, 22 bp, Homo sapiens
tctgctgaggccttcccactcc

SEQ ID NO: 7233771 - DNA, 22 bp, Homo sapiens
tctgctgaggtggttttagaga

SEQ ID NO: 7233772 - DNA, 22 bp, Homo sapiens
tctgctgaggtggttttagaga

SEQ ID NO: 7233773 - DNA, 22 bp, Homo sapiens
tctgctgagatgcccatggtta

SEQ ID NO: 7233774 - DNA, 22 bp, Homo sapiens
tctgctgacatttatgaataga

SEQ ID NO: 7233775 - DNA, 22 bp, Homo sapiens
tctgctgacatttatgaataga

SEQ ID NO: 7233776 - DNA, 22 bp, Homo sapiens
tctgctgaatcagatagctaag

SEQ ID NO: 7233777 - DNA, 22 bp, Homo sapiens
tctgctgcctgcagggcagaga

SEQ ID NO: 7233778 - DNA, 22 bp, Homo sapiens
tctgctgccatgcagagcagta

SEQ ID NO: 7233779 - DNA, 22 bp, Homo sapiens
tctgctgtaaccttcagaggta

SEQ ID NO: 7233780 - DNA, 22 bp, Homo sapiens
tctgctgtaaccttcagaggta

SEQ ID NO: 7233781 - DNA, 22 bp, Homo sapiens
tctgctggtgatgacctcataa

SEQ ID NO: 7233782 - DNA, 22 bp, Homo sapiens
tctgctggtgatgacctcataa

SEQ ID NO: 7233783 - DNA, 22 bp, Homo sapiens
tctgctggttccgaattaggcc

SEQ ID NO: 7233784 - DNA, 22 bp, Homo sapiens
tctgctggttccgaattaggcc

SEQ ID NO: 7233785 - DNA, 22 bp, Homo sapiens
tctgctggccttagcaggtcta

SEQ ID NO: 7233786 - DNA, 22 bp, Homo sapiens
tctgctggtcaaggctgggtcc

SEQ ID NO: 7233787 - DNA, 22 bp, Homo sapiens
tctgctggtcaaggctgggtcc

SEQ ID NO: 7233788 - DNA, 22 bp, Homo sapiens
tctgctggtcaaggctgggtcc

SEQ ID NO: 7233789 - DNA, 22 bp, Homo sapiens
tctgctggtcaaggctgggtcc

SEQ ID NO: 7233790 - DNA, 22 bp, Homo sapiens
tctgctggtgatgacctcataa

SEQ ID NO: 7233791 - DNA, 22 bp, Homo sapiens
tctgctggtgatgacctcataa

SEQ ID NO: 7233792 - DNA, 22 bp, Homo sapiens
tctgctgctgcagctacactat

SEQ ID NO: 7233793 - DNA, 22 bp, Homo sapiens
tctgctggaaaaccagggaatt

SEQ ID NO: 7233794 - DNA, 19 bp, Homo sapiens
tctgctggcagaattccct

SEQ ID NO: 7233795 - DNA, 20 bp, Homo sapiens
tctgctggccaaaacttcac

SEQ ID NO: 7233796 - DNA, 22 bp, Homo sapiens
tctgctggccttagcaggtcta

SEQ ID NO: 7233797 - DNA, 22 bp, Homo sapiens
tctgctgtgatttgctacctgt

SEQ ID NO: 7233798 - DNA, 22 bp, Homo sapiens
tctgctgtgaggaggcaggatg

SEQ ID NO: 7233799 - DNA, 22 bp, Homo sapiens
tctgctgtgtcccctgtgcggg

SEQ ID NO: 7233800 - DNA, 22 bp, Homo sapiens
tctggaagaacggggcatgctg

SEQ ID NO: 7233801 - DNA, 22 bp, Homo sapiens
tctgctgtttactgtgtgatat

SEQ ID NO: 7233802 - DNA, 21 bp, Homo sapiens
tctggaagaaaaaagtattat

SEQ ID NO: 7233803 - DNA, 22 bp, Homo sapiens
tctgctgttctcatgctgattt

SEQ ID NO: 7233804 - DNA, 22 bp, Homo sapiens
tctggagaagcccagggagctg

SEQ ID NO: 7233805 - DNA, 22 bp, Homo sapiens
tctggagaagcccagggagctg

SEQ ID NO: 7233806 - DNA, 22 bp, Homo sapiens
tctggagaagcccagggagctg

SEQ ID NO: 7233807 - DNA, 22 bp, Homo sapiens
tctggagaagcagtgagagtca

SEQ ID NO: 7233808 - DNA, 22 bp, Homo sapiens
tctggagaagcagtgagagtca

SEQ ID NO: 7233809 - DNA, 22 bp, Homo sapiens
tctggagaaggaagagtctttg

SEQ ID NO: 7233810 - DNA, 22 bp, Homo sapiens
tctggagaaggaagagtctttg

SEQ ID NO: 7233811 - DNA, 22 bp, Homo sapiens
tctggagaatctgtcagtgtgg

SEQ ID NO: 7233812 - DNA, 22 bp, Homo sapiens
tctggagaatctgtcagtgtgg

SEQ ID NO: 7233813 - DNA, 22 bp, Homo sapiens
tctggagacctagccctgttgt

SEQ ID NO: 7233814 - DNA, 22 bp, Homo sapiens
tctggagaagaaacttgctctg

SEQ ID NO: 7233815 - DNA, 22 bp, Homo sapiens
tctggagaagcagtgagagtca

SEQ ID NO: 7233816 - DNA, 22 bp, Homo sapiens
tctggagaagcagtgagagtca

SEQ ID NO: 7233817 - DNA, 22 bp, Homo sapiens
tctggagaacttgcaagaggat

SEQ ID NO: 7233818 - DNA, 22 bp, Homo sapiens
tctggagaacttgcaagaggat

SEQ ID NO: 7233819 - DNA, 22 bp, Homo sapiens
tctggagaagaaacttgctctg

SEQ ID NO: 7233820 - DNA, 22 bp, Homo sapiens
tctggactctagggggactgtg

SEQ ID NO: 7233821 - DNA, 20 bp, Homo sapiens
tctggactgtcagacaggga

SEQ ID NO: 7233822 - DNA, 22 bp, Homo sapiens
tctggacttgaatcagagtaga

SEQ ID NO: 7233823 - DNA, 22 bp, Homo sapiens
tctggagaaagttgagtttgtg

SEQ ID NO: 7233824 - DNA, 22 bp, Homo sapiens
tctggagacctgcatttatatt

SEQ ID NO: 7233825 - DNA, 22 bp, Homo sapiens
tctggagagatcttccacaaca

SEQ ID NO: 7233826 - DNA, 22 bp, Homo sapiens
tctggagagatcttccacaaca

SEQ ID NO: 7233827 - DNA, 22 bp, Homo sapiens
tctggagagatcttccacaaca

SEQ ID NO: 7233828 - DNA, 22 bp, Homo sapiens
tctggagagcagatgcctctgg

SEQ ID NO: 7233829 - DNA, 22 bp, Homo sapiens
tctggagaggaggatgtggaca

SEQ ID NO: 7233830 - DNA, 22 bp, Homo sapiens
tctggagaggaggatgtggaca

SEQ ID NO: 7233831 - DNA, 22 bp, Homo sapiens
tctggagaggggcctagaattt

SEQ ID NO: 7233832 - DNA, 22 bp, Homo sapiens
tctggagaggggcctagaattt

SEQ ID NO: 7233833 - DNA, 22 bp, Homo sapiens
tctggagagtcacagtgccaga

SEQ ID NO: 7233834 - DNA, 22 bp, Homo sapiens
tctggagagtcacagtgccaga

SEQ ID NO: 7233835 - DNA, 22 bp, Homo sapiens
tctggagagtcctgctcacgtc

SEQ ID NO: 7233836 - DNA, 22 bp, Homo sapiens
tctggagagtcctgctcacgtc

SEQ ID NO: 7233837 - DNA, 22 bp, Homo sapiens
tctggagagtcctgctcacgtc

SEQ ID NO: 7233838 - DNA, 22 bp, Homo sapiens
tctggagataagacagacagat

SEQ ID NO: 7233839 - DNA, 22 bp, Homo sapiens
tctggagataagacagacagat

SEQ ID NO: 7233840 - DNA, 22 bp, Homo sapiens
tctggagataagcagcaatgaa

SEQ ID NO: 7233841 - DNA, 22 bp, Homo sapiens
tctggaattttattgatcaaaa

SEQ ID NO: 7233842 - DNA, 22 bp, Homo sapiens
tctggaattctcaagtcctgga

SEQ ID NO: 7233843 - DNA, 22 bp, Homo sapiens
tctggaattgctgtgtgagttc

SEQ ID NO: 7233844 - DNA, 22 bp, Homo sapiens
tctggaattctcaagtcctgga

SEQ ID NO: 7233845 - DNA, 22 bp, Homo sapiens
tctggaattaaactcaggagac

SEQ ID NO: 7233846 - DNA, 22 bp, Homo sapiens
tctggaatgatttccttcccct

SEQ ID NO: 7233847 - DNA, 22 bp, Homo sapiens
tctggaatgatttccttcccct

SEQ ID NO: 7233848 - DNA, 22 bp, Homo sapiens
tctggaattaaactcaggagac

SEQ ID NO: 7233849 - DNA, 22 bp, Homo sapiens
tctggaatgtaaagtttatggg

SEQ ID NO: 7233850 - DNA, 22 bp, Homo sapiens
tctggacaatcctgagacagac

SEQ ID NO: 7233851 - DNA, 22 bp, Homo sapiens
tctggacagagcttcaggagct

SEQ ID NO: 7233852 - DNA, 22 bp, Homo sapiens
tctggacatcctggagaatgac

SEQ ID NO: 7233853 - DNA, 22 bp, Homo sapiens
tctggaccctgggctgtgattt

SEQ ID NO: 7233854 - DNA, 22 bp, Homo sapiens
tctggactaacagcagcctcag

SEQ ID NO: 7233855 - DNA, 22 bp, Homo sapiens
tctggactaatattctggctgc

SEQ ID NO: 7233856 - DNA, 22 bp, Homo sapiens
tctggactaacagcagcctcag

SEQ ID NO: 7233857 - DNA, 22 bp, Homo sapiens
tctggactaggggaaggcctgt

SEQ ID NO: 7233858 - DNA, 22 bp, Homo sapiens
tctggactccatgctgcctgga

SEQ ID NO: 7233859 - DNA, 22 bp, Homo sapiens
tctggactcgggtgggtgacac

SEQ ID NO: 7233860 - DNA, 20 bp, Homo sapiens
tctggactctaaggtatatt

SEQ ID NO: 7233861 - DNA, 22 bp, Homo sapiens
tctggaaggaacccttagagga

SEQ ID NO: 7233862 - DNA, 22 bp, Homo sapiens
tctggaaggaacccttagagga

SEQ ID NO: 7233863 - DNA, 22 bp, Homo sapiens
tctggaaggaacccttagagga

SEQ ID NO: 7233864 - DNA, 22 bp, Homo sapiens
tctggaagacagtgagcccgct

SEQ ID NO: 7233865 - DNA, 22 bp, Homo sapiens
tctggaagacagtgagcccgct

SEQ ID NO: 7233866 - DNA, 22 bp, Homo sapiens
tctggaagacattaatttggtt

SEQ ID NO: 7233867 - DNA, 22 bp, Homo sapiens
tctggaaggaacccttagagga

SEQ ID NO: 7233868 - DNA, 22 bp, Homo sapiens
tctggaaggaagagctgagtcc

SEQ ID NO: 7233869 - DNA, 22 bp, Homo sapiens
tctggaaggaagagctgagtcc

SEQ ID NO: 7233870 - DNA, 22 bp, Homo sapiens
tctggaaggcttcaaggtctaa

SEQ ID NO: 7233871 - DNA, 22 bp, Homo sapiens
tctggaaggcttcaaggtctaa

SEQ ID NO: 7233872 - DNA, 22 bp, Homo sapiens
tctggaaggggatctgtggtca

SEQ ID NO: 7233873 - DNA, 22 bp, Homo sapiens
tctggaaggttggctcccagtt

SEQ ID NO: 7233874 - DNA, 22 bp, Homo sapiens
tctggaaggttggctcccagtt

SEQ ID NO: 7233875 - DNA, 22 bp, Homo sapiens
tctggaagtcccttgatgccag

SEQ ID NO: 7233876 - DNA, 22 bp, Homo sapiens
tctggaatgatttccttcccct

SEQ ID NO: 7233877 - DNA, 22 bp, Homo sapiens
tctggaatgaatgaggttctgt

SEQ ID NO: 7233878 - DNA, 23 bp, Homo sapiens
tctggaatcctcccccttggttc

SEQ ID NO: 7233879 - DNA, 22 bp, Homo sapiens
tctggaatcagtggcttaccct

SEQ ID NO: 7233880 - DNA, 22 bp, Homo sapiens
tctggaatcagacctaatccca

SEQ ID NO: 7233881 - DNA, 22 bp, Homo sapiens
tctggaatcagacctaatccca

SEQ ID NO: 7233882 - DNA, 22 bp, Homo sapiens
tctggaataggtcctgagtatt

SEQ ID NO: 7233883 - DNA, 22 bp, Homo sapiens
tctggaataggtcctgagtatt

SEQ ID NO: 7233884 - DNA, 22 bp, Homo sapiens
tctggaataggtcctgagtatt

SEQ ID NO: 7233885 - DNA, 22 bp, Homo sapiens
tctggaataaccctgcttccaa

SEQ ID NO: 7233886 - DNA, 22 bp, Homo sapiens
tctggaagttagaggaggaaag

SEQ ID NO: 7233887 - DNA, 22 bp, Homo sapiens
tctggaagttagaggaggaaag

SEQ ID NO: 7233888 - DNA, 22 bp, Homo sapiens
tctggaagttagaggaggaaag

SEQ ID NO: 7233889 - DNA, 22 bp, Homo sapiens
tctgggctcttagtgtaccctc

SEQ ID NO: 7233890 - DNA, 22 bp, Homo sapiens
tctgggctcttagtgtaccctc

SEQ ID NO: 7233891 - DNA, 22 bp, Homo sapiens
tctgggccctaaaccagctcta

SEQ ID NO: 7233892 - DNA, 22 bp, Homo sapiens
tctgggccctaaaccagctcta

SEQ ID NO: 7233893 - DNA, 21 bp, Homo sapiens
tctgggcccatgctgcctcac

SEQ ID NO: 7233894 - DNA, 21 bp, Homo sapiens
tctgggcccatgctgcctcac

SEQ ID NO: 7233895 - DNA, 22 bp, Homo sapiens
tctgggcccactcaacttcact

SEQ ID NO: 7233896 - DNA, 21 bp, Homo sapiens
tctgggcccatgctgcctcac

SEQ ID NO: 7233897 - DNA, 21 bp, Homo sapiens
tctgggcccatgctgcctcac

SEQ ID NO: 7233898 - DNA, 22 bp, Homo sapiens
tctgggccctaaaccagctcta

SEQ ID NO: 7233899 - DNA, 22 bp, Homo sapiens
tctgggccctaaaccagctcta

SEQ ID NO: 7233900 - DNA, 22 bp, Homo sapiens
tctgggccctaaaccagctcta

SEQ ID NO: 7233901 - DNA, 22 bp, Homo sapiens
tctgggccaacccttccatggg

SEQ ID NO: 7233902 - DNA, 22 bp, Homo sapiens
tctgggccaacccttccatggg

SEQ ID NO: 7233903 - DNA, 22 bp, Homo sapiens
tctgggcatgtctgtgaacacg

SEQ ID NO: 7233904 - DNA, 22 bp, Homo sapiens
tctgggccaacccttccatggg

SEQ ID NO: 7233905 - DNA, 22 bp, Homo sapiens
tctgggccaacccttccatggg

SEQ ID NO: 7233906 - DNA, 23 bp, Homo sapiens
tctgggccacttgtctgcacttc

SEQ ID NO: 7233907 - DNA, 23 bp, Homo sapiens
tctgggccacttgtctgcacttc

SEQ ID NO: 7233908 - DNA, 23 bp, Homo sapiens
tctgggccacttgtctgcacttc

SEQ ID NO: 7233909 - DNA, 23 bp, Homo sapiens
tctgggccacttgtctgcacttc

SEQ ID NO: 7233910 - DNA, 22 bp, Homo sapiens
tctgggccagatctagggatct

SEQ ID NO: 7233911 - DNA, 22 bp, Homo sapiens
tctgggccagatctagggatct

SEQ ID NO: 7233912 - DNA, 22 bp, Homo sapiens
tctgggccagatctagggatct

SEQ ID NO: 7233913 - DNA, 22 bp, Homo sapiens
tctgggccagatctagggatct

SEQ ID NO: 7233914 - DNA, 22 bp, Homo sapiens
tctgggccagtgatttttccag

SEQ ID NO: 7233915 - DNA, 22 bp, Homo sapiens
tctgggccagtgatttttccag

SEQ ID NO: 7233916 - DNA, 22 bp, Homo sapiens
tctgggccagtgatttttccag

SEQ ID NO: 7233917 - DNA, 22 bp, Homo sapiens
tctgggcccactcaacttcact

SEQ ID NO: 7233918 - DNA, 22 bp, Homo sapiens
tctgggcccactcaacttcact

SEQ ID NO: 7233919 - DNA, 22 bp, Homo sapiens
tctgggctgaaatgaaggcctt

SEQ ID NO: 7233920 - DNA, 22 bp, Homo sapiens
tctgggctcttagtgtaccctc

SEQ ID NO: 7233921 - DNA, 22 bp, Homo sapiens
tctgggctgaaatgaaggcctt

SEQ ID NO: 7233922 - DNA, 23 bp, Homo sapiens
tctgggctgagacttggaaggtc

SEQ ID NO: 7233923 - DNA, 23 bp, Homo sapiens
tctgggctgagacttggaaggtc

SEQ ID NO: 7233924 - DNA, 23 bp, Homo sapiens
tctgggctgagctcgagtgtaga

SEQ ID NO: 7233925 - DNA, 22 bp, Homo sapiens
tctgggctgctatgaggcagag

SEQ ID NO: 7233926 - DNA, 22 bp, Homo sapiens
tctgggctgctatgaggcagag

SEQ ID NO: 7233927 - DNA, 22 bp, Homo sapiens
tctgggctgctatgaggcagag

SEQ ID NO: 7233928 - DNA, 21 bp, Homo sapiens
tctgggctgctgctgcccatc

SEQ ID NO: 7233929 - DNA, 21 bp, Homo sapiens
tctgggctgctgctgcccatc

SEQ ID NO: 7233930 - DNA, 22 bp, Homo sapiens
tctgggctgctgtgcagtgacc

SEQ ID NO: 7233931 - DNA, 22 bp, Homo sapiens
tctgggctgctgtgcagtgacc

SEQ ID NO: 7233932 - DNA, 23 bp, Homo sapiens
tctgggctgcttaaggatcaagg

SEQ ID NO: 7233933 - DNA, 22 bp, Homo sapiens
tctgggataagaccacagattt

SEQ ID NO: 7233934 - DNA, 22 bp, Homo sapiens
tctgggagtttctgtgggagct

SEQ ID NO: 7233935 - DNA, 22 bp, Homo sapiens
tctgggatgagatcagagacac

SEQ ID NO: 7233936 - DNA, 22 bp, Homo sapiens
tctgggattttatagacatgct

SEQ ID NO: 7233937 - DNA, 22 bp, Homo sapiens
tctgggatttttgacactgaag

SEQ ID NO: 7233938 - DNA, 22 bp, Homo sapiens
tctgggcaatggatgcactcac

SEQ ID NO: 7233939 - DNA, 18 bp, Homo sapiens
tctgggcaatctcagtat

SEQ ID NO: 7233940 - DNA, 18 bp, Homo sapiens
tctgggcaatctcagtat

SEQ ID NO: 7233941 - DNA, 22 bp, Homo sapiens
tctgggcaatggatgcactcac

SEQ ID NO: 7233942 - DNA, 22 bp, Homo sapiens
tctgggcacacaccatgcccac

SEQ ID NO: 7233943 - DNA, 22 bp, Homo sapiens
tctgggcacacaccatgcccac

SEQ ID NO: 7233944 - DNA, 22 bp, Homo sapiens
tctgggcactgctgagcctgta

SEQ ID NO: 7233945 - DNA, 22 bp, Homo sapiens
tctgggcactgctgagcctgta

SEQ ID NO: 7233946 - DNA, 22 bp, Homo sapiens
tctgggcagaagcagtgcaaag

SEQ ID NO: 7233947 - DNA, 22 bp, Homo sapiens
tctgggcagcagcagctagtag

SEQ ID NO: 7233948 - DNA, 22 bp, Homo sapiens
tctgggcagagggtcttagtca

SEQ ID NO: 7233949 - DNA, 22 bp, Homo sapiens
tctgggcagagggtcttagtca

SEQ ID NO: 7233950 - DNA, 22 bp, Homo sapiens
tctgggcagcagcagctagtag

SEQ ID NO: 7233951 - DNA, 22 bp, Homo sapiens
tctgggcagccatgtgcctggc

SEQ ID NO: 7233952 - DNA, 21 bp, Homo sapiens
tctgggcagcccagtcctgag

SEQ ID NO: 7233953 - DNA, 21 bp, Homo sapiens
tctgggcagcccagtcctgag

SEQ ID NO: 7233954 - DNA, 19 bp, Homo sapiens
tctgggcagggccagcacc

SEQ ID NO: 7233955 - DNA, 22 bp, Homo sapiens
tctgggcagtacccctctccta

SEQ ID NO: 7233956 - DNA, 22 bp, Homo sapiens
tctgggcagtacccctctccta

SEQ ID NO: 7233957 - DNA, 22 bp, Homo sapiens
tctgggcagttcggatcctctg

SEQ ID NO: 7233958 - DNA, 23 bp, Homo sapiens
tctgggcatatctagtcacatcg

SEQ ID NO: 7233959 - DNA, 22 bp, Homo sapiens
tctgggcagcctcaggccaggg

SEQ ID NO: 7233960 - DNA, 22 bp, Homo sapiens
tctgggcagcctcaggccaggg

SEQ ID NO: 7233961 - DNA, 20 bp, Homo sapiens
tctgggcagggcacatggaa

SEQ ID NO: 7233962 - DNA, 20 bp, Homo sapiens
tctgggcagggcacatggaa

SEQ ID NO: 7233963 - DNA, 22 bp, Homo sapiens
tctgggagagcacgtggctgac

SEQ ID NO: 7233964 - DNA, 22 bp, Homo sapiens
tctgggagagcacgtggctgac

SEQ ID NO: 7233965 - DNA, 22 bp, Homo sapiens
tctgggagagcacgtggctgac

SEQ ID NO: 7233966 - DNA, 22 bp, Homo sapiens
tctgggagagcacgtggctgac

SEQ ID NO: 7233967 - DNA, 22 bp, Homo sapiens
tctgggacattctctccatagt

SEQ ID NO: 7233968 - DNA, 23 bp, Homo sapiens
tctgggaccactcaacaagtcag

SEQ ID NO: 7233969 - DNA, 22 bp, Homo sapiens
tctgggagaagctgatgtgaag

SEQ ID NO: 7233970 - DNA, 22 bp, Homo sapiens
tctgggagacgtgtgttgtcag

SEQ ID NO: 7233971 - DNA, 22 bp, Homo sapiens
tctgggagacgtgtgttgtcag

SEQ ID NO: 7233972 - DNA, 22 bp, Homo sapiens
tctgggagagcacgtggctgac

SEQ ID NO: 7233973 - DNA, 22 bp, Homo sapiens
tctgggagagcacgtggctgac

SEQ ID NO: 7233974 - DNA, 22 bp, Homo sapiens
tctgggagagcacgtggctgac

SEQ ID NO: 7233975 - DNA, 22 bp, Homo sapiens
tctgggagagctgctgtcagag

SEQ ID NO: 7233976 - DNA, 22 bp, Homo sapiens
tctgggagagctgctgtcagag

SEQ ID NO: 7233977 - DNA, 22 bp, Homo sapiens
tctgggagagctgctgtcagag

SEQ ID NO: 7233978 - DNA, 19 bp, Homo sapiens
tctgggaatgatgccagca

SEQ ID NO: 7233979 - DNA, 19 bp, Homo sapiens
tctgggaatgatgccagca

SEQ ID NO: 7233980 - DNA, 19 bp, Homo sapiens
tctgggaatgatgccagca

SEQ ID NO: 7233981 - DNA, 23 bp, Homo sapiens
tctgggaattggctgtccacagg

SEQ ID NO: 7233982 - DNA, 22 bp, Homo sapiens
tctgggaatgaggcccagcgat

SEQ ID NO: 7233983 - DNA, 22 bp, Homo sapiens
tctgggaatgaggcccagcgat

SEQ ID NO: 7233984 - DNA, 22 bp, Homo sapiens
tctgggaatgaggcttgggcaa

SEQ ID NO: 7233985 - DNA, 22 bp, Homo sapiens
tctgggaatgaggcttgggcaa

SEQ ID NO: 7233986 - DNA, 22 bp, Homo sapiens
tctgggaatggttgatccacac

SEQ ID NO: 7233987 - DNA, 22 bp, Homo sapiens
tctgggaatggttgatccacac

SEQ ID NO: 7233988 - DNA, 23 bp, Homo sapiens
tctgggaattggctgtccacagg

SEQ ID NO: 7233989 - DNA, 23 bp, Homo sapiens
tctgggaattggctgtccacagg

SEQ ID NO: 7233990 - DNA, 22 bp, Homo sapiens
tctgggaatttattggcacttt

SEQ ID NO: 7233991 - DNA, 22 bp, Homo sapiens
tctgggaatttattggcacttt

SEQ ID NO: 7233992 - DNA, 22 bp, Homo sapiens
tctgggaatttattggcacttt

SEQ ID NO: 7233993 - DNA, 21 bp, Homo sapiens
tctgggacagggcctgaggag

SEQ ID NO: 7233994 - DNA, 21 bp, Homo sapiens
tctgggacagggcctgaggag

SEQ ID NO: 7233995 - DNA, 22 bp, Homo sapiens
tctgggaatacacactgattta

SEQ ID NO: 7233996 - DNA, 22 bp, Homo sapiens
tctgggaatgaataagacctgt

SEQ ID NO: 7233997 - DNA, 22 bp, Homo sapiens
tctgggaatgaataagacctgt

SEQ ID NO: 7233998 - DNA, 22 bp, Homo sapiens
tctgggaataaaactagggact

SEQ ID NO: 7233999 - DNA, 22 bp, Homo sapiens
tctgggaataaaactagggact

SEQ ID NO: 7234000 - DNA, 22 bp, Homo sapiens
tctgggaagttggcagccagct

SEQ ID NO: 7234001 - DNA, 22 bp, Homo sapiens
tctgggaagtgagatgctgtgt

SEQ ID NO: 7234002 - DNA, 22 bp, Homo sapiens
tctgggaagtgagatgctgtgt

SEQ ID NO: 7234003 - DNA, 22 bp, Homo sapiens
tctgggaagtcctctgtcatgc

SEQ ID NO: 7234004 - DNA, 22 bp, Homo sapiens
tctgggaagtcctctgtcatgc

SEQ ID NO: 7234005 - DNA, 22 bp, Homo sapiens
tctgggaaggctctgcagatat

SEQ ID NO: 7234006 - DNA, 22 bp, Homo sapiens
tctgggaagtcctctgtcatgc

SEQ ID NO: 7234007 - DNA, 22 bp, Homo sapiens
tctgggaggtactgggaggtgt

SEQ ID NO: 7234008 - DNA, 22 bp, Homo sapiens
tctgggaggtaaccatgctgat

SEQ ID NO: 7234009 - DNA, 22 bp, Homo sapiens
tctgggaggtaaccatgctgat

SEQ ID NO: 7234010 - DNA, 22 bp, Homo sapiens
tctgggaggtactgggaggtgt

SEQ ID NO: 7234011 - DNA, 22 bp, Homo sapiens
tctgggaggtcacattggtctt

SEQ ID NO: 7234012 - DNA, 22 bp, Homo sapiens
tctgggaggtcacattggtctt

SEQ ID NO: 7234013 - DNA, 22 bp, Homo sapiens
tctgggaggtcacattggtctt

SEQ ID NO: 7234014 - DNA, 22 bp, Homo sapiens
tctgggaggtcacattggtctt

SEQ ID NO: 7234015 - DNA, 22 bp, Homo sapiens
tctgggaggtggcagggtgcat

SEQ ID NO: 7234016 - DNA, 22 bp, Homo sapiens
tctgggaggtggcagggtgcat

SEQ ID NO: 7234017 - DNA, 22 bp, Homo sapiens
tctgggaggtggcagggtgcat

SEQ ID NO: 7234018 - DNA, 22 bp, Homo sapiens
tctgggagagtcacaggcattg

SEQ ID NO: 7234019 - DNA, 22 bp, Homo sapiens
tctgggagagtcacaggcattg

SEQ ID NO: 7234020 - DNA, 22 bp, Homo sapiens
tctgggagggagcctcagaatc

SEQ ID NO: 7234021 - DNA, 22 bp, Homo sapiens
tctgggaggggctgccattgct

SEQ ID NO: 7234022 - DNA, 22 bp, Homo sapiens
tctgggaggggctgccattgct

SEQ ID NO: 7234023 - DNA, 22 bp, Homo sapiens
tctgggaggtggcagggtgcat

SEQ ID NO: 7234024 - DNA, 22 bp, Homo sapiens
tctgggaggtgttttgagaact

SEQ ID NO: 7234025 - DNA, 22 bp, Homo sapiens
tctgggaggtgttttgagaact

SEQ ID NO: 7234026 - DNA, 22 bp, Homo sapiens
tctgggagtaaggcctaggcat

SEQ ID NO: 7234027 - DNA, 22 bp, Homo sapiens
tctgggagtaaggcctaggcat

SEQ ID NO: 7234028 - DNA, 22 bp, Homo sapiens
tctgggagtaaggcctaggcat

SEQ ID NO: 7234029 - DNA, 22 bp, Homo sapiens
tctgggaggtgttttgagaact

SEQ ID NO: 7234030 - DNA, 21 bp, Homo sapiens
tctgggagtgggaaaatggtc

SEQ ID NO: 7234031 - DNA, 22 bp, Homo sapiens
tctgggagtgtgtctggccatc

SEQ ID NO: 7234032 - DNA, 22 bp, Homo sapiens
tctgggagtgtgtctggccatc

SEQ ID NO: 7234033 - DNA, 22 bp, Homo sapiens
tctgggagtgtgtctggccatc

SEQ ID NO: 7234034 - DNA, 22 bp, Homo sapiens
tctgggagttgtagtccggtgg

SEQ ID NO: 7234035 - DNA, 22 bp, Homo sapiens
tctgggagtttctgtgggagct

SEQ ID NO: 7234036 - DNA, 22 bp, Homo sapiens
tctggctgaagcttttgcagct

SEQ ID NO: 7234037 - DNA, 22 bp, Homo sapiens
tctggctgaaattagaaggttc

SEQ ID NO: 7234038 - DNA, 22 bp, Homo sapiens
tctggctgaattagccttgggt

SEQ ID NO: 7234039 - DNA, 22 bp, Homo sapiens
tctggctgaattagccttgggt

SEQ ID NO: 7234040 - DNA, 22 bp, Homo sapiens
tctggctgaattagccttgggt

SEQ ID NO: 7234041 - DNA, 22 bp, Homo sapiens
tctggctgaattagccttgggt

SEQ ID NO: 7234042 - DNA, 22 bp, Homo sapiens
tctggctgacatcctgtatgag

SEQ ID NO: 7234043 - DNA, 22 bp, Homo sapiens
tctggctgacatcctgtatgag

SEQ ID NO: 7234044 - DNA, 20 bp, Homo sapiens
tctggctctttgctcctccc

SEQ ID NO: 7234045 - DNA, 22 bp, Homo sapiens
tctggctgaaaggggctgtgcc

SEQ ID NO: 7234046 - DNA, 22 bp, Homo sapiens
tctggctgaaaggggctgtgcc

SEQ ID NO: 7234047 - DNA, 22 bp, Homo sapiens
tctggctctctcatcacccaat

SEQ ID NO: 7234048 - DNA, 22 bp, Homo sapiens
tctggctctctcatcacccaat

SEQ ID NO: 7234049 - DNA, 22 bp, Homo sapiens
tctggctctgaattcacttctg

SEQ ID NO: 7234050 - DNA, 22 bp, Homo sapiens
tctggctctggagtccacctgc

SEQ ID NO: 7234051 - DNA, 22 bp, Homo sapiens
tctggctctgtgtccccaccca

SEQ ID NO: 7234052 - DNA, 22 bp, Homo sapiens
tctggctctgtgtcctcaccca

SEQ ID NO: 7234053 - DNA, 20 bp, Homo sapiens
tctggctctttgctcctccc

SEQ ID NO: 7234054 - DNA, 19 bp, Homo sapiens
tctggctcctgccaggctg

SEQ ID NO: 7234055 - DNA, 22 bp, Homo sapiens
tctggctcctggctccactgcc

SEQ ID NO: 7234056 - DNA, 22 bp, Homo sapiens
tctggctcggatttgtctagca

SEQ ID NO: 7234057 - DNA, 22 bp, Homo sapiens
tctggctcggatttgtctagca

SEQ ID NO: 7234058 - DNA, 22 bp, Homo sapiens
tctggctcggatttgtctagca

SEQ ID NO: 7234059 - DNA, 22 bp, Homo sapiens
tctggctctaactaggcatcag

SEQ ID NO: 7234060 - DNA, 22 bp, Homo sapiens
tctggctctaactaggcatcag

SEQ ID NO: 7234061 - DNA, 22 bp, Homo sapiens
tctggctctaactaggcatcag

SEQ ID NO: 7234062 - DNA, 22 bp, Homo sapiens
tctggctctaactaggcatcag

SEQ ID NO: 7234063 - DNA, 22 bp, Homo sapiens
tctggctctaactaggcatcag

SEQ ID NO: 7234064 - DNA, 22 bp, Homo sapiens
tctggctctaactaggcatcag

SEQ ID NO: 7234065 - DNA, 22 bp, Homo sapiens
tctggctctataactcctagct

SEQ ID NO: 7234066 - DNA, 22 bp, Homo sapiens
tctggctctataactcctagct

SEQ ID NO: 7234067 - DNA, 23 bp, Homo sapiens
tctggctctatgtgacagctctc

SEQ ID NO: 7234068 - DNA, 22 bp, Homo sapiens
tctggctctcaacaaatattta

SEQ ID NO: 7234069 - DNA, 22 bp, Homo sapiens
tctggctctcatactcgccagt

SEQ ID NO: 7234070 - DNA, 22 bp, Homo sapiens
tctggctctcatactcgccagt

SEQ ID NO: 7234071 - DNA, 22 bp, Homo sapiens
tctggctctccagtgctcttag

SEQ ID NO: 7234072 - DNA, 22 bp, Homo sapiens
tctggctctccagtgctcttag

SEQ ID NO: 7234073 - DNA, 22 bp, Homo sapiens
tctggctccacacctcactgca

SEQ ID NO: 7234074 - DNA, 22 bp, Homo sapiens
tctggccctatggcatgtacct

SEQ ID NO: 7234075 - DNA, 21 bp, Homo sapiens
tctggccctcacagtcacacc

SEQ ID NO: 7234076 - DNA, 21 bp, Homo sapiens
tctggccctcacagtcacacc

SEQ ID NO: 7234077 - DNA, 22 bp, Homo sapiens
tctggctccactctgtgcatgc

SEQ ID NO: 7234078 - DNA, 22 bp, Homo sapiens
tctggctccactttcttcattt

SEQ ID NO: 7234079 - DNA, 22 bp, Homo sapiens
tctggctccactttcttcattt

SEQ ID NO: 7234080 - DNA, 22 bp, Homo sapiens
tctggctccaggaccgggcaca

SEQ ID NO: 7234081 - DNA, 22 bp, Homo sapiens
tctggctcccagcctgctctca

SEQ ID NO: 7234082 - DNA, 22 bp, Homo sapiens
tctggctcccagcctgctctca

SEQ ID NO: 7234083 - DNA, 22 bp, Homo sapiens
tctggctccctggagctccaca

SEQ ID NO: 7234084 - DNA, 22 bp, Homo sapiens
tctggctccctggagctccaca

SEQ ID NO: 7234085 - DNA, 19 bp, Homo sapiens
tctggctccgcctcttagt

SEQ ID NO: 7234086 - DNA, 22 bp, Homo sapiens
tctggctccgtgtccgctccca

SEQ ID NO: 7234087 - DNA, 22 bp, Homo sapiens
tctggctcctgagtccatgctc

SEQ ID NO: 7234088 - DNA, 22 bp, Homo sapiens
tctggctcctgagtccatgctc

SEQ ID NO: 7234089 - DNA, 22 bp, Homo sapiens
tctggctcctgagtccatgctc

SEQ ID NO: 7234090 - DNA, 22 bp, Homo sapiens
tctggcccctggtctctggtgt

SEQ ID NO: 7234091 - DNA, 22 bp, Homo sapiens
tctggcccctggcagtcctgga

SEQ ID NO: 7234092 - DNA, 22 bp, Homo sapiens
tctggccccggtcttcacagct

SEQ ID NO: 7234093 - DNA, 22 bp, Homo sapiens
tctggcccctggcagtcctgga

SEQ ID NO: 7234094 - DNA, 22 bp, Homo sapiens
tctggccccggtcttcacagct

SEQ ID NO: 7234095 - DNA, 22 bp, Homo sapiens
tctggctgtgtaaggtagcacc

SEQ ID NO: 7234096 - DNA, 22 bp, Homo sapiens
tctggctgtgtatgagagtttt

SEQ ID NO: 7234097 - DNA, 22 bp, Homo sapiens
tctggctgttaggcctgacctt

SEQ ID NO: 7234098 - DNA, 22 bp, Homo sapiens
tctggctgggaagggggcccga

SEQ ID NO: 7234099 - DNA, 22 bp, Homo sapiens
tctggctgggtgagagcttctc

SEQ ID NO: 7234100 - DNA, 23 bp, Homo sapiens
tctggctgtaatatgaaagttag

SEQ ID NO: 7234101 - DNA, 23 bp, Homo sapiens
tctggctgtaatatgaaagttag

SEQ ID NO: 7234102 - DNA, 22 bp, Homo sapiens
tctggctgtcattggaggcccc

SEQ ID NO: 7234103 - DNA, 22 bp, Homo sapiens
tctggctgtcattggaggcccc

SEQ ID NO: 7234104 - DNA, 22 bp, Homo sapiens
tctggctgtcattggaggcccc

SEQ ID NO: 7234105 - DNA, 22 bp, Homo sapiens
tctggctgtcattggaggcccc

SEQ ID NO: 7234106 - DNA, 22 bp, Homo sapiens
tctggctgtgtaaggtagcacc

SEQ ID NO: 7234107 - DNA, 22 bp, Homo sapiens
tctggctgacatcctgtatgag

SEQ ID NO: 7234108 - DNA, 22 bp, Homo sapiens
tctggctgattccctgggactg

SEQ ID NO: 7234109 - DNA, 22 bp, Homo sapiens
tctggctgattccctgggactg

SEQ ID NO: 7234110 - DNA, 22 bp, Homo sapiens
tctggctgattccctgggactg

SEQ ID NO: 7234111 - DNA, 19 bp, Homo sapiens
tctggctgccaaggattga

SEQ ID NO: 7234112 - DNA, 22 bp, Homo sapiens
tctggctgccaccatcctcccc

SEQ ID NO: 7234113 - DNA, 23 bp, Homo sapiens
tctggctgctcctttcaatgctc

SEQ ID NO: 7234114 - DNA, 23 bp, Homo sapiens
tctggctgctcctttcaatgctc

SEQ ID NO: 7234115 - DNA, 22 bp, Homo sapiens
tctggctgctgcgtgagtgctt

SEQ ID NO: 7234116 - DNA, 22 bp, Homo sapiens
tctggctggcagtgatggtgtg

SEQ ID NO: 7234117 - DNA, 22 bp, Homo sapiens
tctggctggcagtgatggtgtg

SEQ ID NO: 7234118 - DNA, 22 bp, Homo sapiens
tctggctggctcggccgggagt

SEQ ID NO: 7234119 - DNA, 22 bp, Homo sapiens
tctggctggctcggccgggagt

SEQ ID NO: 7234120 - DNA, 22 bp, Homo sapiens
tctggctggctcggccgggagt

SEQ ID NO: 7234121 - DNA, 22 bp, Homo sapiens
tctgggaacacacgtcacttca

SEQ ID NO: 7234122 - DNA, 21 bp, Homo sapiens
tctgggaaattgggaaagaag

SEQ ID NO: 7234123 - DNA, 21 bp, Homo sapiens
tctgggaaattgggaaagaag

SEQ ID NO: 7234124 - DNA, 22 bp, Homo sapiens
tctgggaacacacgtcacttca

SEQ ID NO: 7234125 - DNA, 22 bp, Homo sapiens
tctgggaaatgggcagcttcgc

SEQ ID NO: 7234126 - DNA, 22 bp, Homo sapiens
tctgggaacactttgtgagctc

SEQ ID NO: 7234127 - DNA, 22 bp, Homo sapiens
tctgggaacagcctggctgtgt

SEQ ID NO: 7234128 - DNA, 22 bp, Homo sapiens
tctgggaacagcctggctgtgt

SEQ ID NO: 7234129 - DNA, 22 bp, Homo sapiens
tctgggaacagcttagctccag

SEQ ID NO: 7234130 - DNA, 22 bp, Homo sapiens
tctgggaacagcttagctccag

SEQ ID NO: 7234131 - DNA, 22 bp, Homo sapiens
tctgggaacatggcttggaatc

SEQ ID NO: 7234132 - DNA, 22 bp, Homo sapiens
tctgggaacatggcttggaatc

SEQ ID NO: 7234133 - DNA, 22 bp, Homo sapiens
tctgggaaatggctacttgtca

SEQ ID NO: 7234134 - DNA, 22 bp, Homo sapiens
tctgggaaatagaggaccctag

SEQ ID NO: 7234135 - DNA, 22 bp, Homo sapiens
tctgggaaatagaggaccctag

SEQ ID NO: 7234136 - DNA, 22 bp, Homo sapiens
tctgggaaatgctgttccttgt

SEQ ID NO: 7234137 - DNA, 22 bp, Homo sapiens
tctgggaaacactgcatcccca

SEQ ID NO: 7234138 - DNA, 22 bp, Homo sapiens
tctgggaaacactgcatcccca

SEQ ID NO: 7234139 - DNA, 22 bp, Homo sapiens
tctgggaaacactgcatcccca

SEQ ID NO: 7234140 - DNA, 22 bp, Homo sapiens
tctgggaaagtaaatgtaaagg

SEQ ID NO: 7234141 - DNA, 22 bp, Homo sapiens
tctgggaaagtaaatgtaaagg

SEQ ID NO: 7234142 - DNA, 22 bp, Homo sapiens
tctgggaaagtaaatgtaaagg

SEQ ID NO: 7234143 - DNA, 23 bp, Homo sapiens
tctggctttgctggaagttttga

SEQ ID NO: 7234144 - DNA, 22 bp, Homo sapiens
tctgggaacgaaggctaatatg

SEQ ID NO: 7234145 - DNA, 22 bp, Homo sapiens
tctgggaactatatctggtggt

SEQ ID NO: 7234146 - DNA, 22 bp, Homo sapiens
tctgggaactctgtcatttccc

SEQ ID NO: 7234147 - DNA, 22 bp, Homo sapiens
tctgggaactgagctcccctag

SEQ ID NO: 7234148 - DNA, 22 bp, Homo sapiens
tctgggaactgagctcccctag

SEQ ID NO: 7234149 - DNA, 22 bp, Homo sapiens
tctgggaactgagctcccctag

SEQ ID NO: 7234150 - DNA, 22 bp, Homo sapiens
tctgggaacattttgagggcaa

SEQ ID NO: 7234151 - DNA, 22 bp, Homo sapiens
tctgggaaccaaagggtgctta

SEQ ID NO: 7234152 - DNA, 22 bp, Homo sapiens
tctgggaaccagtgcggctggg

SEQ ID NO: 7234153 - DNA, 22 bp, Homo sapiens
tctgggaaccattggtggggat

SEQ ID NO: 7234154 - DNA, 22 bp, Homo sapiens
tctgggaacgaaggctaatatg

SEQ ID NO: 7234155 - DNA, 22 bp, Homo sapiens
tctgggaacgaaggctaatatg

SEQ ID NO: 7234156 - DNA, 22 bp, Homo sapiens
tctgggaacattttgagggcaa

SEQ ID NO: 7234157 - DNA, 22 bp, Homo sapiens
tctgggaaccaaagggtgctta

SEQ ID NO: 7234158 - DNA, 22 bp, Homo sapiens
tctgggaaggagcctgagaatt

SEQ ID NO: 7234159 - DNA, 22 bp, Homo sapiens
tctgggaaggctctgcagatat

SEQ ID NO: 7234160 - DNA, 22 bp, Homo sapiens
tctgggaaggctctgcagatat

SEQ ID NO: 7234161 - DNA, 22 bp, Homo sapiens
tctgggaagctgcgtgcctgtt

SEQ ID NO: 7234162 - DNA, 22 bp, Homo sapiens
tctgggaagctgcgtgcctgtt

SEQ ID NO: 7234163 - DNA, 22 bp, Homo sapiens
tctgggaagctggtcctgttct

SEQ ID NO: 7234164 - DNA, 22 bp, Homo sapiens
tctgggaagcaaatatgtaaga

SEQ ID NO: 7234165 - DNA, 22 bp, Homo sapiens
tctgggaagcaaatatgtaaga

SEQ ID NO: 7234166 - DNA, 22 bp, Homo sapiens
tctgggaagacggatggaccct

SEQ ID NO: 7234167 - DNA, 22 bp, Homo sapiens
tctgggaagacggatggaccct

SEQ ID NO: 7234168 - DNA, 22 bp, Homo sapiens
tctgggaagatgtttcaaaggt

SEQ ID NO: 7234169 - DNA, 22 bp, Homo sapiens
tctgggaagatgtttcaaaggt

SEQ ID NO: 7234170 - DNA, 19 bp, Homo sapiens
tctgggaagccgggctcca

SEQ ID NO: 7234171 - DNA, 22 bp, Homo sapiens
tctgggaagctgcgtgcctgtt

SEQ ID NO: 7234172 - DNA, 22 bp, Homo sapiens
tctgggaagcctgtatgcagaa

SEQ ID NO: 7234173 - DNA, 22 bp, Homo sapiens
tctgggaagcctgtatgcagaa

SEQ ID NO: 7234174 - DNA, 22 bp, Homo sapiens
tctgggaagcctgtatgcagaa

SEQ ID NO: 7234175 - DNA, 19 bp, Homo sapiens
tctgcccagttgtctgccc

SEQ ID NO: 7234176 - DNA, 22 bp, Homo sapiens
tctgcccagtttgtgctcaggt

SEQ ID NO: 7234177 - DNA, 22 bp, Homo sapiens
tctgcccagtttgtgctcaggt

SEQ ID NO: 7234178 - DNA, 22 bp, Homo sapiens
tctgcccagtttgtgctcaggt

SEQ ID NO: 7234179 - DNA, 22 bp, Homo sapiens
tctgcccattcttagagtctag

SEQ ID NO: 7234180 - DNA, 22 bp, Homo sapiens
tctgcccattcttagagtctag

SEQ ID NO: 7234181 - DNA, 18 bp, Homo sapiens
tctgccccagccgcactg

SEQ ID NO: 7234182 - DNA, 22 bp, Homo sapiens
tctgcccctgctgggcacagag

SEQ ID NO: 7234183 - DNA, 22 bp, Homo sapiens
tctgccctaattcagtgcttag

SEQ ID NO: 7234184 - DNA, 22 bp, Homo sapiens
tctgccctcgaggagcttgtgt

SEQ ID NO: 7234185 - DNA, 22 bp, Homo sapiens
tctgccctcattgctgcctgga

SEQ ID NO: 7234186 - DNA, 21 bp, Homo sapiens
tctgccctccaggagctcata

SEQ ID NO: 7234187 - DNA, 21 bp, Homo sapiens
tctgccctccaggagctcata

SEQ ID NO: 7234188 - DNA, 22 bp, Homo sapiens
tctgccctcattgctgcctgga

SEQ ID NO: 7234189 - DNA, 19 bp, Homo sapiens
tctgcccagttgtctgccc

SEQ ID NO: 7234190 - DNA, 22 bp, Homo sapiens
tctgcccagggcagggcttgca

SEQ ID NO: 7234191 - DNA, 22 bp, Homo sapiens
tctgcccagggacaggacacag

SEQ ID NO: 7234192 - DNA, 22 bp, Homo sapiens
tctgcccagggacaggacacag

SEQ ID NO: 7234193 - DNA, 22 bp, Homo sapiens
tctgcccagggacccacaggga

SEQ ID NO: 7234194 - DNA, 22 bp, Homo sapiens
tctgcccagggacccacaggga

SEQ ID NO: 7234195 - DNA, 22 bp, Homo sapiens
tctgcccagggacccacaggga

SEQ ID NO: 7234196 - DNA, 22 bp, Homo sapiens
tctgcccaggaggtcccatggg

SEQ ID NO: 7234197 - DNA, 22 bp, Homo sapiens
tctgcccaggaggtcccatggg

SEQ ID NO: 7234198 - DNA, 18 bp, Homo sapiens
tctgcccaggacttggac

SEQ ID NO: 7234199 - DNA, 18 bp, Homo sapiens
tctgcccaggacttggac

SEQ ID NO: 7234200 - DNA, 22 bp, Homo sapiens
tctgcccaggacacctgccact

SEQ ID NO: 7234201 - DNA, 22 bp, Homo sapiens
tctgcccaggacacctgccact

SEQ ID NO: 7234202 - DNA, 22 bp, Homo sapiens
tctgcccactgctctgctgccc

SEQ ID NO: 7234203 - DNA, 20 bp, Homo sapiens
tctgcccaccccggctccca

SEQ ID NO: 7234204 - DNA, 22 bp, Homo sapiens
tctgcccactgctctgctgccc

SEQ ID NO: 7234205 - DNA, 22 bp, Homo sapiens
tctgcccactgctctgctgccc

SEQ ID NO: 7234206 - DNA, 22 bp, Homo sapiens
tctgcccactgctctgctgccc

SEQ ID NO: 7234207 - DNA, 22 bp, Homo sapiens
tctgcccagccagacccaaggt

SEQ ID NO: 7234208 - DNA, 22 bp, Homo sapiens
tctgcccagccagacccaaggt

SEQ ID NO: 7234209 - DNA, 22 bp, Homo sapiens
tctgcccagctaaaaatgggag

SEQ ID NO: 7234210 - DNA, 22 bp, Homo sapiens
tctgcccaggacacctgccact

SEQ ID NO: 7234211 - DNA, 20 bp, Homo sapiens
tctgcccaccccggctccca

SEQ ID NO: 7234212 - DNA, 20 bp, Homo sapiens
tctgcccaccccggctccca

SEQ ID NO: 7234213 - DNA, 22 bp, Homo sapiens
tctgcccaccagcggttgcata

SEQ ID NO: 7234214 - DNA, 22 bp, Homo sapiens
tctgcccaccagcggttgcata

SEQ ID NO: 7234215 - DNA, 22 bp, Homo sapiens
tctgcccacagcctcctgtcca

SEQ ID NO: 7234216 - DNA, 22 bp, Homo sapiens
tctgcccacagcctcctgtcca

SEQ ID NO: 7234217 - DNA, 22 bp, Homo sapiens
tctgcccacagcctcctgtcca

SEQ ID NO: 7234218 - DNA, 22 bp, Homo sapiens
tctgcccacagtccaatagttg

SEQ ID NO: 7234219 - DNA, 22 bp, Homo sapiens
tctgcccacagtccaatagttg

SEQ ID NO: 7234220 - DNA, 22 bp, Homo sapiens
tctgccgtgcgaggtcccacca

SEQ ID NO: 7234221 - DNA, 22 bp, Homo sapiens
tctgccgtgcgaggtcccacca

SEQ ID NO: 7234222 - DNA, 22 bp, Homo sapiens
tctgccgtgcgaggtcccacca

SEQ ID NO: 7234223 - DNA, 22 bp, Homo sapiens
tctgcctgagcagagggaggcc

SEQ ID NO: 7234224 - DNA, 21 bp, Homo sapiens
tctgcctgagactttgctggt

SEQ ID NO: 7234225 - DNA, 22 bp, Homo sapiens
tctgcctgaggactgacaccag

SEQ ID NO: 7234226 - DNA, 22 bp, Homo sapiens
tctgccctggggtcagcctcca

SEQ ID NO: 7234227 - DNA, 22 bp, Homo sapiens
tctgccctggggtcagcctcca

SEQ ID NO: 7234228 - DNA, 22 bp, Homo sapiens
tctgccctggggtcagcctcca

SEQ ID NO: 7234229 - DNA, 22 bp, Homo sapiens
tctgccctggggtcagcctcca

SEQ ID NO: 7234230 - DNA, 22 bp, Homo sapiens
tctgccctgccattcactggaa

SEQ ID NO: 7234231 - DNA, 22 bp, Homo sapiens
tctgccctgccattcactggaa

SEQ ID NO: 7234232 - DNA, 22 bp, Homo sapiens
tctgccctgcagggagcagtaa

SEQ ID NO: 7234233 - DNA, 22 bp, Homo sapiens
tctgcctgagggagctgaggaa

SEQ ID NO: 7234234 - DNA, 18 bp, Homo sapiens
tctgcctgcagggcatct

SEQ ID NO: 7234235 - DNA, 18 bp, Homo sapiens
tctgcctgcagggcatct

SEQ ID NO: 7234236 - DNA, 22 bp, Homo sapiens
tctgcctgagggagctgaggaa

SEQ ID NO: 7234237 - DNA, 22 bp, Homo sapiens
tctgcctgagggagctgaggaa

SEQ ID NO: 7234238 - DNA, 22 bp, Homo sapiens
tctgcctgccagtctggtcctc

SEQ ID NO: 7234239 - DNA, 22 bp, Homo sapiens
tctgcctgccagtctggtcctc

SEQ ID NO: 7234240 - DNA, 22 bp, Homo sapiens
tctgcctgccgagaacacctac

SEQ ID NO: 7234241 - DNA, 22 bp, Homo sapiens
tctgcctgcgctcacggggccg

SEQ ID NO: 7234242 - DNA, 22 bp, Homo sapiens
tctgcctgccagtctggtcctc

SEQ ID NO: 7234243 - DNA, 22 bp, Homo sapiens
tctgcctgccagtctggtcctc

SEQ ID NO: 7234244 - DNA, 22 bp, Homo sapiens
tctgcctgcagtgtggcagggc

SEQ ID NO: 7234245 - DNA, 22 bp, Homo sapiens
tctgcctggagagttcttctct

SEQ ID NO: 7234246 - DNA, 22 bp, Homo sapiens
tctgcctggaccctggtgagct

SEQ ID NO: 7234247 - DNA, 22 bp, Homo sapiens
tctgcctggagagttcttctct

SEQ ID NO: 7234248 - DNA, 22 bp, Homo sapiens
tctgcctgctgcctgggggctc

SEQ ID NO: 7234249 - DNA, 22 bp, Homo sapiens
tctgcctgctgcctgggggctc

SEQ ID NO: 7234250 - DNA, 22 bp, Homo sapiens
tctgcctgcttcttcatagtct

SEQ ID NO: 7234251 - DNA, 22 bp, Homo sapiens
tctgcctgcttcttcatagtct

SEQ ID NO: 7234252 - DNA, 22 bp, Homo sapiens
tctgcctgcttcttcatagtct

SEQ ID NO: 7234253 - DNA, 19 bp, Homo sapiens
tctgcctgcttgtaggggc

SEQ ID NO: 7234254 - DNA, 19 bp, Homo sapiens
tctgcctgcttgtaggggc

SEQ ID NO: 7234255 - DNA, 22 bp, Homo sapiens
tctgcctggaccctggtgagct

SEQ ID NO: 7234256 - DNA, 22 bp, Homo sapiens
tctgcctgcggctgcaggtggc

SEQ ID NO: 7234257 - DNA, 22 bp, Homo sapiens
tctgcctgcgctcacggggccg

SEQ ID NO: 7234258 - DNA, 22 bp, Homo sapiens
tctgcctgcgctcacggggccg

SEQ ID NO: 7234259 - DNA, 22 bp, Homo sapiens
tctgcctgcggctgcaggtggc

SEQ ID NO: 7234260 - DNA, 22 bp, Homo sapiens
tctgcctgctaactcctgcacc

SEQ ID NO: 7234261 - DNA, 22 bp, Homo sapiens
tctgcctgctaactcctgcacc

SEQ ID NO: 7234262 - DNA, 22 bp, Homo sapiens
tctgcctgctaactcctgcacc

SEQ ID NO: 7234263 - DNA, 22 bp, Homo sapiens
tctgcctgcggctgcaggtggc

SEQ ID NO: 7234264 - DNA, 22 bp, Homo sapiens
tctgcctgctaactcctgcacc

SEQ ID NO: 7234265 - DNA, 22 bp, Homo sapiens
tctgcctgtagtcccacacctc

SEQ ID NO: 7234266 - DNA, 22 bp, Homo sapiens
tctgcctgtacctcttttttgc

SEQ ID NO: 7234267 - DNA, 22 bp, Homo sapiens
tctgcctgggtgtggagcagag

SEQ ID NO: 7234268 - DNA, 22 bp, Homo sapiens
tctgcctgggtgtggagcagag

SEQ ID NO: 7234269 - DNA, 22 bp, Homo sapiens
tctgcctgtaatatttggagaa

SEQ ID NO: 7234270 - DNA, 22 bp, Homo sapiens
tctgcctgggtgtggagcagag

SEQ ID NO: 7234271 - DNA, 22 bp, Homo sapiens
tctgcctggattccattctcca

SEQ ID NO: 7234272 - DNA, 22 bp, Homo sapiens
tctgcctggattttggaaagct

SEQ ID NO: 7234273 - DNA, 22 bp, Homo sapiens
tctgcctggattccattctcca

SEQ ID NO: 7234274 - DNA, 22 bp, Homo sapiens
tctgcctggattccattctcca

SEQ ID NO: 7234275 - DNA, 22 bp, Homo sapiens
tctgcctggatgatggcagggc

SEQ ID NO: 7234276 - DNA, 22 bp, Homo sapiens
tctgcctggattttggaaagct

SEQ ID NO: 7234277 - DNA, 22 bp, Homo sapiens
tctgcctggcctggagggcaca

SEQ ID NO: 7234278 - DNA, 22 bp, Homo sapiens
tctgcctggcctggagggcaca

SEQ ID NO: 7234279 - DNA, 22 bp, Homo sapiens
tctgcctggcctggagggcaca

SEQ ID NO: 7234280 - DNA, 22 bp, Homo sapiens
tctgccttccccataatctgat

SEQ ID NO: 7234281 - DNA, 22 bp, Homo sapiens
tctgccttccccataatctgat

SEQ ID NO: 7234282 - DNA, 22 bp, Homo sapiens
tctgccttagcaattgtcaagg

SEQ ID NO: 7234283 - DNA, 20 bp, Homo sapiens
tctgccttatgaccttcgcc

SEQ ID NO: 7234284 - DNA, 20 bp, Homo sapiens
tctgccttatgaccttcgcc

SEQ ID NO: 7234285 - DNA, 20 bp, Homo sapiens
tctgccttagggggagcctc

SEQ ID NO: 7234286 - DNA, 22 bp, Homo sapiens
tctgcctgttgagcctaaggcc

SEQ ID NO: 7234287 - DNA, 22 bp, Homo sapiens
tctgcctgttgagcctaaggcc

SEQ ID NO: 7234288 - DNA, 22 bp, Homo sapiens
tctgcctgttgagcctaaggcc

SEQ ID NO: 7234289 - DNA, 22 bp, Homo sapiens
tctgcctgttcccgattccatg

SEQ ID NO: 7234290 - DNA, 22 bp, Homo sapiens
tctgcctgttcccgattccatg

SEQ ID NO: 7234291 - DNA, 22 bp, Homo sapiens
tctgcctgttcaagtcttctag

SEQ ID NO: 7234292 - DNA, 22 bp, Homo sapiens
tctgcctgtggatacatgctct

SEQ ID NO: 7234293 - DNA, 22 bp, Homo sapiens
tctgcctgtggtggaggaagtt

SEQ ID NO: 7234294 - DNA, 22 bp, Homo sapiens
tctgcctgtgctgtgttttcat

SEQ ID NO: 7234295 - DNA, 22 bp, Homo sapiens
tctgctcagtgcttatctctaa

SEQ ID NO: 7234296 - DNA, 22 bp, Homo sapiens
tctgctcaggttacctagctag

SEQ ID NO: 7234297 - DNA, 22 bp, Homo sapiens
tctgctcaggttacctagctag

SEQ ID NO: 7234298 - DNA, 22 bp, Homo sapiens
tctgctctagttgcttcctgcc

SEQ ID NO: 7234299 - DNA, 22 bp, Homo sapiens
tctgctctagttgcttcctgcc

SEQ ID NO: 7234300 - DNA, 22 bp, Homo sapiens
tctgctctagttgcttcctgcc

SEQ ID NO: 7234301 - DNA, 20 bp, Homo sapiens
tctgctcagccctcagtggc

SEQ ID NO: 7234302 - DNA, 22 bp, Homo sapiens
tctgctcagcatccctctgaga

SEQ ID NO: 7234303 - DNA, 20 bp, Homo sapiens
tctgctcagccctcagtggc

SEQ ID NO: 7234304 - DNA, 22 bp, Homo sapiens
tctgctcagccgatctgctccg

SEQ ID NO: 7234305 - DNA, 22 bp, Homo sapiens
tctgccttgaggtcctcagctc

SEQ ID NO: 7234306 - DNA, 22 bp, Homo sapiens
tctgccttgaggtcctcagctc

SEQ ID NO: 7234307 - DNA, 22 bp, Homo sapiens
tctgccttcttttagtcatctt

SEQ ID NO: 7234308 - DNA, 22 bp, Homo sapiens
tctgccttcttttagtcatctt

SEQ ID NO: 7234309 - DNA, 22 bp, Homo sapiens
tctgccttctatcttttgtctg

SEQ ID NO: 7234310 - DNA, 22 bp, Homo sapiens
tctgccttcgctgctccctgaa

SEQ ID NO: 7234311 - DNA, 22 bp, Homo sapiens
tctgccttcgctgctccctgaa

SEQ ID NO: 7234312 - DNA, 22 bp, Homo sapiens
tctgccttcgctgctccctgaa

SEQ ID NO: 7234313 - DNA, 22 bp, Homo sapiens
tctgccttcgctgctccctgaa

SEQ ID NO: 7234314 - DNA, 22 bp, Homo sapiens
tctgccttgaggtcctcagctc

SEQ ID NO: 7234315 - DNA, 22 bp, Homo sapiens
tctgccttgatggcattgagaa

SEQ ID NO: 7234316 - DNA, 22 bp, Homo sapiens
tctgccttgatggcattgagaa

SEQ ID NO: 7234317 - DNA, 22 bp, Homo sapiens
tctgctcacatggctccatgca

SEQ ID NO: 7234318 - DNA, 22 bp, Homo sapiens
tctgctcacgtgtattctccat

SEQ ID NO: 7234319 - DNA, 22 bp, Homo sapiens
tctgctcagcatccctctgaga

SEQ ID NO: 7234320 - DNA, 22 bp, Homo sapiens
tctgccatcttacatggtcact

SEQ ID NO: 7234321 - DNA, 22 bp, Homo sapiens
tctgccatcttaattctctttt

SEQ ID NO: 7234322 - DNA, 22 bp, Homo sapiens
tctgccatgcacccggacagct

SEQ ID NO: 7234323 - DNA, 22 bp, Homo sapiens
tctgccatgctaacttcagtat

SEQ ID NO: 7234324 - DNA, 22 bp, Homo sapiens
tctgccatgggtatttaggatt

SEQ ID NO: 7234325 - DNA, 18 bp, Homo sapiens
tctgccatgtgaggacac

SEQ ID NO: 7234326 - DNA, 22 bp, Homo sapiens
tctgccatgtgaggatatagga

SEQ ID NO: 7234327 - DNA, 22 bp, Homo sapiens
tctgccattgatgagctggcat

SEQ ID NO: 7234328 - DNA, 22 bp, Homo sapiens
tctgcccaaggctgtcactaga

SEQ ID NO: 7234329 - DNA, 19 bp, Homo sapiens
tctgcccacaagaaaggga

SEQ ID NO: 7234330 - DNA, 21 bp, Homo sapiens
tctgcccacactggccactgc

SEQ ID NO: 7234331 - DNA, 21 bp, Homo sapiens
tctgcccacactggccactgc

SEQ ID NO: 7234332 - DNA, 21 bp, Homo sapiens
tctgcccacactggccactgc

SEQ ID NO: 7234333 - DNA, 21 bp, Homo sapiens
tctgcccacactggccactgc

SEQ ID NO: 7234334 - DNA, 22 bp, Homo sapiens
tctgcccacagcctcctgtcca

SEQ ID NO: 7234335 - DNA, 23 bp, Homo sapiens
tctgccagtgtgtgccaggagcc

SEQ ID NO: 7234336 - DNA, 22 bp, Homo sapiens
tctgccagttagaaactggtta

SEQ ID NO: 7234337 - DNA, 23 bp, Homo sapiens
tctgccagttccttgatcatgga

SEQ ID NO: 7234338 - DNA, 22 bp, Homo sapiens
tctgccagtttatagacaagcc

SEQ ID NO: 7234339 - DNA, 22 bp, Homo sapiens
tctgccagtttatagacaagcc

SEQ ID NO: 7234340 - DNA, 22 bp, Homo sapiens
tctgccatcaagatgctctggc

SEQ ID NO: 7234341 - DNA, 22 bp, Homo sapiens
tctgccatcaagatgctctggc

SEQ ID NO: 7234342 - DNA, 22 bp, Homo sapiens
tctgccaggccacacagggcac

SEQ ID NO: 7234343 - DNA, 22 bp, Homo sapiens
tctgccaggccacacagggcac

SEQ ID NO: 7234344 - DNA, 22 bp, Homo sapiens
tctgccacactggttcagtgga

SEQ ID NO: 7234345 - DNA, 22 bp, Homo sapiens
tctgccacatgagggcacagca

SEQ ID NO: 7234346 - DNA, 22 bp, Homo sapiens
tctgccaccaactgtcactaca

SEQ ID NO: 7234347 - DNA, 22 bp, Homo sapiens
tctgccaccaactgtcactaca

SEQ ID NO: 7234348 - DNA, 22 bp, Homo sapiens
tctgccaggcctgcttccgggg

SEQ ID NO: 7234349 - DNA, 22 bp, Homo sapiens
tctgccaggcttggtgctagat

SEQ ID NO: 7234350 - DNA, 22 bp, Homo sapiens
tctgccaggtggggagaggcca

SEQ ID NO: 7234351 - DNA, 22 bp, Homo sapiens
tctgccaggttgttatgctact

SEQ ID NO: 7234352 - DNA, 22 bp, Homo sapiens
tctgccagtattcacggcccgt

SEQ ID NO: 7234353 - DNA, 23 bp, Homo sapiens
tctgccagtgtgtgccaggagcc

SEQ ID NO: 7234354 - DNA, 22 bp, Homo sapiens
tctgcatccgaacccgccaccg

SEQ ID NO: 7234355 - DNA, 22 bp, Homo sapiens
tctgcatctcaggattcccttc

SEQ ID NO: 7234356 - DNA, 19 bp, Homo sapiens
tctgcatggcaggaagaga

SEQ ID NO: 7234357 - DNA, 21 bp, Homo sapiens
tctgcattttagcaagatctc

SEQ ID NO: 7234358 - DNA, 22 bp, Homo sapiens
tctgcatttttaacaagatccc

SEQ ID NO: 7234359 - DNA, 22 bp, Homo sapiens
tctgcaggtagagctcaggaat

SEQ ID NO: 7234360 - DNA, 22 bp, Homo sapiens
tctgcaggtagagctcaggaat

SEQ ID NO: 7234361 - DNA, 22 bp, Homo sapiens
tctgcaggtcacgctccagcct

SEQ ID NO: 7234362 - DNA, 22 bp, Homo sapiens
tctgcaggtcacgctccagcct

SEQ ID NO: 7234363 - DNA, 22 bp, Homo sapiens
tctgcaggtcacgctccagcct

SEQ ID NO: 7234364 - DNA, 22 bp, Homo sapiens
tctgcaggtcacgctccagcct

SEQ ID NO: 7234365 - DNA, 22 bp, Homo sapiens
tctgcaggtgggcccctagaat

SEQ ID NO: 7234366 - DNA, 22 bp, Homo sapiens
tctgcaggtgggcccctagaat

SEQ ID NO: 7234367 - DNA, 22 bp, Homo sapiens
tctgcaggtgggcccctagaat

SEQ ID NO: 7234368 - DNA, 22 bp, Homo sapiens
tctgcaggtgggcccctagaat

SEQ ID NO: 7234369 - DNA, 22 bp, Homo sapiens
tctgcaggtgttggaagggtca

SEQ ID NO: 7234370 - DNA, 22 bp, Homo sapiens
tctgcaggtgttggaagggtca

SEQ ID NO: 7234371 - DNA, 22 bp, Homo sapiens
tctgcatattgttaatggaatg

SEQ ID NO: 7234372 - DNA, 22 bp, Homo sapiens
tctgcaggctctagatgaggtt

SEQ ID NO: 7234373 - DNA, 22 bp, Homo sapiens
tctgcaggctctagatgaggtt

SEQ ID NO: 7234374 - DNA, 22 bp, Homo sapiens
tctgcaggctgtacaggaagca

SEQ ID NO: 7234375 - DNA, 22 bp, Homo sapiens
tctgcaggctgtacaggaagca

SEQ ID NO: 7234376 - DNA, 22 bp, Homo sapiens
tctgcaggcttataggatgggt

SEQ ID NO: 7234377 - DNA, 22 bp, Homo sapiens
tctgcaggcttataggatgggt

SEQ ID NO: 7234378 - DNA, 22 bp, Homo sapiens
tctgcaggcttataggatgggt

SEQ ID NO: 7234379 - DNA, 22 bp, Homo sapiens
tctgcaggcttggagtggcagc

SEQ ID NO: 7234380 - DNA, 22 bp, Homo sapiens
tctgcaggcttggagtggcagc

SEQ ID NO: 7234381 - DNA, 22 bp, Homo sapiens
tctgcaggcttggagtggcagc

SEQ ID NO: 7234382 - DNA, 22 bp, Homo sapiens
tctgcagggatgtgaggggtga

SEQ ID NO: 7234383 - DNA, 22 bp, Homo sapiens
tctgcagggatgtgaggggtga

SEQ ID NO: 7234384 - DNA, 22 bp, Homo sapiens
tctgcagggatgtgaggggtga

SEQ ID NO: 7234385 - DNA, 22 bp, Homo sapiens
tctgcagggcccttggctcctg

SEQ ID NO: 7234386 - DNA, 22 bp, Homo sapiens
tctgcagggcccttggctcctg

SEQ ID NO: 7234387 - DNA, 22 bp, Homo sapiens
tctgcagggcccttggctcctg

SEQ ID NO: 7234388 - DNA, 17 bp, Homo sapiens
tctgcagggggccgtgt

SEQ ID NO: 7234389 - DNA, 17 bp, Homo sapiens
tctgcagggggccgtgt

SEQ ID NO: 7234390 - DNA, 17 bp, Homo sapiens
tctgcagggggccgtgt

SEQ ID NO: 7234391 - DNA, 22 bp, Homo sapiens
tctgcagggtcccagcctcagc

SEQ ID NO: 7234392 - DNA, 22 bp, Homo sapiens
tctgcagggtcccagcctcagc

SEQ ID NO: 7234393 - DNA, 22 bp, Homo sapiens
tctgcaggtaagcgttcttgga

SEQ ID NO: 7234394 - DNA, 22 bp, Homo sapiens
tctgcaggcctcgacaaggcca

SEQ ID NO: 7234395 - DNA, 22 bp, Homo sapiens
tctgcaggcatttttggttgtc

SEQ ID NO: 7234396 - DNA, 22 bp, Homo sapiens
tctgcaggatcagagccagagg

SEQ ID NO: 7234397 - DNA, 22 bp, Homo sapiens
tctgcaggatcagagccagagg

SEQ ID NO: 7234398 - DNA, 22 bp, Homo sapiens
tctgcaggatgcaaagtgtaca

SEQ ID NO: 7234399 - DNA, 22 bp, Homo sapiens
tctgcaggatggatgctcagaa

SEQ ID NO: 7234400 - DNA, 22 bp, Homo sapiens
tctgcaggagagtgccctagag

SEQ ID NO: 7234401 - DNA, 22 bp, Homo sapiens
tctgcaggagagtgccctagag

SEQ ID NO: 7234402 - DNA, 22 bp, Homo sapiens
tctgcaggagagtgccctagag

SEQ ID NO: 7234403 - DNA, 22 bp, Homo sapiens
tctgcaggagcagggcgtggag

SEQ ID NO: 7234404 - DNA, 22 bp, Homo sapiens
tctgcaggagcagggcgtggag

SEQ ID NO: 7234405 - DNA, 22 bp, Homo sapiens
tctgcaggagcagggcgtggag

SEQ ID NO: 7234406 - DNA, 22 bp, Homo sapiens
tctgcaggaggctggctgcagg

SEQ ID NO: 7234407 - DNA, 22 bp, Homo sapiens
tctgcaggaggctggctgcagg

SEQ ID NO: 7234408 - DNA, 22 bp, Homo sapiens
tctgcaggaggctggctgcagg

SEQ ID NO: 7234409 - DNA, 22 bp, Homo sapiens
tctgcaggatcagagccagagg

SEQ ID NO: 7234410 - DNA, 22 bp, Homo sapiens
tctgcaggatcagagccagagg

SEQ ID NO: 7234411 - DNA, 22 bp, Homo sapiens
tctgcaggatcagagccagagg

SEQ ID NO: 7234412 - DNA, 22 bp, Homo sapiens
tctgcagctttcccctgattta

SEQ ID NO: 7234413 - DNA, 22 bp, Homo sapiens
tctgcagctttttggtggggtg

SEQ ID NO: 7234414 - DNA, 22 bp, Homo sapiens
tctgcagcttcttgccagagag

SEQ ID NO: 7234415 - DNA, 22 bp, Homo sapiens
tctgcagcttcttgccagagag

SEQ ID NO: 7234416 - DNA, 22 bp, Homo sapiens
tctgcagcttgcacaggcaggc

SEQ ID NO: 7234417 - DNA, 22 bp, Homo sapiens
tctgcaggaaaaaagtgcctgg

SEQ ID NO: 7234418 - DNA, 22 bp, Homo sapiens
tctgcaggaagctggcggctga

SEQ ID NO: 7234419 - DNA, 22 bp, Homo sapiens
tctgcaggaagctggcggctga

SEQ ID NO: 7234420 - DNA, 22 bp, Homo sapiens
tctgcaggaagctggcggctga

SEQ ID NO: 7234421 - DNA, 18 bp, Homo sapiens
tctgcaggacctcagggc

SEQ ID NO: 7234422 - DNA, 18 bp, Homo sapiens
tctgcaggacctcagggc

SEQ ID NO: 7234423 - DNA, 18 bp, Homo sapiens
tctgcaggacctcagggc

SEQ ID NO: 7234424 - DNA, 22 bp, Homo sapiens
tctgcaggactgaggcctgttt

SEQ ID NO: 7234425 - DNA, 22 bp, Homo sapiens
tctgcaggactgaggcctgttt

SEQ ID NO: 7234426 - DNA, 22 bp, Homo sapiens
tctgcaggactgaggcctgttt

SEQ ID NO: 7234427 - DNA, 22 bp, Homo sapiens
tctgcaggagagtgccctagag

SEQ ID NO: 7234428 - DNA, 22 bp, Homo sapiens
tctgcaagtttatcacttggga

SEQ ID NO: 7234429 - DNA, 22 bp, Homo sapiens
tctgcaagtagatgacagtgag

SEQ ID NO: 7234430 - DNA, 22 bp, Homo sapiens
tctgcacaaaactgtcgcagaa

SEQ ID NO: 7234431 - DNA, 22 bp, Homo sapiens
tctgcacagctcacctccctgg

SEQ ID NO: 7234432 - DNA, 22 bp, Homo sapiens
tctgcacaggcgtaggttgact

SEQ ID NO: 7234433 - DNA, 22 bp, Homo sapiens
tctgcacataggtaggctggaa

SEQ ID NO: 7234434 - DNA, 22 bp, Homo sapiens
tctgcacatggcgctggtcctg

SEQ ID NO: 7234435 - DNA, 22 bp, Homo sapiens
tctgcacatggcgctggtcctg

SEQ ID NO: 7234436 - DNA, 22 bp, Homo sapiens
tctgcacatgtagtaaatatta

SEQ ID NO: 7234437 - DNA, 18 bp, Homo sapiens
tctgcactcctgagagag

SEQ ID NO: 7234438 - DNA, 22 bp, Homo sapiens
tctgcactgggagcatgtctgg

SEQ ID NO: 7234439 - DNA, 22 bp, Homo sapiens
tctgcagaaactgtgactatgt

SEQ ID NO: 7234440 - DNA, 22 bp, Homo sapiens
tctgcagaaactgtgactatgt

SEQ ID NO: 7234441 - DNA, 22 bp, Homo sapiens
tctgcagaaagtggctcagtgg

SEQ ID NO: 7234442 - DNA, 22 bp, Homo sapiens
tctgcagaaagtggctcagtgg

SEQ ID NO: 7234443 - DNA, 22 bp, Homo sapiens
tctgcagaactttatgagcaaa

SEQ ID NO: 7234444 - DNA, 22 bp, Homo sapiens
tctgcagaactttatgagcaaa

SEQ ID NO: 7234445 - DNA, 22 bp, Homo sapiens
tctgcagaactttatgagcaaa

SEQ ID NO: 7234446 - DNA, 22 bp, Homo sapiens
tctgcagaagaattaaggacag

SEQ ID NO: 7234447 - DNA, 22 bp, Homo sapiens
tctgcagaagaattaaggacag

SEQ ID NO: 7234448 - DNA, 22 bp, Homo sapiens
tctgcagaagccatggccttgc

SEQ ID NO: 7234449 - DNA, 22 bp, Homo sapiens
tctgagctatccagatagtatt

SEQ ID NO: 7234450 - DNA, 22 bp, Homo sapiens
tctgagctaatcctgttgccga

SEQ ID NO: 7234451 - DNA, 22 bp, Homo sapiens
tctgagctcaagtgacagttag

SEQ ID NO: 7234452 - DNA, 22 bp, Homo sapiens
tctgagctctatctgtgggaat

SEQ ID NO: 7234453 - DNA, 22 bp, Homo sapiens
tctgagctctatctgtgggaat

SEQ ID NO: 7234454 - DNA, 21 bp, Homo sapiens
tctgagctgagtcctctaggt

SEQ ID NO: 7234455 - DNA, 19 bp, Homo sapiens
tctgagctgatatgacatt

SEQ ID NO: 7234456 - DNA, 21 bp, Homo sapiens
tctgagctgagtcctctaggt

SEQ ID NO: 7234457 - DNA, 22 bp, Homo sapiens
tctgagctgcccctttactttg

SEQ ID NO: 7234458 - DNA, 22 bp, Homo sapiens
tctgagctgcagagtggggtgg

SEQ ID NO: 7234459 - DNA, 22 bp, Homo sapiens
tctgagctgggtcttgacagct

SEQ ID NO: 7234460 - DNA, 22 bp, Homo sapiens
tctgagcttactcagggataca

SEQ ID NO: 7234461 - DNA, 22 bp, Homo sapiens
tctgagcttctgcatttccaac

SEQ ID NO: 7234462 - DNA, 22 bp, Homo sapiens
tctgagctgtggccattcttcc

SEQ ID NO: 7234463 - DNA, 22 bp, Homo sapiens
tctgagacttctgaagctagaa

SEQ ID NO: 7234464 - DNA, 23 bp, Homo sapiens
tctgagagaacaatgcctcctat

SEQ ID NO: 7234465 - DNA, 22 bp, Homo sapiens
tctgagagagcacctatccact

SEQ ID NO: 7234466 - DNA, 22 bp, Homo sapiens
tctgagacccatacaggcccac

SEQ ID NO: 7234467 - DNA, 20 bp, Homo sapiens
tctgagacctttccacaccc

SEQ ID NO: 7234468 - DNA, 22 bp, Homo sapiens
tctgagaatggtggatgtggtg

SEQ ID NO: 7234469 - DNA, 22 bp, Homo sapiens
tctgagaatggtggatgtggtg

SEQ ID NO: 7234470 - DNA, 22 bp, Homo sapiens
tctgagacaacttagccctcga

SEQ ID NO: 7234471 - DNA, 22 bp, Homo sapiens
tctgagagagggtcagatgcta

SEQ ID NO: 7234472 - DNA, 22 bp, Homo sapiens
tctgagagagggtcagatgcta

SEQ ID NO: 7234473 - DNA, 22 bp, Homo sapiens
tctgagagagggtcagatgcta

SEQ ID NO: 7234474 - DNA, 22 bp, Homo sapiens
tctgagagatacaaggaggcaa

SEQ ID NO: 7234475 - DNA, 22 bp, Homo sapiens
tctgagagatacaaggaggcaa

SEQ ID NO: 7234476 - DNA, 22 bp, Homo sapiens
tctgagcacatcacacagctca

SEQ ID NO: 7234477 - DNA, 22 bp, Homo sapiens
tctgagcactgggcagtcggtg

SEQ ID NO: 7234478 - DNA, 22 bp, Homo sapiens
tctgagcactgggcagtcggtg

SEQ ID NO: 7234479 - DNA, 22 bp, Homo sapiens
tctgagcagctttgttttgtgt

SEQ ID NO: 7234480 - DNA, 22 bp, Homo sapiens
tctgagcagctttgttttgtgt

SEQ ID NO: 7234481 - DNA, 22 bp, Homo sapiens
tctgagcatatgcagcacctgg

SEQ ID NO: 7234482 - DNA, 22 bp, Homo sapiens
tctgagcagggcagtgtccatg

SEQ ID NO: 7234483 - DNA, 22 bp, Homo sapiens
tctgagcatatgcagcacctgg

SEQ ID NO: 7234484 - DNA, 22 bp, Homo sapiens
tctgagcagggcagtgtccatg

SEQ ID NO: 7234485 - DNA, 22 bp, Homo sapiens
tctgagcagggcagtgtccatg

SEQ ID NO: 7234486 - DNA, 22 bp, Homo sapiens
tctgagcattgagctctccaaa

SEQ ID NO: 7234487 - DNA, 22 bp, Homo sapiens
tctgagccacagatgtcctgtt

SEQ ID NO: 7234488 - DNA, 22 bp, Homo sapiens
tctgagccacctgagcccatgg

SEQ ID NO: 7234489 - DNA, 22 bp, Homo sapiens
tctgagccacctgagcccatgg

SEQ ID NO: 7234490 - DNA, 22 bp, Homo sapiens
tctgagccacctgccagtgctg

SEQ ID NO: 7234491 - DNA, 22 bp, Homo sapiens
tctgagccacctgccagtgctg

SEQ ID NO: 7234492 - DNA, 22 bp, Homo sapiens
tctgagccagacaagacagcca

SEQ ID NO: 7234493 - DNA, 22 bp, Homo sapiens
tctgagccagggtctcctccct

SEQ ID NO: 7234494 - DNA, 22 bp, Homo sapiens
tctgagccagggtctcctccct

SEQ ID NO: 7234495 - DNA, 22 bp, Homo sapiens
tctgagccataagagtacagga

SEQ ID NO: 7234496 - DNA, 22 bp, Homo sapiens
tctgagcccagtgagtctcgca

SEQ ID NO: 7234497 - DNA, 22 bp, Homo sapiens
tctgacttccttttctgatcca

SEQ ID NO: 7234498 - DNA, 22 bp, Homo sapiens
tctgacctgcaggcacagcaat

SEQ ID NO: 7234499 - DNA, 22 bp, Homo sapiens
tctgactagttgcagccaggag

SEQ ID NO: 7234500 - DNA, 22 bp, Homo sapiens
tctgacattttgagaatgacat

SEQ ID NO: 7234501 - DNA, 22 bp, Homo sapiens
tctgacattttgagaatgacat

SEQ ID NO: 7234502 - DNA, 22 bp, Homo sapiens
tctgacattagattaattggaa

SEQ ID NO: 7234503 - DNA, 22 bp, Homo sapiens
tctgacagtgtgaatattgact

SEQ ID NO: 7234504 - DNA, 22 bp, Homo sapiens
tctgacagttatataagcacca

SEQ ID NO: 7234505 - DNA, 22 bp, Homo sapiens
tctgacagttatataagcacca

SEQ ID NO: 7234506 - DNA, 22 bp, Homo sapiens
tctgacattagattaattggaa

SEQ ID NO: 7234507 - DNA, 22 bp, Homo sapiens
tctgacattagattaattggaa

SEQ ID NO: 7234508 - DNA, 22 bp, Homo sapiens
tctgacaggtcattttctatag

SEQ ID NO: 7234509 - DNA, 22 bp, Homo sapiens
tctgacaggtcattttctatag

SEQ ID NO: 7234510 - DNA, 22 bp, Homo sapiens
tctgacaggttgggatatggaa

SEQ ID NO: 7234511 - DNA, 22 bp, Homo sapiens
tctgacagtcacagtggaggat

SEQ ID NO: 7234512 - DNA, 22 bp, Homo sapiens
tctgacagtcacagtggaggat

SEQ ID NO: 7234513 - DNA, 22 bp, Homo sapiens
tctgacaagtcaagtcttgact

SEQ ID NO: 7234514 - DNA, 22 bp, Homo sapiens
tctgacaatgaacaatctatag

SEQ ID NO: 7234515 - DNA, 22 bp, Homo sapiens
tctgacaatgaacaatctatag

SEQ ID NO: 7234516 - DNA, 19 bp, Homo sapiens
tctgacagccccagtcaac

SEQ ID NO: 7234517 - DNA, 22 bp, Homo sapiens
tctgacagctccaggcagcaat

SEQ ID NO: 7234518 - DNA, 22 bp, Homo sapiens
tctgacagctccaggcagcaat

SEQ ID NO: 7234519 - DNA, 22 bp, Homo sapiens
tctgacagggccaaacatgaca

SEQ ID NO: 7234520 - DNA, 17 bp, Homo sapiens
tctgagaatgctggagg

SEQ ID NO: 7234521 - DNA, 22 bp, Homo sapiens
tctgagaatggagctaaaaatc

SEQ ID NO: 7234522 - DNA, 22 bp, Homo sapiens
tctgagaatggagctaaaaatc

SEQ ID NO: 7234523 - DNA, 17 bp, Homo sapiens
tctgagaatgctggagg

SEQ ID NO: 7234524 - DNA, 22 bp, Homo sapiens
tctgagaatgagtgttttctta

SEQ ID NO: 7234525 - DNA, 17 bp, Homo sapiens
tctgagaatgctggagg

SEQ ID NO: 7234526 - DNA, 22 bp, Homo sapiens
tctgagaagggtaggctccatt

SEQ ID NO: 7234527 - DNA, 22 bp, Homo sapiens
tctgagaaggtgcatcagctgc

SEQ ID NO: 7234528 - DNA, 23 bp, Homo sapiens
tctgagaaggtttcagccagact

SEQ ID NO: 7234529 - DNA, 23 bp, Homo sapiens
tctgagaaggtttcagccagact

SEQ ID NO: 7234530 - DNA, 23 bp, Homo sapiens
tctgagaaggtttcagccagact

SEQ ID NO: 7234531 - DNA, 22 bp, Homo sapiens
tctgagaataaaaattgcattt

SEQ ID NO: 7234532 - DNA, 22 bp, Homo sapiens
tctgagaataaaaattgcattt

SEQ ID NO: 7234533 - DNA, 22 bp, Homo sapiens
tctgagaatagtgccactgtgg

SEQ ID NO: 7234534 - DNA, 22 bp, Homo sapiens
tctgagaaggaagctctgtgta

SEQ ID NO: 7234535 - DNA, 22 bp, Homo sapiens
tctgagaagctagaggacaaag

SEQ ID NO: 7234536 - DNA, 22 bp, Homo sapiens
tctgagaagctagaggacaaag

SEQ ID NO: 7234537 - DNA, 22 bp, Homo sapiens
tctgagaagctagaggacaaag

SEQ ID NO: 7234538 - DNA, 20 bp, Homo sapiens
tctgagaagccactgtccaa

SEQ ID NO: 7234539 - DNA, 22 bp, Homo sapiens
tctgagaagccctgtggggagg

SEQ ID NO: 7234540 - DNA, 22 bp, Homo sapiens
tctgagaagccctgtggggagg

SEQ ID NO: 7234541 - DNA, 22 bp, Homo sapiens
tctgagaagcgggagcctgtga

SEQ ID NO: 7234542 - DNA, 22 bp, Homo sapiens
tctgagaagcgtgtctctgttt

SEQ ID NO: 7234543 - DNA, 22 bp, Homo sapiens
tctgagaagcgtgtctctgttt

SEQ ID NO: 7234544 - DNA, 22 bp, Homo sapiens
tctgagaagctagaggacaaag

SEQ ID NO: 7234545 - DNA, 22 bp, Homo sapiens
tctgagaagctagaggacaaag

SEQ ID NO: 7234546 - DNA, 21 bp, Homo sapiens
tctgagaacttctgctgcagc

SEQ ID NO: 7234547 - DNA, 21 bp, Homo sapiens
tctgagaacttctgctgcagc

SEQ ID NO: 7234548 - DNA, 22 bp, Homo sapiens
tctgagaacatgctttgatcat

SEQ ID NO: 7234549 - DNA, 22 bp, Homo sapiens
tctgagaactccgggttagatc

SEQ ID NO: 7234550 - DNA, 21 bp, Homo sapiens
tctgagaacttctgctgcagc

SEQ ID NO: 7234551 - DNA, 17 bp, Homo sapiens
tctgagaacttgaagca

SEQ ID NO: 7234552 - DNA, 17 bp, Homo sapiens
tctgagaacttgaagca

SEQ ID NO: 7234553 - DNA, 20 bp, Homo sapiens
tctgagaagcaaacaatgtt

SEQ ID NO: 7234554 - DNA, 20 bp, Homo sapiens
tctgagaagcaaacaatgtt

SEQ ID NO: 7234555 - DNA, 22 bp, Homo sapiens
tctgagaagcaccttctggaca

SEQ ID NO: 7234556 - DNA, 22 bp, Homo sapiens
tctgagaagcaccttctggaca

SEQ ID NO: 7234557 - DNA, 22 bp, Homo sapiens
tctgagaaatcagtggtgaata

SEQ ID NO: 7234558 - DNA, 22 bp, Homo sapiens
tctgagaaatcagtggtgaata

SEQ ID NO: 7234559 - DNA, 22 bp, Homo sapiens
tctgagaaatcagtggtgaata

SEQ ID NO: 7234560 - DNA, 22 bp, Homo sapiens
tctgagaaatcagtggtgaata

SEQ ID NO: 7234561 - DNA, 22 bp, Homo sapiens
tctgagaaatttctttgtgatg

SEQ ID NO: 7234562 - DNA, 22 bp, Homo sapiens
tctgagaaatttctttgtgatg

SEQ ID NO: 7234563 - DNA, 22 bp, Homo sapiens
tctgagaacatcatttcctaca

SEQ ID NO: 7234564 - DNA, 22 bp, Homo sapiens
tctgagaacataaattgacttc

SEQ ID NO: 7234565 - DNA, 22 bp, Homo sapiens
tctgagaacataaattgacttc

SEQ ID NO: 7234566 - DNA, 22 bp, Homo sapiens
tctgagaaaataggaaacttga

SEQ ID NO: 7234567 - DNA, 17 bp, Homo sapiens
tctgagaaaggagaatc

SEQ ID NO: 7234568 - DNA, 17 bp, Homo sapiens
tctgagaaaggagaatc

SEQ ID NO: 7234569 - DNA, 17 bp, Homo sapiens
tctgagaaaggagaatc

SEQ ID NO: 7234570 - DNA, 22 bp, Homo sapiens
tctgagaaagtactgtatgttc

SEQ ID NO: 7234571 - DNA, 22 bp, Homo sapiens
tctgaggtcacagatttcaaga

SEQ ID NO: 7234572 - DNA, 22 bp, Homo sapiens
tctgaggtaccagctggtttat

SEQ ID NO: 7234573 - DNA, 22 bp, Homo sapiens
tctgagggttgtagagagggac

SEQ ID NO: 7234574 - DNA, 22 bp, Homo sapiens
tctgagggttgtagagagggac

SEQ ID NO: 7234575 - DNA, 22 bp, Homo sapiens
tctgagggtgggagaaggagct

SEQ ID NO: 7234576 - DNA, 22 bp, Homo sapiens
tctgagggttgtagagagggac

SEQ ID NO: 7234577 - DNA, 19 bp, Homo sapiens
tctgagggtccagatgcat

SEQ ID NO: 7234578 - DNA, 22 bp, Homo sapiens
tctgagggtgaggcccagaatc

SEQ ID NO: 7234579 - DNA, 18 bp, Homo sapiens
tctgagggtgcgggagct

SEQ ID NO: 7234580 - DNA, 18 bp, Homo sapiens
tctgagggtgcgggagct

SEQ ID NO: 7234581 - DNA, 22 bp, Homo sapiens
tctgagggctgtactatgcacg

SEQ ID NO: 7234582 - DNA, 22 bp, Homo sapiens
tctgaggggccagggatctggg

SEQ ID NO: 7234583 - DNA, 22 bp, Homo sapiens
tctgagggaatagctattgtag

SEQ ID NO: 7234584 - DNA, 23 bp, Homo sapiens
tctgagggagtgggcagtggcac

SEQ ID NO: 7234585 - DNA, 23 bp, Homo sapiens
tctgagggagtgggcagtggcac

SEQ ID NO: 7234586 - DNA, 23 bp, Homo sapiens
tctgagggagtgggcagtggcac

SEQ ID NO: 7234587 - DNA, 19 bp, Homo sapiens
tctgaggcttctccccttg

SEQ ID NO: 7234588 - DNA, 19 bp, Homo sapiens
tctgaggcttctccccttg

SEQ ID NO: 7234589 - DNA, 22 bp, Homo sapiens
tctgagggaatagctattgtag

SEQ ID NO: 7234590 - DNA, 22 bp, Homo sapiens
tctgaggctgcatctatgtgac

SEQ ID NO: 7234591 - DNA, 22 bp, Homo sapiens
tctgaggctgtctctgggctcc

SEQ ID NO: 7234592 - DNA, 22 bp, Homo sapiens
tctgaggctgtctctgggctcc

SEQ ID NO: 7234593 - DNA, 22 bp, Homo sapiens
tctgaggcttcagactgtactg

SEQ ID NO: 7234594 - DNA, 20 bp, Homo sapiens
tctgaggctgagcccagcgt

SEQ ID NO: 7234595 - DNA, 20 bp, Homo sapiens
tctgaggctgagctctactt

SEQ ID NO: 7234596 - DNA, 22 bp, Homo sapiens
tctgaggctaagagacagaggc

SEQ ID NO: 7234597 - DNA, 22 bp, Homo sapiens
tctgaggctaagagacagaggc

SEQ ID NO: 7234598 - DNA, 22 bp, Homo sapiens
tctgaggctatgttcaggctaa

SEQ ID NO: 7234599 - DNA, 22 bp, Homo sapiens
tctgaggccttggcagctaagg

SEQ ID NO: 7234600 - DNA, 22 bp, Homo sapiens
tctgaggccttcagcatgaatc

SEQ ID NO: 7234601 - DNA, 22 bp, Homo sapiens
tctgaggccttgggacagaagt

SEQ ID NO: 7234602 - DNA, 22 bp, Homo sapiens
tctgaggctaagagacagaggc

SEQ ID NO: 7234603 - DNA, 22 bp, Homo sapiens
tctgaggcctgaagcagcagag

SEQ ID NO: 7234604 - DNA, 22 bp, Homo sapiens
tctgaggcctgaagcagcagag

SEQ ID NO: 7234605 - DNA, 22 bp, Homo sapiens
tctgaggccctgcaggcagtgt

SEQ ID NO: 7234606 - DNA, 22 bp, Homo sapiens
tctgaggccctaccctgagcct

SEQ ID NO: 7234607 - DNA, 22 bp, Homo sapiens
tctgaggccctaccctgagcct

SEQ ID NO: 7234608 - DNA, 22 bp, Homo sapiens
tctgaggccctaccctgagcct

SEQ ID NO: 7234609 - DNA, 22 bp, Homo sapiens
tctgaggccctgcaggcagtgt

SEQ ID NO: 7234610 - DNA, 22 bp, Homo sapiens
tctgaggacaaactgcatgctg

SEQ ID NO: 7234611 - DNA, 18 bp, Homo sapiens
tctgaggaatggaagagc

SEQ ID NO: 7234612 - DNA, 18 bp, Homo sapiens
tctgaggaatggaagagc

SEQ ID NO: 7234613 - DNA, 18 bp, Homo sapiens
tctgaggaatggaagagc

SEQ ID NO: 7234614 - DNA, 22 bp, Homo sapiens
tctgaggaattctgcagtgaga

SEQ ID NO: 7234615 - DNA, 22 bp, Homo sapiens
tctgagctttcttgtgctcaag

SEQ ID NO: 7234616 - DNA, 22 bp, Homo sapiens
tctgaggaaagagagtgggatg

SEQ ID NO: 7234617 - DNA, 22 bp, Homo sapiens
tctgaggaactggcaaagatgg

SEQ ID NO: 7234618 - DNA, 21 bp, Homo sapiens
tctgatggtagatgagatgtg

SEQ ID NO: 7234619 - DNA, 21 bp, Homo sapiens
tctgatggtagatgagatgtg

SEQ ID NO: 7234620 - DNA, 21 bp, Homo sapiens
tctgatggtagatgagatgtg

SEQ ID NO: 7234621 - DNA, 21 bp, Homo sapiens
tctgatggtagatgagatgtg

SEQ ID NO: 7234622 - DNA, 22 bp, Homo sapiens
tctgatgtaagttcttccagag

SEQ ID NO: 7234623 - DNA, 22 bp, Homo sapiens
tctgatgtaggcttttctggga

SEQ ID NO: 7234624 - DNA, 21 bp, Homo sapiens
tctgatggtagatgagatgtg

SEQ ID NO: 7234625 - DNA, 22 bp, Homo sapiens
tctgatgcaatgtaagtcttgg

SEQ ID NO: 7234626 - DNA, 21 bp, Homo sapiens
tctgatggtagatgagatgtg

SEQ ID NO: 7234627 - DNA, 21 bp, Homo sapiens
tctgatggtagatgagatgtg

SEQ ID NO: 7234628 - DNA, 21 bp, Homo sapiens
tctgatggtagatgagatgtg

SEQ ID NO: 7234629 - DNA, 22 bp, Homo sapiens
tctgatgcaatgtaagtcttgg

SEQ ID NO: 7234630 - DNA, 22 bp, Homo sapiens
tctgaggttactgctttgtaga

SEQ ID NO: 7234631 - DNA, 22 bp, Homo sapiens
tctgaggttattgtctgccatt

SEQ ID NO: 7234632 - DNA, 22 bp, Homo sapiens
tctgaggttaatcctgctgcat

SEQ ID NO: 7234633 - DNA, 22 bp, Homo sapiens
tctgaggttaatcctgctgcat

SEQ ID NO: 7234634 - DNA, 23 bp, Homo sapiens
tctgaggtggctcttgctttgaa

SEQ ID NO: 7234635 - DNA, 17 bp, Homo sapiens
tctgaggtgaggatgca

SEQ ID NO: 7234636 - DNA, 22 bp, Homo sapiens
tctgaggtctatgactttgctt

SEQ ID NO: 7234637 - DNA, 23 bp, Homo sapiens
tctgaggtccaccagtttgcaga

SEQ ID NO: 7234638 - DNA, 22 bp, Homo sapiens
tctgattccagagcattgctca

SEQ ID NO: 7234639 - DNA, 22 bp, Homo sapiens
tctgattgatgcagaccatatt

SEQ ID NO: 7234640 - DNA, 22 bp, Homo sapiens
tctgatttactggaaaaaagga

SEQ ID NO: 7234641 - DNA, 22 bp, Homo sapiens
tctgattagctccatttgctaa

SEQ ID NO: 7234642 - DNA, 22 bp, Homo sapiens
tctgattcattcatgtgcacca

SEQ ID NO: 7234643 - DNA, 22 bp, Homo sapiens
tctgattagcagtttagggaaa

SEQ ID NO: 7234644 - DNA, 22 bp, Homo sapiens
tctgattagagcattcttgagt

SEQ ID NO: 7234645 - DNA, 22 bp, Homo sapiens
tctgattagagcattcttgagt

SEQ ID NO: 7234646 - DNA, 22 bp, Homo sapiens
tctgatgttgtgacatcacttc

SEQ ID NO: 7234647 - DNA, 22 bp, Homo sapiens
tctgattacttgagttatttag

SEQ ID NO: 7234648 - DNA, 23 bp, Homo sapiens
tctgatgttctcttatgctgtag

SEQ ID NO: 7234649 - DNA, 23 bp, Homo sapiens
tctgatgttctcttatgctgtag

SEQ ID NO: 7234650 - DNA, 21 bp, Homo sapiens
tctgatgtgtttaatggtggg

SEQ ID NO: 7234651 - DNA, 21 bp, Homo sapiens
tctgatgtgtttaatggtggg

SEQ ID NO: 7234652 - DNA, 21 bp, Homo sapiens
tctgatgtgtttaatggtggg

SEQ ID NO: 7234653 - DNA, 22 bp, Homo sapiens
tctgatgtggcagctgcatcta

SEQ ID NO: 7234654 - DNA, 22 bp, Homo sapiens
tctgatgtctgaaatgctcttg

SEQ ID NO: 7234655 - DNA, 22 bp, Homo sapiens
tctgcaaaagtgttcataaaga

SEQ ID NO: 7234656 - DNA, 22 bp, Homo sapiens
tctgcaaacccccatctatcat

SEQ ID NO: 7234657 - DNA, 22 bp, Homo sapiens
tctgcaaactggctcttactgc

SEQ ID NO: 7234658 - DNA, 22 bp, Homo sapiens
tctgcaaatattagcttagaca

SEQ ID NO: 7234659 - DNA, 22 bp, Homo sapiens
tctgcaacagtgccctgtaaat

SEQ ID NO: 7234660 - DNA, 22 bp, Homo sapiens
tctgcaagcgtcacatgattct

SEQ ID NO: 7234661 - DNA, 22 bp, Homo sapiens
tctgcaagatcattaaagcaga

SEQ ID NO: 7234662 - DNA, 22 bp, Homo sapiens
tctgcaacattcctctccccac

SEQ ID NO: 7234663 - DNA, 22 bp, Homo sapiens
tctcaaataggccttggtcctg

SEQ ID NO: 7234664 - DNA, 22 bp, Homo sapiens
tctcaaatatttggagagagga

SEQ ID NO: 7234665 - DNA, 23 bp, Homo sapiens
tctcaaatatgatctgggtcatc

SEQ ID NO: 7234666 - DNA, 22 bp, Homo sapiens
tctcaaatatttggagagagga

SEQ ID NO: 7234667 - DNA, 22 bp, Homo sapiens
tctcaaactgtgtattataatt

SEQ ID NO: 7234668 - DNA, 23 bp, Homo sapiens
tctcaaacagtgagttcaccaga

SEQ ID NO: 7234669 - DNA, 22 bp, Homo sapiens
tctcaaactaacaatgattata

SEQ ID NO: 7234670 - DNA, 23 bp, Homo sapiens
tctcaaacagtgagttcaccaga

SEQ ID NO: 7234671 - DNA, 22 bp, Homo sapiens
tctatttttatagttgaagtgc

SEQ ID NO: 7234672 - DNA, 18 bp, Homo sapiens
tctcaaaaataatggctt

SEQ ID NO: 7234673 - DNA, 18 bp, Homo sapiens
tctcaaaaataatggctt

SEQ ID NO: 7234674 - DNA, 22 bp, Homo sapiens
tctatttttatagttgaagtgc

SEQ ID NO: 7234675 - DNA, 22 bp, Homo sapiens
tctatttttatagttgaagtgc

SEQ ID NO: 7234676 - DNA, 22 bp, Homo sapiens
tctatttttatagttgaagtgc

SEQ ID NO: 7234677 - DNA, 22 bp, Homo sapiens
tctatttttatagttgaagtgc

SEQ ID NO: 7234678 - DNA, 22 bp, Homo sapiens
tctattttcttgccaaaactgc

SEQ ID NO: 7234679 - DNA, 22 bp, Homo sapiens
tctattttgtttccagctctac

SEQ ID NO: 7234680 - DNA, 22 bp, Homo sapiens
tctattttgtttccagctctac

SEQ ID NO: 7234681 - DNA, 22 bp, Homo sapiens
tctatttaccaaatgtagttcc

SEQ ID NO: 7234682 - DNA, 22 bp, Homo sapiens
tctatttaggagaccctggttc

SEQ ID NO: 7234683 - DNA, 22 bp, Homo sapiens
tctattgtccaatctttcacct

SEQ ID NO: 7234684 - DNA, 22 bp, Homo sapiens
tctattgtccaatctttcacct

SEQ ID NO: 7234685 - DNA, 22 bp, Homo sapiens
tctattcattcaatttagctct

SEQ ID NO: 7234686 - DNA, 22 bp, Homo sapiens
tctattgattggcttcctggat

SEQ ID NO: 7234687 - DNA, 22 bp, Homo sapiens
tctattgggactctgcggtgag

SEQ ID NO: 7234688 - DNA, 22 bp, Homo sapiens
tctattgggactctgcggtgag

SEQ ID NO: 7234689 - DNA, 22 bp, Homo sapiens
tctattggtaggggctgaggca

SEQ ID NO: 7234690 - DNA, 22 bp, Homo sapiens
tctattggtaggggctgaggca

SEQ ID NO: 7234691 - DNA, 22 bp, Homo sapiens
tctattttatactcaaatcttc

SEQ ID NO: 7234692 - DNA, 22 bp, Homo sapiens
tctattttatactcaaatcttc

SEQ ID NO: 7234693 - DNA, 22 bp, Homo sapiens
tctatttgctggttgcttctgt

SEQ ID NO: 7234694 - DNA, 22 bp, Homo sapiens
tctatttctgggtttgtgtggt

SEQ ID NO: 7234695 - DNA, 22 bp, Homo sapiens
tctattttatactcaaatcttc

SEQ ID NO: 7234696 - DNA, 22 bp, Homo sapiens
tctattttatactcaaatcttc

SEQ ID NO: 7234697 - DNA, 22 bp, Homo sapiens
tctattttcttgccaaaactgc

SEQ ID NO: 7234698 - DNA, 22 bp, Homo sapiens
tctcacagcatcattgctcatg

SEQ ID NO: 7234699 - DNA, 22 bp, Homo sapiens
tctcacagcatcattgctcatg

SEQ ID NO: 7234700 - DNA, 22 bp, Homo sapiens
tctcacagcaggggccaggtct

SEQ ID NO: 7234701 - DNA, 22 bp, Homo sapiens
tctcacagcatcattgctcatg

SEQ ID NO: 7234702 - DNA, 22 bp, Homo sapiens
tctcacagccatttctccctct

SEQ ID NO: 7234703 - DNA, 19 bp, Homo sapiens
tctcacagctctactatgt

SEQ ID NO: 7234704 - DNA, 19 bp, Homo sapiens
tctcacagctctactatgt

SEQ ID NO: 7234705 - DNA, 19 bp, Homo sapiens
tctcacagctctactatgt

SEQ ID NO: 7234706 - DNA, 22 bp, Homo sapiens
tctcacagctctgctgcatgct

SEQ ID NO: 7234707 - DNA, 22 bp, Homo sapiens
tctcacagcaggggccaggtct

SEQ ID NO: 7234708 - DNA, 22 bp, Homo sapiens
tctcacagcagagaagggacat

SEQ ID NO: 7234709 - DNA, 22 bp, Homo sapiens
tctcacagatcagcagggggct

SEQ ID NO: 7234710 - DNA, 22 bp, Homo sapiens
tctcacacttctgtgttgcaca

SEQ ID NO: 7234711 - DNA, 22 bp, Homo sapiens
tctcacacttctgtgttgcaca

SEQ ID NO: 7234712 - DNA, 22 bp, Homo sapiens
tctcacagaggcttgggctcat

SEQ ID NO: 7234713 - DNA, 22 bp, Homo sapiens
tctcacactatttcaggtgact

SEQ ID NO: 7234714 - DNA, 22 bp, Homo sapiens
tctcacactatttattctgctt

SEQ ID NO: 7234715 - DNA, 22 bp, Homo sapiens
tctcacactatttcaggtgact

SEQ ID NO: 7234716 - DNA, 22 bp, Homo sapiens
tctcacactatttattctgctt

SEQ ID NO: 7234717 - DNA, 22 bp, Homo sapiens
tctcacactatttattctgctt

SEQ ID NO: 7234718 - DNA, 22 bp, Homo sapiens
tctcacactaatgctctatcag

SEQ ID NO: 7234719 - DNA, 22 bp, Homo sapiens
tctcacaccgtccctaaaccat

SEQ ID NO: 7234720 - DNA, 22 bp, Homo sapiens
tctcacactaatgctctatcag

SEQ ID NO: 7234721 - DNA, 22 bp, Homo sapiens
tctcacacaacatgttactttg

SEQ ID NO: 7234722 - DNA, 21 bp, Homo sapiens
tctcacaatatgatgccagat

SEQ ID NO: 7234723 - DNA, 22 bp, Homo sapiens
tctcaattgtgggtgaggagca

SEQ ID NO: 7234724 - DNA, 19 bp, Homo sapiens
tctcacaagcaacattgtt

SEQ ID NO: 7234725 - DNA, 19 bp, Homo sapiens
tctcaatgttcagaaagct

SEQ ID NO: 7234726 - DNA, 19 bp, Homo sapiens
tctcaattcagactgagag

SEQ ID NO: 7234727 - DNA, 19 bp, Homo sapiens
tctcaattctccccactgc

SEQ ID NO: 7234728 - DNA, 22 bp, Homo sapiens
tctcaaatggcaaatgtgggtc

SEQ ID NO: 7234729 - DNA, 22 bp, Homo sapiens
tctcaaatgtaaagcatgattt

SEQ ID NO: 7234730 - DNA, 22 bp, Homo sapiens
tctcaagttatgtaacagctgt

SEQ ID NO: 7234731 - DNA, 22 bp, Homo sapiens
tctcaatattatatgtcataaa

SEQ ID NO: 7234732 - DNA, 22 bp, Homo sapiens
tctcaaatcaaactttgagctt

SEQ ID NO: 7234733 - DNA, 22 bp, Homo sapiens
tctcaaatcaaactttgagctt

SEQ ID NO: 7234734 - DNA, 22 bp, Homo sapiens
tctcaaatcaaactttgagctt

SEQ ID NO: 7234735 - DNA, 23 bp, Homo sapiens
tctcaaatctttgcgttgtatct

SEQ ID NO: 7234736 - DNA, 22 bp, Homo sapiens
tctcaaatggacaatattgtgg

SEQ ID NO: 7234737 - DNA, 22 bp, Homo sapiens
tctcaaatggacaatattgtgg

SEQ ID NO: 7234738 - DNA, 22 bp, Homo sapiens
tctcaaatggacaatattgtgg

SEQ ID NO: 7234739 - DNA, 22 bp, Homo sapiens
tctattacttaccactaattca

SEQ ID NO: 7234740 - DNA, 22 bp, Homo sapiens
tctattagaatgttctttttca

SEQ ID NO: 7234741 - DNA, 22 bp, Homo sapiens
tctattagattattctcaagga

SEQ ID NO: 7234742 - DNA, 22 bp, Homo sapiens
tctattatggtacttatcatga

SEQ ID NO: 7234743 - DNA, 22 bp, Homo sapiens
tctattaatgattcaatagtgt

SEQ ID NO: 7234744 - DNA, 22 bp, Homo sapiens
tctatggggcctcacaggcact

SEQ ID NO: 7234745 - DNA, 21 bp, Homo sapiens
tctatgtacgcatctatgcct

SEQ ID NO: 7234746 - DNA, 22 bp, Homo sapiens
tctatgtatatctttccattca

SEQ ID NO: 7234747 - DNA, 22 bp, Homo sapiens
tctatgtcagcatctttctacc

SEQ ID NO: 7234748 - DNA, 22 bp, Homo sapiens
tctatgtcctttctcccattcc

SEQ ID NO: 7234749 - DNA, 22 bp, Homo sapiens
tctatgtctccaccttcgcaga

SEQ ID NO: 7234750 - DNA, 22 bp, Homo sapiens
tctatattttgaaaggtattta

SEQ ID NO: 7234751 - DNA, 22 bp, Homo sapiens
tctataaagggccagatagtag

SEQ ID NO: 7234752 - DNA, 22 bp, Homo sapiens
tctatattttgaaaggtattta

SEQ ID NO: 7234753 - DNA, 22 bp, Homo sapiens
tctatcctgcttagaagtatgt

SEQ ID NO: 7234754 - DNA, 22 bp, Homo sapiens
tctatctgaggaggtgacattt

SEQ ID NO: 7234755 - DNA, 22 bp, Homo sapiens
tctatctgggagttccccatta

SEQ ID NO: 7234756 - DNA, 21 bp, Homo sapiens
tctatgaacatggagaagggc

SEQ ID NO: 7234757 - DNA, 22 bp, Homo sapiens
tctatgaacctctgcaatgaca

SEQ ID NO: 7234758 - DNA, 22 bp, Homo sapiens
tctatgaagtgcaattaactgt

SEQ ID NO: 7234759 - DNA, 22 bp, Homo sapiens
tctatgaagtgcgaagaggcac

SEQ ID NO: 7234760 - DNA, 22 bp, Homo sapiens
tctatgaagtgcgaagaggcac

SEQ ID NO: 7234761 - DNA, 22 bp, Homo sapiens
tctatgaatgacacagataata

SEQ ID NO: 7234762 - DNA, 22 bp, Homo sapiens
tctatgaatgacacagataata

SEQ ID NO: 7234763 - DNA, 21 bp, Homo sapiens
tctatgcaagaccctagtcct

SEQ ID NO: 7234764 - DNA, 22 bp, Homo sapiens
tctatgcttgagacagatgggg

SEQ ID NO: 7234765 - DNA, 22 bp, Homo sapiens
tctataaagggccagatagtag

SEQ ID NO: 7234766 - DNA, 22 bp, Homo sapiens
tctataaagggccagatagtag

SEQ ID NO: 7234767 - DNA, 22 bp, Homo sapiens
tctataaagggccagatagtag

SEQ ID NO: 7234768 - DNA, 22 bp, Homo sapiens
tctataaagggccagatagtag

SEQ ID NO: 7234769 - DNA, 22 bp, Homo sapiens
tctataaaactcaagagcaatt

SEQ ID NO: 7234770 - DNA, 22 bp, Homo sapiens
tctataaaactcaagagcaatt

SEQ ID NO: 7234771 - DNA, 22 bp, Homo sapiens
tctataaaactcaagagcaatt

SEQ ID NO: 7234772 - DNA, 22 bp, Homo sapiens
tctataaaactcaagagcaatt

SEQ ID NO: 7234773 - DNA, 22 bp, Homo sapiens
tctataaaactcaagagcaatt

SEQ ID NO: 7234774 - DNA, 22 bp, Homo sapiens
tctataaaactcaagagcaatt

SEQ ID NO: 7234775 - DNA, 22 bp, Homo sapiens
tctagttctagatccctgagga

SEQ ID NO: 7234776 - DNA, 22 bp, Homo sapiens
tctagtgttaaggcaaagtaaa

SEQ ID NO: 7234777 - DNA, 22 bp, Homo sapiens
tctagtgttttggaacatggaa

SEQ ID NO: 7234778 - DNA, 22 bp, Homo sapiens
tctagtgttttggaacatggaa

SEQ ID NO: 7234779 - DNA, 17 bp, Homo sapiens
tctagtgttcttgctca

SEQ ID NO: 7234780 - DNA, 22 bp, Homo sapiens
tctagtgttttggaacatggaa

SEQ ID NO: 7234781 - DNA, 22 bp, Homo sapiens
tctagtttaagatctgttagtc

SEQ ID NO: 7234782 - DNA, 22 bp, Homo sapiens
tctagtttaagatctgttagtc

SEQ ID NO: 7234783 - DNA, 22 bp, Homo sapiens
tctagtttaagatctgttagtc

SEQ ID NO: 7234784 - DNA, 22 bp, Homo sapiens
tctagttttagcttgagttgca

SEQ ID NO: 7234785 - DNA, 19 bp, Homo sapiens
tctagttttgagagacttc

SEQ ID NO: 7234786 - DNA, 22 bp, Homo sapiens
tctagtcatattttttcagtat

SEQ ID NO: 7234787 - DNA, 19 bp, Homo sapiens
tctagtcagtcagtcattc

SEQ ID NO: 7234788 - DNA, 22 bp, Homo sapiens
tctagtcatattttttcagtat

SEQ ID NO: 7234789 - DNA, 22 bp, Homo sapiens
tctagtctcagccttcacctaa

SEQ ID NO: 7234790 - DNA, 22 bp, Homo sapiens
tctaggtataaagaaatcagga

SEQ ID NO: 7234791 - DNA, 22 bp, Homo sapiens
tctagggtgatgattcaggatg

SEQ ID NO: 7234792 - DNA, 22 bp, Homo sapiens
tctagggtgtataaggaagcct

SEQ ID NO: 7234793 - DNA, 22 bp, Homo sapiens
tctagggtgttacatacctgct

SEQ ID NO: 7234794 - DNA, 22 bp, Homo sapiens
tctaggtagcgatacagcagca

SEQ ID NO: 7234795 - DNA, 22 bp, Homo sapiens
tctaggcccaggcctgcggctg

SEQ ID NO: 7234796 - DNA, 22 bp, Homo sapiens
tctaggccgtaggatacagagc

SEQ ID NO: 7234797 - DNA, 22 bp, Homo sapiens
tctagggagagttgttatgggt

SEQ ID NO: 7234798 - DNA, 22 bp, Homo sapiens
tctagggagctctagcagtggt

SEQ ID NO: 7234799 - DNA, 22 bp, Homo sapiens
tctagggagctctagcagtggt

SEQ ID NO: 7234800 - DNA, 20 bp, Homo sapiens
tctagggatggcatatgtct

SEQ ID NO: 7234801 - DNA, 22 bp, Homo sapiens
tctagggggacagctggctgtg

SEQ ID NO: 7234802 - DNA, 22 bp, Homo sapiens
tctagcatgggaaaatcacagc

SEQ ID NO: 7234803 - DNA, 22 bp, Homo sapiens
tctagcatctaattatggaatc

SEQ ID NO: 7234804 - DNA, 22 bp, Homo sapiens
tctagcagagggaagaggcttt

SEQ ID NO: 7234805 - DNA, 22 bp, Homo sapiens
tctagcagggaaagcagagaat

SEQ ID NO: 7234806 - DNA, 22 bp, Homo sapiens
tctagcaagctcgtgctcaagg

SEQ ID NO: 7234807 - DNA, 22 bp, Homo sapiens
tctagatgaatgtgaggatatc

SEQ ID NO: 7234808 - DNA, 22 bp, Homo sapiens
tctagatgtactgctgaagagt

SEQ ID NO: 7234809 - DNA, 22 bp, Homo sapiens
tctagatgtactgctgaagagt

SEQ ID NO: 7234810 - DNA, 22 bp, Homo sapiens
tctagagacaaaggaaggaggg

SEQ ID NO: 7234811 - DNA, 22 bp, Homo sapiens
tctagagacaaaggaaggaggg

SEQ ID NO: 7234812 - DNA, 22 bp, Homo sapiens
tctagagctggagtagaatgtg

SEQ ID NO: 7234813 - DNA, 22 bp, Homo sapiens
tctagagctttttcctcttgta

SEQ ID NO: 7234814 - DNA, 22 bp, Homo sapiens
tctagatcagtgcctgaaggaa

SEQ ID NO: 7234815 - DNA, 22 bp, Homo sapiens
tctaggaaagcctttcacaact

SEQ ID NO: 7234816 - DNA, 22 bp, Homo sapiens
tctaggaaataatgactcatcc

SEQ ID NO: 7234817 - DNA, 22 bp, Homo sapiens
tctagctctgcttatcatggct

SEQ ID NO: 7234818 - DNA, 22 bp, Homo sapiens
tctagctctgcttatcatggct

SEQ ID NO: 7234819 - DNA, 23 bp, Homo sapiens
tctagcctgtcatcagcctctcc

SEQ ID NO: 7234820 - DNA, 22 bp, Homo sapiens
tctagctgagggtaggagacct

SEQ ID NO: 7234821 - DNA, 22 bp, Homo sapiens
tctaggaagtaaggagggacta

SEQ ID NO: 7234822 - DNA, 22 bp, Homo sapiens
tctaggaatgttcttagggatt

SEQ ID NO: 7234823 - DNA, 22 bp, Homo sapiens
tctactgccacttaagacattt

SEQ ID NO: 7234824 - DNA, 22 bp, Homo sapiens
tctactgcactggtgtctcatc

SEQ ID NO: 7234825 - DNA, 22 bp, Homo sapiens
tctactctactgtctgtgccta

SEQ ID NO: 7234826 - DNA, 22 bp, Homo sapiens
tctactctactgtctgtgccta

SEQ ID NO: 7234827 - DNA, 22 bp, Homo sapiens
tctactatgtttcttaaataga

SEQ ID NO: 7234828 - DNA, 22 bp, Homo sapiens
tctactatgtttcttaaataga

SEQ ID NO: 7234829 - DNA, 22 bp, Homo sapiens
tctacgaagccaccatggagac

SEQ ID NO: 7234830 - DNA, 22 bp, Homo sapiens
tctacgaatggtccccggtgtg

SEQ ID NO: 7234831 - DNA, 22 bp, Homo sapiens
tctaccctgcggtcttggggca

SEQ ID NO: 7234832 - DNA, 22 bp, Homo sapiens
tctaccctgcggtcttggggca

SEQ ID NO: 7234833 - DNA, 22 bp, Homo sapiens
tctaccctgcggtcttggggca

SEQ ID NO: 7234834 - DNA, 22 bp, Homo sapiens
tctacccagagctatgacctga

SEQ ID NO: 7234835 - DNA, 22 bp, Homo sapiens
tctaccagggtcacagaggccc

SEQ ID NO: 7234836 - DNA, 22 bp, Homo sapiens
tctaccagagcctagcaggccg

SEQ ID NO: 7234837 - DNA, 23 bp, Homo sapiens
tctaccagctagtctccccagca

SEQ ID NO: 7234838 - DNA, 23 bp, Homo sapiens
tctaccagctagtctccccagca

SEQ ID NO: 7234839 - DNA, 22 bp, Homo sapiens
tctaccagggtcacagaggccc

SEQ ID NO: 7234840 - DNA, 22 bp, Homo sapiens
tctagaattttgccatatagct

SEQ ID NO: 7234841 - DNA, 19 bp, Homo sapiens
tctagacaccaaagttgtc

SEQ ID NO: 7234842 - DNA, 22 bp, Homo sapiens
tctagaaacaggtttctagaaa

SEQ ID NO: 7234843 - DNA, 22 bp, Homo sapiens
tctactttcactcatacttatt

SEQ ID NO: 7234844 - DNA, 22 bp, Homo sapiens
tctacttttccctatacagttt

SEQ ID NO: 7234845 - DNA, 22 bp, Homo sapiens
tctacttttccctatacagttt

SEQ ID NO: 7234846 - DNA, 22 bp, Homo sapiens
tctagaaaaacaaagtatctga

SEQ ID NO: 7234847 - DNA, 22 bp, Homo sapiens
tctagaaaaccaatattacatg

SEQ ID NO: 7234848 - DNA, 22 bp, Homo sapiens
tctacaggtggggcctggcaat

SEQ ID NO: 7234849 - DNA, 22 bp, Homo sapiens
tctacagctgctgcttctcatg

SEQ ID NO: 7234850 - DNA, 22 bp, Homo sapiens
tctacagggtcagagtttcatg

SEQ ID NO: 7234851 - DNA, 22 bp, Homo sapiens
tctacagggtaaggggcttgcc

SEQ ID NO: 7234852 - DNA, 22 bp, Homo sapiens
tctacagctgaacagtgtctca

SEQ ID NO: 7234853 - DNA, 22 bp, Homo sapiens
tctacagctgaacagtgtctca

SEQ ID NO: 7234854 - DNA, 22 bp, Homo sapiens
tctacagctgaacagtgtctca

SEQ ID NO: 7234855 - DNA, 22 bp, Homo sapiens
tctacagccattttgagcagtg

SEQ ID NO: 7234856 - DNA, 22 bp, Homo sapiens
tctacagccattttgagcagtg

SEQ ID NO: 7234857 - DNA, 22 bp, Homo sapiens
tctacagctctggagcttttgg

SEQ ID NO: 7234858 - DNA, 22 bp, Homo sapiens
tctacaggtggggcctggcaat

SEQ ID NO: 7234859 - DNA, 22 bp, Homo sapiens
tctacagtagaaagatcccagt

SEQ ID NO: 7234860 - DNA, 22 bp, Homo sapiens
tctacagtcaagttatattgct

SEQ ID NO: 7234861 - DNA, 22 bp, Homo sapiens
tctacagtgtcaatgtgtcttg

SEQ ID NO: 7234862 - DNA, 22 bp, Homo sapiens
tctacataaaaattcagaaggc

SEQ ID NO: 7234863 - DNA, 21 bp, Homo sapiens
tctacatatcaatatgtaatt

SEQ ID NO: 7234864 - DNA, 21 bp, Homo sapiens
tctacatatcaatatgtaatt

SEQ ID NO: 7234865 - DNA, 21 bp, Homo sapiens
tctacatatcaatatgtaatt

SEQ ID NO: 7234866 - DNA, 20 bp, Homo sapiens
tctacatctacctgacggct

SEQ ID NO: 7234867 - DNA, 22 bp, Homo sapiens
tctacatgatgtaccatctaag

SEQ ID NO: 7234868 - DNA, 22 bp, Homo sapiens
tctacatgatgtaccatctaag

SEQ ID NO: 7234869 - DNA, 22 bp, Homo sapiens
tctacatatgtgatttctaagt

SEQ ID NO: 7234870 - DNA, 22 bp, Homo sapiens
tctacatatgtgatttctaagt

SEQ ID NO: 7234871 - DNA, 22 bp, Homo sapiens
tctacatgcagcgaggggactt

SEQ ID NO: 7234872 - DNA, 22 bp, Homo sapiens
tctacatgcagcgaggggactt

SEQ ID NO: 7234873 - DNA, 22 bp, Homo sapiens
tctacattccttttataatatc

SEQ ID NO: 7234874 - DNA, 22 bp, Homo sapiens
tctacattttaacaagatgccc

SEQ ID NO: 7234875 - DNA, 22 bp, Homo sapiens
tctacattttaacaagatgccc

SEQ ID NO: 7234876 - DNA, 22 bp, Homo sapiens
tctacattttcacaaggtctcc

SEQ ID NO: 7234877 - DNA, 22 bp, Homo sapiens
tctacattttcacaaggtctcc

SEQ ID NO: 7234878 - DNA, 22 bp, Homo sapiens
tctacagccattttgagcagtg

SEQ ID NO: 7234879 - DNA, 22 bp, Homo sapiens
tctacacatttgtaaaggcatt

SEQ ID NO: 7234880 - DNA, 22 bp, Homo sapiens
tctacacatttgtaaaggcatt

SEQ ID NO: 7234881 - DNA, 22 bp, Homo sapiens
tctacactccagagtctcatca

SEQ ID NO: 7234882 - DNA, 22 bp, Homo sapiens
tctacaagtcaagtctatcaag

SEQ ID NO: 7234883 - DNA, 22 bp, Homo sapiens
tctacaatgagaaatgatcagt

SEQ ID NO: 7234884 - DNA, 22 bp, Homo sapiens
tctacaaataaattactatgta

SEQ ID NO: 7234885 - DNA, 22 bp, Homo sapiens
tctacaaaggttgaggtgccct

SEQ ID NO: 7234886 - DNA, 22 bp, Homo sapiens
tctacaaaggttgaggtgccct

SEQ ID NO: 7234887 - DNA, 19 bp, Homo sapiens
tctacaaagtggcatcagg

SEQ ID NO: 7234888 - DNA, 19 bp, Homo sapiens
tctacaaagtggcatcagg

SEQ ID NO: 7234889 - DNA, 22 bp, Homo sapiens
tctacaaataaattactatgta

SEQ ID NO: 7234890 - DNA, 22 bp, Homo sapiens
tctaactatacaaagaaaacat

SEQ ID NO: 7234891 - DNA, 22 bp, Homo sapiens
tctaactaactacagtaagagg

SEQ ID NO: 7234892 - DNA, 22 bp, Homo sapiens
tctaactatacaaagaaaacat

SEQ ID NO: 7234893 - DNA, 22 bp, Homo sapiens
tctaactaactacagtaagagg

SEQ ID NO: 7234894 - DNA, 22 bp, Homo sapiens
tctaacctttgaaactgctttc

SEQ ID NO: 7234895 - DNA, 22 bp, Homo sapiens
tctaacattgtttttcacagat

SEQ ID NO: 7234896 - DNA, 22 bp, Homo sapiens
tctaaattcagtttattttgat

SEQ ID NO: 7234897 - DNA, 19 bp, Homo sapiens
tctaacagctttcattcta

SEQ ID NO: 7234898 - DNA, 22 bp, Homo sapiens
tctaatgcttgactgggggctt

SEQ ID NO: 7234899 - DNA, 22 bp, Homo sapiens
tctaattgcaattctcagagat

SEQ ID NO: 7234900 - DNA, 22 bp, Homo sapiens
tctacaaagaagaattaatgtc

SEQ ID NO: 7234901 - DNA, 22 bp, Homo sapiens
tctacaaagaagaattaatgtc

SEQ ID NO: 7234902 - DNA, 22 bp, Homo sapiens
tctaattttggcattttaacct

SEQ ID NO: 7234903 - DNA, 22 bp, Homo sapiens
tctacaaactaaggagggtaat

SEQ ID NO: 7234904 - DNA, 22 bp, Homo sapiens
tctacaaagccattcaggatct

SEQ ID NO: 7234905 - DNA, 23 bp, Homo sapiens
tctacaaagctgtgtcaggaccc

SEQ ID NO: 7234906 - DNA, 23 bp, Homo sapiens
tctacaaagctgtgtcaggaccc

SEQ ID NO: 7234907 - DNA, 23 bp, Homo sapiens
tctacaaagctgtgtcaggaccc

SEQ ID NO: 7234908 - DNA, 22 bp, Homo sapiens
tctaaagagaaccttttctcat

SEQ ID NO: 7234909 - DNA, 22 bp, Homo sapiens
tctaaagatgtttattgacata

SEQ ID NO: 7234910 - DNA, 22 bp, Homo sapiens
tctaaagatttggattcatttg

SEQ ID NO: 7234911 - DNA, 22 bp, Homo sapiens
tctaaagatttggattcatttg

SEQ ID NO: 7234912 - DNA, 22 bp, Homo sapiens
tctaaagtatgctaatatgtga

SEQ ID NO: 7234913 - DNA, 22 bp, Homo sapiens
tctaaactgcgagcatgccccc

SEQ ID NO: 7234914 - DNA, 22 bp, Homo sapiens
tctaaactgctagctgactgag

SEQ ID NO: 7234915 - DNA, 22 bp, Homo sapiens
tctaaacttcactttaagtgct

SEQ ID NO: 7234916 - DNA, 22 bp, Homo sapiens
tctaaacttcactttaagtgct

SEQ ID NO: 7234917 - DNA, 22 bp, Homo sapiens
tctaaacttgtaaacaagcata

SEQ ID NO: 7234918 - DNA, 22 bp, Homo sapiens
tctaaacattggtatggagcag

SEQ ID NO: 7234919 - DNA, 22 bp, Homo sapiens
tctaaacattgtgatagacctt

SEQ ID NO: 7234920 - DNA, 22 bp, Homo sapiens
tctaaactacgtcaaaactagt

SEQ ID NO: 7234921 - DNA, 22 bp, Homo sapiens
tctaaactagggttaaaggaaa

SEQ ID NO: 7234922 - DNA, 19 bp, Homo sapiens
tctaaactagtcccataac

SEQ ID NO: 7234923 - DNA, 22 bp, Homo sapiens
tctaaactcctttacccagacc

SEQ ID NO: 7234924 - DNA, 19 bp, Homo sapiens
tctaaactctatactggta

SEQ ID NO: 7234925 - DNA, 22 bp, Homo sapiens
tctaaactctctttgaattatg

SEQ ID NO: 7234926 - DNA, 22 bp, Homo sapiens
tctaaactctgattaatccaca

SEQ ID NO: 7234927 - DNA, 22 bp, Homo sapiens
tctaaactctgcaatttacggt

SEQ ID NO: 7234928 - DNA, 22 bp, Homo sapiens
tctaaaaaagtctgttcacttg

SEQ ID NO: 7234929 - DNA, 22 bp, Homo sapiens
tctaaaatgcagatctactggt

SEQ ID NO: 7234930 - DNA, 22 bp, Homo sapiens
tctaaaatgcagatctactggt

SEQ ID NO: 7234931 - DNA, 22 bp, Homo sapiens
tctaaaatgcagatctactggt

SEQ ID NO: 7234932 - DNA, 22 bp, Homo sapiens
tctaaaatgcagatctactggt

SEQ ID NO: 7234933 - DNA, 23 bp, Homo sapiens
tctaaaattcatcatttacgttc

SEQ ID NO: 7234934 - DNA, 22 bp, Homo sapiens
tctaaacacgtctctttgaata

SEQ ID NO: 7234935 - DNA, 22 bp, Homo sapiens
tctaaacactaagtcttgatgc

SEQ ID NO: 7234936 - DNA, 22 bp, Homo sapiens
tctaaacagcctcttaccaact

SEQ ID NO: 7234937 - DNA, 22 bp, Homo sapiens
tctaaacagtttcactcttaat

SEQ ID NO: 7234938 - DNA, 22 bp, Homo sapiens
tctaaacagtttcactcttaat

SEQ ID NO: 7234939 - DNA, 22 bp, Homo sapiens
tctaaacattatgatagtagag

SEQ ID NO: 7234940 - DNA, 22 bp, Homo sapiens
tctaaacattatgatagtagag

SEQ ID NO: 7234941 - DNA, 22 bp, Homo sapiens
tcgtgatctgtccacctcggcc

SEQ ID NO: 7234942 - DNA, 22 bp, Homo sapiens
tcgtgaggctctgcatcgcaca

SEQ ID NO: 7234943 - DNA, 22 bp, Homo sapiens
tcgtggaggcaccgtgagcttt

SEQ ID NO: 7234944 - DNA, 19 bp, Homo sapiens
tcgtggggaggtgggcagc

SEQ ID NO: 7234945 - DNA, 19 bp, Homo sapiens
tcgtggggaggtgggcagc

SEQ ID NO: 7234946 - DNA, 19 bp, Homo sapiens
tcgtggggaggtgggcagc

SEQ ID NO: 7234947 - DNA, 22 bp, Homo sapiens
tcgtgtgtattccctctccttc

SEQ ID NO: 7234948 - DNA, 19 bp, Homo sapiens
tcgtggggaggtgggcagc

SEQ ID NO: 7234949 - DNA, 22 bp, Homo sapiens
tcgttaaatgctaaaactgaca

SEQ ID NO: 7234950 - DNA, 22 bp, Homo sapiens
tcgttaaatgctaaaactgaca

SEQ ID NO: 7234951 - DNA, 22 bp, Homo sapiens
tcgttttaggtggacattgtgt

SEQ ID NO: 7234952 - DNA, 22 bp, Homo sapiens
tcgcccaggctggaagtgcagt

SEQ ID NO: 7234953 - DNA, 22 bp, Homo sapiens
tcgcccaggatggagtgcagta

SEQ ID NO: 7234954 - DNA, 22 bp, Homo sapiens
tcgccagggatgctgtaaggaa

SEQ ID NO: 7234955 - DNA, 22 bp, Homo sapiens
tcgcaccattgcactccagcca

SEQ ID NO: 7234956 - DNA, 22 bp, Homo sapiens
tcgcagaggcacgagtgcagaa

SEQ ID NO: 7234957 - DNA, 22 bp, Homo sapiens
tcgcagcactagccctgcattg

SEQ ID NO: 7234958 - DNA, 22 bp, Homo sapiens
tcgcccaggctggaagtgcagt

SEQ ID NO: 7234959 - DNA, 22 bp, Homo sapiens
tcgcccaggctggaagtgcagt

SEQ ID NO: 7234960 - DNA, 22 bp, Homo sapiens
tcgcccaggctggaagtgcagt

SEQ ID NO: 7234961 - DNA, 22 bp, Homo sapiens
tcgtcatctgaaggctgtcaat

SEQ ID NO: 7234962 - DNA, 22 bp, Homo sapiens
tcgtcctgtgcacctgcctgca

SEQ ID NO: 7234963 - DNA, 22 bp, Homo sapiens
tcgtctgtgaaattgggataag

SEQ ID NO: 7234964 - DNA, 22 bp, Homo sapiens
tcgtctgtgaaattgggataag

SEQ ID NO: 7234965 - DNA, 22 bp, Homo sapiens
tcgtgaggctctgcatcgcaca

SEQ ID NO: 7234966 - DNA, 22 bp, Homo sapiens
tcctttctccttccgacttcat

SEQ ID NO: 7234967 - DNA, 18 bp, Homo sapiens
tcctttctccctcatctt

SEQ ID NO: 7234968 - DNA, 22 bp, Homo sapiens
tcctttctccttccgacttcat

SEQ ID NO: 7234969 - DNA, 22 bp, Homo sapiens
tcctttctccgggggactgttg

SEQ ID NO: 7234970 - DNA, 18 bp, Homo sapiens
tcctttctccctcatctt

SEQ ID NO: 7234971 - DNA, 18 bp, Homo sapiens
tcctttctccctcatctt

SEQ ID NO: 7234972 - DNA, 18 bp, Homo sapiens
tcctttctccctcatctt

SEQ ID NO: 7234973 - DNA, 22 bp, Homo sapiens
tcctttctgtctttactctgga

SEQ ID NO: 7234974 - DNA, 22 bp, Homo sapiens
tcctttctgtctttactctgga

SEQ ID NO: 7234975 - DNA, 22 bp, Homo sapiens
tcctttctgggcctcagtgact

SEQ ID NO: 7234976 - DNA, 22 bp, Homo sapiens
tcctttctgtctttactctgga

SEQ ID NO: 7234977 - DNA, 22 bp, Homo sapiens
tcctttctgtgctgtcaggtcc

SEQ ID NO: 7234978 - DNA, 19 bp, Homo sapiens
tcctttctgttcctgagat

SEQ ID NO: 7234979 - DNA, 19 bp, Homo sapiens
tcctttctgttcctgagat

SEQ ID NO: 7234980 - DNA, 19 bp, Homo sapiens
tcctttctgttcctgagat

SEQ ID NO: 7234981 - DNA, 19 bp, Homo sapiens
tcctttctgttcctgagat

SEQ ID NO: 7234982 - DNA, 22 bp, Homo sapiens
tcctttcttcttctgcccatgg

SEQ ID NO: 7234983 - DNA, 22 bp, Homo sapiens
tcctttcttcttctgcccatgg

SEQ ID NO: 7234984 - DNA, 22 bp, Homo sapiens
tcctttcttcttctgcccatgg

SEQ ID NO: 7234985 - DNA, 22 bp, Homo sapiens
tcctttcttcttctgcccatgg

SEQ ID NO: 7234986 - DNA, 22 bp, Homo sapiens
tcctttcttgtgtatcaaatgg

SEQ ID NO: 7234987 - DNA, 22 bp, Homo sapiens
tcctttcttgtgtatcaaatgg

SEQ ID NO: 7234988 - DNA, 22 bp, Homo sapiens
tcctttcttgtgtatcaaatgg

SEQ ID NO: 7234989 - DNA, 17 bp, Homo sapiens
tcctttctttacctgtt

SEQ ID NO: 7234990 - DNA, 17 bp, Homo sapiens
tcctttctttacctgtt

SEQ ID NO: 7234991 - DNA, 19 bp, Homo sapiens
tcctttgaatatcagttga

SEQ ID NO: 7234992 - DNA, 22 bp, Homo sapiens
tcctttctatcttgggtatcta

SEQ ID NO: 7234993 - DNA, 22 bp, Homo sapiens
tcctttctcccaggttagttgt

SEQ ID NO: 7234994 - DNA, 20 bp, Homo sapiens
tcctttcctccttctaaatg

SEQ ID NO: 7234995 - DNA, 22 bp, Homo sapiens
tcctttctatcttgggtatcta

SEQ ID NO: 7234996 - DNA, 22 bp, Homo sapiens
tcctttctccagctggcattgt

SEQ ID NO: 7234997 - DNA, 22 bp, Homo sapiens
tcctttctccagctggcattgt

SEQ ID NO: 7234998 - DNA, 22 bp, Homo sapiens
tcctttccctttccatcctggc

SEQ ID NO: 7234999 - DNA, 22 bp, Homo sapiens
tcctttccctttccatcctggc

SEQ ID NO: 7235000 - DNA, 22 bp, Homo sapiens
tcctttccctttccatcctggc

SEQ ID NO: 7235001 - DNA, 22 bp, Homo sapiens
tcctttccatgcttctagaggc

SEQ ID NO: 7235002 - DNA, 22 bp, Homo sapiens
tccttgggaaacatcatgtaat

SEQ ID NO: 7235003 - DNA, 22 bp, Homo sapiens
tccttgggaaatcactagcact

SEQ ID NO: 7235004 - DNA, 22 bp, Homo sapiens
tccttggctagtactggccagc

SEQ ID NO: 7235005 - DNA, 22 bp, Homo sapiens
tccttggctagtactggccagc

SEQ ID NO: 7235006 - DNA, 22 bp, Homo sapiens
tccttggctagtactggccagc

SEQ ID NO: 7235007 - DNA, 22 bp, Homo sapiens
tcctttttggtccaaggtgacc

SEQ ID NO: 7235008 - DNA, 22 bp, Homo sapiens
tcctttttggtccaaggtgacc

SEQ ID NO: 7235009 - DNA, 22 bp, Homo sapiens
tcctttttctcacacaacgaac

SEQ ID NO: 7235010 - DNA, 22 bp, Homo sapiens
tcctttttctcacacaacgaac

SEQ ID NO: 7235011 - DNA, 22 bp, Homo sapiens
tcctttttaagtcgttgtggta

SEQ ID NO: 7235012 - DNA, 22 bp, Homo sapiens
tcctttttatagttagagaaac

SEQ ID NO: 7235013 - DNA, 22 bp, Homo sapiens
tccttttttatgaagctttgag

SEQ ID NO: 7235014 - DNA, 22 bp, Homo sapiens
tcgaaataatttagaatataga

SEQ ID NO: 7235015 - DNA, 22 bp, Homo sapiens
tcgagctctggagccaaggatg

SEQ ID NO: 7235016 - DNA, 22 bp, Homo sapiens
tcgagctctggagccaaggatg

SEQ ID NO: 7235017 - DNA, 22 bp, Homo sapiens
tcgagctctggagccaaggatg

SEQ ID NO: 7235018 - DNA, 22 bp, Homo sapiens
tcgagctgcacgcccccgagct

SEQ ID NO: 7235019 - DNA, 22 bp, Homo sapiens
tcgagctgggcaagcttccata

SEQ ID NO: 7235020 - DNA, 19 bp, Homo sapiens
tcgagtcaagacactaggc

SEQ ID NO: 7235021 - DNA, 22 bp, Homo sapiens
tcgataatatcttacatgtgct

SEQ ID NO: 7235022 - DNA, 22 bp, Homo sapiens
tcgagtcatgttctcccattaa

SEQ ID NO: 7235023 - DNA, 22 bp, Homo sapiens
tcgatttgtattacatctacat

SEQ ID NO: 7235024 - DNA, 22 bp, Homo sapiens
tcgcaccattgcactccagcca

SEQ ID NO: 7235025 - DNA, 22 bp, Homo sapiens
tcgcaccattgcactccagcca

SEQ ID NO: 7235026 - DNA, 22 bp, Homo sapiens
tcgcaccattgcactccagcca

SEQ ID NO: 7235027 - DNA, 22 bp, Homo sapiens
tcctttggttctctaagatgct

SEQ ID NO: 7235028 - DNA, 22 bp, Homo sapiens
tcctttggtagttttcttaaag

SEQ ID NO: 7235029 - DNA, 22 bp, Homo sapiens
tcctttgcttctgtcattctcc

SEQ ID NO: 7235030 - DNA, 22 bp, Homo sapiens
tcctttggaactgactccgtta

SEQ ID NO: 7235031 - DNA, 22 bp, Homo sapiens
tcctttgcttctgtcattctcc

SEQ ID NO: 7235032 - DNA, 22 bp, Homo sapiens
tcctttgcttctgtcattctcc

SEQ ID NO: 7235033 - DNA, 22 bp, Homo sapiens
tccttttgctgggatcatcagg

SEQ ID NO: 7235034 - DNA, 22 bp, Homo sapiens
tccttctggaggctctaagggg

SEQ ID NO: 7235035 - DNA, 20 bp, Homo sapiens
tccttctgaggtgaggagga

SEQ ID NO: 7235036 - DNA, 22 bp, Homo sapiens
tccttctctggtttttactgta

SEQ ID NO: 7235037 - DNA, 22 bp, Homo sapiens
tccttctgaaaaatgcacacga

SEQ ID NO: 7235038 - DNA, 22 bp, Homo sapiens
tccttctgaaaaatgcacacga

SEQ ID NO: 7235039 - DNA, 22 bp, Homo sapiens
tccttctgaaaaatgcacacga

SEQ ID NO: 7235040 - DNA, 22 bp, Homo sapiens
tccttctggaggctctaagggg

SEQ ID NO: 7235041 - DNA, 22 bp, Homo sapiens
tccttctgtagtccctgtccct

SEQ ID NO: 7235042 - DNA, 19 bp, Homo sapiens
tccttctccggccaccccg

SEQ ID NO: 7235043 - DNA, 19 bp, Homo sapiens
tccttctccggccaccccg

SEQ ID NO: 7235044 - DNA, 22 bp, Homo sapiens
tccttctcctccttgagtgaca

SEQ ID NO: 7235045 - DNA, 22 bp, Homo sapiens
tccttctctacaaatccaggca

SEQ ID NO: 7235046 - DNA, 21 bp, Homo sapiens
tccttctctatgattgtctga

SEQ ID NO: 7235047 - DNA, 22 bp, Homo sapiens
tccttctctacaaatccaggca

SEQ ID NO: 7235048 - DNA, 22 bp, Homo sapiens
tccttctctacaaatccaggca

SEQ ID NO: 7235049 - DNA, 21 bp, Homo sapiens
tccttctctatgattgtctga

SEQ ID NO: 7235050 - DNA, 23 bp, Homo sapiens
tccttcctttgagaggctccatc

SEQ ID NO: 7235051 - DNA, 23 bp, Homo sapiens
tccttcctttgagaggctccatc

SEQ ID NO: 7235052 - DNA, 22 bp, Homo sapiens
tccttcctggggtctctgctgc

SEQ ID NO: 7235053 - DNA, 22 bp, Homo sapiens
tccttccttcctgaaattttag

SEQ ID NO: 7235054 - DNA, 22 bp, Homo sapiens
tccttccttcctgaaattttag

SEQ ID NO: 7235055 - DNA, 21 bp, Homo sapiens
tccttccttgaggtcctttcc

SEQ ID NO: 7235056 - DNA, 21 bp, Homo sapiens
tccttccttgaggtcctttcc

SEQ ID NO: 7235057 - DNA, 22 bp, Homo sapiens
tccttcctggggtctctgctgc

SEQ ID NO: 7235058 - DNA, 22 bp, Homo sapiens
tccttcctggggtctctgctgc

SEQ ID NO: 7235059 - DNA, 22 bp, Homo sapiens
tccttcctggggtctctgctgc

SEQ ID NO: 7235060 - DNA, 21 bp, Homo sapiens
tccttcagtctagatgattgt

SEQ ID NO: 7235061 - DNA, 22 bp, Homo sapiens
tccttcctggggtctctgctgc

SEQ ID NO: 7235062 - DNA, 22 bp, Homo sapiens
tccttcctggggtctctgctgc

SEQ ID NO: 7235063 - DNA, 22 bp, Homo sapiens
tccttcagggggccgcctgcac

SEQ ID NO: 7235064 - DNA, 19 bp, Homo sapiens
tccttcagtcagatctggg

SEQ ID NO: 7235065 - DNA, 22 bp, Homo sapiens
tccttgagagccactgtcttgg

SEQ ID NO: 7235066 - DNA, 22 bp, Homo sapiens
tccttgactgtgaggaactagc

SEQ ID NO: 7235067 - DNA, 22 bp, Homo sapiens
tccttgaatgaatgttctctcc

SEQ ID NO: 7235068 - DNA, 22 bp, Homo sapiens
tccttgagagctgctctccccc

SEQ ID NO: 7235069 - DNA, 22 bp, Homo sapiens
tccttgagaggacagagccata

SEQ ID NO: 7235070 - DNA, 22 bp, Homo sapiens
tccttgagattaattaatcacc

SEQ ID NO: 7235071 - DNA, 22 bp, Homo sapiens
tccttgagccgtggccagggcc

SEQ ID NO: 7235072 - DNA, 22 bp, Homo sapiens
tccttgagcctcccagactcag

SEQ ID NO: 7235073 - DNA, 22 bp, Homo sapiens
tccttgaaaagaatgtctccat

SEQ ID NO: 7235074 - DNA, 22 bp, Homo sapiens
tccttggagcccaggagtagca

SEQ ID NO: 7235075 - DNA, 21 bp, Homo sapiens
tccttgctattttcctcagct

SEQ ID NO: 7235076 - DNA, 22 bp, Homo sapiens
tccttggaaatttcatcagaca

SEQ ID NO: 7235077 - DNA, 22 bp, Homo sapiens
tccttgccctaaatgtctgtgt

SEQ ID NO: 7235078 - DNA, 21 bp, Homo sapiens
tccttgctattttcctcagct

SEQ ID NO: 7235079 - DNA, 18 bp, Homo sapiens
tccttgaggtatctctat

SEQ ID NO: 7235080 - DNA, 23 bp, Homo sapiens
tccttgagtgtcccccaagagtc

SEQ ID NO: 7235081 - DNA, 22 bp, Homo sapiens
tccttggcaagacacagcacag

SEQ ID NO: 7235082 - DNA, 22 bp, Homo sapiens
tccttggatctttcctatgatt

SEQ ID NO: 7235083 - DNA, 22 bp, Homo sapiens
tccttggcaagctgcaatggga

SEQ ID NO: 7235084 - DNA, 22 bp, Homo sapiens
tccttggagctctccaagggat

SEQ ID NO: 7235085 - DNA, 22 bp, Homo sapiens
tccttggaggtcaacgggacgg

SEQ ID NO: 7235086 - DNA, 22 bp, Homo sapiens
tccttggagtcatgatggaggt

SEQ ID NO: 7235087 - DNA, 19 bp, Homo sapiens
tccttcacttcttaccagg

SEQ ID NO: 7235088 - DNA, 22 bp, Homo sapiens
tccttcacctcaagcttttgaa

SEQ ID NO: 7235089 - DNA, 22 bp, Homo sapiens
tccttcaccttagccctcctag

SEQ ID NO: 7235090 - DNA, 18 bp, Homo sapiens
tccttcacagcaggaagg

SEQ ID NO: 7235091 - DNA, 20 bp, Homo sapiens
tccttcagacgacaagcaag

SEQ ID NO: 7235092 - DNA, 20 bp, Homo sapiens
tccttcagacgacaagcaag

SEQ ID NO: 7235093 - DNA, 23 bp, Homo sapiens
tccttcagagcctccctccaagc

SEQ ID NO: 7235094 - DNA, 22 bp, Homo sapiens
tccttcagaggataaggaagaa

SEQ ID NO: 7235095 - DNA, 22 bp, Homo sapiens
tccttcagctactcagtttcca

SEQ ID NO: 7235096 - DNA, 22 bp, Homo sapiens
tccttcagctgctaggaaatga

SEQ ID NO: 7235097 - DNA, 22 bp, Homo sapiens
tccttcagcttgttagagtgac

SEQ ID NO: 7235098 - DNA, 22 bp, Homo sapiens
tccttcaggcctcattctcata

SEQ ID NO: 7235099 - DNA, 23 bp, Homo sapiens
tccttcaggctcttcccctggac

SEQ ID NO: 7235100 - DNA, 17 bp, Homo sapiens
tccttcagggcctcaca

SEQ ID NO: 7235101 - DNA, 22 bp, Homo sapiens
tccttcagggctgaccacaggc

SEQ ID NO: 7235102 - DNA, 22 bp, Homo sapiens
tccttcagggggccgcctgcac

SEQ ID NO: 7235103 - DNA, 22 bp, Homo sapiens
tccttcagggggccgcctgcac

SEQ ID NO: 7235104 - DNA, 22 bp, Homo sapiens
tccttagcaacactgttataat

SEQ ID NO: 7235105 - DNA, 22 bp, Homo sapiens
tccttacagttaaaatgggagt

SEQ ID NO: 7235106 - DNA, 22 bp, Homo sapiens
tccttacatagtgctgaaatat

SEQ ID NO: 7235107 - DNA, 22 bp, Homo sapiens
tccttagacaaagagtgggctt

SEQ ID NO: 7235108 - DNA, 22 bp, Homo sapiens
tccttagacaaagagtgggctt

SEQ ID NO: 7235109 - DNA, 22 bp, Homo sapiens
tccttaaatatttactgttaac

SEQ ID NO: 7235110 - DNA, 22 bp, Homo sapiens
tccttaaatatttactgttaac

SEQ ID NO: 7235111 - DNA, 22 bp, Homo sapiens
tccttaaatccttcagagatta

SEQ ID NO: 7235112 - DNA, 22 bp, Homo sapiens
tccttaaatgaactctgcatga

SEQ ID NO: 7235113 - DNA, 22 bp, Homo sapiens
tccttaaatgaactctgcatga

SEQ ID NO: 7235114 - DNA, 22 bp, Homo sapiens
tccttaaatgtgatctagattt

SEQ ID NO: 7235115 - DNA, 20 bp, Homo sapiens
tccttaagtacctaagagtg

SEQ ID NO: 7235116 - DNA, 22 bp, Homo sapiens
tccttatatggcagacagcaga

SEQ ID NO: 7235117 - DNA, 22 bp, Homo sapiens
tccttatatcttcagagaagca

SEQ ID NO: 7235118 - DNA, 22 bp, Homo sapiens
tccttatacctttgctccgctt

SEQ ID NO: 7235119 - DNA, 22 bp, Homo sapiens
tccttatagcccaagtgatgga

SEQ ID NO: 7235120 - DNA, 22 bp, Homo sapiens
tccttatatctatagttttgca

SEQ ID NO: 7235121 - DNA, 22 bp, Homo sapiens
tccttatagttgtctttgaacc

SEQ ID NO: 7235122 - DNA, 21 bp, Homo sapiens
tccttatatttgaatacttta

SEQ ID NO: 7235123 - DNA, 22 bp, Homo sapiens
tccttcaaagctcctagtgagc

SEQ ID NO: 7235124 - DNA, 22 bp, Homo sapiens
tccttcaactttttacttgccc

SEQ ID NO: 7235125 - DNA, 22 bp, Homo sapiens
tccttcaagtgcagtacctgag

SEQ ID NO: 7235126 - DNA, 22 bp, Homo sapiens
tccttaggcaatttgggagagt

SEQ ID NO: 7235127 - DNA, 22 bp, Homo sapiens
tccttagggatttttccagtca

SEQ ID NO: 7235128 - DNA, 22 bp, Homo sapiens
tccttaggtatttagcatgaat

SEQ ID NO: 7235129 - DNA, 22 bp, Homo sapiens
tccttataaatgaggccctggg

SEQ ID NO: 7235130 - DNA, 22 bp, Homo sapiens
tccttataacaacaggagtgga

SEQ ID NO: 7235131 - DNA, 22 bp, Homo sapiens
tccttaggcaatttgggagagt

SEQ ID NO: 7235132 - DNA, 22 bp, Homo sapiens
tccttagcaggcattcaggacc

SEQ ID NO: 7235133 - DNA, 22 bp, Homo sapiens
tccttagccagggcagctcaaa

SEQ ID NO: 7235134 - DNA, 22 bp, Homo sapiens
tccttagcccactaatacttat

SEQ ID NO: 7235135 - DNA, 22 bp, Homo sapiens
tccttagccggagcagctcatc

SEQ ID NO: 7235136 - DNA, 18 bp, Homo sapiens
tccttagctgagcttgtc

SEQ ID NO: 7235137 - DNA, 22 bp, Homo sapiens
tccttagctgtgaaatgagaat

SEQ ID NO: 7235138 - DNA, 22 bp, Homo sapiens
tccttaggaaaatgatgagggg

SEQ ID NO: 7235139 - DNA, 22 bp, Homo sapiens
tccttagcttacaagtcttctg

SEQ ID NO: 7235140 - DNA, 22 bp, Homo sapiens
tcctggggccagcactggtgga

SEQ ID NO: 7235141 - DNA, 22 bp, Homo sapiens
tcctggggccagcactggtgga

SEQ ID NO: 7235142 - DNA, 19 bp, Homo sapiens
tcctggggatgtggtcacc

SEQ ID NO: 7235143 - DNA, 19 bp, Homo sapiens
tcctggggatgtggtcacc

SEQ ID NO: 7235144 - DNA, 19 bp, Homo sapiens
tcctggggatgtggtcacc

SEQ ID NO: 7235145 - DNA, 19 bp, Homo sapiens
tcctggggatgtggtcacc

SEQ ID NO: 7235146 - DNA, 19 bp, Homo sapiens
tcctggggatgtggtcacc

SEQ ID NO: 7235147 - DNA, 16 bp, Homo sapiens
tcctggggatactgga

SEQ ID NO: 7235148 - DNA, 16 bp, Homo sapiens
tcctggggatactgga

SEQ ID NO: 7235149 - DNA, 22 bp, Homo sapiens
tcctggggaggtcgaggctgag

SEQ ID NO: 7235150 - DNA, 22 bp, Homo sapiens
tcctggggaggtcgaggctgag

SEQ ID NO: 7235151 - DNA, 22 bp, Homo sapiens
tcctggggaggtcgaggctgag

SEQ ID NO: 7235152 - DNA, 22 bp, Homo sapiens
tcctggggccagcactggtgga

SEQ ID NO: 7235153 - DNA, 22 bp, Homo sapiens
tcctggggccagcactggtgga

SEQ ID NO: 7235154 - DNA, 22 bp, Homo sapiens
tcctggggccagcactggtgga

SEQ ID NO: 7235155 - DNA, 22 bp, Homo sapiens
tcctggggccagcactggtgga

SEQ ID NO: 7235156 - DNA, 22 bp, Homo sapiens
tcctggggccagcactggtgga

SEQ ID NO: 7235157 - DNA, 22 bp, Homo sapiens
tcctggggccaggcacctctgg

SEQ ID NO: 7235158 - DNA, 22 bp, Homo sapiens
tcctggggccaggcacctctgg

SEQ ID NO: 7235159 - DNA, 22 bp, Homo sapiens
tcctggggccaggcacctctgg

SEQ ID NO: 7235160 - DNA, 22 bp, Homo sapiens
tcctggggccaggcacctctgg

SEQ ID NO: 7235161 - DNA, 22 bp, Homo sapiens
tcctggggccaggcacctctgg

SEQ ID NO: 7235162 - DNA, 22 bp, Homo sapiens
tcctggggctcatgggatttgt

SEQ ID NO: 7235163 - DNA, 22 bp, Homo sapiens
tcctggggctcatgggatttgt

SEQ ID NO: 7235164 - DNA, 22 bp, Homo sapiens
tcctggggctcatgggatttgt

SEQ ID NO: 7235165 - DNA, 20 bp, Homo sapiens
tcctggggtaagccatggtc

SEQ ID NO: 7235166 - DNA, 21 bp, Homo sapiens
tcctggggggtaggtgagttt

SEQ ID NO: 7235167 - DNA, 21 bp, Homo sapiens
tcctggggggtaggtgagttt

SEQ ID NO: 7235168 - DNA, 20 bp, Homo sapiens
tcctggggtaagccatggtc

SEQ ID NO: 7235169 - DNA, 22 bp, Homo sapiens
tcctggggctgcaaggcctgtc

SEQ ID NO: 7235170 - DNA, 22 bp, Homo sapiens
tcctggggctgcaaggcctgtc

SEQ ID NO: 7235171 - DNA, 21 bp, Homo sapiens
tcctggggggtaggtgagttt

SEQ ID NO: 7235172 - DNA, 22 bp, Homo sapiens
tcctggggctgcaaggcctgtc

SEQ ID NO: 7235173 - DNA, 22 bp, Homo sapiens
tcctggggctgcaaggcctgtc

SEQ ID NO: 7235174 - DNA, 22 bp, Homo sapiens
tcctggggctctttgatgtgat

SEQ ID NO: 7235175 - DNA, 22 bp, Homo sapiens
tcctggggctgcaaggcctgtc

SEQ ID NO: 7235176 - DNA, 22 bp, Homo sapiens
tcctggggctctgagcgagaca

SEQ ID NO: 7235177 - DNA, 22 bp, Homo sapiens
tcctggggctctgagcgagaca

SEQ ID NO: 7235178 - DNA, 22 bp, Homo sapiens
tcctggggctctgagcgagaca

SEQ ID NO: 7235179 - DNA, 22 bp, Homo sapiens
tcctggggctctttgatgtgat

SEQ ID NO: 7235180 - DNA, 22 bp, Homo sapiens
tcctggggctctttgatgtgat

SEQ ID NO: 7235181 - DNA, 22 bp, Homo sapiens
tcctggggctctttgatgtgat

SEQ ID NO: 7235182 - DNA, 22 bp, Homo sapiens
tcctggggctctttgatgtgat

SEQ ID NO: 7235183 - DNA, 22 bp, Homo sapiens
tcctggggctctttgatgtgat

SEQ ID NO: 7235184 - DNA, 22 bp, Homo sapiens
tcctggtggctctttgggaagg

SEQ ID NO: 7235185 - DNA, 22 bp, Homo sapiens
tcctggtggctctttgggaagg

SEQ ID NO: 7235186 - DNA, 22 bp, Homo sapiens
tcctggtggctttccctgcctt

SEQ ID NO: 7235187 - DNA, 22 bp, Homo sapiens
tcctggtcagctttgaggttgt

SEQ ID NO: 7235188 - DNA, 22 bp, Homo sapiens
tcctggtggcagattttaggtc

SEQ ID NO: 7235189 - DNA, 22 bp, Homo sapiens
tcctggtggcagattttaggtc

SEQ ID NO: 7235190 - DNA, 22 bp, Homo sapiens
tcctgggttcatgtcctggtgc

SEQ ID NO: 7235191 - DNA, 22 bp, Homo sapiens
tcctgggttaattatgattcac

SEQ ID NO: 7235192 - DNA, 22 bp, Homo sapiens
tcctgggtctgggtgtctgagg

SEQ ID NO: 7235193 - DNA, 22 bp, Homo sapiens
tcctgggtgaaagaacaggcag

SEQ ID NO: 7235194 - DNA, 22 bp, Homo sapiens
tcctgggtcccgcacatctgtc

SEQ ID NO: 7235195 - DNA, 22 bp, Homo sapiens
tcctgggtcccgcacatctgtc

SEQ ID NO: 7235196 - DNA, 22 bp, Homo sapiens
tcctgggtcctgggaagccctg

SEQ ID NO: 7235197 - DNA, 22 bp, Homo sapiens
tcctgggtctcttccttagttc

SEQ ID NO: 7235198 - DNA, 22 bp, Homo sapiens
tcctgggtctgggtgtctgagg

SEQ ID NO: 7235199 - DNA, 22 bp, Homo sapiens
tcctgggtagagacctgatgaa

SEQ ID NO: 7235200 - DNA, 22 bp, Homo sapiens
tcctgggtagagacctgatgaa

SEQ ID NO: 7235201 - DNA, 22 bp, Homo sapiens
tcctggggtttagagggaagtg

SEQ ID NO: 7235202 - DNA, 22 bp, Homo sapiens
tcctggggttttggccgcagct

SEQ ID NO: 7235203 - DNA, 22 bp, Homo sapiens
tcctggggttttggccgcagct

SEQ ID NO: 7235204 - DNA, 22 bp, Homo sapiens
tcctggggttttggccgcagct

SEQ ID NO: 7235205 - DNA, 22 bp, Homo sapiens
tcctggggtcctgactgcttcc

SEQ ID NO: 7235206 - DNA, 22 bp, Homo sapiens
tcctggggtcctgactgcttcc

SEQ ID NO: 7235207 - DNA, 20 bp, Homo sapiens
tcctggggtaagccatggtc

SEQ ID NO: 7235208 - DNA, 20 bp, Homo sapiens
tcctggggtaagccatggtc

SEQ ID NO: 7235209 - DNA, 22 bp, Homo sapiens
tcctggggtcctgactgcttcc

SEQ ID NO: 7235210 - DNA, 22 bp, Homo sapiens
tcctggggtcctgactgcttcc

SEQ ID NO: 7235211 - DNA, 22 bp, Homo sapiens
tcctggggtcctgactgcttcc

SEQ ID NO: 7235212 - DNA, 22 bp, Homo sapiens
tcctggggtgtgttttgctgct

SEQ ID NO: 7235213 - DNA, 22 bp, Homo sapiens
tcctggggtgtgttttgctgct

SEQ ID NO: 7235214 - DNA, 22 bp, Homo sapiens
tcctggggtgtgttttgctgct

SEQ ID NO: 7235215 - DNA, 22 bp, Homo sapiens
tcctggggtgtgttttgctgct

SEQ ID NO: 7235216 - DNA, 22 bp, Homo sapiens
tcctggggtttagagggaagtg

SEQ ID NO: 7235217 - DNA, 22 bp, Homo sapiens
tcctggggtttagagggaagtg

SEQ ID NO: 7235218 - DNA, 22 bp, Homo sapiens
tcctgtcttaatgatctcgtgc

SEQ ID NO: 7235219 - DNA, 22 bp, Homo sapiens
tcctgtcttaatgatctcgtgc

SEQ ID NO: 7235220 - DNA, 22 bp, Homo sapiens
tcctgtctgctcacagagctgg

SEQ ID NO: 7235221 - DNA, 22 bp, Homo sapiens
tcctgtctcagtgtatttgcag

SEQ ID NO: 7235222 - DNA, 22 bp, Homo sapiens
tcctgtctgctcacagagctgg

SEQ ID NO: 7235223 - DNA, 22 bp, Homo sapiens
tcctgtctcagtgtatttgcag

SEQ ID NO: 7235224 - DNA, 22 bp, Homo sapiens
tcctgtctcagtgtatttgcag

SEQ ID NO: 7235225 - DNA, 22 bp, Homo sapiens
tcctgtctcagtgtatttgcag

SEQ ID NO: 7235226 - DNA, 22 bp, Homo sapiens
tcctgtcttaatgatctcgtgc

SEQ ID NO: 7235227 - DNA, 22 bp, Homo sapiens
tcctgtgaagaatagcactcaa

SEQ ID NO: 7235228 - DNA, 23 bp, Homo sapiens
tcctgtgaagccatgtttgttgt

SEQ ID NO: 7235229 - DNA, 22 bp, Homo sapiens
tcctgtgaccagcttccatgct

SEQ ID NO: 7235230 - DNA, 22 bp, Homo sapiens
tcctgtgaccagcttccatgct

SEQ ID NO: 7235231 - DNA, 22 bp, Homo sapiens
tcctgtgacggagcgccagagg

SEQ ID NO: 7235232 - DNA, 22 bp, Homo sapiens
tcctgtgagacttgtccattat

SEQ ID NO: 7235233 - DNA, 22 bp, Homo sapiens
tcctgtgagcagcacagagaca

SEQ ID NO: 7235234 - DNA, 21 bp, Homo sapiens
tcctgtgaggacctgtcagtg

SEQ ID NO: 7235235 - DNA, 21 bp, Homo sapiens
tcctgtgaggacctgtcagtg

SEQ ID NO: 7235236 - DNA, 22 bp, Homo sapiens
tcctgtgagtagatagtattgt

SEQ ID NO: 7235237 - DNA, 22 bp, Homo sapiens
tcctgtgatattgtttgttata

SEQ ID NO: 7235238 - DNA, 22 bp, Homo sapiens
tcctgtgatggcttgcgatgtg

SEQ ID NO: 7235239 - DNA, 22 bp, Homo sapiens
tcctgtgcctccacctgctccg

SEQ ID NO: 7235240 - DNA, 22 bp, Homo sapiens
tcctgtggagaggactggaggt

SEQ ID NO: 7235241 - DNA, 18 bp, Homo sapiens
tcctgtggcccagagttt

SEQ ID NO: 7235242 - DNA, 22 bp, Homo sapiens
tcctgtggtatgggagtgatgt

SEQ ID NO: 7235243 - DNA, 22 bp, Homo sapiens
tcctgtgggctctcggcctcca

SEQ ID NO: 7235244 - DNA, 22 bp, Homo sapiens
tcctgtggcgttatcatgtgat

SEQ ID NO: 7235245 - DNA, 22 bp, Homo sapiens
tcctgtggctctgtggaacctt

SEQ ID NO: 7235246 - DNA, 22 bp, Homo sapiens
tcctgtctaaagacctgcaggc

SEQ ID NO: 7235247 - DNA, 22 bp, Homo sapiens
tcctgtctaaagacctgcaggc

SEQ ID NO: 7235248 - DNA, 22 bp, Homo sapiens
tcctgtcctgaggctccaggcc

SEQ ID NO: 7235249 - DNA, 22 bp, Homo sapiens
tcctgtcctgaggctccaggcc

SEQ ID NO: 7235250 - DNA, 22 bp, Homo sapiens
tcctgtcctgaggctccaggcc

SEQ ID NO: 7235251 - DNA, 22 bp, Homo sapiens
tcctgtccacagccctgacctc

SEQ ID NO: 7235252 - DNA, 20 bp, Homo sapiens
tcctgtccgcgccttgcgtc

SEQ ID NO: 7235253 - DNA, 22 bp, Homo sapiens
tcctgtcctctgggtgccccat

SEQ ID NO: 7235254 - DNA, 22 bp, Homo sapiens
tcctggttcttgaggagccatg

SEQ ID NO: 7235255 - DNA, 22 bp, Homo sapiens
tcctggtttatagactgatggc

SEQ ID NO: 7235256 - DNA, 21 bp, Homo sapiens
tcctgtaagcttgggtggctc

SEQ ID NO: 7235257 - DNA, 21 bp, Homo sapiens
tcctgtaagcttgggtggctc

SEQ ID NO: 7235258 - DNA, 21 bp, Homo sapiens
tcctgtaagcttgggtggctc

SEQ ID NO: 7235259 - DNA, 22 bp, Homo sapiens
tcctgtatcctgatacaataag

SEQ ID NO: 7235260 - DNA, 22 bp, Homo sapiens
tcctgtcagtgaggcagatgaa

SEQ ID NO: 7235261 - DNA, 22 bp, Homo sapiens
tcctggtgtcctggtctgctag

SEQ ID NO: 7235262 - DNA, 22 bp, Homo sapiens
tcctggtgtcctggtctgctag

SEQ ID NO: 7235263 - DNA, 22 bp, Homo sapiens
tcctggtgtcctggtctgctag

SEQ ID NO: 7235264 - DNA, 22 bp, Homo sapiens
tcctggtgtcctggtctgctag

SEQ ID NO: 7235265 - DNA, 22 bp, Homo sapiens
tcctggtgtcgcctggtcagtt

SEQ ID NO: 7235266 - DNA, 22 bp, Homo sapiens
tcctggtgtcgcctggtcagtt

SEQ ID NO: 7235267 - DNA, 22 bp, Homo sapiens
tcctggtgtcgcctggtcagtt

SEQ ID NO: 7235268 - DNA, 22 bp, Homo sapiens
tcctggtgttactaaattgaaa

SEQ ID NO: 7235269 - DNA, 22 bp, Homo sapiens
tcctggtgttactaaattgaaa

SEQ ID NO: 7235270 - DNA, 22 bp, Homo sapiens
tcctggtgtttatgtcacatag

SEQ ID NO: 7235271 - DNA, 22 bp, Homo sapiens
tcctggtgtttatgtcacatag

SEQ ID NO: 7235272 - DNA, 22 bp, Homo sapiens
tcctggttaccaagcagctctc

SEQ ID NO: 7235273 - DNA, 22 bp, Homo sapiens
tcctggttagagctctctgggg

SEQ ID NO: 7235274 - DNA, 22 bp, Homo sapiens
tcctggttagagctctctgggg

SEQ ID NO: 7235275 - DNA, 22 bp, Homo sapiens
tcctggttcctaccttcagctg

SEQ ID NO: 7235276 - DNA, 22 bp, Homo sapiens
tcctggttctggaatgtttaag

SEQ ID NO: 7235277 - DNA, 22 bp, Homo sapiens
tcctggtggtttgaaaactgaa

SEQ ID NO: 7235278 - DNA, 22 bp, Homo sapiens
tcctggtgtaatggtaagcatg

SEQ ID NO: 7235279 - DNA, 22 bp, Homo sapiens
tcctggtgtaatggtaagcatg

SEQ ID NO: 7235280 - DNA, 22 bp, Homo sapiens
tcctggtggtgccggtgcccgg

SEQ ID NO: 7235281 - DNA, 22 bp, Homo sapiens
tcctggtggtgccagctgcagg

SEQ ID NO: 7235282 - DNA, 22 bp, Homo sapiens
tcctggtggtgccggtgcccgg

SEQ ID NO: 7235283 - DNA, 22 bp, Homo sapiens
tcctggtggtgccggtgcccgg

SEQ ID NO: 7235284 - DNA, 22 bp, Homo sapiens
tcctggtggtttgaaaactgaa

SEQ ID NO: 7235285 - DNA, 22 bp, Homo sapiens
tcctggtggtgccagctgcagg

SEQ ID NO: 7235286 - DNA, 22 bp, Homo sapiens
tcctggtggtctgtgcttcttc

SEQ ID NO: 7235287 - DNA, 22 bp, Homo sapiens
tcctggtggtctgtgcttcttc

SEQ ID NO: 7235288 - DNA, 22 bp, Homo sapiens
tcctggtggtctgtgcttcttc

SEQ ID NO: 7235289 - DNA, 22 bp, Homo sapiens
tcctggtggctttccctgcctt

SEQ ID NO: 7235290 - DNA, 22 bp, Homo sapiens
tcctggtgggacagaaaacctc

SEQ ID NO: 7235291 - DNA, 22 bp, Homo sapiens
tcctggtgggacagaaaacctc

SEQ ID NO: 7235292 - DNA, 22 bp, Homo sapiens
tcctggtggtctgtgcttcttc

SEQ ID NO: 7235293 - DNA, 22 bp, Homo sapiens
tcctggggaggtcgaggctgag

SEQ ID NO: 7235294 - DNA, 22 bp, Homo sapiens
tcctggggagggttctggctcc

SEQ ID NO: 7235295 - DNA, 22 bp, Homo sapiens
tcctggggagggttctggctcc

SEQ ID NO: 7235296 - DNA, 22 bp, Homo sapiens
tcctggggaggtcgaggctgag

SEQ ID NO: 7235297 - DNA, 22 bp, Homo sapiens
tcctgggctgtggccccgggca

SEQ ID NO: 7235298 - DNA, 22 bp, Homo sapiens
tcctgggctgtgtgccactctg

SEQ ID NO: 7235299 - DNA, 19 bp, Homo sapiens
tcctgggctgggccaggtc

SEQ ID NO: 7235300 - DNA, 19 bp, Homo sapiens
tcctgggctgggccaggtc

SEQ ID NO: 7235301 - DNA, 22 bp, Homo sapiens
tcctgggcgattttctgaatat

SEQ ID NO: 7235302 - DNA, 22 bp, Homo sapiens
tcctgggcggttatgtgatctg

SEQ ID NO: 7235303 - DNA, 19 bp, Homo sapiens
tcctgggcgttgactttgg

SEQ ID NO: 7235304 - DNA, 19 bp, Homo sapiens
tcctgggctgcgtcttgcc

SEQ ID NO: 7235305 - DNA, 22 bp, Homo sapiens
tcctgggccctccggatcaggt

SEQ ID NO: 7235306 - DNA, 22 bp, Homo sapiens
tcctgggcccaggctgccaggg

SEQ ID NO: 7235307 - DNA, 22 bp, Homo sapiens
tcctgggcgagtggtggtacac

SEQ ID NO: 7235308 - DNA, 22 bp, Homo sapiens
tcctgggccaagggctgtgagg

SEQ ID NO: 7235309 - DNA, 22 bp, Homo sapiens
tcctgggccaagggctgtgagg

SEQ ID NO: 7235310 - DNA, 22 bp, Homo sapiens
tcctgggcccaggctgccaggg

SEQ ID NO: 7235311 - DNA, 22 bp, Homo sapiens
tcctgggcagcctctctggaag

SEQ ID NO: 7235312 - DNA, 22 bp, Homo sapiens
tcctgggcagcctctctggaag

SEQ ID NO: 7235313 - DNA, 22 bp, Homo sapiens
tcctgggcagaatgggatggct

SEQ ID NO: 7235314 - DNA, 22 bp, Homo sapiens
tcctgggcagaatgggatggct

SEQ ID NO: 7235315 - DNA, 22 bp, Homo sapiens
tcctgggcagaatgggatggct

SEQ ID NO: 7235316 - DNA, 22 bp, Homo sapiens
tcctgggcagaatgggatggct

SEQ ID NO: 7235317 - DNA, 22 bp, Homo sapiens
tcctgggcacaagtgagtctcc

SEQ ID NO: 7235318 - DNA, 22 bp, Homo sapiens
tcctgggcaaagaggggcagtg

SEQ ID NO: 7235319 - DNA, 22 bp, Homo sapiens
tcctgggcaaagaggggcagtg

SEQ ID NO: 7235320 - DNA, 22 bp, Homo sapiens
tcctgggatttgcccttttctc

SEQ ID NO: 7235321 - DNA, 22 bp, Homo sapiens
tcctgggcaaaagtatctgtga

SEQ ID NO: 7235322 - DNA, 22 bp, Homo sapiens
tcctgggattaaggtggtgatt

SEQ ID NO: 7235323 - DNA, 22 bp, Homo sapiens
tcctgggattaaggtggtgatt

SEQ ID NO: 7235324 - DNA, 22 bp, Homo sapiens
tcctgggattctgcatttctaa

SEQ ID NO: 7235325 - DNA, 22 bp, Homo sapiens
tcctgggatgaggaaacaagga

SEQ ID NO: 7235326 - DNA, 22 bp, Homo sapiens
tcctgggatgacttttgaaatg

SEQ ID NO: 7235327 - DNA, 22 bp, Homo sapiens
tcctgggatgcataaaatatgt

SEQ ID NO: 7235328 - DNA, 22 bp, Homo sapiens
tcctgggatactaagaaatttt

SEQ ID NO: 7235329 - DNA, 22 bp, Homo sapiens
tcctgggatcaagtgatcctcc

SEQ ID NO: 7235330 - DNA, 22 bp, Homo sapiens
tcctgggagtaaaagctgccct

SEQ ID NO: 7235331 - DNA, 22 bp, Homo sapiens
tcctgggagtaattgagtcatg

SEQ ID NO: 7235332 - DNA, 22 bp, Homo sapiens
tcctgggagtaattgagtcatg

SEQ ID NO: 7235333 - DNA, 22 bp, Homo sapiens
tcctgggagtggccatgtaatg

SEQ ID NO: 7235334 - DNA, 21 bp, Homo sapiens
tcctgggagtctgagatcctg

SEQ ID NO: 7235335 - DNA, 22 bp, Homo sapiens
tcctggcttttcttggctcatc

SEQ ID NO: 7235336 - DNA, 22 bp, Homo sapiens
tcctggcttttcttggctcatc

SEQ ID NO: 7235337 - DNA, 18 bp, Homo sapiens
tcctgggaaaggcataca

SEQ ID NO: 7235338 - DNA, 18 bp, Homo sapiens
tcctgggaaaggcataca

SEQ ID NO: 7235339 - DNA, 21 bp, Homo sapiens
tcctggctttatgctacctct

SEQ ID NO: 7235340 - DNA, 21 bp, Homo sapiens
tcctggctttatgctacctct

SEQ ID NO: 7235341 - DNA, 21 bp, Homo sapiens
tcctggctttatgctacctct

SEQ ID NO: 7235342 - DNA, 22 bp, Homo sapiens
tcctggcttctgtctccttatt

SEQ ID NO: 7235343 - DNA, 22 bp, Homo sapiens
tcctggcttgtcacatctacgt

SEQ ID NO: 7235344 - DNA, 22 bp, Homo sapiens
tcctgggaactcggaaagctct

SEQ ID NO: 7235345 - DNA, 18 bp, Homo sapiens
tcctgggaacttgctagc

SEQ ID NO: 7235346 - DNA, 22 bp, Homo sapiens
tcctgggaagactgtgaggaca

SEQ ID NO: 7235347 - DNA, 22 bp, Homo sapiens
tcctgggaagactgtgaggaca

SEQ ID NO: 7235348 - DNA, 22 bp, Homo sapiens
tcctgggaagactgtgaggaca

SEQ ID NO: 7235349 - DNA, 22 bp, Homo sapiens
tcctgggaagagacctgagcat

SEQ ID NO: 7235350 - DNA, 22 bp, Homo sapiens
tcctgggaagagacctgagcat

SEQ ID NO: 7235351 - DNA, 22 bp, Homo sapiens
tcctggctggaatttctcactc

SEQ ID NO: 7235352 - DNA, 22 bp, Homo sapiens
tcctggctgccgtcgtcctgcg

SEQ ID NO: 7235353 - DNA, 22 bp, Homo sapiens
tcctggctgttagagaggcaag

SEQ ID NO: 7235354 - DNA, 22 bp, Homo sapiens
tcctggctgtcactcgggttga

SEQ ID NO: 7235355 - DNA, 22 bp, Homo sapiens
tcctggctgtcactcgggttga

SEQ ID NO: 7235356 - DNA, 22 bp, Homo sapiens
tcctggctcttctgagttttct

SEQ ID NO: 7235357 - DNA, 22 bp, Homo sapiens
tcctggctgagttcccaagtcg

SEQ ID NO: 7235358 - DNA, 22 bp, Homo sapiens
tcctggctgagttcccaagtcg

SEQ ID NO: 7235359 - DNA, 22 bp, Homo sapiens
tcctggctgcaccagtgaccct

SEQ ID NO: 7235360 - DNA, 22 bp, Homo sapiens
tcctggctgcaccagtgaccct

SEQ ID NO: 7235361 - DNA, 22 bp, Homo sapiens
tcctggctgcaccagtgaccct

SEQ ID NO: 7235362 - DNA, 22 bp, Homo sapiens
tcctggctgccgtcgtcctgcg

SEQ ID NO: 7235363 - DNA, 22 bp, Homo sapiens
tcctggctgttagagaggcaag

SEQ ID NO: 7235364 - DNA, 22 bp, Homo sapiens
tcctggctgttagagaggcaag

SEQ ID NO: 7235365 - DNA, 22 bp, Homo sapiens
tcctggctgttagagaggcaag

SEQ ID NO: 7235366 - DNA, 22 bp, Homo sapiens
tcctggcttaggtttccagaac

SEQ ID NO: 7235367 - DNA, 22 bp, Homo sapiens
tcctggcttccacacctgtcat

SEQ ID NO: 7235368 - DNA, 22 bp, Homo sapiens
tcctggcttccactcctctgtt

SEQ ID NO: 7235369 - DNA, 22 bp, Homo sapiens
tcctggcttccactcctctgtt

SEQ ID NO: 7235370 - DNA, 22 bp, Homo sapiens
tcctggcttccactcctctgtt

SEQ ID NO: 7235371 - DNA, 22 bp, Homo sapiens
tcctggcttcctgctcttgtca

SEQ ID NO: 7235372 - DNA, 22 bp, Homo sapiens
tcctggcttcctgctcttgtca

SEQ ID NO: 7235373 - DNA, 22 bp, Homo sapiens
tcctgggaccctgggtgcagag

SEQ ID NO: 7235374 - DNA, 22 bp, Homo sapiens
tcctgggaccctgggtgcagag

SEQ ID NO: 7235375 - DNA, 22 bp, Homo sapiens
tcctgggaccgagggaagagct

SEQ ID NO: 7235376 - DNA, 22 bp, Homo sapiens
tcctgggaccgagggaagagct

SEQ ID NO: 7235377 - DNA, 22 bp, Homo sapiens
tcctgggaccgagggaagagct

SEQ ID NO: 7235378 - DNA, 22 bp, Homo sapiens
tcctgggactcaacttagaagg

SEQ ID NO: 7235379 - DNA, 22 bp, Homo sapiens
tcctgggactctgcctcaggct

SEQ ID NO: 7235380 - DNA, 22 bp, Homo sapiens
tcctgggactctgcctcaggct

SEQ ID NO: 7235381 - DNA, 22 bp, Homo sapiens
tcctgggaggcaggaccccttt

SEQ ID NO: 7235382 - DNA, 22 bp, Homo sapiens
tcctgggaggcggaggttgcag

SEQ ID NO: 7235383 - DNA, 22 bp, Homo sapiens
tcctgggaggctgtgcctggct

SEQ ID NO: 7235384 - DNA, 22 bp, Homo sapiens
tcctgggaggctgtgcctggct

SEQ ID NO: 7235385 - DNA, 22 bp, Homo sapiens
tcctgggaggtaaaccagcatc

SEQ ID NO: 7235386 - DNA, 22 bp, Homo sapiens
tcctgggaagttgcatcaccgt

SEQ ID NO: 7235387 - DNA, 22 bp, Homo sapiens
tcctgggaagttgcatcaccgt

SEQ ID NO: 7235388 - DNA, 22 bp, Homo sapiens
tcctgggaagtggctggctgag

SEQ ID NO: 7235389 - DNA, 22 bp, Homo sapiens
tcctgggacaagccgtggaagt

SEQ ID NO: 7235390 - DNA, 22 bp, Homo sapiens
tcctgggacaccccaatatgag

SEQ ID NO: 7235391 - DNA, 22 bp, Homo sapiens
tcctgggaccaggcacctactg

SEQ ID NO: 7235392 - DNA, 22 bp, Homo sapiens
tcctgggaagtggctggctgag

SEQ ID NO: 7235393 - DNA, 22 bp, Homo sapiens
tcctgggaagcgccggcctgcg

SEQ ID NO: 7235394 - DNA, 21 bp, Homo sapiens
tcctgggaagcactggggtgg

SEQ ID NO: 7235395 - DNA, 21 bp, Homo sapiens
tcctgggaagcactggggtgg

SEQ ID NO: 7235396 - DNA, 21 bp, Homo sapiens
tcctgggaagcactggggtgg

SEQ ID NO: 7235397 - DNA, 22 bp, Homo sapiens
tcctggagaagaggggcttgga

SEQ ID NO: 7235398 - DNA, 22 bp, Homo sapiens
tcctggagaagaggggcttgga

SEQ ID NO: 7235399 - DNA, 22 bp, Homo sapiens
tcctggagaagaggggcttgga

SEQ ID NO: 7235400 - DNA, 22 bp, Homo sapiens
tcctggagaagaggggcttgga

SEQ ID NO: 7235401 - DNA, 22 bp, Homo sapiens
tcctggagaactgattcgcggg

SEQ ID NO: 7235402 - DNA, 22 bp, Homo sapiens
tcctggagaactgattcgcggg

SEQ ID NO: 7235403 - DNA, 23 bp, Homo sapiens
tcctggagaaaagaaacatttct

SEQ ID NO: 7235404 - DNA, 22 bp, Homo sapiens
tcctggagaaactcagagatct

SEQ ID NO: 7235405 - DNA, 22 bp, Homo sapiens
tcctggagaaactcagagatct

SEQ ID NO: 7235406 - DNA, 22 bp, Homo sapiens
tcctggagaaactcagagatct

SEQ ID NO: 7235407 - DNA, 22 bp, Homo sapiens
tcctggagaaactcagagatct

SEQ ID NO: 7235408 - DNA, 22 bp, Homo sapiens
tcctggagaaactcagagatct

SEQ ID NO: 7235409 - DNA, 22 bp, Homo sapiens
tcctggagaaactcagagatct

SEQ ID NO: 7235410 - DNA, 23 bp, Homo sapiens
tcctggagaaaagaaacatttct

SEQ ID NO: 7235411 - DNA, 22 bp, Homo sapiens
tcctggaagtgcttggtgaggg

SEQ ID NO: 7235412 - DNA, 22 bp, Homo sapiens
tcctggaagtgcttggtgaggg

SEQ ID NO: 7235413 - DNA, 22 bp, Homo sapiens
tcctggaatcagctttggagac

SEQ ID NO: 7235414 - DNA, 22 bp, Homo sapiens
tcctgctttgtgcctcacactt

SEQ ID NO: 7235415 - DNA, 19 bp, Homo sapiens
tcctgctttctactctgct

SEQ ID NO: 7235416 - DNA, 19 bp, Homo sapiens
tcctgctttctactctgct

SEQ ID NO: 7235417 - DNA, 19 bp, Homo sapiens
tcctgctttctactctgct

SEQ ID NO: 7235418 - DNA, 22 bp, Homo sapiens
tcctggaacatggataaagaat

SEQ ID NO: 7235419 - DNA, 22 bp, Homo sapiens
tcctggaacatggataaagaat

SEQ ID NO: 7235420 - DNA, 22 bp, Homo sapiens
tcctggaacatggataaagaat

SEQ ID NO: 7235421 - DNA, 22 bp, Homo sapiens
tcctggaactgggctgggcgga

SEQ ID NO: 7235422 - DNA, 22 bp, Homo sapiens
tcctggaagatctctgtgagat

SEQ ID NO: 7235423 - DNA, 22 bp, Homo sapiens
tcctggaagatctctgtgagat

SEQ ID NO: 7235424 - DNA, 22 bp, Homo sapiens
tcctggaagatctctgtgagat

SEQ ID NO: 7235425 - DNA, 22 bp, Homo sapiens
tcctggagagaggcctggaaga

SEQ ID NO: 7235426 - DNA, 22 bp, Homo sapiens
tcctggagagaggcctggaaga

SEQ ID NO: 7235427 - DNA, 22 bp, Homo sapiens
tcctggagagaggcctggaaga

SEQ ID NO: 7235428 - DNA, 22 bp, Homo sapiens
tcctggagagaggcctggaaga

SEQ ID NO: 7235429 - DNA, 22 bp, Homo sapiens
tcctggagagtgggcgagcaca

SEQ ID NO: 7235430 - DNA, 22 bp, Homo sapiens
tcctggagagtgggcgagcaca

SEQ ID NO: 7235431 - DNA, 22 bp, Homo sapiens
tcctggagagtgggcgagcaca

SEQ ID NO: 7235432 - DNA, 22 bp, Homo sapiens
tcctggagaatcctgccacctg

SEQ ID NO: 7235433 - DNA, 22 bp, Homo sapiens
tcctggagaatcctgccacctg

SEQ ID NO: 7235434 - DNA, 22 bp, Homo sapiens
tcctggagaatcctgccacctg

SEQ ID NO: 7235435 - DNA, 22 bp, Homo sapiens
tcctggagaatggacaatgcac

SEQ ID NO: 7235436 - DNA, 22 bp, Homo sapiens
tcctggagaatggacaatgcac

SEQ ID NO: 7235437 - DNA, 22 bp, Homo sapiens
tcctggagaatggacaatgcac

SEQ ID NO: 7235438 - DNA, 22 bp, Homo sapiens
tcctggagataattgcagtgaa

SEQ ID NO: 7235439 - DNA, 22 bp, Homo sapiens
tcctggagataattgcagtgaa

SEQ ID NO: 7235440 - DNA, 22 bp, Homo sapiens
tcctggagataattgcagtgaa

SEQ ID NO: 7235441 - DNA, 22 bp, Homo sapiens
tcctggagagtgggcgagcaca

SEQ ID NO: 7235442 - DNA, 22 bp, Homo sapiens
tcctggagataattgcagtgaa

SEQ ID NO: 7235443 - DNA, 22 bp, Homo sapiens
tcctggagataattgcagtgaa

SEQ ID NO: 7235444 - DNA, 22 bp, Homo sapiens
tcctggagataattgcagtgaa

SEQ ID NO: 7235445 - DNA, 22 bp, Homo sapiens
tcctggagccaatgtgctgctg

SEQ ID NO: 7235446 - DNA, 22 bp, Homo sapiens
tcctggagccaatgtgctgctg

SEQ ID NO: 7235447 - DNA, 22 bp, Homo sapiens
tcctggagggaggcggtgctac

SEQ ID NO: 7235448 - DNA, 22 bp, Homo sapiens
tcctggagggaggcggtgctac

SEQ ID NO: 7235449 - DNA, 22 bp, Homo sapiens
tcctggagggaggcggtgctac

SEQ ID NO: 7235450 - DNA, 20 bp, Homo sapiens
tcctggaggcttcatccata

SEQ ID NO: 7235451 - DNA, 20 bp, Homo sapiens
tcctggaggcttcatccata

SEQ ID NO: 7235452 - DNA, 20 bp, Homo sapiens
tcctggaggcttcatccata

SEQ ID NO: 7235453 - DNA, 22 bp, Homo sapiens
tcctggaggcactcgctggggc

SEQ ID NO: 7235454 - DNA, 22 bp, Homo sapiens
tcctggaggcactcgctggggc

SEQ ID NO: 7235455 - DNA, 22 bp, Homo sapiens
tcctggaggcactcgctggggc

SEQ ID NO: 7235456 - DNA, 22 bp, Homo sapiens
tcctggaggcactcgctggggc

SEQ ID NO: 7235457 - DNA, 22 bp, Homo sapiens
tcctggagccaatgtgctgctg

SEQ ID NO: 7235458 - DNA, 22 bp, Homo sapiens
tcctggagccaatgtgctgctg

SEQ ID NO: 7235459 - DNA, 22 bp, Homo sapiens
tcctggaggcaaatgaagactc

SEQ ID NO: 7235460 - DNA, 22 bp, Homo sapiens
tcctggaggcaaatgaagactc

SEQ ID NO: 7235461 - DNA, 22 bp, Homo sapiens
tcctggaggcaaatgaagactc

SEQ ID NO: 7235462 - DNA, 22 bp, Homo sapiens
tcctggaggcaaatgaagactc

SEQ ID NO: 7235463 - DNA, 22 bp, Homo sapiens
tcctggaggcaaatgaagactc

SEQ ID NO: 7235464 - DNA, 22 bp, Homo sapiens
tcctggaggcaaatgagcacat

SEQ ID NO: 7235465 - DNA, 22 bp, Homo sapiens
tcctggaggcaaatgagcacat

SEQ ID NO: 7235466 - DNA, 22 bp, Homo sapiens
tcctggaggcaaatgagcacat

SEQ ID NO: 7235467 - DNA, 22 bp, Homo sapiens
tcctggaggcaaatgagcacat

SEQ ID NO: 7235468 - DNA, 22 bp, Homo sapiens
tcctggaggcaaatgagcacat

SEQ ID NO: 7235469 - DNA, 22 bp, Homo sapiens
tcctggaggggacagcatgggc

SEQ ID NO: 7235470 - DNA, 22 bp, Homo sapiens
tcctggaggggacagcatgggc

SEQ ID NO: 7235471 - DNA, 22 bp, Homo sapiens
tcctggaggggacagcatgggc

SEQ ID NO: 7235472 - DNA, 22 bp, Homo sapiens
tcctggaggggacagcatgggc

SEQ ID NO: 7235473 - DNA, 22 bp, Homo sapiens
tcctggaggggacagcatgggc

SEQ ID NO: 7235474 - DNA, 22 bp, Homo sapiens
tcctggagggctcacaggcggc

SEQ ID NO: 7235475 - DNA, 22 bp, Homo sapiens
tcctggagggctcacaggcggc

SEQ ID NO: 7235476 - DNA, 22 bp, Homo sapiens
tcctggagggctcacaggcggc

SEQ ID NO: 7235477 - DNA, 22 bp, Homo sapiens
tcctggagggctcacaggcggc

SEQ ID NO: 7235478 - DNA, 22 bp, Homo sapiens
tcctggagtatttctgtggtgt

SEQ ID NO: 7235479 - DNA, 22 bp, Homo sapiens
tcctggagtatttctgtggtgt

SEQ ID NO: 7235480 - DNA, 22 bp, Homo sapiens
tcctggagtatttctgtggtgt

SEQ ID NO: 7235481 - DNA, 20 bp, Homo sapiens
tcctggagtattccatgctt

SEQ ID NO: 7235482 - DNA, 20 bp, Homo sapiens
tcctggagtattccatgctt

SEQ ID NO: 7235483 - DNA, 22 bp, Homo sapiens
tcctggagtaggccttagccat

SEQ ID NO: 7235484 - DNA, 22 bp, Homo sapiens
tcctggagtaggccttagccat

SEQ ID NO: 7235485 - DNA, 22 bp, Homo sapiens
tcctggagtaggccttagccat

SEQ ID NO: 7235486 - DNA, 22 bp, Homo sapiens
tcctggagtaggccttagccat

SEQ ID NO: 7235487 - DNA, 20 bp, Homo sapiens
tcctggagtattccatgctt

SEQ ID NO: 7235488 - DNA, 18 bp, Homo sapiens
taagaaggtggctccagc

SEQ ID NO: 7235489 - DNA, 22 bp, Homo sapiens
taagaatacctctcagctcttt

SEQ ID NO: 7235490 - DNA, 22 bp, Homo sapiens
taagaatacctctcagctcttt

SEQ ID NO: 7235491 - DNA, 22 bp, Homo sapiens
taagaatagtccctagatgtgt

SEQ ID NO: 7235492 - DNA, 22 bp, Homo sapiens
taagaatagtccctagatgtgt

SEQ ID NO: 7235493 - DNA, 22 bp, Homo sapiens
taagaatagtccctagatgtgt

SEQ ID NO: 7235494 - DNA, 22 bp, Homo sapiens
taagaatagtccctagatgtgt

SEQ ID NO: 7235495 - DNA, 22 bp, Homo sapiens
taagaacattttcggaaagata

SEQ ID NO: 7235496 - DNA, 22 bp, Homo sapiens
taagaacattttcggaaagata

SEQ ID NO: 7235497 - DNA, 22 bp, Homo sapiens
taagaacattttcggaaagata

SEQ ID NO: 7235498 - DNA, 22 bp, Homo sapiens
taagaacattttcggaaagata

SEQ ID NO: 7235499 - DNA, 22 bp, Homo sapiens
taagaactcgtgatcatttgaa

SEQ ID NO: 7235500 - DNA, 22 bp, Homo sapiens
taagaacttcggacatgttatc

SEQ ID NO: 7235501 - DNA, 22 bp, Homo sapiens
taagaacttggcagcaagaaat

SEQ ID NO: 7235502 - DNA, 22 bp, Homo sapiens
taagaacttggcagcaagaaat

SEQ ID NO: 7235503 - DNA, 22 bp, Homo sapiens
taagaagcagttcacaagtaaa

SEQ ID NO: 7235504 - DNA, 22 bp, Homo sapiens
taagaagcttctgctaatgcct

SEQ ID NO: 7235505 - DNA, 22 bp, Homo sapiens
taagaacagtagaacagtaggt

SEQ ID NO: 7235506 - DNA, 22 bp, Homo sapiens
taagaacagtagaacagtaggt

SEQ ID NO: 7235507 - DNA, 22 bp, Homo sapiens
taagaacagtgacagccaacat

SEQ ID NO: 7235508 - DNA, 22 bp, Homo sapiens
taagaacagtgtctgtctcaca

SEQ ID NO: 7235509 - DNA, 22 bp, Homo sapiens
taagaacagtgtttcatctcta

SEQ ID NO: 7235510 - DNA, 22 bp, Homo sapiens
taagaacataaattcatacggg

SEQ ID NO: 7235511 - DNA, 22 bp, Homo sapiens
taagaacatctgtccccagatt

SEQ ID NO: 7235512 - DNA, 22 bp, Homo sapiens
taagaacatctgtccccagatt

SEQ ID NO: 7235513 - DNA, 22 bp, Homo sapiens
tcctgcttgaaactctgccttc

SEQ ID NO: 7235514 - DNA, 22 bp, Homo sapiens
tcctgcttgaaactctgccttc

SEQ ID NO: 7235515 - DNA, 22 bp, Homo sapiens
tcctgcttgaaactctgccttc

SEQ ID NO: 7235516 - DNA, 20 bp, Homo sapiens
tcctgcttccaccagagcac

SEQ ID NO: 7235517 - DNA, 22 bp, Homo sapiens
tcctgcttccttgtctttagac

SEQ ID NO: 7235518 - DNA, 22 bp, Homo sapiens
tcctgcttcttcgagcttctgg

SEQ ID NO: 7235519 - DNA, 22 bp, Homo sapiens
tcctgctgtttacctacaatgg

SEQ ID NO: 7235520 - DNA, 22 bp, Homo sapiens
tcctgctgttttctggcccaca

SEQ ID NO: 7235521 - DNA, 22 bp, Homo sapiens
tcctgctgttttctggcccaca

SEQ ID NO: 7235522 - DNA, 22 bp, Homo sapiens
tcctgctgggtctaactctggt

SEQ ID NO: 7235523 - DNA, 22 bp, Homo sapiens
taagaatagtgtttgcctttgg

SEQ ID NO: 7235524 - DNA, 22 bp, Homo sapiens
taagaatagtgtttgcctttgg

SEQ ID NO: 7235525 - DNA, 22 bp, Homo sapiens
taagaatagtccctagatgtgt

SEQ ID NO: 7235526 - DNA, 22 bp, Homo sapiens
taagaatagtgtttgcctttgg

SEQ ID NO: 7235527 - DNA, 22 bp, Homo sapiens
taagaatattgggaatggatgg

SEQ ID NO: 7235528 - DNA, 22 bp, Homo sapiens
taagaatattgggaatggatgg

SEQ ID NO: 7235529 - DNA, 22 bp, Homo sapiens
taagaatattgggaatggatgg

SEQ ID NO: 7235530 - DNA, 22 bp, Homo sapiens
taagaatattgggaatggatgg

SEQ ID NO: 7235531 - DNA, 22 bp, Homo sapiens
taagaatcagtagatatagatt

SEQ ID NO: 7235532 - DNA, 22 bp, Homo sapiens
taagaatcggtcgcaacagagg

SEQ ID NO: 7235533 - DNA, 22 bp, Homo sapiens
taagaattatctcatggataat

SEQ ID NO: 7235534 - DNA, 22 bp, Homo sapiens
taagaattatctcatggataat

SEQ ID NO: 7235535 - DNA, 22 bp, Homo sapiens
taagaattccatcgcagagtat

SEQ ID NO: 7235536 - DNA, 22 bp, Homo sapiens
taagaattccatcgcagagtat

SEQ ID NO: 7235537 - DNA, 18 bp, Homo sapiens
taagaattgagagtttac

SEQ ID NO: 7235538 - DNA, 18 bp, Homo sapiens
taagaattgagagtttac

SEQ ID NO: 7235539 - DNA, 22 bp, Homo sapiens
taagaattgtgttgaatagagt

SEQ ID NO: 7235540 - DNA, 22 bp, Homo sapiens
taagaattgtgttgaatagagt

SEQ ID NO: 7235541 - DNA, 22 bp, Homo sapiens
taagaattgtgttgaatagagt

SEQ ID NO: 7235542 - DNA, 22 bp, Homo sapiens
taagacaaatactatttcaaga

SEQ ID NO: 7235543 - DNA, 22 bp, Homo sapiens
tcctgctggattgtgtctggtg

SEQ ID NO: 7235544 - DNA, 21 bp, Homo sapiens
tcctggccagggcactaggca

SEQ ID NO: 7235545 - DNA, 22 bp, Homo sapiens
tcctggccaagttactctctgc

SEQ ID NO: 7235546 - DNA, 22 bp, Homo sapiens
tcctggcatttacaaacccacc

SEQ ID NO: 7235547 - DNA, 22 bp, Homo sapiens
tcctggcagttcagccccctaa

SEQ ID NO: 7235548 - DNA, 22 bp, Homo sapiens
tcctggcacccttgggttggag

SEQ ID NO: 7235549 - DNA, 17 bp, Homo sapiens
tcctggcagtcccctgg

SEQ ID NO: 7235550 - DNA, 17 bp, Homo sapiens
tcctggcagtcccctgg

SEQ ID NO: 7235551 - DNA, 22 bp, Homo sapiens
tcctggcagttcagccccctaa

SEQ ID NO: 7235552 - DNA, 22 bp, Homo sapiens
tcctggcataatggctttgctc

SEQ ID NO: 7235553 - DNA, 22 bp, Homo sapiens
tcctggcatccgtgggtctgtg

SEQ ID NO: 7235554 - DNA, 22 bp, Homo sapiens
tcctggcatccgtgggtctgtg

SEQ ID NO: 7235555 - DNA, 22 bp, Homo sapiens
tcctggcatccgtgggtctgtg

SEQ ID NO: 7235556 - DNA, 22 bp, Homo sapiens
tcctggcattgtgcagggtgtg

SEQ ID NO: 7235557 - DNA, 22 bp, Homo sapiens
tcctggcattgtgcagggtgtg

SEQ ID NO: 7235558 - DNA, 22 bp, Homo sapiens
tcctggcattgtgcagggtgtg

SEQ ID NO: 7235559 - DNA, 22 bp, Homo sapiens
tcctggagtttgtggtgatatg

SEQ ID NO: 7235560 - DNA, 22 bp, Homo sapiens
tcctggagtttgtggtgatatg

SEQ ID NO: 7235561 - DNA, 22 bp, Homo sapiens
tcctggagtttgtaaggtgagc

SEQ ID NO: 7235562 - DNA, 22 bp, Homo sapiens
tcctggagtttgtaaggtgagc

SEQ ID NO: 7235563 - DNA, 22 bp, Homo sapiens
tcctggagtttgtaaggtgagc

SEQ ID NO: 7235564 - DNA, 22 bp, Homo sapiens
tcctggagttgtgcagtgcaca

SEQ ID NO: 7235565 - DNA, 22 bp, Homo sapiens
tcctggagttgtgcagtgcaca

SEQ ID NO: 7235566 - DNA, 22 bp, Homo sapiens
tcctggagttgtgcagtgcaca

SEQ ID NO: 7235567 - DNA, 22 bp, Homo sapiens
tcctggagtatttctgtggtgt

SEQ ID NO: 7235568 - DNA, 20 bp, Homo sapiens
tcctggagtctggtttggct

SEQ ID NO: 7235569 - DNA, 20 bp, Homo sapiens
tcctggagtctggtttggct

SEQ ID NO: 7235570 - DNA, 20 bp, Homo sapiens
tcctggagtctggtttggct

SEQ ID NO: 7235571 - DNA, 22 bp, Homo sapiens
tcctggagtggagtctgttgtt

SEQ ID NO: 7235572 - DNA, 22 bp, Homo sapiens
tcctggagtggagtctgttgtt

SEQ ID NO: 7235573 - DNA, 22 bp, Homo sapiens
tcctggagtggagtctgttgtt

SEQ ID NO: 7235574 - DNA, 22 bp, Homo sapiens
tcctggagtgtcttccccaagg

SEQ ID NO: 7235575 - DNA, 22 bp, Homo sapiens
tcctggagtgtcttccccaagg

SEQ ID NO: 7235576 - DNA, 22 bp, Homo sapiens
tcctggagttgtctgtactcat

SEQ ID NO: 7235577 - DNA, 22 bp, Homo sapiens
tcctggagttgtctgtactcat

SEQ ID NO: 7235578 - DNA, 22 bp, Homo sapiens
tcctggagttgtctgtactcat

SEQ ID NO: 7235579 - DNA, 22 bp, Homo sapiens
tcctggagttgtctgtactcat

SEQ ID NO: 7235580 - DNA, 22 bp, Homo sapiens
tcctggatatttgcttaaggtt

SEQ ID NO: 7235581 - DNA, 17 bp, Homo sapiens
tcctggatccatggtgg

SEQ ID NO: 7235582 - DNA, 22 bp, Homo sapiens
tcctggcaaagatgttggtgtt

SEQ ID NO: 7235583 - DNA, 20 bp, Homo sapiens
tcctggcaagccgtacctcc

SEQ ID NO: 7235584 - DNA, 22 bp, Homo sapiens
tcctggcaatggcaggttcagg

SEQ ID NO: 7235585 - DNA, 22 bp, Homo sapiens
tcctggcacaaccctttaccag

SEQ ID NO: 7235586 - DNA, 19 bp, Homo sapiens
tcctggcacagtggaacca

SEQ ID NO: 7235587 - DNA, 22 bp, Homo sapiens
tcctggcacattgcaggggctc

SEQ ID NO: 7235588 - DNA, 22 bp, Homo sapiens
tcctggcctagctcaccctgga

SEQ ID NO: 7235589 - DNA, 22 bp, Homo sapiens
tcctggcctagctcaccctgga

SEQ ID NO: 7235590 - DNA, 22 bp, Homo sapiens
tcctggccctgtggcctgcagt

SEQ ID NO: 7235591 - DNA, 22 bp, Homo sapiens
tcctggccgccgcgtggggccg

SEQ ID NO: 7235592 - DNA, 22 bp, Homo sapiens
tcctggccctgtggcctgcagt

SEQ ID NO: 7235593 - DNA, 22 bp, Homo sapiens
tcctggccctctgcaaacgcca

SEQ ID NO: 7235594 - DNA, 22 bp, Homo sapiens
tcctggcccactcctagcttct

SEQ ID NO: 7235595 - DNA, 17 bp, Homo sapiens
tcctggctctgccactg

SEQ ID NO: 7235596 - DNA, 17 bp, Homo sapiens
tcctggctctgccactg

SEQ ID NO: 7235597 - DNA, 22 bp, Homo sapiens
tcctggctctctacaaaccaga

SEQ ID NO: 7235598 - DNA, 23 bp, Homo sapiens
tcctggctctgcacttgctaatg

SEQ ID NO: 7235599 - DNA, 22 bp, Homo sapiens
tcctggctctctacaaaccaga

SEQ ID NO: 7235600 - DNA, 22 bp, Homo sapiens
tcctggctctctacaaaccaga

SEQ ID NO: 7235601 - DNA, 17 bp, Homo sapiens
tcctggctctgccactg

SEQ ID NO: 7235602 - DNA, 22 bp, Homo sapiens
tcctggctctgctgcctcctag

SEQ ID NO: 7235603 - DNA, 22 bp, Homo sapiens
tcctggctctgctgcctcctag

SEQ ID NO: 7235604 - DNA, 17 bp, Homo sapiens
tcctggctctgccactg

SEQ ID NO: 7235605 - DNA, 22 bp, Homo sapiens
tcctggctctgctgcctcctag

SEQ ID NO: 7235606 - DNA, 22 bp, Homo sapiens
tcctggctctaagtcctgagtg

SEQ ID NO: 7235607 - DNA, 22 bp, Homo sapiens
tcctggctctaagtcctgagtg

SEQ ID NO: 7235608 - DNA, 22 bp, Homo sapiens
tcctggctctaagtcctgagtg

SEQ ID NO: 7235609 - DNA, 22 bp, Homo sapiens
tcctggctcgattgctaccaat

SEQ ID NO: 7235610 - DNA, 22 bp, Homo sapiens
tcctggctcgattgctaccaat

SEQ ID NO: 7235611 - DNA, 22 bp, Homo sapiens
tcctggctcgattgctaccaat

SEQ ID NO: 7235612 - DNA, 22 bp, Homo sapiens
tcctggctcggcttggggactt

SEQ ID NO: 7235613 - DNA, 22 bp, Homo sapiens
tcctggctcggcttggggactt

SEQ ID NO: 7235614 - DNA, 22 bp, Homo sapiens
tcctggctcggcttggggactt

SEQ ID NO: 7235615 - DNA, 22 bp, Homo sapiens
tcctggcctctgagtcaagaac

SEQ ID NO: 7235616 - DNA, 22 bp, Homo sapiens
tcctggctcctggagacctgct

SEQ ID NO: 7235617 - DNA, 22 bp, Homo sapiens
tcctggctcctggagacctgct

SEQ ID NO: 7235618 - DNA, 22 bp, Homo sapiens
tcctggctcctggagacctgct

SEQ ID NO: 7235619 - DNA, 22 bp, Homo sapiens
tcctggctcctggagacctgct

SEQ ID NO: 7235620 - DNA, 22 bp, Homo sapiens
tcctggcctcacagtcctgggt

SEQ ID NO: 7235621 - DNA, 22 bp, Homo sapiens
tcctggcctccgttctctgcat

SEQ ID NO: 7235622 - DNA, 20 bp, Homo sapiens
tcctggcctccctggggctc

SEQ ID NO: 7235623 - DNA, 22 bp, Homo sapiens
tctccccagctgagctgccctt

SEQ ID NO: 7235624 - DNA, 22 bp, Homo sapiens
tctccccagctgagctgccctt

SEQ ID NO: 7235625 - DNA, 22 bp, Homo sapiens
tctccccaaccatggcactcac

SEQ ID NO: 7235626 - DNA, 22 bp, Homo sapiens
tctccccaaaggactcactctc

SEQ ID NO: 7235627 - DNA, 22 bp, Homo sapiens
tctccccaaaggactcactctc

SEQ ID NO: 7235628 - DNA, 22 bp, Homo sapiens
tctcccagtgtctggcagtcag

SEQ ID NO: 7235629 - DNA, 22 bp, Homo sapiens
tctcccagtggtgcagaaagca

SEQ ID NO: 7235630 - DNA, 22 bp, Homo sapiens
tctcccagtgtctggcagtcag

SEQ ID NO: 7235631 - DNA, 22 bp, Homo sapiens
tctcccagtgtctggcagtcag

SEQ ID NO: 7235632 - DNA, 22 bp, Homo sapiens
tctcccagtgtctggcagtcag

SEQ ID NO: 7235633 - DNA, 22 bp, Homo sapiens
tctcccatgaggctgcggtcaa

SEQ ID NO: 7235634 - DNA, 19 bp, Homo sapiens
tctcccatgcctgtgtcta

SEQ ID NO: 7235635 - DNA, 22 bp, Homo sapiens
tctcccattacttatggcccac

SEQ ID NO: 7235636 - DNA, 22 bp, Homo sapiens
tctcccattacttatggcccac

SEQ ID NO: 7235637 - DNA, 22 bp, Homo sapiens
tctccccagtatggattctctg

SEQ ID NO: 7235638 - DNA, 22 bp, Homo sapiens
tctccccaggggtatgggtatt

SEQ ID NO: 7235639 - DNA, 22 bp, Homo sapiens
tctcccctactctaaatctgca

SEQ ID NO: 7235640 - DNA, 22 bp, Homo sapiens
tctcccccagtctctacagcag

SEQ ID NO: 7235641 - DNA, 22 bp, Homo sapiens
tctcccctccctggaccagtgc

SEQ ID NO: 7235642 - DNA, 22 bp, Homo sapiens
tctcctactcactcaaggcttg

SEQ ID NO: 7235643 - DNA, 23 bp, Homo sapiens
tctcctaaaatggcctgcctgca

SEQ ID NO: 7235644 - DNA, 22 bp, Homo sapiens
tctcctaaggctgaatatctct

SEQ ID NO: 7235645 - DNA, 23 bp, Homo sapiens
tctccctcatgcctaggcctggg

SEQ ID NO: 7235646 - DNA, 22 bp, Homo sapiens
tctccctcattcctgcttccat

SEQ ID NO: 7235647 - DNA, 22 bp, Homo sapiens
tctccctcattcctgcttccat

SEQ ID NO: 7235648 - DNA, 23 bp, Homo sapiens
tctccctcatgcctaggcctggg

SEQ ID NO: 7235649 - DNA, 23 bp, Homo sapiens
tctccctcatgcctaggcctggg

SEQ ID NO: 7235650 - DNA, 23 bp, Homo sapiens
tctccctcatgcctaggcctggg

SEQ ID NO: 7235651 - DNA, 23 bp, Homo sapiens
tctccctcatgcctaggcctggg

SEQ ID NO: 7235652 - DNA, 23 bp, Homo sapiens
tctccctcatgcctaggcctggg

SEQ ID NO: 7235653 - DNA, 22 bp, Homo sapiens
tctcccagtggtgcagaaagca

SEQ ID NO: 7235654 - DNA, 22 bp, Homo sapiens
tctcccagtggtgcagaaagca

SEQ ID NO: 7235655 - DNA, 22 bp, Homo sapiens
tctcccagtcctctgtgcttac

SEQ ID NO: 7235656 - DNA, 22 bp, Homo sapiens
tctcccaggtgggtgcctggag

SEQ ID NO: 7235657 - DNA, 22 bp, Homo sapiens
tctcccaggtgggtgcctggag

SEQ ID NO: 7235658 - DNA, 22 bp, Homo sapiens
tctcccaggtgggtgcctggag

SEQ ID NO: 7235659 - DNA, 22 bp, Homo sapiens
tctcccaggtgggtgcctggag

SEQ ID NO: 7235660 - DNA, 22 bp, Homo sapiens
tctcccagtcctctgtgcttac

SEQ ID NO: 7235661 - DNA, 22 bp, Homo sapiens
tctcccagtcctctgtgcttac

SEQ ID NO: 7235662 - DNA, 22 bp, Homo sapiens
tctcccaggtgggtgcctggag

SEQ ID NO: 7235663 - DNA, 22 bp, Homo sapiens
tctcccaggtgggtgcctggag

SEQ ID NO: 7235664 - DNA, 22 bp, Homo sapiens
tctcccaggtgggtgcctggag

SEQ ID NO: 7235665 - DNA, 22 bp, Homo sapiens
tctcccaggtcatacacagaga

SEQ ID NO: 7235666 - DNA, 22 bp, Homo sapiens
tctcccaggtcatacacagaga

SEQ ID NO: 7235667 - DNA, 22 bp, Homo sapiens
tctcccaggctggagtgcagtg

SEQ ID NO: 7235668 - DNA, 22 bp, Homo sapiens
tctcccaggtcatacacagaga

SEQ ID NO: 7235669 - DNA, 22 bp, Homo sapiens
tctcccaggtcatacacagaga

SEQ ID NO: 7235670 - DNA, 22 bp, Homo sapiens
tctcccaggctgccctgtggac

SEQ ID NO: 7235671 - DNA, 22 bp, Homo sapiens
tctcccaggctgccctgtggac

SEQ ID NO: 7235672 - DNA, 22 bp, Homo sapiens
tctcccaggctggagtgcagtg

SEQ ID NO: 7235673 - DNA, 22 bp, Homo sapiens
tctcccaggctggagtgcagtg

SEQ ID NO: 7235674 - DNA, 20 bp, Homo sapiens
tctcccaggctcagggaaga

SEQ ID NO: 7235675 - DNA, 20 bp, Homo sapiens
tctcccaggctcagggaaga

SEQ ID NO: 7235676 - DNA, 22 bp, Homo sapiens
tctcccaggcaggagtgcagtg

SEQ ID NO: 7235677 - DNA, 20 bp, Homo sapiens
tctcccaggctcagggaaga

SEQ ID NO: 7235678 - DNA, 22 bp, Homo sapiens
tctcccagaggatcccagtgga

SEQ ID NO: 7235679 - DNA, 19 bp, Homo sapiens
tctcccagctgagaagggc

SEQ ID NO: 7235680 - DNA, 22 bp, Homo sapiens
tctcccaggcaggagtgcagtg

SEQ ID NO: 7235681 - DNA, 22 bp, Homo sapiens
tctcccaggcaggagtgcagtg

SEQ ID NO: 7235682 - DNA, 22 bp, Homo sapiens
tctcccagaggatcccagtgga

SEQ ID NO: 7235683 - DNA, 22 bp, Homo sapiens
tctcccagaggatcccagtgga

SEQ ID NO: 7235684 - DNA, 22 bp, Homo sapiens
tctcccagaagtcctcagtaca

SEQ ID NO: 7235685 - DNA, 22 bp, Homo sapiens
tctcccagaagtcctcagtaca

SEQ ID NO: 7235686 - DNA, 22 bp, Homo sapiens
tctcccagaagtcctcagtaca

SEQ ID NO: 7235687 - DNA, 22 bp, Homo sapiens
tctcccactgcaagcccaggct

SEQ ID NO: 7235688 - DNA, 22 bp, Homo sapiens
tctcccactgcaagcccaggct

SEQ ID NO: 7235689 - DNA, 22 bp, Homo sapiens
tctcccactgcaagcccaggct

SEQ ID NO: 7235690 - DNA, 21 bp, Homo sapiens
tctccagtatccttctctgag

SEQ ID NO: 7235691 - DNA, 21 bp, Homo sapiens
tctccagtatccttctctgag

SEQ ID NO: 7235692 - DNA, 22 bp, Homo sapiens
tctccaggtggggtcacctttt

SEQ ID NO: 7235693 - DNA, 22 bp, Homo sapiens
tctccaggtggggtcacctttt

SEQ ID NO: 7235694 - DNA, 22 bp, Homo sapiens
tctccaggttcagtcgatggaa

SEQ ID NO: 7235695 - DNA, 22 bp, Homo sapiens
tctccaggttcagtcgatggaa

SEQ ID NO: 7235696 - DNA, 22 bp, Homo sapiens
tctccaggtagatatgtcagga

SEQ ID NO: 7235697 - DNA, 22 bp, Homo sapiens
tctccaggtagatatgtcagga

SEQ ID NO: 7235698 - DNA, 22 bp, Homo sapiens
tctccaggtagatatgtcagga

SEQ ID NO: 7235699 - DNA, 22 bp, Homo sapiens
tctccaggtagatatgtcagga

SEQ ID NO: 7235700 - DNA, 22 bp, Homo sapiens
tctccaggtgaaacttgcaggg

SEQ ID NO: 7235701 - DNA, 22 bp, Homo sapiens
tctccaggtgaaacttgcaggg

SEQ ID NO: 7235702 - DNA, 22 bp, Homo sapiens
tctccaggtgaaacttgcaggg

SEQ ID NO: 7235703 - DNA, 22 bp, Homo sapiens
tctccaggtgaaacttgcaggg

SEQ ID NO: 7235704 - DNA, 22 bp, Homo sapiens
tctccaggtgaaacttgcaggg

SEQ ID NO: 7235705 - DNA, 22 bp, Homo sapiens
tctccaggtgactctgatgtat

SEQ ID NO: 7235706 - DNA, 22 bp, Homo sapiens
tctccaggtgactctgatgtat

SEQ ID NO: 7235707 - DNA, 22 bp, Homo sapiens
tctccaggtgagggtggttaga

SEQ ID NO: 7235708 - DNA, 22 bp, Homo sapiens
tctccaggtgagggtggttaga

SEQ ID NO: 7235709 - DNA, 19 bp, Homo sapiens
tctccaggtgccccaaaca

SEQ ID NO: 7235710 - DNA, 22 bp, Homo sapiens
tctccaggtgctaagtgtgcct

SEQ ID NO: 7235711 - DNA, 22 bp, Homo sapiens
tctccaggtgctaagtgtgcct

SEQ ID NO: 7235712 - DNA, 22 bp, Homo sapiens
tctccaggtgctaagtgtgcct

SEQ ID NO: 7235713 - DNA, 22 bp, Homo sapiens
tctccaggtgctaagtgtgcct

SEQ ID NO: 7235714 - DNA, 23 bp, Homo sapiens
tctccaggccttactccaggcct

SEQ ID NO: 7235715 - DNA, 22 bp, Homo sapiens
tctccaggcctttcccatctta

SEQ ID NO: 7235716 - DNA, 22 bp, Homo sapiens
tctccaggcctttcccatctta

SEQ ID NO: 7235717 - DNA, 22 bp, Homo sapiens
tctccaggcttaatctcagctt

SEQ ID NO: 7235718 - DNA, 22 bp, Homo sapiens
tctccaggcttaatctcagctt

SEQ ID NO: 7235719 - DNA, 22 bp, Homo sapiens
tctccaggcttaatctcagctt

SEQ ID NO: 7235720 - DNA, 22 bp, Homo sapiens
tctccaggcttaatctcagctt

SEQ ID NO: 7235721 - DNA, 22 bp, Homo sapiens
tctccaggcttaatctcagctt

SEQ ID NO: 7235722 - DNA, 22 bp, Homo sapiens
tctccaggctttttgtgaattg

SEQ ID NO: 7235723 - DNA, 22 bp, Homo sapiens
tctccaggctttttgtgaattg

SEQ ID NO: 7235724 - DNA, 22 bp, Homo sapiens
tctccagggacatgtttctgga

SEQ ID NO: 7235725 - DNA, 22 bp, Homo sapiens
tctccagggactgaggctggag

SEQ ID NO: 7235726 - DNA, 22 bp, Homo sapiens
tctccagggactgaggctggag

SEQ ID NO: 7235727 - DNA, 22 bp, Homo sapiens
tctccagggactgaggctggag

SEQ ID NO: 7235728 - DNA, 22 bp, Homo sapiens
tctccagggaggtagcccagtg

SEQ ID NO: 7235729 - DNA, 22 bp, Homo sapiens
tctccagggaggtagcccagtg

SEQ ID NO: 7235730 - DNA, 22 bp, Homo sapiens
tctccagggcagagaatagcaa

SEQ ID NO: 7235731 - DNA, 22 bp, Homo sapiens
tctccagggcccccgagcgttg

SEQ ID NO: 7235732 - DNA, 22 bp, Homo sapiens
tctccagggcccccgagcgttg

SEQ ID NO: 7235733 - DNA, 22 bp, Homo sapiens
tctccaggggcagggtctggag

SEQ ID NO: 7235734 - DNA, 22 bp, Homo sapiens
tctccaggggcagggtctggag

SEQ ID NO: 7235735 - DNA, 22 bp, Homo sapiens
tctccaggggctgctgtgccac

SEQ ID NO: 7235736 - DNA, 22 bp, Homo sapiens
tctccaggggctgctgtgccac

SEQ ID NO: 7235737 - DNA, 22 bp, Homo sapiens
tctccaggggctgctgtgccac

SEQ ID NO: 7235738 - DNA, 22 bp, Homo sapiens
tctccagggtgagctaggccag

SEQ ID NO: 7235739 - DNA, 22 bp, Homo sapiens
tctccaggtaaatggcatcctg

SEQ ID NO: 7235740 - DNA, 22 bp, Homo sapiens
tctccaggtaaatggcatcctg

SEQ ID NO: 7235741 - DNA, 22 bp, Homo sapiens
tctccaggtaaatggcatcctg

SEQ ID NO: 7235742 - DNA, 22 bp, Homo sapiens
tctcgctctgtcgcccaggctg

SEQ ID NO: 7235743 - DNA, 22 bp, Homo sapiens
tctcgctctgtcgcccaggctg

SEQ ID NO: 7235744 - DNA, 22 bp, Homo sapiens
tctcgctctgtcgcccaggctg

SEQ ID NO: 7235745 - DNA, 22 bp, Homo sapiens
tctctagtgaagggctttccaa

SEQ ID NO: 7235746 - DNA, 22 bp, Homo sapiens
tctctagttgaggactgagcag

SEQ ID NO: 7235747 - DNA, 22 bp, Homo sapiens
tctctaaagaagcctccctaaa

SEQ ID NO: 7235748 - DNA, 22 bp, Homo sapiens
tctctaaagatagctgcctcga

SEQ ID NO: 7235749 - DNA, 22 bp, Homo sapiens
tctctaaagatatttatggcaa

SEQ ID NO: 7235750 - DNA, 21 bp, Homo sapiens
tctcgttgtatggtcttgggg

SEQ ID NO: 7235751 - DNA, 22 bp, Homo sapiens
tctcgggctgtgcctctagcca

SEQ ID NO: 7235752 - DNA, 22 bp, Homo sapiens
tctcgtgcaggccttgctcgga

SEQ ID NO: 7235753 - DNA, 21 bp, Homo sapiens
tctctaaaaagattctatttg

SEQ ID NO: 7235754 - DNA, 21 bp, Homo sapiens
tctctaaaaagattctatttg

SEQ ID NO: 7235755 - DNA, 22 bp, Homo sapiens
tctctaaaattcccggccaact

SEQ ID NO: 7235756 - DNA, 22 bp, Homo sapiens
tctctaaacttatatgaactat

SEQ ID NO: 7235757 - DNA, 22 bp, Homo sapiens
tctctaaacttatatgaactat

SEQ ID NO: 7235758 - DNA, 22 bp, Homo sapiens
tctccttcgaggcccagctccc

SEQ ID NO: 7235759 - DNA, 22 bp, Homo sapiens
tctccttgacaggcaggcagac

SEQ ID NO: 7235760 - DNA, 22 bp, Homo sapiens
tctccttcgaggcccagctccc

SEQ ID NO: 7235761 - DNA, 22 bp, Homo sapiens
tctccttcgaggcccagctccc

SEQ ID NO: 7235762 - DNA, 22 bp, Homo sapiens
tctccttgctacccagtatgtc

SEQ ID NO: 7235763 - DNA, 22 bp, Homo sapiens
tctccttgtgctgggtccttcc

SEQ ID NO: 7235764 - DNA, 22 bp, Homo sapiens
tctcctttaagatttcctcagg

SEQ ID NO: 7235765 - DNA, 22 bp, Homo sapiens
tctcctttctggagcctgctca

SEQ ID NO: 7235766 - DNA, 22 bp, Homo sapiens
tctcctttctggagcctgctca

SEQ ID NO: 7235767 - DNA, 22 bp, Homo sapiens
tctcgctctgtcgcccaggctg

SEQ ID NO: 7235768 - DNA, 22 bp, Homo sapiens
tctcgctctgtcgcccaggctg

SEQ ID NO: 7235769 - DNA, 22 bp, Homo sapiens
tctcgctctgtcgcccaggctg

SEQ ID NO: 7235770 - DNA, 22 bp, Homo sapiens
tctcgctctgtcgcccaggctg

SEQ ID NO: 7235771 - DNA, 22 bp, Homo sapiens
tctcgatctcctgaccttgtga

SEQ ID NO: 7235772 - DNA, 20 bp, Homo sapiens
tctcgcactcggagcagccg

SEQ ID NO: 7235773 - DNA, 22 bp, Homo sapiens
tctcctttctggagcctgctca

SEQ ID NO: 7235774 - DNA, 22 bp, Homo sapiens
tctcctttgaaagttaggactg

SEQ ID NO: 7235775 - DNA, 22 bp, Homo sapiens
tctcctgggcttggttgaagtt

SEQ ID NO: 7235776 - DNA, 22 bp, Homo sapiens
tctcctgggtaaaagggttgat

SEQ ID NO: 7235777 - DNA, 22 bp, Homo sapiens
tctcctggccctgtcgccatct

SEQ ID NO: 7235778 - DNA, 22 bp, Homo sapiens
tctcctgggcttggttgaagtt

SEQ ID NO: 7235779 - DNA, 22 bp, Homo sapiens
tctcctgggcttggttgaagtt

SEQ ID NO: 7235780 - DNA, 18 bp, Homo sapiens
tctcctgggtaggggcct

SEQ ID NO: 7235781 - DNA, 22 bp, Homo sapiens
tctcctgggtaaaagggttgat

SEQ ID NO: 7235782 - DNA, 18 bp, Homo sapiens
tctcctgggtaggggcct

SEQ ID NO: 7235783 - DNA, 21 bp, Homo sapiens
tctcctgggtccaacccatgc

SEQ ID NO: 7235784 - DNA, 22 bp, Homo sapiens
tctcctggtacccttcctagca

SEQ ID NO: 7235785 - DNA, 22 bp, Homo sapiens
tctcctggtacccttcctagca

SEQ ID NO: 7235786 - DNA, 22 bp, Homo sapiens
tctcctggtacccttcctagca

SEQ ID NO: 7235787 - DNA, 22 bp, Homo sapiens
tctcctgggtgctttatcagaa

SEQ ID NO: 7235788 - DNA, 22 bp, Homo sapiens
tctcctggtacccttcctagca

SEQ ID NO: 7235789 - DNA, 22 bp, Homo sapiens
tctcctgggtgctttatcagaa

SEQ ID NO: 7235790 - DNA, 22 bp, Homo sapiens
tctcctggtatgtatgcacctg

SEQ ID NO: 7235791 - DNA, 20 bp, Homo sapiens
tctcctggtctggtccgtgc

SEQ ID NO: 7235792 - DNA, 22 bp, Homo sapiens
tctcctggtcacctcagaagtc

SEQ ID NO: 7235793 - DNA, 22 bp, Homo sapiens
tctcctggtcacctcagaagtc

SEQ ID NO: 7235794 - DNA, 20 bp, Homo sapiens
tctcctggtgacagtaccca

SEQ ID NO: 7235795 - DNA, 20 bp, Homo sapiens
tctcctggtgacagtaccca

SEQ ID NO: 7235796 - DNA, 20 bp, Homo sapiens
tctcctggtgacagtaccca

SEQ ID NO: 7235797 - DNA, 22 bp, Homo sapiens
tctcctggtttgttaaataatt

SEQ ID NO: 7235798 - DNA, 22 bp, Homo sapiens
tctccttccaacaaaaggtcac

SEQ ID NO: 7235799 - DNA, 23 bp, Homo sapiens
tctcctgtcctaattaccacccc

SEQ ID NO: 7235800 - DNA, 22 bp, Homo sapiens
tctcctgatgatggtactggca

SEQ ID NO: 7235801 - DNA, 22 bp, Homo sapiens
tctcctctgtgccacagcttgg

SEQ ID NO: 7235802 - DNA, 22 bp, Homo sapiens
tctcctctgtgccacagcttgg

SEQ ID NO: 7235803 - DNA, 22 bp, Homo sapiens
tctcctctgcgcggcagtgccc

SEQ ID NO: 7235804 - DNA, 22 bp, Homo sapiens
tctcctctcttacctggtacaa

SEQ ID NO: 7235805 - DNA, 22 bp, Homo sapiens
tctcctctcctttcatgttgtt

SEQ ID NO: 7235806 - DNA, 22 bp, Homo sapiens
tctcctctcttacctggtacaa

SEQ ID NO: 7235807 - DNA, 22 bp, Homo sapiens
tctcctctcttacctggtacaa

SEQ ID NO: 7235808 - DNA, 22 bp, Homo sapiens
tctcctctcttacctggtacaa

SEQ ID NO: 7235809 - DNA, 22 bp, Homo sapiens
tctcctctgcgcggcagtgccc

SEQ ID NO: 7235810 - DNA, 22 bp, Homo sapiens
tctcctctgcgcggcagtgccc

SEQ ID NO: 7235811 - DNA, 22 bp, Homo sapiens
tctcctctatttctgtatgtat

SEQ ID NO: 7235812 - DNA, 22 bp, Homo sapiens
tctcctctatttctgtatgtat

SEQ ID NO: 7235813 - DNA, 22 bp, Homo sapiens
tctcctctcctttcatgttgtt

SEQ ID NO: 7235814 - DNA, 22 bp, Homo sapiens
tctcctctcctttcatgttgtt

SEQ ID NO: 7235815 - DNA, 22 bp, Homo sapiens
tctcctctactgggtctgcaga

SEQ ID NO: 7235816 - DNA, 22 bp, Homo sapiens
tctcctctatttctgtatgtat

SEQ ID NO: 7235817 - DNA, 22 bp, Homo sapiens
tctcctctactgggtctgcaga

SEQ ID NO: 7235818 - DNA, 22 bp, Homo sapiens
tctcctactcactcaaggcttg

SEQ ID NO: 7235819 - DNA, 22 bp, Homo sapiens
tctcctactcactcaaggcttg

SEQ ID NO: 7235820 - DNA, 22 bp, Homo sapiens
tctcctaggctggagtgcagtg

SEQ ID NO: 7235821 - DNA, 22 bp, Homo sapiens
tctcctcaccaccagcagcaga

SEQ ID NO: 7235822 - DNA, 22 bp, Homo sapiens
tctcctcccaggctcttccagg

SEQ ID NO: 7235823 - DNA, 22 bp, Homo sapiens
tctcctcccaggctcttccagg

SEQ ID NO: 7235824 - DNA, 21 bp, Homo sapiens
tctcctcccggggagaggccg

SEQ ID NO: 7235825 - DNA, 21 bp, Homo sapiens
tctcctcccggggagaggccg

SEQ ID NO: 7235826 - DNA, 23 bp, Homo sapiens
tctcctcctagatacagtcatgg

SEQ ID NO: 7235827 - DNA, 23 bp, Homo sapiens
tctcctcctagatacagtcatgg

SEQ ID NO: 7235828 - DNA, 23 bp, Homo sapiens
tctcctcctagatacagtcatgg

SEQ ID NO: 7235829 - DNA, 23 bp, Homo sapiens
tctcctcctagatacagtcatgg

SEQ ID NO: 7235830 - DNA, 22 bp, Homo sapiens
tctcctctactgggtctgcaga

SEQ ID NO: 7235831 - DNA, 22 bp, Homo sapiens
tctcctctactgggtctgcaga

SEQ ID NO: 7235832 - DNA, 22 bp, Homo sapiens
tctcctctactgggtctgcaga

SEQ ID NO: 7235833 - DNA, 22 bp, Homo sapiens
tctcctctactgggtctgcaga

SEQ ID NO: 7235834 - DNA, 22 bp, Homo sapiens
tctcctctactgggtctgcaga

SEQ ID NO: 7235835 - DNA, 22 bp, Homo sapiens
tctcctctactgggtctgcaga

SEQ ID NO: 7235836 - DNA, 22 bp, Homo sapiens
tctcctggaagaataccacact

SEQ ID NO: 7235837 - DNA, 22 bp, Homo sapiens
tctcctggaagaataccacact

SEQ ID NO: 7235838 - DNA, 22 bp, Homo sapiens
tctcctggaagtgattcccctg

SEQ ID NO: 7235839 - DNA, 22 bp, Homo sapiens
tctcctggaagtgattcccctg

SEQ ID NO: 7235840 - DNA, 22 bp, Homo sapiens
tctcctgcttcaactgatggac

SEQ ID NO: 7235841 - DNA, 22 bp, Homo sapiens
tctcctgcttcaactgatggac

SEQ ID NO: 7235842 - DNA, 22 bp, Homo sapiens
tctcctgcttcaactgatggac

SEQ ID NO: 7235843 - DNA, 22 bp, Homo sapiens
tctcctgctcccaactgctgca

SEQ ID NO: 7235844 - DNA, 22 bp, Homo sapiens
tctcctgctcccaactgctgca

SEQ ID NO: 7235845 - DNA, 22 bp, Homo sapiens
tctcctgctcagaacagcctca

SEQ ID NO: 7235846 - DNA, 22 bp, Homo sapiens
tctcctgccactgcttcccatt

SEQ ID NO: 7235847 - DNA, 22 bp, Homo sapiens
tctcctgccactgcttcccatt

SEQ ID NO: 7235848 - DNA, 22 bp, Homo sapiens
tctcctgctcagaacagcctca

SEQ ID NO: 7235849 - DNA, 22 bp, Homo sapiens
tctcctgctcagaacagcctca

SEQ ID NO: 7235850 - DNA, 22 bp, Homo sapiens
tctcctgccactgcttcccatt

SEQ ID NO: 7235851 - DNA, 22 bp, Homo sapiens
tctcctggagcaggaaggtggg

SEQ ID NO: 7235852 - DNA, 22 bp, Homo sapiens
tctcctggagcaggaaggtggg

SEQ ID NO: 7235853 - DNA, 22 bp, Homo sapiens
tctcctggagcaggaaggtggg

SEQ ID NO: 7235854 - DNA, 22 bp, Homo sapiens
tctcctggagcaggaaggtggg

SEQ ID NO: 7235855 - DNA, 22 bp, Homo sapiens
tctcctggatagatactatcca

SEQ ID NO: 7235856 - DNA, 22 bp, Homo sapiens
tctcctggatagatactatcca

SEQ ID NO: 7235857 - DNA, 22 bp, Homo sapiens
tctcctggatagatactatcca

SEQ ID NO: 7235858 - DNA, 22 bp, Homo sapiens
tctcctggagcccagatgctgg

SEQ ID NO: 7235859 - DNA, 22 bp, Homo sapiens
tctcctggcatgtgggtcatct

SEQ ID NO: 7235860 - DNA, 22 bp, Homo sapiens
tctcctggccctgtcgccatct

SEQ ID NO: 7235861 - DNA, 22 bp, Homo sapiens
tctcctggcatttggttgagta

SEQ ID NO: 7235862 - DNA, 22 bp, Homo sapiens
tctcctggcatttggttgagta

SEQ ID NO: 7235863 - DNA, 22 bp, Homo sapiens
tctcctggcatgtgggtcatct

SEQ ID NO: 7235864 - DNA, 22 bp, Homo sapiens
tctcctggatggaccttctctt

SEQ ID NO: 7235865 - DNA, 22 bp, Homo sapiens
tctcagagcatcattttcttag

SEQ ID NO: 7235866 - DNA, 22 bp, Homo sapiens
tctcagagattttgtttccctt

SEQ ID NO: 7235867 - DNA, 23 bp, Homo sapiens
tctcagaggattcctgggccttg

SEQ ID NO: 7235868 - DNA, 22 bp, Homo sapiens
tctcagagagctgtgttttcct

SEQ ID NO: 7235869 - DNA, 22 bp, Homo sapiens
tctcagaaggcaagggctgggg

SEQ ID NO: 7235870 - DNA, 22 bp, Homo sapiens
tctcagagagatgaaacttcca

SEQ ID NO: 7235871 - DNA, 22 bp, Homo sapiens
tctcagagaggggccgggcctt

SEQ ID NO: 7235872 - DNA, 22 bp, Homo sapiens
tctcagaaggcaagggctgggg

SEQ ID NO: 7235873 - DNA, 22 bp, Homo sapiens
tctcagaactttatatgtatca

SEQ ID NO: 7235874 - DNA, 22 bp, Homo sapiens
tctcagaacacccttctatggt

SEQ ID NO: 7235875 - DNA, 22 bp, Homo sapiens
tctcagaaatactatgttgtca

SEQ ID NO: 7235876 - DNA, 22 bp, Homo sapiens
tctcagaaatactatgttgtca

SEQ ID NO: 7235877 - DNA, 23 bp, Homo sapiens
tctcagaaaggagaagtaatttg

SEQ ID NO: 7235878 - DNA, 22 bp, Homo sapiens
tctcagaaaaaggagaaactgg

SEQ ID NO: 7235879 - DNA, 22 bp, Homo sapiens
tctcagaaaagagcttcagaaa

SEQ ID NO: 7235880 - DNA, 22 bp, Homo sapiens
tctcactttccagacttttcaa

SEQ ID NO: 7235881 - DNA, 22 bp, Homo sapiens
tctcactttgttgcccagactt

SEQ ID NO: 7235882 - DNA, 21 bp, Homo sapiens
tctcactgtctgctttgttta

SEQ ID NO: 7235883 - DNA, 22 bp, Homo sapiens
tctcactgggtcacagcagagg

SEQ ID NO: 7235884 - DNA, 22 bp, Homo sapiens
tctcactgggtataaatgagta

SEQ ID NO: 7235885 - DNA, 22 bp, Homo sapiens
tctcactgggtataaatgagta

SEQ ID NO: 7235886 - DNA, 22 bp, Homo sapiens
tctcactgcaaatattatgtat

SEQ ID NO: 7235887 - DNA, 22 bp, Homo sapiens
tctcactgatttgagaccaagg

SEQ ID NO: 7235888 - DNA, 22 bp, Homo sapiens
tctcactgatttgagaccaagg

SEQ ID NO: 7235889 - DNA, 22 bp, Homo sapiens
tctcactcatttcctaggtctt

SEQ ID NO: 7235890 - DNA, 22 bp, Homo sapiens
tctcacagtgagcctgaggtcg

SEQ ID NO: 7235891 - DNA, 22 bp, Homo sapiens
tctcacagtgagcctgaggtcg

SEQ ID NO: 7235892 - DNA, 22 bp, Homo sapiens
tctcacaggtgcacgtggctgt

SEQ ID NO: 7235893 - DNA, 22 bp, Homo sapiens
tctcacagttgtccactgaaaa

SEQ ID NO: 7235894 - DNA, 22 bp, Homo sapiens
tctcacagttgtcccttgtgag

SEQ ID NO: 7235895 - DNA, 19 bp, Homo sapiens
tctcacatcagctcctagc

SEQ ID NO: 7235896 - DNA, 22 bp, Homo sapiens
tctcacatctgccctgtgctgg

SEQ ID NO: 7235897 - DNA, 22 bp, Homo sapiens
tctcaccaaagccttgaccata

SEQ ID NO: 7235898 - DNA, 22 bp, Homo sapiens
tctcaccatcttgaatccctta

SEQ ID NO: 7235899 - DNA, 22 bp, Homo sapiens
tctcaccatggtgcttgcttat

SEQ ID NO: 7235900 - DNA, 22 bp, Homo sapiens
tctcaccatggtgcttgcttat

SEQ ID NO: 7235901 - DNA, 22 bp, Homo sapiens
tctcacccaacgtgcaatgagt

SEQ ID NO: 7235902 - DNA, 22 bp, Homo sapiens
tctcaccccgttttctgtgtga

SEQ ID NO: 7235903 - DNA, 22 bp, Homo sapiens
tctcactcatttcctaggtctt

SEQ ID NO: 7235904 - DNA, 22 bp, Homo sapiens
tctcactcatttcctaggtctt

SEQ ID NO: 7235905 - DNA, 22 bp, Homo sapiens
tctcagagttcctctggagtcc

SEQ ID NO: 7235906 - DNA, 22 bp, Homo sapiens
tctcagagttcctctggagtcc

SEQ ID NO: 7235907 - DNA, 22 bp, Homo sapiens
tctcagagtggtggtccctctg

SEQ ID NO: 7235908 - DNA, 22 bp, Homo sapiens
tctcagaggtcttcagcctctg

SEQ ID NO: 7235909 - DNA, 22 bp, Homo sapiens
tctcagaggtcttcagcctctg

SEQ ID NO: 7235910 - DNA, 22 bp, Homo sapiens
tctcagaggtgccctggcatct

SEQ ID NO: 7235911 - DNA, 22 bp, Homo sapiens
tctcagagggaaacatgagtga

SEQ ID NO: 7235912 - DNA, 22 bp, Homo sapiens
tctcagagggaaacatgagtga

SEQ ID NO: 7235913 - DNA, 22 bp, Homo sapiens
tctcagagggaaacatgagtga

SEQ ID NO: 7235914 - DNA, 22 bp, Homo sapiens
tctcagaggcccgacgttctcc

SEQ ID NO: 7235915 - DNA, 22 bp, Homo sapiens
tctcagagtttagagctgagcc

SEQ ID NO: 7235916 - DNA, 22 bp, Homo sapiens
tctcagagtttagagctgagcc

SEQ ID NO: 7235917 - DNA, 20 bp, Homo sapiens
tctcagcataagaacccttc

SEQ ID NO: 7235918 - DNA, 22 bp, Homo sapiens
tctcagcagggccatcctgagc

SEQ ID NO: 7235919 - DNA, 22 bp, Homo sapiens
tctcagcagccagatccagagc

SEQ ID NO: 7235920 - DNA, 22 bp, Homo sapiens
tctcagcagccagatccagagc

SEQ ID NO: 7235921 - DNA, 22 bp, Homo sapiens
tctcagcagggccatcctgagc

SEQ ID NO: 7235922 - DNA, 22 bp, Homo sapiens
tctcagatgcccttgcatcacc

SEQ ID NO: 7235923 - DNA, 23 bp, Homo sapiens
tctcagattcagagatccctaaa

SEQ ID NO: 7235924 - DNA, 22 bp, Homo sapiens
tctcagcaacgatccggagtaa

SEQ ID NO: 7235925 - DNA, 22 bp, Homo sapiens
tctcagcaaggaaagaggcagg

SEQ ID NO: 7235926 - DNA, 22 bp, Homo sapiens
tctcagcaaggaaagaggcagg

SEQ ID NO: 7235927 - DNA, 22 bp, Homo sapiens
tctcagcacgttgttttcattg

SEQ ID NO: 7235928 - DNA, 22 bp, Homo sapiens
tctcagcacgttgttttcattg

SEQ ID NO: 7235929 - DNA, 21 bp, Homo sapiens
tctcaggcgagaattctttta

SEQ ID NO: 7235930 - DNA, 21 bp, Homo sapiens
tctcaggcgagaattctttta

SEQ ID NO: 7235931 - DNA, 22 bp, Homo sapiens
tctcaggcccctgagtttctct

SEQ ID NO: 7235932 - DNA, 22 bp, Homo sapiens
tctcaggcccctgagtttctct

SEQ ID NO: 7235933 - DNA, 20 bp, Homo sapiens
tctcaggccccctccttgct

SEQ ID NO: 7235934 - DNA, 20 bp, Homo sapiens
tctcaggccccctccttgct

SEQ ID NO: 7235935 - DNA, 22 bp, Homo sapiens
tctcaggctaccttgcacaagg

SEQ ID NO: 7235936 - DNA, 22 bp, Homo sapiens
tctcaggctaccttgcacaagg

SEQ ID NO: 7235937 - DNA, 22 bp, Homo sapiens
tctcaggctagtaaaagatggg

SEQ ID NO: 7235938 - DNA, 22 bp, Homo sapiens
tctcaggctagtaaaagatggg

SEQ ID NO: 7235939 - DNA, 22 bp, Homo sapiens
tctcaggctcctgacatatatg

SEQ ID NO: 7235940 - DNA, 22 bp, Homo sapiens
tctcaggctcttggaacctgtt

SEQ ID NO: 7235941 - DNA, 22 bp, Homo sapiens
tctcagctgcctgccctgctcc

SEQ ID NO: 7235942 - DNA, 22 bp, Homo sapiens
tctcagctgactgctttcctcg

SEQ ID NO: 7235943 - DNA, 22 bp, Homo sapiens
tctcagctgcctgccctgctcc

SEQ ID NO: 7235944 - DNA, 18 bp, Homo sapiens
tctcagcccagctccggc

SEQ ID NO: 7235945 - DNA, 22 bp, Homo sapiens
tctcagctcagcttccacagag

SEQ ID NO: 7235946 - DNA, 22 bp, Homo sapiens
tctcagctcagcttccacagag

SEQ ID NO: 7235947 - DNA, 22 bp, Homo sapiens
tctcagctcatggcagccttga

SEQ ID NO: 7235948 - DNA, 22 bp, Homo sapiens
tctcagggcctccctctgtttc

SEQ ID NO: 7235949 - DNA, 22 bp, Homo sapiens
tctcagggcctccctctgtttc

SEQ ID NO: 7235950 - DNA, 22 bp, Homo sapiens
tctcagggccccaaaggctagt

SEQ ID NO: 7235951 - DNA, 22 bp, Homo sapiens
tctcagggcagcaaggaagcat

SEQ ID NO: 7235952 - DNA, 18 bp, Homo sapiens
tctcagggcatacccaga

SEQ ID NO: 7235953 - DNA, 22 bp, Homo sapiens
tctcagggccccaaaggctagt

SEQ ID NO: 7235954 - DNA, 22 bp, Homo sapiens
tctcagggaggttccccgttct

SEQ ID NO: 7235955 - DNA, 22 bp, Homo sapiens
tctcagggaggttccccgttct

SEQ ID NO: 7235956 - DNA, 22 bp, Homo sapiens
tctcagggagttgaggctgcct

SEQ ID NO: 7235957 - DNA, 22 bp, Homo sapiens
tctcagggagttgaggctgcct

SEQ ID NO: 7235958 - DNA, 22 bp, Homo sapiens
tctcagggatgggaggccccag

SEQ ID NO: 7235959 - DNA, 22 bp, Homo sapiens
tctcagggcaattctcagcgac

SEQ ID NO: 7235960 - DNA, 22 bp, Homo sapiens
tctcagggcaattctcagcgac

SEQ ID NO: 7235961 - DNA, 22 bp, Homo sapiens
tctcagggagcccagtacttac

SEQ ID NO: 7235962 - DNA, 22 bp, Homo sapiens
tctcagggagggcgagtcagcg

SEQ ID NO: 7235963 - DNA, 22 bp, Homo sapiens
tctcaggcttcctggtgctgtg

SEQ ID NO: 7235964 - DNA, 22 bp, Homo sapiens
tctcagggaccatgatgatgac

SEQ ID NO: 7235965 - DNA, 22 bp, Homo sapiens
tctcagggagagctgctggcat

SEQ ID NO: 7235966 - DNA, 22 bp, Homo sapiens
tctcagggagagctgctggcat

SEQ ID NO: 7235967 - DNA, 22 bp, Homo sapiens
tctcaggctcttggaacctgtt

SEQ ID NO: 7235968 - DNA, 22 bp, Homo sapiens
tctcaggctgacattgggactc

SEQ ID NO: 7235969 - DNA, 19 bp, Homo sapiens
tctcaggctgggcggctgc

SEQ ID NO: 7235970 - DNA, 19 bp, Homo sapiens
tctcaggctgggcggctgc

SEQ ID NO: 7235971 - DNA, 22 bp, Homo sapiens
tctcaggctgtgtgtggaggac

SEQ ID NO: 7235972 - DNA, 22 bp, Homo sapiens
tctcaggctgtgtgtggaggac

SEQ ID NO: 7235973 - DNA, 22 bp, Homo sapiens
tctcaggcttcctggtgctgtg

SEQ ID NO: 7235974 - DNA, 19 bp, Homo sapiens
tctccaggcaggtgagcga

SEQ ID NO: 7235975 - DNA, 19 bp, Homo sapiens
tctccaggcaggtgagcga

SEQ ID NO: 7235976 - DNA, 22 bp, Homo sapiens
tctccaggcacttggctgctac

SEQ ID NO: 7235977 - DNA, 22 bp, Homo sapiens
tctccaggcccactgatttata

SEQ ID NO: 7235978 - DNA, 23 bp, Homo sapiens
tctccaggccttactccaggcct

SEQ ID NO: 7235979 - DNA, 23 bp, Homo sapiens
tctccaggccttactccaggcct

SEQ ID NO: 7235980 - DNA, 23 bp, Homo sapiens
tctccaggccttactccaggcct

SEQ ID NO: 7235981 - DNA, 23 bp, Homo sapiens
tctccaggccttactccaggcct

SEQ ID NO: 7235982 - DNA, 22 bp, Homo sapiens
tctccaggagaaatatgaagga

SEQ ID NO: 7235983 - DNA, 22 bp, Homo sapiens
tctccaggagcaagtcacccag

SEQ ID NO: 7235984 - DNA, 22 bp, Homo sapiens
tctccaggagcaagtcacccag

SEQ ID NO: 7235985 - DNA, 22 bp, Homo sapiens
tctccaggagcaagtcacccag

SEQ ID NO: 7235986 - DNA, 22 bp, Homo sapiens
tctccaggagcaagtcacccag

SEQ ID NO: 7235987 - DNA, 22 bp, Homo sapiens
tctccaggcactacctgggtaa

SEQ ID NO: 7235988 - DNA, 22 bp, Homo sapiens
tctccaggcactacctgggtaa

SEQ ID NO: 7235989 - DNA, 22 bp, Homo sapiens
tctccaggcactacctgggtaa

SEQ ID NO: 7235990 - DNA, 22 bp, Homo sapiens
tctccaggcacttggctgctac

SEQ ID NO: 7235991 - DNA, 22 bp, Homo sapiens
tctccaggcacttggctgctac

SEQ ID NO: 7235992 - DNA, 22 bp, Homo sapiens
tctccacaagctttctcctttt

SEQ ID NO: 7235993 - DNA, 22 bp, Homo sapiens
tctccacaagctgatgctagga

SEQ ID NO: 7235994 - DNA, 22 bp, Homo sapiens
tctccaggaagccctccctgac

SEQ ID NO: 7235995 - DNA, 22 bp, Homo sapiens
tctccaggaagccctccctgac

SEQ ID NO: 7235996 - DNA, 22 bp, Homo sapiens
tctccaaggccctactctattt

SEQ ID NO: 7235997 - DNA, 22 bp, Homo sapiens
tctccacaagctgatgctagga

SEQ ID NO: 7235998 - DNA, 22 bp, Homo sapiens
tctccaagaaaagatctcagct

SEQ ID NO: 7235999 - DNA, 17 bp, Homo sapiens
tctccaggacgagctca

SEQ ID NO: 7236000 - DNA, 17 bp, Homo sapiens
tctccaggacgagctca

SEQ ID NO: 7236001 - DNA, 17 bp, Homo sapiens
tctccaggacgagctca

SEQ ID NO: 7236002 - DNA, 22 bp, Homo sapiens
tctccaggactgagctccagcc

SEQ ID NO: 7236003 - DNA, 22 bp, Homo sapiens
tctccaggactgagctccagcc

SEQ ID NO: 7236004 - DNA, 22 bp, Homo sapiens
tctccaggactgagctccagcc

SEQ ID NO: 7236005 - DNA, 22 bp, Homo sapiens
tctccaggactgagctccagcc

SEQ ID NO: 7236006 - DNA, 22 bp, Homo sapiens
tctccaggagaaatatgaagga

SEQ ID NO: 7236007 - DNA, 22 bp, Homo sapiens
tctcattattgtattcttagtt

SEQ ID NO: 7236008 - DNA, 20 bp, Homo sapiens
tctcattatatccaagaggc

SEQ ID NO: 7236009 - DNA, 22 bp, Homo sapiens
tctcatgttttacctgtcctca

SEQ ID NO: 7236010 - DNA, 22 bp, Homo sapiens
tctcattaaaacattttaatta

SEQ ID NO: 7236011 - DNA, 22 bp, Homo sapiens
tctcatggtttgtgattcaaat

SEQ ID NO: 7236012 - DNA, 22 bp, Homo sapiens
tctcattgtccaattgaattta

SEQ ID NO: 7236013 - DNA, 17 bp, Homo sapiens
tctcattgttggttcag

SEQ ID NO: 7236014 - DNA, 22 bp, Homo sapiens
tctcatttacttccacaggctg

SEQ ID NO: 7236015 - DNA, 23 bp, Homo sapiens
tctcatttcccttgatctatctt

SEQ ID NO: 7236016 - DNA, 22 bp, Homo sapiens
tctcattcataccctacatgct

SEQ ID NO: 7236017 - DNA, 22 bp, Homo sapiens
tctcattcataccctacatgct

SEQ ID NO: 7236018 - DNA, 23 bp, Homo sapiens
tctcatttcccttgatctatctt

SEQ ID NO: 7236019 - DNA, 23 bp, Homo sapiens
tctcatttcccttgatctatctt

SEQ ID NO: 7236020 - DNA, 23 bp, Homo sapiens
tctcatttcccttgatctatctt

SEQ ID NO: 7236021 - DNA, 22 bp, Homo sapiens
tctcatttgcctcatctataaa

SEQ ID NO: 7236022 - DNA, 22 bp, Homo sapiens
tctcatttgcctcatctataaa

SEQ ID NO: 7236023 - DNA, 22 bp, Homo sapiens
tctcatttgcctcatctataaa

SEQ ID NO: 7236024 - DNA, 22 bp, Homo sapiens
tctcatttgcctcatctataaa

SEQ ID NO: 7236025 - DNA, 22 bp, Homo sapiens
tctcatttgcctcatctataaa

SEQ ID NO: 7236026 - DNA, 22 bp, Homo sapiens
tctcatttgcctcatctataaa

SEQ ID NO: 7236027 - DNA, 22 bp, Homo sapiens
tctcatttggctttgttttaaa

SEQ ID NO: 7236028 - DNA, 22 bp, Homo sapiens
tctcatttggctttgttttaaa

SEQ ID NO: 7236029 - DNA, 22 bp, Homo sapiens
tctcatttggctttgttttaaa

SEQ ID NO: 7236030 - DNA, 22 bp, Homo sapiens
tctcatttgtgtgcaattcaga

SEQ ID NO: 7236031 - DNA, 22 bp, Homo sapiens
tctcatttgtgtgcaattcaga

SEQ ID NO: 7236032 - DNA, 22 bp, Homo sapiens
tctcatttgtgtgcaattcaga

SEQ ID NO: 7236033 - DNA, 22 bp, Homo sapiens
tctcatttgtgtgcaattcaga

SEQ ID NO: 7236034 - DNA, 22 bp, Homo sapiens
tctcattttgagtcagacacta

SEQ ID NO: 7236035 - DNA, 22 bp, Homo sapiens
tctcattttgagtcagacacta

SEQ ID NO: 7236036 - DNA, 19 bp, Homo sapiens
tctccaaaaccaatcacta

SEQ ID NO: 7236037 - DNA, 19 bp, Homo sapiens
tctccaaaaccaatcacta

SEQ ID NO: 7236038 - DNA, 19 bp, Homo sapiens
tctccaaaaccaatcacta

SEQ ID NO: 7236039 - DNA, 22 bp, Homo sapiens
tctccaaactcagactaagtat

SEQ ID NO: 7236040 - DNA, 22 bp, Homo sapiens
tctccaaatagttatatttaga

SEQ ID NO: 7236041 - DNA, 22 bp, Homo sapiens
tctccaaatcaatcaatatgaa

SEQ ID NO: 7236042 - DNA, 22 bp, Homo sapiens
tctccaaatcaatcaatatgaa

SEQ ID NO: 7236043 - DNA, 22 bp, Homo sapiens
tctcagtctttttggttactca

SEQ ID NO: 7236044 - DNA, 23 bp, Homo sapiens
tctcagtgaatctcagaattcgc

SEQ ID NO: 7236045 - DNA, 17 bp, Homo sapiens
tctcagtgactgatagc

SEQ ID NO: 7236046 - DNA, 19 bp, Homo sapiens
tctcagtatattcctgcct

SEQ ID NO: 7236047 - DNA, 22 bp, Homo sapiens
tctcagtaagtggcactctgtc

SEQ ID NO: 7236048 - DNA, 22 bp, Homo sapiens
tctcagtaattaatgttatgga

SEQ ID NO: 7236049 - DNA, 19 bp, Homo sapiens
tctcagtagactgtatgtt

SEQ ID NO: 7236050 - DNA, 22 bp, Homo sapiens
tctcagtatgcttgattggatt

SEQ ID NO: 7236051 - DNA, 22 bp, Homo sapiens
tctcagtatgcttgattggatt

SEQ ID NO: 7236052 - DNA, 22 bp, Homo sapiens
tctcagtgactgctgggtcccc

SEQ ID NO: 7236053 - DNA, 22 bp, Homo sapiens
tctcagtgatggcccatttgga

SEQ ID NO: 7236054 - DNA, 23 bp, Homo sapiens
tctcagtgcacgcaccatgcctg

SEQ ID NO: 7236055 - DNA, 22 bp, Homo sapiens
tctcagtgcagcaaggaattta

SEQ ID NO: 7236056 - DNA, 22 bp, Homo sapiens
tctcagtgcagcttgacagaga

SEQ ID NO: 7236057 - DNA, 22 bp, Homo sapiens
tctcagtgcagcttgacagaga

SEQ ID NO: 7236058 - DNA, 22 bp, Homo sapiens
tctcagggtttgtacaagtgta

SEQ ID NO: 7236059 - DNA, 22 bp, Homo sapiens
tctcagggtttgtacaagtgta

SEQ ID NO: 7236060 - DNA, 22 bp, Homo sapiens
tctcaggtaaaagggtatctac

SEQ ID NO: 7236061 - DNA, 22 bp, Homo sapiens
tctcaggtctcatgccaggcct

SEQ ID NO: 7236062 - DNA, 22 bp, Homo sapiens
tctcaggtggcccccatgagtg

SEQ ID NO: 7236063 - DNA, 22 bp, Homo sapiens
tctcagggggacttaatttact

SEQ ID NO: 7236064 - DNA, 20 bp, Homo sapiens
tctcagggtcttagatggaa

SEQ ID NO: 7236065 - DNA, 22 bp, Homo sapiens
tctcagggtgaggaaagaattt

SEQ ID NO: 7236066 - DNA, 23 bp, Homo sapiens
tctcagggtggctgggcccatcc

SEQ ID NO: 7236067 - DNA, 20 bp, Homo sapiens
tctcagggttcagcaaagta

SEQ ID NO: 7236068 - DNA, 22 bp, Homo sapiens
tctcagggttctgtgttataat

SEQ ID NO: 7236069 - DNA, 22 bp, Homo sapiens
tctcagggttctgtgttataat

SEQ ID NO: 7236070 - DNA, 22 bp, Homo sapiens
tctcagggtttcctgggggctg

SEQ ID NO: 7236071 - DNA, 22 bp, Homo sapiens
tctcagggcgcagtgaggcagt

SEQ ID NO: 7236072 - DNA, 22 bp, Homo sapiens
tctcagggctcagagctcaggc

SEQ ID NO: 7236073 - DNA, 22 bp, Homo sapiens
tctcagggctcagagctcaggc

SEQ ID NO: 7236074 - DNA, 22 bp, Homo sapiens
tctcagggctcagagctcaggc

SEQ ID NO: 7236075 - DNA, 22 bp, Homo sapiens
tctcagggcttttcttttgaat

SEQ ID NO: 7236076 - DNA, 22 bp, Homo sapiens
tctcaggggattcactggcacc

SEQ ID NO: 7236077 - DNA, 22 bp, Homo sapiens
tctcaggggcagtgatcctaag

SEQ ID NO: 7236078 - DNA, 22 bp, Homo sapiens
tctcaggggcctggagtcctgg

SEQ ID NO: 7236079 - DNA, 17 bp, Homo sapiens
tctcaggggctagccct

SEQ ID NO: 7236080 - DNA, 17 bp, Homo sapiens
tctcaggggctagccct

SEQ ID NO: 7236081 - DNA, 22 bp, Homo sapiens
tctcagggggacttaatttact

SEQ ID NO: 7236082 - DNA, 20 bp, Homo sapiens
tctcagggtcttagatggaa

SEQ ID NO: 7236083 - DNA, 22 bp, Homo sapiens
tctcatctccattatagcatca

SEQ ID NO: 7236084 - DNA, 22 bp, Homo sapiens
tctcatctcaaattgtaatccc

SEQ ID NO: 7236085 - DNA, 22 bp, Homo sapiens
tctcatctagactctgcccttg

SEQ ID NO: 7236086 - DNA, 22 bp, Homo sapiens
tctcatcattccttcaaagccc

SEQ ID NO: 7236087 - DNA, 22 bp, Homo sapiens
tctcatcagcccaaacatgaca

SEQ ID NO: 7236088 - DNA, 22 bp, Homo sapiens
tctcatacatgtttgcagaaag

SEQ ID NO: 7236089 - DNA, 22 bp, Homo sapiens
tctcatacgtttccaggtgtca

SEQ ID NO: 7236090 - DNA, 22 bp, Homo sapiens
tctcataaactcagttttctca

SEQ ID NO: 7236091 - DNA, 22 bp, Homo sapiens
tctcataaggtcagatttcaca

SEQ ID NO: 7236092 - DNA, 22 bp, Homo sapiens
tctcataaggtcagatttcaca

SEQ ID NO: 7236093 - DNA, 22 bp, Homo sapiens
tctcataaggtcagatttcaca

SEQ ID NO: 7236094 - DNA, 22 bp, Homo sapiens
tctcagtggacgtgtctgtctt

SEQ ID NO: 7236095 - DNA, 22 bp, Homo sapiens
tctcatcttcatatctgaaaga

SEQ ID NO: 7236096 - DNA, 22 bp, Homo sapiens
tctcatcttcattgtctcccat

SEQ ID NO: 7236097 - DNA, 22 bp, Homo sapiens
tctcatctgcgagctctgccag

SEQ ID NO: 7236098 - DNA, 22 bp, Homo sapiens
tctcatctgcgagctctgccag

SEQ ID NO: 7236099 - DNA, 22 bp, Homo sapiens
tctcatctttaaatgaaaattt

SEQ ID NO: 7236100 - DNA, 22 bp, Homo sapiens
tctcatcttgttcatctaccct

SEQ ID NO: 7236101 - DNA, 22 bp, Homo sapiens
tctcatggagtcaggagcagaa

SEQ ID NO: 7236102 - DNA, 22 bp, Homo sapiens
tctcatgccctgtttttggttg

SEQ ID NO: 7236103 - DNA, 22 bp, Homo sapiens
tctcatgccctgtttttggttg

SEQ ID NO: 7236104 - DNA, 22 bp, Homo sapiens
tctcatgccctgtttttggttg

SEQ ID NO: 7236105 - DNA, 22 bp, Homo sapiens
tctcatgctgaagtattttctc

SEQ ID NO: 7236106 - DNA, 22 bp, Homo sapiens
tctcatgctgtagtgcactaac

SEQ ID NO: 7236107 - DNA, 22 bp, Homo sapiens
tctcatgctgtagtgcactaac

SEQ ID NO: 7236108 - DNA, 22 bp, Homo sapiens
tctctgaagctcaattgagata

SEQ ID NO: 7236109 - DNA, 22 bp, Homo sapiens
tctctgaagctcaattgagata

SEQ ID NO: 7236110 - DNA, 22 bp, Homo sapiens
tctctcttttttgaacccgctc

SEQ ID NO: 7236111 - DNA, 22 bp, Homo sapiens
tctctgaaagcagctgctcatc

SEQ ID NO: 7236112 - DNA, 22 bp, Homo sapiens
tctctctttttaatcatgtaat

SEQ ID NO: 7236113 - DNA, 22 bp, Homo sapiens
tctctctttttaatcatgtaat

SEQ ID NO: 7236114 - DNA, 22 bp, Homo sapiens
tctctctttttaatcatgtaat

SEQ ID NO: 7236115 - DNA, 22 bp, Homo sapiens
tctctcttttttgaacccgctc

SEQ ID NO: 7236116 - DNA, 22 bp, Homo sapiens
tctctctttttaatcatgtaat

SEQ ID NO: 7236117 - DNA, 22 bp, Homo sapiens
tctctctttttaatcatgtaat

SEQ ID NO: 7236118 - DNA, 23 bp, Homo sapiens
tctctctggcaaatttcacatat

SEQ ID NO: 7236119 - DNA, 22 bp, Homo sapiens
tctctctggagctggggcatga

SEQ ID NO: 7236120 - DNA, 22 bp, Homo sapiens
tctctctgccaactcacagcca

SEQ ID NO: 7236121 - DNA, 22 bp, Homo sapiens
tctctctgccaactcacagcca

SEQ ID NO: 7236122 - DNA, 22 bp, Homo sapiens
tctctctgccaactcacagcca

SEQ ID NO: 7236123 - DNA, 22 bp, Homo sapiens
tctctgacagtgaaagagttca

SEQ ID NO: 7236124 - DNA, 22 bp, Homo sapiens
tctctgacatgcctaagacttt

SEQ ID NO: 7236125 - DNA, 22 bp, Homo sapiens
tctctgaattctgatgcaagtg

SEQ ID NO: 7236126 - DNA, 22 bp, Homo sapiens
tctctgaagctgttgtagtctc

SEQ ID NO: 7236127 - DNA, 22 bp, Homo sapiens
tctctgaaggggagctgtttaa

SEQ ID NO: 7236128 - DNA, 22 bp, Homo sapiens
tctctgagaagttcctttgtga

SEQ ID NO: 7236129 - DNA, 22 bp, Homo sapiens
tctctgacttgatgcaatggcc

SEQ ID NO: 7236130 - DNA, 22 bp, Homo sapiens
tctctgagaagctgaggctggg

SEQ ID NO: 7236131 - DNA, 22 bp, Homo sapiens
tctctgagaagttcctttgtga

SEQ ID NO: 7236132 - DNA, 22 bp, Homo sapiens
tctctgagaatatcccataaga

SEQ ID NO: 7236133 - DNA, 18 bp, Homo sapiens
tctctgagaatattaatg

SEQ ID NO: 7236134 - DNA, 20 bp, Homo sapiens
tctctgacttctccccgcct

SEQ ID NO: 7236135 - DNA, 22 bp, Homo sapiens
tctctgactggcctttcacctg

SEQ ID NO: 7236136 - DNA, 22 bp, Homo sapiens
tctctgactggcctttcacctg

SEQ ID NO: 7236137 - DNA, 22 bp, Homo sapiens
tctctgactaggtctgattttc

SEQ ID NO: 7236138 - DNA, 22 bp, Homo sapiens
tctctgactcatatttgtgcct

SEQ ID NO: 7236139 - DNA, 22 bp, Homo sapiens
tctctgactcatatttgtgcct

SEQ ID NO: 7236140 - DNA, 22 bp, Homo sapiens
tctctgacatgcctaagacttt

SEQ ID NO: 7236141 - DNA, 22 bp, Homo sapiens
tctctgaccaagagaattggta

SEQ ID NO: 7236142 - DNA, 22 bp, Homo sapiens
tctctgaccaagagaattggta

SEQ ID NO: 7236143 - DNA, 22 bp, Homo sapiens
tctctgaccactgagggattta

SEQ ID NO: 7236144 - DNA, 21 bp, Homo sapiens
tctctgacccaggaagagggc

SEQ ID NO: 7236145 - DNA, 22 bp, Homo sapiens
tctctgagttctcctccagccc

SEQ ID NO: 7236146 - DNA, 22 bp, Homo sapiens
tctctgagtcaccgtggagacg

SEQ ID NO: 7236147 - DNA, 22 bp, Homo sapiens
tctctgagtaagtgacagttca

SEQ ID NO: 7236148 - DNA, 22 bp, Homo sapiens
tctctgagtatcctgaactgcc

SEQ ID NO: 7236149 - DNA, 22 bp, Homo sapiens
tctctgaggttgtttccagcac

SEQ ID NO: 7236150 - DNA, 22 bp, Homo sapiens
tctctgagtaagtgacagttca

SEQ ID NO: 7236151 - DNA, 22 bp, Homo sapiens
tctctgagggagatggcctgcc

SEQ ID NO: 7236152 - DNA, 20 bp, Homo sapiens
tctctgagcttctcttgggg

SEQ ID NO: 7236153 - DNA, 22 bp, Homo sapiens
tctctgaggaagaggctgtaat

SEQ ID NO: 7236154 - DNA, 20 bp, Homo sapiens
tctctgagcttctcttgggg

SEQ ID NO: 7236155 - DNA, 22 bp, Homo sapiens
tctctgagctgcttcttgcata

SEQ ID NO: 7236156 - DNA, 22 bp, Homo sapiens
tctctgagctcaggagctgcag

SEQ ID NO: 7236157 - DNA, 22 bp, Homo sapiens
tctctgagcgcattcctccggc

SEQ ID NO: 7236158 - DNA, 22 bp, Homo sapiens
tctctgagcgcattcctccggc

SEQ ID NO: 7236159 - DNA, 22 bp, Homo sapiens
tctctgagcccagtgtccccct

SEQ ID NO: 7236160 - DNA, 22 bp, Homo sapiens
tctctgagcccagtgtccccct

SEQ ID NO: 7236161 - DNA, 21 bp, Homo sapiens
tctctgagcccaccaggatct

SEQ ID NO: 7236162 - DNA, 22 bp, Homo sapiens
tctctgagcccaatgtagcaat

SEQ ID NO: 7236163 - DNA, 23 bp, Homo sapiens
tctctgagccatagcagtcccaa

SEQ ID NO: 7236164 - DNA, 22 bp, Homo sapiens
tctctgagacagtagcctctgc

SEQ ID NO: 7236165 - DNA, 21 bp, Homo sapiens
tctctgagacactctggagcc

SEQ ID NO: 7236166 - DNA, 21 bp, Homo sapiens
tctctgagacactctggagcc

SEQ ID NO: 7236167 - DNA, 22 bp, Homo sapiens
tctctgagacagtagcctctgc

SEQ ID NO: 7236168 - DNA, 22 bp, Homo sapiens
tctctgagatcagccactgact

SEQ ID NO: 7236169 - DNA, 22 bp, Homo sapiens
tctctgagatcagccactgact

SEQ ID NO: 7236170 - DNA, 22 bp, Homo sapiens
tctctgagcatgccatattgct

SEQ ID NO: 7236171 - DNA, 22 bp, Homo sapiens
tctctgagcacctaagatatat

SEQ ID NO: 7236172 - DNA, 22 bp, Homo sapiens
tctctccaacatggtggtgctg

SEQ ID NO: 7236173 - DNA, 18 bp, Homo sapiens
tctctccatctatttgtt

SEQ ID NO: 7236174 - DNA, 22 bp, Homo sapiens
tctctcataagatgagtactta

SEQ ID NO: 7236175 - DNA, 22 bp, Homo sapiens
tctctccaacatggtggtgctg

SEQ ID NO: 7236176 - DNA, 22 bp, Homo sapiens
tctctccaacatggtggtgctg

SEQ ID NO: 7236177 - DNA, 22 bp, Homo sapiens
tctctcagggggaaggctgaag

SEQ ID NO: 7236178 - DNA, 22 bp, Homo sapiens
tctctcagtcagatgctaaaga

SEQ ID NO: 7236179 - DNA, 22 bp, Homo sapiens
tctctcatagagaaaaatatat

SEQ ID NO: 7236180 - DNA, 22 bp, Homo sapiens
tctctcatagagaaaaatatat

SEQ ID NO: 7236181 - DNA, 22 bp, Homo sapiens
tctctcagggggaaggctgaag

SEQ ID NO: 7236182 - DNA, 22 bp, Homo sapiens
tctctcaggctggagtgcagtg

SEQ ID NO: 7236183 - DNA, 22 bp, Homo sapiens
tctctcaggctggagtgcagtg

SEQ ID NO: 7236184 - DNA, 22 bp, Homo sapiens
tctctcagatggggcactagta

SEQ ID NO: 7236185 - DNA, 22 bp, Homo sapiens
tctctcagaactgcagctgcag

SEQ ID NO: 7236186 - DNA, 22 bp, Homo sapiens
tctctcactggtgcctctgttg

SEQ ID NO: 7236187 - DNA, 22 bp, Homo sapiens
tctctcagaaagcccatgtctg

SEQ ID NO: 7236188 - DNA, 22 bp, Homo sapiens
tctctcagaaagcccatgtctg

SEQ ID NO: 7236189 - DNA, 22 bp, Homo sapiens
tctctatttgcctaggcttgtg

SEQ ID NO: 7236190 - DNA, 20 bp, Homo sapiens
tctctatgaagtcaacagga

SEQ ID NO: 7236191 - DNA, 22 bp, Homo sapiens
tctctattaattgacaatggct

SEQ ID NO: 7236192 - DNA, 22 bp, Homo sapiens
tctctatattatatgtagtttg

SEQ ID NO: 7236193 - DNA, 22 bp, Homo sapiens
tctctcaacctcggcactattg

SEQ ID NO: 7236194 - DNA, 22 bp, Homo sapiens
tctctcaagcactatccaccca

SEQ ID NO: 7236195 - DNA, 22 bp, Homo sapiens
tctctcaagcactatccaccca

SEQ ID NO: 7236196 - DNA, 19 bp, Homo sapiens
tctctcaattgcttcaatt

SEQ ID NO: 7236197 - DNA, 19 bp, Homo sapiens
tctctcaattgcttcaatt

SEQ ID NO: 7236198 - DNA, 22 bp, Homo sapiens
tctctcaccctggaaaagccaa

SEQ ID NO: 7236199 - DNA, 20 bp, Homo sapiens
tctctcacgggttggtttct

SEQ ID NO: 7236200 - DNA, 22 bp, Homo sapiens
tctctcactggtgcctctgttg

SEQ ID NO: 7236201 - DNA, 22 bp, Homo sapiens
tctctcactggtgcctctgttg

SEQ ID NO: 7236202 - DNA, 22 bp, Homo sapiens
tctctcctaatttcaggtgctt

SEQ ID NO: 7236203 - DNA, 22 bp, Homo sapiens
tctctcctaatttcaggtgctt

SEQ ID NO: 7236204 - DNA, 22 bp, Homo sapiens
tctctcctaatttcaggtgctt

SEQ ID NO: 7236205 - DNA, 22 bp, Homo sapiens
tctctccctttccttatcagtt

SEQ ID NO: 7236206 - DNA, 22 bp, Homo sapiens
tctctcccctggccgctacgcg

SEQ ID NO: 7236207 - DNA, 22 bp, Homo sapiens
tctctccctttccttatcagtt

SEQ ID NO: 7236208 - DNA, 22 bp, Homo sapiens
tctctccctttccttatcagtt

SEQ ID NO: 7236209 - DNA, 22 bp, Homo sapiens
tctctccctttccttatcagtt

SEQ ID NO: 7236210 - DNA, 18 bp, Homo sapiens
tctctccatctatttgtt

SEQ ID NO: 7236211 - DNA, 22 bp, Homo sapiens
tctctcccaaatctgcagatag

SEQ ID NO: 7236212 - DNA, 22 bp, Homo sapiens
tctctcccaaatctgcagatag

SEQ ID NO: 7236213 - DNA, 22 bp, Homo sapiens
tctctcccctggccgctacgcg

SEQ ID NO: 7236214 - DNA, 22 bp, Homo sapiens
tctctcctctagtcagggtggt

SEQ ID NO: 7236215 - DNA, 22 bp, Homo sapiens
tctctcctctagtcagggtggt

SEQ ID NO: 7236216 - DNA, 22 bp, Homo sapiens
tctctcctccacaccgggtgct

SEQ ID NO: 7236217 - DNA, 22 bp, Homo sapiens
tctctcctccacaccgggtgct

SEQ ID NO: 7236218 - DNA, 21 bp, Homo sapiens
tctctcctcaagctcgacccc

SEQ ID NO: 7236219 - DNA, 21 bp, Homo sapiens
tctctcctcaagctcgacccc

SEQ ID NO: 7236220 - DNA, 22 bp, Homo sapiens
tctctcctaatttcaggtgctt

SEQ ID NO: 7236221 - DNA, 21 bp, Homo sapiens
tctctcctcaagctcgacccc

SEQ ID NO: 7236222 - DNA, 21 bp, Homo sapiens
tctctcctcaagctcgacccc

SEQ ID NO: 7236223 - DNA, 22 bp, Homo sapiens
tctctcctgtgttctgatgttt

SEQ ID NO: 7236224 - DNA, 22 bp, Homo sapiens
tctctcctgtgttctgatgttt

SEQ ID NO: 7236225 - DNA, 22 bp, Homo sapiens
tctctcctgcactgaattatgt

SEQ ID NO: 7236226 - DNA, 22 bp, Homo sapiens
tctctctcagccattacagaac

SEQ ID NO: 7236227 - DNA, 22 bp, Homo sapiens
tctctctaggcatctattttca

SEQ ID NO: 7236228 - DNA, 22 bp, Homo sapiens
tctctctaggcatctattttca

SEQ ID NO: 7236229 - DNA, 22 bp, Homo sapiens
tctctctatatgtcaacagggg

SEQ ID NO: 7236230 - DNA, 22 bp, Homo sapiens
tctctctatatgtcaacagggg

SEQ ID NO: 7236231 - DNA, 22 bp, Homo sapiens
tctctctatttatttgtcttgt

SEQ ID NO: 7236232 - DNA, 22 bp, Homo sapiens
tctctctcagccattacagaac

SEQ ID NO: 7236233 - DNA, 22 bp, Homo sapiens
tctctctcagccattacagaac

SEQ ID NO: 7236234 - DNA, 22 bp, Homo sapiens
tctctccttatcattgtgttta

SEQ ID NO: 7236235 - DNA, 22 bp, Homo sapiens
tctctccttatcattgtgttta

SEQ ID NO: 7236236 - DNA, 22 bp, Homo sapiens
tctctctactggggcactagga

SEQ ID NO: 7236237 - DNA, 22 bp, Homo sapiens
tctctcctgtgttctgatgttt

SEQ ID NO: 7236238 - DNA, 22 bp, Homo sapiens
tctctctgagttgagcaggagt

SEQ ID NO: 7236239 - DNA, 22 bp, Homo sapiens
tctctctgagttgagcaggagt

SEQ ID NO: 7236240 - DNA, 22 bp, Homo sapiens
tctctctgagccctgctttttc

SEQ ID NO: 7236241 - DNA, 22 bp, Homo sapiens
tctctctgagttgagcaggagt

SEQ ID NO: 7236242 - DNA, 22 bp, Homo sapiens
tctctctcctagtttttagtgg

SEQ ID NO: 7236243 - DNA, 19 bp, Homo sapiens
tctctgcttctcttggcat

SEQ ID NO: 7236244 - DNA, 16 bp, Homo sapiens
tctctgcttcataggt

SEQ ID NO: 7236245 - DNA, 20 bp, Homo sapiens
tctctgctgtccacatttgc

SEQ ID NO: 7236246 - DNA, 22 bp, Homo sapiens
tctctgctctgtgcctcagttt

SEQ ID NO: 7236247 - DNA, 22 bp, Homo sapiens
tctctgctctgtgcctcagttt

SEQ ID NO: 7236248 - DNA, 22 bp, Homo sapiens
tctctgctcaggcaccagccct

SEQ ID NO: 7236249 - DNA, 22 bp, Homo sapiens
tctctgagttctcctccagccc

SEQ ID NO: 7236250 - DNA, 22 bp, Homo sapiens
tctctggagctgcagatccagg

SEQ ID NO: 7236251 - DNA, 22 bp, Homo sapiens
tctctggagctgcagatccagg

SEQ ID NO: 7236252 - DNA, 22 bp, Homo sapiens
tctctggacttccacctctatt

SEQ ID NO: 7236253 - DNA, 22 bp, Homo sapiens
tctctggagctgcagatccagg

SEQ ID NO: 7236254 - DNA, 22 bp, Homo sapiens
tctctggaattggctgaggcaa

SEQ ID NO: 7236255 - DNA, 22 bp, Homo sapiens
tctctggaattttgagagtgac

SEQ ID NO: 7236256 - DNA, 22 bp, Homo sapiens
tctctggactcgagcttactca

SEQ ID NO: 7236257 - DNA, 22 bp, Homo sapiens
tctctggagctgcagatccagg

SEQ ID NO: 7236258 - DNA, 22 bp, Homo sapiens
tctctggagggctccaggcggg

SEQ ID NO: 7236259 - DNA, 22 bp, Homo sapiens
tctctggagggctccaggcggg

SEQ ID NO: 7236260 - DNA, 22 bp, Homo sapiens
tctctggagtataaccagggat

SEQ ID NO: 7236261 - DNA, 22 bp, Homo sapiens
tctctggagtataaccagggat

SEQ ID NO: 7236262 - DNA, 22 bp, Homo sapiens
tctctggagtataaccagggat

SEQ ID NO: 7236263 - DNA, 22 bp, Homo sapiens
tctctggagtataaccagggat

SEQ ID NO: 7236264 - DNA, 23 bp, Homo sapiens
tctctggaactggagagtacggt

SEQ ID NO: 7236265 - DNA, 23 bp, Homo sapiens
tctctggaactggagagtacggt

SEQ ID NO: 7236266 - DNA, 22 bp, Homo sapiens
tctctgcttggtgtatgtgagt

SEQ ID NO: 7236267 - DNA, 22 bp, Homo sapiens
tctctggaattggctgaggcaa

SEQ ID NO: 7236268 - DNA, 22 bp, Homo sapiens
tctctggaattggctgaggcaa

SEQ ID NO: 7236269 - DNA, 21 bp, Homo sapiens
tctctggaattagaccatgtt

SEQ ID NO: 7236270 - DNA, 22 bp, Homo sapiens
tctctggaagcgcagatctgtt

SEQ ID NO: 7236271 - DNA, 21 bp, Homo sapiens
tctctggaattagaccatgtt

SEQ ID NO: 7236272 - DNA, 21 bp, Homo sapiens
tctctggaattagaccatgtt

SEQ ID NO: 7236273 - DNA, 22 bp, Homo sapiens
tctctggctgatattcctctgc

SEQ ID NO: 7236274 - DNA, 22 bp, Homo sapiens
tctctggctggcaccccaggga

SEQ ID NO: 7236275 - DNA, 22 bp, Homo sapiens
tctctggctggcaccccaggga

SEQ ID NO: 7236276 - DNA, 22 bp, Homo sapiens
tctctggctggcaccccaggga

SEQ ID NO: 7236277 - DNA, 22 bp, Homo sapiens
tctctggctcctgccgggtcca

SEQ ID NO: 7236278 - DNA, 22 bp, Homo sapiens
tctctggctgatattcctctgc

SEQ ID NO: 7236279 - DNA, 22 bp, Homo sapiens
tctctggccctgttttctatct

SEQ ID NO: 7236280 - DNA, 23 bp, Homo sapiens
tctctggcctttgatcaggttga

SEQ ID NO: 7236281 - DNA, 22 bp, Homo sapiens
tctctggccccatggctgagct

SEQ ID NO: 7236282 - DNA, 22 bp, Homo sapiens
tctctggccccatggctgagct

SEQ ID NO: 7236283 - DNA, 22 bp, Homo sapiens
tctctggccccatggctgagct

SEQ ID NO: 7236284 - DNA, 22 bp, Homo sapiens
tctctggccccatggctgagct

SEQ ID NO: 7236285 - DNA, 19 bp, Homo sapiens
tctctggcatagactcaat

SEQ ID NO: 7236286 - DNA, 19 bp, Homo sapiens
tctctggcatagactcaat

SEQ ID NO: 7236287 - DNA, 19 bp, Homo sapiens
tctctggcatagactcaat

SEQ ID NO: 7236288 - DNA, 22 bp, Homo sapiens
tctctggcagacacctccctga

SEQ ID NO: 7236289 - DNA, 22 bp, Homo sapiens
tctctggcacataataaggtct

SEQ ID NO: 7236290 - DNA, 21 bp, Homo sapiens
tctctggagttagcagagaga

SEQ ID NO: 7236291 - DNA, 21 bp, Homo sapiens
tctctggagttagcagagaga

SEQ ID NO: 7236292 - DNA, 19 bp, Homo sapiens
tctctggatgacagacact

SEQ ID NO: 7236293 - DNA, 19 bp, Homo sapiens
tctctggatgacagacact

SEQ ID NO: 7236294 - DNA, 20 bp, Homo sapiens
tctctggcaagaagctgcag

SEQ ID NO: 7236295 - DNA, 22 bp, Homo sapiens
tctctggcagggatatctggct

SEQ ID NO: 7236296 - DNA, 19 bp, Homo sapiens
tctctggcagttcagagca

SEQ ID NO: 7236297 - DNA, 22 bp, Homo sapiens
tctctggcagaggccctatccc

SEQ ID NO: 7236298 - DNA, 22 bp, Homo sapiens
tctctggcagaggccctatccc

SEQ ID NO: 7236299 - DNA, 22 bp, Homo sapiens
tctctggcagacacctccctga

SEQ ID NO: 7236300 - DNA, 22 bp, Homo sapiens
tctctggcagactggctgggct

SEQ ID NO: 7236301 - DNA, 22 bp, Homo sapiens
tctctgggatcgttttgggctc

SEQ ID NO: 7236302 - DNA, 22 bp, Homo sapiens
tctctgggatcgttttgggctc

SEQ ID NO: 7236303 - DNA, 22 bp, Homo sapiens
tctctgggatcaggtggcccag

SEQ ID NO: 7236304 - DNA, 22 bp, Homo sapiens
tctctgggatcaggtggcccag

SEQ ID NO: 7236305 - DNA, 19 bp, Homo sapiens
tctctggcttgtctgcctg

SEQ ID NO: 7236306 - DNA, 19 bp, Homo sapiens
tctctggcttgtctgcctg

SEQ ID NO: 7236307 - DNA, 22 bp, Homo sapiens
tctctgggaaatggagaatttt

SEQ ID NO: 7236308 - DNA, 22 bp, Homo sapiens
tctctggctggcaccccaggga

SEQ ID NO: 7236309 - DNA, 22 bp, Homo sapiens
tctctggctggcaccccaggga

SEQ ID NO: 7236310 - DNA, 19 bp, Homo sapiens
tctctggcttgtctgcctg

SEQ ID NO: 7236311 - DNA, 21 bp, Homo sapiens
tctctgggccctcctgtgggg

SEQ ID NO: 7236312 - DNA, 21 bp, Homo sapiens
tctctgggccctcctgtgggg

SEQ ID NO: 7236313 - DNA, 22 bp, Homo sapiens
tctctgggcccagaccttcctt

SEQ ID NO: 7236314 - DNA, 22 bp, Homo sapiens
tctctgggcccagaccttcctt

SEQ ID NO: 7236315 - DNA, 22 bp, Homo sapiens
tctctgggcccagaccttcctt

SEQ ID NO: 7236316 - DNA, 22 bp, Homo sapiens
tctctgggcctcagttttctca

SEQ ID NO: 7236317 - DNA, 21 bp, Homo sapiens
tctctgggccctcctgtgggg

SEQ ID NO: 7236318 - DNA, 21 bp, Homo sapiens
tctctgggccctcctgtgggg

SEQ ID NO: 7236319 - DNA, 21 bp, Homo sapiens
tctctgggccctcctgtgggg

SEQ ID NO: 7236320 - DNA, 21 bp, Homo sapiens
tctctgggccctcctgtgggg

SEQ ID NO: 7236321 - DNA, 22 bp, Homo sapiens
tctctgggctaaaatcaaggtg

SEQ ID NO: 7236322 - DNA, 22 bp, Homo sapiens
tctctgggctaaaatcaaggtg

SEQ ID NO: 7236323 - DNA, 22 bp, Homo sapiens
tctctgggctcaggagcccggc

SEQ ID NO: 7236324 - DNA, 22 bp, Homo sapiens
tctctgggctcaggagcccggc

SEQ ID NO: 7236325 - DNA, 22 bp, Homo sapiens
tctctgggcctccctttccaag

SEQ ID NO: 7236326 - DNA, 22 bp, Homo sapiens
tctctgggcctccctttccaag

SEQ ID NO: 7236327 - DNA, 22 bp, Homo sapiens
tctctgggcctgttttctcatc

SEQ ID NO: 7236328 - DNA, 22 bp, Homo sapiens
tctctgggcctgttttctcatc

SEQ ID NO: 7236329 - DNA, 19 bp, Homo sapiens
tctctggggacactttcac

SEQ ID NO: 7236330 - DNA, 22 bp, Homo sapiens
tctctggggatgcttattcttg

SEQ ID NO: 7236331 - DNA, 22 bp, Homo sapiens
tctctggggaaaaggctgatac

SEQ ID NO: 7236332 - DNA, 19 bp, Homo sapiens
tctctggggacactttcac

SEQ ID NO: 7236333 - DNA, 19 bp, Homo sapiens
tctctggggacactttcac

SEQ ID NO: 7236334 - DNA, 22 bp, Homo sapiens
tctctggggatggacctgggag

SEQ ID NO: 7236335 - DNA, 22 bp, Homo sapiens
tctctggggatggacctgggag

SEQ ID NO: 7236336 - DNA, 22 bp, Homo sapiens
tctctggggcctttctacatca

SEQ ID NO: 7236337 - DNA, 22 bp, Homo sapiens
tctctggggtagggcccaggac

SEQ ID NO: 7236338 - DNA, 22 bp, Homo sapiens
tctctggggtagggcccaggac

SEQ ID NO: 7236339 - DNA, 22 bp, Homo sapiens
tctctgggggtagaactcaggc

SEQ ID NO: 7236340 - DNA, 22 bp, Homo sapiens
tctctgggggtagaactcaggc

SEQ ID NO: 7236341 - DNA, 22 bp, Homo sapiens
tctctgggtcctggcaagctca

SEQ ID NO: 7236342 - DNA, 22 bp, Homo sapiens
tctctgggtcctggcaagctca

SEQ ID NO: 7236343 - DNA, 22 bp, Homo sapiens
tctctgggtatggtaacgttgg

SEQ ID NO: 7236344 - DNA, 22 bp, Homo sapiens
tctctgggtattcactgccttc

SEQ ID NO: 7236345 - DNA, 22 bp, Homo sapiens
tctctgggtattcactgccttc

SEQ ID NO: 7236346 - DNA, 22 bp, Homo sapiens
tctctgggtaaagttctctcat

SEQ ID NO: 7236347 - DNA, 22 bp, Homo sapiens
tctctgggtaaagttctctcat

SEQ ID NO: 7236348 - DNA, 22 bp, Homo sapiens
tctctggggtagggcccaggac

SEQ ID NO: 7236349 - DNA, 22 bp, Homo sapiens
tctctggggtagggcccaggac

SEQ ID NO: 7236350 - DNA, 22 bp, Homo sapiens
tctctgggttctcactcagcac

SEQ ID NO: 7236351 - DNA, 22 bp, Homo sapiens
tctctgggttctcactcagcac

SEQ ID NO: 7236352 - DNA, 20 bp, Homo sapiens
tctctgggttctcactcagc

SEQ ID NO: 7236353 - DNA, 20 bp, Homo sapiens
tctctgggttctcactcagc

SEQ ID NO: 7236354 - DNA, 20 bp, Homo sapiens
tctctgggttctcactcagc

SEQ ID NO: 7236355 - DNA, 22 bp, Homo sapiens
tctctgggttgagaactaggac

SEQ ID NO: 7236356 - DNA, 22 bp, Homo sapiens
tctctgggttgagaactaggac

SEQ ID NO: 7236357 - DNA, 16 bp, Homo sapiens
tctctgggttgcacag

SEQ ID NO: 7236358 - DNA, 16 bp, Homo sapiens
tctctgggttgcacag

SEQ ID NO: 7236359 - DNA, 23 bp, Homo sapiens
tctctgggtgggctgtgtctata

SEQ ID NO: 7236360 - DNA, 22 bp, Homo sapiens
tctctgggtgatggcagggcac

SEQ ID NO: 7236361 - DNA, 22 bp, Homo sapiens
tctctgggtcctggcaagctca

SEQ ID NO: 7236362 - DNA, 22 bp, Homo sapiens
tctctgggtctcagtttgtaca

SEQ ID NO: 7236363 - DNA, 22 bp, Homo sapiens
tctctgggtctcagtttgtaca

SEQ ID NO: 7236364 - DNA, 22 bp, Homo sapiens
tctctgggtgatggcagggcac

SEQ ID NO: 7236365 - DNA, 22 bp, Homo sapiens
tctctgggtgatggcagggcac

SEQ ID NO: 7236366 - DNA, 22 bp, Homo sapiens
tctgaagattaccagctaaatg

SEQ ID NO: 7236367 - DNA, 22 bp, Homo sapiens
tctgaagattctttccactatt

SEQ ID NO: 7236368 - DNA, 22 bp, Homo sapiens
tctgaagagtcttgcaagaaag

SEQ ID NO: 7236369 - DNA, 22 bp, Homo sapiens
tctgaagagtcttgcaagaaag

SEQ ID NO: 7236370 - DNA, 22 bp, Homo sapiens
tctgaagattaccagctaaatg

SEQ ID NO: 7236371 - DNA, 22 bp, Homo sapiens
tctgaagagtcttgcaagaaag

SEQ ID NO: 7236372 - DNA, 22 bp, Homo sapiens
tctgaagagtcatctttgggtg

SEQ ID NO: 7236373 - DNA, 22 bp, Homo sapiens
tctgaagagaatgctgctgaac

SEQ ID NO: 7236374 - DNA, 22 bp, Homo sapiens
tctgaagagaatgctgctgaac

SEQ ID NO: 7236375 - DNA, 22 bp, Homo sapiens
tctgaagacatatgatatggtg

SEQ ID NO: 7236376 - DNA, 19 bp, Homo sapiens
tctgaagaattagagagca

SEQ ID NO: 7236377 - DNA, 22 bp, Homo sapiens
tctgaaggtgctagagaaagct

SEQ ID NO: 7236378 - DNA, 22 bp, Homo sapiens
tctgaaggtgctagagaaagct

SEQ ID NO: 7236379 - DNA, 22 bp, Homo sapiens
tctgaaggtgctagagaaagct

SEQ ID NO: 7236380 - DNA, 22 bp, Homo sapiens
tctgaaggtctgagaaccagga

SEQ ID NO: 7236381 - DNA, 22 bp, Homo sapiens
tctgaaggtctgagaaccagga

SEQ ID NO: 7236382 - DNA, 22 bp, Homo sapiens
tctgaaggtctgagaaccagga

SEQ ID NO: 7236383 - DNA, 22 bp, Homo sapiens
tctgaagggctgagtggaggag

SEQ ID NO: 7236384 - DNA, 17 bp, Homo sapiens
tctgaagccagtctgct

SEQ ID NO: 7236385 - DNA, 22 bp, Homo sapiens
tctgaagctggaggaagctttg

SEQ ID NO: 7236386 - DNA, 22 bp, Homo sapiens
tctgaaggcatcctcactgcaa

SEQ ID NO: 7236387 - DNA, 21 bp, Homo sapiens
tctgaaggcattttccaaggt

SEQ ID NO: 7236388 - DNA, 22 bp, Homo sapiens
tctgaaggcctggagggtccca

SEQ ID NO: 7236389 - DNA, 22 bp, Homo sapiens
tctgaagaataggatgttgtgt

SEQ ID NO: 7236390 - DNA, 22 bp, Homo sapiens
tctgaagaactgtctagagaac

SEQ ID NO: 7236391 - DNA, 22 bp, Homo sapiens
tctgaagaactgtctagagaac

SEQ ID NO: 7236392 - DNA, 22 bp, Homo sapiens
tctgaagaaatacagctggggt

SEQ ID NO: 7236393 - DNA, 22 bp, Homo sapiens
tctgaactccagccctgctctc

SEQ ID NO: 7236394 - DNA, 22 bp, Homo sapiens
tctgaagaaatacagctggggt

SEQ ID NO: 7236395 - DNA, 20 bp, Homo sapiens
tctgaagaaagacagggact

SEQ ID NO: 7236396 - DNA, 22 bp, Homo sapiens
tctgaacagaaaagatgcacaa

SEQ ID NO: 7236397 - DNA, 22 bp, Homo sapiens
tctgaacagaaaagatgcacaa

SEQ ID NO: 7236398 - DNA, 22 bp, Homo sapiens
tctgaacatcctacaacatttt

SEQ ID NO: 7236399 - DNA, 22 bp, Homo sapiens
tctgaaattccttccagacttt

SEQ ID NO: 7236400 - DNA, 22 bp, Homo sapiens
tctgaaatgttctcttgttttg

SEQ ID NO: 7236401 - DNA, 22 bp, Homo sapiens
tctgaaatgcaggcaatttgct

SEQ ID NO: 7236402 - DNA, 22 bp, Homo sapiens
tctgaaataggaaagcaaatgg

SEQ ID NO: 7236403 - DNA, 22 bp, Homo sapiens
tctgaaatagaagtgtctttct

SEQ ID NO: 7236404 - DNA, 22 bp, Homo sapiens
tctgaaatagaagtgtctttct

SEQ ID NO: 7236405 - DNA, 22 bp, Homo sapiens
tctgaaagatgagtggtccatt

SEQ ID NO: 7236406 - DNA, 22 bp, Homo sapiens
tctgaaagccctagtttgtaat

SEQ ID NO: 7236407 - DNA, 18 bp, Homo sapiens
tctgaaagcaccggtgaa

SEQ ID NO: 7236408 - DNA, 22 bp, Homo sapiens
tctgaaagcattacagtttatt

SEQ ID NO: 7236409 - DNA, 22 bp, Homo sapiens
tctgaaagtatctggatctttt

SEQ ID NO: 7236410 - DNA, 22 bp, Homo sapiens
tctgaaatagaagtgtctttct

SEQ ID NO: 7236411 - DNA, 22 bp, Homo sapiens
tctgaaatactgcaggttctct

SEQ ID NO: 7236412 - DNA, 22 bp, Homo sapiens
tctgaaataaatgcactgttag

SEQ ID NO: 7236413 - DNA, 22 bp, Homo sapiens
tctgaaataaatgcactgttag

SEQ ID NO: 7236414 - DNA, 22 bp, Homo sapiens
tctctttgtctgctcttagttg

SEQ ID NO: 7236415 - DNA, 22 bp, Homo sapiens
tctctttgtggccaggagagga

SEQ ID NO: 7236416 - DNA, 20 bp, Homo sapiens
tctcttttagcttacagctg

SEQ ID NO: 7236417 - DNA, 20 bp, Homo sapiens
tctcttttagcttacagctg

SEQ ID NO: 7236418 - DNA, 22 bp, Homo sapiens
tctcttttatgtacaccctgac

SEQ ID NO: 7236419 - DNA, 22 bp, Homo sapiens
tctcttttatgtacaccctgac

SEQ ID NO: 7236420 - DNA, 18 bp, Homo sapiens
tctcttttcccctcattg

SEQ ID NO: 7236421 - DNA, 18 bp, Homo sapiens
tctcttttcccctcattg

SEQ ID NO: 7236422 - DNA, 22 bp, Homo sapiens
tctgaaagaaagattttgtttc

SEQ ID NO: 7236423 - DNA, 22 bp, Homo sapiens
tctgaaagaagggcagtctttt

SEQ ID NO: 7236424 - DNA, 22 bp, Homo sapiens
tctcttttctttctggataaaa

SEQ ID NO: 7236425 - DNA, 22 bp, Homo sapiens
tctgaaaatgttgactttgttt

SEQ ID NO: 7236426 - DNA, 22 bp, Homo sapiens
tctgaaaatgttgactttgttt

SEQ ID NO: 7236427 - DNA, 22 bp, Homo sapiens
tctcttctttggggtgggctca

SEQ ID NO: 7236428 - DNA, 22 bp, Homo sapiens
tctctttaaaaatagtgaaata

SEQ ID NO: 7236429 - DNA, 22 bp, Homo sapiens
tctctttaaaaatagtgaaata

SEQ ID NO: 7236430 - DNA, 22 bp, Homo sapiens
tctctttaaagactcagagatt

SEQ ID NO: 7236431 - DNA, 22 bp, Homo sapiens
tctctttaaagactcagagatt

SEQ ID NO: 7236432 - DNA, 22 bp, Homo sapiens
tctctttaagtataatcttata

SEQ ID NO: 7236433 - DNA, 22 bp, Homo sapiens
tctctttactttcaccaatttg

SEQ ID NO: 7236434 - DNA, 22 bp, Homo sapiens
tctctttactttcaccaatttg

SEQ ID NO: 7236435 - DNA, 23 bp, Homo sapiens
tctctttcaagagcttaatgtgc

SEQ ID NO: 7236436 - DNA, 22 bp, Homo sapiens
tctctttctattgcaccatgct

SEQ ID NO: 7236437 - DNA, 22 bp, Homo sapiens
tctctttctatatgtgagtctt

SEQ ID NO: 7236438 - DNA, 18 bp, Homo sapiens
tctctttcctcagtggag

SEQ ID NO: 7236439 - DNA, 17 bp, Homo sapiens
tctctttccctttctgc

SEQ ID NO: 7236440 - DNA, 22 bp, Homo sapiens
tctctttctttgtatgtctatt

SEQ ID NO: 7236441 - DNA, 22 bp, Homo sapiens
tctctttctttgtatgtctatt

SEQ ID NO: 7236442 - DNA, 22 bp, Homo sapiens
tctctttgaccctttagctcca

SEQ ID NO: 7236443 - DNA, 22 bp, Homo sapiens
tctctttgcctgctgccatcca

SEQ ID NO: 7236444 - DNA, 22 bp, Homo sapiens
tctcttcttgtgttttcctgcc

SEQ ID NO: 7236445 - DNA, 18 bp, Homo sapiens
tctcttcttggcagtcaa

SEQ ID NO: 7236446 - DNA, 18 bp, Homo sapiens
tctcttcttggcagtcaa

SEQ ID NO: 7236447 - DNA, 18 bp, Homo sapiens
tctcttcttggcagtcaa

SEQ ID NO: 7236448 - DNA, 22 bp, Homo sapiens
tctcttcttgattttcactgga

SEQ ID NO: 7236449 - DNA, 22 bp, Homo sapiens
tctcttcttgattttcactgga

SEQ ID NO: 7236450 - DNA, 20 bp, Homo sapiens
tctcttctggggagataaaa

SEQ ID NO: 7236451 - DNA, 22 bp, Homo sapiens
tctcttcttgattttcactgga

SEQ ID NO: 7236452 - DNA, 22 bp, Homo sapiens
tctcttctgaaacctgtcttta

SEQ ID NO: 7236453 - DNA, 22 bp, Homo sapiens
tctcttctgacctagccttgga

SEQ ID NO: 7236454 - DNA, 22 bp, Homo sapiens
tctcttctgacctagccttgga

SEQ ID NO: 7236455 - DNA, 22 bp, Homo sapiens
tctcttctgaaacctgtcttta

SEQ ID NO: 7236456 - DNA, 22 bp, Homo sapiens
tctcttctctagtgagcaactg

SEQ ID NO: 7236457 - DNA, 22 bp, Homo sapiens
tctcttctaattttcccgagta

SEQ ID NO: 7236458 - DNA, 22 bp, Homo sapiens
tctcttctaattagggtccatg

SEQ ID NO: 7236459 - DNA, 22 bp, Homo sapiens
tctcttctaattttcccgagta

SEQ ID NO: 7236460 - DNA, 22 bp, Homo sapiens
tctcttctatttgagactattt

SEQ ID NO: 7236461 - DNA, 22 bp, Homo sapiens
tctcttctatttgagactattt

SEQ ID NO: 7236462 - DNA, 22 bp, Homo sapiens
tctcttctagcttcttgtggtt

SEQ ID NO: 7236463 - DNA, 22 bp, Homo sapiens
tctcttctatttgagactattt

SEQ ID NO: 7236464 - DNA, 22 bp, Homo sapiens
tctcttctgaaacctgtcttta

SEQ ID NO: 7236465 - DNA, 22 bp, Homo sapiens
tctcttctctagtgagcaactg

SEQ ID NO: 7236466 - DNA, 19 bp, Homo sapiens
tctcttctccctggtttta

SEQ ID NO: 7236467 - DNA, 22 bp, Homo sapiens
tctcttattttgcctttgacaa

SEQ ID NO: 7236468 - DNA, 23 bp, Homo sapiens
tctcttatcacaattcattttgc

SEQ ID NO: 7236469 - DNA, 22 bp, Homo sapiens
tctcttatgggatagagagggg

SEQ ID NO: 7236470 - DNA, 22 bp, Homo sapiens
tctcttaatccggtgctttctg

SEQ ID NO: 7236471 - DNA, 23 bp, Homo sapiens
tctcttacctgagacatttccta

SEQ ID NO: 7236472 - DNA, 22 bp, Homo sapiens
tctcttaggagaaattcataaa

SEQ ID NO: 7236473 - DNA, 21 bp, Homo sapiens
tctctgtgtctttaagctgga

SEQ ID NO: 7236474 - DNA, 22 bp, Homo sapiens
tctcttccatgtttcagcccca

SEQ ID NO: 7236475 - DNA, 22 bp, Homo sapiens
tctcttccatgtttcagcccca

SEQ ID NO: 7236476 - DNA, 22 bp, Homo sapiens
tctcttccagtggctttgattt

SEQ ID NO: 7236477 - DNA, 22 bp, Homo sapiens
tctcttccatgtttcagcccca

SEQ ID NO: 7236478 - DNA, 21 bp, Homo sapiens
tctcttcccatcaggacacta

SEQ ID NO: 7236479 - DNA, 21 bp, Homo sapiens
tctcttcccatcaggacacta

SEQ ID NO: 7236480 - DNA, 21 bp, Homo sapiens
tctcttcccatcaggacacta

SEQ ID NO: 7236481 - DNA, 22 bp, Homo sapiens
tctcttcccctttcctttaaca

SEQ ID NO: 7236482 - DNA, 22 bp, Homo sapiens
tctcttcccctttcctttaaca

SEQ ID NO: 7236483 - DNA, 22 bp, Homo sapiens
tctcttcccggataaagtaagt

SEQ ID NO: 7236484 - DNA, 22 bp, Homo sapiens
tctcttccttgacctattgtaa

SEQ ID NO: 7236485 - DNA, 22 bp, Homo sapiens
tctcttccctttatggtatgtg

SEQ ID NO: 7236486 - DNA, 22 bp, Homo sapiens
tctcttcctagtgatgggcttt

SEQ ID NO: 7236487 - DNA, 22 bp, Homo sapiens
tctcttctaacactagaaattc

SEQ ID NO: 7236488 - DNA, 22 bp, Homo sapiens
tctcttccttgacctattgtaa

SEQ ID NO: 7236489 - DNA, 22 bp, Homo sapiens
tctcttctaacactagaaattc

SEQ ID NO: 7236490 - DNA, 21 bp, Homo sapiens
tctctgtggtccaatcccagc

SEQ ID NO: 7236491 - DNA, 22 bp, Homo sapiens
tctctgtgggtttcaccagcgc

SEQ ID NO: 7236492 - DNA, 22 bp, Homo sapiens
tctctgtggtatgtcatagcaa

SEQ ID NO: 7236493 - DNA, 22 bp, Homo sapiens
tctctgtgtctcatgttcctat

SEQ ID NO: 7236494 - DNA, 22 bp, Homo sapiens
tctctgtggcatccactcaact

SEQ ID NO: 7236495 - DNA, 21 bp, Homo sapiens
tctctgtggcctaccctctac

SEQ ID NO: 7236496 - DNA, 22 bp, Homo sapiens
tctctgtggcaactacttagct

SEQ ID NO: 7236497 - DNA, 22 bp, Homo sapiens
tctctgtgcaggatgctgagtt

SEQ ID NO: 7236498 - DNA, 22 bp, Homo sapiens
tctctgtgcttgactttcccat

SEQ ID NO: 7236499 - DNA, 22 bp, Homo sapiens
tctctgtgcttgactttcccat

SEQ ID NO: 7236500 - DNA, 22 bp, Homo sapiens
tctctgtggagcagtgtgttca

SEQ ID NO: 7236501 - DNA, 22 bp, Homo sapiens
tctctgtggagcagtgtgttca

SEQ ID NO: 7236502 - DNA, 22 bp, Homo sapiens
tctctgtgagccaggtcctagt

SEQ ID NO: 7236503 - DNA, 22 bp, Homo sapiens
tctctgtgcaggatgctgagtt

SEQ ID NO: 7236504 - DNA, 22 bp, Homo sapiens
tctctgtgcaggatgctgagtt

SEQ ID NO: 7236505 - DNA, 22 bp, Homo sapiens
tctctgtgagatgccttcctga

SEQ ID NO: 7236506 - DNA, 22 bp, Homo sapiens
tctctgtgagatttgtattaag

SEQ ID NO: 7236507 - DNA, 22 bp, Homo sapiens
tctctgtgagatttgtattaag

SEQ ID NO: 7236508 - DNA, 22 bp, Homo sapiens
tctctgtgactgcagctttgca

SEQ ID NO: 7236509 - DNA, 22 bp, Homo sapiens
tctctgtgagatgccttcctga

SEQ ID NO: 7236510 - DNA, 22 bp, Homo sapiens
tctctgtgaagctcccgttagg

SEQ ID NO: 7236511 - DNA, 22 bp, Homo sapiens
tctctgtctgcacccaatcaat

SEQ ID NO: 7236512 - DNA, 22 bp, Homo sapiens
tctctgtctttgttgtcttcac

SEQ ID NO: 7236513 - DNA, 22 bp, Homo sapiens
tctctgtctgagcctggcagac

SEQ ID NO: 7236514 - DNA, 22 bp, Homo sapiens
tctctgtctgagcctggcagac

SEQ ID NO: 7236515 - DNA, 22 bp, Homo sapiens
tctctgtctcccgtgtgtccgg

SEQ ID NO: 7236516 - DNA, 22 bp, Homo sapiens
tctctgtcccctcagctggggt

SEQ ID NO: 7236517 - DNA, 21 bp, Homo sapiens
tctctggttctgaaatggttt

SEQ ID NO: 7236518 - DNA, 22 bp, Homo sapiens
tctctggtcccacctggccatt

SEQ ID NO: 7236519 - DNA, 22 bp, Homo sapiens
tctctggtggctccatcagtag

SEQ ID NO: 7236520 - DNA, 23 bp, Homo sapiens
tctctggttaggggagattggtg

SEQ ID NO: 7236521 - DNA, 22 bp, Homo sapiens
tctctgggtttttgtcctgtac

SEQ ID NO: 7236522 - DNA, 22 bp, Homo sapiens
tctctgggtttttgtcctgtac

SEQ ID NO: 7236523 - DNA, 22 bp, Homo sapiens
tctctgggtttttgtcctgtac

SEQ ID NO: 7236524 - DNA, 22 bp, Homo sapiens
tctctgggtttttgtcctgtac

SEQ ID NO: 7236525 - DNA, 22 bp, Homo sapiens
tctctgggtttttgtcctgtac

SEQ ID NO: 7236526 - DNA, 22 bp, Homo sapiens
ttccaggaacaaactcacctta

SEQ ID NO: 7236527 - DNA, 22 bp, Homo sapiens
actgcactccagcctgggtgac

SEQ ID NO: 7236528 - DNA, 22 bp, Homo sapiens
actgcactccaacctgggtgac

SEQ ID NO: 7236529 - DNA, 20 bp, Homo sapiens
acgtggccaccagtggctta

SEQ ID NO: 7236530 - DNA, 22 bp, Homo sapiens
aagtctcagaaaactagtgtgg

SEQ ID NO: 7236531 - DNA, 22 bp, Homo sapiens
agaagcagaaggaagcagggcc

SEQ ID NO: 7236532 - DNA, 22 bp, Homo sapiens
aatactgcctgtgaggtaactc

SEQ ID NO: 7236533 - DNA, 23 bp, Homo sapiens
actttattgaccccaggtcagtt

SEQ ID NO: 7236534 - DNA, 22 bp, Homo sapiens
actttaaaactgatcatcagag

SEQ ID NO: 7236535 - DNA, 22 bp, Homo sapiens
actttatttcctattgcatcca

SEQ ID NO: 7236536 - DNA, 22 bp, Homo sapiens
aatcagaaagaggtcatgttgc

SEQ ID NO: 7236537 - DNA, 22 bp, Homo sapiens
accatgttggccaagctggtct

SEQ ID NO: 7236538 - DNA, 22 bp, Homo sapiens
aagctatgggggagtttcaacc

SEQ ID NO: 7236539 - DNA, 22 bp, Homo sapiens
acagggcagagaggcaggcttg

SEQ ID NO: 7236540 - DNA, 22 bp, Homo sapiens
acagggcagaaatgttgcatct

SEQ ID NO: 7236541 - DNA, 22 bp, Homo sapiens
acagggcagagggcagttggta

SEQ ID NO: 7236542 - DNA, 22 bp, Homo sapiens
acagggcagagtgaaatgctat

SEQ ID NO: 7236543 - DNA, 19 bp, Homo sapiens
acagggcagcaataggata

SEQ ID NO: 7236544 - DNA, 22 bp, Homo sapiens
acagggcagcaactttgtgcct

SEQ ID NO: 7236545 - DNA, 22 bp, Homo sapiens
agccaggggattcatcagggac

SEQ ID NO: 7236546 - DNA, 22 bp, Homo sapiens
acagacagggcacctgcctcct

SEQ ID NO: 7236547 - DNA, 22 bp, Homo sapiens
acagacagattttgtctgatgt

SEQ ID NO: 7236548 - DNA, 22 bp, Homo sapiens
acagacagaggctccatgagga

SEQ ID NO: 7236549 - DNA, 22 bp, Homo sapiens
acagacagacagattgcatatg

SEQ ID NO: 7236550 - DNA, 22 bp, Homo sapiens
acagacagacagagaactattc

SEQ ID NO: 7236551 - DNA, 20 bp, Homo sapiens
acagatatttgattttcagt

SEQ ID NO: 7236552 - DNA, 22 bp, Homo sapiens
acagattcactgcactggccat

SEQ ID NO: 7236553 - DNA, 22 bp, Homo sapiens
acacttcagcagtatgcttggg

SEQ ID NO: 7236554 - DNA, 22 bp, Homo sapiens
acactgcagatgaaagcataag

SEQ ID NO: 7236555 - DNA, 22 bp, Homo sapiens
acacttcacccctgctcccagt

SEQ ID NO: 7236556 - DNA, 22 bp, Homo sapiens
agataacttttgggtattcatg

SEQ ID NO: 7236557 - DNA, 22 bp, Homo sapiens
aatgttttaaaagagattgaga

SEQ ID NO: 7236558 - DNA, 22 bp, Homo sapiens
aatgtgggggtgagctgtatat

SEQ ID NO: 7236559 - DNA, 22 bp, Homo sapiens
aatgtgtacatgacagatagaa

SEQ ID NO: 7236560 - DNA, 22 bp, Homo sapiens
aatgggtttctgtcccagctct

SEQ ID NO: 7236561 - DNA, 22 bp, Homo sapiens
aatgggttgctttccacagcct

SEQ ID NO: 7236562 - DNA, 22 bp, Homo sapiens
aatggtttgtacctgtccttgg

SEQ ID NO: 7236563 - DNA, 22 bp, Homo sapiens
aatggtttggactattcaatag

SEQ ID NO: 7236564 - DNA, 22 bp, Homo sapiens
aatggtttaacatatgcttgag

SEQ ID NO: 7236565 - DNA, 22 bp, Homo sapiens
aatgggaagtcactactgttac

SEQ ID NO: 7236566 - DNA, 22 bp, Homo sapiens
acagcagaggaaaagtctgata

SEQ ID NO: 7236567 - DNA, 19 bp, Homo sapiens
aagcaatgttgtgaatcta

SEQ ID NO: 7236568 - DNA, 22 bp, Homo sapiens
aagcaatgttagaggccttagg

SEQ ID NO: 7236569 - DNA, 22 bp, Homo sapiens
aagcaatgtgtttgaaaggcca

SEQ ID NO: 7236570 - DNA, 22 bp, Homo sapiens
aagcaatgtgttaatgaatgag

SEQ ID NO: 7236571 - DNA, 23 bp, Homo sapiens
aagcaatgctgagccagttctga

SEQ ID NO: 7236572 - DNA, 22 bp, Homo sapiens
aagcaaggcaacctatgtccag

SEQ ID NO: 7236573 - DNA, 22 bp, Homo sapiens
aagatgtgtctcatcagggtgt

SEQ ID NO: 7236574 - DNA, 22 bp, Homo sapiens
aagatgatagatctgtcaatgt

SEQ ID NO: 7236575 - DNA, 22 bp, Homo sapiens
aagatgataggacttgcttaag

SEQ ID NO: 7236576 - DNA, 22 bp, Homo sapiens
aagatgatgttgtgttttcact

SEQ ID NO: 7236577 - DNA, 22 bp, Homo sapiens
aagatgtatcagttaagtcttc

SEQ ID NO: 7236578 - DNA, 22 bp, Homo sapiens
aagaaagataaggtttgcttgg

SEQ ID NO: 7236579 - DNA, 22 bp, Homo sapiens
aactgcttgatgaagctcccac

SEQ ID NO: 7236580 - DNA, 22 bp, Homo sapiens
aactgcttgagatatgtttgtc

SEQ ID NO: 7236581 - DNA, 22 bp, Homo sapiens
aactgctttttgatctcaggag

SEQ ID NO: 7236582 - DNA, 22 bp, Homo sapiens
aactgctttgtgagctttctgg

SEQ ID NO: 7236583 - DNA, 22 bp, Homo sapiens
aactgcttgtagtgacttgcct

SEQ ID NO: 7236584 - DNA, 22 bp, Homo sapiens
aactgcttgtaaataatgttga

SEQ ID NO: 7236585 - DNA, 17 bp, Homo sapiens
aactgctttttttagcc

SEQ ID NO: 7236586 - DNA, 20 bp, Homo sapiens
aattttatctccatcctttg

SEQ ID NO: 7236587 - DNA, 22 bp, Homo sapiens
aatttcagctcaaacttgtgtt

SEQ ID NO: 7236588 - DNA, 22 bp, Homo sapiens
aacagacatatttttaatatgc

SEQ ID NO: 7236589 - DNA, 22 bp, Homo sapiens
aacagacagaaaaatgtgatct

SEQ ID NO: 7236590 - DNA, 22 bp, Homo sapiens
aacagacaactcctgtggctca

SEQ ID NO: 7236591 - DNA, 22 bp, Homo sapiens
aacacagctaatttctgtcaat

SEQ ID NO: 7236592 - DNA, 22 bp, Homo sapiens
aacatgtgtctggctagattgt

SEQ ID NO: 7236593 - DNA, 22 bp, Homo sapiens
aacatgtgagcaggttttttat

SEQ ID NO: 7236594 - DNA, 22 bp, Homo sapiens
aatagactttctttttagaaca

SEQ ID NO: 7236595 - DNA, 22 bp, Homo sapiens
aacccgggaggtggaggttatg

SEQ ID NO: 7236596 - DNA, 22 bp, Homo sapiens
aacccgggaggcggaggttgtg

SEQ ID NO: 7236597 - DNA, 22 bp, Homo sapiens
aacatgtgtcttgcatttcttg

SEQ ID NO: 7236598 - DNA, 22 bp, Homo sapiens
aatgaattgcagtactgacttg

SEQ ID NO: 7236599 - DNA, 22 bp, Homo sapiens
aactagaacgtctagttgctgg

SEQ ID NO: 7236600 - DNA, 22 bp, Homo sapiens
aatgctttcaaaaatgtgcagt

SEQ ID NO: 7236601 - DNA, 22 bp, Homo sapiens
aacccgggaggcagaggttgtg

SEQ ID NO: 7236602 - DNA, 22 bp, Homo sapiens
aaagcctcccaggttatgagta

SEQ ID NO: 7236603 - DNA, 22 bp, Homo sapiens
aacactgtggtcttttcagtaa

SEQ ID NO: 7236604 - DNA, 22 bp, Homo sapiens
aagatccatgagggcagagatt

SEQ ID NO: 7236605 - DNA, 22 bp, Homo sapiens
aaacactgtgggacatcttact

SEQ ID NO: 7236606 - DNA, 22 bp, Homo sapiens
aaacactgaagacctatctggt

SEQ ID NO: 7236607 - DNA, 22 bp, Homo sapiens
aaacactgaaaattttggtcat

SEQ ID NO: 7236608 - DNA, 22 bp, Homo sapiens
aaacactgatggatatttttcc

SEQ ID NO: 7236609 - DNA, 22 bp, Homo sapiens
aaaagtaattgatgcaatcgta

SEQ ID NO: 7236610 - DNA, 22 bp, Homo sapiens
aaaagtaattgcaattttgtag

SEQ ID NO: 7236611 - DNA, 22 bp, Homo sapiens
aaaatattttagggccaggaga

SEQ ID NO: 7236612 - DNA, 22 bp, Homo sapiens
aaacacaagaggcagggtacag

SEQ ID NO: 7236613 - DNA, 22 bp, Homo sapiens
acaggtggacacagcagcagtc

SEQ ID NO: 7236614 - DNA, 22 bp, Homo sapiens
acaggtggaaacatggtgttgg

SEQ ID NO: 7236615 - DNA, 22 bp, Homo sapiens
acaggtggccccgagggagtgg

SEQ ID NO: 7236616 - DNA, 22 bp, Homo sapiens
acaggtggcataggcagtttga

SEQ ID NO: 7236617 - DNA, 22 bp, Homo sapiens
acaggtggcagaagcatttact

SEQ ID NO: 7236618 - DNA, 22 bp, Homo sapiens
acaggtggcactgctgttactc

SEQ ID NO: 7236619 - DNA, 22 bp, Homo sapiens
acaggtggagtggttagcaggc

SEQ ID NO: 7236620 - DNA, 22 bp, Homo sapiens
acaggtggaggctttaggaggt

SEQ ID NO: 7236621 - DNA, 22 bp, Homo sapiens
acagggcacctgaggtaggaag

SEQ ID NO: 7236622 - DNA, 22 bp, Homo sapiens
acagggcaacctctgggagact

SEQ ID NO: 7236623 - DNA, 22 bp, Homo sapiens
acaggtggcttattggctgatt

SEQ ID NO: 7236624 - DNA, 22 bp, Homo sapiens
acaggtggcttccattttctaa

SEQ ID NO: 7236625 - DNA, 22 bp, Homo sapiens
acaggtgggcttaagagtcggc

SEQ ID NO: 7236626 - DNA, 22 bp, Homo sapiens
acaggtggggcacttggagcct

SEQ ID NO: 7236627 - DNA, 22 bp, Homo sapiens
acaggtggggaggctgaggttc

SEQ ID NO: 7236628 - DNA, 22 bp, Homo sapiens
acaggtggtaaaatggactgtc

SEQ ID NO: 7236629 - DNA, 22 bp, Homo sapiens
acaggtggtagagtggaaagag

SEQ ID NO: 7236630 - DNA, 21 bp, Homo sapiens
aggagctgtgttagctggtcg

SEQ ID NO: 7236631 - DNA, 22 bp, Homo sapiens
acaggtgtaaaacccaggatgg

SEQ ID NO: 7236632 - DNA, 22 bp, Homo sapiens
acaggtggtctttgctcctttt

SEQ ID NO: 7236633 - DNA, 22 bp, Homo sapiens
acaggtgtaatttgcccgaggt

SEQ ID NO: 7236634 - DNA, 22 bp, Homo sapiens
agctttatcagaggagtctcta

SEQ ID NO: 7236635 - DNA, 22 bp, Homo sapiens
agctttatcacaatattggcta

SEQ ID NO: 7236636 - DNA, 22 bp, Homo sapiens
agctttatgcttcctacaagct

SEQ ID NO: 7236637 - DNA, 22 bp, Homo sapiens
agctttatgaggagaccttagt

SEQ ID NO: 7236638 - DNA, 22 bp, Homo sapiens
agctttatcttcacctgggaat

SEQ ID NO: 7236639 - DNA, 22 bp, Homo sapiens
agctttatcccttgcccatcga

SEQ ID NO: 7236640 - DNA, 22 bp, Homo sapiens
agctttatgggagcttagataa

SEQ ID NO: 7236641 - DNA, 21 bp, Homo sapiens
agggagctatttatagtaagc

SEQ ID NO: 7236642 - DNA, 22 bp, Homo sapiens
agggagctattgtgttactttg

SEQ ID NO: 7236643 - DNA, 22 bp, Homo sapiens
agggagctaggatcctgaaggt

SEQ ID NO: 7236644 - DNA, 23 bp, Homo sapiens
agggagctaaaaggctggagcag

SEQ ID NO: 7236645 - DNA, 22 bp, Homo sapiens
agggacagatgaatgactgagt

SEQ ID NO: 7236646 - DNA, 22 bp, Homo sapiens
agggagctctttggtcttgccg

SEQ ID NO: 7236647 - DNA, 22 bp, Homo sapiens
agggagctctgggggcacacgg

SEQ ID NO: 7236648 - DNA, 22 bp, Homo sapiens
agggagctctaagtagagggac

SEQ ID NO: 7236649 - DNA, 22 bp, Homo sapiens
agggagctcgatgcctgagtgt

SEQ ID NO: 7236650 - DNA, 22 bp, Homo sapiens
agggagctcagttggaagcggt

SEQ ID NO: 7236651 - DNA, 22 bp, Homo sapiens
agggagctcacagtccagtaga

SEQ ID NO: 7236652 - DNA, 22 bp, Homo sapiens
agggagctatttcagggttatt

SEQ ID NO: 7236653 - DNA, 22 bp, Homo sapiens
acccggagtcggaggttgcagt

SEQ ID NO: 7236654 - DNA, 22 bp, Homo sapiens
acccgggaggcaggagtcatag

SEQ ID NO: 7236655 - DNA, 22 bp, Homo sapiens
acatggaaaactaactgctttt

SEQ ID NO: 7236656 - DNA, 22 bp, Homo sapiens
aggcagggaccagttgttttct

SEQ ID NO: 7236657 - DNA, 22 bp, Homo sapiens
aggcagggctcatttcttaggc

SEQ ID NO: 7236658 - DNA, 22 bp, Homo sapiens
aggcaggggagctggaagggta

SEQ ID NO: 7236659 - DNA, 22 bp, Homo sapiens
aggcagggctgggattagactc

SEQ ID NO: 7236660 - DNA, 22 bp, Homo sapiens
agaagaaatgtgaaggccactg

SEQ ID NO: 7236661 - DNA, 22 bp, Homo sapiens
agaagaaatgaggccgttctgc

SEQ ID NO: 7236662 - DNA, 22 bp, Homo sapiens
agaagaaatgaggccgttctgc

SEQ ID NO: 7236663 - DNA, 22 bp, Homo sapiens
actgtaaattacataagaacag

SEQ ID NO: 7236664 - DNA, 22 bp, Homo sapiens
agtttccactggagacactgtg

SEQ ID NO: 7236665 - DNA, 22 bp, Homo sapiens
acttcatagaatgagcttggaa

SEQ ID NO: 7236666 - DNA, 22 bp, Homo sapiens
acttcaaattttcagaagaaat

SEQ ID NO: 7236667 - DNA, 22 bp, Homo sapiens
acttcagagactttatggtcca

SEQ ID NO: 7236668 - DNA, 19 bp, Homo sapiens
acttcaaatcttagagaaa

SEQ ID NO: 7236669 - DNA, 22 bp, Homo sapiens
acttcaaatgtgacaatgtgaa

SEQ ID NO: 7236670 - DNA, 22 bp, Homo sapiens
acttcaaattctgggggaagag

SEQ ID NO: 7236671 - DNA, 22 bp, Homo sapiens
acttcaaaatgagtttcctggt

SEQ ID NO: 7236672 - DNA, 22 bp, Homo sapiens
acttcaaacaattaacagagaa

SEQ ID NO: 7236673 - DNA, 22 bp, Homo sapiens
acttcaaatctcttgaaagcaa

SEQ ID NO: 7236674 - DNA, 22 bp, Homo sapiens
acttcaaaaataagtgagaggt

SEQ ID NO: 7236675 - DNA, 22 bp, Homo sapiens
actgttacagagcaggaaattg

SEQ ID NO: 7236676 - DNA, 22 bp, Homo sapiens
actgatttcagggatgagaaga

SEQ ID NO: 7236677 - DNA, 22 bp, Homo sapiens
actgcaacctccacctcctggg

SEQ ID NO: 7236678 - DNA, 22 bp, Homo sapiens
actgcaacacctcctgggttca

SEQ ID NO: 7236679 - DNA, 22 bp, Homo sapiens
actggacagaggaaatatggag

SEQ ID NO: 7236680 - DNA, 22 bp, Homo sapiens
actgctgtgatctgatgtaatt

SEQ ID NO: 7236681 - DNA, 22 bp, Homo sapiens
actgctttagacctagagctct

SEQ ID NO: 7236682 - DNA, 22 bp, Homo sapiens
actgctttaaaaaagcaagctt

SEQ ID NO: 7236683 - DNA, 22 bp, Homo sapiens
acctggacacctgctgtcatct

SEQ ID NO: 7236684 - DNA, 22 bp, Homo sapiens
actcacagcagactatgaggga

SEQ ID NO: 7236685 - DNA, 20 bp, Homo sapiens
accttcaggaacttatcagc

SEQ ID NO: 7236686 - DNA, 22 bp, Homo sapiens
accttcagacatcaactatctc

SEQ ID NO: 7236687 - DNA, 19 bp, Homo sapiens
agccccttggtactgtcct

SEQ ID NO: 7236688 - DNA, 22 bp, Homo sapiens
cagagctggcggtgagaagaca

SEQ ID NO: 7236689 - DNA, 22 bp, Homo sapiens
cagacagacctgcaagggcaca

SEQ ID NO: 7236690 - DNA, 22 bp, Homo sapiens
cagaagaatggtgtctgagctc

SEQ ID NO: 7236691 - DNA, 22 bp, Homo sapiens
cagcacagtacaaggcacggat

SEQ ID NO: 7236692 - DNA, 22 bp, Homo sapiens
agcataagttggtacagccact

SEQ ID NO: 7236693 - DNA, 22 bp, Homo sapiens
agcataagttggtacagccact

SEQ ID NO: 7236694 - DNA, 22 bp, Homo sapiens
agcaggtgcgttacttcactct

SEQ ID NO: 7236695 - DNA, 21 bp, Homo sapiens
agcaggtgctgttggaggaaa

SEQ ID NO: 7236696 - DNA, 22 bp, Homo sapiens
agcaggtggaaaattcttatca

SEQ ID NO: 7236697 - DNA, 18 bp, Homo sapiens
agcaggtgctgtttcttt

SEQ ID NO: 7236698 - DNA, 22 bp, Homo sapiens
agcaggtggacagaggaagaaa

SEQ ID NO: 7236699 - DNA, 22 bp, Homo sapiens
agcagggcagtgcttcagctct

SEQ ID NO: 7236700 - DNA, 22 bp, Homo sapiens
agcagggctctgccatgggccc

SEQ ID NO: 7236701 - DNA, 22 bp, Homo sapiens
agcagggctcctgaaagccgcg

SEQ ID NO: 7236702 - DNA, 22 bp, Homo sapiens
agcagggctccatttcactgcc

SEQ ID NO: 7236703 - DNA, 16 bp, Homo sapiens
agcagggcgggaagga

SEQ ID NO: 7236704 - DNA, 22 bp, Homo sapiens
agcagggctcacattagtggat

SEQ ID NO: 7236705 - DNA, 22 bp, Homo sapiens
agcagggcctggcactcctggg

SEQ ID NO: 7236706 - DNA, 22 bp, Homo sapiens
agcagggcctgagtgacctaac

SEQ ID NO: 7236707 - DNA, 22 bp, Homo sapiens
agcaggtgccaggtgtacccgc

SEQ ID NO: 7236708 - DNA, 22 bp, Homo sapiens
agcaggtgcatggcgagcgcgg

SEQ ID NO: 7236709 - DNA, 22 bp, Homo sapiens
agcaggtgatgtgagtctggaa

SEQ ID NO: 7236710 - DNA, 22 bp, Homo sapiens
agcagcatgttcattacattat

SEQ ID NO: 7236711 - DNA, 22 bp, Homo sapiens
caacttcactgtgcctctagtt

SEQ ID NO: 7236712 - DNA, 22 bp, Homo sapiens
atttattgaagcttattacgtt

SEQ ID NO: 7236713 - DNA, 22 bp, Homo sapiens
agatgaaaatacgtgactttaa

SEQ ID NO: 7236714 - DNA, 22 bp, Homo sapiens
atttcattgaagttaattcttc

SEQ ID NO: 7236715 - DNA, 22 bp, Homo sapiens
agatgtgcctccaaggggtgca

SEQ ID NO: 7236716 - DNA, 22 bp, Homo sapiens
atttattgaacactgactatgt

SEQ ID NO: 7236717 - DNA, 22 bp, Homo sapiens
attctgtatttctaataagatc

SEQ ID NO: 7236718 - DNA, 22 bp, Homo sapiens
attataaagaacatgtgtgtgg

SEQ ID NO: 7236719 - DNA, 22 bp, Homo sapiens
agacacataggaccacactgtg

SEQ ID NO: 7236720 - DNA, 22 bp, Homo sapiens
agacaggtgttttacaacttcg

SEQ ID NO: 7236721 - DNA, 22 bp, Homo sapiens
agacaggtgctcgcccaagtcc

SEQ ID NO: 7236722 - DNA, 21 bp, Homo sapiens
agacaggtcagggagaggtga

SEQ ID NO: 7236723 - DNA, 17 bp, Homo sapiens
agacaggttatagttga

SEQ ID NO: 7236724 - DNA, 22 bp, Homo sapiens
agacagtgatggacaggcagac

SEQ ID NO: 7236725 - DNA, 22 bp, Homo sapiens
agacagtgcaagaagagcaggc

SEQ ID NO: 7236726 - DNA, 22 bp, Homo sapiens
agaatgaattaatcaactggaa

SEQ ID NO: 7236727 - DNA, 22 bp, Homo sapiens
agaatgttgatagcacctattt

SEQ ID NO: 7236728 - DNA, 22 bp, Homo sapiens
agaatgtgaagattttgaatta

SEQ ID NO: 7236729 - DNA, 22 bp, Homo sapiens
agaatgtagtcttggagattta

SEQ ID NO: 7236730 - DNA, 22 bp, Homo sapiens
agaatactaggcttcagaaagg

SEQ ID NO: 7236731 - DNA, 21 bp, Homo sapiens
atctttattacgcagagaaga

SEQ ID NO: 7236732 - DNA, 22 bp, Homo sapiens
agaagaaatgtgaaggccactg

SEQ ID NO: 7236733 - DNA, 22 bp, Homo sapiens
agaagaaatgtgaaggccactg

SEQ ID NO: 7236734 - DNA, 22 bp, Homo sapiens
agaagcaaggtctgtcagtata

SEQ ID NO: 7236735 - DNA, 22 bp, Homo sapiens
atgtctgtacgagttacaatgg

SEQ ID NO: 7236736 - DNA, 22 bp, Homo sapiens
atgtccaatttctgaggctgct

SEQ ID NO: 7236737 - DNA, 22 bp, Homo sapiens
atggataagaacaaatatctga

SEQ ID NO: 7236738 - DNA, 22 bp, Homo sapiens
atggataagtcaaagagtatcc

SEQ ID NO: 7236739 - DNA, 22 bp, Homo sapiens
aggagagagctgagctttgctg

SEQ ID NO: 7236740 - DNA, 22 bp, Homo sapiens
aggagctgtgaatgggaggggt

SEQ ID NO: 7236741 - DNA, 22 bp, Homo sapiens
aggagctgataaaagggggtca

SEQ ID NO: 7236742 - DNA, 20 bp, Homo sapiens
aggagctgaattagagggtt

SEQ ID NO: 7236743 - DNA, 22 bp, Homo sapiens
aggaagctggttacgaagggat

SEQ ID NO: 7236744 - DNA, 22 bp, Homo sapiens
aggaagctggtgtgaggatgaa

SEQ ID NO: 7236745 - DNA, 21 bp, Homo sapiens
aggaagctgcccagatagtag

SEQ ID NO: 7236746 - DNA, 22 bp, Homo sapiens
aggaagctgctggagtagtgtg

SEQ ID NO: 7236747 - DNA, 22 bp, Homo sapiens
aggaagctgcctgggatgggaa

SEQ ID NO: 7236748 - DNA, 22 bp, Homo sapiens
aggaagctttatgaccagctaa

SEQ ID NO: 7236749 - DNA, 20 bp, Homo sapiens
aggaaggaagtttgcatgga

SEQ ID NO: 7236750 - DNA, 22 bp, Homo sapiens
catgaaatatgctacctgtctt

SEQ ID NO: 7236751 - DNA, 22 bp, Homo sapiens
catgaaatattagtaactgttt

SEQ ID NO: 7236752 - DNA, 22 bp, Homo sapiens
catgaaatgtgttaatctcttg

SEQ ID NO: 7236753 - DNA, 22 bp, Homo sapiens
catgaaatggccaaccttcggc

SEQ ID NO: 7236754 - DNA, 22 bp, Homo sapiens
catgaaatctgagtatgtttcc

SEQ ID NO: 7236755 - DNA, 22 bp, Homo sapiens
catgaaatcacaagctgaggac

SEQ ID NO: 7236756 - DNA, 22 bp, Homo sapiens
catgaaatgatatttgggtggg

SEQ ID NO: 7236757 - DNA, 22 bp, Homo sapiens
catgaaattgctcctttggtgc

SEQ ID NO: 7236758 - DNA, 22 bp, Homo sapiens
catgaaattcagcaggtgagta

SEQ ID NO: 7236759 - DNA, 22 bp, Homo sapiens
catgaaatgttagaattagaca

SEQ ID NO: 7236760 - DNA, 22 bp, Homo sapiens
agctctggaagccctggtagtt

SEQ ID NO: 7236761 - DNA, 22 bp, Homo sapiens
caggacagagcccagactgtgt

SEQ ID NO: 7236762 - DNA, 22 bp, Homo sapiens
caggacagacagaatgcctaac

SEQ ID NO: 7236763 - DNA, 22 bp, Homo sapiens
agctttatagaaaggatcagtg

SEQ ID NO: 7236764 - DNA, 22 bp, Homo sapiens
agctttatataaaagagtacat

SEQ ID NO: 7236765 - DNA, 22 bp, Homo sapiens
agctttatatgttgtttctcca

SEQ ID NO: 7236766 - DNA, 22 bp, Homo sapiens
aggaagctccatgaaggcagag

SEQ ID NO: 7236767 - DNA, 22 bp, Homo sapiens
aggaagctcctggagagccagt

SEQ ID NO: 7236768 - DNA, 22 bp, Homo sapiens
aggaagctcggagagggcaaat

SEQ ID NO: 7236769 - DNA, 22 bp, Homo sapiens
agggaaggaggttagaacccac

SEQ ID NO: 7236770 - DNA, 22 bp, Homo sapiens
agggagctttttcatgtgtcta

SEQ ID NO: 7236771 - DNA, 20 bp, Homo sapiens
aggctctgcatttctgagtg

SEQ ID NO: 7236772 - DNA, 22 bp, Homo sapiens
aggctctgttattctagagggc

SEQ ID NO: 7236773 - DNA, 23 bp, Homo sapiens
ccactgctttcattttgtcatgg

SEQ ID NO: 7236774 - DNA, 22 bp, Homo sapiens
aggcaggtttactcttatttgg

SEQ ID NO: 7236775 - DNA, 18 bp, Homo sapiens
aggcaggtgctggaagtc

SEQ ID NO: 7236776 - DNA, 23 bp, Homo sapiens
aggcaggtttgggctcttcttgt

SEQ ID NO: 7236777 - DNA, 22 bp, Homo sapiens
aggcaggtttcccggctgtcaa

SEQ ID NO: 7236778 - DNA, 22 bp, Homo sapiens
atatgaagaattccaatttgga

SEQ ID NO: 7236779 - DNA, 22 bp, Homo sapiens
atatgaagtcagacaaactggg

SEQ ID NO: 7236780 - DNA, 22 bp, Homo sapiens
atcatgtgtaatttcaagctac

SEQ ID NO: 7236781 - DNA, 22 bp, Homo sapiens
atcatgtgaagtggggggttga

SEQ ID NO: 7236782 - DNA, 22 bp, Homo sapiens
ctgtctttagtacaaaaaatgt

SEQ ID NO: 7236783 - DNA, 22 bp, Homo sapiens
ctgtcctctgtcctcagcagga

SEQ ID NO: 7236784 - DNA, 22 bp, Homo sapiens
ctgtcctccggccacctacagt

SEQ ID NO: 7236785 - DNA, 22 bp, Homo sapiens
ctgtcctccagacgacagtccc

SEQ ID NO: 7236786 - DNA, 22 bp, Homo sapiens
ctgtcctcatctgccccaaggg

SEQ ID NO: 7236787 - DNA, 21 bp, Homo sapiens
ctgtcctcagatgtggacgag

SEQ ID NO: 7236788 - DNA, 22 bp, Homo sapiens
ctgtcctcaccttggcaggggg

SEQ ID NO: 7236789 - DNA, 22 bp, Homo sapiens
ctgtcctcaacccatccttctc

SEQ ID NO: 7236790 - DNA, 22 bp, Homo sapiens
atccaaatcatgtcagaagaac

SEQ ID NO: 7236791 - DNA, 22 bp, Homo sapiens
ctgctttaatccctgcctggaa

SEQ ID NO: 7236792 - DNA, 22 bp, Homo sapiens
ctgctttaacaaggctgatcag

SEQ ID NO: 7236793 - DNA, 20 bp, Homo sapiens
atacaagatgagtaatttct

SEQ ID NO: 7236794 - DNA, 19 bp, Homo sapiens
cctgctgcaccacttgtta

SEQ ID NO: 7236795 - DNA, 19 bp, Homo sapiens
cctgctgcccaccctctgc

SEQ ID NO: 7236796 - DNA, 22 bp, Homo sapiens
cctttgttctgtgtatctttgt

SEQ ID NO: 7236797 - DNA, 22 bp, Homo sapiens
cctttgttcattgccttcagtc

SEQ ID NO: 7236798 - DNA, 22 bp, Homo sapiens
aggtggggtgagctgcagacta

SEQ ID NO: 7236799 - DNA, 22 bp, Homo sapiens
aggtggggtgttggatgtttat

SEQ ID NO: 7236800 - DNA, 22 bp, Homo sapiens
aggtggggttcagtctcagccg

SEQ ID NO: 7236801 - DNA, 22 bp, Homo sapiens
cggagctggcgtctgtgtggac

SEQ ID NO: 7236802 - DNA, 21 bp, Homo sapiens
cggagctgggcagggcatccc

SEQ ID NO: 7236803 - DNA, 22 bp, Homo sapiens
cggctcactgcagctccgcctc

SEQ ID NO: 7236804 - DNA, 22 bp, Homo sapiens
aggtggggctgggaaagattcc

SEQ ID NO: 7236805 - DNA, 22 bp, Homo sapiens
aggtgggggctgtgtccttgac

SEQ ID NO: 7236806 - DNA, 22 bp, Homo sapiens
aggtggctgtattcagctgtaa

SEQ ID NO: 7236807 - DNA, 22 bp, Homo sapiens
aggtggcttctggccaggtgtg

SEQ ID NO: 7236808 - DNA, 20 bp, Homo sapiens
aggtggctcttcctgggctt

SEQ ID NO: 7236809 - DNA, 22 bp, Homo sapiens
ctcctggttcctgtcttaaata

SEQ ID NO: 7236810 - DNA, 22 bp, Homo sapiens
ctcctggttcagagagctgaga

SEQ ID NO: 7236811 - DNA, 15 bp, Homo sapiens
ctctggtttttcttc

SEQ ID NO: 7236812 - DNA, 21 bp, Homo sapiens
ctctggtttgcattggattat

SEQ ID NO: 7236813 - DNA, 22 bp, Homo sapiens
ctctggtttctgacctgaattt

SEQ ID NO: 7236814 - DNA, 22 bp, Homo sapiens
ctctggtttttcttccattaag

SEQ ID NO: 7236815 - DNA, 22 bp, Homo sapiens
ctctgctgcccaggcctgctag

SEQ ID NO: 7236816 - DNA, 22 bp, Homo sapiens
ctcttagtaatgccatgaagca

SEQ ID NO: 7236817 - DNA, 23 bp, Homo sapiens
agtctcagctggaaacatgtgtc

SEQ ID NO: 7236818 - DNA, 20 bp, Homo sapiens
agtgacagagactgtgtggc

SEQ ID NO: 7236819 - DNA, 22 bp, Homo sapiens
atggcaggatacccagtccggc

SEQ ID NO: 7236820 - DNA, 22 bp, Homo sapiens
gagagctgtggtttgaccaggc

SEQ ID NO: 7236821 - DNA, 22 bp, Homo sapiens
gagaggaactcccagtgcctgg

SEQ ID NO: 7236822 - DNA, 22 bp, Homo sapiens
atggaatgcggtagtatgtgca

SEQ ID NO: 7236823 - DNA, 22 bp, Homo sapiens
atggaatatagtcttatatctc

SEQ ID NO: 7236824 - DNA, 22 bp, Homo sapiens
atgtctttcaaattctgcctag

SEQ ID NO: 7236825 - DNA, 22 bp, Homo sapiens
atgtgtcctgctgtgtcacaca

SEQ ID NO: 7236826 - DNA, 22 bp, Homo sapiens
atgtgtcctctggcaggtttag

SEQ ID NO: 7236827 - DNA, 22 bp, Homo sapiens
atgtgtccattatcagttctgg

SEQ ID NO: 7236828 - DNA, 22 bp, Homo sapiens
atgtgtccacaggtgtgagaga

SEQ ID NO: 7236829 - DNA, 22 bp, Homo sapiens
atgtgtccaaggccacaatagc

SEQ ID NO: 7236830 - DNA, 22 bp, Homo sapiens
atgtgtcatttttctgtgcata

SEQ ID NO: 7236831 - DNA, 22 bp, Homo sapiens
atgtgtcattatccagaataac

SEQ ID NO: 7236832 - DNA, 22 bp, Homo sapiens
atgtgtcaggtacactcattag

SEQ ID NO: 7236833 - DNA, 22 bp, Homo sapiens
atgtgtcaggcaatagaagcta

SEQ ID NO: 7236834 - DNA, 22 bp, Homo sapiens
atgtgtcaattttcaaatgctt

SEQ ID NO: 7236835 - DNA, 22 bp, Homo sapiens
atgaagactatttgaaggtgcc

SEQ ID NO: 7236836 - DNA, 22 bp, Homo sapiens
atgaagcaattagaaacttgaa

SEQ ID NO: 7236837 - DNA, 21 bp, Homo sapiens
atgaagcaagggtcacacgtg

SEQ ID NO: 7236838 - DNA, 22 bp, Homo sapiens
atgaagcaacagccctcctatt

SEQ ID NO: 7236839 - DNA, 22 bp, Homo sapiens
atgaggaacagacttgctggat

SEQ ID NO: 7236840 - DNA, 22 bp, Homo sapiens
atgaagcagcctcttccctctg

SEQ ID NO: 7236841 - DNA, 22 bp, Homo sapiens
atgaagcagatttattactcac

SEQ ID NO: 7236842 - DNA, 22 bp, Homo sapiens
atgaagcagactcaggtggtgc

SEQ ID NO: 7236843 - DNA, 22 bp, Homo sapiens
atgaagcagaatttcccactct

SEQ ID NO: 7236844 - DNA, 19 bp, Homo sapiens
atgaggtagcagctggtgc

SEQ ID NO: 7236845 - DNA, 22 bp, Homo sapiens
atgattcagcaattttatatct

SEQ ID NO: 7236846 - DNA, 22 bp, Homo sapiens
atgatacacctaggagtgggag

SEQ ID NO: 7236847 - DNA, 22 bp, Homo sapiens
atgaagactaatgtgaatggga

SEQ ID NO: 7236848 - DNA, 22 bp, Homo sapiens
attcttattatagtaaaacagt

SEQ ID NO: 7236849 - DNA, 22 bp, Homo sapiens
attctacacaaagcaagaagac

SEQ ID NO: 7236850 - DNA, 22 bp, Homo sapiens
gatgagtaatagctaatggttc

SEQ ID NO: 7236851 - DNA, 22 bp, Homo sapiens
attaaaagcttcccaagagtta

SEQ ID NO: 7236852 - DNA, 22 bp, Homo sapiens
atgttttattaccaacttgtac

SEQ ID NO: 7236853 - DNA, 22 bp, Homo sapiens
caaaggcaggccccctgtgcag

SEQ ID NO: 7236854 - DNA, 22 bp, Homo sapiens
attgctttagaaagaaaaatat

SEQ ID NO: 7236855 - DNA, 22 bp, Homo sapiens
atttattgagacttaacaaccc

SEQ ID NO: 7236856 - DNA, 22 bp, Homo sapiens
atttattgagcctttcctatgt

SEQ ID NO: 7236857 - DNA, 22 bp, Homo sapiens
atttattgagagggaggggaat

SEQ ID NO: 7236858 - DNA, 22 bp, Homo sapiens
atttattggtttgcatggtgaa

SEQ ID NO: 7236859 - DNA, 22 bp, Homo sapiens
atttattggatgcttacttggg

SEQ ID NO: 7236860 - DNA, 22 bp, Homo sapiens
cactgcactccatcctgggaaa

SEQ ID NO: 7236861 - DNA, 22 bp, Homo sapiens
cactgcttttttggctatgtac

SEQ ID NO: 7236862 - DNA, 22 bp, Homo sapiens
cactgctttttctcctcactgg

SEQ ID NO: 7236863 - DNA, 22 bp, Homo sapiens
cactgcttttcagacagttatt

SEQ ID NO: 7236864 - DNA, 22 bp, Homo sapiens
cactgctttgcccaagagggca

SEQ ID NO: 7236865 - DNA, 22 bp, Homo sapiens
cactgctttcacagtttgttcc

SEQ ID NO: 7236866 - DNA, 22 bp, Homo sapiens
caacactgattatggctgagct

SEQ ID NO: 7236867 - DNA, 19 bp, Homo sapiens
gctgcagagtattcttggg

SEQ ID NO: 7236868 - DNA, 22 bp, Homo sapiens
gctcctggagagattgagaaag

SEQ ID NO: 7236869 - DNA, 22 bp, Homo sapiens
caaagtatattggattgaatgg

SEQ ID NO: 7236870 - DNA, 22 bp, Homo sapiens
gctgctggagctttgcagaagg

SEQ ID NO: 7236871 - DNA, 22 bp, Homo sapiens
gctgccttgaacttggcctggg

SEQ ID NO: 7236872 - DNA, 22 bp, Homo sapiens
caagctgcttattctctgctct

SEQ ID NO: 7236873 - DNA, 22 bp, Homo sapiens
caagctgctataggttgctggg

SEQ ID NO: 7236874 - DNA, 22 bp, Homo sapiens
cacacattgagcagctgtttgt

SEQ ID NO: 7236875 - DNA, 22 bp, Homo sapiens
cacaagtcattttcagcaggct

SEQ ID NO: 7236876 - DNA, 22 bp, Homo sapiens
cacaaacatcaatcctgttttc

SEQ ID NO: 7236877 - DNA, 22 bp, Homo sapiens
gctgtctcgcctgacactggct

SEQ ID NO: 7236878 - DNA, 22 bp, Homo sapiens
gctgtctccatagctgtgtgtc

SEQ ID NO: 7236879 - DNA, 22 bp, Homo sapiens
gctgtctccatagctgtgtgtc

SEQ ID NO: 7236880 - DNA, 22 bp, Homo sapiens
gctgtctcatgggtgctagtcc

SEQ ID NO: 7236881 - DNA, 21 bp, Homo sapiens
gctgtctctggctcctgggaa

SEQ ID NO: 7236882 - DNA, 22 bp, Homo sapiens
cagacaggctagccagactcac

SEQ ID NO: 7236883 - DNA, 22 bp, Homo sapiens
cagacaggcaggtgctgctttg

SEQ ID NO: 7236884 - DNA, 22 bp, Homo sapiens
cagacaggcaggtgagagctcc

SEQ ID NO: 7236885 - DNA, 22 bp, Homo sapiens
cagacaggaattctggcgtggt

SEQ ID NO: 7236886 - DNA, 22 bp, Homo sapiens
cagacaggagactggatcatgg

SEQ ID NO: 7236887 - DNA, 22 bp, Homo sapiens
gggagcactgagaggcaggtag

SEQ ID NO: 7236888 - DNA, 22 bp, Homo sapiens
cagacagggacctcgctccaga

SEQ ID NO: 7236889 - DNA, 17 bp, Homo sapiens
cagacaggctgtcaccc

SEQ ID NO: 7236890 - DNA, 22 bp, Homo sapiens
cagacaggggtaaccttcctca

SEQ ID NO: 7236891 - DNA, 22 bp, Homo sapiens
cagacagggccctgtgatggta

SEQ ID NO: 7236892 - DNA, 22 bp, Homo sapiens
gggacagaggcaaactagcaga

SEQ ID NO: 7236893 - DNA, 22 bp, Homo sapiens
gggacagacccatgggccaggt

SEQ ID NO: 7236894 - DNA, 22 bp, Homo sapiens
gggacagaaggaagtgagcaca

SEQ ID NO: 7236895 - DNA, 22 bp, Homo sapiens
gggaaaaataatgcacagatat

SEQ ID NO: 7236896 - DNA, 22 bp, Homo sapiens
cagaaggtttgaaagatgtctt

SEQ ID NO: 7236897 - DNA, 22 bp, Homo sapiens
cagaagtaagattactgtgaga

SEQ ID NO: 7236898 - DNA, 22 bp, Homo sapiens
cagaagtaagattactgtgagt

SEQ ID NO: 7236899 - DNA, 21 bp, Homo sapiens
cagaagtaagggtaacttctc

SEQ ID NO: 7236900 - DNA, 22 bp, Homo sapiens
cagcaatggcaggcggagagtg

SEQ ID NO: 7236901 - DNA, 22 bp, Homo sapiens
ggtggggctgcaagcagttcgg

SEQ ID NO: 7236902 - DNA, 22 bp, Homo sapiens
ggtggggctcagcaatctgtgt

SEQ ID NO: 7236903 - DNA, 22 bp, Homo sapiens
cagtcctggggaccaggctgag

SEQ ID NO: 7236904 - DNA, 22 bp, Homo sapiens
cagtcctgggcaggtcaggcca

SEQ ID NO: 7236905 - DNA, 22 bp, Homo sapiens
tacatgtgttctgtttcaagtt

SEQ ID NO: 7236906 - DNA, 22 bp, Homo sapiens
tacatgtgggttaaaaacactc

SEQ ID NO: 7236907 - DNA, 22 bp, Homo sapiens
tacatgtggtagggagggcagt

SEQ ID NO: 7236908 - DNA, 17 bp, Homo sapiens
tacatgtgtatctgatt

SEQ ID NO: 7236909 - DNA, 22 bp, Homo sapiens
tatgtttttcaagtgcacacta

SEQ ID NO: 7236910 - DNA, 22 bp, Homo sapiens
tatgtttttcagacgtcctaca

SEQ ID NO: 7236911 - DNA, 22 bp, Homo sapiens
tatgtgtcctaagcaatcatcc

SEQ ID NO: 7236912 - DNA, 22 bp, Homo sapiens
tatgtgtcccttggtgtagcaa

SEQ ID NO: 7236913 - DNA, 22 bp, Homo sapiens
tatgtgtccctgctactcaaca

SEQ ID NO: 7236914 - DNA, 22 bp, Homo sapiens
tatgtgtcaaaccattcatctg

SEQ ID NO: 7236915 - DNA, 22 bp, Homo sapiens
tatgtgtccctgctactcaaca

SEQ ID NO: 7236916 - DNA, 22 bp, Homo sapiens
tatgtgtcaaaccattcatctg

SEQ ID NO: 7236917 - DNA, 22 bp, Homo sapiens
tatgttttaggaattaattgtt

SEQ ID NO: 7236918 - DNA, 22 bp, Homo sapiens
tatgtttttaagagaatgcatt

SEQ ID NO: 7236919 - DNA, 22 bp, Homo sapiens
tcagggcattcaagaggcctgg

SEQ ID NO: 7236920 - DNA, 22 bp, Homo sapiens
tcagggcatgtatgtttcttta

SEQ ID NO: 7236921 - DNA, 20 bp, Homo sapiens
tcagggcatgggacagcccc

SEQ ID NO: 7236922 - DNA, 22 bp, Homo sapiens
tcaggtgtaggttgttcagttt

SEQ ID NO: 7236923 - DNA, 22 bp, Homo sapiens
tcaggtgtaggttgttcagttt

SEQ ID NO: 7236924 - DNA, 22 bp, Homo sapiens
tcaggtggtcctaagtgccatc

SEQ ID NO: 7236925 - DNA, 22 bp, Homo sapiens
tcaggtgggtctacaattagtt

SEQ ID NO: 7236926 - DNA, 22 bp, Homo sapiens
tcaggtgggagtagaatgctag

SEQ ID NO: 7236927 - DNA, 22 bp, Homo sapiens
tcaggtgggcagtgggttgagc

SEQ ID NO: 7236928 - DNA, 22 bp, Homo sapiens
tcaggtgggcgttccggtgcgg

SEQ ID NO: 7236929 - DNA, 22 bp, Homo sapiens
tcaggtggctggttgctggcta

SEQ ID NO: 7236930 - DNA, 22 bp, Homo sapiens
tcaggtggcttcggggagtggc

SEQ ID NO: 7236931 - DNA, 22 bp, Homo sapiens
tcaggtggcttggagggggacg

SEQ ID NO: 7236932 - DNA, 22 bp, Homo sapiens
tcaggtgggacctgctaggaca

SEQ ID NO: 7236933 - DNA, 22 bp, Homo sapiens
catccattcattaattctaaag

SEQ ID NO: 7236934 - DNA, 22 bp, Homo sapiens
tctgcctttgctttggctgtca

SEQ ID NO: 7236935 - DNA, 22 bp, Homo sapiens
tctgcctgaaattcacatgtaa

SEQ ID NO: 7236936 - DNA, 22 bp, Homo sapiens
tctgcctgaaccactcttggag

SEQ ID NO: 7236937 - DNA, 22 bp, Homo sapiens
tctcctgggaggacaaggaagg

SEQ ID NO: 7236938 - DNA, 20 bp, Homo sapiens
ccagacagcacctgcctggt

SEQ ID NO: 7236939 - DNA, 22 bp, Homo sapiens
ccagaatttgaactcaggcaat

SEQ ID NO: 7236940 - DNA, 22 bp, Homo sapiens
ccagaattcagaaagggcataa

SEQ ID NO: 7236941 - DNA, 22 bp, Homo sapiens
ccagacagcagttaaaggacat

SEQ ID NO: 7236942 - DNA, 22 bp, Homo sapiens
ccagagcctgctgagccccatt

SEQ ID NO: 7236943 - DNA, 22 bp, Homo sapiens
ccagacaggggctgttcctgct

SEQ ID NO: 7236944 - DNA, 22 bp, Homo sapiens
ccagacaggaacacacatctcc

SEQ ID NO: 7236945 - DNA, 22 bp, Homo sapiens
tcctggtgaatgactttttatt

SEQ ID NO: 7236946 - DNA, 22 bp, Homo sapiens
tcctggtgctgacacccatagc

SEQ ID NO: 7236947 - DNA, 22 bp, Homo sapiens
tcctggtgcctggagctctcca

SEQ ID NO: 7236948 - DNA, 22 bp, Homo sapiens
tcctggtgatcaaaattcattt

SEQ ID NO: 7236949 - DNA, 22 bp, Homo sapiens
tcctggtgaggctagaagtgtc

SEQ ID NO: 7236950 - DNA, 22 bp, Homo sapiens
tcctggtgaggactccaagata

SEQ ID NO: 7236951 - DNA, 19 bp, Homo sapiens
tcctggtgaccctgaaatt

SEQ ID NO: 7236952 - DNA, 23 bp, Homo sapiens
tcctggtgacatgcctgagcatc

SEQ ID NO: 7236953 - DNA, 22 bp, Homo sapiens
tcctggtggatagaagccaagg

SEQ ID NO: 7236954 - DNA, 20 bp, Homo sapiens
tcctggtggatactgcttaa

SEQ ID NO: 7236955 - DNA, 19 bp, Homo sapiens
tcctggtgcttgacactga

SEQ ID NO: 7236956 - DNA, 22 bp, Homo sapiens
tcctggtgcttgtatttgaagt

SEQ ID NO: 7236957 - DNA, 18 bp, Homo sapiens
tcctggtggagaagtggt

SEQ ID NO: 7236958 - DNA, 22 bp, Homo sapiens
taaagtgaagttcagaatggct

SEQ ID NO: 7236959 - DNA, 22 bp, Homo sapiens
caggagactcagcatccaggat

SEQ ID NO: 7236960 - DNA, 22 bp, Homo sapiens
taaatgtataggcactaaacct

SEQ ID NO: 7236961 - DNA, 22 bp, Homo sapiens
caggaggattgcttgaggccag

SEQ ID NO: 7236962 - DNA, 22 bp, Homo sapiens
caggacagttggcatctgctgc

SEQ ID NO: 7236963 - DNA, 22 bp, Homo sapiens
taaaatgacttcctccaacatc

SEQ ID NO: 7236964 - DNA, 22 bp, Homo sapiens
caggaattcatagcattgttct

SEQ ID NO: 7236965 - DNA, 22 bp, Homo sapiens
caggacagtataggctttagga

SEQ ID NO: 7236966 - DNA, 22 bp, Homo sapiens
caggacagtgcaggtccatcct

SEQ ID NO: 7236967 - DNA, 22 bp, Homo sapiens
tacaaatggttgaatggatgaa

SEQ ID NO: 7236968 - DNA, 22 bp, Homo sapiens
tacaaatgcctgacacacagat

SEQ ID NO: 7236969 - DNA, 22 bp, Homo sapiens
tacaagttgcagaaagttgttt

SEQ ID NO: 7236970 - DNA, 22 bp, Homo sapiens
tacatgtgcacgtgtgactttg

SEQ ID NO: 7236971 - DNA, 22 bp, Homo sapiens
tacatgtgatcagaaagtgaaa

SEQ ID NO: 7236972 - DNA, 22 bp, Homo sapiens
tacatgtggccagaaatttgag

SEQ ID NO: 7236973 - DNA, 22 bp, Homo sapiens
tacatgtggagttttctagtca

SEQ ID NO: 7236974 - DNA, 22 bp, Homo sapiens
tacatgtgctgggttcttggcc

SEQ ID NO: 7236975 - DNA, 22 bp, Homo sapiens
tacatgtgctatttgttttgta

SEQ ID NO: 7236976 - DNA, 22 bp, Homo sapiens
tacatgtggagataactgaagc

SEQ ID NO: 7236977 - DNA, 22 bp, Homo sapiens
tacaggtggtaaaaatattgtt

SEQ ID NO: 7236978 - DNA, 22 bp, Homo sapiens
tacaggtggatcactagtatag

SEQ ID NO: 7236979 - DNA, 22 bp, Homo sapiens
tacaggtgctctacagacagga

SEQ ID NO: 7236980 - DNA, 22 bp, Homo sapiens
gtggcagggtgctcatcatgca

SEQ ID NO: 7236981 - DNA, 22 bp, Homo sapiens
cagctgctgcccttggctgcag

SEQ ID NO: 7236982 - DNA, 22 bp, Homo sapiens
cagctgctgatggcctgacaga

SEQ ID NO: 7236983 - DNA, 22 bp, Homo sapiens
gtgggtggggagctctctggag

SEQ ID NO: 7236984 - DNA, 22 bp, Homo sapiens
caggaagaggacaggcttcccc

SEQ ID NO: 7236985 - DNA, 22 bp, Homo sapiens
gtttattgggtattgtggagcc

SEQ ID NO: 7236986 - DNA, 22 bp, Homo sapiens
gtttattgataaaagctggaca

SEQ ID NO: 7236987 - DNA, 22 bp, Homo sapiens
gtgttttagtgctgctgagctg

SEQ ID NO: 7236988 - DNA, 22 bp, Homo sapiens
gtgttttattggtgcagtcaga

SEQ ID NO: 7236989 - DNA, 22 bp, Homo sapiens
gttacaatgtccttacatgaaa

SEQ ID NO: 7236990 - DNA, 22 bp, Homo sapiens
gttattgaggtggagtctcact

SEQ ID NO: 7236991 - DNA, 22 bp, Homo sapiens
gttattgagacatagagttatg

SEQ ID NO: 7236992 - DNA, 22 bp, Homo sapiens
gttattgactctcttgtggctt

SEQ ID NO: 7236993 - DNA, 21 bp, Homo sapiens
gttattgacctccaggctggc

SEQ ID NO: 7236994 - DNA, 22 bp, Homo sapiens
gttattgacatgtattaagcac

SEQ ID NO: 7236995 - DNA, 22 bp, Homo sapiens
tgtctttagccacttgcctctt

SEQ ID NO: 7236996 - DNA, 22 bp, Homo sapiens
tgtctggtgggttgacaggcag

SEQ ID NO: 7236997 - DNA, 22 bp, Homo sapiens
tgtgggggtacacgtacacatg

SEQ ID NO: 7236998 - DNA, 22 bp, Homo sapiens
tgtggggctgtggtgttcttct

SEQ ID NO: 7236999 - DNA, 22 bp, Homo sapiens
tgtggggcttacaaaggcagat

SEQ ID NO: 7237000 - DNA, 22 bp, Homo sapiens
tgtggggcagctagccggcctg

SEQ ID NO: 7237001 - DNA, 22 bp, Homo sapiens
tgtggggcctcgtgctagctgg

SEQ ID NO: 7237002 - DNA, 22 bp, Homo sapiens
tgtggggccaaagcccagccac

SEQ ID NO: 7237003 - DNA, 22 bp, Homo sapiens
tgtggggctccctggcagcctg

SEQ ID NO: 7237004 - DNA, 22 bp, Homo sapiens
tgtggggctgtcaggcaactgg

SEQ ID NO: 7237005 - DNA, 22 bp, Homo sapiens
tgtaccaaaaatgtgtcagact

SEQ ID NO: 7237006 - DNA, 22 bp, Homo sapiens
tgtagtaagtgcgcaataaata

SEQ ID NO: 7237007 - DNA, 22 bp, Homo sapiens
tgtctcagagtgttgtattaga

SEQ ID NO: 7237008 - DNA, 22 bp, Homo sapiens
tgtcctcatcttttccagaaat

SEQ ID NO: 7237009 - DNA, 22 bp, Homo sapiens
tgtcctcatcctccagtctgtc

SEQ ID NO: 7237010 - DNA, 23 bp, Homo sapiens
tggagctgacagtcagagggagg

SEQ ID NO: 7237011 - DNA, 22 bp, Homo sapiens
tggagctgagaagtggagctct

SEQ ID NO: 7237012 - DNA, 22 bp, Homo sapiens
ctggcaagaaatatatatctta

SEQ ID NO: 7237013 - DNA, 22 bp, Homo sapiens
ctgctttagagctgagcctcag

SEQ ID NO: 7237014 - DNA, 22 bp, Homo sapiens
ctgctttaggtggaatgttcta

SEQ ID NO: 7237015 - DNA, 22 bp, Homo sapiens
ctgctttgaggggctctgtata

SEQ ID NO: 7237016 - DNA, 22 bp, Homo sapiens
ctgcagcaggaggctcctgcag

SEQ ID NO: 7237017 - DNA, 22 bp, Homo sapiens
ctgcagattggcctgatgttca

SEQ ID NO: 7237018 - DNA, 22 bp, Homo sapiens
ctgcagatggtattgttctggt

SEQ ID NO: 7237019 - DNA, 22 bp, Homo sapiens
ttttgttttcttagaaacctgg

SEQ ID NO: 7237020 - DNA, 23 bp, Homo sapiens
ctctggttagatatcatatgctg

SEQ ID NO: 7237021 - DNA, 22 bp, Homo sapiens
ctctggttcgtggtagatttta

SEQ ID NO: 7237022 - DNA, 22 bp, Homo sapiens
ctctggttcagggctccctggc

SEQ ID NO: 7237023 - DNA, 22 bp, Homo sapiens
ctctggttcaaagtagtataat

SEQ ID NO: 7237024 - DNA, 22 bp, Homo sapiens
ctctggtcatttggaagagcat

SEQ ID NO: 7237025 - DNA, 21 bp, Homo sapiens
ttttattgatgaatggccact

SEQ ID NO: 7237026 - DNA, 21 bp, Homo sapiens
ttttattgatgaatggccact

SEQ ID NO: 7237027 - DNA, 22 bp, Homo sapiens
ctgaagaagtctctaggctatt

SEQ ID NO: 7237028 - DNA, 22 bp, Homo sapiens
ctctcctggggagcacacacac

SEQ ID NO: 7237029 - DNA, 23 bp, Homo sapiens
ttttattgatatgtagctgttgt

SEQ ID NO: 7237030 - DNA, 23 bp, Homo sapiens
ttttattgatatgtagctgttgt

SEQ ID NO: 7237031 - DNA, 17 bp, Homo sapiens
tttagaatacaatgttt

SEQ ID NO: 7237032 - DNA, 22 bp, Homo sapiens
tttaaaaaactagtctgagtct

SEQ ID NO: 7237033 - DNA, 22 bp, Homo sapiens
ttgtatttgggtagtatagaga

SEQ ID NO: 7237034 - DNA, 22 bp, Homo sapiens
ctcatcataaccctgtgaggat

SEQ ID NO: 7237035 - DNA, 22 bp, Homo sapiens
ttgggcagggaaaggacaggca

SEQ ID NO: 7237036 - DNA, 22 bp, Homo sapiens
ctatttttctgtaccctaattt

SEQ ID NO: 7237037 - DNA, 22 bp, Homo sapiens
ttgaggaaagagtgcaaagagg

SEQ ID NO: 7237038 - DNA, 22 bp, Homo sapiens
ttgactctggaggtcactgaag

SEQ ID NO: 7237039 - DNA, 22 bp, Homo sapiens
ttccaaaatgccttgatatgat

SEQ ID NO: 7237040 - DNA, 22 bp, Homo sapiens
gactgcttttctagtctaaaat

SEQ ID NO: 7237041 - DNA, 22 bp, Homo sapiens
gactgctttggtttgtaaatgt

SEQ ID NO: 7237042 - DNA, 22 bp, Homo sapiens
gactgctttgaccaatagcaca

SEQ ID NO: 7237043 - DNA, 22 bp, Homo sapiens
gactgctttgacaaatgatacc

SEQ ID NO: 7237044 - DNA, 22 bp, Homo sapiens
gactgctttaaccaagaaagca

SEQ ID NO: 7237045 - DNA, 22 bp, Homo sapiens
gactgcttgagaaggaacaaat

SEQ ID NO: 7237046 - DNA, 22 bp, Homo sapiens
gactgcttctccttggtaggtt

SEQ ID NO: 7237047 - DNA, 22 bp, Homo sapiens
gactgcttccctgggattgctc

SEQ ID NO: 7237048 - DNA, 22 bp, Homo sapiens
gactgcttcccagtaagggttt

SEQ ID NO: 7237049 - DNA, 22 bp, Homo sapiens
gactgcttatatgttaaagata

SEQ ID NO: 7237050 - DNA, 22 bp, Homo sapiens
gactgcttaaatatatgatgtt

SEQ ID NO: 7237051 - DNA, 20 bp, Homo sapiens
gaaggaagggggcaaggtga

SEQ ID NO: 7237052 - DNA, 22 bp, Homo sapiens
gaaggaagtcattagtgcagac

SEQ ID NO: 7237053 - DNA, 19 bp, Homo sapiens
gacaggaaggctaccagta

SEQ ID NO: 7237054 - DNA, 19 bp, Homo sapiens
gacaggacgaagggaagtt

SEQ ID NO: 7237055 - DNA, 22 bp, Homo sapiens
cttgggagtagaggcaggagca

SEQ ID NO: 7237056 - DNA, 22 bp, Homo sapiens
gaacactgacattttcctgact

SEQ ID NO: 7237057 - DNA, 22 bp, Homo sapiens
gaacactgagaaagtcagcttt

SEQ ID NO: 7237058 - DNA, 22 bp, Homo sapiens
gaacactgtttcttcgtgaaca

SEQ ID NO: 7237059 - DNA, 22 bp, Homo sapiens
gaacactggggtatcattgagc

SEQ ID NO: 7237060 - DNA, 22 bp, Homo sapiens
gaacactgctgttgggttctga

SEQ ID NO: 7237061 - DNA, 22 bp, Homo sapiens
gaacactgaggacactgagaat

SEQ ID NO: 7237062 - DNA, 22 bp, Homo sapiens
gaacactgagagagatgggcag

SEQ ID NO: 7237063 - DNA, 22 bp, Homo sapiens
gatcattgaacaggcactggag

SEQ ID NO: 7237064 - DNA, 22 bp, Homo sapiens
gatcaaaagctgggttctaaaa

SEQ ID NO: 7237065 - DNA, 19 bp, Homo sapiens
gatagctgatgaccatcat

SEQ ID NO: 7237066 - DNA, 22 bp, Homo sapiens
gataccagacagggagggagaa

SEQ ID NO: 7237067 - DNA, 22 bp, Homo sapiens
gatgaaatagaattaatttagg

SEQ ID NO: 7237068 - DNA, 22 bp, Homo sapiens
gatgaaattcagaattgagggg

SEQ ID NO: 7237069 - DNA, 22 bp, Homo sapiens
gatgaaatgtgaaagttctggg

SEQ ID NO: 7237070 - DNA, 22 bp, Homo sapiens
gatgaaatgctgagcctgagtt

SEQ ID NO: 7237071 - DNA, 22 bp, Homo sapiens
gatgaaattgttttgatacttt

SEQ ID NO: 7237072 - DNA, 22 bp, Homo sapiens
gatgaaatttgaaaatagtgtt

SEQ ID NO: 7237073 - DNA, 22 bp, Homo sapiens
gatgaaatccagatcacaggtg

SEQ ID NO: 7237074 - DNA, 17 bp, Homo sapiens
gatgaaatgatgcacac

SEQ ID NO: 7237075 - DNA, 22 bp, Homo sapiens
gatgaaatagcaaaggcatttg

SEQ ID NO: 7237076 - DNA, 20 bp, Homo sapiens
gatgaaatcactgggcagcc

SEQ ID NO: 7237077 - DNA, 22 bp, Homo sapiens
gatgacagttctagcatctgaa

SEQ ID NO: 7237078 - DNA, 22 bp, Homo sapiens
gatgaaatttgggcaggttaaa

SEQ ID NO: 7237079 - DNA, 21 bp, Homo sapiens
gatgaagcaatctttctgttg

SEQ ID NO: 7237080 - DNA, 22 bp, Homo sapiens
gataaatggctgaagaaatagt

SEQ ID NO: 7237081 - DNA, 22 bp, Homo sapiens
gagtgtggtatgctctgaggct

SEQ ID NO: 7237082 - DNA, 22 bp, Homo sapiens
gagagttccagtaagtggattc

SEQ ID NO: 7237083 - DNA, 16 bp, Homo sapiens
gagggcagaggcggaa

SEQ ID NO: 7237084 - DNA, 22 bp, Homo sapiens
gagggcagagtctaatgatgca

SEQ ID NO: 7237085 - DNA, 22 bp, Homo sapiens
gagggcaggggtcttgcacggt

SEQ ID NO: 7237086 - DNA, 20 bp, Homo sapiens
gagggcaggcacccatttca

SEQ ID NO: 7237087 - DNA, 22 bp, Homo sapiens
gagggcagtgaattttgaagct

SEQ ID NO: 7237088 - DNA, 22 bp, Homo sapiens
gagggcagtagcctcgtaccct

SEQ ID NO: 7237089 - DNA, 22 bp, Homo sapiens
gaggtggtggtggaggcatagc

SEQ ID NO: 7237090 - DNA, 22 bp, Homo sapiens
gaggtggtcgaggaggggtacc

SEQ ID NO: 7237091 - DNA, 22 bp, Homo sapiens
gaggtgtcagggtagtcatgat

SEQ ID NO: 7237092 - DNA, 22 bp, Homo sapiens
gaggtgtcactattttgcttat

SEQ ID NO: 7237093 - DNA, 22 bp, Homo sapiens
gaggtggtttgtggtgactcat

SEQ ID NO: 7237094 - DNA, 22 bp, Homo sapiens
gaggtggttcaggtagagccca

SEQ ID NO: 7237095 - DNA, 22 bp, Homo sapiens
gaggtgtctggcctttgtagga

SEQ ID NO: 7237096 - DNA, 22 bp, Homo sapiens
gaggtgtctgctgtgttcaaag

SEQ ID NO: 7237097 - DNA, 22 bp, Homo sapiens
gaggtgtctgagtggggacctg

SEQ ID NO: 7237098 - DNA, 22 bp, Homo sapiens
gaggtgtctagatctaccagta

SEQ ID NO: 7237099 - DNA, 22 bp, Homo sapiens
gaggtgtcgtagattattctca

SEQ ID NO: 7237100 - DNA, 22 bp, Homo sapiens
gaggtgtcctcagccaactctg

SEQ ID NO: 7237101 - DNA, 22 bp, Homo sapiens
gaggtgtcatttagttaatcag

SEQ ID NO: 7237102 - DNA, 22 bp, Homo sapiens
gaggtgtcatgagggcctgctc

SEQ ID NO: 7237103 - DNA, 22 bp, Homo sapiens
gaggtgtcatcaggcagctctg

SEQ ID NO: 7237104 - DNA, 22 bp, Homo sapiens
gaggtgtcctagaagtattcag

SEQ ID NO: 7237105 - DNA, 22 bp, Homo sapiens
gaggtgtccctgaccctttgca

SEQ ID NO: 7237106 - DNA, 22 bp, Homo sapiens
gaggtgtcccgcagtccccaag

SEQ ID NO: 7237107 - DNA, 22 bp, Homo sapiens
gcaattacagtggcatgtattt

SEQ ID NO: 7237108 - DNA, 22 bp, Homo sapiens
gattttgaatattaaagaagag

SEQ ID NO: 7237109 - DNA, 22 bp, Homo sapiens
gattttatatggcatactgtgg

SEQ ID NO: 7237110 - DNA, 22 bp, Homo sapiens
gattttatagtcaggaaaaaga

SEQ ID NO: 7237111 - DNA, 22 bp, Homo sapiens
gattttatctttgtgtgcagta

SEQ ID NO: 7237112 - DNA, 22 bp, Homo sapiens
gattttattagcccaaactttg

SEQ ID NO: 7237113 - DNA, 22 bp, Homo sapiens
gattttatcgtcatccttctgg

SEQ ID NO: 7237114 - DNA, 22 bp, Homo sapiens
gcagagccaggagagacccttg

SEQ ID NO: 7237115 - DNA, 22 bp, Homo sapiens
gcagagccaggctggggcaggt

SEQ ID NO: 7237116 - DNA, 22 bp, Homo sapiens
gcagagcccctcaagccagcct

SEQ ID NO: 7237117 - DNA, 22 bp, Homo sapiens
gatggaatgtcacttctgtggt

SEQ ID NO: 7237118 - DNA, 22 bp, Homo sapiens
gatgtgtctggctcccctgcaa

SEQ ID NO: 7237119 - DNA, 22 bp, Homo sapiens
gatgtgtctggctcccctgcaa

SEQ ID NO: 7237120 - DNA, 22 bp, Homo sapiens
gatgtgtctccgtttcaaggca

SEQ ID NO: 7237121 - DNA, 22 bp, Homo sapiens
gatgtgtctccatacaccaccc

SEQ ID NO: 7237122 - DNA, 22 bp, Homo sapiens
gatgtgtctccgtttcaaggca

SEQ ID NO: 7237123 - DNA, 22 bp, Homo sapiens
gatgtgtctccatacaccaccc

SEQ ID NO: 7237124 - DNA, 22 bp, Homo sapiens
gatgtgtctattcaacatgaaa

SEQ ID NO: 7237125 - DNA, 22 bp, Homo sapiens
gatgtgtccttttctccatcca

SEQ ID NO: 7237126 - DNA, 22 bp, Homo sapiens
gatgtgtctattcaacatgaaa

SEQ ID NO: 7237127 - DNA, 22 bp, Homo sapiens
gatgtgtccttttctccatcca

SEQ ID NO: 7237128 - DNA, 20 bp, Homo sapiens
gatgtgtcctcagcagtggt

SEQ ID NO: 7237129 - DNA, 20 bp, Homo sapiens
gatgtgtcctcagcagtggt

SEQ ID NO: 7237130 - DNA, 22 bp, Homo sapiens
gatgtgtcctagtacgggtggg

SEQ ID NO: 7237131 - DNA, 22 bp, Homo sapiens
gatgtgtccctttcaactcaga

SEQ ID NO: 7237132 - DNA, 22 bp, Homo sapiens
gatgtgtcctagtacgggtggg

SEQ ID NO: 7237133 - DNA, 22 bp, Homo sapiens
gatgtgtccctttcaactcaga

SEQ ID NO: 7237134 - DNA, 22 bp, Homo sapiens
gatgtgtccccagaggattgaa

SEQ ID NO: 7237135 - DNA, 22 bp, Homo sapiens
gatgtgtccccagaggattgaa

SEQ ID NO: 7237136 - DNA, 22 bp, Homo sapiens
gattgtggaagtcagtggttct

SEQ ID NO: 7237137 - DNA, 22 bp, Homo sapiens
gattgtctttattttatggcta

SEQ ID NO: 7237138 - DNA, 22 bp, Homo sapiens
gatttacagatctaagggtcac

SEQ ID NO: 7237139 - DNA, 22 bp, Homo sapiens
gatgttttttaggatctcagca

SEQ ID NO: 7237140 - DNA, 22 bp, Homo sapiens
gatgttttctggaaaatgaatg

SEQ ID NO: 7237141 - DNA, 22 bp, Homo sapiens
gatgttttaggtccctgtagct

SEQ ID NO: 7237142 - DNA, 22 bp, Homo sapiens
gatgtgtttccaggatttgttt

SEQ ID NO: 7237143 - DNA, 22 bp, Homo sapiens
gattctttactcagattttgtt

SEQ ID NO: 7237144 - DNA, 22 bp, Homo sapiens
gattctttggcctttattgaca

SEQ ID NO: 7237145 - DNA, 22 bp, Homo sapiens
gattatataatggaagctcttg

SEQ ID NO: 7237146 - DNA, 20 bp, Homo sapiens
gcagggcaagggatatgaaa

SEQ ID NO: 7237147 - DNA, 22 bp, Homo sapiens
gcagggcaaatgtggaaaggag

SEQ ID NO: 7237148 - DNA, 22 bp, Homo sapiens
gcagggcacaaggacgcacagg

SEQ ID NO: 7237149 - DNA, 22 bp, Homo sapiens
gcagggcaatgatcccgagagg

SEQ ID NO: 7237150 - DNA, 22 bp, Homo sapiens
gcagggcacacaagaatgataa

SEQ ID NO: 7237151 - DNA, 22 bp, Homo sapiens
gcagggcagagggagaatctct

SEQ ID NO: 7237152 - DNA, 22 bp, Homo sapiens
gcagggcagacctccagcctat

SEQ ID NO: 7237153 - DNA, 22 bp, Homo sapiens
gcagggcacagacagtgccaag

SEQ ID NO: 7237154 - DNA, 22 bp, Homo sapiens
gcagggcagaaggtgctgagga

SEQ ID NO: 7237155 - DNA, 22 bp, Homo sapiens
gcagggcagccacaggccccct

SEQ ID NO: 7237156 - DNA, 22 bp, Homo sapiens
gcagctgacatctggctgggcc

SEQ ID NO: 7237157 - DNA, 22 bp, Homo sapiens
gcaggacaggcgttggtccagt

SEQ ID NO: 7237158 - DNA, 20 bp, Homo sapiens
gcagagcctcactgcaaggg

SEQ ID NO: 7237159 - DNA, 21 bp, Homo sapiens
gcagagccggggcgagaaggc

SEQ ID NO: 7237160 - DNA, 22 bp, Homo sapiens
gcagagcctgtgtctgagcaaa

SEQ ID NO: 7237161 - DNA, 22 bp, Homo sapiens
gcagagcctgggggtctgcgga

SEQ ID NO: 7237162 - DNA, 23 bp, Homo sapiens
gcaggtggttcgaacagaagttt

SEQ ID NO: 7237163 - DNA, 22 bp, Homo sapiens
gcaggtggttaaggtcccatgt

SEQ ID NO: 7237164 - DNA, 22 bp, Homo sapiens
gcaggtggtggcgcgcgccctg

SEQ ID NO: 7237165 - DNA, 22 bp, Homo sapiens
gcaggtggtccccgtggagtgg

SEQ ID NO: 7237166 - DNA, 22 bp, Homo sapiens
gcaggtggtggggctatgatct

SEQ ID NO: 7237167 - DNA, 22 bp, Homo sapiens
gcaggtggtgggggagccgttc

SEQ ID NO: 7237168 - DNA, 22 bp, Homo sapiens
gcaggtggtcactcatccccag

SEQ ID NO: 7237169 - DNA, 22 bp, Homo sapiens
gcaggtgggggtcggtgcatct

SEQ ID NO: 7237170 - DNA, 22 bp, Homo sapiens
gcaggtgggggagaagttgtga

SEQ ID NO: 7237171 - DNA, 22 bp, Homo sapiens
gcaggtggggctgctaccagaa

SEQ ID NO: 7237172 - DNA, 16 bp, Homo sapiens
gcaggtggggcgcgca

SEQ ID NO: 7237173 - DNA, 22 bp, Homo sapiens
gcaggtgggagccgctgcctga

SEQ ID NO: 7237174 - DNA, 22 bp, Homo sapiens
gcaggtggcagaggtgggatct

SEQ ID NO: 7237175 - DNA, 22 bp, Homo sapiens
gcaggtggagcagtagtctggt

SEQ ID NO: 7237176 - DNA, 22 bp, Homo sapiens
gcaggtggattatcagaagtgc

SEQ ID NO: 7237177 - DNA, 22 bp, Homo sapiens
gcaggtgtgctgaattacgtga

SEQ ID NO: 7237178 - DNA, 22 bp, Homo sapiens
gcaggtgtgaatgtgaattaag

SEQ ID NO: 7237179 - DNA, 22 bp, Homo sapiens
gcaggtgtgaatgtgaattaag

SEQ ID NO: 7237180 - DNA, 19 bp, Homo sapiens
gcaggtgtgaatccgtaga

SEQ ID NO: 7237181 - DNA, 22 bp, Homo sapiens
gcaggtgtcttcatggaactct

SEQ ID NO: 7237182 - DNA, 22 bp, Homo sapiens
gcaggtgtcttcagcaggatga

SEQ ID NO: 7237183 - DNA, 22 bp, Homo sapiens
gcaggtgtctgactgccttctt

SEQ ID NO: 7237184 - DNA, 22 bp, Homo sapiens
gcaggtgtcctgggctggcagt

SEQ ID NO: 7237185 - DNA, 22 bp, Homo sapiens
gcaggtgtcagtccccaaggtg

SEQ ID NO: 7237186 - DNA, 22 bp, Homo sapiens
gcatgtgttggtttatgcatgt

SEQ ID NO: 7237187 - DNA, 22 bp, Homo sapiens
gcatgtgttcttgaaaggccac

SEQ ID NO: 7237188 - DNA, 22 bp, Homo sapiens
gcatgtgttattttatgtatga

SEQ ID NO: 7237189 - DNA, 22 bp, Homo sapiens
gcatgtgttatttctctgtggg

SEQ ID NO: 7237190 - DNA, 22 bp, Homo sapiens
gcatgtgttagagtgtgcatgc

SEQ ID NO: 7237191 - DNA, 22 bp, Homo sapiens
gcatgtgtgtcactttcctgcc

SEQ ID NO: 7237192 - DNA, 21 bp, Homo sapiens
gcatgtgtggtgtgctccaca

SEQ ID NO: 7237193 - DNA, 21 bp, Homo sapiens
gcatgtgtgggactggatcct

SEQ ID NO: 7237194 - DNA, 22 bp, Homo sapiens
gcatgtgtggaggagatgtgct

SEQ ID NO: 7237195 - DNA, 22 bp, Homo sapiens
gcatgtgtgagaccttttagca

SEQ ID NO: 7237196 - DNA, 22 bp, Homo sapiens
gcatgtgtctttatagcagcat

SEQ ID NO: 7237197 - DNA, 22 bp, Homo sapiens
gcatgtgtctccccagtggagg

SEQ ID NO: 7237198 - DNA, 22 bp, Homo sapiens
gcatgtgtccctcagtctgtgc

SEQ ID NO: 7237199 - DNA, 22 bp, Homo sapiens
gcatgtgtcatctgcctttcgt

SEQ ID NO: 7237200 - DNA, 22 bp, Homo sapiens
gcatgtgtatggtaggaatatt

SEQ ID NO: 7237201 - DNA, 20 bp, Homo sapiens
gcatgtgtatggaaggggga

SEQ ID NO: 7237202 - DNA, 15 bp, Homo sapiens
gcatgtgtaataggc

SEQ ID NO: 7237203 - DNA, 22 bp, Homo sapiens
gctctgagcccccagaagcaga

SEQ ID NO: 7237204 - DNA, 22 bp, Homo sapiens
gctctgaggagccaagaatgtg

SEQ ID NO: 7237205 - DNA, 22 bp, Homo sapiens
gctctgttgaagtagaatagac

SEQ ID NO: 7237206 - DNA, 22 bp, Homo sapiens
gctgctctgttaattgctgtaa

SEQ ID NO: 7237207 - DNA, 22 bp, Homo sapiens
gccggggctggggagagacatg

SEQ ID NO: 7237208 - DNA, 22 bp, Homo sapiens
ggaggccagcctgaggctgagg

SEQ ID NO: 7237209 - DNA, 22 bp, Homo sapiens
ggagctctcctgatgtgaagat

SEQ ID NO: 7237210 - DNA, 22 bp, Homo sapiens
gcttaattctggctcagtttcc

SEQ ID NO: 7237211 - DNA, 22 bp, Homo sapiens
gcttcagattcttttcatgtct

SEQ ID NO: 7237212 - DNA, 22 bp, Homo sapiens
gcttcagattcctcttctgtaa

SEQ ID NO: 7237213 - DNA, 22 bp, Homo sapiens
gcttcagactgtgcttctgttg

SEQ ID NO: 7237214 - DNA, 22 bp, Homo sapiens
gcttcagactggagcagaggaa

SEQ ID NO: 7237215 - DNA, 22 bp, Homo sapiens
gcttcagaagttgggctctgac

SEQ ID NO: 7237216 - DNA, 20 bp, Homo sapiens
gcttcagaacctgggtgctg

SEQ ID NO: 7237217 - DNA, 22 bp, Homo sapiens
gcttctaattttttacagaata

SEQ ID NO: 7237218 - DNA, 22 bp, Homo sapiens
gcttctaatttcctttgagatt

SEQ ID NO: 7237219 - DNA, 22 bp, Homo sapiens
ggaagaaaagcttccagcgcct

SEQ ID NO: 7237220 - DNA, 22 bp, Homo sapiens
ggaagaaaatgggcaacaggtg

SEQ ID NO: 7237221 - DNA, 18 bp, Homo sapiens
ggaagaaaaggaactcag

SEQ ID NO: 7237222 - DNA, 18 bp, Homo sapiens
ggaagaaaaggaactcag

SEQ ID NO: 7237223 - DNA, 17 bp, Homo sapiens
ggaagaaaaggatcatc

SEQ ID NO: 7237224 - DNA, 22 bp, Homo sapiens
ggaagaaaatgggcaacaggtg

SEQ ID NO: 7237225 - DNA, 22 bp, Homo sapiens
ggaagaaagacatttattttga

SEQ ID NO: 7237226 - DNA, 22 bp, Homo sapiens
ggaagaaaggtggacaacaggt

SEQ ID NO: 7237227 - DNA, 22 bp, Homo sapiens
ggaagaaagcacacaaacttga

SEQ ID NO: 7237228 - DNA, 22 bp, Homo sapiens
ggaagaaatctggttaagagat

SEQ ID NO: 7237229 - DNA, 22 bp, Homo sapiens
ggaagaaagtagaaaaccgtgg

SEQ ID NO: 7237230 - DNA, 22 bp, Homo sapiens
ggaagaaaggtggacaacaggt

SEQ ID NO: 7237231 - DNA, 22 bp, Homo sapiens
ggaagaaatgctcttctatgcg

SEQ ID NO: 7237232 - DNA, 22 bp, Homo sapiens
ggaaaacagcgattggtatcat

SEQ ID NO: 7237233 - DNA, 22 bp, Homo sapiens
ggcacacagcggaatttgctct

SEQ ID NO: 7237234 - DNA, 19 bp, Homo sapiens
ggcagacacagttgacatg

SEQ ID NO: 7237235 - DNA, 22 bp, Homo sapiens
ggcaggtgagttcattatctgc

SEQ ID NO: 7237236 - DNA, 22 bp, Homo sapiens
ggcaggtgaggcatgtgcctgg

SEQ ID NO: 7237237 - DNA, 17 bp, Homo sapiens
ggcaggtgcggggccgc

SEQ ID NO: 7237238 - DNA, 22 bp, Homo sapiens
ggcaggtgctaagagaggtaaa

SEQ ID NO: 7237239 - DNA, 22 bp, Homo sapiens
ggcaggtgctcaaaaatatttg

SEQ ID NO: 7237240 - DNA, 20 bp, Homo sapiens
ggcaggtgctcgcttggtct

SEQ ID NO: 7237241 - DNA, 22 bp, Homo sapiens
ggcaggtgctctgtgggcctgg

SEQ ID NO: 7237242 - DNA, 22 bp, Homo sapiens
gggctactgagctggaactggg

SEQ ID NO: 7237243 - DNA, 22 bp, Homo sapiens
gggatctgagtaggcagaagct

SEQ ID NO: 7237244 - DNA, 22 bp, Homo sapiens
gggctctgggtcgtgtctccat

SEQ ID NO: 7237245 - DNA, 20 bp, Homo sapiens
gggctctgtaaggttgaaag

SEQ ID NO: 7237246 - DNA, 22 bp, Homo sapiens
gggctctggtgctattgacgaa

SEQ ID NO: 7237247 - DNA, 22 bp, Homo sapiens
gggctctggtgccttcacagaa

SEQ ID NO: 7237248 - DNA, 22 bp, Homo sapiens
gggctctggtcctgaactgaag

SEQ ID NO: 7237249 - DNA, 22 bp, Homo sapiens
gggctctggtacttcctggctc

SEQ ID NO: 7237250 - DNA, 22 bp, Homo sapiens
gggctctgtgcaccccagcacc

SEQ ID NO: 7237251 - DNA, 22 bp, Homo sapiens
gggctctgtccattccttcata

SEQ ID NO: 7237252 - DNA, 22 bp, Homo sapiens
gggctctgtggatgtgagagct

SEQ ID NO: 7237253 - DNA, 22 bp, Homo sapiens
gggctctgtggttgtgctttgt

SEQ ID NO: 7237254 - DNA, 22 bp, Homo sapiens
gggctctgtggcttccttctta

SEQ ID NO: 7237255 - DNA, 22 bp, Homo sapiens
gggctctgtgttctagctctcg

SEQ ID NO: 7237256 - DNA, 22 bp, Homo sapiens
gggggctccaggcgagaatgtg

SEQ ID NO: 7237257 - DNA, 22 bp, Homo sapiens
ggctgctgaacaagggaaccct

SEQ ID NO: 7237258 - DNA, 22 bp, Homo sapiens
ggctcgtgtccagtatagaaag

SEQ ID NO: 7237259 - DNA, 22 bp, Homo sapiens
gggaaatctcgtcctctattta

SEQ ID NO: 7237260 - DNA, 22 bp, Homo sapiens
gggaacagagtgccagactgac

SEQ ID NO: 7237261 - DNA, 22 bp, Homo sapiens
ggcaggtggaagttggcagagc

SEQ ID NO: 7237262 - DNA, 22 bp, Homo sapiens
ggcaggtggaaggtctccattc

SEQ ID NO: 7237263 - DNA, 22 bp, Homo sapiens
ggcaggtgcttgtcgaaggcct

SEQ ID NO: 7237264 - DNA, 20 bp, Homo sapiens
ggcaggtgctgtcccctcct

SEQ ID NO: 7237265 - DNA, 22 bp, Homo sapiens
ggcaggtgctgggagcatctca

SEQ ID NO: 7237266 - DNA, 22 bp, Homo sapiens
ggccagaagttggaaaagagcc

SEQ ID NO: 7237267 - DNA, 22 bp, Homo sapiens
taaatgaaagggtttaatttat

SEQ ID NO: 7237268 - DNA, 22 bp, Homo sapiens
taaatgaagctcatgggccaca

SEQ ID NO: 7237269 - DNA, 22 bp, Homo sapiens
taaatgaagaaatggagattgt

SEQ ID NO: 7237270 - DNA, 22 bp, Homo sapiens
taaatgagggctgacatgattg

SEQ ID NO: 7237271 - DNA, 22 bp, Homo sapiens
taacactgaaaatgatgcatgt

SEQ ID NO: 7237272 - DNA, 22 bp, Homo sapiens
taacactggagagttggttgtg

SEQ ID NO: 7237273 - DNA, 22 bp, Homo sapiens
taacactgcttcattttggaga

SEQ ID NO: 7237274 - DNA, 22 bp, Homo sapiens
taacactgccatgctggagtca

SEQ ID NO: 7237275 - DNA, 22 bp, Homo sapiens
taacactgatttgttctcaggg

SEQ ID NO: 7237276 - DNA, 22 bp, Homo sapiens
taacactggcttttgctgaggc

SEQ ID NO: 7237277 - DNA, 22 bp, Homo sapiens
taacactggtatttcatttagt

SEQ ID NO: 7237278 - DNA, 22 bp, Homo sapiens
taacactggttatccctgtgca

SEQ ID NO: 7237279 - DNA, 22 bp, Homo sapiens
taacactgtaaacctagatgtt

SEQ ID NO: 7237280 - DNA, 22 bp, Homo sapiens
taacactgtgtctgccatatcc

SEQ ID NO: 7237281 - DNA, 22 bp, Homo sapiens
taacactgtggtgttctttgtc

SEQ ID NO: 7237282 - DNA, 22 bp, Homo sapiens
taacactgtgcccagagtccca

SEQ ID NO: 7237283 - DNA, 22 bp, Homo sapiens
taacactgtccaaagaattcca

SEQ ID NO: 7237284 - DNA, 22 bp, Homo sapiens
taaagcaggccacatatgtgat

SEQ ID NO: 7237285 - DNA, 22 bp, Homo sapiens
gtttaataatgttgaattacta

SEQ ID NO: 7237286 - DNA, 22 bp, Homo sapiens
taaaacacctgtagtgtctgcc

SEQ ID NO: 7237287 - DNA, 22 bp, Homo sapiens
taaaacacataaactctctatt

SEQ ID NO: 7237288 - DNA, 22 bp, Homo sapiens
gtggtgcaggaagcatctggct

SEQ ID NO: 7237289 - DNA, 22 bp, Homo sapiens
gtggtatctgtctcccccactg

SEQ ID NO: 7237290 - DNA, 22 bp, Homo sapiens
gtgtggggtcttctcttggcct

SEQ ID NO: 7237291 - DNA, 22 bp, Homo sapiens
gtgtgggggcagctctgatatg

SEQ ID NO: 7237292 - DNA, 22 bp, Homo sapiens
gtgtggggccaggatcagggct

SEQ ID NO: 7237293 - DNA, 22 bp, Homo sapiens
gtgtcctcttattgctcttggc

SEQ ID NO: 7237294 - DNA, 22 bp, Homo sapiens
gtgtccttatgcataccagagt

SEQ ID NO: 7237295 - DNA, 22 bp, Homo sapiens
gtgtcatggggtttgttataca

SEQ ID NO: 7237296 - DNA, 22 bp, Homo sapiens
gtgtcaggggcagccaggaaat

SEQ ID NO: 7237297 - DNA, 22 bp, Homo sapiens
gtgtcaggccctgcattatgtg

SEQ ID NO: 7237298 - DNA, 22 bp, Homo sapiens
gtgtcaggcagtcagcatggag

SEQ ID NO: 7237299 - DNA, 19 bp, Homo sapiens
gtgtcaggatgtgcagggg

SEQ ID NO: 7237300 - DNA, 22 bp, Homo sapiens
gtgtcaggagccttccatgggc

SEQ ID NO: 7237301 - DNA, 22 bp, Homo sapiens
gtgtcaggagaattagggcttt

SEQ ID NO: 7237302 - DNA, 22 bp, Homo sapiens
gttgtatagagggcatgaatct

SEQ ID NO: 7237303 - DNA, 22 bp, Homo sapiens
gtgtgtcctcagtagtggcatg

SEQ ID NO: 7237304 - DNA, 22 bp, Homo sapiens
gtgtgtcccttggaacctcagc

SEQ ID NO: 7237305 - DNA, 22 bp, Homo sapiens
gtgtgtccctcctctcctgagt

SEQ ID NO: 7237306 - DNA, 22 bp, Homo sapiens
gtgtgtccctacaacagcttca

SEQ ID NO: 7237307 - DNA, 23 bp, Homo sapiens
gtgtgtccattcgcactcttagg

SEQ ID NO: 7237308 - DNA, 22 bp, Homo sapiens
gtgtgtccaggcgggagtcaag

SEQ ID NO: 7237309 - DNA, 22 bp, Homo sapiens
gtgtgtccacacatacatacat

SEQ ID NO: 7237310 - DNA, 22 bp, Homo sapiens
gtgtgtccaaggccacaatagc

SEQ ID NO: 7237311 - DNA, 22 bp, Homo sapiens
gtgtgtcaggtactgtgctagg

SEQ ID NO: 7237312 - DNA, 22 bp, Homo sapiens
gtgtgtccaaggcacggatgac

SEQ ID NO: 7237313 - DNA, 22 bp, Homo sapiens
gtctgagggttgtgctggagga

SEQ ID NO: 7237314 - DNA, 22 bp, Homo sapiens
gtcagctgcagtgggcacagcc

SEQ ID NO: 7237315 - DNA, 21 bp, Homo sapiens
gtcagctgtgtgtgaggaccc

SEQ ID NO: 7237316 - DNA, 20 bp, Homo sapiens
gtaaagcattcttggcatac

SEQ ID NO: 7237317 - DNA, 22 bp, Homo sapiens
ggtgtcctcactatagcaagtc

SEQ ID NO: 7237318 - DNA, 22 bp, Homo sapiens
ggtgtcctcatgattttctaga

SEQ ID NO: 7237319 - DNA, 21 bp, Homo sapiens
ggtgtcctgagggataggtag

SEQ ID NO: 7237320 - DNA, 22 bp, Homo sapiens
ggtgtcctcggattcagggcag

SEQ ID NO: 7237321 - DNA, 22 bp, Homo sapiens
ggtgtcctgtcagctagagtga

SEQ ID NO: 7237322 - DNA, 22 bp, Homo sapiens
ggtgtcctgggcaggcagctga

SEQ ID NO: 7237323 - DNA, 22 bp, Homo sapiens
ggtgtcagttgctcatcagagt

SEQ ID NO: 7237324 - DNA, 20 bp, Homo sapiens
ggtgtcagggccatgcctgg

SEQ ID NO: 7237325 - DNA, 22 bp, Homo sapiens
ggtgtcaggaaaatctcagtgt

SEQ ID NO: 7237326 - DNA, 22 bp, Homo sapiens
ggtgtcagatttgacatccaga

SEQ ID NO: 7237327 - DNA, 19 bp, Homo sapiens
ggtgtcctagagataagag

SEQ ID NO: 7237328 - DNA, 22 bp, Homo sapiens
ggtgtcctactgcttggttgct

SEQ ID NO: 7237329 - DNA, 22 bp, Homo sapiens
ggtgtcctacagggccgcaggc

SEQ ID NO: 7237330 - DNA, 22 bp, Homo sapiens
gggtggggtgtatcggatccta

SEQ ID NO: 7237331 - DNA, 22 bp, Homo sapiens
gggtggggcccaggaaatctat

SEQ ID NO: 7237332 - DNA, 22 bp, Homo sapiens
gggtggggccaggcaatttgca

SEQ ID NO: 7237333 - DNA, 22 bp, Homo sapiens
gggtggggttcaggaatcttca

SEQ ID NO: 7237334 - DNA, 21 bp, Homo sapiens
gggtggggttccagccttttc

SEQ ID NO: 7237335 - DNA, 22 bp, Homo sapiens
ggtgcaggagcggggtgctcgg

SEQ ID NO: 7237336 - DNA, 22 bp, Homo sapiens
gtgacaggtatactcaccattg

SEQ ID NO: 7237337 - DNA, 22 bp, Homo sapiens
gtgacatttacgaatcttatcc

SEQ ID NO: 7237338 - DNA, 22 bp, Homo sapiens
gtgacattgctaggaacagatt

SEQ ID NO: 7237339 - DNA, 22 bp, Homo sapiens
gtgacattcaggatatcaatgg

SEQ ID NO: 7237340 - DNA, 22 bp, Homo sapiens
gtgacattttttaagcccttgt

SEQ ID NO: 7237341 - DNA, 21 bp, Homo sapiens
tctctggttctgaaatggttt

SEQ ID NO: 7237342 - DNA, 21 bp, Homo sapiens
tctgaaggcattttccaaggt

SEQ ID NO: 7237343 - DNA, 22 bp, Homo sapiens
tctgaaggtctgagaaccagga

SEQ ID NO: 7237344 - DNA, 22 bp, Homo sapiens
tctcctggatggaccttctctt

SEQ ID NO: 7237345 - DNA, 22 bp, Homo sapiens
tctcctggcatttggttgagta

SEQ ID NO: 7237346 - DNA, 22 bp, Homo sapiens
tctcctggcatgtgggtcatct

SEQ ID NO: 7237347 - DNA, 22 bp, Homo sapiens
tctcctggagcccagatgctgg

SEQ ID NO: 7237348 - DNA, 22 bp, Homo sapiens
tctcctggatagatactatcca

SEQ ID NO: 7237349 - DNA, 22 bp, Homo sapiens
tctcctggagcaggaaggtggg

SEQ ID NO: 7237350 - DNA, 22 bp, Homo sapiens
tctcctggaagtgattcccctg

SEQ ID NO: 7237351 - DNA, 22 bp, Homo sapiens
tctcctggaagaataccacact

SEQ ID NO: 7237352 - DNA, 22 bp, Homo sapiens
tctcctgaagtttatgaaaact

SEQ ID NO: 7237353 - DNA, 22 bp, Homo sapiens
tctcctggtttgttaaataatt

SEQ ID NO: 7237354 - DNA, 20 bp, Homo sapiens
tctcctggtgacagtaccca

SEQ ID NO: 7237355 - DNA, 22 bp, Homo sapiens
tctcctggtcacctcagaagtc

SEQ ID NO: 7237356 - DNA, 20 bp, Homo sapiens
tctcctggtctggtccgtgc

SEQ ID NO: 7237357 - DNA, 22 bp, Homo sapiens
tctcctggtatgtatgcacctg

SEQ ID NO: 7237358 - DNA, 22 bp, Homo sapiens
tctcctgggtgctttatcagaa

SEQ ID NO: 7237359 - DNA, 22 bp, Homo sapiens
tctcctggtacccttcctagca

SEQ ID NO: 7237360 - DNA, 21 bp, Homo sapiens
tctcctgggtccaacccatgc

SEQ ID NO: 7237361 - DNA, 18 bp, Homo sapiens
tctcctgggtaggggcct

SEQ ID NO: 7237362 - DNA, 22 bp, Homo sapiens
tctcctgggcttggttgaagtt

SEQ ID NO: 7237363 - DNA, 22 bp, Homo sapiens
tctcctggccctgtcgccatct

SEQ ID NO: 7237364 - DNA, 22 bp, Homo sapiens
tctcctgggtaaaagggttgat

SEQ ID NO: 7237365 - DNA, 22 bp, Homo sapiens
tctcgatctcctgaccttgtga

SEQ ID NO: 7237366 - DNA, 22 bp, Homo sapiens
tctcgctctgtcgcccaggctg

SEQ ID NO: 7237367 - DNA, 22 bp, Homo sapiens
taagaacagtgtctgtctcaca

SEQ ID NO: 7237368 - DNA, 22 bp, Homo sapiens
taagaacagtagaacagtaggt

SEQ ID NO: 7237369 - DNA, 22 bp, Homo sapiens
taagaacagataaagtttcccc

SEQ ID NO: 7237370 - DNA, 22 bp, Homo sapiens
tcctggtgggacagaaaacctc

SEQ ID NO: 7237371 - DNA, 22 bp, Homo sapiens
tcctggtggctttccctgcctt

SEQ ID NO: 7237372 - DNA, 22 bp, Homo sapiens
tcctggtggtctgtgcttcttc

SEQ ID NO: 7237373 - DNA, 22 bp, Homo sapiens
tcctggtggtgccggtgcccgg

SEQ ID NO: 7237374 - DNA, 22 bp, Homo sapiens
tcctggtggtgccagctgcagg

SEQ ID NO: 7237375 - DNA, 22 bp, Homo sapiens
tcctggtgtaatggtaagcatg

SEQ ID NO: 7237376 - DNA, 22 bp, Homo sapiens
tcctggtggtttgaaaactgaa

SEQ ID NO: 7237377 - DNA, 22 bp, Homo sapiens
tcctggtgtttatgtcacatag

SEQ ID NO: 7237378 - DNA, 22 bp, Homo sapiens
tcctggtgttactaaattgaaa

SEQ ID NO: 7237379 - DNA, 22 bp, Homo sapiens
tcctggtgtcgcctggtcagtt

SEQ ID NO: 7237380 - DNA, 22 bp, Homo sapiens
tcctggtgtcctggtctgctag

SEQ ID NO: 7237381 - DNA, 22 bp, Homo sapiens
tcctggtggcagattttaggtc

SEQ ID NO: 7237382 - DNA, 22 bp, Homo sapiens
tcctggtggctctttgggaagg

SEQ ID NO: 7237383 - DNA, 22 bp, Homo sapiens
tccttgggaaatcactagcact

SEQ ID NO: 7237384 - DNA, 22 bp, Homo sapiens
tctagcatgggaaaatcacagc

SEQ ID NO: 7237385 - DNA, 21 bp, Homo sapiens
tctgatggtagatgagatgtg

SEQ ID NO: 7237386 - DNA, 22 bp, Homo sapiens
tctgaggtcacagatttcaaga

SEQ ID NO: 7237387 - DNA, 22 bp, Homo sapiens
tctgagccataagagtacagga

SEQ ID NO: 7237388 - DNA, 20 bp, Homo sapiens
tctgctcagccctcagtggc

SEQ ID NO: 7237389 - DNA, 22 bp, Homo sapiens
tctgctcagtgcttatctctaa

SEQ ID NO: 7237390 - DNA, 20 bp, Homo sapiens
tctgccttatgaccttcgcc

SEQ ID NO: 7237391 - DNA, 23 bp, Homo sapiens
tctggctgtaatatgaaagttag

SEQ ID NO: 7237392 - DNA, 22 bp, Homo sapiens
tctggaaggcttcaaggtctaa

SEQ ID NO: 7237393 - DNA, 22 bp, Homo sapiens
tctgctgtaaccttcagaggta

SEQ ID NO: 7237394 - DNA, 22 bp, Homo sapiens
tcttagcatttcataacaactg

SEQ ID NO: 7237395 - DNA, 22 bp, Homo sapiens
tctgtttttgaggctatcttct

SEQ ID NO: 7237396 - DNA, 22 bp, Homo sapiens
tctgttttgtgtctctctggtg

SEQ ID NO: 7237397 - DNA, 22 bp, Homo sapiens
tctgttttctctgtattttgac

SEQ ID NO: 7237398 - DNA, 22 bp, Homo sapiens
tctgtaaagactccaaaagcca

SEQ ID NO: 7237399 - DNA, 18 bp, Homo sapiens
tctgtccaccctgtgctg

SEQ ID NO: 7237400 - DNA, 20 bp, Homo sapiens
tctgtccaccagcctcgcct

SEQ ID NO: 7237401 - DNA, 22 bp, Homo sapiens
tctgtccagaggtcctggagac

SEQ ID NO: 7237402 - DNA, 22 bp, Homo sapiens
tctgtccattcagccatccatc

SEQ ID NO: 7237403 - DNA, 22 bp, Homo sapiens
tctgtccattcagaatggccct

SEQ ID NO: 7237404 - DNA, 22 bp, Homo sapiens
tctgtccatgcttttctctcac

SEQ ID NO: 7237405 - DNA, 22 bp, Homo sapiens
tctgtccaggtcagcctacatt

SEQ ID NO: 7237406 - DNA, 22 bp, Homo sapiens
tctttacaagtcacattttctg

SEQ ID NO: 7237407 - DNA, 22 bp, Homo sapiens
tctttagtattgagttatggta

SEQ ID NO: 7237408 - DNA, 22 bp, Homo sapiens
tctttagtaatgtagcagttta

SEQ ID NO: 7237409 - DNA, 22 bp, Homo sapiens
tctttattgctactggtttgtc

SEQ ID NO: 7237410 - DNA, 22 bp, Homo sapiens
tctttagttttctaggttctat

SEQ ID NO: 7237411 - DNA, 22 bp, Homo sapiens
tctttatttaagtctgttgtaa

SEQ ID NO: 7237412 - DNA, 22 bp, Homo sapiens
tcttccttttgtaccttctgaa

SEQ ID NO: 7237413 - DNA, 22 bp, Homo sapiens
tcttcaaaaatacaggttttca

SEQ ID NO: 7237414 - DNA, 20 bp, Homo sapiens
tcttattgtcttgaggagtt

SEQ ID NO: 7237415 - DNA, 22 bp, Homo sapiens
tgattaactgtctattaatcat

SEQ ID NO: 7237416 - DNA, 22 bp, Homo sapiens
tgatgtcctcatgtcaagctcc

SEQ ID NO: 7237417 - DNA, 22 bp, Homo sapiens
tgatggaagtgactgtcagttc

SEQ ID NO: 7237418 - DNA, 19 bp, Homo sapiens
tgagtgaaggccgtggtgg

SEQ ID NO: 7237419 - DNA, 22 bp, Homo sapiens
tgcaatctcggcactttgggag

SEQ ID NO: 7237420 - DNA, 17 bp, Homo sapiens
tgcaagaagattaggaa

SEQ ID NO: 7237421 - DNA, 22 bp, Homo sapiens
tgcaagaaaggtggggccaggc

SEQ ID NO: 7237422 - DNA, 21 bp, Homo sapiens
tgcaagaatcaggaagctgcc

SEQ ID NO: 7237423 - DNA, 21 bp, Homo sapiens
tgcaggaagtatggtgcctat

SEQ ID NO: 7237424 - DNA, 22 bp, Homo sapiens
tgcagcaagcaagtatggttct

SEQ ID NO: 7237425 - DNA, 22 bp, Homo sapiens
tgcagataatactagaacttac

SEQ ID NO: 7237426 - DNA, 20 bp, Homo sapiens
tgcagagctggctggctcct

SEQ ID NO: 7237427 - DNA, 22 bp, Homo sapiens
tgcagagcagcaactgcgtgcg

SEQ ID NO: 7237428 - DNA, 20 bp, Homo sapiens
tgcagggctgcctcccagct

SEQ ID NO: 7237429 - DNA, 20 bp, Homo sapiens
tgcagggctctgcttctctc

SEQ ID NO: 7237430 - DNA, 19 bp, Homo sapiens
tgcagggctgcgcctgggg

SEQ ID NO: 7237431 - DNA, 22 bp, Homo sapiens
tgcagggcttcctcttggagtt

SEQ ID NO: 7237432 - DNA, 22 bp, Homo sapiens
tgcaggtgacaccactcttcct

SEQ ID NO: 7237433 - DNA, 22 bp, Homo sapiens
tgcaggtgagtgcaggggctca

SEQ ID NO: 7237434 - DNA, 22 bp, Homo sapiens
tgcaggtgaaaattatgaggat

SEQ ID NO: 7237435 - DNA, 22 bp, Homo sapiens
tgcaggtggatatctcatcaga

SEQ ID NO: 7237436 - DNA, 22 bp, Homo sapiens
tgcaggtggatatctcatcaga

SEQ ID NO: 7237437 - DNA, 22 bp, Homo sapiens
tgcaggtgcagcgatactgtga

SEQ ID NO: 7237438 - DNA, 23 bp, Homo sapiens
tgcaggtgattaatccagtttca

SEQ ID NO: 7237439 - DNA, 22 bp, Homo sapiens
tgcaggtgattctgatgcagtt

SEQ ID NO: 7237440 - DNA, 22 bp, Homo sapiens
tgcaggtggcagcggggcacca

SEQ ID NO: 7237441 - DNA, 22 bp, Homo sapiens
tgcaggtggattcaatgtggga

SEQ ID NO: 7237442 - DNA, 22 bp, Homo sapiens
tgcaggtggccatcttcgttct

SEQ ID NO: 7237443 - DNA, 22 bp, Homo sapiens
tgcaggtggctccagggactgc

SEQ ID NO: 7237444 - DNA, 22 bp, Homo sapiens
tgcaggtgtgggcaggggagca

SEQ ID NO: 7237445 - DNA, 22 bp, Homo sapiens
tgcaggtgtctctgtctagcgt

SEQ ID NO: 7237446 - DNA, 23 bp, Homo sapiens
tgcaggtgtgcagagggctcttg

SEQ ID NO: 7237447 - DNA, 22 bp, Homo sapiens
tgcaggtgtctgggggcaacag

SEQ ID NO: 7237448 - DNA, 22 bp, Homo sapiens
tgcaggtgtggttcctcagcca

SEQ ID NO: 7237449 - DNA, 20 bp, Homo sapiens
tgcaggtgtgtccaagcact

SEQ ID NO: 7237450 - DNA, 20 bp, Homo sapiens
tgcaggtgttggagaaggta

SEQ ID NO: 7237451 - DNA, 22 bp, Homo sapiens
tgcaggtgtgtgcaagggaggg

SEQ ID NO: 7237452 - DNA, 22 bp, Homo sapiens
tgcaggtggtccatttgggaac

SEQ ID NO: 7237453 - DNA, 22 bp, Homo sapiens
tgcaggtggtacttctttttct

SEQ ID NO: 7237454 - DNA, 20 bp, Homo sapiens
tgcaggtgggcccttctggg

SEQ ID NO: 7237455 - DNA, 22 bp, Homo sapiens
tgcaggtggtttggacactgct

SEQ ID NO: 7237456 - DNA, 22 bp, Homo sapiens
tgcaggtggtccttcctctgct

SEQ ID NO: 7237457 - DNA, 22 bp, Homo sapiens
tgcaggtgtagagttgggctcc

SEQ ID NO: 7237458 - DNA, 22 bp, Homo sapiens
tgcaggtgtaaattttcaagag

SEQ ID NO: 7237459 - DNA, 22 bp, Homo sapiens
tgcaggtgtctccagggcaggt

SEQ ID NO: 7237460 - DNA, 22 bp, Homo sapiens
tgcagggcccttggggttgaac

SEQ ID NO: 7237461 - DNA, 22 bp, Homo sapiens
tgcagggccctcattcctgtcc

SEQ ID NO: 7237462 - DNA, 22 bp, Homo sapiens
tgcagggctcctggctccaatc

SEQ ID NO: 7237463 - DNA, 22 bp, Homo sapiens
tgcagggctataactccattct

SEQ ID NO: 7237464 - DNA, 22 bp, Homo sapiens
tgcagggccgctggaggtcatg

SEQ ID NO: 7237465 - DNA, 22 bp, Homo sapiens
tgcagggccatggtggcggctg

SEQ ID NO: 7237466 - DNA, 22 bp, Homo sapiens
tgcagggcccctctgcatgagt

SEQ ID NO: 7237467 - DNA, 22 bp, Homo sapiens
tgcagggccagactgggttgga

SEQ ID NO: 7237468 - DNA, 22 bp, Homo sapiens
tgcagggcatctttgaagtgtg

SEQ ID NO: 7237469 - DNA, 22 bp, Homo sapiens
tgcagggcatagggtccagttt

SEQ ID NO: 7237470 - DNA, 22 bp, Homo sapiens
tgcagggcacggtgcgcgtggg

SEQ ID NO: 7237471 - DNA, 22 bp, Homo sapiens
tgcagggcagatatgactgtag

SEQ ID NO: 7237472 - DNA, 22 bp, Homo sapiens
tgcagggcagtttgtttcggca

SEQ ID NO: 7237473 - DNA, 22 bp, Homo sapiens
tgcagggcagtggaggttgagt

SEQ ID NO: 7237474 - DNA, 22 bp, Homo sapiens
tgcagggcagctagggagcttt

SEQ ID NO: 7237475 - DNA, 22 bp, Homo sapiens
tgcagggcacacgcacgggtgt

SEQ ID NO: 7237476 - DNA, 23 bp, Homo sapiens
tgcagggcaagttagagacccca

SEQ ID NO: 7237477 - DNA, 22 bp, Homo sapiens
tgaaaacactttagtttaggtc

SEQ ID NO: 7237478 - DNA, 22 bp, Homo sapiens
tctttgttggagtccaaggata

SEQ ID NO: 7237479 - DNA, 22 bp, Homo sapiens
tctttgtttgcctttatcaaga

SEQ ID NO: 7237480 - DNA, 22 bp, Homo sapiens
tctttggaaaaaatggacaatc

SEQ ID NO: 7237481 - DNA, 20 bp, Homo sapiens
tctttgtgtcagatggacag

SEQ ID NO: 7237482 - DNA, 22 bp, Homo sapiens
tgaaatacacaaatttagtaag

SEQ ID NO: 7237483 - DNA, 22 bp, Homo sapiens
tgaagaaacgcagagaggtagg

SEQ ID NO: 7237484 - DNA, 22 bp, Homo sapiens
tgaagaaacagaccaagaggat

SEQ ID NO: 7237485 - DNA, 22 bp, Homo sapiens
tgaagaaacagaccaagaggat

SEQ ID NO: 7237486 - DNA, 22 bp, Homo sapiens
tgaagaaaatatgattacccca

SEQ ID NO: 7237487 - DNA, 22 bp, Homo sapiens
tgaagaaaggtgtgggatactc

SEQ ID NO: 7237488 - DNA, 22 bp, Homo sapiens
tgaagaaacgcagagaggtagg

SEQ ID NO: 7237489 - DNA, 22 bp, Homo sapiens
tgaagaaacgcagagaggtagg

SEQ ID NO: 7237490 - DNA, 22 bp, Homo sapiens
tgaagacagggtctttaacgag

SEQ ID NO: 7237491 - DNA, 22 bp, Homo sapiens
tgaagcaatgatcttttggtgg

SEQ ID NO: 7237492 - DNA, 22 bp, Homo sapiens
tgaagcaaacgcttctgttcct

SEQ ID NO: 7237493 - DNA, 22 bp, Homo sapiens
tgaagcaggaaacttcttgttt

SEQ ID NO: 7237494 - DNA, 22 bp, Homo sapiens
tgaagcagcttctttctgtcaa

SEQ ID NO: 7237495 - DNA, 20 bp, Homo sapiens
tgaagcagccttgattctgt

SEQ ID NO: 7237496 - DNA, 22 bp, Homo sapiens
tgaagcagatggtctggtcatt

SEQ ID NO: 7237497 - DNA, 22 bp, Homo sapiens
tgaagcaggcattgactgatga

SEQ ID NO: 7237498 - DNA, 22 bp, Homo sapiens
tgaagcaggatcgtttgcttca

SEQ ID NO: 7237499 - DNA, 22 bp, Homo sapiens
tgaagcaggtgaatggatgtcg

SEQ ID NO: 7237500 - DNA, 22 bp, Homo sapiens
tgaagcagttactgggtgttaa

SEQ ID NO: 7237501 - DNA, 22 bp, Homo sapiens
tgacagacagcttctcatttta

SEQ ID NO: 7237502 - DNA, 22 bp, Homo sapiens
tgacagacacaccttaggaaag

SEQ ID NO: 7237503 - DNA, 22 bp, Homo sapiens
tgacagacatggaagccagagt

SEQ ID NO: 7237504 - DNA, 17 bp, Homo sapiens
tgacagacatcatgagc

SEQ ID NO: 7237505 - DNA, 22 bp, Homo sapiens
tgacagaccactgcaactctgt

SEQ ID NO: 7237506 - DNA, 23 bp, Homo sapiens
tgacagaccttcccagacagtca

SEQ ID NO: 7237507 - DNA, 22 bp, Homo sapiens
tgacagcagccacctctcaccc

SEQ ID NO: 7237508 - DNA, 22 bp, Homo sapiens
tgacagcataacactggtcttg

SEQ ID NO: 7237509 - DNA, 21 bp, Homo sapiens
tgacaggtatttatctggaaa

SEQ ID NO: 7237510 - DNA, 22 bp, Homo sapiens
tgacaggtgaaatgtccttatt

SEQ ID NO: 7237511 - DNA, 22 bp, Homo sapiens
tgacaggtcatataagcttgca

SEQ ID NO: 7237512 - DNA, 19 bp, Homo sapiens
tgacaggttttatgtgttt

SEQ ID NO: 7237513 - DNA, 21 bp, Homo sapiens
tgacaggtttaggattaaaat

SEQ ID NO: 7237514 - DNA, 22 bp, Homo sapiens
tgacaggttgtgtaggtggcca

SEQ ID NO: 7237515 - DNA, 22 bp, Homo sapiens
tgacaggttcgttagtcatgtt

SEQ ID NO: 7237516 - DNA, 22 bp, Homo sapiens
tgacaggtgctgggggcagtgt

SEQ ID NO: 7237517 - DNA, 22 bp, Homo sapiens
tgacaggtgattgtgaactaag

SEQ ID NO: 7237518 - DNA, 22 bp, Homo sapiens
tgacatgtatgtatttgtttat

SEQ ID NO: 7237519 - DNA, 22 bp, Homo sapiens
tgacatgtatatcttacgctat

SEQ ID NO: 7237520 - DNA, 22 bp, Homo sapiens
tgacatgtaagatggaaaagcg

SEQ ID NO: 7237521 - DNA, 22 bp, Homo sapiens
tgacatttcagatatggtattt

SEQ ID NO: 7237522 - DNA, 21 bp, Homo sapiens
tgacatttagtagcattgtca

SEQ ID NO: 7237523 - DNA, 22 bp, Homo sapiens
tgacatttactattcctggtta

SEQ ID NO: 7237524 - DNA, 22 bp, Homo sapiens
tgacatgttagggaaatgtgat

SEQ ID NO: 7237525 - DNA, 22 bp, Homo sapiens
tgacatgtgtctccttccgtct

SEQ ID NO: 7237526 - DNA, 22 bp, Homo sapiens
tgacatgtgtaatcagctccgt

SEQ ID NO: 7237527 - DNA, 22 bp, Homo sapiens
tgacatgtggctttgacccagg

SEQ ID NO: 7237528 - DNA, 22 bp, Homo sapiens
tgacatgtgctcatcttggcta

SEQ ID NO: 7237529 - DNA, 22 bp, Homo sapiens
tgacatgtcctgagaagatggc

SEQ ID NO: 7237530 - DNA, 22 bp, Homo sapiens
tgacatgtccaggtggtcctgt

SEQ ID NO: 7237531 - DNA, 22 bp, Homo sapiens
tgacatgtatgttgttggcatg

SEQ ID NO: 7237532 - DNA, 22 bp, Homo sapiens
tgacatttcctagtgctttgtg

SEQ ID NO: 7237533 - DNA, 22 bp, Homo sapiens
tgacttgtctctttgggagaca

SEQ ID NO: 7237534 - DNA, 22 bp, Homo sapiens
tgaatgtttgatgagaaataga

SEQ ID NO: 7237535 - DNA, 23 bp, Homo sapiens
tgaatgtttattctcggtgcaga

SEQ ID NO: 7237536 - DNA, 22 bp, Homo sapiens
tgaagcataagagggttctttt

SEQ ID NO: 7237537 - DNA, 22 bp, Homo sapiens
tgaaggagctgatgtaaggggt

SEQ ID NO: 7237538 - DNA, 22 bp, Homo sapiens
tgagcaagagaaactgactgta

SEQ ID NO: 7237539 - DNA, 22 bp, Homo sapiens
tgagcaagacccggcctctgcc

SEQ ID NO: 7237540 - DNA, 22 bp, Homo sapiens
tgagaagagcaaggaactggtt

SEQ ID NO: 7237541 - DNA, 22 bp, Homo sapiens
tgagaattacaaatgagtcaca

SEQ ID NO: 7237542 - DNA, 22 bp, Homo sapiens
tgaggaagggtgtgacggcacc

SEQ ID NO: 7237543 - DNA, 22 bp, Homo sapiens
tgcttcagagaagaatggaaag

SEQ ID NO: 7237544 - DNA, 22 bp, Homo sapiens
tgctgtgaggttgagaaggaag

SEQ ID NO: 7237545 - DNA, 22 bp, Homo sapiens
tgctctggctggagcaatgact

SEQ ID NO: 7237546 - DNA, 23 bp, Homo sapiens
tgctctgggaggccctggagagc

SEQ ID NO: 7237547 - DNA, 22 bp, Homo sapiens
tgctctgggctatctgagaaag

SEQ ID NO: 7237548 - DNA, 22 bp, Homo sapiens
tgctctgggggaagccagctgt

SEQ ID NO: 7237549 - DNA, 20 bp, Homo sapiens
tgctctgggggtggagagac

SEQ ID NO: 7237550 - DNA, 22 bp, Homo sapiens
tgctgagcgcatccggcggccg

SEQ ID NO: 7237551 - DNA, 22 bp, Homo sapiens
tgctataagaattatattactc

SEQ ID NO: 7237552 - DNA, 18 bp, Homo sapiens
tggagctgagtgctgtgc

SEQ ID NO: 7237553 - DNA, 22 bp, Homo sapiens
tggagctggaagaatgtagacg

SEQ ID NO: 7237554 - DNA, 22 bp, Homo sapiens
tggagctggaatttgagctgga

SEQ ID NO: 7237555 - DNA, 22 bp, Homo sapiens
tggagctggcttgtggaagttg

SEQ ID NO: 7237556 - DNA, 21 bp, Homo sapiens
tggagagtgatttcagtgtgg

SEQ ID NO: 7237557 - DNA, 19 bp, Homo sapiens
tggaggccaggacacaggt

SEQ ID NO: 7237558 - DNA, 22 bp, Homo sapiens
tggaggcccccaggcaacagca

SEQ ID NO: 7237559 - DNA, 20 bp, Homo sapiens
tggagctgtaatcttgtctg

SEQ ID NO: 7237560 - DNA, 22 bp, Homo sapiens
tggagctgggatttgaactgca

SEQ ID NO: 7237561 - DNA, 23 bp, Homo sapiens
tggagctgggatttgatttgatt

SEQ ID NO: 7237562 - DNA, 23 bp, Homo sapiens
tggagctgggcagctgggaaagt

SEQ ID NO: 7237563 - DNA, 23 bp, Homo sapiens
tggagctgggctcagaccctggg

SEQ ID NO: 7237564 - DNA, 22 bp, Homo sapiens
tggagctggggtttgaatctgg

SEQ ID NO: 7237565 - DNA, 19 bp, Homo sapiens
tggatggagcctgtggttg

SEQ ID NO: 7237566 - DNA, 22 bp, Homo sapiens
tggataaactcactgtaagttg

SEQ ID NO: 7237567 - DNA, 23 bp, Homo sapiens
tggataaagctgtgctgcatagg

SEQ ID NO: 7237568 - DNA, 22 bp, Homo sapiens
tgcttttaggagattaaaatta

SEQ ID NO: 7237569 - DNA, 22 bp, Homo sapiens
tgctttatctgtgagaacctga

SEQ ID NO: 7237570 - DNA, 22 bp, Homo sapiens
tgctttatctgacttggcgctg

SEQ ID NO: 7237571 - DNA, 22 bp, Homo sapiens
tgctttatcaaagctatagtga

SEQ ID NO: 7237572 - DNA, 22 bp, Homo sapiens
tgctttatatctctcttcttag

SEQ ID NO: 7237573 - DNA, 22 bp, Homo sapiens
tgctttataggggattgcaggc

SEQ ID NO: 7237574 - DNA, 22 bp, Homo sapiens
tgctttatagacaaggaagtag

SEQ ID NO: 7237575 - DNA, 22 bp, Homo sapiens
tgctttataacttagtttatgg

SEQ ID NO: 7237576 - DNA, 22 bp, Homo sapiens
tgctttatgttatcagaagggt

SEQ ID NO: 7237577 - DNA, 22 bp, Homo sapiens
tgctttatgtggctgatactca

SEQ ID NO: 7237578 - DNA, 21 bp, Homo sapiens
tgctttatgggaaaaatgtca

SEQ ID NO: 7237579 - DNA, 22 bp, Homo sapiens
tgctttatggatttgtgtcctg

SEQ ID NO: 7237580 - DNA, 22 bp, Homo sapiens
tgctttatggagcccatctcat

SEQ ID NO: 7237581 - DNA, 20 bp, Homo sapiens
tgctttatgctatactttgt

SEQ ID NO: 7237582 - DNA, 18 bp, Homo sapiens
tgctttatgcttatataa

SEQ ID NO: 7237583 - DNA, 22 bp, Homo sapiens
tgctttattcccttctgatgtg

SEQ ID NO: 7237584 - DNA, 22 bp, Homo sapiens
tgctttattcagtctctgccat

SEQ ID NO: 7237585 - DNA, 22 bp, Homo sapiens
tgctttattcagggtttacccc

SEQ ID NO: 7237586 - DNA, 22 bp, Homo sapiens
tgctttattaagagagaaattt

SEQ ID NO: 7237587 - DNA, 22 bp, Homo sapiens
tgctttattgcatcagtgtggg

SEQ ID NO: 7237588 - DNA, 22 bp, Homo sapiens
tgctttattcgacatctggtag

SEQ ID NO: 7237589 - DNA, 22 bp, Homo sapiens
tgctttataaccatttctgtgg

SEQ ID NO: 7237590 - DNA, 18 bp, Homo sapiens
tggaagctggcagatttt

SEQ ID NO: 7237591 - DNA, 22 bp, Homo sapiens
tggaagcttttgagattgttgc

SEQ ID NO: 7237592 - DNA, 17 bp, Homo sapiens
tggaagcttcatgttgg

SEQ ID NO: 7237593 - DNA, 22 bp, Homo sapiens
tggaaggaagccaaggaaggtt

SEQ ID NO: 7237594 - DNA, 18 bp, Homo sapiens
tggcagggaggaaatata

SEQ ID NO: 7237595 - DNA, 19 bp, Homo sapiens
tggcagggagtgatattag

SEQ ID NO: 7237596 - DNA, 22 bp, Homo sapiens
tggcagggagttcgttcacaac

SEQ ID NO: 7237597 - DNA, 22 bp, Homo sapiens
tggcagggcctaccccaatatc

SEQ ID NO: 7237598 - DNA, 22 bp, Homo sapiens
tggcagggagttgcaggatttc

SEQ ID NO: 7237599 - DNA, 22 bp, Homo sapiens
tggcagggcctgaatcttatac

SEQ ID NO: 7237600 - DNA, 22 bp, Homo sapiens
tggcagggcctgctcatcatcc

SEQ ID NO: 7237601 - DNA, 22 bp, Homo sapiens
tggcaggggaggtgcttgctta

SEQ ID NO: 7237602 - DNA, 18 bp, Homo sapiens
tggcaggggcagtacgcc

SEQ ID NO: 7237603 - DNA, 22 bp, Homo sapiens
tggcagggtacaccttaacacc

SEQ ID NO: 7237604 - DNA, 21 bp, Homo sapiens
tggcaggggtagtagtacagc

SEQ ID NO: 7237605 - DNA, 22 bp, Homo sapiens
tggcaggttatgcgggccacat

SEQ ID NO: 7237606 - DNA, 22 bp, Homo sapiens
tggcaggttaacttacaactgt

SEQ ID NO: 7237607 - DNA, 23 bp, Homo sapiens
tggcaggtggttagatgttttgt

SEQ ID NO: 7237608 - DNA, 22 bp, Homo sapiens
tggcaggtggctctggcattct

SEQ ID NO: 7237609 - DNA, 20 bp, Homo sapiens
tggcaggtggcctcagttcc

SEQ ID NO: 7237610 - DNA, 22 bp, Homo sapiens
tggcaggtggcacagcctggga

SEQ ID NO: 7237611 - DNA, 22 bp, Homo sapiens
tggcaggtggagacagcagagc

SEQ ID NO: 7237612 - DNA, 22 bp, Homo sapiens
tggcaggtgcctgtaatctcag

SEQ ID NO: 7237613 - DNA, 22 bp, Homo sapiens
tggcaggtgccatgggctcaga

SEQ ID NO: 7237614 - DNA, 22 bp, Homo sapiens
tggcaggtgcacttttggtttc

SEQ ID NO: 7237615 - DNA, 18 bp, Homo sapiens
tggcaggtccagctgtgg

SEQ ID NO: 7237616 - DNA, 22 bp, Homo sapiens
tggcaggtccactcacagatct

SEQ ID NO: 7237617 - DNA, 22 bp, Homo sapiens
tggcaggtgaagttgttaggga

SEQ ID NO: 7237618 - DNA, 22 bp, Homo sapiens
tggcagggtcttgctgtgttgc

SEQ ID NO: 7237619 - DNA, 22 bp, Homo sapiens
tggcaggtcatgagtggccacc

SEQ ID NO: 7237620 - DNA, 22 bp, Homo sapiens
tggcagggtggcaacttttggt

SEQ ID NO: 7237621 - DNA, 22 bp, Homo sapiens
tggcagggtgccagttgcgagt

SEQ ID NO: 7237622 - DNA, 16 bp, Homo sapiens
tggcaggtttttatct

SEQ ID NO: 7237623 - DNA, 22 bp, Homo sapiens
tggcaggtttcgttaaaaatgg

SEQ ID NO: 7237624 - DNA, 22 bp, Homo sapiens
tggcaggtttcctcctcatagt

SEQ ID NO: 7237625 - DNA, 21 bp, Homo sapiens
tggcaggttcaaaggcctatc

SEQ ID NO: 7237626 - DNA, 22 bp, Homo sapiens
tggcaggttggcctttggttca

SEQ ID NO: 7237627 - DNA, 19 bp, Homo sapiens
tgggaaagtaacatacaaa

SEQ ID NO: 7237628 - DNA, 22 bp, Homo sapiens
tgggaaagactcaggacaggag

SEQ ID NO: 7237629 - DNA, 22 bp, Homo sapiens
tgggaagaagcagagaactgga

SEQ ID NO: 7237630 - DNA, 22 bp, Homo sapiens
tgggagctggggttggacgtct

SEQ ID NO: 7237631 - DNA, 20 bp, Homo sapiens
tgggagctggtgaggtctca

SEQ ID NO: 7237632 - DNA, 22 bp, Homo sapiens
tgggacacaaaccagaccagga

SEQ ID NO: 7237633 - DNA, 22 bp, Homo sapiens
tgggacacattagtcaccttac

SEQ ID NO: 7237634 - DNA, 22 bp, Homo sapiens
tgggacacagaaaaggcaggtt

SEQ ID NO: 7237635 - DNA, 22 bp, Homo sapiens
tgggacacacaaggtcagctct

SEQ ID NO: 7237636 - DNA, 22 bp, Homo sapiens
tgggaagagttagagacagctg

SEQ ID NO: 7237637 - DNA, 22 bp, Homo sapiens
tgggaagagttagagacagctg

SEQ ID NO: 7237638 - DNA, 22 bp, Homo sapiens
tgggaagatggagtgacaggca

SEQ ID NO: 7237639 - DNA, 22 bp, Homo sapiens
tgggaagcacgctcagcagaaa

SEQ ID NO: 7237640 - DNA, 18 bp, Homo sapiens
tggctctgcagccagatg

SEQ ID NO: 7237641 - DNA, 22 bp, Homo sapiens
tggctctgcacctcagtgtacc

SEQ ID NO: 7237642 - DNA, 22 bp, Homo sapiens
tggctctgatcagatgtccagt

SEQ ID NO: 7237643 - DNA, 21 bp, Homo sapiens
tggctctgctcagagcagtcc

SEQ ID NO: 7237644 - DNA, 22 bp, Homo sapiens
tggctctgcgtctgttcgtggg

SEQ ID NO: 7237645 - DNA, 17 bp, Homo sapiens
tggctctgaggctgaat

SEQ ID NO: 7237646 - DNA, 22 bp, Homo sapiens
tggctctgagctgcaaagctgc

SEQ ID NO: 7237647 - DNA, 23 bp, Homo sapiens
tggctctgagaggttcagatgct

SEQ ID NO: 7237648 - DNA, 22 bp, Homo sapiens
tggctctgagacacaggctctc

SEQ ID NO: 7237649 - DNA, 22 bp, Homo sapiens
tggctctgtgcttctagtatct

SEQ ID NO: 7237650 - DNA, 22 bp, Homo sapiens
tggctctgtgaacagacgactg

SEQ ID NO: 7237651 - DNA, 22 bp, Homo sapiens
tggctctgtcgccgtttggaat

SEQ ID NO: 7237652 - DNA, 22 bp, Homo sapiens
tggctctgtggatgttctgacc

SEQ ID NO: 7237653 - DNA, 22 bp, Homo sapiens
tggctctgggaatctgttgctt

SEQ ID NO: 7237654 - DNA, 22 bp, Homo sapiens
tggctctggcgtgaagcccaga

SEQ ID NO: 7237655 - DNA, 22 bp, Homo sapiens
tggctctgggaatgggaagatg

SEQ ID NO: 7237656 - DNA, 22 bp, Homo sapiens
tggctctgttgtaaagaaattt

SEQ ID NO: 7237657 - DNA, 22 bp, Homo sapiens
tggctctgttgctcgcagtttt

SEQ ID NO: 7237658 - DNA, 22 bp, Homo sapiens
tggctctgttgaggtatggatt

SEQ ID NO: 7237659 - DNA, 22 bp, Homo sapiens
tggctctgtgtctcccagcagc

SEQ ID NO: 7237660 - DNA, 23 bp, Homo sapiens
tggctctgtgtcacatacaggat

SEQ ID NO: 7237661 - DNA, 22 bp, Homo sapiens
tggctctgtttgttaactagac

SEQ ID NO: 7237662 - DNA, 22 bp, Homo sapiens
tggctgaatctgcagcaggaag

SEQ ID NO: 7237663 - DNA, 22 bp, Homo sapiens
tggctaacaaggtgaaaccccg

SEQ ID NO: 7237664 - DNA, 22 bp, Homo sapiens
tggccttggcagtgagaagagt

SEQ ID NO: 7237665 - DNA, 22 bp, Homo sapiens
tgggccaggtctgtgtcagctg

SEQ ID NO: 7237666 - DNA, 22 bp, Homo sapiens
tgggccaggggcctcttctgat

SEQ ID NO: 7237667 - DNA, 22 bp, Homo sapiens
tgggccaggcatgtgatcagca

SEQ ID NO: 7237668 - DNA, 22 bp, Homo sapiens
tgggccagtccagccccaggga

SEQ ID NO: 7237669 - DNA, 22 bp, Homo sapiens
tgggctctcgtccctgcagaag

SEQ ID NO: 7237670 - DNA, 22 bp, Homo sapiens
tgggctctctcacctggaggct

SEQ ID NO: 7237671 - DNA, 22 bp, Homo sapiens
tgggctctctggcaggaaggct

SEQ ID NO: 7237672 - DNA, 22 bp, Homo sapiens
tgggctctcctggaggacaaca

SEQ ID NO: 7237673 - DNA, 22 bp, Homo sapiens
tgggctctattcagagtttttc

SEQ ID NO: 7237674 - DNA, 22 bp, Homo sapiens
tgggctctcaaagtgcggcttg

SEQ ID NO: 7237675 - DNA, 22 bp, Homo sapiens
tgggctctgctgcgtaccagtt

SEQ ID NO: 7237676 - DNA, 22 bp, Homo sapiens
tgggctctgaagtcagtctgct

SEQ ID NO: 7237677 - DNA, 22 bp, Homo sapiens
tgggctctgcatcagtgcccat

SEQ ID NO: 7237678 - DNA, 22 bp, Homo sapiens
tgggctctggggaaactgtgat

SEQ ID NO: 7237679 - DNA, 22 bp, Homo sapiens
tgggctctgggtggcctgagca

SEQ ID NO: 7237680 - DNA, 22 bp, Homo sapiens
tgggctctggaattgagtggcc

SEQ ID NO: 7237681 - DNA, 22 bp, Homo sapiens
tgggctctgtgccaggttggtg

SEQ ID NO: 7237682 - DNA, 22 bp, Homo sapiens
tgggcagggtctctgttatcag

SEQ ID NO: 7237683 - DNA, 22 bp, Homo sapiens
tgggcaggtgctattttccatg

SEQ ID NO: 7237684 - DNA, 19 bp, Homo sapiens
tgggcaggttcagtaatgg

SEQ ID NO: 7237685 - DNA, 22 bp, Homo sapiens
tgggcaggttgttatttgacat

SEQ ID NO: 7237686 - DNA, 22 bp, Homo sapiens
tgggccagcactgggtgctcat

SEQ ID NO: 7237687 - DNA, 22 bp, Homo sapiens
tgggcaggagagaagctaaaga

SEQ ID NO: 7237688 - DNA, 22 bp, Homo sapiens
tgggcagggatctcttttgcaa

SEQ ID NO: 7237689 - DNA, 22 bp, Homo sapiens
tgggcaggggccctgcttccgt

SEQ ID NO: 7237690 - DNA, 22 bp, Homo sapiens
tgggcacagtgagttgccttta

SEQ ID NO: 7237691 - DNA, 22 bp, Homo sapiens
tggggctcacctaggctggaag

SEQ ID NO: 7237692 - DNA, 23 bp, Homo sapiens
tgtcaggtaaggaaggattcact

SEQ ID NO: 7237693 - DNA, 22 bp, Homo sapiens
tgtcaggtctaaaatgggtctc

SEQ ID NO: 7237694 - DNA, 22 bp, Homo sapiens
tgtcaggtcattgccatggaaa

SEQ ID NO: 7237695 - DNA, 22 bp, Homo sapiens
tgtcaggtcagtatttgatgcc

SEQ ID NO: 7237696 - DNA, 22 bp, Homo sapiens
tgtcaggtcagacttggttttt

SEQ ID NO: 7237697 - DNA, 22 bp, Homo sapiens
tgtcaggtatgcaacagaatgc

SEQ ID NO: 7237698 - DNA, 22 bp, Homo sapiens
tgtcaggtagtaggtagaaact

SEQ ID NO: 7237699 - DNA, 22 bp, Homo sapiens
tgtcaggtagagataatggggg

SEQ ID NO: 7237700 - DNA, 22 bp, Homo sapiens
tgtcaggttcaaatcttggtcc

SEQ ID NO: 7237701 - DNA, 22 bp, Homo sapiens
tgtcaggtgcagcttggatgca

SEQ ID NO: 7237702 - DNA, 22 bp, Homo sapiens
tgtcaggtgacagtttttacca

SEQ ID NO: 7237703 - DNA, 22 bp, Homo sapiens
tgtcaggtgacacactaggagc

SEQ ID NO: 7237704 - DNA, 15 bp, Homo sapiens
tgtcaggtgaatggt

SEQ ID NO: 7237705 - DNA, 22 bp, Homo sapiens
tgtcaggtctctgtgatggtaa

SEQ ID NO: 7237706 - DNA, 22 bp, Homo sapiens
tgtcaggtctacaaaaatgctg

SEQ ID NO: 7237707 - DNA, 22 bp, Homo sapiens
tgtcaggttctttaattctgca

SEQ ID NO: 7237708 - DNA, 22 bp, Homo sapiens
tgtcaggttcagtgattttact

SEQ ID NO: 7237709 - DNA, 22 bp, Homo sapiens
tgtcaggtttcagttaatggtt

SEQ ID NO: 7237710 - DNA, 22 bp, Homo sapiens
tgtcaggttggttttcagagaa

SEQ ID NO: 7237711 - DNA, 22 bp, Homo sapiens
tgtcaggtttctccaacttata

SEQ ID NO: 7237712 - DNA, 22 bp, Homo sapiens
tgtcctcacaggaatgaacttt

SEQ ID NO: 7237713 - DNA, 19 bp, Homo sapiens
tgtcctcacagagcataac

SEQ ID NO: 7237714 - DNA, 22 bp, Homo sapiens
tgtcctcacacgtagggagtaa

SEQ ID NO: 7237715 - DNA, 22 bp, Homo sapiens
tgtcctcaaggagcttcagtct

SEQ ID NO: 7237716 - DNA, 22 bp, Homo sapiens
tgtcctcagatatgtctactct

SEQ ID NO: 7237717 - DNA, 22 bp, Homo sapiens
tgtcctcacatggtggggagag

SEQ ID NO: 7237718 - DNA, 22 bp, Homo sapiens
tgtcctcaggacctggcacagt

SEQ ID NO: 7237719 - DNA, 22 bp, Homo sapiens
tgtcaaagtatcagtctctggc

SEQ ID NO: 7237720 - DNA, 22 bp, Homo sapiens
tgtcacattgaatatgatttat

SEQ ID NO: 7237721 - DNA, 22 bp, Homo sapiens
tgtattttctgaggagcattag

SEQ ID NO: 7237722 - DNA, 22 bp, Homo sapiens
tgtattctctcaatatttcata

SEQ ID NO: 7237723 - DNA, 22 bp, Homo sapiens
tgtatttatattagaatggttg

SEQ ID NO: 7237724 - DNA, 20 bp, Homo sapiens
tgtatttaatgaaggctttt

SEQ ID NO: 7237725 - DNA, 22 bp, Homo sapiens
tgtatagagttggaagatgact

SEQ ID NO: 7237726 - DNA, 22 bp, Homo sapiens
tgtatcaaaccaaattaattct

SEQ ID NO: 7237727 - DNA, 22 bp, Homo sapiens
tgtatcaagggtttatgtaagc

SEQ ID NO: 7237728 - DNA, 22 bp, Homo sapiens
tgtatctttctgtacttttatg

SEQ ID NO: 7237729 - DNA, 22 bp, Homo sapiens
tgtaagatattcagcttattga

SEQ ID NO: 7237730 - DNA, 22 bp, Homo sapiens
tgtaaagatccttagcaacatc

SEQ ID NO: 7237731 - DNA, 22 bp, Homo sapiens
tgtaaaaagcccagccgctgag

SEQ ID NO: 7237732 - DNA, 22 bp, Homo sapiens
tggtttctttccactctccacc

SEQ ID NO: 7237733 - DNA, 22 bp, Homo sapiens
tggtttgtctaaatgagtaata

SEQ ID NO: 7237734 - DNA, 18 bp, Homo sapiens
tggtttgtcatgagaatt

SEQ ID NO: 7237735 - DNA, 22 bp, Homo sapiens
tggtttgtatatgtttgtgaga

SEQ ID NO: 7237736 - DNA, 22 bp, Homo sapiens
tggtttgtttgttcatgtaaaa

SEQ ID NO: 7237737 - DNA, 22 bp, Homo sapiens
tggtttataacatgtctcatga

SEQ ID NO: 7237738 - DNA, 22 bp, Homo sapiens
tggtttcatgagatgagaattt

SEQ ID NO: 7237739 - DNA, 22 bp, Homo sapiens
tggtttctgggtttgtctagga

SEQ ID NO: 7237740 - DNA, 23 bp, Homo sapiens
tggtggggtcttggagacagcac

SEQ ID NO: 7237741 - DNA, 22 bp, Homo sapiens
tggtgtcatgttggggtttatt

SEQ ID NO: 7237742 - DNA, 22 bp, Homo sapiens
tggtggggccagacttcagctc

SEQ ID NO: 7237743 - DNA, 22 bp, Homo sapiens
tggtggggctttccttctgctt

SEQ ID NO: 7237744 - DNA, 22 bp, Homo sapiens
tggtgggggaggctgtctagca

SEQ ID NO: 7237745 - DNA, 22 bp, Homo sapiens
tggtggggtcatcgtcagatgc

SEQ ID NO: 7237746 - DNA, 22 bp, Homo sapiens
tggtgggggaggctgtctagca

SEQ ID NO: 7237747 - DNA, 16 bp, Homo sapiens
tggtggggaggacagc

SEQ ID NO: 7237748 - DNA, 22 bp, Homo sapiens
tggtggggattccctccctggc

SEQ ID NO: 7237749 - DNA, 22 bp, Homo sapiens
tggtgggagtccgctgtgctgc

SEQ ID NO: 7237750 - DNA, 22 bp, Homo sapiens
tggtggcagctgagtgtcaggt

SEQ ID NO: 7237751 - DNA, 19 bp, Homo sapiens
tggtggcaatgtcagctaa

SEQ ID NO: 7237752 - DNA, 23 bp, Homo sapiens
tggtggcagaagtagcagatgac

SEQ ID NO: 7237753 - DNA, 22 bp, Homo sapiens
tggtgcagtagagctgtctggg

SEQ ID NO: 7237754 - DNA, 22 bp, Homo sapiens
tggtgcaagtctctgaggaggg

SEQ ID NO: 7237755 - DNA, 22 bp, Homo sapiens
tgtgaaaagggctttgtacaaa

SEQ ID NO: 7237756 - DNA, 22 bp, Homo sapiens
tgtctttgttattgtggacagg

SEQ ID NO: 7237757 - DNA, 22 bp, Homo sapiens
tgtctcctaatgtctgtttcct

SEQ ID NO: 7237758 - DNA, 22 bp, Homo sapiens
tgtctcctactgcctgtggatc

SEQ ID NO: 7237759 - DNA, 22 bp, Homo sapiens
tgtctcctatttcctgctaagg

SEQ ID NO: 7237760 - DNA, 22 bp, Homo sapiens
tgtctcctcaactcatgctcga

SEQ ID NO: 7237761 - DNA, 22 bp, Homo sapiens
tgtctcctcggctgtccagcca

SEQ ID NO: 7237762 - DNA, 19 bp, Homo sapiens
tgtctcctccccgccgtct

SEQ ID NO: 7237763 - DNA, 19 bp, Homo sapiens
tgtctcctcatgcaagtgt

SEQ ID NO: 7237764 - DNA, 22 bp, Homo sapiens
tgtctcctcatactgtcatatt

SEQ ID NO: 7237765 - DNA, 21 bp, Homo sapiens
tgtctcctgttggcacatggc

SEQ ID NO: 7237766 - DNA, 22 bp, Homo sapiens
tgtctcctgggtcccttccacc

SEQ ID NO: 7237767 - DNA, 22 bp, Homo sapiens
tgtctcctgggccctggccctg

SEQ ID NO: 7237768 - DNA, 22 bp, Homo sapiens
tgtctcctgcaggggtgtgggc

SEQ ID NO: 7237769 - DNA, 22 bp, Homo sapiens
tgtctcctgagagctggacaga

SEQ ID NO: 7237770 - DNA, 22 bp, Homo sapiens
tgtctcctctgtcctgtcagga

SEQ ID NO: 7237771 - DNA, 22 bp, Homo sapiens
tgtctccttgcttttccctgta

SEQ ID NO: 7237772 - DNA, 22 bp, Homo sapiens
tgtctgcaaagtccagcacagg

SEQ ID NO: 7237773 - DNA, 22 bp, Homo sapiens
tgtgggaggaacacagccagaa

SEQ ID NO: 7237774 - DNA, 22 bp, Homo sapiens
tgtgggaggaattagaatggga

SEQ ID NO: 7237775 - DNA, 22 bp, Homo sapiens
tgtggaagtgccaatgacaaat

SEQ ID NO: 7237776 - DNA, 22 bp, Homo sapiens
tgtggacaccactgggaggtct

SEQ ID NO: 7237777 - DNA, 22 bp, Homo sapiens
tgtgggcaggagcacaagtcag

SEQ ID NO: 7237778 - DNA, 22 bp, Homo sapiens
tgtgtacaagagtgtttactgt

SEQ ID NO: 7237779 - DNA, 22 bp, Homo sapiens
tgtgtcagaagtacttttggaa

SEQ ID NO: 7237780 - DNA, 22 bp, Homo sapiens
tgtgtcagaaggcaatggggat

SEQ ID NO: 7237781 - DNA, 22 bp, Homo sapiens
tgtgtcagaaatcagtgcctcg

SEQ ID NO: 7237782 - DNA, 22 bp, Homo sapiens
tgtgtcagaaatcagtgcctcg

SEQ ID NO: 7237783 - DNA, 22 bp, Homo sapiens
tgtgtcaagacatttagtcatt

SEQ ID NO: 7237784 - DNA, 22 bp, Homo sapiens
tgtgtcagaggtagagatggca

SEQ ID NO: 7237785 - DNA, 22 bp, Homo sapiens
tgtgtcagaatttttgtggcaa

SEQ ID NO: 7237786 - DNA, 22 bp, Homo sapiens
tgtttatagggtctgtcacttg

SEQ ID NO: 7237787 - DNA, 22 bp, Homo sapiens
tgtttaaatagaacatactgca

SEQ ID NO: 7237788 - DNA, 22 bp, Homo sapiens
ttaaaatgtacaggggaaagtg

SEQ ID NO: 7237789 - DNA, 22 bp, Homo sapiens
ttaaaatgcagattctgattca

SEQ ID NO: 7237790 - DNA, 22 bp, Homo sapiens
tgttttagctgacacatggagc

SEQ ID NO: 7237791 - DNA, 22 bp, Homo sapiens
ttagaacatctgtgtctttatg

SEQ ID NO: 7237792 - DNA, 22 bp, Homo sapiens
ttatatgtttctgtttggaggc

SEQ ID NO: 7237793 - DNA, 22 bp, Homo sapiens
ttatgatttgccacagattggt

SEQ ID NO: 7237794 - DNA, 22 bp, Homo sapiens
ttatttatggccctcacctgat

SEQ ID NO: 7237795 - DNA, 22 bp, Homo sapiens
ttacaaagttctgagttcaaac

SEQ ID NO: 7237796 - DNA, 21 bp, Homo sapiens
acagacagggccagtgtcccc

SEQ ID NO: 7237797 - DNA, 22 bp, Homo sapiens
acagacagtatggtggggctga

SEQ ID NO: 7237798 - DNA, 22 bp, Homo sapiens
acagacagtaaatagtgtggct

SEQ ID NO: 7237799 - DNA, 21 bp, Homo sapiens
acagacagtccagagaaaaga

SEQ ID NO: 7237800 - DNA, 22 bp, Homo sapiens
agcattctcagaatgtcatttt

SEQ ID NO: 7237801 - DNA, 23 bp, Homo sapiens
agcattctctccaacatttaaca

SEQ ID NO: 7237802 - DNA, 22 bp, Homo sapiens
agattttatagataatttccca

SEQ ID NO: 7237803 - DNA, 22 bp, Homo sapiens
acacactggaggtaaatggggt

SEQ ID NO: 7237804 - DNA, 22 bp, Homo sapiens
agcagggctgtgtaggtaatga

SEQ ID NO: 7237805 - DNA, 22 bp, Homo sapiens
agcagggcctctggcactggtc

SEQ ID NO: 7237806 - DNA, 22 bp, Homo sapiens
agcagggcttctgtgcctgtgc

SEQ ID NO: 7237807 - DNA, 22 bp, Homo sapiens
agcagggctttggctggctttc

SEQ ID NO: 7237808 - DNA, 22 bp, Homo sapiens
agcagggctttgcagacttggg

SEQ ID NO: 7237809 - DNA, 22 bp, Homo sapiens
agcagggcttgccgcttgtcct

SEQ ID NO: 7237810 - DNA, 22 bp, Homo sapiens
agcagggctttgtctctgtgaa

SEQ ID NO: 7237811 - DNA, 21 bp, Homo sapiens
agcaggtgaacctccagtaca

SEQ ID NO: 7237812 - DNA, 22 bp, Homo sapiens
agcaggtgaattcctggatgtg

SEQ ID NO: 7237813 - DNA, 20 bp, Homo sapiens
agcaggtgacggggcctgct

SEQ ID NO: 7237814 - DNA, 22 bp, Homo sapiens
agcaggtgacagggctgtggtg

SEQ ID NO: 7237815 - DNA, 22 bp, Homo sapiens
agcaggtgacccaagcaggctg

SEQ ID NO: 7237816 - DNA, 22 bp, Homo sapiens
agcaggtgagcacagccaggct

SEQ ID NO: 7237817 - DNA, 22 bp, Homo sapiens
agcaggagggttttgtagagtc

SEQ ID NO: 7237818 - DNA, 22 bp, Homo sapiens
aatgtataaagtgttaataact

SEQ ID NO: 7237819 - DNA, 22 bp, Homo sapiens
aatggacaaacttgggaagtat

SEQ ID NO: 7237820 - DNA, 22 bp, Homo sapiens
aatggaatacctaggtggccca

SEQ ID NO: 7237821 - DNA, 22 bp, Homo sapiens
aatgctttggggttggtactgt

SEQ ID NO: 7237822 - DNA, 22 bp, Homo sapiens
agagatatgagtagttgtgaca

SEQ ID NO: 7237823 - DNA, 20 bp, Homo sapiens
agagagttgtcagtagcttc

SEQ ID NO: 7237824 - DNA, 22 bp, Homo sapiens
agactgaagtaagaatgcagct

SEQ ID NO: 7237825 - DNA, 22 bp, Homo sapiens
agactgaaacaatctgcaggca

SEQ ID NO: 7237826 - DNA, 22 bp, Homo sapiens
agactgaaccctctgctgcact

SEQ ID NO: 7237827 - DNA, 22 bp, Homo sapiens
agatatgactagaagctcattt

SEQ ID NO: 7237828 - DNA, 21 bp, Homo sapiens
agagtctgcatttctgacaag

SEQ ID NO: 7237829 - DNA, 22 bp, Homo sapiens
agaggtgggagcctggtcacat

SEQ ID NO: 7237830 - DNA, 20 bp, Homo sapiens
agagtaactggcacataggg

SEQ ID NO: 7237831 - DNA, 22 bp, Homo sapiens
acatgtgttttcctacttatga

SEQ ID NO: 7237832 - DNA, 22 bp, Homo sapiens
acatgtgttaaaattctcacca

SEQ ID NO: 7237833 - DNA, 22 bp, Homo sapiens
aagggcagcctgactcacggtc

SEQ ID NO: 7237834 - DNA, 22 bp, Homo sapiens
accactgcccatggtgaaaact

SEQ ID NO: 7237835 - DNA, 22 bp, Homo sapiens
aagggcagctattatcgtcatc

SEQ ID NO: 7237836 - DNA, 22 bp, Homo sapiens
aagggcagctgacagatgctta

SEQ ID NO: 7237837 - DNA, 22 bp, Homo sapiens
aagggcagcttaaattggtagc

SEQ ID NO: 7237838 - DNA, 22 bp, Homo sapiens
aaggtgtcactgtttctggcct

SEQ ID NO: 7237839 - DNA, 22 bp, Homo sapiens
aaggtgtcactgggacaggaaa

SEQ ID NO: 7237840 - DNA, 22 bp, Homo sapiens
acagctggcaggggggcatgaa

SEQ ID NO: 7237841 - DNA, 22 bp, Homo sapiens
acaggtgtaggtacatttgcat

SEQ ID NO: 7237842 - DNA, 22 bp, Homo sapiens
acaggtgtatgaatatgttcca

SEQ ID NO: 7237843 - DNA, 22 bp, Homo sapiens
acaggtgtaggtacatttgcat

SEQ ID NO: 7237844 - DNA, 22 bp, Homo sapiens
acaggtgtagcaggagcatcaa

SEQ ID NO: 7237845 - DNA, 22 bp, Homo sapiens
acaggtgtagcaggagcatcaa

SEQ ID NO: 7237846 - DNA, 22 bp, Homo sapiens
acaggtgtagaaaacagattat

SEQ ID NO: 7237847 - DNA, 22 bp, Homo sapiens
acaggtgtctgcaagttactgg

SEQ ID NO: 7237848 - DNA, 22 bp, Homo sapiens
acaggtgtccaacatttacctt

SEQ ID NO: 7237849 - DNA, 22 bp, Homo sapiens
acaggtgtctaaggcagacagc

SEQ ID NO: 7237850 - DNA, 22 bp, Homo sapiens
acaggtgtcctcacagggggtg

SEQ ID NO: 7237851 - DNA, 22 bp, Homo sapiens
acaggtgtggggctgtggtact

SEQ ID NO: 7237852 - DNA, 22 bp, Homo sapiens
acaggtgtgggctgggctctga

SEQ ID NO: 7237853 - DNA, 22 bp, Homo sapiens
acaggtgtgcggaaagctgtga

SEQ ID NO: 7237854 - DNA, 22 bp, Homo sapiens
acaggtgtgagaacatgccttg

SEQ ID NO: 7237855 - DNA, 22 bp, Homo sapiens
acaggtgtgagaacatgccttg

SEQ ID NO: 7237856 - DNA, 22 bp, Homo sapiens
acttatttcatggatcataatg

SEQ ID NO: 7237857 - DNA, 21 bp, Homo sapiens
aagtaaatcagagaaataacc

SEQ ID NO: 7237858 - DNA, 21 bp, Homo sapiens
acctttaattcaagcatcagg

SEQ ID NO: 7237859 - DNA, 22 bp, Homo sapiens
aagtgaagaaatacatgagaat

SEQ ID NO: 7237860 - DNA, 22 bp, Homo sapiens
aataaatgaacaaagcaggttg

SEQ ID NO: 7237861 - DNA, 22 bp, Homo sapiens
aataaatgttaagattgtctca

SEQ ID NO: 7237862 - DNA, 22 bp, Homo sapiens
aataaatgtttgttggatgttt

SEQ ID NO: 7237863 - DNA, 22 bp, Homo sapiens
aatgttttgtatgcctctgagc

SEQ ID NO: 7237864 - DNA, 22 bp, Homo sapiens
aatgttttttggtctgatgaat

SEQ ID NO: 7237865 - DNA, 22 bp, Homo sapiens
aatgtcttgagaagagaaatct

SEQ ID NO: 7237866 - DNA, 20 bp, Homo sapiens
aatgtattgttttgtttcag

SEQ ID NO: 7237867 - DNA, 22 bp, Homo sapiens
aagaattattgcaatactagat

SEQ ID NO: 7237868 - DNA, 23 bp, Homo sapiens
acagatgaaagtgtggctcagag

SEQ ID NO: 7237869 - DNA, 22 bp, Homo sapiens
aagagttctcagaaacgtgggt

SEQ ID NO: 7237870 - DNA, 22 bp, Homo sapiens
aagaggttgtctgtgatgagtt

SEQ ID NO: 7237871 - DNA, 22 bp, Homo sapiens
aacactgtactggaagatggac

SEQ ID NO: 7237872 - DNA, 22 bp, Homo sapiens
aacactgctgctgggttctgtg

SEQ ID NO: 7237873 - DNA, 22 bp, Homo sapiens
aacactgctccaaaaaaggctt

SEQ ID NO: 7237874 - DNA, 22 bp, Homo sapiens
aaagcaatttaatggaccatga

SEQ ID NO: 7237875 - DNA, 22 bp, Homo sapiens
aaagcaattgtggtttttgtca

SEQ ID NO: 7237876 - DNA, 22 bp, Homo sapiens
aaagcaattgtggtttttgcca

SEQ ID NO: 7237877 - DNA, 22 bp, Homo sapiens
aaagcaattacaaaagggataa

SEQ ID NO: 7237878 - DNA, 22 bp, Homo sapiens
aaagcaatgtctctgcctggtt

SEQ ID NO: 7237879 - DNA, 22 bp, Homo sapiens
aaagcaatgggtctaaggtaaa

SEQ ID NO: 7237880 - DNA, 22 bp, Homo sapiens
aaagcaatagagggtaagactg

SEQ ID NO: 7237881 - DNA, 22 bp, Homo sapiens
aaagcaatggcacatgatggta

SEQ ID NO: 7237882 - DNA, 22 bp, Homo sapiens
aagcactttagtgagaataagg

SEQ ID NO: 7237883 - DNA, 22 bp, Homo sapiens
aagcactgtacaaatgtcactt

SEQ ID NO: 7237884 - DNA, 22 bp, Homo sapiens
aagcagattggggatttccatg

SEQ ID NO: 7237885 - DNA, 22 bp, Homo sapiens
aagcagatgccaagatttacca

SEQ ID NO: 7237886 - DNA, 22 bp, Homo sapiens
aagcagatgggactccaaggca

SEQ ID NO: 7237887 - DNA, 23 bp, Homo sapiens
aagcatggttcacagttagtact

SEQ ID NO: 7237888 - DNA, 22 bp, Homo sapiens
aagaatgttagtttctgataca

SEQ ID NO: 7237889 - DNA, 22 bp, Homo sapiens
aagaatgtgggtggatatgatg

SEQ ID NO: 7237890 - DNA, 22 bp, Homo sapiens
aagaatgtcgttggtattttaa

SEQ ID NO: 7237891 - DNA, 22 bp, Homo sapiens
aaatagaaaccaacaaggtcag

SEQ ID NO: 7237892 - DNA, 22 bp, Homo sapiens
aaagcaataggttaggtcaaga

SEQ ID NO: 7237893 - DNA, 22 bp, Homo sapiens
aaagcaatgcccgttcattatc

SEQ ID NO: 7237894 - DNA, 22 bp, Homo sapiens
aaagcaatgatggtagacacgt

SEQ ID NO: 7237895 - DNA, 22 bp, Homo sapiens
aaagcaatctagttccaattct

SEQ ID NO: 7237896 - DNA, 22 bp, Homo sapiens
aaagcaatcagattcagatgtc

SEQ ID NO: 7237897 - DNA, 22 bp, Homo sapiens
aaagcaatagtaatggtaatag

SEQ ID NO: 7237898 - DNA, 22 bp, Homo sapiens
aaagcaatgcttgtggaatgta

SEQ ID NO: 7237899 - DNA, 22 bp, Homo sapiens
aaacactgcgtggtggcaactc

SEQ ID NO: 7237900 - DNA, 22 bp, Homo sapiens
aaacactgcagggtttacttga

SEQ ID NO: 7237901 - DNA, 22 bp, Homo sapiens
aaacactggcaatttcatgcac

SEQ ID NO: 7237902 - DNA, 20 bp, Homo sapiens
aaacactggctggggcacag

SEQ ID NO: 7237903 - DNA, 22 bp, Homo sapiens
aaacactggtatgatgtatagt

SEQ ID NO: 7237904 - DNA, 22 bp, Homo sapiens
aaacactgtctctggtattgaa

SEQ ID NO: 7237905 - DNA, 22 bp, Homo sapiens
aaacactgtacaatctgcaggg

SEQ ID NO: 7237906 - DNA, 22 bp, Homo sapiens
aaagtccaattttgttcaggct

SEQ ID NO: 7237907 - DNA, 21 bp, Homo sapiens
aaaaatgaagttgttcaggaa

SEQ ID NO: 7237908 - DNA, 22 bp, Homo sapiens
aaaaatgaattcttcagtggca

SEQ ID NO: 7237909 - DNA, 22 bp, Homo sapiens
aaagaagatggagacctgacta

SEQ ID NO: 7237910 - DNA, 22 bp, Homo sapiens
aaagaagagctggaaggagtct

SEQ ID NO: 7237911 - DNA, 22 bp, Homo sapiens
aaagaagagcaaatttgttgta

SEQ ID NO: 7237912 - DNA, 22 bp, Homo sapiens
aaagaagacagacatttctttc

SEQ ID NO: 7237913 - DNA, 17 bp, Homo sapiens
aaagagcttggagtgtt

SEQ ID NO: 7237914 - DNA, 22 bp, Homo sapiens
aaactgtaaacacagcagtaca

SEQ ID NO: 7237915 - DNA, 22 bp, Homo sapiens
aaacatgagcatctcttcaagc

SEQ ID NO: 7237916 - DNA, 22 bp, Homo sapiens
accaggggtgtcaacagcattt

SEQ ID NO: 7237917 - DNA, 22 bp, Homo sapiens
acattcatgtcccacttctagc

SEQ ID NO: 7237918 - DNA, 22 bp, Homo sapiens
aggcatggggctgcagtcaggt

SEQ ID NO: 7237919 - DNA, 22 bp, Homo sapiens
agctttatggtgcctcacttga

SEQ ID NO: 7237920 - DNA, 22 bp, Homo sapiens
agctttattaactctccaggtg

SEQ ID NO: 7237921 - DNA, 22 bp, Homo sapiens
agcttcagcttgcagctgtgat

SEQ ID NO: 7237922 - DNA, 22 bp, Homo sapiens
acagccaggtaaaggcatggca

SEQ ID NO: 7237923 - DNA, 22 bp, Homo sapiens
acatacagacctgcagggcagc

SEQ ID NO: 7237924 - DNA, 22 bp, Homo sapiens
aggagacatctaactgtaggtt

SEQ ID NO: 7237925 - DNA, 23 bp, Homo sapiens
aggaagctaagtgtggctgcgga

SEQ ID NO: 7237926 - DNA, 22 bp, Homo sapiens
aggaagctaaccagggagtgag

SEQ ID NO: 7237927 - DNA, 22 bp, Homo sapiens
aggagctgcatggatacctggt

SEQ ID NO: 7237928 - DNA, 22 bp, Homo sapiens
aggagctgcagattctgccttg

SEQ ID NO: 7237929 - DNA, 22 bp, Homo sapiens
aggagctgcactgggagttttt

SEQ ID NO: 7237930 - DNA, 22 bp, Homo sapiens
aggagctgcttaaatggttggt

SEQ ID NO: 7237931 - DNA, 21 bp, Homo sapiens
agtagtttagcacagggtttg

SEQ ID NO: 7237932 - DNA, 22 bp, Homo sapiens
aggtggggaaaccagcgatccc

SEQ ID NO: 7237933 - DNA, 22 bp, Homo sapiens
agtgtcctttctgttccagcca

SEQ ID NO: 7237934 - DNA, 22 bp, Homo sapiens
agtgtccttgttattactgctc

SEQ ID NO: 7237935 - DNA, 22 bp, Homo sapiens
agtgtccttgattcctgttgtt

SEQ ID NO: 7237936 - DNA, 21 bp, Homo sapiens
agtgtccttgatcttgccttg

SEQ ID NO: 7237937 - DNA, 22 bp, Homo sapiens
agtgtccttgaggttcctagga

SEQ ID NO: 7237938 - DNA, 22 bp, Homo sapiens
agtgtccttagttagctttggg

SEQ ID NO: 7237939 - DNA, 21 bp, Homo sapiens
agtgtccttttactgtgaata

SEQ ID NO: 7237940 - DNA, 22 bp, Homo sapiens
agtgtcctgtgtcccagactgt

SEQ ID NO: 7237941 - DNA, 22 bp, Homo sapiens
agtgtcctggggccctaaggcc

SEQ ID NO: 7237942 - DNA, 22 bp, Homo sapiens
actgcacttcagcctgggtgac

SEQ ID NO: 7237943 - DNA, 22 bp, Homo sapiens
actgcactccagcctgggtgat

SEQ ID NO: 7237944 - DNA, 22 bp, Homo sapiens
actgcacttcaccctgggtgac

SEQ ID NO: 7237945 - DNA, 22 bp, Homo sapiens
agtgaagccccgatgcgttttg

SEQ ID NO: 7237946 - DNA, 22 bp, Homo sapiens
agtgaagcccatttttagctgt

SEQ ID NO: 7237947 - DNA, 22 bp, Homo sapiens
agtgaagctaacctgctgattt

SEQ ID NO: 7237948 - DNA, 22 bp, Homo sapiens
actgtttcagtttctgaagttt

SEQ ID NO: 7237949 - DNA, 22 bp, Homo sapiens
actgttttcttagctccctgct

SEQ ID NO: 7237950 - DNA, 22 bp, Homo sapiens
actttgttcctttcacaaagaa

SEQ ID NO: 7237951 - DNA, 22 bp, Homo sapiens
actttgtgcccaacagaaagaa

SEQ ID NO: 7237952 - DNA, 21 bp, Homo sapiens
atatttttgtttggactgtca

SEQ ID NO: 7237953 - DNA, 22 bp, Homo sapiens
atatttttccatgtgggactct

SEQ ID NO: 7237954 - DNA, 22 bp, Homo sapiens
atcaggtgtggtccaatcagca

SEQ ID NO: 7237955 - DNA, 20 bp, Homo sapiens
atcaggtgtattccttatct

SEQ ID NO: 7237956 - DNA, 22 bp, Homo sapiens
agagtccagaaaacagtgtgct

SEQ ID NO: 7237957 - DNA, 22 bp, Homo sapiens
agagtccaggtgggctggaggc

SEQ ID NO: 7237958 - DNA, 22 bp, Homo sapiens
agagtctgaggcagctgcagcc

SEQ ID NO: 7237959 - DNA, 22 bp, Homo sapiens
agatcaaagccatgagagattt

SEQ ID NO: 7237960 - DNA, 22 bp, Homo sapiens
agagtggcagcaagtcaggtag

SEQ ID NO: 7237961 - DNA, 22 bp, Homo sapiens
agatgtgtttctagttcctgca

SEQ ID NO: 7237962 - DNA, 22 bp, Homo sapiens
caaaggcaggtgctgaatattc

SEQ ID NO: 7237963 - DNA, 22 bp, Homo sapiens
agagagttctttctagttgaag

SEQ ID NO: 7237964 - DNA, 22 bp, Homo sapiens
atgatacatttacctatggtct

SEQ ID NO: 7237965 - DNA, 22 bp, Homo sapiens
agacagacagagaatttaaata

SEQ ID NO: 7237966 - DNA, 22 bp, Homo sapiens
agacagacacatggtaacagat

SEQ ID NO: 7237967 - DNA, 22 bp, Homo sapiens
agacagacaaaattcctgcctg

SEQ ID NO: 7237968 - DNA, 15 bp, Homo sapiens
agacagacagtggga

SEQ ID NO: 7237969 - DNA, 18 bp, Homo sapiens
agacagacaggtttgtgc

SEQ ID NO: 7237970 - DNA, 22 bp, Homo sapiens
agacagacatagaaattagtaa

SEQ ID NO: 7237971 - DNA, 22 bp, Homo sapiens
agacgagggcccccaggacagc

SEQ ID NO: 7237972 - DNA, 22 bp, Homo sapiens
agacacattttacattaactgt

SEQ ID NO: 7237973 - DNA, 22 bp, Homo sapiens
agacactgttctcacatgcttg

SEQ ID NO: 7237974 - DNA, 22 bp, Homo sapiens
atctgctgttcttcacagcttg

SEQ ID NO: 7237975 - DNA, 18 bp, Homo sapiens
atctgctggcaggtctgg

SEQ ID NO: 7237976 - DNA, 20 bp, Homo sapiens
atctgctgagaatgaaaggc

SEQ ID NO: 7237977 - DNA, 19 bp, Homo sapiens
atctgccttagtgctgctg

SEQ ID NO: 7237978 - DNA, 19 bp, Homo sapiens
atgaagcattgtttttgta

SEQ ID NO: 7237979 - DNA, 22 bp, Homo sapiens
atgaagcattacaggatgacag

SEQ ID NO: 7237980 - DNA, 22 bp, Homo sapiens
atgaagcatctcacaatctagt

SEQ ID NO: 7237981 - DNA, 22 bp, Homo sapiens
atgaagcagttaaggtgcatga

SEQ ID NO: 7237982 - DNA, 22 bp, Homo sapiens
cagatgtacatgaagggcaatg

SEQ ID NO: 7237983 - DNA, 22 bp, Homo sapiens
agctctgggccaggaaccctaa

SEQ ID NO: 7237984 - DNA, 22 bp, Homo sapiens
agcagggctgcggccccaccac

SEQ ID NO: 7237985 - DNA, 22 bp, Homo sapiens
agcagggctgcagtgtgtcttt

SEQ ID NO: 7237986 - DNA, 22 bp, Homo sapiens
agcagggctctgtggagggtgg

SEQ ID NO: 7237987 - DNA, 22 bp, Homo sapiens
agcagggcagctgatgcgcacg

SEQ ID NO: 7237988 - DNA, 22 bp, Homo sapiens
agcagggcactggaaggcactg

SEQ ID NO: 7237989 - DNA, 22 bp, Homo sapiens
agcagggcaaagtcaggctaac

SEQ ID NO: 7237990 - DNA, 22 bp, Homo sapiens
agcagggcagtgatcagaaagg

SEQ ID NO: 7237991 - DNA, 22 bp, Homo sapiens
agcagggcaggtaaggatcaga

SEQ ID NO: 7237992 - DNA, 22 bp, Homo sapiens
agcagggcagcttttttcagaa

SEQ ID NO: 7237993 - DNA, 19 bp, Homo sapiens
agcaggtgggtaagaaaat

SEQ ID NO: 7237994 - DNA, 22 bp, Homo sapiens
agcagggctggggcacgagcca

SEQ ID NO: 7237995 - DNA, 22 bp, Homo sapiens
agcagggctggatttggcaaga

SEQ ID NO: 7237996 - DNA, 22 bp, Homo sapiens
agcaggtgtcggcgagggtctt

SEQ ID NO: 7237997 - DNA, 22 bp, Homo sapiens
agcaggtgttagggatccaatg

SEQ ID NO: 7237998 - DNA, 18 bp, Homo sapiens
agcaggtgtgcagaatgt

SEQ ID NO: 7237999 - DNA, 22 bp, Homo sapiens
agcaggtgttggctgggccatc

SEQ ID NO: 7238000 - DNA, 22 bp, Homo sapiens
agcaggtgtttgtatcataagg

SEQ ID NO: 7238001 - DNA, 22 bp, Homo sapiens
agcagccctagggattgctgtt

SEQ ID NO: 7238002 - DNA, 22 bp, Homo sapiens
agcagcccagttgtactgagtg

SEQ ID NO: 7238003 - DNA, 20 bp, Homo sapiens
agcagagtgcccatcccgga

SEQ ID NO: 7238004 - DNA, 22 bp, Homo sapiens
agcactctaagtgcaagacact

SEQ ID NO: 7238005 - DNA, 22 bp, Homo sapiens
caaaggcatgtgagtatatgtg

SEQ ID NO: 7238006 - DNA, 22 bp, Homo sapiens
caaaggcagttactgaatgaag

SEQ ID NO: 7238007 - DNA, 22 bp, Homo sapiens
ccagggcaggagaaagactcac

SEQ ID NO: 7238008 - DNA, 22 bp, Homo sapiens
aggctagaggcttctggcttca

SEQ ID NO: 7238009 - DNA, 22 bp, Homo sapiens
ccagagcctggcatctgcataa

SEQ ID NO: 7238010 - DNA, 21 bp, Homo sapiens
ccagagcctgctgagccccct

SEQ ID NO: 7238011 - DNA, 22 bp, Homo sapiens
ccagaaatcctctctttcttgc

SEQ ID NO: 7238012 - DNA, 22 bp, Homo sapiens
aggcggtgtgctttgcagagca

SEQ ID NO: 7238013 - DNA, 22 bp, Homo sapiens
caggaaatataggaaaaggaac

SEQ ID NO: 7238014 - DNA, 22 bp, Homo sapiens
agctggtcctaattgagccatt

SEQ ID NO: 7238015 - DNA, 22 bp, Homo sapiens
agctttatttgtcattcacggc

SEQ ID NO: 7238016 - DNA, 22 bp, Homo sapiens
agctttattcatgatttcaggg

SEQ ID NO: 7238017 - DNA, 22 bp, Homo sapiens
agctttatatttaatgaattct

SEQ ID NO: 7238018 - DNA, 22 bp, Homo sapiens
agctttatatttaatgaattct

SEQ ID NO: 7238019 - DNA, 22 bp, Homo sapiens
aggaagatgggagagctctgga

SEQ ID NO: 7238020 - DNA, 22 bp, Homo sapiens
aggaatgtgactattttttcag

SEQ ID NO: 7238021 - DNA, 22 bp, Homo sapiens
aggagctgatagtctatggaga

SEQ ID NO: 7238022 - DNA, 22 bp, Homo sapiens
aggagctggccactaggatgca

SEQ ID NO: 7238023 - DNA, 22 bp, Homo sapiens
aggagctggcctagaaaggaga

SEQ ID NO: 7238024 - DNA, 22 bp, Homo sapiens
aggagctgggcccaaggatgct

SEQ ID NO: 7238025 - DNA, 22 bp, Homo sapiens
catgtgtcctagctattctcct

SEQ ID NO: 7238026 - DNA, 22 bp, Homo sapiens
catgtgtccacccttgaacaca

SEQ ID NO: 7238027 - DNA, 22 bp, Homo sapiens
catgtgtctttatggagccaca

SEQ ID NO: 7238028 - DNA, 21 bp, Homo sapiens
catgtgtcttgtgttactgct

SEQ ID NO: 7238029 - DNA, 22 bp, Homo sapiens
catgtgtctaatctactaatat

SEQ ID NO: 7238030 - DNA, 22 bp, Homo sapiens
catgtgtcttgctgccctccat

SEQ ID NO: 7238031 - DNA, 22 bp, Homo sapiens
catgtgtctaatctactaatat

SEQ ID NO: 7238032 - DNA, 22 bp, Homo sapiens
catgtgtcctagctattctcct

SEQ ID NO: 7238033 - DNA, 22 bp, Homo sapiens
aggcactgattctcagagttac

SEQ ID NO: 7238034 - DNA, 22 bp, Homo sapiens
aggcactgattctgttttccat

SEQ ID NO: 7238035 - DNA, 22 bp, Homo sapiens
aggcactgacctgcttccttga

SEQ ID NO: 7238036 - DNA, 22 bp, Homo sapiens
aggcactgactcaagggagcca

SEQ ID NO: 7238037 - DNA, 22 bp, Homo sapiens
aggcactgagaggctgtgttgc

SEQ ID NO: 7238038 - DNA, 23 bp, Homo sapiens
aggcactgaatgtgtcagtgagt

SEQ ID NO: 7238039 - DNA, 22 bp, Homo sapiens
aggcactgacaattctggactg

SEQ ID NO: 7238040 - DNA, 22 bp, Homo sapiens
aggcactgacagattctgtgtc

SEQ ID NO: 7238041 - DNA, 22 bp, Homo sapiens
aggcactgaaaggtggccagag

SEQ ID NO: 7238042 - DNA, 22 bp, Homo sapiens
aggcactgaagaactctttttg

SEQ ID NO: 7238043 - DNA, 22 bp, Homo sapiens
aggcactgaaggaagcttgcgc

SEQ ID NO: 7238044 - DNA, 22 bp, Homo sapiens
aggcactgaagtggtaaatgta

SEQ ID NO: 7238045 - DNA, 22 bp, Homo sapiens
aggcactgaatatccagtaaaa

SEQ ID NO: 7238046 - DNA, 22 bp, Homo sapiens
aggcagcttaagccctggccca

SEQ ID NO: 7238047 - DNA, 22 bp, Homo sapiens
ccaaaatgtttgaatgcatgtg

SEQ ID NO: 7238048 - DNA, 22 bp, Homo sapiens
ccaaagaaacccaagctcaggg

SEQ ID NO: 7238049 - DNA, 22 bp, Homo sapiens
ctattgaggacataaggactct

SEQ ID NO: 7238050 - DNA, 22 bp, Homo sapiens
agtaaatggcccagggttatca

SEQ ID NO: 7238051 - DNA, 22 bp, Homo sapiens
agtaaatgaaagcaattttaga

SEQ ID NO: 7238052 - DNA, 22 bp, Homo sapiens
agtcaagattctggcactagca

SEQ ID NO: 7238053 - DNA, 22 bp, Homo sapiens
agtgtttatggaatcttagtta

SEQ ID NO: 7238054 - DNA, 18 bp, Homo sapiens
agtgtttatttaggtgaa

SEQ ID NO: 7238055 - DNA, 22 bp, Homo sapiens
agtgtcaactcggaataaggat

SEQ ID NO: 7238056 - DNA, 22 bp, Homo sapiens
agtgtcagttgccttgtcataa

SEQ ID NO: 7238057 - DNA, 22 bp, Homo sapiens
agtgtcagctaattattcatga

SEQ ID NO: 7238058 - DNA, 22 bp, Homo sapiens
agtgtcctcctctgggagccag

SEQ ID NO: 7238059 - DNA, 22 bp, Homo sapiens
agtgtcctctattatgacttta

SEQ ID NO: 7238060 - DNA, 22 bp, Homo sapiens
agtgtcctcatctgtaaaatga

SEQ ID NO: 7238061 - DNA, 22 bp, Homo sapiens
agtgtcctcaggctttgttcct

SEQ ID NO: 7238062 - DNA, 19 bp, Homo sapiens
agtgtcctagtcatttgcc

SEQ ID NO: 7238063 - DNA, 22 bp, Homo sapiens
agtgtcctagcaagccggtcct

SEQ ID NO: 7238064 - DNA, 22 bp, Homo sapiens
agtgtcctacagctcctgcctg

SEQ ID NO: 7238065 - DNA, 22 bp, Homo sapiens
agtggggccgcggtcctgccct

SEQ ID NO: 7238066 - DNA, 22 bp, Homo sapiens
agtgatgccacacaatgctttg

SEQ ID NO: 7238067 - DNA, 22 bp, Homo sapiens
agtgataggacatatggatttt

SEQ ID NO: 7238068 - DNA, 22 bp, Homo sapiens
agtgcattctctaattacaggt

SEQ ID NO: 7238069 - DNA, 22 bp, Homo sapiens
ataaagcatactttgtatgact

SEQ ID NO: 7238070 - DNA, 22 bp, Homo sapiens
ataaaagaagttttggtacttg

SEQ ID NO: 7238071 - DNA, 22 bp, Homo sapiens
atacatgatgggtgtatagttt

SEQ ID NO: 7238072 - DNA, 22 bp, Homo sapiens
atagttttatagatattgtgta

SEQ ID NO: 7238073 - DNA, 22 bp, Homo sapiens
ctgtaatcccagctactcggga

SEQ ID NO: 7238074 - DNA, 23 bp, Homo sapiens
ctgtctcctgggctaggtggaat

SEQ ID NO: 7238075 - DNA, 22 bp, Homo sapiens
ctgtctcctcctttgttcttaa

SEQ ID NO: 7238076 - DNA, 22 bp, Homo sapiens
ctgtctccgccctcttggtagg

SEQ ID NO: 7238077 - DNA, 22 bp, Homo sapiens
ctgtctcctccactgcatggga

SEQ ID NO: 7238078 - DNA, 22 bp, Homo sapiens
atcaggtgcattagattaatta

SEQ ID NO: 7238079 - DNA, 22 bp, Homo sapiens
atcagctgctacattggcctct

SEQ ID NO: 7238080 - DNA, 22 bp, Homo sapiens
ctgtctccagggcaggtgcagg

SEQ ID NO: 7238081 - DNA, 22 bp, Homo sapiens
ctgtctcaagactgcaggcact

SEQ ID NO: 7238082 - DNA, 23 bp, Homo sapiens
atctcctgagaacccacagtggt

SEQ ID NO: 7238083 - DNA, 22 bp, Homo sapiens
atctggtttggggatccttgtg

SEQ ID NO: 7238084 - DNA, 22 bp, Homo sapiens
cttcaaggtggctaaatggggc

SEQ ID NO: 7238085 - DNA, 22 bp, Homo sapiens
cttattataaaatcctgtttga

SEQ ID NO: 7238086 - DNA, 22 bp, Homo sapiens
gaactttgcaaatgtcagaagc

SEQ ID NO: 7238087 - DNA, 22 bp, Homo sapiens
gaagaaagatcaaatagtttcc

SEQ ID NO: 7238088 - DNA, 22 bp, Homo sapiens
gaagaaagatcaaatagtttcc

SEQ ID NO: 7238089 - DNA, 22 bp, Homo sapiens
gaagaaagattggcatgcttca

SEQ ID NO: 7238090 - DNA, 22 bp, Homo sapiens
atgaagcaggcacagcttcagg

SEQ ID NO: 7238091 - DNA, 22 bp, Homo sapiens
atgaagcagcgttgtagagtga

SEQ ID NO: 7238092 - DNA, 22 bp, Homo sapiens
atcttcaaagcacatcgtttgt

SEQ ID NO: 7238093 - DNA, 22 bp, Homo sapiens
atcttcaacttgatcatttgaa

SEQ ID NO: 7238094 - DNA, 22 bp, Homo sapiens
cttgagaatgtgagccacagat

SEQ ID NO: 7238095 - DNA, 22 bp, Homo sapiens
cttgagaaggaggaagggcttt

SEQ ID NO: 7238096 - DNA, 22 bp, Homo sapiens
atgctttattgttaggtcatgt

SEQ ID NO: 7238097 - DNA, 22 bp, Homo sapiens
atgctttattggagacagtcat

SEQ ID NO: 7238098 - DNA, 22 bp, Homo sapiens
atgctttatgttctggcatttt

SEQ ID NO: 7238099 - DNA, 22 bp, Homo sapiens
atgctttagtgtcaagtttggg

SEQ ID NO: 7238100 - DNA, 22 bp, Homo sapiens
atgctttatacaaaacacttaa

SEQ ID NO: 7238101 - DNA, 22 bp, Homo sapiens
atgctttaaaacgtatgtgtaa

SEQ ID NO: 7238102 - DNA, 22 bp, Homo sapiens
atgctttaaatgtcttttgctt

SEQ ID NO: 7238103 - DNA, 22 bp, Homo sapiens
atgctttacagttttccaaaca

SEQ ID NO: 7238104 - DNA, 22 bp, Homo sapiens
gaagcaatttagaatcagaagc

SEQ ID NO: 7238105 - DNA, 22 bp, Homo sapiens
gaagcaattaagtttgtgatct

SEQ ID NO: 7238106 - DNA, 22 bp, Homo sapiens
gaagcaatgtgttttcaacatt

SEQ ID NO: 7238107 - DNA, 22 bp, Homo sapiens
gaagcaatctggctcccagcca

SEQ ID NO: 7238108 - DNA, 22 bp, Homo sapiens
gaatgtttaaaaggtgcagttt

SEQ ID NO: 7238109 - DNA, 22 bp, Homo sapiens
gaatgtttcatgtgtatgttag

SEQ ID NO: 7238110 - DNA, 19 bp, Homo sapiens
gaatgtttctgtctcttct

SEQ ID NO: 7238111 - DNA, 22 bp, Homo sapiens
atgcataatgtatgtattgact

SEQ ID NO: 7238112 - DNA, 22 bp, Homo sapiens
gagaggtggaggttgcagtgag

SEQ ID NO: 7238113 - DNA, 22 bp, Homo sapiens
gagcaggtctttcatggtgcat

SEQ ID NO: 7238114 - DNA, 22 bp, Homo sapiens
gagggcagaaaattatgcggtg

SEQ ID NO: 7238115 - DNA, 23 bp, Homo sapiens
gagtgcagaatagacatgcagtg

SEQ ID NO: 7238116 - DNA, 22 bp, Homo sapiens
atttgccttactgaagaaggag

SEQ ID NO: 7238117 - DNA, 22 bp, Homo sapiens
atttaccagtgctgacatttga

SEQ ID NO: 7238118 - DNA, 22 bp, Homo sapiens
caaatgaatatttccatgggtt

SEQ ID NO: 7238119 - DNA, 22 bp, Homo sapiens
caaatgaatttccctgcaaatg

SEQ ID NO: 7238120 - DNA, 20 bp, Homo sapiens
caaatgaagctgttggcctc

SEQ ID NO: 7238121 - DNA, 22 bp, Homo sapiens
caaatgaagagggcaacttctg

SEQ ID NO: 7238122 - DNA, 22 bp, Homo sapiens
caaatgaagtccaaagggctta

SEQ ID NO: 7238123 - DNA, 22 bp, Homo sapiens
gctctggttccagcgcgcccga

SEQ ID NO: 7238124 - DNA, 22 bp, Homo sapiens
gctctggttaaaaagaattaaa

SEQ ID NO: 7238125 - DNA, 22 bp, Homo sapiens
gctctggtggtgatcagacgct

SEQ ID NO: 7238126 - DNA, 22 bp, Homo sapiens
gctctggtgagtgtagttcagg

SEQ ID NO: 7238127 - DNA, 22 bp, Homo sapiens
gctctggtctgcttatatctat

SEQ ID NO: 7238128 - DNA, 22 bp, Homo sapiens
gctctggtagatcctcaggctc

SEQ ID NO: 7238129 - DNA, 22 bp, Homo sapiens
gctctggtaccagctactccta

SEQ ID NO: 7238130 - DNA, 22 bp, Homo sapiens
caaatgaaaatggcgtcttgga

SEQ ID NO: 7238131 - DNA, 20 bp, Homo sapiens
caaatccctgctctgtgctg

SEQ ID NO: 7238132 - DNA, 18 bp, Homo sapiens
gctcaggtatagacaggg

SEQ ID NO: 7238133 - DNA, 21 bp, Homo sapiens
gccacgtttcagtcttctcag

SEQ ID NO: 7238134 - DNA, 22 bp, Homo sapiens
attgtttccccggaattattca

SEQ ID NO: 7238135 - DNA, 22 bp, Homo sapiens
attgtaagtagaaatgttatgg

SEQ ID NO: 7238136 - DNA, 22 bp, Homo sapiens
gcaggtggatattgctacttga

SEQ ID NO: 7238137 - DNA, 22 bp, Homo sapiens
gcaggtggatcaccacgtcagg

SEQ ID NO: 7238138 - DNA, 14 bp, Homo sapiens
gcaggtggatcacc

SEQ ID NO: 7238139 - DNA, 15 bp, Homo sapiens
gcaggtggatcactt

SEQ ID NO: 7238140 - DNA, 14 bp, Homo sapiens
gcaggtggatcact

SEQ ID NO: 7238141 - DNA, 22 bp, Homo sapiens
gcaggtggatcacctgaggtca

SEQ ID NO: 7238142 - DNA, 16 bp, Homo sapiens
gcaggtggatcacctg

SEQ ID NO: 7238143 - DNA, 22 bp, Homo sapiens
atgtttctcactgtttctctat

SEQ ID NO: 7238144 - DNA, 22 bp, Homo sapiens
gcaggagagtctgtgccaggtt

SEQ ID NO: 7238145 - DNA, 22 bp, Homo sapiens
gcagatagggtattaggagtaa

SEQ ID NO: 7238146 - DNA, 22 bp, Homo sapiens
gcagaggctccattttacagat

SEQ ID NO: 7238147 - DNA, 22 bp, Homo sapiens
caatgtactacaaagattgtca

SEQ ID NO: 7238148 - DNA, 22 bp, Homo sapiens
caatggttctcaaactatcatg

SEQ ID NO: 7238149 - DNA, 22 bp, Homo sapiens
cacaggagaggttaatgggggc

SEQ ID NO: 7238150 - DNA, 19 bp, Homo sapiens
ggacacagaaagctgcatt

SEQ ID NO: 7238151 - DNA, 22 bp, Homo sapiens
ggacacagataatcacacagat

SEQ ID NO: 7238152 - DNA, 22 bp, Homo sapiens
ggacagcatatcagcagggcag

SEQ ID NO: 7238153 - DNA, 22 bp, Homo sapiens
ggacagcattcctagttccaaa

SEQ ID NO: 7238154 - DNA, 22 bp, Homo sapiens
cagaacagacttaacagggctg

SEQ ID NO: 7238155 - DNA, 22 bp, Homo sapiens
cagaacattcactcatatgtgg

SEQ ID NO: 7238156 - DNA, 22 bp, Homo sapiens
cagaacatgatataaacagaag

SEQ ID NO: 7238157 - DNA, 20 bp, Homo sapiens
cagaacatgagcatcgagcc

SEQ ID NO: 7238158 - DNA, 22 bp, Homo sapiens
cagaacattcttgccagtacat

SEQ ID NO: 7238159 - DNA, 22 bp, Homo sapiens
ggcaggtgtttttatattaaag

SEQ ID NO: 7238160 - DNA, 22 bp, Homo sapiens
ggcaggtgtggtgaccagagat

SEQ ID NO: 7238161 - DNA, 22 bp, Homo sapiens
ggcaggtgcgcatgttgcatta

SEQ ID NO: 7238162 - DNA, 19 bp, Homo sapiens
ggcaggtgtgcttatgctt

SEQ ID NO: 7238163 - DNA, 22 bp, Homo sapiens
ggcaggtgtgagctgtaaagga

SEQ ID NO: 7238164 - DNA, 22 bp, Homo sapiens
ggcaggtgtggagtgttatttt

SEQ ID NO: 7238165 - DNA, 22 bp, Homo sapiens
ggcaggtgtggtgaccagagat

SEQ ID NO: 7238166 - DNA, 22 bp, Homo sapiens
ggataagaaaattgtaataact

SEQ ID NO: 7238167 - DNA, 22 bp, Homo sapiens
cagcaggtgtctagcaagggtc

SEQ ID NO: 7238168 - DNA, 22 bp, Homo sapiens
cagaggctgatggctgtagcca

SEQ ID NO: 7238169 - DNA, 22 bp, Homo sapiens
cagagtggtgcaagggcagtgt

SEQ ID NO: 7238170 - DNA, 22 bp, Homo sapiens
cagagtgtttctttgggtgggt

SEQ ID NO: 7238171 - DNA, 22 bp, Homo sapiens
cagatagtaacctttctagagc

SEQ ID NO: 7238172 - DNA, 20 bp, Homo sapiens
cagataggttagtgtttcag

SEQ ID NO: 7238173 - DNA, 22 bp, Homo sapiens
cagataggaaaagctaggcata

SEQ ID NO: 7238174 - DNA, 22 bp, Homo sapiens
ggtgtcctttgggggctccgag

SEQ ID NO: 7238175 - DNA, 22 bp, Homo sapiens
ggtgtccttgttgaacgaaaat

SEQ ID NO: 7238176 - DNA, 22 bp, Homo sapiens
ggtgtccttgtcctttggtacc

SEQ ID NO: 7238177 - DNA, 22 bp, Homo sapiens
gggctctgcagtgacttgaggg

SEQ ID NO: 7238178 - DNA, 22 bp, Homo sapiens
gggctctgcagagaactggctc

SEQ ID NO: 7238179 - DNA, 22 bp, Homo sapiens
gggctctgcacgttctggcgtc

SEQ ID NO: 7238180 - DNA, 18 bp, Homo sapiens
gggctctgatccttcacc

SEQ ID NO: 7238181 - DNA, 22 bp, Homo sapiens
gggctctgatagagattattgc

SEQ ID NO: 7238182 - DNA, 22 bp, Homo sapiens
gggctctgcctggctgggagta

SEQ ID NO: 7238183 - DNA, 21 bp, Homo sapiens
gggctctgccctcctggagct

SEQ ID NO: 7238184 - DNA, 20 bp, Homo sapiens
gggctctgcatccatcagcc

SEQ ID NO: 7238185 - DNA, 22 bp, Homo sapiens
gggctctgcgctcagctccagc

SEQ ID NO: 7238186 - DNA, 22 bp, Homo sapiens
cagaggacaactggggcaagga

SEQ ID NO: 7238187 - DNA, 22 bp, Homo sapiens
catcaaatggcaagtgaaagct

SEQ ID NO: 7238188 - DNA, 22 bp, Homo sapiens
tcacttataaaatgcaagatct

SEQ ID NO: 7238189 - DNA, 21 bp, Homo sapiens
tcacttataatgtatttgctg

SEQ ID NO: 7238190 - DNA, 22 bp, Homo sapiens
tcacttattgctcatctcatgc

SEQ ID NO: 7238191 - DNA, 22 bp, Homo sapiens
catgttttgtgtacagaatatt

SEQ ID NO: 7238192 - DNA, 20 bp, Homo sapiens
catgtgtcagttctcaccca

SEQ ID NO: 7238193 - DNA, 22 bp, Homo sapiens
catgtgtcacagccttttattg

SEQ ID NO: 7238194 - DNA, 22 bp, Homo sapiens
catgtgtcacagccttttattg

SEQ ID NO: 7238195 - DNA, 19 bp, Homo sapiens
catgtgtcaatactgtacc

SEQ ID NO: 7238196 - DNA, 22 bp, Homo sapiens
catgtgtcaaatgatgtagctg

SEQ ID NO: 7238197 - DNA, 22 bp, Homo sapiens
catgtgggttattgggttctag

SEQ ID NO: 7238198 - DNA, 22 bp, Homo sapiens
catgtgggacaatctcaggtat

SEQ ID NO: 7238199 - DNA, 20 bp, Homo sapiens
catggtggaggagcagggcc

SEQ ID NO: 7238200 - DNA, 22 bp, Homo sapiens
tccaagatctacagcagtttag

SEQ ID NO: 7238201 - DNA, 22 bp, Homo sapiens
tcctgtttttgtaatcgactct

SEQ ID NO: 7238202 - DNA, 22 bp, Homo sapiens
ccagatgtccctctcaggtttg

SEQ ID NO: 7238203 - DNA, 22 bp, Homo sapiens
ccagatgtccctctcaggtttg

SEQ ID NO: 7238204 - DNA, 22 bp, Homo sapiens
ccagagcccagggtcatgcagg

SEQ ID NO: 7238205 - DNA, 22 bp, Homo sapiens
ccagagcccgggacctggactt

SEQ ID NO: 7238206 - DNA, 22 bp, Homo sapiens
ccagagccggctccctcagctt

SEQ ID NO: 7238207 - DNA, 22 bp, Homo sapiens
ccagagcctaagatctgatcct

SEQ ID NO: 7238208 - DNA, 22 bp, Homo sapiens
ccagagcctcgcccggagcctc

SEQ ID NO: 7238209 - DNA, 21 bp, Homo sapiens
catttcatgattatagaaatg

SEQ ID NO: 7238210 - DNA, 22 bp, Homo sapiens
cattttatcctctgggaagcta

SEQ ID NO: 7238211 - DNA, 22 bp, Homo sapiens
cattttatgtttatggagtgct

SEQ ID NO: 7238212 - DNA, 22 bp, Homo sapiens
tcctggctaacacggtgacacc

SEQ ID NO: 7238213 - DNA, 22 bp, Homo sapiens
tacagacatttactccactcct

SEQ ID NO: 7238214 - DNA, 22 bp, Homo sapiens
tacagacatttactccactcct

SEQ ID NO: 7238215 - DNA, 22 bp, Homo sapiens
tagacagggtggcttagaaaca

SEQ ID NO: 7238216 - DNA, 22 bp, Homo sapiens
tagacagggtggcttagaaaca

SEQ ID NO: 7238217 - DNA, 22 bp, Homo sapiens
tagacaggagtcaggctagaat

SEQ ID NO: 7238218 - DNA, 22 bp, Homo sapiens
tagaacacagaaatgtgtggcc

SEQ ID NO: 7238219 - DNA, 22 bp, Homo sapiens
tagaaagactgtccagatttca

SEQ ID NO: 7238220 - DNA, 22 bp, Homo sapiens
tagcaatgtgttgacttggtca

SEQ ID NO: 7238221 - DNA, 22 bp, Homo sapiens
cagggcataagatgaggctgta

SEQ ID NO: 7238222 - DNA, 22 bp, Homo sapiens
cagggcagttttacttctctct

SEQ ID NO: 7238223 - DNA, 22 bp, Homo sapiens
cagggcagtgaagaacacacgt

SEQ ID NO: 7238224 - DNA, 22 bp, Homo sapiens
cagggcagtaccgccctctggc

SEQ ID NO: 7238225 - DNA, 22 bp, Homo sapiens
cagggcagtttgtgcctatgag

SEQ ID NO: 7238226 - DNA, 22 bp, Homo sapiens
tagcataacaggtaagagtgag

SEQ ID NO: 7238227 - DNA, 22 bp, Homo sapiens
taggtagttacacagcaatgta

SEQ ID NO: 7238228 - DNA, 22 bp, Homo sapiens
tagtaaatgtgaaatgtgggga

SEQ ID NO: 7238229 - DNA, 22 bp, Homo sapiens
tatatagaaaagcagatgttgg

SEQ ID NO: 7238230 - DNA, 22 bp, Homo sapiens
caggtgggcgtggcgagaaggc

SEQ ID NO: 7238231 - DNA, 22 bp, Homo sapiens
caggtggcttattagggtcagt

SEQ ID NO: 7238232 - DNA, 22 bp, Homo sapiens
tatgaagaagttctgtgaaatg

SEQ ID NO: 7238233 - DNA, 22 bp, Homo sapiens
tatgaagacaatgatagcatga

SEQ ID NO: 7238234 - DNA, 22 bp, Homo sapiens
tatgaagatatatctgatctct

SEQ ID NO: 7238235 - DNA, 22 bp, Homo sapiens
tggagctgaggggaatgctgag

SEQ ID NO: 7238236 - DNA, 18 bp, Homo sapiens
tggagctgagggcaatgc

SEQ ID NO: 7238237 - DNA, 22 bp, Homo sapiens
tggacatgtcttctccaagaaa

SEQ ID NO: 7238238 - DNA, 22 bp, Homo sapiens
tggacatgtccggccagacaat

SEQ ID NO: 7238239 - DNA, 22 bp, Homo sapiens
tggcagggaatacagatgttta

SEQ ID NO: 7238240 - DNA, 19 bp, Homo sapiens
tggcagggagagtttgaag

SEQ ID NO: 7238241 - DNA, 22 bp, Homo sapiens
tggcagggagccaccggtcatg

SEQ ID NO: 7238242 - DNA, 22 bp, Homo sapiens
tggcaggtagtcagaggcgaca

SEQ ID NO: 7238243 - DNA, 22 bp, Homo sapiens
tgctgtttgccaagatcacttt

SEQ ID NO: 7238244 - DNA, 22 bp, Homo sapiens
tgctctggagggtgaagctttt

SEQ ID NO: 7238245 - DNA, 22 bp, Homo sapiens
tgcaggtgctgtgtcaagagag

SEQ ID NO: 7238246 - DNA, 22 bp, Homo sapiens
tgcaggtgctgatacctactcc

SEQ ID NO: 7238247 - DNA, 22 bp, Homo sapiens
tgcaggtgctccgggggtgccc

SEQ ID NO: 7238248 - DNA, 22 bp, Homo sapiens
tgcaggtgctacaagaactcac

SEQ ID NO: 7238249 - DNA, 22 bp, Homo sapiens
tgcaggtgcgttttcaagcctc

SEQ ID NO: 7238250 - DNA, 22 bp, Homo sapiens
tgcagggctacaggactacaac

SEQ ID NO: 7238251 - DNA, 22 bp, Homo sapiens
tgcaggtgcctcttgagcttgt

SEQ ID NO: 7238252 - DNA, 22 bp, Homo sapiens
tgcaggtgccatcgctgctcat

SEQ ID NO: 7238253 - DNA, 19 bp, Homo sapiens
tgggacacgatctgcctgt

SEQ ID NO: 7238254 - DNA, 19 bp, Homo sapiens
tggcaggtagtgagcagtc

SEQ ID NO: 7238255 - DNA, 22 bp, Homo sapiens
tgggcaggcaagtgaatacctt

SEQ ID NO: 7238256 - DNA, 22 bp, Homo sapiens
tgggcaggataatatctcatgt

SEQ ID NO: 7238257 - DNA, 22 bp, Homo sapiens
tgggcaggatgcgttgattctt

SEQ ID NO: 7238258 - DNA, 22 bp, Homo sapiens
cctgcctgcaccttctctgggg

SEQ ID NO: 7238259 - DNA, 22 bp, Homo sapiens
ccagggcaattatttggagggt

SEQ ID NO: 7238260 - DNA, 22 bp, Homo sapiens
ccagggcaataggaacactttt

SEQ ID NO: 7238261 - DNA, 22 bp, Homo sapiens
ccagggcaaatgagatcatagc

SEQ ID NO: 7238262 - DNA, 22 bp, Homo sapiens
ccagggcaacgctgtctcagag

SEQ ID NO: 7238263 - DNA, 22 bp, Homo sapiens
ccagggcacgttgggacagtac

SEQ ID NO: 7238264 - DNA, 22 bp, Homo sapiens
ccagggcagtgggagaaggtgc

SEQ ID NO: 7238265 - DNA, 22 bp, Homo sapiens
ccagggcaggggctggagttca

SEQ ID NO: 7238266 - DNA, 22 bp, Homo sapiens
ccagggcagggaccacgtgtct

SEQ ID NO: 7238267 - DNA, 22 bp, Homo sapiens
ccagggctgagactgtattggg

SEQ ID NO: 7238268 - DNA, 22 bp, Homo sapiens
ccagggcatgggaagaactgaa

SEQ ID NO: 7238269 - DNA, 22 bp, Homo sapiens
ccagggcatcctcacatcgcag

SEQ ID NO: 7238270 - DNA, 22 bp, Homo sapiens
ccagggcatcacatccagtgtt

SEQ ID NO: 7238271 - DNA, 22 bp, Homo sapiens
ccagggctgctcattggctggt

SEQ ID NO: 7238272 - DNA, 22 bp, Homo sapiens
ccaggtgtgtctggccccgaag

SEQ ID NO: 7238273 - DNA, 22 bp, Homo sapiens
ccaggtgtgtcaccattgccca

SEQ ID NO: 7238274 - DNA, 22 bp, Homo sapiens
ccaggtggacttgatttgaata

SEQ ID NO: 7238275 - DNA, 22 bp, Homo sapiens
ccaggtggaggtgtgaggtcct

SEQ ID NO: 7238276 - DNA, 22 bp, Homo sapiens
ccaggtggataaggtttctgga

SEQ ID NO: 7238277 - DNA, 22 bp, Homo sapiens
ccaggtggccctgccctactct

SEQ ID NO: 7238278 - DNA, 22 bp, Homo sapiens
ccaggtgggaggaaagcagaga

SEQ ID NO: 7238279 - DNA, 22 bp, Homo sapiens
ccaggtggcttctgcccgatgt

SEQ ID NO: 7238280 - DNA, 22 bp, Homo sapiens
ccaggtgtgtcaccattgccca

SEQ ID NO: 7238281 - DNA, 17 bp, Homo sapiens
ccaggtgggaggtgggg

SEQ ID NO: 7238282 - DNA, 20 bp, Homo sapiens
tgcagggcctaaaaagggaa

SEQ ID NO: 7238283 - DNA, 22 bp, Homo sapiens
tgcagggccttctagaccatgg

SEQ ID NO: 7238284 - DNA, 22 bp, Homo sapiens
tgcagggccttgggatgtgtcc

SEQ ID NO: 7238285 - DNA, 22 bp, Homo sapiens
tgcagggccttgggtctttctt

SEQ ID NO: 7238286 - DNA, 22 bp, Homo sapiens
tgcagggctaagtcagagcctg

SEQ ID NO: 7238287 - DNA, 22 bp, Homo sapiens
tgcagggccttgttgatgtgct

SEQ ID NO: 7238288 - DNA, 22 bp, Homo sapiens
tgcaataaggagtaatagtaaa

SEQ ID NO: 7238289 - DNA, 22 bp, Homo sapiens
tgcaataaagtgctataaatcc

SEQ ID NO: 7238290 - DNA, 22 bp, Homo sapiens
tgcaataacccagtatctgtga

SEQ ID NO: 7238291 - DNA, 21 bp, Homo sapiens
tgcaatccagcctgggcgaca

SEQ ID NO: 7238292 - DNA, 22 bp, Homo sapiens
tgcactccaggctgggtgacag

SEQ ID NO: 7238293 - DNA, 22 bp, Homo sapiens
cgtcctcagaggccatccgaaa

SEQ ID NO: 7238294 - DNA, 22 bp, Homo sapiens
ttaaaatgaatattgattagca

SEQ ID NO: 7238295 - DNA, 21 bp, Homo sapiens
ttaaaatgaggaagtggtggc

SEQ ID NO: 7238296 - DNA, 22 bp, Homo sapiens
ttaatatgttgaaatttattag

SEQ ID NO: 7238297 - DNA, 18 bp, Homo sapiens
cgatgtgtatgtgatttg

SEQ ID NO: 7238298 - DNA, 17 bp, Homo sapiens
ttattttttgggctgag

SEQ ID NO: 7238299 - DNA, 22 bp, Homo sapiens
ttcaaaacagctagatattgga

SEQ ID NO: 7238300 - DNA, 21 bp, Homo sapiens
cgcagagcgaacttgcggcgc

SEQ ID NO: 7238301 - DNA, 22 bp, Homo sapiens
ttatttttaaaagttcacacag

SEQ ID NO: 7238302 - DNA, 22 bp, Homo sapiens
ctgcctgcactgcctggctcca

SEQ ID NO: 7238303 - DNA, 22 bp, Homo sapiens
ctgaagcaaaggatcgagctaa

SEQ ID NO: 7238304 - DNA, 22 bp, Homo sapiens
tttcttgagcccaggaggtgga

SEQ ID NO: 7238305 - DNA, 22 bp, Homo sapiens
ctctgcttctgagatggaagct

SEQ ID NO: 7238306 - DNA, 22 bp, Homo sapiens
ttgtttatgtgttgtctatggc

SEQ ID NO: 7238307 - DNA, 22 bp, Homo sapiens
tttacaattctctaccagtgtt

SEQ ID NO: 7238308 - DNA, 22 bp, Homo sapiens
tttacaatagggtctgaatgaa

SEQ ID NO: 7238309 - DNA, 22 bp, Homo sapiens
tttcaaatggagtcgtgaaatg

SEQ ID NO: 7238310 - DNA, 22 bp, Homo sapiens
tttcaaataccataaacctaat

SEQ ID NO: 7238311 - DNA, 22 bp, Homo sapiens
gaaacactcaatttagtaattc

SEQ ID NO: 7238312 - DNA, 22 bp, Homo sapiens
gaaacactatgccaagacaggg

SEQ ID NO: 7238313 - DNA, 22 bp, Homo sapiens
ctttgacctcatatgacacatt

SEQ ID NO: 7238314 - DNA, 21 bp, Homo sapiens
ctgtttcttgtgaagtgacac

SEQ ID NO: 7238315 - DNA, 22 bp, Homo sapiens
cttccaaagcactttatggacc

SEQ ID NO: 7238316 - DNA, 22 bp, Homo sapiens
cttccaaaatttatatgttgaa

SEQ ID NO: 7238317 - DNA, 22 bp, Homo sapiens
ctgggaagatggtgacagaatt

SEQ ID NO: 7238318 - DNA, 22 bp, Homo sapiens
ctgctgtgattgggagaaaccg

SEQ ID NO: 7238319 - DNA, 22 bp, Homo sapiens
ctgtctgctagaacatctatac

SEQ ID NO: 7238320 - DNA, 22 bp, Homo sapiens
ctgtcacactgatatcaggctt

SEQ ID NO: 7238321 - DNA, 22 bp, Homo sapiens
ctgtattttttaagaatatctc

SEQ ID NO: 7238322 - DNA, 22 bp, Homo sapiens
ctgtctgccaataatctatggc

SEQ ID NO: 7238323 - DNA, 22 bp, Homo sapiens
ctggtctgctagaaagatgcat

SEQ ID NO: 7238324 - DNA, 22 bp, Homo sapiens
ctggtctggctacccagcgaat

SEQ ID NO: 7238325 - DNA, 22 bp, Homo sapiens
ctgtacaagtccttcatcaggg

SEQ ID NO: 7238326 - DNA, 22 bp, Homo sapiens
ctgtacaaagtagctgctggga

SEQ ID NO: 7238327 - DNA, 22 bp, Homo sapiens
ctggtgcacatgaaagagaagg

SEQ ID NO: 7238328 - DNA, 22 bp, Homo sapiens
ctggtgcaaggctttggaatcc

SEQ ID NO: 7238329 - DNA, 22 bp, Homo sapiens
ctggtgcaagattccctgcttc

SEQ ID NO: 7238330 - DNA, 22 bp, Homo sapiens
ctggtgcaaaagtaattgtggt

SEQ ID NO: 7238331 - DNA, 22 bp, Homo sapiens
ctggtgcatgtggccttgctct

SEQ ID NO: 7238332 - DNA, 22 bp, Homo sapiens
ctggtgcaggaaggagctggca

SEQ ID NO: 7238333 - DNA, 22 bp, Homo sapiens
ctggtgcactacagcctggaac

SEQ ID NO: 7238334 - DNA, 22 bp, Homo sapiens
ctggtgcacgtggctgcagtcg

SEQ ID NO: 7238335 - DNA, 22 bp, Homo sapiens
ctggtgcacattcgctctcata

SEQ ID NO: 7238336 - DNA, 22 bp, Homo sapiens
gaggaagaattggttattggag

SEQ ID NO: 7238337 - DNA, 22 bp, Homo sapiens
gagctgctgtgaggggagcttc

SEQ ID NO: 7238338 - DNA, 22 bp, Homo sapiens
gaggctgaggcaggaggatcac

SEQ ID NO: 7238339 - DNA, 22 bp, Homo sapiens
gacagcaatgacggggcagctg

SEQ ID NO: 7238340 - DNA, 22 bp, Homo sapiens
gacagacatttcctgatccaat

SEQ ID NO: 7238341 - DNA, 22 bp, Homo sapiens
gacagacatgggacttcatact

SEQ ID NO: 7238342 - DNA, 22 bp, Homo sapiens
gaagcagtagcaactgtgtctt

SEQ ID NO: 7238343 - DNA, 22 bp, Homo sapiens
gaagcagtgtgaacccatgtaa

SEQ ID NO: 7238344 - DNA, 18 bp, Homo sapiens
gaagcatatttgttcttc

SEQ ID NO: 7238345 - DNA, 22 bp, Homo sapiens
gaagcatgctaaggattctcag

SEQ ID NO: 7238346 - DNA, 22 bp, Homo sapiens
gaaggagctaaagggagccctg

SEQ ID NO: 7238347 - DNA, 22 bp, Homo sapiens
gacagaaggcatctagggcacg

SEQ ID NO: 7238348 - DNA, 22 bp, Homo sapiens
gacagaagaggaacttggacag

SEQ ID NO: 7238349 - DNA, 22 bp, Homo sapiens
gacagacactattggtatgcct

SEQ ID NO: 7238350 - DNA, 22 bp, Homo sapiens
gacagacacctggggggttgct

SEQ ID NO: 7238351 - DNA, 22 bp, Homo sapiens
gacagacacagggccatgattg

SEQ ID NO: 7238352 - DNA, 22 bp, Homo sapiens
gacagacacaattgatccatga

SEQ ID NO: 7238353 - DNA, 22 bp, Homo sapiens
gacagacaaatgtttttaactt

SEQ ID NO: 7238354 - DNA, 22 bp, Homo sapiens
gacagacatgggacttcatact

SEQ ID NO: 7238355 - DNA, 22 bp, Homo sapiens
gacagacaggtgtggtaggcac

SEQ ID NO: 7238356 - DNA, 22 bp, Homo sapiens
gacagacaggggttctcctgga

SEQ ID NO: 7238357 - DNA, 22 bp, Homo sapiens
gacagacaggaggccacctgct

SEQ ID NO: 7238358 - DNA, 22 bp, Homo sapiens
gacagacagagaatgggcttga

SEQ ID NO: 7238359 - DNA, 22 bp, Homo sapiens
gacagacactgtgtcctcactt

SEQ ID NO: 7238360 - DNA, 22 bp, Homo sapiens
gacagacaggagctcacaggca

SEQ ID NO: 7238361 - DNA, 22 bp, Homo sapiens
gacagacaggaggcattcaggg

SEQ ID NO: 7238362 - DNA, 22 bp, Homo sapiens
gcaggagctttgcttactgctg

SEQ ID NO: 7238363 - DNA, 23 bp, Homo sapiens
gccagagctgcctgcccttgctg

SEQ ID NO: 7238364 - DNA, 22 bp, Homo sapiens
gctggtagacctcactgcactc

SEQ ID NO: 7238365 - DNA, 21 bp, Homo sapiens
ggacagaggagaaggcaccct

SEQ ID NO: 7238366 - DNA, 22 bp, Homo sapiens
ggaccggtggcttcctcgggtc

SEQ ID NO: 7238367 - DNA, 22 bp, Homo sapiens
ggacagagagtgaatatgacat

SEQ ID NO: 7238368 - DNA, 22 bp, Homo sapiens
ggacagactttacagccccggg

SEQ ID NO: 7238369 - DNA, 19 bp, Homo sapiens
ggacagacgcagagatctg

SEQ ID NO: 7238370 - DNA, 22 bp, Homo sapiens
ggacagacagtgtgagtgaggc

SEQ ID NO: 7238371 - DNA, 22 bp, Homo sapiens
ggacagacaaaaatagtaagca

SEQ ID NO: 7238372 - DNA, 22 bp, Homo sapiens
ggaagctgttgtgagtgcagca

SEQ ID NO: 7238373 - DNA, 21 bp, Homo sapiens
ggaagctgtgtccatgctcct

SEQ ID NO: 7238374 - DNA, 22 bp, Homo sapiens
ggaagctgttatcatctgtatc

SEQ ID NO: 7238375 - DNA, 22 bp, Homo sapiens
ggccctggcagccacgaaagcc

SEQ ID NO: 7238376 - DNA, 22 bp, Homo sapiens
ggcaggtgagagctctttgaaa

SEQ ID NO: 7238377 - DNA, 22 bp, Homo sapiens
ggcaggtgacggggatgagtat

SEQ ID NO: 7238378 - DNA, 17 bp, Homo sapiens
ggcaggtgacagacacc

SEQ ID NO: 7238379 - DNA, 22 bp, Homo sapiens
ggcaggtgacctggcctcccag

SEQ ID NO: 7238380 - DNA, 22 bp, Homo sapiens
ggcactgtttttgtattcagtt

SEQ ID NO: 7238381 - DNA, 22 bp, Homo sapiens
ggctctgggtgtgaccttgggt

SEQ ID NO: 7238382 - DNA, 17 bp, Homo sapiens
ggctctgggtgtcacat

SEQ ID NO: 7238383 - DNA, 22 bp, Homo sapiens
ggctctgggtctgtggggagcg

SEQ ID NO: 7238384 - DNA, 22 bp, Homo sapiens
ggctctggtgtgaagcagcctc

SEQ ID NO: 7238385 - DNA, 22 bp, Homo sapiens
ggctctggttgaccatgatggc

SEQ ID NO: 7238386 - DNA, 22 bp, Homo sapiens
ggctctggggcctcctcccttg

SEQ ID NO: 7238387 - DNA, 22 bp, Homo sapiens
ggctctggggaagctctcttca

SEQ ID NO: 7238388 - DNA, 22 bp, Homo sapiens
ggctctgggcctccaaggtctg

SEQ ID NO: 7238389 - DNA, 22 bp, Homo sapiens
ggctctggggggaagtctgttg

SEQ ID NO: 7238390 - DNA, 22 bp, Homo sapiens
ggctctggggttggcccatctc

SEQ ID NO: 7238391 - DNA, 22 bp, Homo sapiens
ggctctgggtaaggcgtttgac

SEQ ID NO: 7238392 - DNA, 22 bp, Homo sapiens
gggagctgagggacctctgtgg

SEQ ID NO: 7238393 - DNA, 22 bp, Homo sapiens
gggagctgaggagccccgtcgg

SEQ ID NO: 7238394 - DNA, 22 bp, Homo sapiens
gggagctgagctggaagagaat

SEQ ID NO: 7238395 - DNA, 19 bp, Homo sapiens
gggagctgaggtctttggt

SEQ ID NO: 7238396 - DNA, 22 bp, Homo sapiens
gggagctgagaaacaacattct

SEQ ID NO: 7238397 - DNA, 22 bp, Homo sapiens
gggagctgacctgcaggttccc

SEQ ID NO: 7238398 - DNA, 21 bp, Homo sapiens
gggagctgacagcagcacggc

SEQ ID NO: 7238399 - DNA, 22 bp, Homo sapiens
gggagctgagctctgagccacg

SEQ ID NO: 7238400 - DNA, 22 bp, Homo sapiens
ggctttatattgtttgagcaga

SEQ ID NO: 7238401 - DNA, 22 bp, Homo sapiens
ggctttatgcagggatagaaat

SEQ ID NO: 7238402 - DNA, 22 bp, Homo sapiens
ggctttatcaaatgagaccctg

SEQ ID NO: 7238403 - DNA, 22 bp, Homo sapiens
ggctttatgcacagcagatggt

SEQ ID NO: 7238404 - DNA, 22 bp, Homo sapiens
ggctttattaagcagggtaagt

SEQ ID NO: 7238405 - DNA, 22 bp, Homo sapiens
ggctttattaactcatccgtaa

SEQ ID NO: 7238406 - DNA, 22 bp, Homo sapiens
ggctttatgtttttcatgtggt

SEQ ID NO: 7238407 - DNA, 21 bp, Homo sapiens
ggctttatgctcacccagcct

SEQ ID NO: 7238408 - DNA, 22 bp, Homo sapiens
ggctttattttgcatgaatgct

SEQ ID NO: 7238409 - DNA, 22 bp, Homo sapiens
ggctttatttgcagccattgtt

SEQ ID NO: 7238410 - DNA, 22 bp, Homo sapiens
ggctttattatgtggccatgtg

SEQ ID NO: 7238411 - DNA, 22 bp, Homo sapiens
ggctttatttcactgtaccata

SEQ ID NO: 7238412 - DNA, 22 bp, Homo sapiens
gggcaggttattggagtaggga

SEQ ID NO: 7238413 - DNA, 22 bp, Homo sapiens
gggcaggttggcatcccgggca

SEQ ID NO: 7238414 - DNA, 23 bp, Homo sapiens
gggcaggtttttataggcttcag

SEQ ID NO: 7238415 - DNA, 22 bp, Homo sapiens
gggagctggcctactattagat

SEQ ID NO: 7238416 - DNA, 22 bp, Homo sapiens
gggagctggatgattgaggcaa

SEQ ID NO: 7238417 - DNA, 22 bp, Homo sapiens
gggagctggatcgcgcgcccgg

SEQ ID NO: 7238418 - DNA, 22 bp, Homo sapiens
gggagctggagttgtgttgcct

SEQ ID NO: 7238419 - DNA, 22 bp, Homo sapiens
gggagctggagctggaagactc

SEQ ID NO: 7238420 - DNA, 22 bp, Homo sapiens
gggaggttgaggctgcagtgag

SEQ ID NO: 7238421 - DNA, 22 bp, Homo sapiens
ggtagacaactttgtaatagcc

SEQ ID NO: 7238422 - DNA, 22 bp, Homo sapiens
ggtagggcaaagtagggcacct

SEQ ID NO: 7238423 - DNA, 22 bp, Homo sapiens
ggggcaggagcccttcttcagc

SEQ ID NO: 7238424 - DNA, 22 bp, Homo sapiens
ggggcaggaggtgttctctttt

SEQ ID NO: 7238425 - DNA, 22 bp, Homo sapiens
gtcaggtggctggtgattcaac

SEQ ID NO: 7238426 - DNA, 22 bp, Homo sapiens
gtaatctcagctacttgggagg

SEQ ID NO: 7238427 - DNA, 22 bp, Homo sapiens
ggtgggcagctcttggcaggca

SEQ ID NO: 7238428 - DNA, 22 bp, Homo sapiens
gtctcctggcttttgtcccagt

SEQ ID NO: 7238429 - DNA, 22 bp, Homo sapiens
gtctcctgtcctgcaggatgga

SEQ ID NO: 7238430 - DNA, 22 bp, Homo sapiens
gtctcctgagactgcagtcacc

SEQ ID NO: 7238431 - DNA, 22 bp, Homo sapiens
gtctcctgagccttgactgcaa

SEQ ID NO: 7238432 - DNA, 22 bp, Homo sapiens
gtctcctgaggcatccattgaa

SEQ ID NO: 7238433 - DNA, 22 bp, Homo sapiens
gtctcctgccacactcagtccc

SEQ ID NO: 7238434 - DNA, 22 bp, Homo sapiens
gtctcctggcctccagtttctc

SEQ ID NO: 7238435 - DNA, 22 bp, Homo sapiens
gtctcctggctgcagctaagac

SEQ ID NO: 7238436 - DNA, 22 bp, Homo sapiens
gtctcctgcccccggtgcttgg

SEQ ID NO: 7238437 - DNA, 22 bp, Homo sapiens
gtctcctgctagcaagcaccac

SEQ ID NO: 7238438 - DNA, 22 bp, Homo sapiens
gtctcctggaaatatgcccata

SEQ ID NO: 7238439 - DNA, 22 bp, Homo sapiens
gtgaggtggtacaatattaact

SEQ ID NO: 7238440 - DNA, 22 bp, Homo sapiens
tagatgtgttgcctggagttgt

SEQ ID NO: 7238441 - DNA, 22 bp, Homo sapiens
tagaagcactgacagagtttga

SEQ ID NO: 7238442 - DNA, 22 bp, Homo sapiens
taggctaggctgaaggttttgg

SEQ ID NO: 7238443 - DNA, 20 bp, Homo sapiens
taggtgtctttgccagcttt

SEQ ID NO: 7238444 - DNA, 22 bp, Homo sapiens
tatagaagagacatgtgcatag

SEQ ID NO: 7238445 - DNA, 22 bp, Homo sapiens
tatagaagtaagcattgtgatg

SEQ ID NO: 7238446 - DNA, 22 bp, Homo sapiens
tataccttccacaaaacagctt

SEQ ID NO: 7238447 - DNA, 22 bp, Homo sapiens
tatactctgagaaacgtgtcac

SEQ ID NO: 7238448 - DNA, 22 bp, Homo sapiens
tatgttattttcatacaacaga

SEQ ID NO: 7238449 - DNA, 22 bp, Homo sapiens
tattgagaaccctcaggaggca

SEQ ID NO: 7238450 - DNA, 22 bp, Homo sapiens
gtgctttaataagatttcactt

SEQ ID NO: 7238451 - DNA, 22 bp, Homo sapiens
gtgtgtcctgttttaaaatagt

SEQ ID NO: 7238452 - DNA, 22 bp, Homo sapiens
gtgtgtcctcttaactattatg

SEQ ID NO: 7238453 - DNA, 22 bp, Homo sapiens
gtgtgtcctcataagatggagg

SEQ ID NO: 7238454 - DNA, 22 bp, Homo sapiens
gtgtgtccttgggcctctgcag

SEQ ID NO: 7238455 - DNA, 22 bp, Homo sapiens
gtttcgtcaggcttattctatc

SEQ ID NO: 7238456 - DNA, 22 bp, Homo sapiens
taaacatggattctgatcacag

SEQ ID NO: 7238457 - DNA, 21 bp, Homo sapiens
taaagaagatgaatgtgatca

SEQ ID NO: 7238458 - DNA, 17 bp, Homo sapiens
taaatacacaagggtat

SEQ ID NO: 7238459 - DNA, 22 bp, Homo sapiens
taagatatggtaggaagtttgg

SEQ ID NO: 7238460 - DNA, 22 bp, Homo sapiens
tacaatgaccatattatgtaag

SEQ ID NO: 7238461 - DNA, 19 bp, Homo sapiens
tacaatgatgttacctttg

SEQ ID NO: 7238462 - DNA, 22 bp, Homo sapiens
tacaatgatgatactttactgg

SEQ ID NO: 7238463 - DNA, 22 bp, Homo sapiens
tacaatgagctgtacatctcca

SEQ ID NO: 7238464 - DNA, 22 bp, Homo sapiens
taagcaatgctgtagttcagtc

SEQ ID NO: 7238465 - DNA, 22 bp, Homo sapiens
taagcaatgagataatcatggg

SEQ ID NO: 7238466 - DNA, 18 bp, Homo sapiens
taagcaatgacattgcaa

SEQ ID NO: 7238467 - DNA, 22 bp, Homo sapiens
taagcaatctgtagttggaatc

SEQ ID NO: 7238468 - DNA, 22 bp, Homo sapiens
taagcaatctaaaagccttacc

SEQ ID NO: 7238469 - DNA, 22 bp, Homo sapiens
taagcataactaaaaatgattt

SEQ ID NO: 7238470 - DNA, 22 bp, Homo sapiens
tacatgtgataaattgattaaa

SEQ ID NO: 7238471 - DNA, 22 bp, Homo sapiens
tacgcctgtaatcccagcactt

SEQ ID NO: 7238472 - DNA, 22 bp, Homo sapiens
tactgcttggtgttgttgtatc

SEQ ID NO: 7238473 - DNA, 22 bp, Homo sapiens
tactgcttgatctagcatggct

SEQ ID NO: 7238474 - DNA, 22 bp, Homo sapiens
tactgcttcatatatgggagac

SEQ ID NO: 7238475 - DNA, 22 bp, Homo sapiens
tactgcttcatatagggatgta

SEQ ID NO: 7238476 - DNA, 22 bp, Homo sapiens
tactgcttcacccttgagtctt

SEQ ID NO: 7238477 - DNA, 22 bp, Homo sapiens
tactgcttttagctggatacac

SEQ ID NO: 7238478 - DNA, 22 bp, Homo sapiens
tactgctttgactgtatgggac

SEQ ID NO: 7238479 - DNA, 22 bp, Homo sapiens
tactgcttgttagctgtatttg

SEQ ID NO: 7238480 - DNA, 22 bp, Homo sapiens
tccgggaggcagaggttgcagt

SEQ ID NO: 7238481 - DNA, 22 bp, Homo sapiens
tcatgtgtgtttcatgtatgga

SEQ ID NO: 7238482 - DNA, 20 bp, Homo sapiens
tcatgtgtgtcctacagaga

SEQ ID NO: 7238483 - DNA, 22 bp, Homo sapiens
tcatgtgtctgctgcagctgtt

SEQ ID NO: 7238484 - DNA, 22 bp, Homo sapiens
tcatgtgttgcactgaggacct

SEQ ID NO: 7238485 - DNA, 22 bp, Homo sapiens
tcatgtgttaaactccaagata

SEQ ID NO: 7238486 - DNA, 22 bp, Homo sapiens
tcatgtgtctgccagtgtttat

SEQ ID NO: 7238487 - DNA, 22 bp, Homo sapiens
tcatgtgtcctagttcatataa

SEQ ID NO: 7238488 - DNA, 21 bp, Homo sapiens
tcatgtgtaacttttgaccac

SEQ ID NO: 7238489 - DNA, 22 bp, Homo sapiens
tcagagtgaggcgtcaacatga

SEQ ID NO: 7238490 - DNA, 22 bp, Homo sapiens
tcaggaaatggtgatttggttg

SEQ ID NO: 7238491 - DNA, 22 bp, Homo sapiens
tcaggaaatggacatctttgct

SEQ ID NO: 7238492 - DNA, 22 bp, Homo sapiens
tcagggcaatgtccctcagaag

SEQ ID NO: 7238493 - DNA, 22 bp, Homo sapiens
tcagggcaagtctcagaaggtt

SEQ ID NO: 7238494 - DNA, 22 bp, Homo sapiens
tcagggcaagattggttaataa

SEQ ID NO: 7238495 - DNA, 22 bp, Homo sapiens
tcagggcaaagggcagagtttg

SEQ ID NO: 7238496 - DNA, 22 bp, Homo sapiens
tcagggcaccaaaaaagatgcc

SEQ ID NO: 7238497 - DNA, 22 bp, Homo sapiens
tcagggcacaggcctgtgggtt

SEQ ID NO: 7238498 - DNA, 22 bp, Homo sapiens
tcagggcacattctgcagtggc

SEQ ID NO: 7238499 - DNA, 22 bp, Homo sapiens
tcagggcaaaagggaaaccatt

SEQ ID NO: 7238500 - DNA, 22 bp, Homo sapiens
tcaggtggaattaattaagaga

SEQ ID NO: 7238501 - DNA, 22 bp, Homo sapiens
tcaggtggagacctccttggcc

SEQ ID NO: 7238502 - DNA, 22 bp, Homo sapiens
tcagggcagcctaaggcacctc

SEQ ID NO: 7238503 - DNA, 16 bp, Homo sapiens
tcagggcagaatggca

SEQ ID NO: 7238504 - DNA, 22 bp, Homo sapiens
tcagggcagaatccaaagaatt

SEQ ID NO: 7238505 - DNA, 22 bp, Homo sapiens
tcagggcactgtcacctgatat

SEQ ID NO: 7238506 - DNA, 22 bp, Homo sapiens
tcagggcacgtttctgcaatgc

SEQ ID NO: 7238507 - DNA, 21 bp, Homo sapiens
tcagggcagctgctcttcaga

SEQ ID NO: 7238508 - DNA, 22 bp, Homo sapiens
tcactacaacctccgcctcctg

SEQ ID NO: 7238509 - DNA, 22 bp, Homo sapiens
tcagaagcaggagtgtgcacaa

SEQ ID NO: 7238510 - DNA, 22 bp, Homo sapiens
tcagaagccaccttttgttggg

SEQ ID NO: 7238511 - DNA, 22 bp, Homo sapiens
tcaattatgccattgcaatatt

SEQ ID NO: 7238512 - DNA, 23 bp, Homo sapiens
tcacacagctggtcaggtacaga

SEQ ID NO: 7238513 - DNA, 22 bp, Homo sapiens
tcaaaagtttcacatagagata

SEQ ID NO: 7238514 - DNA, 22 bp, Homo sapiens
tttgggaaacttaggggtcaga

SEQ ID NO: 7238515 - DNA, 22 bp, Homo sapiens
tttgggaaagtgtcttttgtat

SEQ ID NO: 7238516 - DNA, 20 bp, Homo sapiens
tttgagaccagtctgcccaa

SEQ ID NO: 7238517 - DNA, 21 bp, Homo sapiens
tttgagaattggtcagagtgc

SEQ ID NO: 7238518 - DNA, 22 bp, Homo sapiens
tttgaagactactgggagtgaa

SEQ ID NO: 7238519 - DNA, 22 bp, Homo sapiens
ttttattgtctcccagttctgg

SEQ ID NO: 7238520 - DNA, 22 bp, Homo sapiens
ttttattgtcaatgaagacaga

SEQ ID NO: 7238521 - DNA, 22 bp, Homo sapiens
ttttattgtcaatgaagacaga

SEQ ID NO: 7238522 - DNA, 22 bp, Homo sapiens
ttttattgtctgtattgcctat

SEQ ID NO: 7238523 - DNA, 22 bp, Homo sapiens
ttttattgtctgtattgcctat

SEQ ID NO: 7238524 - DNA, 22 bp, Homo sapiens
ttttattgtctcccagttctgg

SEQ ID NO: 7238525 - DNA, 16 bp, Homo sapiens
ttttattgtgacagcc

SEQ ID NO: 7238526 - DNA, 16 bp, Homo sapiens
ttttattgtgacagcc

SEQ ID NO: 7238527 - DNA, 22 bp, Homo sapiens
ttttattgggagtcctctactg

SEQ ID NO: 7238528 - DNA, 22 bp, Homo sapiens
ttttagaagtgcctatcctatg

SEQ ID NO: 7238529 - DNA, 22 bp, Homo sapiens
ttttattgggagtcctctactg

SEQ ID NO: 7238530 - DNA, 22 bp, Homo sapiens
ttttattggtaatgataaaagt

SEQ ID NO: 7238531 - DNA, 22 bp, Homo sapiens
ttttattggtaatgataaaagt

SEQ ID NO: 7238532 - DNA, 22 bp, Homo sapiens
ttttaattttagcccttctggt

SEQ ID NO: 7238533 - DNA, 22 bp, Homo sapiens
tttgtctacaaaaagtgtacag

SEQ ID NO: 7238534 - DNA, 22 bp, Homo sapiens
tttccaaataaggtcacattct

SEQ ID NO: 7238535 - DNA, 22 bp, Homo sapiens
ttgttgctgctcaacctctata

SEQ ID NO: 7238536 - DNA, 22 bp, Homo sapiens
ttgttgctcttgttgccacatg

SEQ ID NO: 7238537 - DNA, 22 bp, Homo sapiens
tttaggaagtttcagataggaa

SEQ ID NO: 7238538 - DNA, 22 bp, Homo sapiens
tttaggaatagctgacaatctt

SEQ ID NO: 7238539 - DNA, 22 bp, Homo sapiens
tttattgggtgcagtgcccaca

SEQ ID NO: 7238540 - DNA, 22 bp, Homo sapiens
tttattgggcctggaggatcta

SEQ ID NO: 7238541 - DNA, 22 bp, Homo sapiens
tttattggaacacagccatgac

SEQ ID NO: 7238542 - DNA, 22 bp, Homo sapiens
tttattggatatttacaagata

SEQ ID NO: 7238543 - DNA, 22 bp, Homo sapiens
tttattggatgggtcagctcta

SEQ ID NO: 7238544 - DNA, 22 bp, Homo sapiens
tttattggatggatggatggat

SEQ ID NO: 7238545 - DNA, 20 bp, Homo sapiens
tttattggcctttcaggaac

SEQ ID NO: 7238546 - DNA, 22 bp, Homo sapiens
ttggaacatccaggacagatat

SEQ ID NO: 7238547 - DNA, 20 bp, Homo sapiens
ttgctttatcagacatgata

SEQ ID NO: 7238548 - DNA, 22 bp, Homo sapiens
ttgctttatattcaagagagga

SEQ ID NO: 7238549 - DNA, 22 bp, Homo sapiens
ttgctttagggcaaatatttca

SEQ ID NO: 7238550 - DNA, 22 bp, Homo sapiens
ttgctttaactagtaaatgggg

SEQ ID NO: 7238551 - DNA, 22 bp, Homo sapiens
ttgctttaatgagattttgcca

SEQ ID NO: 7238552 - DNA, 22 bp, Homo sapiens
ttgctttacaaaaattgatggt

SEQ ID NO: 7238553 - DNA, 22 bp, Homo sapiens
ttgctcagcactggagccagct

SEQ ID NO: 7238554 - DNA, 22 bp, Homo sapiens
ttgctcaggcttagagctacta

SEQ ID NO: 7238555 - DNA, 22 bp, Homo sapiens
ttgggaaattactctgctagga

SEQ ID NO: 7238556 - DNA, 23 bp, Homo sapiens
ttgggaaatagttaagacatgag

SEQ ID NO: 7238557 - DNA, 23 bp, Homo sapiens
ttgggaaatagttaagacatgag

SEQ ID NO: 7238558 - DNA, 22 bp, Homo sapiens
ttgttcatggttgtaagtttga

SEQ ID NO: 7238559 - DNA, 23 bp, Homo sapiens
ttgtggaagggagatggcaacag

SEQ ID NO: 7238560 - DNA, 22 bp, Homo sapiens
ttgtgcatttctctgagtgtgt

SEQ ID NO: 7238561 - DNA, 22 bp, Homo sapiens
ttgtagaagcagggtgccctct

SEQ ID NO: 7238562 - DNA, 22 bp, Homo sapiens
ttgtatagcccagagagtgaga

SEQ ID NO: 7238563 - DNA, 23 bp, Homo sapiens
ttgtatctctggaaattcttcaa

SEQ ID NO: 7238564 - DNA, 22 bp, Homo sapiens
ttgagacacagtttcactctgt

SEQ ID NO: 7238565 - DNA, 22 bp, Homo sapiens
ttgagacactttgggcatcact

SEQ ID NO: 7238566 - DNA, 23 bp, Homo sapiens
ttcttctcaattagttgattcag

SEQ ID NO: 7238567 - DNA, 20 bp, Homo sapiens
ttcttctctagttatcttca

SEQ ID NO: 7238568 - DNA, 22 bp, Homo sapiens
ttctcttcccactttctgtatt

SEQ ID NO: 7238569 - DNA, 22 bp, Homo sapiens
ttattttaccttcctctgagct

SEQ ID NO: 7238570 - DNA, 22 bp, Homo sapiens
ttatttatggcactgttggtgg

SEQ ID NO: 7238571 - DNA, 22 bp, Homo sapiens
ttatttaaaagtggtaagattc

SEQ ID NO: 7238572 - DNA, 22 bp, Homo sapiens
ttatttaaaagtggtaagattc

SEQ ID NO: 7238573 - DNA, 22 bp, Homo sapiens
ttagttgatgttctggaggtag

SEQ ID NO: 7238574 - DNA, 22 bp, Homo sapiens
ttatacagtttatacttagaat

SEQ ID NO: 7238575 - DNA, 22 bp, Homo sapiens
ttccaaggctgctatttgtttc

SEQ ID NO: 7238576 - DNA, 19 bp, Homo sapiens
ttccaaaatcaggatttga

SEQ ID NO: 7238577 - DNA, 22 bp, Homo sapiens
acacaggaagtcagcactgatg

SEQ ID NO: 7238578 - DNA, 22 bp, Homo sapiens
acacaggaagagagataataat

SEQ ID NO: 7238579 - DNA, 22 bp, Homo sapiens
agcaccctggggaagcacaaag

SEQ ID NO: 7238580 - DNA, 22 bp, Homo sapiens
acagaaattctgggacagaaaa

SEQ ID NO: 7238581 - DNA, 19 bp, Homo sapiens
acagaaattagttattttc

SEQ ID NO: 7238582 - DNA, 22 bp, Homo sapiens
acagaaattagcagtgagttta

SEQ ID NO: 7238583 - DNA, 22 bp, Homo sapiens
acagaaattgggcaaatggaag

SEQ ID NO: 7238584 - DNA, 22 bp, Homo sapiens
agcagggcagttaaagggtcct

SEQ ID NO: 7238585 - DNA, 23 bp, Homo sapiens
agcagggccagaatacttgctgt

SEQ ID NO: 7238586 - DNA, 22 bp, Homo sapiens
agcagggcccactaggggagat

SEQ ID NO: 7238587 - DNA, 22 bp, Homo sapiens
agcagggccaacagtaaacacc

SEQ ID NO: 7238588 - DNA, 18 bp, Homo sapiens
agcagggcattttgccat

SEQ ID NO: 7238589 - DNA, 22 bp, Homo sapiens
agcagggcatgaataagggttt

SEQ ID NO: 7238590 - DNA, 22 bp, Homo sapiens
aattttatgccttgcacgttgg

SEQ ID NO: 7238591 - DNA, 22 bp, Homo sapiens
aattttattaactggatgtagc

SEQ ID NO: 7238592 - DNA, 22 bp, Homo sapiens
aattttattagaaggcaagggg

SEQ ID NO: 7238593 - DNA, 22 bp, Homo sapiens
acaaatgtctacattgagaata

SEQ ID NO: 7238594 - DNA, 22 bp, Homo sapiens
aattagtattgcgattcattag

SEQ ID NO: 7238595 - DNA, 22 bp, Homo sapiens
aatgtgttcagttaaatgaact

SEQ ID NO: 7238596 - DNA, 22 bp, Homo sapiens
actgccttataatatgtcaaca

SEQ ID NO: 7238597 - DNA, 22 bp, Homo sapiens
actgccttagaacaaagcagga

SEQ ID NO: 7238598 - DNA, 22 bp, Homo sapiens
actgccttatatgctgtgtgtg

SEQ ID NO: 7238599 - DNA, 22 bp, Homo sapiens
aataagaattgccagatttgaa

SEQ ID NO: 7238600 - DNA, 22 bp, Homo sapiens
aagtcagagcaactgagacatt

SEQ ID NO: 7238601 - DNA, 22 bp, Homo sapiens
aatgaacatgggagtactaata

SEQ ID NO: 7238602 - DNA, 22 bp, Homo sapiens
aatgaacatggacaagttaata

SEQ ID NO: 7238603 - DNA, 22 bp, Homo sapiens
aatgaacacttagcctttctat

SEQ ID NO: 7238604 - DNA, 22 bp, Homo sapiens
aatgaacagtgggtgaggtacc

SEQ ID NO: 7238605 - DNA, 22 bp, Homo sapiens
aatgaacacatgtggtcagttt

SEQ ID NO: 7238606 - DNA, 22 bp, Homo sapiens
agaaaacataggagacaggaaa

SEQ ID NO: 7238607 - DNA, 22 bp, Homo sapiens
aaggcacttttcctgagatgat

SEQ ID NO: 7238608 - DNA, 22 bp, Homo sapiens
aaggcacttgcccagagctgca

SEQ ID NO: 7238609 - DNA, 22 bp, Homo sapiens
aaggcacttaacgtgggaggat

SEQ ID NO: 7238610 - DNA, 22 bp, Homo sapiens
aaggcactacgctgctggggcg

SEQ ID NO: 7238611 - DNA, 22 bp, Homo sapiens
aaggcacttttctaaagacctt

SEQ ID NO: 7238612 - DNA, 22 bp, Homo sapiens
aagctgcaggttgaatccaggt

SEQ ID NO: 7238613 - DNA, 22 bp, Homo sapiens
acagggctccttgggctgacac

SEQ ID NO: 7238614 - DNA, 22 bp, Homo sapiens
acagggctgaggctggcttctt

SEQ ID NO: 7238615 - DNA, 22 bp, Homo sapiens
acagggctggcgttgggacaga

SEQ ID NO: 7238616 - DNA, 22 bp, Homo sapiens
acagggcttagaaatctgttgc

SEQ ID NO: 7238617 - DNA, 22 bp, Homo sapiens
acaggtgtgttcccggaaagcc

SEQ ID NO: 7238618 - DNA, 22 bp, Homo sapiens
acaggtgttgaatgatgtcaca

SEQ ID NO: 7238619 - DNA, 22 bp, Homo sapiens
aagtatgaatcaaagactatct

SEQ ID NO: 7238620 - DNA, 22 bp, Homo sapiens
aagtatgacatttaagacaatt

SEQ ID NO: 7238621 - DNA, 22 bp, Homo sapiens
aaggtggtaggctatatcagta

SEQ ID NO: 7238622 - DNA, 22 bp, Homo sapiens
aaggtggtaatagtgcaggatt

SEQ ID NO: 7238623 - DNA, 22 bp, Homo sapiens
acatgtgtatagcctgtataga

SEQ ID NO: 7238624 - DNA, 22 bp, Homo sapiens
acatgtgtctaagaatgaaaga

SEQ ID NO: 7238625 - DNA, 22 bp, Homo sapiens
acatgtgtgacaacagaggtga

SEQ ID NO: 7238626 - DNA, 22 bp, Homo sapiens
acatgtgtggccgctgtagaca

SEQ ID NO: 7238627 - DNA, 22 bp, Homo sapiens
acatgtgtggacatgaatctac

SEQ ID NO: 7238628 - DNA, 22 bp, Homo sapiens
acatgtgtgtatacgtatttat

SEQ ID NO: 7238629 - DNA, 22 bp, Homo sapiens
acatgtgtacatatatatgtgc

SEQ ID NO: 7238630 - DNA, 22 bp, Homo sapiens
acatgtgtacttttaaggatgt

SEQ ID NO: 7238631 - DNA, 22 bp, Homo sapiens
aagggcaggaaaagatggatgt

SEQ ID NO: 7238632 - DNA, 22 bp, Homo sapiens
aacaggcaggagaattctgcct

SEQ ID NO: 7238633 - DNA, 22 bp, Homo sapiens
aataagaacaactaaggtttat

SEQ ID NO: 7238634 - DNA, 22 bp, Homo sapiens
aataagaactccatttactcgt

SEQ ID NO: 7238635 - DNA, 22 bp, Homo sapiens
aactgcttcttactgctgggca

SEQ ID NO: 7238636 - DNA, 19 bp, Homo sapiens
aactgcttctgaaggagcc

SEQ ID NO: 7238637 - DNA, 22 bp, Homo sapiens
aactgcttccttggcaggcatg

SEQ ID NO: 7238638 - DNA, 21 bp, Homo sapiens
aactgcttcccatcttagggc

SEQ ID NO: 7238639 - DNA, 22 bp, Homo sapiens
aactgcttcacttggcatttgg

SEQ ID NO: 7238640 - DNA, 22 bp, Homo sapiens
aactgcttcaagtctgtgggga

SEQ ID NO: 7238641 - DNA, 22 bp, Homo sapiens
aactgcttatctttggtagatg

SEQ ID NO: 7238642 - DNA, 22 bp, Homo sapiens
aactgcttagtgatggatgacc

SEQ ID NO: 7238643 - DNA, 22 bp, Homo sapiens
aactggttctcttttgcttgtg

SEQ ID NO: 7238644 - DNA, 22 bp, Homo sapiens
aactgtttttcacgtgtctcat

SEQ ID NO: 7238645 - DNA, 22 bp, Homo sapiens
aactgtttcagaaatattgttg

SEQ ID NO: 7238646 - DNA, 23 bp, Homo sapiens
aacttaatactgggataagatgc

SEQ ID NO: 7238647 - DNA, 22 bp, Homo sapiens
aacaaacattacctggtgctgg

SEQ ID NO: 7238648 - DNA, 22 bp, Homo sapiens
aacaaacagttaagtgtggatg

SEQ ID NO: 7238649 - DNA, 22 bp, Homo sapiens
aaattgaatgattaagtggtga

SEQ ID NO: 7238650 - DNA, 22 bp, Homo sapiens
aaatgtgtttagatggtttatt

SEQ ID NO: 7238651 - DNA, 17 bp, Homo sapiens
aagtccagagttgagca

SEQ ID NO: 7238652 - DNA, 22 bp, Homo sapiens
aagtccaggtccaggaggttcc

SEQ ID NO: 7238653 - DNA, 22 bp, Homo sapiens
aagtccagggatcaaagtaggc

SEQ ID NO: 7238654 - DNA, 22 bp, Homo sapiens
acactgcatttcaacaaggccc

SEQ ID NO: 7238655 - DNA, 21 bp, Homo sapiens
acactgcaggtgaagtgcact

SEQ ID NO: 7238656 - DNA, 22 bp, Homo sapiens
acactgctaaacagtaaagatg

SEQ ID NO: 7238657 - DNA, 22 bp, Homo sapiens
aagacaggaaaagctccaggcc

SEQ ID NO: 7238658 - DNA, 22 bp, Homo sapiens
aagacaggaacatagcaaatcc

SEQ ID NO: 7238659 - DNA, 22 bp, Homo sapiens
aagaataaattaagatacttag

SEQ ID NO: 7238660 - DNA, 22 bp, Homo sapiens
aatgttttgcattagttttcta

SEQ ID NO: 7238661 - DNA, 22 bp, Homo sapiens
aatgttttctgactgctaactt

SEQ ID NO: 7238662 - DNA, 22 bp, Homo sapiens
aatgttttcattatcctaactg

SEQ ID NO: 7238663 - DNA, 22 bp, Homo sapiens
aatgttttctctgtgaacacat

SEQ ID NO: 7238664 - DNA, 22 bp, Homo sapiens
aatgttttcccagtgcagacga

SEQ ID NO: 7238665 - DNA, 22 bp, Homo sapiens
aagaaatgctgatgttggatgg

SEQ ID NO: 7238666 - DNA, 22 bp, Homo sapiens
aatgttttacagatcccattag

SEQ ID NO: 7238667 - DNA, 22 bp, Homo sapiens
aatgttttatagctcaagcaat

SEQ ID NO: 7238668 - DNA, 22 bp, Homo sapiens
aatgttttagattactgctggg

SEQ ID NO: 7238669 - DNA, 22 bp, Homo sapiens
aacttcagagctgtgtggtttg

SEQ ID NO: 7238670 - DNA, 22 bp, Homo sapiens
acaaggagaagaaattggtcat

SEQ ID NO: 7238671 - DNA, 22 bp, Homo sapiens
aagctctttccctcttcagaac

SEQ ID NO: 7238672 - DNA, 22 bp, Homo sapiens
aaatgtatcctacttcctgagt

SEQ ID NO: 7238673 - DNA, 22 bp, Homo sapiens
aaatgtattgcataggatattt

SEQ ID NO: 7238674 - DNA, 22 bp, Homo sapiens
aaagctgccctacacggaagca

SEQ ID NO: 7238675 - DNA, 22 bp, Homo sapiens
aaagctgcccagctgcctgttt

SEQ ID NO: 7238676 - DNA, 22 bp, Homo sapiens
aacaaacaaacattttgtcatc

SEQ ID NO: 7238677 - DNA, 22 bp, Homo sapiens
aaagtgggaacaatggagagtg

SEQ ID NO: 7238678 - DNA, 22 bp, Homo sapiens
aaaggtcaaaatcgtgacattg

SEQ ID NO: 7238679 - DNA, 22 bp, Homo sapiens
aaagttcatggtgttatagaaa

SEQ ID NO: 7238680 - DNA, 22 bp, Homo sapiens
aaaatgaagcaaaggcattcag

SEQ ID NO: 7238681 - DNA, 22 bp, Homo sapiens
aaaatgaacagaacaatgggga

SEQ ID NO: 7238682 - DNA, 22 bp, Homo sapiens
aaaaacacaagtggcttggtct

SEQ ID NO: 7238683 - DNA, 22 bp, Homo sapiens
aaaaacacaactgtctttctct

SEQ ID NO: 7238684 - DNA, 22 bp, Homo sapiens
aaacactgtgtcaaactggggc

SEQ ID NO: 7238685 - DNA, 22 bp, Homo sapiens
aaagaaggggtctacatccaat

SEQ ID NO: 7238686 - DNA, 22 bp, Homo sapiens
actgcacttcagcctgggtgtc

SEQ ID NO: 7238687 - DNA, 22 bp, Homo sapiens
agtggcagggctggctgctgca

SEQ ID NO: 7238688 - DNA, 22 bp, Homo sapiens
agtggcagagctgtgtcttgaa

SEQ ID NO: 7238689 - DNA, 22 bp, Homo sapiens
agtggcaggtgtttcgtggtgc

SEQ ID NO: 7238690 - DNA, 20 bp, Homo sapiens
agtgtttagaatactattat

SEQ ID NO: 7238691 - DNA, 22 bp, Homo sapiens
agtgtttaccccaatcagttta

SEQ ID NO: 7238692 - DNA, 22 bp, Homo sapiens
agtgtttacagagtagtggaaa

SEQ ID NO: 7238693 - DNA, 22 bp, Homo sapiens
agtgtttaagttacacacatat

SEQ ID NO: 7238694 - DNA, 22 bp, Homo sapiens
actgcttttctaagattctgtg

SEQ ID NO: 7238695 - DNA, 16 bp, Homo sapiens
actgcttttcataaga

SEQ ID NO: 7238696 - DNA, 22 bp, Homo sapiens
actgcttttcagagtctgcctg

SEQ ID NO: 7238697 - DNA, 22 bp, Homo sapiens
actgcttttagaaatctataga

SEQ ID NO: 7238698 - DNA, 22 bp, Homo sapiens
actgctttgctctgcccccagg

SEQ ID NO: 7238699 - DNA, 22 bp, Homo sapiens
actgctttatctgagaagtcct

SEQ ID NO: 7238700 - DNA, 23 bp, Homo sapiens
actgctttattcatgaggctctc

SEQ ID NO: 7238701 - DNA, 22 bp, Homo sapiens
actgcttttgatctcttctgta

SEQ ID NO: 7238702 - DNA, 22 bp, Homo sapiens
agtgcatatatgaagagtatga

SEQ ID NO: 7238703 - DNA, 22 bp, Homo sapiens
acgcctgtaatcccagcacttt

SEQ ID NO: 7238704 - DNA, 22 bp, Homo sapiens
ataaaatgtctccactgggctc

SEQ ID NO: 7238705 - DNA, 22 bp, Homo sapiens
atacagggacatccagtttttc

SEQ ID NO: 7238706 - DNA, 22 bp, Homo sapiens
acttactactcctttgcaattt

SEQ ID NO: 7238707 - DNA, 22 bp, Homo sapiens
atactgctgctgctgaaatcac

SEQ ID NO: 7238708 - DNA, 22 bp, Homo sapiens
atcatcgtcccttctcttgtca

SEQ ID NO: 7238709 - DNA, 22 bp, Homo sapiens
aggcagctggaaaactccaggc

SEQ ID NO: 7238710 - DNA, 22 bp, Homo sapiens
aggcactgcttctaagtaggaa

SEQ ID NO: 7238711 - DNA, 18 bp, Homo sapiens
aggcactggaattaaggg

SEQ ID NO: 7238712 - DNA, 22 bp, Homo sapiens
aggcactgggaatatgctgagg

SEQ ID NO: 7238713 - DNA, 20 bp, Homo sapiens
aggcactggatttcttatat

SEQ ID NO: 7238714 - DNA, 20 bp, Homo sapiens
aggcactggggataggtaag

SEQ ID NO: 7238715 - DNA, 22 bp, Homo sapiens
aggcactgggtaattagtagct

SEQ ID NO: 7238716 - DNA, 22 bp, Homo sapiens
aggcactgggggatgagcaagg

SEQ ID NO: 7238717 - DNA, 22 bp, Homo sapiens
acaggtgttttggaggatgatt

SEQ ID NO: 7238718 - DNA, 22 bp, Homo sapiens
acaggtgtacaatgcatgacag

SEQ ID NO: 7238719 - DNA, 22 bp, Homo sapiens
acaggtgttgactcacaggccc

SEQ ID NO: 7238720 - DNA, 22 bp, Homo sapiens
acaggcagattaagggtaggca

SEQ ID NO: 7238721 - DNA, 22 bp, Homo sapiens
aggaagaaactgagctctgaca

SEQ ID NO: 7238722 - DNA, 22 bp, Homo sapiens
agctgaagtttagaattgtgaa

SEQ ID NO: 7238723 - DNA, 22 bp, Homo sapiens
agctctggttattgaagcaggg

SEQ ID NO: 7238724 - DNA, 22 bp, Homo sapiens
agctctggtgagatgttattca

SEQ ID NO: 7238725 - DNA, 21 bp, Homo sapiens
acagctggtgcagggcgggga

SEQ ID NO: 7238726 - DNA, 22 bp, Homo sapiens
acatcagagggctcacatgatc

SEQ ID NO: 7238727 - DNA, 22 bp, Homo sapiens
acatgtgtaaggtctctcagtc

SEQ ID NO: 7238728 - DNA, 22 bp, Homo sapiens
aggctctggctactacagagct

SEQ ID NO: 7238729 - DNA, 22 bp, Homo sapiens
aggctctgtttgctgtggtacc

SEQ ID NO: 7238730 - DNA, 22 bp, Homo sapiens
agggagacaaaagcagctgcca

SEQ ID NO: 7238731 - DNA, 22 bp, Homo sapiens
agacagacatgctagttttctt

SEQ ID NO: 7238732 - DNA, 22 bp, Homo sapiens
agacagacattctagagccacc

SEQ ID NO: 7238733 - DNA, 22 bp, Homo sapiens
agacagaccatggctattcaga

SEQ ID NO: 7238734 - DNA, 22 bp, Homo sapiens
agacagacggctttatacacag

SEQ ID NO: 7238735 - DNA, 17 bp, Homo sapiens
agacagacctctgcatc

SEQ ID NO: 7238736 - DNA, 22 bp, Homo sapiens
agacagacgtagtgtgagagta

SEQ ID NO: 7238737 - DNA, 21 bp, Homo sapiens
agacagactgcctgacccacg

SEQ ID NO: 7238738 - DNA, 22 bp, Homo sapiens
agacagactggtttgaattggt

SEQ ID NO: 7238739 - DNA, 22 bp, Homo sapiens
agacagactttgatctggatgt

SEQ ID NO: 7238740 - DNA, 22 bp, Homo sapiens
agacagacttgaaaatgttctt

SEQ ID NO: 7238741 - DNA, 22 bp, Homo sapiens
agacagactgtgtttgaatcct

SEQ ID NO: 7238742 - DNA, 22 bp, Homo sapiens
agacagctagggctgcagggac

SEQ ID NO: 7238743 - DNA, 23 bp, Homo sapiens
agacattttaataaggacttttt

SEQ ID NO: 7238744 - DNA, 22 bp, Homo sapiens
agacatttggagccaactttcc

SEQ ID NO: 7238745 - DNA, 22 bp, Homo sapiens
agacatttggaagatacacata

SEQ ID NO: 7238746 - DNA, 22 bp, Homo sapiens
agacatttcctagacatcaatg

SEQ ID NO: 7238747 - DNA, 22 bp, Homo sapiens
atgtattttaagatttgcctca

SEQ ID NO: 7238748 - DNA, 22 bp, Homo sapiens
atgtggggactctgagagaatt

SEQ ID NO: 7238749 - DNA, 22 bp, Homo sapiens
atgtgtaaaaagtgcttaatat

SEQ ID NO: 7238750 - DNA, 22 bp, Homo sapiens
agagagttgtatgtttctaaaa

SEQ ID NO: 7238751 - DNA, 22 bp, Homo sapiens
agacattttagacataaaagat

SEQ ID NO: 7238752 - DNA, 22 bp, Homo sapiens
agacattttacattcttccatt

SEQ ID NO: 7238753 - DNA, 22 bp, Homo sapiens
agacattttgcattccctgaag

SEQ ID NO: 7238754 - DNA, 22 bp, Homo sapiens
agataggagccaggacttaaca

SEQ ID NO: 7238755 - DNA, 22 bp, Homo sapiens
atttgtttcagggccttggtat

SEQ ID NO: 7238756 - DNA, 22 bp, Homo sapiens
agagtttgaattttgaaaagat

SEQ ID NO: 7238757 - DNA, 22 bp, Homo sapiens
attgataaattgcaatggggct

SEQ ID NO: 7238758 - DNA, 21 bp, Homo sapiens
attattatttctgtgtccagc

SEQ ID NO: 7238759 - DNA, 22 bp, Homo sapiens
caccgcggagtgatggagaaac

SEQ ID NO: 7238760 - DNA, 22 bp, Homo sapiens
cactgcttagatcttccttcaa

SEQ ID NO: 7238761 - DNA, 22 bp, Homo sapiens
cactgcttccattgttcacctg

SEQ ID NO: 7238762 - DNA, 22 bp, Homo sapiens
cactgcttcagtcagagaaatt

SEQ ID NO: 7238763 - DNA, 22 bp, Homo sapiens
cactgcttatgtctccttttca

SEQ ID NO: 7238764 - DNA, 22 bp, Homo sapiens
cactgcttataaattctaggca

SEQ ID NO: 7238765 - DNA, 22 bp, Homo sapiens
cactgcttagttggtaaatgtg

SEQ ID NO: 7238766 - DNA, 22 bp, Homo sapiens
cactgctttaaggctgagtaac

SEQ ID NO: 7238767 - DNA, 22 bp, Homo sapiens
cactgcttggttgcaacattgc

SEQ ID NO: 7238768 - DNA, 22 bp, Homo sapiens
cactgcttggccctgagggcag

SEQ ID NO: 7238769 - DNA, 22 bp, Homo sapiens
cactgcttgcagtatgagtgga

SEQ ID NO: 7238770 - DNA, 22 bp, Homo sapiens
cactgcttctggaggaatttgg

SEQ ID NO: 7238771 - DNA, 22 bp, Homo sapiens
cactgcttgattgacatgcacg

SEQ ID NO: 7238772 - DNA, 22 bp, Homo sapiens
agcagggctgtgctccttccga

SEQ ID NO: 7238773 - DNA, 22 bp, Homo sapiens
agcacatgcacagtgctacact

SEQ ID NO: 7238774 - DNA, 22 bp, Homo sapiens
agcacatgacttttagtcgagt

SEQ ID NO: 7238775 - DNA, 22 bp, Homo sapiens
agcacaggtgaaacagtcaggt

SEQ ID NO: 7238776 - DNA, 20 bp, Homo sapiens
caacactgcccattgtttgc

SEQ ID NO: 7238777 - DNA, 23 bp, Homo sapiens
caacactgccttcaggtgaagaa

SEQ ID NO: 7238778 - DNA, 22 bp, Homo sapiens
caagcaatgctatactcattat

SEQ ID NO: 7238779 - DNA, 22 bp, Homo sapiens
caagcaatgccctggtatatta

SEQ ID NO: 7238780 - DNA, 22 bp, Homo sapiens
caagcaatattttagaaaggta

SEQ ID NO: 7238781 - DNA, 22 bp, Homo sapiens
cagctcatgacctttgttatct

SEQ ID NO: 7238782 - DNA, 22 bp, Homo sapiens
cagacaggttgcaaaacttcaa

SEQ ID NO: 7238783 - DNA, 22 bp, Homo sapiens
cagacaggtagggacagaacat

SEQ ID NO: 7238784 - DNA, 22 bp, Homo sapiens
cagacagggttttggtctttgg

SEQ ID NO: 7238785 - DNA, 22 bp, Homo sapiens
cagacagggtgggtttctgggc

SEQ ID NO: 7238786 - DNA, 22 bp, Homo sapiens
cagacaggaagttcagaagaaa

SEQ ID NO: 7238787 - DNA, 22 bp, Homo sapiens
aggacatgtttgtatcttcctt

SEQ ID NO: 7238788 - DNA, 22 bp, Homo sapiens
aggacatgtgcctccagggcag

SEQ ID NO: 7238789 - DNA, 22 bp, Homo sapiens
aggcactgcagattacaggcgc

SEQ ID NO: 7238790 - DNA, 23 bp, Homo sapiens
catgtttttctatctcagcgtgt

SEQ ID NO: 7238791 - DNA, 22 bp, Homo sapiens
aggcactgtactaggtacaggg

SEQ ID NO: 7238792 - DNA, 22 bp, Homo sapiens
aggcactggtctaccccttagt

SEQ ID NO: 7238793 - DNA, 22 bp, Homo sapiens
aggcactgtgcagtcccaagca

SEQ ID NO: 7238794 - DNA, 22 bp, Homo sapiens
aggcactgtgctgatgtcttat

SEQ ID NO: 7238795 - DNA, 22 bp, Homo sapiens
aggcactgtgcttcttatatgt

SEQ ID NO: 7238796 - DNA, 22 bp, Homo sapiens
aggcactgtggaagacatggtt

SEQ ID NO: 7238797 - DNA, 15 bp, Homo sapiens
aggcactgtgggacc

SEQ ID NO: 7238798 - DNA, 22 bp, Homo sapiens
cattttaaatgatttaagccaa

SEQ ID NO: 7238799 - DNA, 23 bp, Homo sapiens
caggaggagaaggcttggttggc

SEQ ID NO: 7238800 - DNA, 22 bp, Homo sapiens
aggctctgtgacaatcaagctg

SEQ ID NO: 7238801 - DNA, 22 bp, Homo sapiens
aggcatggatggatccagggct

SEQ ID NO: 7238802 - DNA, 17 bp, Homo sapiens
aggcaggtaagagttat

SEQ ID NO: 7238803 - DNA, 22 bp, Homo sapiens
aggcagggtgatgataatgatt

SEQ ID NO: 7238804 - DNA, 22 bp, Homo sapiens
aggcagggtcttgctatgttgc

SEQ ID NO: 7238805 - DNA, 18 bp, Homo sapiens
ccctcttgcacaaagcaa

SEQ ID NO: 7238806 - DNA, 18 bp, Homo sapiens
ccctcttgcacaaagcaa

SEQ ID NO: 7238807 - DNA, 21 bp, Homo sapiens
aggggacagagtagctccagg

SEQ ID NO: 7238808 - DNA, 22 bp, Homo sapiens
agggctctcttcttggtttgca

SEQ ID NO: 7238809 - DNA, 22 bp, Homo sapiens
agggctctgagtgggaaagagg

SEQ ID NO: 7238810 - DNA, 20 bp, Homo sapiens
agggctctgccttgctgatg

SEQ ID NO: 7238811 - DNA, 22 bp, Homo sapiens
ccgcccacactaaatatgagcg

SEQ ID NO: 7238812 - DNA, 22 bp, Homo sapiens
agtctgcttttgtgaagagctg

SEQ ID NO: 7238813 - DNA, 22 bp, Homo sapiens
agtctgcttcctggagaactca

SEQ ID NO: 7238814 - DNA, 22 bp, Homo sapiens
agtgacagtctcagagatcagg

SEQ ID NO: 7238815 - DNA, 17 bp, Homo sapiens
agtggcaggcagatggg

SEQ ID NO: 7238816 - DNA, 22 bp, Homo sapiens
ctgaagcatgcgtttgtaaact

SEQ ID NO: 7238817 - DNA, 22 bp, Homo sapiens
ctgaagcatatcatgccaagtt

SEQ ID NO: 7238818 - DNA, 23 bp, Homo sapiens
ctgaagcagttccctctctgccc

SEQ ID NO: 7238819 - DNA, 22 bp, Homo sapiens
ctgaagcagggagtgatgaagt

SEQ ID NO: 7238820 - DNA, 22 bp, Homo sapiens
ctgaagcaggcctacttcattg

SEQ ID NO: 7238821 - DNA, 22 bp, Homo sapiens
ctgaagcaggaggggaggcgct

SEQ ID NO: 7238822 - DNA, 23 bp, Homo sapiens
ctgaagcaatatcccctcacttc

SEQ ID NO: 7238823 - DNA, 22 bp, Homo sapiens
ctgaagcaaatgaaacagctct

SEQ ID NO: 7238824 - DNA, 22 bp, Homo sapiens
ctgaagcacagcatataaataa

SEQ ID NO: 7238825 - DNA, 22 bp, Homo sapiens
ctgaagcaattgagagatgttt

SEQ ID NO: 7238826 - DNA, 22 bp, Homo sapiens
ctgaagcaggaacagcgagatt

SEQ ID NO: 7238827 - DNA, 22 bp, Homo sapiens
ctgaagcagatgtggctgagat

SEQ ID NO: 7238828 - DNA, 22 bp, Homo sapiens
agtgtcctggcaagggtttcag

SEQ ID NO: 7238829 - DNA, 22 bp, Homo sapiens
aggtgtcttcagggtgagacag

SEQ ID NO: 7238830 - DNA, 22 bp, Homo sapiens
cctggtgcccccaagccagctg

SEQ ID NO: 7238831 - DNA, 22 bp, Homo sapiens
cctggtgccactagagaatgtc

SEQ ID NO: 7238832 - DNA, 22 bp, Homo sapiens
cctggtgcaggtgtgttgccag

SEQ ID NO: 7238833 - DNA, 22 bp, Homo sapiens
cctggtgcaccaagtaagggtg

SEQ ID NO: 7238834 - DNA, 22 bp, Homo sapiens
cctttattcaattagtcctaat

SEQ ID NO: 7238835 - DNA, 20 bp, Homo sapiens
cctttattatttgtatgatg

SEQ ID NO: 7238836 - DNA, 22 bp, Homo sapiens
cgcgaggtggaggttgcagtga

SEQ ID NO: 7238837 - DNA, 17 bp, Homo sapiens
aggtctgagagtatctg

SEQ ID NO: 7238838 - DNA, 22 bp, Homo sapiens
aggtctgagcaggggagaacag

SEQ ID NO: 7238839 - DNA, 18 bp, Homo sapiens
aggtctgaggaagagcct

SEQ ID NO: 7238840 - DNA, 22 bp, Homo sapiens
ctgtccagctgaccagagcagc

SEQ ID NO: 7238841 - DNA, 21 bp, Homo sapiens
ctgtccaaatttcataacttt

SEQ ID NO: 7238842 - DNA, 22 bp, Homo sapiens
ctgtatttgaaagaaaagattt

SEQ ID NO: 7238843 - DNA, 22 bp, Homo sapiens
ctggtggagagtgggctctgga

SEQ ID NO: 7238844 - DNA, 22 bp, Homo sapiens
ctgtttctaaagggagcagatt

SEQ ID NO: 7238845 - DNA, 22 bp, Homo sapiens
cttcagagtgcagaagattggg

SEQ ID NO: 7238846 - DNA, 22 bp, Homo sapiens
cttcagaggggactcaaagtca

SEQ ID NO: 7238847 - DNA, 22 bp, Homo sapiens
cttcagagcttgttaaaactgt

SEQ ID NO: 7238848 - DNA, 22 bp, Homo sapiens
ctgtgtcccacacgaggtgtat

SEQ ID NO: 7238849 - DNA, 22 bp, Homo sapiens
ctgtgtccatttatcattgtca

SEQ ID NO: 7238850 - DNA, 22 bp, Homo sapiens
ctgtgtccatgttctaatttgg

SEQ ID NO: 7238851 - DNA, 22 bp, Homo sapiens
ctgtgtcactcactgcgttatg

SEQ ID NO: 7238852 - DNA, 22 bp, Homo sapiens
ctgtgtccaatggccttagcag

SEQ ID NO: 7238853 - DNA, 19 bp, Homo sapiens
ctgtgtcacatttatgaaa

SEQ ID NO: 7238854 - DNA, 22 bp, Homo sapiens
ctgtgggagcacatgacagata

SEQ ID NO: 7238855 - DNA, 22 bp, Homo sapiens
ctgtgggagcacatgacagata

SEQ ID NO: 7238856 - DNA, 22 bp, Homo sapiens
ctgtgtcccttgtcccagagcc

SEQ ID NO: 7238857 - DNA, 22 bp, Homo sapiens
ctgtgtccccctcagccaggtg

SEQ ID NO: 7238858 - DNA, 22 bp, Homo sapiens
ctgtgtcccagtaccttgggta

SEQ ID NO: 7238859 - DNA, 22 bp, Homo sapiens
ctgtgtcccagccaggataatg

SEQ ID NO: 7238860 - DNA, 22 bp, Homo sapiens
ctgtgtcctccccatcacttct

SEQ ID NO: 7238861 - DNA, 22 bp, Homo sapiens
atagcatagtcagcttcgctga

SEQ ID NO: 7238862 - DNA, 22 bp, Homo sapiens
atgggatgcatggctgtggcca

SEQ ID NO: 7238863 - DNA, 22 bp, Homo sapiens
atgggatcttgccctgagggct

SEQ ID NO: 7238864 - DNA, 22 bp, Homo sapiens
atgggatgaacttgatctgctt

SEQ ID NO: 7238865 - DNA, 22 bp, Homo sapiens
atggctgaggctggaggtggca

SEQ ID NO: 7238866 - DNA, 22 bp, Homo sapiens
gagcacagctggaggtagcatt

SEQ ID NO: 7238867 - DNA, 22 bp, Homo sapiens
gagaagtttctggtttgcatag

SEQ ID NO: 7238868 - DNA, 22 bp, Homo sapiens
gagacaggatttaaccaaagct

SEQ ID NO: 7238869 - DNA, 22 bp, Homo sapiens
gagacaggccaggtggtactta

SEQ ID NO: 7238870 - DNA, 22 bp, Homo sapiens
gagacaggcagctagtgggtca

SEQ ID NO: 7238871 - DNA, 22 bp, Homo sapiens
atggataatggtgatagttgca

SEQ ID NO: 7238872 - DNA, 22 bp, Homo sapiens
atgttatagttataaaatgagg

SEQ ID NO: 7238873 - DNA, 22 bp, Homo sapiens
atgtcaggaccctactgcattg

SEQ ID NO: 7238874 - DNA, 22 bp, Homo sapiens
atgtatttctatgtagtgaaga

SEQ ID NO: 7238875 - DNA, 22 bp, Homo sapiens
atgtatttactgagaaggaaac

SEQ ID NO: 7238876 - DNA, 22 bp, Homo sapiens
gaagtccagaatactgctctga

SEQ ID NO: 7238877 - DNA, 22 bp, Homo sapiens
gacaggaaacaagaaggcagga

SEQ ID NO: 7238878 - DNA, 22 bp, Homo sapiens
gaatttcctctaaacccctgag

SEQ ID NO: 7238879 - DNA, 22 bp, Homo sapiens
gaagaaagggaattaacttgag

SEQ ID NO: 7238880 - DNA, 22 bp, Homo sapiens
gaagagagagtggggttctgcg

SEQ ID NO: 7238881 - DNA, 22 bp, Homo sapiens
atgatgtccacaggggtgttca

SEQ ID NO: 7238882 - DNA, 22 bp, Homo sapiens
ctttggaacaagaagaaatggc

SEQ ID NO: 7238883 - DNA, 22 bp, Homo sapiens
ctttggaaagtaagcagctaga

SEQ ID NO: 7238884 - DNA, 22 bp, Homo sapiens
ctttggaaaaagtgactggctc

SEQ ID NO: 7238885 - DNA, 22 bp, Homo sapiens
ctttggaaaaatacctggcata

SEQ ID NO: 7238886 - DNA, 22 bp, Homo sapiens
atgacagaggagtgcaggtgat

SEQ ID NO: 7238887 - DNA, 22 bp, Homo sapiens
ctttattgtccttcttaggtgg

SEQ ID NO: 7238888 - DNA, 22 bp, Homo sapiens
gatgtgtcatttggtcatctgc

SEQ ID NO: 7238889 - DNA, 22 bp, Homo sapiens
gatgtgtcatttggtcatctgc

SEQ ID NO: 7238890 - DNA, 22 bp, Homo sapiens
gagtggggaaagccaggacaga

SEQ ID NO: 7238891 - DNA, 22 bp, Homo sapiens
attatattgagtataaccagag

SEQ ID NO: 7238892 - DNA, 22 bp, Homo sapiens
attataggcttgagccaccgtg

SEQ ID NO: 7238893 - DNA, 20 bp, Homo sapiens
gcagggcatcttggccccca

SEQ ID NO: 7238894 - DNA, 22 bp, Homo sapiens
gcagggcatagaggcacggagg

SEQ ID NO: 7238895 - DNA, 22 bp, Homo sapiens
gcagggcatccctgagcgggtg

SEQ ID NO: 7238896 - DNA, 22 bp, Homo sapiens
gcagggcaaacccaggtgttca

SEQ ID NO: 7238897 - DNA, 22 bp, Homo sapiens
gcagggcagtgtgtctgtgggg

SEQ ID NO: 7238898 - DNA, 21 bp, Homo sapiens
gcatggcaggtcactggggca

SEQ ID NO: 7238899 - DNA, 22 bp, Homo sapiens
gcatggcaagatcaggagacca

SEQ ID NO: 7238900 - DNA, 22 bp, Homo sapiens
gcaggtgtggagtggggtgagc

SEQ ID NO: 7238901 - DNA, 22 bp, Homo sapiens
gcaggtgtggagagtggtcggg

SEQ ID NO: 7238902 - DNA, 18 bp, Homo sapiens
gcaggtgtggagaagggg

SEQ ID NO: 7238903 - DNA, 22 bp, Homo sapiens
gcaggtgtgctgaattacgtga

SEQ ID NO: 7238904 - DNA, 19 bp, Homo sapiens
gcaggtggatgtggtcagc

SEQ ID NO: 7238905 - DNA, 22 bp, Homo sapiens
gcaggtgttctcagaggaggct

SEQ ID NO: 7238906 - DNA, 21 bp, Homo sapiens
gcaggtgtggtatcagcttcc

SEQ ID NO: 7238907 - DNA, 21 bp, Homo sapiens
gcaggtgtggtatcagcttcc

SEQ ID NO: 7238908 - DNA, 22 bp, Homo sapiens
gcaggtgtgggtggctgccagg

SEQ ID NO: 7238909 - DNA, 22 bp, Homo sapiens
gcaggtgtggatttgcatccag

SEQ ID NO: 7238910 - DNA, 22 bp, Homo sapiens
gcaggtgtggatttgcatccag

SEQ ID NO: 7238911 - DNA, 22 bp, Homo sapiens
gcaggtgttttaagacattgaa

SEQ ID NO: 7238912 - DNA, 22 bp, Homo sapiens
gcaggtgttttaagacattgaa

SEQ ID NO: 7238913 - DNA, 22 bp, Homo sapiens
gcagtaaaaaaggatatgtgca

SEQ ID NO: 7238914 - DNA, 22 bp, Homo sapiens
atttgtatcttctaatattatc

SEQ ID NO: 7238915 - DNA, 22 bp, Homo sapiens
caaagaagagatttacagagct

SEQ ID NO: 7238916 - DNA, 22 bp, Homo sapiens
caaagaaggaactataatccca

SEQ ID NO: 7238917 - DNA, 22 bp, Homo sapiens
atttatgtatctgtgtagatca

SEQ ID NO: 7238918 - DNA, 22 bp, Homo sapiens
atttattatgggatttggcaca

SEQ ID NO: 7238919 - DNA, 19 bp, Homo sapiens
atttattgtatgattccat

SEQ ID NO: 7238920 - DNA, 22 bp, Homo sapiens
cacatgtgtatatgtgaggggg

SEQ ID NO: 7238921 - DNA, 22 bp, Homo sapiens
cacatgtgggaaatggtgctta

SEQ ID NO: 7238922 - DNA, 22 bp, Homo sapiens
cacatgtgcagttacatgaatt

SEQ ID NO: 7238923 - DNA, 22 bp, Homo sapiens
cacatgtgcaaatactgaggct

SEQ ID NO: 7238924 - DNA, 22 bp, Homo sapiens
cacatgtgtgctgaggactgtg

SEQ ID NO: 7238925 - DNA, 22 bp, Homo sapiens
cacatgaaggctggggtcgtga

SEQ ID NO: 7238926 - DNA, 22 bp, Homo sapiens
cacatgaaggctggggtcgtga

SEQ ID NO: 7238927 - DNA, 22 bp, Homo sapiens
cacaggaggttaggaagtggtc

SEQ ID NO: 7238928 - DNA, 23 bp, Homo sapiens
cacaggcagaaatcaagacggta

SEQ ID NO: 7238929 - DNA, 22 bp, Homo sapiens
cacaggcagccttgtagaagaa

SEQ ID NO: 7238930 - DNA, 22 bp, Homo sapiens
cacaggcaggaggttctccagt

SEQ ID NO: 7238931 - DNA, 18 bp, Homo sapiens
cacaggcaggtgataggt

SEQ ID NO: 7238932 - DNA, 22 bp, Homo sapiens
cacaggtgccatctcttcatgg

SEQ ID NO: 7238933 - DNA, 22 bp, Homo sapiens
cacaggtgcaagaagttgcagt

SEQ ID NO: 7238934 - DNA, 22 bp, Homo sapiens
cacaggtggctccaagttagag

SEQ ID NO: 7238935 - DNA, 22 bp, Homo sapiens
cacaggtgctcctcggggagct

SEQ ID NO: 7238936 - DNA, 22 bp, Homo sapiens
cacaggtgtttgttatactcag

SEQ ID NO: 7238937 - DNA, 23 bp, Homo sapiens
cacaggtgtttcatcttctcagt

SEQ ID NO: 7238938 - DNA, 22 bp, Homo sapiens
cacaggtgttcttgcagtgaaa

SEQ ID NO: 7238939 - DNA, 22 bp, Homo sapiens
cacaggtgtgtgccttatcaaa

SEQ ID NO: 7238940 - DNA, 22 bp, Homo sapiens
cacaggtgtgtcctggtcttgt

SEQ ID NO: 7238941 - DNA, 17 bp, Homo sapiens
cacaggtgtggtttgag

SEQ ID NO: 7238942 - DNA, 22 bp, Homo sapiens
cacaggtgtctctagtagcgtt

SEQ ID NO: 7238943 - DNA, 22 bp, Homo sapiens
cacaggtgtccaatacctgctt

SEQ ID NO: 7238944 - DNA, 21 bp, Homo sapiens
cacaggtgggtcagtgaggcc

SEQ ID NO: 7238945 - DNA, 22 bp, Homo sapiens
cacaggtggcttctttcatctt

SEQ ID NO: 7238946 - DNA, 22 bp, Homo sapiens
cacaggtgtatgaatatgtcca

SEQ ID NO: 7238947 - DNA, 22 bp, Homo sapiens
cacttcaaggaatatctagaaa

SEQ ID NO: 7238948 - DNA, 19 bp, Homo sapiens
cacttcaatcctttatcaa

SEQ ID NO: 7238949 - DNA, 22 bp, Homo sapiens
cacttcaatctctgcctccatc

SEQ ID NO: 7238950 - DNA, 22 bp, Homo sapiens
cacttcaattaacttcagcatt

SEQ ID NO: 7238951 - DNA, 22 bp, Homo sapiens
cacttcaaataagctcttctca

SEQ ID NO: 7238952 - DNA, 22 bp, Homo sapiens
cacttcaaatatggcttcatga

SEQ ID NO: 7238953 - DNA, 22 bp, Homo sapiens
cacttcaagagcaagggtgcca

SEQ ID NO: 7238954 - DNA, 22 bp, Homo sapiens
cacttcaacctctgagtcctgg

SEQ ID NO: 7238955 - DNA, 22 bp, Homo sapiens
cacttcaacagttatttcttag

SEQ ID NO: 7238956 - DNA, 22 bp, Homo sapiens
ggctctggaaagtgtccttgat

SEQ ID NO: 7238957 - DNA, 21 bp, Homo sapiens
cactttaaaaatatctttata

SEQ ID NO: 7238958 - DNA, 22 bp, Homo sapiens
cactggttggctgagatccata

SEQ ID NO: 7238959 - DNA, 22 bp, Homo sapiens
cactggttgcctctttctgttc

SEQ ID NO: 7238960 - DNA, 22 bp, Homo sapiens
cactgcactccagcttgggtga

SEQ ID NO: 7238961 - DNA, 22 bp, Homo sapiens
cactgcactccagcctgggtga

SEQ ID NO: 7238962 - DNA, 22 bp, Homo sapiens
cactgcactccagcctgggtga

SEQ ID NO: 7238963 - DNA, 22 bp, Homo sapiens
cactgcactccagcctgggcaa

SEQ ID NO: 7238964 - DNA, 22 bp, Homo sapiens
cactgcactccagcctgggtca

SEQ ID NO: 7238965 - DNA, 22 bp, Homo sapiens
cactgcactccagcctgggtca

SEQ ID NO: 7238966 - DNA, 22 bp, Homo sapiens
cactgcactccagcctgggaga

SEQ ID NO: 7238967 - DNA, 22 bp, Homo sapiens
cactgcaacctccacctcctgg

SEQ ID NO: 7238968 - DNA, 22 bp, Homo sapiens
caatgttttgttgaatgaatag

SEQ ID NO: 7238969 - DNA, 22 bp, Homo sapiens
ggacatttgcacctacctcagc

SEQ ID NO: 7238970 - DNA, 22 bp, Homo sapiens
ggacatttttcttcctacaatg

SEQ ID NO: 7238971 - DNA, 22 bp, Homo sapiens
ggacatgttccttttcatcttt

SEQ ID NO: 7238972 - DNA, 22 bp, Homo sapiens
ggacatgtgcaacttctttgga

SEQ ID NO: 7238973 - DNA, 23 bp, Homo sapiens
ggacatgtctctgggtattttga

SEQ ID NO: 7238974 - DNA, 22 bp, Homo sapiens
ggaagctggtaattgttgggac

SEQ ID NO: 7238975 - DNA, 22 bp, Homo sapiens
caacactgacaatggactgatt

SEQ ID NO: 7238976 - DNA, 22 bp, Homo sapiens
caagaacattgtgatcacttca

SEQ ID NO: 7238977 - DNA, 22 bp, Homo sapiens
caaagtcctagaacagtgcttg

SEQ ID NO: 7238978 - DNA, 22 bp, Homo sapiens
gctgcttttcacagagacaaga

SEQ ID NO: 7238979 - DNA, 22 bp, Homo sapiens
gctgctttgtgaaaatcattca

SEQ ID NO: 7238980 - DNA, 22 bp, Homo sapiens
gctgctttgtctgtaaaatgga

SEQ ID NO: 7238981 - DNA, 22 bp, Homo sapiens
gctgctttggggatgaatgaga

SEQ ID NO: 7238982 - DNA, 22 bp, Homo sapiens
gctgctttggaaagcatggaaa

SEQ ID NO: 7238983 - DNA, 22 bp, Homo sapiens
gctgctttgcagtagagtaata

SEQ ID NO: 7238984 - DNA, 22 bp, Homo sapiens
gctgctttctgttaggaattgg

SEQ ID NO: 7238985 - DNA, 22 bp, Homo sapiens
gctgctttctgaaggtgcactg

SEQ ID NO: 7238986 - DNA, 22 bp, Homo sapiens
gctgctttgaaagaggagcttt

SEQ ID NO: 7238987 - DNA, 22 bp, Homo sapiens
gctgctttgacagtgggaacag

SEQ ID NO: 7238988 - DNA, 22 bp, Homo sapiens
gctgctttgatatgcaaggaac

SEQ ID NO: 7238989 - DNA, 22 bp, Homo sapiens
gctgctttttggatttggcaca

SEQ ID NO: 7238990 - DNA, 22 bp, Homo sapiens
gctgcttttgagttaaagtcat

SEQ ID NO: 7238991 - DNA, 22 bp, Homo sapiens
caagaagaggtgattggtaagt

SEQ ID NO: 7238992 - DNA, 22 bp, Homo sapiens
gtactgttggatgttgcagttt

SEQ ID NO: 7238993 - DNA, 22 bp, Homo sapiens
cagattctcactgtattcaggt

SEQ ID NO: 7238994 - DNA, 22 bp, Homo sapiens
gtgagcaattcaaaggcaggaa

SEQ ID NO: 7238995 - DNA, 22 bp, Homo sapiens
cagaatttaagtggattattct

SEQ ID NO: 7238996 - DNA, 22 bp, Homo sapiens
gggagctgatcaggtggattca

SEQ ID NO: 7238997 - DNA, 22 bp, Homo sapiens
gggagctgatgatgtaagtccc

SEQ ID NO: 7238998 - DNA, 22 bp, Homo sapiens
gggagctgcacacgccccggaa

SEQ ID NO: 7238999 - DNA, 22 bp, Homo sapiens
gggagctgcggtcttgcgaaga

SEQ ID NO: 7239000 - DNA, 22 bp, Homo sapiens
gggagctgccttagaccggagg

SEQ ID NO: 7239001 - DNA, 22 bp, Homo sapiens
gggagctgccaccacccctggg

SEQ ID NO: 7239002 - DNA, 20 bp, Homo sapiens
gggagctggaattgtcttag

SEQ ID NO: 7239003 - DNA, 21 bp, Homo sapiens
gggagctggaaactgggtgac

SEQ ID NO: 7239004 - DNA, 22 bp, Homo sapiens
gggagctgctgaacacaagggt

SEQ ID NO: 7239005 - DNA, 22 bp, Homo sapiens
gggcaggtactgggtggtgagc

SEQ ID NO: 7239006 - DNA, 22 bp, Homo sapiens
gggcaggtacaagatgcttctt

SEQ ID NO: 7239007 - DNA, 22 bp, Homo sapiens
gggcaggtaggtgaaataatga

SEQ ID NO: 7239008 - DNA, 22 bp, Homo sapiens
cagagcagtgaggagttgtgta

SEQ ID NO: 7239009 - DNA, 22 bp, Homo sapiens
gggcaggggtcagtggccccaa

SEQ ID NO: 7239010 - DNA, 22 bp, Homo sapiens
gggcaggggtagcattccaagt

SEQ ID NO: 7239011 - DNA, 18 bp, Homo sapiens
cagagcagaggtggagcg

SEQ ID NO: 7239012 - DNA, 23 bp, Homo sapiens
gggatctgtaagttgaagacaaa

SEQ ID NO: 7239013 - DNA, 23 bp, Homo sapiens
gggatctgtaaacctggagaacc

SEQ ID NO: 7239014 - DNA, 22 bp, Homo sapiens
gggatctgctccagagggaaaa

SEQ ID NO: 7239015 - DNA, 22 bp, Homo sapiens
gggtgtttatgtattatgatgt

SEQ ID NO: 7239016 - DNA, 22 bp, Homo sapiens
gggttactgcttcaaaaaatta

SEQ ID NO: 7239017 - DNA, 19 bp, Homo sapiens
ggtcctcagcagagcatgc

SEQ ID NO: 7239018 - DNA, 22 bp, Homo sapiens
ggtcctcaatcccaacaaggca

SEQ ID NO: 7239019 - DNA, 22 bp, Homo sapiens
tgaggacattggtcaggacatg

SEQ ID NO: 7239020 - DNA, 22 bp, Homo sapiens
tgagagttattctgaatttagc

SEQ ID NO: 7239021 - DNA, 22 bp, Homo sapiens
tgagagttttgacgcttgtaac

SEQ ID NO: 7239022 - DNA, 22 bp, Homo sapiens
tgagagttctctcttcaggtgg

SEQ ID NO: 7239023 - DNA, 22 bp, Homo sapiens
tgaccaaagactttagatgttc

SEQ ID NO: 7239024 - DNA, 22 bp, Homo sapiens
tgaccaaaggtggtttatttgg

SEQ ID NO: 7239025 - DNA, 22 bp, Homo sapiens
tgaccaaaggtggtttatttgg

SEQ ID NO: 7239026 - DNA, 22 bp, Homo sapiens
tgacagagagcttttgactgtc

SEQ ID NO: 7239027 - DNA, 22 bp, Homo sapiens
tgacagaggagctggaatgatt

SEQ ID NO: 7239028 - DNA, 22 bp, Homo sapiens
tgacagagctggagaataattt

SEQ ID NO: 7239029 - DNA, 22 bp, Homo sapiens
tgacagagtgacactcttgtct

SEQ ID NO: 7239030 - DNA, 22 bp, Homo sapiens
tgacagagtccagaagtagtgt

SEQ ID NO: 7239031 - DNA, 22 bp, Homo sapiens
tgacagaggctgagttagtctg

SEQ ID NO: 7239032 - DNA, 22 bp, Homo sapiens
tgacagagttcggattgagttt

SEQ ID NO: 7239033 - DNA, 22 bp, Homo sapiens
ccagggcatgtccaagacttag

SEQ ID NO: 7239034 - DNA, 22 bp, Homo sapiens
ccagggcatgtaactaatggtg

SEQ ID NO: 7239035 - DNA, 22 bp, Homo sapiens
tgacagagacttcagagccaaa

SEQ ID NO: 7239036 - DNA, 22 bp, Homo sapiens
tgacagagacagattgaagctt

SEQ ID NO: 7239037 - DNA, 22 bp, Homo sapiens
tgacagactttacttctcctat

SEQ ID NO: 7239038 - DNA, 22 bp, Homo sapiens
tgacagactactgcctctattg

SEQ ID NO: 7239039 - DNA, 22 bp, Homo sapiens
tgaaagcagtgccatgattatg

SEQ ID NO: 7239040 - DNA, 22 bp, Homo sapiens
tctttatttctgaatcccccat

SEQ ID NO: 7239041 - DNA, 22 bp, Homo sapiens
tctttattttatgcttgtgcaa

SEQ ID NO: 7239042 - DNA, 22 bp, Homo sapiens
tgcaggtggacacgggagacgg

SEQ ID NO: 7239043 - DNA, 22 bp, Homo sapiens
ccctggtggtacggcactggca

SEQ ID NO: 7239044 - DNA, 22 bp, Homo sapiens
ccggctactcgggaggctgacg

SEQ ID NO: 7239045 - DNA, 22 bp, Homo sapiens
tggctaacaaggtgaaaccccg

SEQ ID NO: 7239046 - DNA, 22 bp, Homo sapiens
tggacatgtaaaggctcaaggt

SEQ ID NO: 7239047 - DNA, 22 bp, Homo sapiens
tggacatgagctgagtgggtgt

SEQ ID NO: 7239048 - DNA, 22 bp, Homo sapiens
tggacatgacctcgagcgagat

SEQ ID NO: 7239049 - DNA, 22 bp, Homo sapiens
tgctttcattgtgataggaagc

SEQ ID NO: 7239050 - DNA, 22 bp, Homo sapiens
tgctttattttaaatatgccat

SEQ ID NO: 7239051 - DNA, 22 bp, Homo sapiens
tgctttatttataaaatagcaa

SEQ ID NO: 7239052 - DNA, 22 bp, Homo sapiens
tgctttattggaacctcatcct

SEQ ID NO: 7239053 - DNA, 22 bp, Homo sapiens
tggtctcttttcagcctgggga

SEQ ID NO: 7239054 - DNA, 22 bp, Homo sapiens
cctgccttcagccctgaagtct

SEQ ID NO: 7239055 - DNA, 21 bp, Homo sapiens
tgtaagtttcatctgaattgg

SEQ ID NO: 7239056 - DNA, 22 bp, Homo sapiens
tgtaaagacagataaaacagca

SEQ ID NO: 7239057 - DNA, 22 bp, Homo sapiens
cctgctttggcaggcagctcct

SEQ ID NO: 7239058 - DNA, 22 bp, Homo sapiens
cctgctttgctggtaccatcag

SEQ ID NO: 7239059 - DNA, 22 bp, Homo sapiens
cctgctttgagatgggcagcag

SEQ ID NO: 7239060 - DNA, 22 bp, Homo sapiens
tgtattctaaatacatcttacc

SEQ ID NO: 7239061 - DNA, 22 bp, Homo sapiens
tgggcagggagctggaaccaca

SEQ ID NO: 7239062 - DNA, 22 bp, Homo sapiens
tgggagctcagaaagggaggtc

SEQ ID NO: 7239063 - DNA, 22 bp, Homo sapiens
tagcaatgtgtgtgtataaatt

SEQ ID NO: 7239064 - DNA, 22 bp, Homo sapiens
tagcaatgtaagatgttaacac

SEQ ID NO: 7239065 - DNA, 22 bp, Homo sapiens
tagcaatgcttcattatttaaa

SEQ ID NO: 7239066 - DNA, 22 bp, Homo sapiens
tagcaatgctctatgatgaaaa

SEQ ID NO: 7239067 - DNA, 20 bp, Homo sapiens
tagcaatgagtgttccattt

SEQ ID NO: 7239068 - DNA, 22 bp, Homo sapiens
cagggcagagccaggatttcaa

SEQ ID NO: 7239069 - DNA, 22 bp, Homo sapiens
cagggcagaaggcactctactc

SEQ ID NO: 7239070 - DNA, 22 bp, Homo sapiens
cagggcagaacatatagatagt

SEQ ID NO: 7239071 - DNA, 22 bp, Homo sapiens
tagaatatgtggtaggatctgg

SEQ ID NO: 7239072 - DNA, 22 bp, Homo sapiens
gtgagggcagaacccccaggcc

SEQ ID NO: 7239073 - DNA, 22 bp, Homo sapiens
cagggcagagggaaactccttt

SEQ ID NO: 7239074 - DNA, 22 bp, Homo sapiens
cagggcagccaggccccgtggg

SEQ ID NO: 7239075 - DNA, 22 bp, Homo sapiens
cagggcagcttcctttgttagg

SEQ ID NO: 7239076 - DNA, 22 bp, Homo sapiens
cagggcaggaatttgacattgc

SEQ ID NO: 7239077 - DNA, 22 bp, Homo sapiens
cagggcaggacagatacattac

SEQ ID NO: 7239078 - DNA, 22 bp, Homo sapiens
tagggcagtttcatgttatctt

SEQ ID NO: 7239079 - DNA, 21 bp, Homo sapiens
tagggcaggcattggaagaga

SEQ ID NO: 7239080 - DNA, 22 bp, Homo sapiens
tagggcaggggaggaatctgaa

SEQ ID NO: 7239081 - DNA, 22 bp, Homo sapiens
tagggcagttataacattagtg

SEQ ID NO: 7239082 - DNA, 22 bp, Homo sapiens
tagggcaggtgaagaaaagcta

SEQ ID NO: 7239083 - DNA, 22 bp, Homo sapiens
caggggacattaaagctccata

SEQ ID NO: 7239084 - DNA, 22 bp, Homo sapiens
tatttcatgtgcaccataattc

SEQ ID NO: 7239085 - DNA, 22 bp, Homo sapiens
caggtggtcaggcagatgggct

SEQ ID NO: 7239086 - DNA, 22 bp, Homo sapiens
caggtgttatacatgaaattta

SEQ ID NO: 7239087 - DNA, 22 bp, Homo sapiens
caggtgttaatcacttttaagc

SEQ ID NO: 7239088 - DNA, 22 bp, Homo sapiens
caggtgttaattgttggagcaa

SEQ ID NO: 7239089 - DNA, 22 bp, Homo sapiens
caggtgttttttattctgaaag

SEQ ID NO: 7239090 - DNA, 23 bp, Homo sapiens
caggtgttttacatatggtagtt

SEQ ID NO: 7239091 - DNA, 22 bp, Homo sapiens
caggtgtttgtcaattccatcc

SEQ ID NO: 7239092 - DNA, 22 bp, Homo sapiens
caggtgtttcctgaagttgatg

SEQ ID NO: 7239093 - DNA, 22 bp, Homo sapiens
caggttcagcaggaggcatccc

SEQ ID NO: 7239094 - DNA, 22 bp, Homo sapiens
caggtgtttcaatcccaagtca

SEQ ID NO: 7239095 - DNA, 22 bp, Homo sapiens
caggtgtttcaaatgtgaaact

SEQ ID NO: 7239096 - DNA, 22 bp, Homo sapiens
caggtgtttaggtttcatggat

SEQ ID NO: 7239097 - DNA, 22 bp, Homo sapiens
caggtgttgtctaaagcttcag

SEQ ID NO: 7239098 - DNA, 22 bp, Homo sapiens
caggtgttgggagaagagataa

SEQ ID NO: 7239099 - DNA, 22 bp, Homo sapiens
caggtgttggaagggcagtggg

SEQ ID NO: 7239100 - DNA, 22 bp, Homo sapiens
caggtgttgatactaatcgtgg

SEQ ID NO: 7239101 - DNA, 17 bp, Homo sapiens
caggtgttctgtttttc

SEQ ID NO: 7239102 - DNA, 22 bp, Homo sapiens
caggtgttctggaaatcagcag

SEQ ID NO: 7239103 - DNA, 22 bp, Homo sapiens
caggtgttctaagccgggcagt

SEQ ID NO: 7239104 - DNA, 22 bp, Homo sapiens
caggtgttcaagctggaggcca

SEQ ID NO: 7239105 - DNA, 22 bp, Homo sapiens
caggtgttgcctaaattgacaa

SEQ ID NO: 7239106 - DNA, 22 bp, Homo sapiens
caggtgttgcagttgaagactg

SEQ ID NO: 7239107 - DNA, 22 bp, Homo sapiens
caggtgttgatgtttattgagt

SEQ ID NO: 7239108 - DNA, 22 bp, Homo sapiens
tatttccacctattattttctg

SEQ ID NO: 7239109 - DNA, 22 bp, Homo sapiens
tatttccaaaagcctattatga

SEQ ID NO: 7239110 - DNA, 22 bp, Homo sapiens
tatttgaaagtgtacaaaaact

SEQ ID NO: 7239111 - DNA, 19 bp, Homo sapiens
cataaatgtacaagataca

SEQ ID NO: 7239112 - DNA, 21 bp, Homo sapiens
cagtttaataacaaagaagga

SEQ ID NO: 7239113 - DNA, 22 bp, Homo sapiens
tctgagagccactgaacagcaa

SEQ ID NO: 7239114 - DNA, 17 bp, Homo sapiens
tctcctggctctatcag

SEQ ID NO: 7239115 - DNA, 22 bp, Homo sapiens
tctcctggctctaaaaggctgt

SEQ ID NO: 7239116 - DNA, 23 bp, Homo sapiens
tctcctggctgcactgtggccac

SEQ ID NO: 7239117 - DNA, 22 bp, Homo sapiens
tctcctggccgggctgtcccct

SEQ ID NO: 7239118 - DNA, 22 bp, Homo sapiens
tctcctggcctttaggttaagg

SEQ ID NO: 7239119 - DNA, 22 bp, Homo sapiens
tctcctggctcaccaggctgga

SEQ ID NO: 7239120 - DNA, 22 bp, Homo sapiens
ccaccgccatggcgttgtacag

SEQ ID NO: 7239121 - DNA, 22 bp, Homo sapiens
tctcaagctagtgtttatagta

SEQ ID NO: 7239122 - DNA, 22 bp, Homo sapiens
catgaaaaatttactgttaaca

SEQ ID NO: 7239123 - DNA, 23 bp, Homo sapiens
tcatgtggaaaaggatctggtct

SEQ ID NO: 7239124 - DNA, 21 bp, Homo sapiens
catgtgtcattggagagcaat

SEQ ID NO: 7239125 - DNA, 18 bp, Homo sapiens
catgtgttctacatcagt

SEQ ID NO: 7239126 - DNA, 22 bp, Homo sapiens
catgtgtccacccttgaacaca

SEQ ID NO: 7239127 - DNA, 22 bp, Homo sapiens
catgttttctaggctttcacaa

SEQ ID NO: 7239128 - DNA, 22 bp, Homo sapiens
ccttcaaaacactagtttttga

SEQ ID NO: 7239129 - DNA, 22 bp, Homo sapiens
ttatcattgtcgcagtctaatt

SEQ ID NO: 7239130 - DNA, 22 bp, Homo sapiens
ttatccaaactggtgaatcatt

SEQ ID NO: 7239131 - DNA, 22 bp, Homo sapiens
ccttcaaattctcttagctgaa

SEQ ID NO: 7239132 - DNA, 22 bp, Homo sapiens
ttagacaggatgtatgaaagct

SEQ ID NO: 7239133 - DNA, 22 bp, Homo sapiens
ttagacagagctccttgagggc

SEQ ID NO: 7239134 - DNA, 22 bp, Homo sapiens
ttagacagtaaggcttcagttg

SEQ ID NO: 7239135 - DNA, 22 bp, Homo sapiens
cggcagggctccatgcatttct

SEQ ID NO: 7239136 - DNA, 22 bp, Homo sapiens
cggcagggttggttttctctga

SEQ ID NO: 7239137 - DNA, 21 bp, Homo sapiens
ttcaaagtttgcctaaagatt

SEQ ID NO: 7239138 - DNA, 22 bp, Homo sapiens
cgtggggcgggtggacacttgc

SEQ ID NO: 7239139 - DNA, 22 bp, Homo sapiens
cggcaggtgtgctcactctgcc

SEQ ID NO: 7239140 - DNA, 22 bp, Homo sapiens
cgagagatgggttggcaggggc

SEQ ID NO: 7239141 - DNA, 22 bp, Homo sapiens
ttattgagtttacagctttaga

SEQ ID NO: 7239142 - DNA, 22 bp, Homo sapiens
ttattgagtttacagctttaga

SEQ ID NO: 7239143 - DNA, 22 bp, Homo sapiens
ttattgagttgtaagagctctt

SEQ ID NO: 7239144 - DNA, 22 bp, Homo sapiens
ttattgagtatctgcttggtgt

SEQ ID NO: 7239145 - DNA, 23 bp, Homo sapiens
ttattgagggtgtagattggtgt

SEQ ID NO: 7239146 - DNA, 16 bp, Homo sapiens
ttattgaggccaagga

SEQ ID NO: 7239147 - DNA, 22 bp, Homo sapiens
cgctctggagaatagtagcttt

SEQ ID NO: 7239148 - DNA, 22 bp, Homo sapiens
ttatttatgttaacagtcgaga

SEQ ID NO: 7239149 - DNA, 22 bp, Homo sapiens
ttatttattgtgtacctactgt

SEQ ID NO: 7239150 - DNA, 22 bp, Homo sapiens
ttgcataaaagagtatatctta

SEQ ID NO: 7239151 - DNA, 22 bp, Homo sapiens
ttgcataaagattttattgcat

SEQ ID NO: 7239152 - DNA, 22 bp, Homo sapiens
ttgcataaatgcttaaaatttg

SEQ ID NO: 7239153 - DNA, 22 bp, Homo sapiens
cgtgtccttttagcttcaggtc

SEQ ID NO: 7239154 - DNA, 20 bp, Homo sapiens
cgtgtccttggcgggagagc

SEQ ID NO: 7239155 - DNA, 23 bp, Homo sapiens
cgtgtccttcagggagagtgtgg

SEQ ID NO: 7239156 - DNA, 22 bp, Homo sapiens
ctgcaggaatctgtgctaggtg

SEQ ID NO: 7239157 - DNA, 22 bp, Homo sapiens
ctgaggtttgtccatccttggt

SEQ ID NO: 7239158 - DNA, 16 bp, Homo sapiens
ctgaggtttggccaca

SEQ ID NO: 7239159 - DNA, 22 bp, Homo sapiens
ctgaggtttacaagctattgct

SEQ ID NO: 7239160 - DNA, 22 bp, Homo sapiens
ctgaggtcaggagttcaagctg

SEQ ID NO: 7239161 - DNA, 22 bp, Homo sapiens
ctgccttggaaaatgtggtaat

SEQ ID NO: 7239162 - DNA, 18 bp, Homo sapiens
ctgcctgttgctgagagg

SEQ ID NO: 7239163 - DNA, 22 bp, Homo sapiens
ctggagcagcaggtggccaggg

SEQ ID NO: 7239164 - DNA, 22 bp, Homo sapiens
ctctggtttcgcaggaaataga

SEQ ID NO: 7239165 - DNA, 22 bp, Homo sapiens
ctctggtttatttcttggaaag

SEQ ID NO: 7239166 - DNA, 22 bp, Homo sapiens
ctctggttgcagctgaagttcc

SEQ ID NO: 7239167 - DNA, 22 bp, Homo sapiens
ctctggttgagtgagaaccaag

SEQ ID NO: 7239168 - DNA, 22 bp, Homo sapiens
tttgagaagagtttgaggtatt

SEQ ID NO: 7239169 - DNA, 22 bp, Homo sapiens
tttgagaagatgtaatgttaag

SEQ ID NO: 7239170 - DNA, 22 bp, Homo sapiens
ctctgaggtttcctcacaagct

SEQ ID NO: 7239171 - DNA, 22 bp, Homo sapiens
tttccaagagcttatttctgaa

SEQ ID NO: 7239172 - DNA, 22 bp, Homo sapiens
ctgggatccacgggctcccaag

SEQ ID NO: 7239173 - DNA, 22 bp, Homo sapiens
ctggttggaggagaagtttgga

SEQ ID NO: 7239174 - DNA, 22 bp, Homo sapiens
ctggtttagtcataatggagaa

SEQ ID NO: 7239175 - DNA, 22 bp, Homo sapiens
ctgtcccaggagctgtaagaca

SEQ ID NO: 7239176 - DNA, 22 bp, Homo sapiens
gaagaacaagcagtgctttcct

SEQ ID NO: 7239177 - DNA, 22 bp, Homo sapiens
ctttggcacagtctcatttgat

SEQ ID NO: 7239178 - DNA, 22 bp, Homo sapiens
gaaaaatgagctgatgtcaggg

SEQ ID NO: 7239179 - DNA, 22 bp, Homo sapiens
gaaaaatgctccaaatctgtgg

SEQ ID NO: 7239180 - DNA, 22 bp, Homo sapiens
gaaaacactttgatctgaaagt

SEQ ID NO: 7239181 - DNA, 22 bp, Homo sapiens
gagctggtgatcagctggagga

SEQ ID NO: 7239182 - DNA, 22 bp, Homo sapiens
gaggccagaagtctgagatcag

SEQ ID NO: 7239183 - DNA, 19 bp, Homo sapiens
gaggtgtctttcctgagta

SEQ ID NO: 7239184 - DNA, 22 bp, Homo sapiens
gaggtgtctgttaggaataggc

SEQ ID NO: 7239185 - DNA, 22 bp, Homo sapiens
gagggccagcctgccaagggcc

SEQ ID NO: 7239186 - DNA, 22 bp, Homo sapiens
gagcaatggaagatagataaca

SEQ ID NO: 7239187 - DNA, 22 bp, Homo sapiens
gagcaatgcccttcaccagccc

SEQ ID NO: 7239188 - DNA, 22 bp, Homo sapiens
gagagacagcacacagtgtggg

SEQ ID NO: 7239189 - DNA, 22 bp, Homo sapiens
gagaagaaatagaatcacattt

SEQ ID NO: 7239190 - DNA, 22 bp, Homo sapiens
gagaagaacttgggcaaagtca

SEQ ID NO: 7239191 - DNA, 22 bp, Homo sapiens
gagagaagaatgttccgaggcc

SEQ ID NO: 7239192 - DNA, 22 bp, Homo sapiens
gagaagcaatttccaactgtgc

SEQ ID NO: 7239193 - DNA, 21 bp, Homo sapiens
gacaaacatttcatagcttta

SEQ ID NO: 7239194 - DNA, 22 bp, Homo sapiens
gaatgtttgtgcagagtcatct

SEQ ID NO: 7239195 - DNA, 22 bp, Homo sapiens
gaatggaaactgggagatggcc

SEQ ID NO: 7239196 - DNA, 22 bp, Homo sapiens
gacatctgaggccctcagagcc

SEQ ID NO: 7239197 - DNA, 22 bp, Homo sapiens
gacatacatctctggaaaaaaa

SEQ ID NO: 7239198 - DNA, 22 bp, Homo sapiens
gacatgtgtctgcaagttgatc

SEQ ID NO: 7239199 - DNA, 22 bp, Homo sapiens
gacatgtgctgtctcttaaatt

SEQ ID NO: 7239200 - DNA, 22 bp, Homo sapiens
gacatgtgagcaagcgtgcggc

SEQ ID NO: 7239201 - DNA, 22 bp, Homo sapiens
gacatgtgagagctcggttttc

SEQ ID NO: 7239202 - DNA, 22 bp, Homo sapiens
gcaggtggaagcagcagactca

SEQ ID NO: 7239203 - DNA, 22 bp, Homo sapiens
gcatttcatgccgtggaagtcc

SEQ ID NO: 7239204 - DNA, 22 bp, Homo sapiens
gcagggcatgggccctgtctgc

SEQ ID NO: 7239205 - DNA, 22 bp, Homo sapiens
gcagggcagggcaagaactggg

SEQ ID NO: 7239206 - DNA, 22 bp, Homo sapiens
gcagggcaggatttgaacccag

SEQ ID NO: 7239207 - DNA, 22 bp, Homo sapiens
gcagggcagtaagagctagagt

SEQ ID NO: 7239208 - DNA, 22 bp, Homo sapiens
gcagggcagctgaagctaggtg

SEQ ID NO: 7239209 - DNA, 22 bp, Homo sapiens
gcagggcagctcactgtggttc

SEQ ID NO: 7239210 - DNA, 22 bp, Homo sapiens
gcagggcagcttagtccctgtc

SEQ ID NO: 7239211 - DNA, 22 bp, Homo sapiens
gcagatgttgatgcaagaagag

SEQ ID NO: 7239212 - DNA, 19 bp, Homo sapiens
gcagagtggggtggagggt

SEQ ID NO: 7239213 - DNA, 22 bp, Homo sapiens
gcagagtgaagggagaggtgtg

SEQ ID NO: 7239214 - DNA, 22 bp, Homo sapiens
gcagacaggggcttaggaaagg

SEQ ID NO: 7239215 - DNA, 22 bp, Homo sapiens
gcagacagggctacagaggtac

SEQ ID NO: 7239216 - DNA, 22 bp, Homo sapiens
gcagacagatgagggtgctggg

SEQ ID NO: 7239217 - DNA, 22 bp, Homo sapiens
gcagacagcatgttgggctatt

SEQ ID NO: 7239218 - DNA, 22 bp, Homo sapiens
gcagacaggattgggttaatag

SEQ ID NO: 7239219 - DNA, 22 bp, Homo sapiens
gcagacagccagactgcactgg

SEQ ID NO: 7239220 - DNA, 22 bp, Homo sapiens
gcagacaggcccagtggaggga

SEQ ID NO: 7239221 - DNA, 22 bp, Homo sapiens
gcagacagaagctaagtagaca

SEQ ID NO: 7239222 - DNA, 22 bp, Homo sapiens
gcagacagactgcagtgatttt

SEQ ID NO: 7239223 - DNA, 23 bp, Homo sapiens
gcagacagagcagactaagacaa

SEQ ID NO: 7239224 - DNA, 20 bp, Homo sapiens
gcaaggcacagtgaggaggg

SEQ ID NO: 7239225 - DNA, 22 bp, Homo sapiens
gcaaggcagtcctggggccctg

SEQ ID NO: 7239226 - DNA, 22 bp, Homo sapiens
gcaaggagactgtagggccaag

SEQ ID NO: 7239227 - DNA, 22 bp, Homo sapiens
gcaaggaggctggtggaggaag

SEQ ID NO: 7239228 - DNA, 22 bp, Homo sapiens
gcaaggagcctggaggtgagtg

SEQ ID NO: 7239229 - DNA, 22 bp, Homo sapiens
ggagaagaggagctggaagcct

SEQ ID NO: 7239230 - DNA, 22 bp, Homo sapiens
ggacagagggttgacagagtat

SEQ ID NO: 7239231 - DNA, 22 bp, Homo sapiens
ggacagagggttgacagagtat

SEQ ID NO: 7239232 - DNA, 22 bp, Homo sapiens
ggaaggagcatttgccagttta

SEQ ID NO: 7239233 - DNA, 19 bp, Homo sapiens
ggaaggagagaaatgcatg

SEQ ID NO: 7239234 - DNA, 18 bp, Homo sapiens
ggaaggagtggaccccag

SEQ ID NO: 7239235 - DNA, 22 bp, Homo sapiens
ggaaggaggggcaaagcagttc

SEQ ID NO: 7239236 - DNA, 22 bp, Homo sapiens
ggaaggagtctttaacacccat

SEQ ID NO: 7239237 - DNA, 22 bp, Homo sapiens
ggaaggagggcggcaatgatga

SEQ ID NO: 7239238 - DNA, 22 bp, Homo sapiens
ggaaggaggatgctctggcctt

SEQ ID NO: 7239239 - DNA, 22 bp, Homo sapiens
ggaaggagccatatcatatcca

SEQ ID NO: 7239240 - DNA, 22 bp, Homo sapiens
gcttggtttggcaaaggaagga

SEQ ID NO: 7239241 - DNA, 22 bp, Homo sapiens
gctgtccaggagtgcagagatt

SEQ ID NO: 7239242 - DNA, 22 bp, Homo sapiens
gctgtccacctccagagcctta

SEQ ID NO: 7239243 - DNA, 22 bp, Homo sapiens
gctgtctcatacaaggccctgc

SEQ ID NO: 7239244 - DNA, 22 bp, Homo sapiens
gctgtacattctgcacaggccc

SEQ ID NO: 7239245 - DNA, 23 bp, Homo sapiens
gctgtacaggaaccagtttggag

SEQ ID NO: 7239246 - DNA, 22 bp, Homo sapiens
gctctggttctcttagagtagt

SEQ ID NO: 7239247 - DNA, 22 bp, Homo sapiens
gctctggttttagcctttcagg

SEQ ID NO: 7239248 - DNA, 22 bp, Homo sapiens
gctctggtttcctgttcactca

SEQ ID NO: 7239249 - DNA, 22 bp, Homo sapiens
gctgctggggtggagaaacgct

SEQ ID NO: 7239250 - DNA, 22 bp, Homo sapiens
ggctcactgcaacttccgcctc

SEQ ID NO: 7239251 - DNA, 22 bp, Homo sapiens
ggctcacgcaattatcccggcc

SEQ ID NO: 7239252 - DNA, 22 bp, Homo sapiens
ggcactgatctgatttccctcc

SEQ ID NO: 7239253 - DNA, 22 bp, Homo sapiens
ggcactgataatgtcctctctc

SEQ ID NO: 7239254 - DNA, 22 bp, Homo sapiens
ggcactgattccattcatgaag

SEQ ID NO: 7239255 - DNA, 22 bp, Homo sapiens
ggcactgagcgggctctgagcg

SEQ ID NO: 7239256 - DNA, 22 bp, Homo sapiens
ggcactgagctgccttggggca

SEQ ID NO: 7239257 - DNA, 22 bp, Homo sapiens
ggcactgagaggctcttcctaa

SEQ ID NO: 7239258 - DNA, 21 bp, Homo sapiens
ggcactgagccagatggactc

SEQ ID NO: 7239259 - DNA, 22 bp, Homo sapiens
ggcactgagaacaggctgactt

SEQ ID NO: 7239260 - DNA, 22 bp, Homo sapiens
ggcactgactgtgcagcgcacc

SEQ ID NO: 7239261 - DNA, 22 bp, Homo sapiens
ggcactgacactagcatggcac

SEQ ID NO: 7239262 - DNA, 22 bp, Homo sapiens
ggcactgaatttcttggcatct

SEQ ID NO: 7239263 - DNA, 22 bp, Homo sapiens
ggcactgaagtgggtgttgggt

SEQ ID NO: 7239264 - DNA, 22 bp, Homo sapiens
ggcactgaaccaggacacaagc

SEQ ID NO: 7239265 - DNA, 23 bp, Homo sapiens
ggcactgaagctacaatggtgag

SEQ ID NO: 7239266 - DNA, 22 bp, Homo sapiens
ggcagggccctgattcctgggg

SEQ ID NO: 7239267 - DNA, 22 bp, Homo sapiens
ggcagggcttgtctctgtgatg

SEQ ID NO: 7239268 - DNA, 20 bp, Homo sapiens
ggcagggcatcaacagctct

SEQ ID NO: 7239269 - DNA, 22 bp, Homo sapiens
gggagctgaactgctgaagttg

SEQ ID NO: 7239270 - DNA, 22 bp, Homo sapiens
gggagctgaaggagccggcggg

SEQ ID NO: 7239271 - DNA, 22 bp, Homo sapiens
gggagctgaagtaggggtaaat

SEQ ID NO: 7239272 - DNA, 22 bp, Homo sapiens
gggagctgaatggcaatggaga

SEQ ID NO: 7239273 - DNA, 22 bp, Homo sapiens
gggcaggtctgggtcagcctga

SEQ ID NO: 7239274 - DNA, 15 bp, Homo sapiens
gggcaggtctggggc

SEQ ID NO: 7239275 - DNA, 22 bp, Homo sapiens
gggcaggtgattttggctccat

SEQ ID NO: 7239276 - DNA, 22 bp, Homo sapiens
gggcaggtgacctcttgtcctg

SEQ ID NO: 7239277 - DNA, 22 bp, Homo sapiens
gggcaggtgcccagggccagag

SEQ ID NO: 7239278 - DNA, 22 bp, Homo sapiens
gggcaggtgccagctccctgtc

SEQ ID NO: 7239279 - DNA, 17 bp, Homo sapiens
gggcagggactcctggg

SEQ ID NO: 7239280 - DNA, 22 bp, Homo sapiens
gggctctggaaggtgcaccatg

SEQ ID NO: 7239281 - DNA, 22 bp, Homo sapiens
gggctctggaaatgggagctcc

SEQ ID NO: 7239282 - DNA, 22 bp, Homo sapiens
gggctctggatggagcctgcag

SEQ ID NO: 7239283 - DNA, 22 bp, Homo sapiens
gggctctggagttctagaaaga

SEQ ID NO: 7239284 - DNA, 22 bp, Homo sapiens
gggctctggacccaggcaagag

SEQ ID NO: 7239285 - DNA, 22 bp, Homo sapiens
gggctctgagctctgggaatta

SEQ ID NO: 7239286 - DNA, 22 bp, Homo sapiens
gggctctgactgaatattgaat

SEQ ID NO: 7239287 - DNA, 22 bp, Homo sapiens
gggctctgaatgagttaccaag

SEQ ID NO: 7239288 - DNA, 22 bp, Homo sapiens
gggctctgaatcccaggtctgc

SEQ ID NO: 7239289 - DNA, 22 bp, Homo sapiens
gggcaggtggcaaagccagagg

SEQ ID NO: 7239290 - DNA, 22 bp, Homo sapiens
gggcaggtggagggcccagcca

SEQ ID NO: 7239291 - DNA, 22 bp, Homo sapiens
gggcaggtggcagggtctctgg

SEQ ID NO: 7239292 - DNA, 22 bp, Homo sapiens
gggcaggtgtgcagagctgttg

SEQ ID NO: 7239293 - DNA, 22 bp, Homo sapiens
gggcaggtggcctcttgtacta

SEQ ID NO: 7239294 - DNA, 22 bp, Homo sapiens
gggcaggtgttgtcaatctaat

SEQ ID NO: 7239295 - DNA, 22 bp, Homo sapiens
gggcaggtgtttccaaggtgag

SEQ ID NO: 7239296 - DNA, 19 bp, Homo sapiens
gggctctggcctcagtggg

SEQ ID NO: 7239297 - DNA, 18 bp, Homo sapiens
gggctctggcatctgggt

SEQ ID NO: 7239298 - DNA, 20 bp, Homo sapiens
gggctctggccaatgctttg

SEQ ID NO: 7239299 - DNA, 22 bp, Homo sapiens
gggctctggggaggacccttca

SEQ ID NO: 7239300 - DNA, 22 bp, Homo sapiens
gggctctgggattcagagcaag

SEQ ID NO: 7239301 - DNA, 22 bp, Homo sapiens
gggctctgggatgctcttagag

SEQ ID NO: 7239302 - DNA, 22 bp, Homo sapiens
gggctctggggtgccctggcat

SEQ ID NO: 7239303 - DNA, 22 bp, Homo sapiens
gggctctggggtcagacagcct

SEQ ID NO: 7239304 - DNA, 20 bp, Homo sapiens
ggggcaggtttttatggcta

SEQ ID NO: 7239305 - DNA, 22 bp, Homo sapiens
ggggcagggaggttatcgccga

SEQ ID NO: 7239306 - DNA, 22 bp, Homo sapiens
gggtggtggccagcagtgggca

SEQ ID NO: 7239307 - DNA, 22 bp, Homo sapiens
ggtggggccctggcactggtat

SEQ ID NO: 7239308 - DNA, 22 bp, Homo sapiens
ggtggggcccaggcatctgatg

SEQ ID NO: 7239309 - DNA, 22 bp, Homo sapiens
ggtggggccagggctccaacct

SEQ ID NO: 7239310 - DNA, 22 bp, Homo sapiens
ggtggggctaggacctcaggat

SEQ ID NO: 7239311 - DNA, 22 bp, Homo sapiens
ggtggggcctgctccagcggcc

SEQ ID NO: 7239312 - DNA, 22 bp, Homo sapiens
ggtggcagagaggaggtagttt

SEQ ID NO: 7239313 - DNA, 22 bp, Homo sapiens
ggttatttttgattctgtggat

SEQ ID NO: 7239314 - DNA, 23 bp, Homo sapiens
ggttatttgcatcctgtaattat

SEQ ID NO: 7239315 - DNA, 22 bp, Homo sapiens
ggttattttggttgtctaaggc

SEQ ID NO: 7239316 - DNA, 22 bp, Homo sapiens
ggtgtttagggaggggttataa

SEQ ID NO: 7239317 - DNA, 22 bp, Homo sapiens
ggtgtttagacagggcccctct

SEQ ID NO: 7239318 - DNA, 23 bp, Homo sapiens
ggtgtttaattacagactgagag

SEQ ID NO: 7239319 - DNA, 17 bp, Homo sapiens
ggtgtttaagtgccagc

SEQ ID NO: 7239320 - DNA, 22 bp, Homo sapiens
gtaatgtgtgtgtcttctctag

SEQ ID NO: 7239321 - DNA, 22 bp, Homo sapiens
ggttgtagttggaggttgtata

SEQ ID NO: 7239322 - DNA, 22 bp, Homo sapiens
ggttggaggtgggaatagctag

SEQ ID NO: 7239323 - DNA, 22 bp, Homo sapiens
ggttccacctggcgaggggtat

SEQ ID NO: 7239324 - DNA, 22 bp, Homo sapiens
ggtgctctttctcagacaagat

SEQ ID NO: 7239325 - DNA, 22 bp, Homo sapiens
gtccagctccagggaggcaggc

SEQ ID NO: 7239326 - DNA, 22 bp, Homo sapiens
gtcacctctcatcacatgctac

SEQ ID NO: 7239327 - DNA, 22 bp, Homo sapiens
gtagtaaagcggaaagggtgat

SEQ ID NO: 7239328 - DNA, 22 bp, Homo sapiens
gtagtaaagcaggttttgctgt

SEQ ID NO: 7239329 - DNA, 22 bp, Homo sapiens
gtatttttaggtaaggaaagta

SEQ ID NO: 7239330 - DNA, 22 bp, Homo sapiens
gtatttttagtagagtcggggt

SEQ ID NO: 7239331 - DNA, 22 bp, Homo sapiens
gtatttttcagttaggagctta

SEQ ID NO: 7239332 - DNA, 22 bp, Homo sapiens
gtatttttcattccaagtgaga

SEQ ID NO: 7239333 - DNA, 22 bp, Homo sapiens
tacagacattcaattttgaccc

SEQ ID NO: 7239334 - DNA, 20 bp, Homo sapiens
tacagacatgacaataatgg

SEQ ID NO: 7239335 - DNA, 22 bp, Homo sapiens
tacatgaatttgagtcagagga

SEQ ID NO: 7239336 - DNA, 22 bp, Homo sapiens
tacatgaacctttatgtgtgat

SEQ ID NO: 7239337 - DNA, 22 bp, Homo sapiens
tacagacagtttttcagatatt

SEQ ID NO: 7239338 - DNA, 22 bp, Homo sapiens
tacagacagacttcccaccctc

SEQ ID NO: 7239339 - DNA, 22 bp, Homo sapiens
tacagacaaagtgctatagggt

SEQ ID NO: 7239340 - DNA, 22 bp, Homo sapiens
tacagacaaagagcatgcggta

SEQ ID NO: 7239341 - DNA, 21 bp, Homo sapiens
taatttattcagcacagtgtt

SEQ ID NO: 7239342 - DNA, 21 bp, Homo sapiens
tacaagatagaggtaatatat

SEQ ID NO: 7239343 - DNA, 22 bp, Homo sapiens
taagctattcctgaagaaggtt

SEQ ID NO: 7239344 - DNA, 22 bp, Homo sapiens
gttatttataaggtgtaactcc

SEQ ID NO: 7239345 - DNA, 22 bp, Homo sapiens
gtttcttagacagacattatct

SEQ ID NO: 7239346 - DNA, 22 bp, Homo sapiens
taaagacatgcaaagtctaatt

SEQ ID NO: 7239347 - DNA, 22 bp, Homo sapiens
taaagacactggttttaatcat

SEQ ID NO: 7239348 - DNA, 22 bp, Homo sapiens
taaatgcaaagcttggcgctta

SEQ ID NO: 7239349 - DNA, 22 bp, Homo sapiens
taaagcaatgaaagttttgcag

SEQ ID NO: 7239350 - DNA, 22 bp, Homo sapiens
taaagcaaggcaaattgttggt

SEQ ID NO: 7239351 - DNA, 22 bp, Homo sapiens
tagagaaaagcagggatcagga

SEQ ID NO: 7239352 - DNA, 21 bp, Homo sapiens
tagagaaaagaagctgttcct

SEQ ID NO: 7239353 - DNA, 22 bp, Homo sapiens
tagacaggaaacattaggatgg

SEQ ID NO: 7239354 - DNA, 22 bp, Homo sapiens
tagaagaaagtgaagctgggga

SEQ ID NO: 7239355 - DNA, 22 bp, Homo sapiens
tagaagaaaagcacttagagat

SEQ ID NO: 7239356 - DNA, 22 bp, Homo sapiens
tagaagaacatgtcaaactata

SEQ ID NO: 7239357 - DNA, 22 bp, Homo sapiens
tagaactaaagaacaactttga

SEQ ID NO: 7239358 - DNA, 22 bp, Homo sapiens
tagatgaaatttgtgtgtatgc

SEQ ID NO: 7239359 - DNA, 22 bp, Homo sapiens
tagatgaattagcaattatctt

SEQ ID NO: 7239360 - DNA, 22 bp, Homo sapiens
tagatgaatgacttatatgtca

SEQ ID NO: 7239361 - DNA, 22 bp, Homo sapiens
tagctgcacaggaagtaagatt

SEQ ID NO: 7239362 - DNA, 22 bp, Homo sapiens
tagggcagattcggtggagttt

SEQ ID NO: 7239363 - DNA, 22 bp, Homo sapiens
tagggcagccacccaggctgct

SEQ ID NO: 7239364 - DNA, 23 bp, Homo sapiens
tagggcagctgggagggacatgc

SEQ ID NO: 7239365 - DNA, 22 bp, Homo sapiens
tagggcagccttatagctccca

SEQ ID NO: 7239366 - DNA, 22 bp, Homo sapiens
tagggcagctgcatcaggcact

SEQ ID NO: 7239367 - DNA, 22 bp, Homo sapiens
tagctgtcagcaatcaagtggt

SEQ ID NO: 7239368 - DNA, 22 bp, Homo sapiens
taggcagattccatattttggc

SEQ ID NO: 7239369 - DNA, 22 bp, Homo sapiens
taggcagatgttaacaggaaaa

SEQ ID NO: 7239370 - DNA, 22 bp, Homo sapiens
tattgtcttcaactctactttt

SEQ ID NO: 7239371 - DNA, 22 bp, Homo sapiens
tattgtctctgcgttgttctat

SEQ ID NO: 7239372 - DNA, 22 bp, Homo sapiens
tattgtctaggaattgtttaaa

SEQ ID NO: 7239373 - DNA, 22 bp, Homo sapiens
tatttgatggttctaaaacagc

SEQ ID NO: 7239374 - DNA, 22 bp, Homo sapiens
tatttgatagagataaatgata

SEQ ID NO: 7239375 - DNA, 22 bp, Homo sapiens
tatttgaccgtgaggaatatga

SEQ ID NO: 7239376 - DNA, 22 bp, Homo sapiens
tatttgactcttaggaagactc

SEQ ID NO: 7239377 - DNA, 20 bp, Homo sapiens
tcaaagaagattcagctcaa

SEQ ID NO: 7239378 - DNA, 22 bp, Homo sapiens
tcaaagaagtgcaaacctcatc

SEQ ID NO: 7239379 - DNA, 22 bp, Homo sapiens
tcaaatatgtgatagaagctaa

SEQ ID NO: 7239380 - DNA, 22 bp, Homo sapiens
tcaaagtaggggtaagccaggc

SEQ ID NO: 7239381 - DNA, 22 bp, Homo sapiens
tcaaagtaaaagtatagagttt

SEQ ID NO: 7239382 - DNA, 20 bp, Homo sapiens
tatgaagatatgtgaacagc

SEQ ID NO: 7239383 - DNA, 22 bp, Homo sapiens
tatgaaatttctagttctgctt

SEQ ID NO: 7239384 - DNA, 22 bp, Homo sapiens
tatgaaatttaaacacagatca

SEQ ID NO: 7239385 - DNA, 22 bp, Homo sapiens
tatgaaatgatggggaaaatag

SEQ ID NO: 7239386 - DNA, 22 bp, Homo sapiens
tatgaaatggtagtaggaaggg

SEQ ID NO: 7239387 - DNA, 22 bp, Homo sapiens
tatgaaattgccatttttatgg

SEQ ID NO: 7239388 - DNA, 22 bp, Homo sapiens
tataaagtttcgaaagatgtat

SEQ ID NO: 7239389 - DNA, 22 bp, Homo sapiens
tatgctttaaccctcttatatt

SEQ ID NO: 7239390 - DNA, 22 bp, Homo sapiens
tcctgagagcagagtccaggtg

SEQ ID NO: 7239391 - DNA, 22 bp, Homo sapiens
tcctgagagccttggcttcaga

SEQ ID NO: 7239392 - DNA, 22 bp, Homo sapiens
tcctgagataggagttgaaggc

SEQ ID NO: 7239393 - DNA, 22 bp, Homo sapiens
tcagctgctcaaatttatgtca

SEQ ID NO: 7239394 - DNA, 22 bp, Homo sapiens
tcagacagattttgacacttgc

SEQ ID NO: 7239395 - DNA, 22 bp, Homo sapiens
tcagacagaggagctcgtgcag

SEQ ID NO: 7239396 - DNA, 22 bp, Homo sapiens
tcagacagagaagtacaatgag

SEQ ID NO: 7239397 - DNA, 22 bp, Homo sapiens
tcagacagaaggactatttgaa

SEQ ID NO: 7239398 - DNA, 22 bp, Homo sapiens
tcagacagaaagatgagtatgg

SEQ ID NO: 7239399 - DNA, 22 bp, Homo sapiens
tcagaacaggttgtactatgtc

SEQ ID NO: 7239400 - DNA, 22 bp, Homo sapiens
tcactgcaacctccacctcctg

SEQ ID NO: 7239401 - DNA, 22 bp, Homo sapiens
tcactgcaacctccacctcctg

SEQ ID NO: 7239402 - DNA, 22 bp, Homo sapiens
tcactgcaacctccacctcccg

SEQ ID NO: 7239403 - DNA, 22 bp, Homo sapiens
tcactgcttaactcaagatctc

SEQ ID NO: 7239404 - DNA, 22 bp, Homo sapiens
tcactgcaacctccacctcccg

SEQ ID NO: 7239405 - DNA, 22 bp, Homo sapiens
tcagggcatggctgcacttggc

SEQ ID NO: 7239406 - DNA, 22 bp, Homo sapiens
tcagggcatctcttaagtggtg

SEQ ID NO: 7239407 - DNA, 22 bp, Homo sapiens
tcagggcatccattgcctgttg

SEQ ID NO: 7239408 - DNA, 22 bp, Homo sapiens
tcagggcatcatcatgaatata

SEQ ID NO: 7239409 - DNA, 22 bp, Homo sapiens
tcagggcatactcttcaaggtc

SEQ ID NO: 7239410 - DNA, 21 bp, Homo sapiens
tcagggcagtgggaggttcct

SEQ ID NO: 7239411 - DNA, 19 bp, Homo sapiens
tcagggcagtccggtcccc

SEQ ID NO: 7239412 - DNA, 22 bp, Homo sapiens
tcagggcaggttaacttgggtg

SEQ ID NO: 7239413 - DNA, 22 bp, Homo sapiens
tcagggcaggacagtgtaggcc

SEQ ID NO: 7239414 - DNA, 22 bp, Homo sapiens
tcagggcaggcgagcagctgct

SEQ ID NO: 7239415 - DNA, 22 bp, Homo sapiens
tcatttaatagcttttgtcttt

SEQ ID NO: 7239416 - DNA, 22 bp, Homo sapiens
tcattgccatggcatttgcaga

SEQ ID NO: 7239417 - DNA, 22 bp, Homo sapiens
ttcctggtgacctcactggtag

SEQ ID NO: 7239418 - DNA, 22 bp, Homo sapiens
ttctggttttactgaggaaatc

SEQ ID NO: 7239419 - DNA, 23 bp, Homo sapiens
ttcatttaggagttcataagagc

SEQ ID NO: 7239420 - DNA, 22 bp, Homo sapiens
ttcataaacaactgatggtaat

SEQ ID NO: 7239421 - DNA, 19 bp, Homo sapiens
ttaggaaaccactttcctt

SEQ ID NO: 7239422 - DNA, 22 bp, Homo sapiens
ttaggaaaatcatgagagatga

SEQ ID NO: 7239423 - DNA, 22 bp, Homo sapiens
ttaggaaaatgaaattacctgt

SEQ ID NO: 7239424 - DNA, 22 bp, Homo sapiens
ttaggaaagtctcttggctggg

SEQ ID NO: 7239425 - DNA, 22 bp, Homo sapiens
ttaggaaagcattgtgtaaaag

SEQ ID NO: 7239426 - DNA, 22 bp, Homo sapiens
ttaggaaatcactttgctcacc

SEQ ID NO: 7239427 - DNA, 22 bp, Homo sapiens
ttattatagattatgcaagatt

SEQ ID NO: 7239428 - DNA, 22 bp, Homo sapiens
ttattataatgagggataaaaa

SEQ ID NO: 7239429 - DNA, 22 bp, Homo sapiens
ttattgagcacatagtatgtgg

SEQ ID NO: 7239430 - DNA, 22 bp, Homo sapiens
ttattgagcaactctggggctc

SEQ ID NO: 7239431 - DNA, 22 bp, Homo sapiens
ttattgagagctgttttatggc

SEQ ID NO: 7239432 - DNA, 22 bp, Homo sapiens
ttattgagaccgtaagtcaggt

SEQ ID NO: 7239433 - DNA, 21 bp, Homo sapiens
ttattgagacatttgtggaaa

SEQ ID NO: 7239434 - DNA, 22 bp, Homo sapiens
ttattgactgatcagagaggga

SEQ ID NO: 7239435 - DNA, 22 bp, Homo sapiens
ttattgagcacctactatgtgt

SEQ ID NO: 7239436 - DNA, 22 bp, Homo sapiens
ttgctttattgggtttactgcc

SEQ ID NO: 7239437 - DNA, 22 bp, Homo sapiens
ttggagatatcacaccttcaca

SEQ ID NO: 7239438 - DNA, 22 bp, Homo sapiens
ttgggacatctggcatacagtt

SEQ ID NO: 7239439 - DNA, 22 bp, Homo sapiens
ttggcataccttagtggtggag

SEQ ID NO: 7239440 - DNA, 22 bp, Homo sapiens
ttgggaagtttaatgacagact

SEQ ID NO: 7239441 - DNA, 22 bp, Homo sapiens
ttgggaagtttaatgacagact

SEQ ID NO: 7239442 - DNA, 22 bp, Homo sapiens
ttgtatttcgatgcacgtgtag

SEQ ID NO: 7239443 - DNA, 22 bp, Homo sapiens
ttgtcaggaactatgattatgc

SEQ ID NO: 7239444 - DNA, 23 bp, Homo sapiens
ttgtcctctggatcggtttggtt

SEQ ID NO: 7239445 - DNA, 21 bp, Homo sapiens
ttgtgtccttctaaagggcca

SEQ ID NO: 7239446 - DNA, 22 bp, Homo sapiens
ttgtgtcctgatttgacacaat

SEQ ID NO: 7239447 - DNA, 22 bp, Homo sapiens
ttgtgtcctctaatctcaccac

SEQ ID NO: 7239448 - DNA, 22 bp, Homo sapiens
ttgtgtcctatatgcatgttct

SEQ ID NO: 7239449 - DNA, 22 bp, Homo sapiens
ttgtgtcctaagcaccagatgg

SEQ ID NO: 7239450 - DNA, 22 bp, Homo sapiens
ttgtgtcctaacatctagttaa

SEQ ID NO: 7239451 - DNA, 22 bp, Homo sapiens
ttgtgtccctgtaagacaaagc

SEQ ID NO: 7239452 - DNA, 22 bp, Homo sapiens
ttgtgtccctggagcttctgtg

SEQ ID NO: 7239453 - DNA, 22 bp, Homo sapiens
ttgtgtccctgcggctgaggag

SEQ ID NO: 7239454 - DNA, 22 bp, Homo sapiens
ttgtgtcccctgttctacctgt

SEQ ID NO: 7239455 - DNA, 22 bp, Homo sapiens
ttgtgtccccctttgagagcca

SEQ ID NO: 7239456 - DNA, 22 bp, Homo sapiens
ttgtgtccatttgagtcatgtg

SEQ ID NO: 7239457 - DNA, 22 bp, Homo sapiens
ttgtgtccaaggctatggtgat

SEQ ID NO: 7239458 - DNA, 22 bp, Homo sapiens
tttattgaacacttgcactggc

SEQ ID NO: 7239459 - DNA, 22 bp, Homo sapiens
tttattgaattgtaaccctatt

SEQ ID NO: 7239460 - DNA, 22 bp, Homo sapiens
tttattgaacacttgcactggc

SEQ ID NO: 7239461 - DNA, 22 bp, Homo sapiens
tttattctagctcagaatagtt

SEQ ID NO: 7239462 - DNA, 20 bp, Homo sapiens
tttattgagcacgtactgtg

SEQ ID NO: 7239463 - DNA, 22 bp, Homo sapiens
tttattgagcacccgttgtgcg

SEQ ID NO: 7239464 - DNA, 22 bp, Homo sapiens
tttattgacttcagtgagtctt

SEQ ID NO: 7239465 - DNA, 22 bp, Homo sapiens
tttattgacccaaagcgagagt

SEQ ID NO: 7239466 - DNA, 22 bp, Homo sapiens
tttattgagtatctactatgtg

SEQ ID NO: 7239467 - DNA, 22 bp, Homo sapiens
tttattgagtatctactatgtg

SEQ ID NO: 7239468 - DNA, 22 bp, Homo sapiens
tttaaatgtgttcttagtagct

SEQ ID NO: 7239469 - DNA, 22 bp, Homo sapiens
tttaccaagctttaattacata

SEQ ID NO: 7239470 - DNA, 22 bp, Homo sapiens
tttgtgtttatgaagttattct

SEQ ID NO: 7239471 - DNA, 22 bp, Homo sapiens
tttgtgttaaatgttaaattca

SEQ ID NO: 7239472 - DNA, 22 bp, Homo sapiens
ttttaaaggctgtatgaccaag

SEQ ID NO: 7239473 - DNA, 18 bp, Homo sapiens
ttttaatttcaggggtgg

SEQ ID NO: 7239474 - DNA, 22 bp, Homo sapiens
ttttattggagtgataccaagc

SEQ ID NO: 7239475 - DNA, 22 bp, Homo sapiens
ttttattggagtgataccaagc

SEQ ID NO: 7239476 - DNA, 22 bp, Homo sapiens
ttttattgcaataaagtgtgta

SEQ ID NO: 7239477 - DNA, 22 bp, Homo sapiens
ttttattgcaataaagtgtgta

SEQ ID NO: 7239478 - DNA, 22 bp, Homo sapiens
tttgacaacagcaaatgtcaca

SEQ ID NO: 7239479 - DNA, 22 bp, Homo sapiens
tttggtattgcacactgtcttc

SEQ ID NO: 7239480 - DNA, 22 bp, Homo sapiens
tttggtcatgtcgtcatttggg

SEQ ID NO: 7239481 - DNA, 18 bp, Homo sapiens
tttgctttccttcttcag

SEQ ID NO: 7239482 - DNA, 21 bp, Homo sapiens
agcgtcaatatcgtcaacagg

SEQ ID NO: 7239483 - DNA, 22 bp, Homo sapiens
acagatagtatgtaaattaagc

SEQ ID NO: 7239484 - DNA, 23 bp, Homo sapiens
acagatagggaaggcagagtttc

SEQ ID NO: 7239485 - DNA, 17 bp, Homo sapiens
acagataggagccccat

SEQ ID NO: 7239486 - DNA, 22 bp, Homo sapiens
acagatagcactaagggatctg

SEQ ID NO: 7239487 - DNA, 22 bp, Homo sapiens
acagatagatttgagggaggct

SEQ ID NO: 7239488 - DNA, 22 bp, Homo sapiens
acagatagatgataatggcttt

SEQ ID NO: 7239489 - DNA, 19 bp, Homo sapiens
acagatagactccaaagca

SEQ ID NO: 7239490 - DNA, 22 bp, Homo sapiens
agctgagggcaggatggggtga

SEQ ID NO: 7239491 - DNA, 22 bp, Homo sapiens
agcaggtgtcactttcactcca

SEQ ID NO: 7239492 - DNA, 22 bp, Homo sapiens
agcaggtggtaggcagtcagca

SEQ ID NO: 7239493 - DNA, 22 bp, Homo sapiens
agcaggtgatcgcgtgtgctcc

SEQ ID NO: 7239494 - DNA, 21 bp, Homo sapiens
agcaggtgtaaaggaggaaat

SEQ ID NO: 7239495 - DNA, 22 bp, Homo sapiens
agcaggtggtgggccagatttg

SEQ ID NO: 7239496 - DNA, 22 bp, Homo sapiens
agcaggtggtctgttgctgctg

SEQ ID NO: 7239497 - DNA, 16 bp, Homo sapiens
agcaggtgtatagtgt

SEQ ID NO: 7239498 - DNA, 22 bp, Homo sapiens
agcaggtgtagggctctttgta

SEQ ID NO: 7239499 - DNA, 22 bp, Homo sapiens
agcaggtgtatataaggctgag

SEQ ID NO: 7239500 - DNA, 22 bp, Homo sapiens
agcaggtgtatcggtcacctac

SEQ ID NO: 7239501 - DNA, 22 bp, Homo sapiens
acacttcaaagggtgacttgat

SEQ ID NO: 7239502 - DNA, 22 bp, Homo sapiens
acacttcaaatggttggaaaat

SEQ ID NO: 7239503 - DNA, 23 bp, Homo sapiens
acacttcacccattgtgatagga

SEQ ID NO: 7239504 - DNA, 20 bp, Homo sapiens
agagtgggtgtcacaggctg

SEQ ID NO: 7239505 - DNA, 22 bp, Homo sapiens
agagtgggttataggcagactt

SEQ ID NO: 7239506 - DNA, 22 bp, Homo sapiens
acaacagggtaaggcaggccat

SEQ ID NO: 7239507 - DNA, 22 bp, Homo sapiens
aatgtgtctatgtggttcacag

SEQ ID NO: 7239508 - DNA, 22 bp, Homo sapiens
aatgtgtcccttatttcacagg

SEQ ID NO: 7239509 - DNA, 22 bp, Homo sapiens
aatgtgtcccttatttcacagg

SEQ ID NO: 7239510 - DNA, 22 bp, Homo sapiens
aatgtgtcatttcccacaggtg

SEQ ID NO: 7239511 - DNA, 22 bp, Homo sapiens
aatgtgtcagcttgtcgatctt

SEQ ID NO: 7239512 - DNA, 22 bp, Homo sapiens
aatgtgtcagcttgtcgatctt

SEQ ID NO: 7239513 - DNA, 22 bp, Homo sapiens
aatgtgtatactggcaattaag

SEQ ID NO: 7239514 - DNA, 22 bp, Homo sapiens
aatgtgtagcatttaatgcagt

SEQ ID NO: 7239515 - DNA, 22 bp, Homo sapiens
agacatttattcacacatttat

SEQ ID NO: 7239516 - DNA, 22 bp, Homo sapiens
agacatgtggtataatcagggg

SEQ ID NO: 7239517 - DNA, 21 bp, Homo sapiens
agacatgtgaactaaaggtga

SEQ ID NO: 7239518 - DNA, 22 bp, Homo sapiens
agacatgtccacaaagcattca

SEQ ID NO: 7239519 - DNA, 22 bp, Homo sapiens
agacatgtcaccaattcttact

SEQ ID NO: 7239520 - DNA, 22 bp, Homo sapiens
agacaggtagcaggacagatat

SEQ ID NO: 7239521 - DNA, 22 bp, Homo sapiens
agacaggtaaatagagatgctg

SEQ ID NO: 7239522 - DNA, 22 bp, Homo sapiens
agagctgaatttgggtggtgga

SEQ ID NO: 7239523 - DNA, 22 bp, Homo sapiens
agagctgcccacacagcagatt

SEQ ID NO: 7239524 - DNA, 22 bp, Homo sapiens
aaggcaattggcttgtataaga

SEQ ID NO: 7239525 - DNA, 22 bp, Homo sapiens
acatgacacctctggctgggtg

SEQ ID NO: 7239526 - DNA, 22 bp, Homo sapiens
aagcttcagtggactgtagtgt

SEQ ID NO: 7239527 - DNA, 22 bp, Homo sapiens
aagctgttggcagatagctctg

SEQ ID NO: 7239528 - DNA, 22 bp, Homo sapiens
aaggaagcagccagagaccctc

SEQ ID NO: 7239529 - DNA, 22 bp, Homo sapiens
aagtatattttttgaagcatat

SEQ ID NO: 7239530 - DNA, 22 bp, Homo sapiens
aagtccagtttttccaggtggt

SEQ ID NO: 7239531 - DNA, 22 bp, Homo sapiens
aagtccagtgctttagattcca

SEQ ID NO: 7239532 - DNA, 22 bp, Homo sapiens
acctcaagaatgtataacacag

SEQ ID NO: 7239533 - DNA, 22 bp, Homo sapiens
aaggtgtcaccagattggcagg

SEQ ID NO: 7239534 - DNA, 19 bp, Homo sapiens
aaggtggtttgtctctgta

SEQ ID NO: 7239535 - DNA, 22 bp, Homo sapiens
aaggtgtcaaactagaagatgt

SEQ ID NO: 7239536 - DNA, 22 bp, Homo sapiens
aaggtggtcttactgatggtat

SEQ ID NO: 7239537 - DNA, 22 bp, Homo sapiens
aaggtggttgcaattaccataa

SEQ ID NO: 7239538 - DNA, 22 bp, Homo sapiens
aaggtggttcgctggtacccag

SEQ ID NO: 7239539 - DNA, 22 bp, Homo sapiens
aaggtggtgcttctgctcctct

SEQ ID NO: 7239540 - DNA, 22 bp, Homo sapiens
aaggtggtgatcatcttgaagg

SEQ ID NO: 7239541 - DNA, 22 bp, Homo sapiens
aaggtggtgagtacagttaggt

SEQ ID NO: 7239542 - DNA, 22 bp, Homo sapiens
aaggtggtttgctaatcccaac

SEQ ID NO: 7239543 - DNA, 22 bp, Homo sapiens
aaggtggtttgcagacagaata

SEQ ID NO: 7239544 - DNA, 22 bp, Homo sapiens
aaggtggtttgattatcccact

SEQ ID NO: 7239545 - DNA, 22 bp, Homo sapiens
aaggtggttgtaggctggtctg

SEQ ID NO: 7239546 - DNA, 22 bp, Homo sapiens
aagggcagagggaatcccacat

SEQ ID NO: 7239547 - DNA, 20 bp, Homo sapiens
aagggcagagggaacagact

SEQ ID NO: 7239548 - DNA, 22 bp, Homo sapiens
aagggcagaaagggacgctttg

SEQ ID NO: 7239549 - DNA, 22 bp, Homo sapiens
aagggcagaatagagaagatgg

SEQ ID NO: 7239550 - DNA, 22 bp, Homo sapiens
actgtccattcactcatattca

SEQ ID NO: 7239551 - DNA, 22 bp, Homo sapiens
actgtctcctcatcatgcctgg

SEQ ID NO: 7239552 - DNA, 22 bp, Homo sapiens
actgtctctctagcagttcagg

SEQ ID NO: 7239553 - DNA, 22 bp, Homo sapiens
actgtctctctagcagttcagg

SEQ ID NO: 7239554 - DNA, 22 bp, Homo sapiens
aatagaatgtaatctaatacat

SEQ ID NO: 7239555 - DNA, 22 bp, Homo sapiens
aagtgtttatggttattgttaa

SEQ ID NO: 7239556 - DNA, 22 bp, Homo sapiens
aagtgtttattgattggtctag

SEQ ID NO: 7239557 - DNA, 22 bp, Homo sapiens
actttgttttcatgaaacagct

SEQ ID NO: 7239558 - DNA, 22 bp, Homo sapiens
actttgttgaagaatatgttag

SEQ ID NO: 7239559 - DNA, 22 bp, Homo sapiens
actttgttgatgaaatagtttt

SEQ ID NO: 7239560 - DNA, 22 bp, Homo sapiens
actttgttgttccttgtctaaa

SEQ ID NO: 7239561 - DNA, 22 bp, Homo sapiens
agaagaaactgtcggggatatt

SEQ ID NO: 7239562 - DNA, 22 bp, Homo sapiens
agaagaaactgtcggggatatt

SEQ ID NO: 7239563 - DNA, 22 bp, Homo sapiens
agaagaaagattgaaggttcct

SEQ ID NO: 7239564 - DNA, 22 bp, Homo sapiens
agaagaaagattgaaggttcct

SEQ ID NO: 7239565 - DNA, 22 bp, Homo sapiens
agaagaaagattgaaggttcct

SEQ ID NO: 7239566 - DNA, 22 bp, Homo sapiens
agaagaaactgtcggggatatt

SEQ ID NO: 7239567 - DNA, 22 bp, Homo sapiens
agaagaaatgaggccgttctgc

SEQ ID NO: 7239568 - DNA, 22 bp, Homo sapiens
aatgaagcagtccatctgctct

SEQ ID NO: 7239569 - DNA, 22 bp, Homo sapiens
aatgaagcaagctgctgtgttt

SEQ ID NO: 7239570 - DNA, 22 bp, Homo sapiens
aaaaatgaaacggctggttggc

SEQ ID NO: 7239571 - DNA, 22 bp, Homo sapiens
aaaaccacttccttgctattgg

SEQ ID NO: 7239572 - DNA, 22 bp, Homo sapiens
aaaacagttataaacagagtca

SEQ ID NO: 7239573 - DNA, 22 bp, Homo sapiens
aaagcaatggatgagaatctgt

SEQ ID NO: 7239574 - DNA, 22 bp, Homo sapiens
aaaatgagccatgaaccaacca

SEQ ID NO: 7239575 - DNA, 22 bp, Homo sapiens
aaagtcacttccttctgtcagc

SEQ ID NO: 7239576 - DNA, 22 bp, Homo sapiens
aaagttcattgatgactgaggt

SEQ ID NO: 7239577 - DNA, 22 bp, Homo sapiens
aaaggagaaaacatacaggact

SEQ ID NO: 7239578 - DNA, 22 bp, Homo sapiens
aaaggagagtgagtcagatgcc

SEQ ID NO: 7239579 - DNA, 22 bp, Homo sapiens
aaaggacatgtcaatatcaggc

SEQ ID NO: 7239580 - DNA, 22 bp, Homo sapiens
aaatgacactcattcagtgtca

SEQ ID NO: 7239581 - DNA, 22 bp, Homo sapiens
aaatgacaataaaagtccatgc

SEQ ID NO: 7239582 - DNA, 21 bp, Homo sapiens
aaatgaatgtggtagtgcaag

SEQ ID NO: 7239583 - DNA, 22 bp, Homo sapiens
aagaagcaggtcacagacaggg

SEQ ID NO: 7239584 - DNA, 22 bp, Homo sapiens
aaatggaactgttgtgcatttg

SEQ ID NO: 7239585 - DNA, 22 bp, Homo sapiens
aaatggaactgggctactaggt

SEQ ID NO: 7239586 - DNA, 22 bp, Homo sapiens
aaatggaaaatgctgttttggt

SEQ ID NO: 7239587 - DNA, 19 bp, Homo sapiens
aaatggaaaactttgggaa

SEQ ID NO: 7239588 - DNA, 22 bp, Homo sapiens
aaatgaggttaatacagtgctt

SEQ ID NO: 7239589 - DNA, 22 bp, Homo sapiens
aaaggcacaaattcagcatttt

SEQ ID NO: 7239590 - DNA, 22 bp, Homo sapiens
aaaggcacacactccttgttat

SEQ ID NO: 7239591 - DNA, 22 bp, Homo sapiens
aaaggcacagaagggaaaccaa

SEQ ID NO: 7239592 - DNA, 22 bp, Homo sapiens
aacatgaaggtaggatggtttt

SEQ ID NO: 7239593 - DNA, 22 bp, Homo sapiens
aacatgaaagttgctaagtgca

SEQ ID NO: 7239594 - DNA, 23 bp, Homo sapiens
aaaggcacagcattgtctagcag

SEQ ID NO: 7239595 - DNA, 20 bp, Homo sapiens
aaaggcacagcaacagagct

SEQ ID NO: 7239596 - DNA, 22 bp, Homo sapiens
aaaggcactagaagttaccttt

SEQ ID NO: 7239597 - DNA, 22 bp, Homo sapiens
aaaggcactggatagctgggga

SEQ ID NO: 7239598 - DNA, 22 bp, Homo sapiens
aaaggcactgatcttatccagt

SEQ ID NO: 7239599 - DNA, 22 bp, Homo sapiens
aaaggcactgatcttatccagt

SEQ ID NO: 7239600 - DNA, 22 bp, Homo sapiens
aaagcatttcatgtctagaaag

SEQ ID NO: 7239601 - DNA, 22 bp, Homo sapiens
aaagtccaggggctggaggcgg

SEQ ID NO: 7239602 - DNA, 22 bp, Homo sapiens
aaagtccagggaaagagcgtct

SEQ ID NO: 7239603 - DNA, 22 bp, Homo sapiens
acaatcacacatgcaattatac

SEQ ID NO: 7239604 - DNA, 22 bp, Homo sapiens
aagaactgtatcaagatgtagt

SEQ ID NO: 7239605 - DNA, 22 bp, Homo sapiens
aagaagaattattccctaatca

SEQ ID NO: 7239606 - DNA, 22 bp, Homo sapiens
aagaagaagtgttatttttaga

SEQ ID NO: 7239607 - DNA, 22 bp, Homo sapiens
aattttatctctaagcaggctt

SEQ ID NO: 7239608 - DNA, 22 bp, Homo sapiens
aagaagatggttaactttcagt

SEQ ID NO: 7239609 - DNA, 22 bp, Homo sapiens
aagaacattttgtagaatgaca

SEQ ID NO: 7239610 - DNA, 22 bp, Homo sapiens
aagaacattcgaactattttct

SEQ ID NO: 7239611 - DNA, 22 bp, Homo sapiens
aagaacattgatattgtctatg

SEQ ID NO: 7239612 - DNA, 22 bp, Homo sapiens
acagagcaactttatttcatgg

SEQ ID NO: 7239613 - DNA, 22 bp, Homo sapiens
acagacattttaagacacttta

SEQ ID NO: 7239614 - DNA, 22 bp, Homo sapiens
acagacattttaagacacttta

SEQ ID NO: 7239615 - DNA, 22 bp, Homo sapiens
acacttcatgcattcttcactc

SEQ ID NO: 7239616 - DNA, 22 bp, Homo sapiens
acacttcatttacattataggc

SEQ ID NO: 7239617 - DNA, 20 bp, Homo sapiens
acacttcatttgcagcagct

SEQ ID NO: 7239618 - DNA, 22 bp, Homo sapiens
acacttcatagcaaggttggag

SEQ ID NO: 7239619 - DNA, 21 bp, Homo sapiens
acacttcagtttttaaaggga

SEQ ID NO: 7239620 - DNA, 22 bp, Homo sapiens
acacttcagctccacaaacatt

SEQ ID NO: 7239621 - DNA, 22 bp, Homo sapiens
acacttcaggactctggggcaa

SEQ ID NO: 7239622 - DNA, 22 bp, Homo sapiens
aataagaacttgtctctggcag

SEQ ID NO: 7239623 - DNA, 22 bp, Homo sapiens
aatatttctccttcgttatagc

SEQ ID NO: 7239624 - DNA, 22 bp, Homo sapiens
aatgaaatagttggctgtagag

SEQ ID NO: 7239625 - DNA, 22 bp, Homo sapiens
aatgaaatgaagatatgatcag

SEQ ID NO: 7239626 - DNA, 22 bp, Homo sapiens
aatgaaatctgctgggtaaaga

SEQ ID NO: 7239627 - DNA, 22 bp, Homo sapiens
aatgaaatgtagcttatccata

SEQ ID NO: 7239628 - DNA, 18 bp, Homo sapiens
aatgaaatgtacaccttt

SEQ ID NO: 7239629 - DNA, 22 bp, Homo sapiens
aagggcaggtgggcatttctgg

SEQ ID NO: 7239630 - DNA, 22 bp, Homo sapiens
aaggtgtcattgtttatggaga

SEQ ID NO: 7239631 - DNA, 23 bp, Homo sapiens
aaggtgtcattgatgggattcta

SEQ ID NO: 7239632 - DNA, 22 bp, Homo sapiens
aaggtgtcatccaggatggtgg

SEQ ID NO: 7239633 - DNA, 22 bp, Homo sapiens
aaggtgtcaggcttgggaaagt

SEQ ID NO: 7239634 - DNA, 22 bp, Homo sapiens
aaggtgtctctctgcttcttgg

SEQ ID NO: 7239635 - DNA, 22 bp, Homo sapiens
aaggtgtcgggttagctcagcc

SEQ ID NO: 7239636 - DNA, 19 bp, Homo sapiens
aaggtgtcccaactgcgtt

SEQ ID NO: 7239637 - DNA, 22 bp, Homo sapiens
aaggtgtcggcagagccgcttc

SEQ ID NO: 7239638 - DNA, 22 bp, Homo sapiens
aaggtgttattggaggcatcag

SEQ ID NO: 7239639 - DNA, 23 bp, Homo sapiens
aaggtgtttgatgggttgaggaa

SEQ ID NO: 7239640 - DNA, 23 bp, Homo sapiens
aaggtgttctgtatttaactcag

SEQ ID NO: 7239641 - DNA, 22 bp, Homo sapiens
aagtccagtgaaatagaatgca

SEQ ID NO: 7239642 - DNA, 22 bp, Homo sapiens
aaggcactgtactagttagtta

SEQ ID NO: 7239643 - DNA, 22 bp, Homo sapiens
aaggcactgctttgctgcgccc

SEQ ID NO: 7239644 - DNA, 22 bp, Homo sapiens
aagggcaggagaagacggatat

SEQ ID NO: 7239645 - DNA, 22 bp, Homo sapiens
aagggcagggagtttgtgtcta

SEQ ID NO: 7239646 - DNA, 22 bp, Homo sapiens
aagggcaggcagagatcatata

SEQ ID NO: 7239647 - DNA, 22 bp, Homo sapiens
aagggcaggcacccaccctcac

SEQ ID NO: 7239648 - DNA, 22 bp, Homo sapiens
aaggcactcattcaaggagata

SEQ ID NO: 7239649 - DNA, 20 bp, Homo sapiens
aaggcactatgtctgctagc

SEQ ID NO: 7239650 - DNA, 22 bp, Homo sapiens
aaggcactcagccttgggacag

SEQ ID NO: 7239651 - DNA, 22 bp, Homo sapiens
aaggcactagcagaattagtga

SEQ ID NO: 7239652 - DNA, 22 bp, Homo sapiens
aaggcactagcaagctgcctgg

SEQ ID NO: 7239653 - DNA, 22 bp, Homo sapiens
aaggcactgaaaaattgtgtgt

SEQ ID NO: 7239654 - DNA, 22 bp, Homo sapiens
aaggcactgaacttaaattctg

SEQ ID NO: 7239655 - DNA, 22 bp, Homo sapiens
aaggcactgagccagccgtctc

SEQ ID NO: 7239656 - DNA, 22 bp, Homo sapiens
aaggcactgactgtgcagggga

SEQ ID NO: 7239657 - DNA, 22 bp, Homo sapiens
atgattgaccatctgctgggct

SEQ ID NO: 7239658 - DNA, 22 bp, Homo sapiens
atgggctcggcgctgctgggat

SEQ ID NO: 7239659 - DNA, 22 bp, Homo sapiens
atgtgatcaagaatgtgggaga

SEQ ID NO: 7239660 - DNA, 22 bp, Homo sapiens
atgttattttggaaaatacaaa

SEQ ID NO: 7239661 - DNA, 22 bp, Homo sapiens
atgttcaaactttttacacacc

SEQ ID NO: 7239662 - DNA, 22 bp, Homo sapiens
caaagtggctggccgggagatc

SEQ ID NO: 7239663 - DNA, 22 bp, Homo sapiens
attttttatataccaaggtggg

SEQ ID NO: 7239664 - DNA, 22 bp, Homo sapiens
attgttaataactattacattg

SEQ ID NO: 7239665 - DNA, 22 bp, Homo sapiens
attgtatttccagcttgaatgt

SEQ ID NO: 7239666 - DNA, 19 bp, Homo sapiens
attgtgtcaatggtgttca

SEQ ID NO: 7239667 - DNA, 23 bp, Homo sapiens
agctctggcgttggggaggtagt

SEQ ID NO: 7239668 - DNA, 22 bp, Homo sapiens
agctctggcactggcgcgggat

SEQ ID NO: 7239669 - DNA, 22 bp, Homo sapiens
agctgaggaggaatgatgggta

SEQ ID NO: 7239670 - DNA, 22 bp, Homo sapiens
agctctggagccggaggatttc

SEQ ID NO: 7239671 - DNA, 22 bp, Homo sapiens
agcgccactgcactccagcctg

SEQ ID NO: 7239672 - DNA, 22 bp, Homo sapiens
agccagggaagaggcctacctc

SEQ ID NO: 7239673 - DNA, 22 bp, Homo sapiens
caagcttgtttctcctgggggt

SEQ ID NO: 7239674 - DNA, 22 bp, Homo sapiens
caagtccatgttagatgctggc

SEQ ID NO: 7239675 - DNA, 22 bp, Homo sapiens
agcaggtggccacgaggaggag

SEQ ID NO: 7239676 - DNA, 18 bp, Homo sapiens
agcaggtggatttattgg

SEQ ID NO: 7239677 - DNA, 22 bp, Homo sapiens
agcaggtggatttagacgggag

SEQ ID NO: 7239678 - DNA, 22 bp, Homo sapiens
agcaggtggcctcctgtctgtc

SEQ ID NO: 7239679 - DNA, 18 bp, Homo sapiens
agcaggtggcgtctgcag

SEQ ID NO: 7239680 - DNA, 22 bp, Homo sapiens
agcaggtgggatcaagctggca

SEQ ID NO: 7239681 - DNA, 22 bp, Homo sapiens
agcaggtgggcatgaaagctga

SEQ ID NO: 7239682 - DNA, 22 bp, Homo sapiens
cacggtggcccacaggtgcaag

SEQ ID NO: 7239683 - DNA, 21 bp, Homo sapiens
cacatgtgaattactgaactg

SEQ ID NO: 7239684 - DNA, 22 bp, Homo sapiens
cactgcacttcagcctgggtga

SEQ ID NO: 7239685 - DNA, 22 bp, Homo sapiens
cactgcacttcagcctgggtga

SEQ ID NO: 7239686 - DNA, 22 bp, Homo sapiens
cactgcaacctccacctcctgg

SEQ ID NO: 7239687 - DNA, 22 bp, Homo sapiens
cactgcactccagcccgggcaa

SEQ ID NO: 7239688 - DNA, 22 bp, Homo sapiens
cactgcactccagcccgggcaa

SEQ ID NO: 7239689 - DNA, 23 bp, Homo sapiens
aggtggtcttgtggatgctgcaa

SEQ ID NO: 7239690 - DNA, 22 bp, Homo sapiens
aggtggtcttaaactgctctgg

SEQ ID NO: 7239691 - DNA, 21 bp, Homo sapiens
aggtggtctgcagcagctgaa

SEQ ID NO: 7239692 - DNA, 19 bp, Homo sapiens
aggtggtctaggctggaga

SEQ ID NO: 7239693 - DNA, 22 bp, Homo sapiens
aggtggggaggagtgtctcttt

SEQ ID NO: 7239694 - DNA, 22 bp, Homo sapiens
aggtggagaagagatgggcagt

SEQ ID NO: 7239695 - DNA, 20 bp, Homo sapiens
aggtgtcctgtagcttgagt

SEQ ID NO: 7239696 - DNA, 22 bp, Homo sapiens
aggtgtccaggaagatgctggc

SEQ ID NO: 7239697 - DNA, 22 bp, Homo sapiens
aggtgtccaatcctggttggat

SEQ ID NO: 7239698 - DNA, 22 bp, Homo sapiens
actcacagtccctgtaggagtg

SEQ ID NO: 7239699 - DNA, 22 bp, Homo sapiens
actctggtctttctgaaagcaa

SEQ ID NO: 7239700 - DNA, 22 bp, Homo sapiens
actctggtagacaaggagaggt

SEQ ID NO: 7239701 - DNA, 22 bp, Homo sapiens
agtcctgtgaggggtgcagctt

SEQ ID NO: 7239702 - DNA, 22 bp, Homo sapiens
agtcctgtaattgtgagttaac

SEQ ID NO: 7239703 - DNA, 22 bp, Homo sapiens
agtcaggtgaatgttatacaca

SEQ ID NO: 7239704 - DNA, 22 bp, Homo sapiens
agtcaggtactccgagggcatg

SEQ ID NO: 7239705 - DNA, 22 bp, Homo sapiens
agtcaggtaccacattacattg

SEQ ID NO: 7239706 - DNA, 22 bp, Homo sapiens
agtcagtggtatttaggggaat

SEQ ID NO: 7239707 - DNA, 22 bp, Homo sapiens
agtcagtgggcttggcacagaa

SEQ ID NO: 7239708 - DNA, 22 bp, Homo sapiens
agtcagtgggagaagtgtgaag

SEQ ID NO: 7239709 - DNA, 22 bp, Homo sapiens
agtcaggttgcattttaagtaa

SEQ ID NO: 7239710 - DNA, 22 bp, Homo sapiens
agttattttggaaaatgagtca

SEQ ID NO: 7239711 - DNA, 22 bp, Homo sapiens
actggttgaagaaaagctagta

SEQ ID NO: 7239712 - DNA, 22 bp, Homo sapiens
agtgggggctggctctgtctgt

SEQ ID NO: 7239713 - DNA, 22 bp, Homo sapiens
agtggggcggacaggaccagga

SEQ ID NO: 7239714 - DNA, 22 bp, Homo sapiens
agtggggccggtgaggccgagg

SEQ ID NO: 7239715 - DNA, 22 bp, Homo sapiens
agtggcagagcaggtgctggaa

SEQ ID NO: 7239716 - DNA, 22 bp, Homo sapiens
agttcagccatttgttaactat

SEQ ID NO: 7239717 - DNA, 22 bp, Homo sapiens
ataaggaatgatgtatcagttt

SEQ ID NO: 7239718 - DNA, 22 bp, Homo sapiens
atacaatgggtgcaaagatgtg

SEQ ID NO: 7239719 - DNA, 20 bp, Homo sapiens
agaaatattgagttcagagg

SEQ ID NO: 7239720 - DNA, 22 bp, Homo sapiens
agaagcacggttttgtctagca

SEQ ID NO: 7239721 - DNA, 22 bp, Homo sapiens
acatgtgtaagatgtgatatat

SEQ ID NO: 7239722 - DNA, 22 bp, Homo sapiens
acatgtgtaaaagtggataaaa

SEQ ID NO: 7239723 - DNA, 22 bp, Homo sapiens
acatgtggaggaggcgagggta

SEQ ID NO: 7239724 - DNA, 22 bp, Homo sapiens
aggctctggacagtgaggagtt

SEQ ID NO: 7239725 - DNA, 22 bp, Homo sapiens
agggagctgactggctgccatt

SEQ ID NO: 7239726 - DNA, 21 bp, Homo sapiens
acctcaagcaacaaccaaggt

SEQ ID NO: 7239727 - DNA, 22 bp, Homo sapiens
acctcaaggaaaatctagacag

SEQ ID NO: 7239728 - DNA, 22 bp, Homo sapiens
acctcaagtgatccactcacct

SEQ ID NO: 7239729 - DNA, 22 bp, Homo sapiens
aggggagcatctgtgatggtta

SEQ ID NO: 7239730 - DNA, 22 bp, Homo sapiens
aggggagccgaggggcatctgt

SEQ ID NO: 7239731 - DNA, 22 bp, Homo sapiens
aggcaggtgttaaccctctgag

SEQ ID NO: 7239732 - DNA, 22 bp, Homo sapiens
aggcaggtgcttatgacttgct

SEQ ID NO: 7239733 - DNA, 22 bp, Homo sapiens
aggcaggtgggagtgattcctt

SEQ ID NO: 7239734 - DNA, 22 bp, Homo sapiens
aggcaggtgggtcacttgagtc

SEQ ID NO: 7239735 - DNA, 22 bp, Homo sapiens
aggcaggtgttacctctggttt

SEQ ID NO: 7239736 - DNA, 22 bp, Homo sapiens
aggcaggtgttgggagacacca

SEQ ID NO: 7239737 - DNA, 22 bp, Homo sapiens
aggcaggttggggaaaagcact

SEQ ID NO: 7239738 - DNA, 22 bp, Homo sapiens
aggcaggttacaaaaactttat

SEQ ID NO: 7239739 - DNA, 22 bp, Homo sapiens
aggcaggttggtgagaagactg

SEQ ID NO: 7239740 - DNA, 22 bp, Homo sapiens
aggcactggtccattttctgca

SEQ ID NO: 7239741 - DNA, 22 bp, Homo sapiens
aggacttagaacattatgtact

SEQ ID NO: 7239742 - DNA, 22 bp, Homo sapiens
acaggacatgtaccaggtggtc

SEQ ID NO: 7239743 - DNA, 22 bp, Homo sapiens
acagggcagtgtcttgaaaaat

SEQ ID NO: 7239744 - DNA, 22 bp, Homo sapiens
acagggcaggtggctactggtc

SEQ ID NO: 7239745 - DNA, 17 bp, Homo sapiens
acagggcagaaacagct

SEQ ID NO: 7239746 - DNA, 22 bp, Homo sapiens
acagggcatgtgcaagagacat

SEQ ID NO: 7239747 - DNA, 21 bp, Homo sapiens
acagggcatgcagctggctgt

SEQ ID NO: 7239748 - DNA, 23 bp, Homo sapiens
acagggcattgctggcctcgagg

SEQ ID NO: 7239749 - DNA, 22 bp, Homo sapiens
acagggcatttcctctatgtgt

SEQ ID NO: 7239750 - DNA, 22 bp, Homo sapiens
aggacatgaagaaagggcaagg

SEQ ID NO: 7239751 - DNA, 22 bp, Homo sapiens
aggacatgtaaatggagaggga

SEQ ID NO: 7239752 - DNA, 22 bp, Homo sapiens
aggctctggtgcagctgtaact

SEQ ID NO: 7239753 - DNA, 22 bp, Homo sapiens
aggctctggttggcaagtaaag

SEQ ID NO: 7239754 - DNA, 18 bp, Homo sapiens
ccaggtggtgacagagat

SEQ ID NO: 7239755 - DNA, 22 bp, Homo sapiens
ccaggtggtgcctctgttcgca

SEQ ID NO: 7239756 - DNA, 20 bp, Homo sapiens
ccaggtggtgcctggagagg

SEQ ID NO: 7239757 - DNA, 22 bp, Homo sapiens
ccaggtggttcaggtcaccata

SEQ ID NO: 7239758 - DNA, 22 bp, Homo sapiens
ccaggtgtttggcctgcatgat

SEQ ID NO: 7239759 - DNA, 22 bp, Homo sapiens
ccaggtgttacacgagtgttaa

SEQ ID NO: 7239760 - DNA, 22 bp, Homo sapiens
ccaggtgttctttgtccctgtt

SEQ ID NO: 7239761 - DNA, 22 bp, Homo sapiens
ccagggcagcgcccctccacgc

SEQ ID NO: 7239762 - DNA, 22 bp, Homo sapiens
ccagggcagccaacccagatgc

SEQ ID NO: 7239763 - DNA, 22 bp, Homo sapiens
ccaggtggtgaaagtgggccct

SEQ ID NO: 7239764 - DNA, 16 bp, Homo sapiens
ccaggtggggctgtga

SEQ ID NO: 7239765 - DNA, 22 bp, Homo sapiens
ccagggcagcagaattggggca

SEQ ID NO: 7239766 - DNA, 22 bp, Homo sapiens
ccagggcagaaaaagagggaat

SEQ ID NO: 7239767 - DNA, 22 bp, Homo sapiens
ccagggcacttaggcccagccc

SEQ ID NO: 7239768 - DNA, 19 bp, Homo sapiens
aggctctgtaggagagggc

SEQ ID NO: 7239769 - DNA, 18 bp, Homo sapiens
aggcaggtgctaatattt

SEQ ID NO: 7239770 - DNA, 19 bp, Homo sapiens
aggcaggtgcagaggtccc

SEQ ID NO: 7239771 - DNA, 22 bp, Homo sapiens
aggcaggtcacatgcttggcga

SEQ ID NO: 7239772 - DNA, 22 bp, Homo sapiens
aggcaggtagaaggatctttat

SEQ ID NO: 7239773 - DNA, 22 bp, Homo sapiens
aggcaggtgagtcaaaacagac

SEQ ID NO: 7239774 - DNA, 22 bp, Homo sapiens
aggcaggtctgtatctagtctc

SEQ ID NO: 7239775 - DNA, 22 bp, Homo sapiens
aggcaggtcccctggaaggcac

SEQ ID NO: 7239776 - DNA, 22 bp, Homo sapiens
agggagcttctggcctcagcct

SEQ ID NO: 7239777 - DNA, 22 bp, Homo sapiens
agggagcttctacttcaaggca

SEQ ID NO: 7239778 - DNA, 22 bp, Homo sapiens
agggagcttccgaactacagct

SEQ ID NO: 7239779 - DNA, 22 bp, Homo sapiens
agggagctgtggtcagctcagt

SEQ ID NO: 7239780 - DNA, 22 bp, Homo sapiens
agggagctggtatttataatga

SEQ ID NO: 7239781 - DNA, 22 bp, Homo sapiens
agggagctgggccacactgatc

SEQ ID NO: 7239782 - DNA, 21 bp, Homo sapiens
agggagctggccacacagcct

SEQ ID NO: 7239783 - DNA, 22 bp, Homo sapiens
agggagctgctctgcttccgtg

SEQ ID NO: 7239784 - DNA, 21 bp, Homo sapiens
agggagctgcgtcttgaaaga

SEQ ID NO: 7239785 - DNA, 22 bp, Homo sapiens
agggagctgagctgtgagcagc

SEQ ID NO: 7239786 - DNA, 22 bp, Homo sapiens
agggagctgagagctactattt

SEQ ID NO: 7239787 - DNA, 22 bp, Homo sapiens
agggagctttcaggtagcttaa

SEQ ID NO: 7239788 - DNA, 21 bp, Homo sapiens
agggagctttaggtagaagtt

SEQ ID NO: 7239789 - DNA, 22 bp, Homo sapiens
agggagctttaccccagatcac

SEQ ID NO: 7239790 - DNA, 22 bp, Homo sapiens
agggagcttgtgtttcttttag

SEQ ID NO: 7239791 - DNA, 22 bp, Homo sapiens
cagtccagccagtagggtgtgg

SEQ ID NO: 7239792 - DNA, 21 bp, Homo sapiens
cagtgtggtgaccagggtctc

SEQ ID NO: 7239793 - DNA, 17 bp, Homo sapiens
aggagctgggggtggtg

SEQ ID NO: 7239794 - DNA, 22 bp, Homo sapiens
aggcactgtgggtgtggccgga

SEQ ID NO: 7239795 - DNA, 22 bp, Homo sapiens
aggcactgttcccagttatcct

SEQ ID NO: 7239796 - DNA, 21 bp, Homo sapiens
aggcactgtttgtggtttggg

SEQ ID NO: 7239797 - DNA, 20 bp, Homo sapiens
aggcactgttgtctgtatcc

SEQ ID NO: 7239798 - DNA, 22 bp, Homo sapiens
aggcaaggtgctacagacagtg

SEQ ID NO: 7239799 - DNA, 22 bp, Homo sapiens
aggcaatcccctgaggatactt

SEQ ID NO: 7239800 - DNA, 22 bp, Homo sapiens
cagggcaggatgctgtgattat

SEQ ID NO: 7239801 - DNA, 22 bp, Homo sapiens
cagggcagggccacaccccctg

SEQ ID NO: 7239802 - DNA, 22 bp, Homo sapiens
cagggcagggatgttgcggcag

SEQ ID NO: 7239803 - DNA, 22 bp, Homo sapiens
cagggcagggagcttagaatga

SEQ ID NO: 7239804 - DNA, 22 bp, Homo sapiens
cagggcagtaacgggaacatct

SEQ ID NO: 7239805 - DNA, 22 bp, Homo sapiens
caggtggtgcctcctcccttcc

SEQ ID NO: 7239806 - DNA, 22 bp, Homo sapiens
caggtggttccatgtttcatga

SEQ ID NO: 7239807 - DNA, 22 bp, Homo sapiens
caggtggttatgaggaaggtga

SEQ ID NO: 7239808 - DNA, 22 bp, Homo sapiens
caggtggtgcctccaggctggt

SEQ ID NO: 7239809 - DNA, 22 bp, Homo sapiens
caggtgtctaattctcaccccc

SEQ ID NO: 7239810 - DNA, 22 bp, Homo sapiens
caggtgtcggtcaggcggtttt

SEQ ID NO: 7239811 - DNA, 16 bp, Homo sapiens
caggtgtcagtcacct

SEQ ID NO: 7239812 - DNA, 22 bp, Homo sapiens
caggtgtcagcagcactgtact

SEQ ID NO: 7239813 - DNA, 22 bp, Homo sapiens
caggtgtcaaaatactaagtgg

SEQ ID NO: 7239814 - DNA, 22 bp, Homo sapiens
caggtggtttgataggataact

SEQ ID NO: 7239815 - DNA, 22 bp, Homo sapiens
caggtggttgtttggattctaa

SEQ ID NO: 7239816 - DNA, 22 bp, Homo sapiens
caggtggttgagagctgtaggc

SEQ ID NO: 7239817 - DNA, 22 bp, Homo sapiens
cagctgtccttcctggtgggcg

SEQ ID NO: 7239818 - DNA, 22 bp, Homo sapiens
agtggcagatctctggtctgga

SEQ ID NO: 7239819 - DNA, 22 bp, Homo sapiens
ctcctggtgctggggctgccgc

SEQ ID NO: 7239820 - DNA, 23 bp, Homo sapiens
ctcctggtgctgctatcaggggt

SEQ ID NO: 7239821 - DNA, 22 bp, Homo sapiens
ctcctggtgactcccagataaa

SEQ ID NO: 7239822 - DNA, 20 bp, Homo sapiens
ctcctggtccaggagcctga

SEQ ID NO: 7239823 - DNA, 22 bp, Homo sapiens
ctcctcaaggtctcaggaataa

SEQ ID NO: 7239824 - DNA, 22 bp, Homo sapiens
ctcattgcaacctccgcctccc

SEQ ID NO: 7239825 - DNA, 22 bp, Homo sapiens
aggtttgttttggaaagatcat

SEQ ID NO: 7239826 - DNA, 22 bp, Homo sapiens
aggtttgtttatgtatcattgg

SEQ ID NO: 7239827 - DNA, 22 bp, Homo sapiens
aggtttgttaaaccagattgct

SEQ ID NO: 7239828 - DNA, 22 bp, Homo sapiens
aggtttgtgtcttgcttaaggt

SEQ ID NO: 7239829 - DNA, 23 bp, Homo sapiens
aggtttgtctcagaggcagagtt

SEQ ID NO: 7239830 - DNA, 22 bp, Homo sapiens
cgcagggccgcgagcgggacca

SEQ ID NO: 7239831 - DNA, 22 bp, Homo sapiens
cgcaggtgaaagaggctgggca

SEQ ID NO: 7239832 - DNA, 22 bp, Homo sapiens
cgcaggtgaactgttctgcagt

SEQ ID NO: 7239833 - DNA, 22 bp, Homo sapiens
agtccagtcggcctggagaaat

SEQ ID NO: 7239834 - DNA, 22 bp, Homo sapiens
ctagaacagaaagtacaggaaa

SEQ ID NO: 7239835 - DNA, 22 bp, Homo sapiens
agtccaccggcagagatgctga

SEQ ID NO: 7239836 - DNA, 22 bp, Homo sapiens
cctggtgctgctatcaggggta

SEQ ID NO: 7239837 - DNA, 22 bp, Homo sapiens
cctggtgccggtagacgcgcag

SEQ ID NO: 7239838 - DNA, 22 bp, Homo sapiens
cctggtgcttaccagagctttt

SEQ ID NO: 7239839 - DNA, 22 bp, Homo sapiens
aggtggggaggagtgtctcttt

SEQ ID NO: 7239840 - DNA, 22 bp, Homo sapiens
aggtggggcccaccaatttgca

SEQ ID NO: 7239841 - DNA, 21 bp, Homo sapiens
aggtggggctgcacctctgct

SEQ ID NO: 7239842 - DNA, 22 bp, Homo sapiens
aggtggggccaaatgctacagt

SEQ ID NO: 7239843 - DNA, 22 bp, Homo sapiens
aggtggggagtatatgtaattg

SEQ ID NO: 7239844 - DNA, 22 bp, Homo sapiens
cctgcagccgtcctgtttgtct

SEQ ID NO: 7239845 - DNA, 23 bp, Homo sapiens
aggtaggttattgctgctacctg

SEQ ID NO: 7239846 - DNA, 23 bp, Homo sapiens
ataagaaaacagtaggctcagag

SEQ ID NO: 7239847 - DNA, 22 bp, Homo sapiens
ataaatgaacattcacagagct

SEQ ID NO: 7239848 - DNA, 22 bp, Homo sapiens
ataaatgattcagcaggaaata

SEQ ID NO: 7239849 - DNA, 22 bp, Homo sapiens
agttatttactcctttgtctct

SEQ ID NO: 7239850 - DNA, 22 bp, Homo sapiens
agttatttaaaatgattgtcct

SEQ ID NO: 7239851 - DNA, 22 bp, Homo sapiens
ctgtgggagaagctagcacagg

SEQ ID NO: 7239852 - DNA, 22 bp, Homo sapiens
atatgcatatgtcaaaacttat

SEQ ID NO: 7239853 - DNA, 22 bp, Homo sapiens
atcaaagtttcccagaagttgt

SEQ ID NO: 7239854 - DNA, 22 bp, Homo sapiens
atattgagatgaggatattaac

SEQ ID NO: 7239855 - DNA, 22 bp, Homo sapiens
atattgagataagaactgacat

SEQ ID NO: 7239856 - DNA, 22 bp, Homo sapiens
atcaaagtccatcagaaggtag

SEQ ID NO: 7239857 - DNA, 22 bp, Homo sapiens
atcaaagttcgtaactgataac

SEQ ID NO: 7239858 - DNA, 22 bp, Homo sapiens
atcaaagagcttgacaatccta

SEQ ID NO: 7239859 - DNA, 22 bp, Homo sapiens
atggttaaattggttatttatg

SEQ ID NO: 7239860 - DNA, 18 bp, Homo sapiens
atggtctcatactgggag

SEQ ID NO: 7239861 - DNA, 22 bp, Homo sapiens
gatatgaagtggcattgtgaag

SEQ ID NO: 7239862 - DNA, 22 bp, Homo sapiens
atgtgtccttgttcccattcca

SEQ ID NO: 7239863 - DNA, 22 bp, Homo sapiens
atgtgtccttataagaagaaga

SEQ ID NO: 7239864 - DNA, 22 bp, Homo sapiens
atgtcctcttctgcctcaggcc

SEQ ID NO: 7239865 - DNA, 22 bp, Homo sapiens
atgtcctcggctctgtgctgct

SEQ ID NO: 7239866 - DNA, 20 bp, Homo sapiens
atgtcctcagccactgccct

SEQ ID NO: 7239867 - DNA, 22 bp, Homo sapiens
atgtcctcaaaactgattgcag

SEQ ID NO: 7239868 - DNA, 22 bp, Homo sapiens
gagggcagagacagtgattcac

SEQ ID NO: 7239869 - DNA, 22 bp, Homo sapiens
atgacaggaggcagctgggcag

SEQ ID NO: 7239870 - DNA, 22 bp, Homo sapiens
atgatcatacagagccctggta

SEQ ID NO: 7239871 - DNA, 22 bp, Homo sapiens
atgaagacaaactgggtagaaa

SEQ ID NO: 7239872 - DNA, 22 bp, Homo sapiens
cttctttaatgtatacaaaaga

SEQ ID NO: 7239873 - DNA, 22 bp, Homo sapiens
cttctttactttctagaaataa

SEQ ID NO: 7239874 - DNA, 22 bp, Homo sapiens
gaccttgtgatctgcctgcctt

SEQ ID NO: 7239875 - DNA, 22 bp, Homo sapiens
gaccttgtgatccgcccgcctt

SEQ ID NO: 7239876 - DNA, 22 bp, Homo sapiens
gaccttgtgatccccctgcctt

SEQ ID NO: 7239877 - DNA, 22 bp, Homo sapiens
gaccttgtgatccacctgcctt

SEQ ID NO: 7239878 - DNA, 22 bp, Homo sapiens
gacatttattagaaaactatca

SEQ ID NO: 7239879 - DNA, 18 bp, Homo sapiens
gctctggttccttcaacc

SEQ ID NO: 7239880 - DNA, 22 bp, Homo sapiens
gctctggttccagttccgcacc

SEQ ID NO: 7239881 - DNA, 22 bp, Homo sapiens
gcctcaagacatttttaattgc

SEQ ID NO: 7239882 - DNA, 22 bp, Homo sapiens
gccaggtggctgagcagctgca

SEQ ID NO: 7239883 - DNA, 22 bp, Homo sapiens
attacctatttcattttctgtc

SEQ ID NO: 7239884 - DNA, 22 bp, Homo sapiens
gcactaaaccaacatgtaataa

SEQ ID NO: 7239885 - DNA, 22 bp, Homo sapiens
gcatatgatcacgtgtgtcggt

SEQ ID NO: 7239886 - DNA, 22 bp, Homo sapiens
caatgtttgagtaggagcataa

SEQ ID NO: 7239887 - DNA, 22 bp, Homo sapiens
gctgttcacggaggaggatggg

SEQ ID NO: 7239888 - DNA, 19 bp, Homo sapiens
caagggttgggtctgtcat

SEQ ID NO: 7239889 - DNA, 23 bp, Homo sapiens
ggagctgctgttgggggagctgc

SEQ ID NO: 7239890 - DNA, 22 bp, Homo sapiens
caatgttttcaactgacaagta

SEQ ID NO: 7239891 - DNA, 22 bp, Homo sapiens
cacagacagtgtccctttgttg

SEQ ID NO: 7239892 - DNA, 22 bp, Homo sapiens
ggctcagggaatgaggaagaat

SEQ ID NO: 7239893 - DNA, 22 bp, Homo sapiens
ggctctggtgagggtaggagat

SEQ ID NO: 7239894 - DNA, 22 bp, Homo sapiens
ggctctggtgccctggctccca

SEQ ID NO: 7239895 - DNA, 22 bp, Homo sapiens
ggctctggtggcaattgactgg

SEQ ID NO: 7239896 - DNA, 22 bp, Homo sapiens
ggctctggtgggaaggttagat

SEQ ID NO: 7239897 - DNA, 20 bp, Homo sapiens
ggctctggaatctggtgggc

SEQ ID NO: 7239898 - DNA, 22 bp, Homo sapiens
ggctctgggttctgcaatgcgt

SEQ ID NO: 7239899 - DNA, 22 bp, Homo sapiens
ggctctggaatgtgtagtcagg

SEQ ID NO: 7239900 - DNA, 22 bp, Homo sapiens
ggctctggtcagtgaggggcct

SEQ ID NO: 7239901 - DNA, 23 bp, Homo sapiens
cagaaataaactggtttgtagat

SEQ ID NO: 7239902 - DNA, 22 bp, Homo sapiens
ggcagggcaggaaagtcaggaa

SEQ ID NO: 7239903 - DNA, 22 bp, Homo sapiens
ggcagggcagcgctgattaggg

SEQ ID NO: 7239904 - DNA, 22 bp, Homo sapiens
ggcaggtgcacctgagccatct

SEQ ID NO: 7239905 - DNA, 22 bp, Homo sapiens
ggcaggtgatctagagtcaata

SEQ ID NO: 7239906 - DNA, 22 bp, Homo sapiens
ggcaggtgccagttggcttggg

SEQ ID NO: 7239907 - DNA, 22 bp, Homo sapiens
ggcaggtgcccagagagcacga

SEQ ID NO: 7239908 - DNA, 22 bp, Homo sapiens
ggcaggtgccttctgtgctagc

SEQ ID NO: 7239909 - DNA, 22 bp, Homo sapiens
cagcctgcagggctgcctgttg

SEQ ID NO: 7239910 - DNA, 21 bp, Homo sapiens
gggcaggtctctgatgtcaac

SEQ ID NO: 7239911 - DNA, 22 bp, Homo sapiens
gggcaggtatttatcttctatt

SEQ ID NO: 7239912 - DNA, 22 bp, Homo sapiens
cagacagggtcctgtccgtcac

SEQ ID NO: 7239913 - DNA, 22 bp, Homo sapiens
cagagctgggatcccatgggcg

SEQ ID NO: 7239914 - DNA, 22 bp, Homo sapiens
gggctctgtttagaccagagat

SEQ ID NO: 7239915 - DNA, 22 bp, Homo sapiens
gggctctgtttagatcagagat

SEQ ID NO: 7239916 - DNA, 20 bp, Homo sapiens
gggctctgcttggcagaagt

SEQ ID NO: 7239917 - DNA, 22 bp, Homo sapiens
gggctctgcgggcccggactcc

SEQ ID NO: 7239918 - DNA, 22 bp, Homo sapiens
ggggagcttggttattcatgca

SEQ ID NO: 7239919 - DNA, 22 bp, Homo sapiens
ggggagcttcaggtggcttaca

SEQ ID NO: 7239920 - DNA, 22 bp, Homo sapiens
ggggagctgggaggtgagttac

SEQ ID NO: 7239921 - DNA, 22 bp, Homo sapiens
ggtcaggtaggaagttaactat

SEQ ID NO: 7239922 - DNA, 22 bp, Homo sapiens
ggtgacatgcacctatcccttg

SEQ ID NO: 7239923 - DNA, 22 bp, Homo sapiens
ggtgacattatcattattttaa

SEQ ID NO: 7239924 - DNA, 22 bp, Homo sapiens
ggtgacatagttacttcaggct

SEQ ID NO: 7239925 - DNA, 22 bp, Homo sapiens
ggtgacatcagtaaccgtggtt

SEQ ID NO: 7239926 - DNA, 22 bp, Homo sapiens
ggtgacatctagagacatccaa

SEQ ID NO: 7239927 - DNA, 22 bp, Homo sapiens
cagggctgtggctttgtgctgt

SEQ ID NO: 7239928 - DNA, 22 bp, Homo sapiens
tattttatctgccagagtggag

SEQ ID NO: 7239929 - DNA, 19 bp, Homo sapiens
caggtggtaatctgagcct

SEQ ID NO: 7239930 - DNA, 22 bp, Homo sapiens
caggtggtcaggcaaggacacg

SEQ ID NO: 7239931 - DNA, 23 bp, Homo sapiens
caggtggtagagaaaaatccaga

SEQ ID NO: 7239932 - DNA, 22 bp, Homo sapiens
caggtggtacttaaagtcagaa

SEQ ID NO: 7239933 - DNA, 22 bp, Homo sapiens
caggtagtccacagtgagggag

SEQ ID NO: 7239934 - DNA, 22 bp, Homo sapiens
taagtcgtggatgattcttcgg

SEQ ID NO: 7239935 - DNA, 22 bp, Homo sapiens
taatgtgatattcctgtccttt

SEQ ID NO: 7239936 - DNA, 22 bp, Homo sapiens
taatgtgaagacataaatcaga

SEQ ID NO: 7239937 - DNA, 22 bp, Homo sapiens
tagattcagatatttaggacaa

SEQ ID NO: 7239938 - DNA, 22 bp, Homo sapiens
cattgttatagcattacacacc

SEQ ID NO: 7239939 - DNA, 22 bp, Homo sapiens
tccttggggacgctgacatcgt

SEQ ID NO: 7239940 - DNA, 22 bp, Homo sapiens
ccactgctagagatgcatcccc

SEQ ID NO: 7239941 - DNA, 22 bp, Homo sapiens
ccagacagttccttgaggttca

SEQ ID NO: 7239942 - DNA, 22 bp, Homo sapiens
tcctggctcctgatctgtcact

SEQ ID NO: 7239943 - DNA, 22 bp, Homo sapiens
tcagagtttgtactgacaggag

SEQ ID NO: 7239944 - DNA, 22 bp, Homo sapiens
tcaggtgtattgatgtctgtga

SEQ ID NO: 7239945 - DNA, 22 bp, Homo sapiens
tcaggtgtatcatggagttgaa

SEQ ID NO: 7239946 - DNA, 22 bp, Homo sapiens
tcaggtgtatcatggagttgaa

SEQ ID NO: 7239947 - DNA, 22 bp, Homo sapiens
catctggtttaaaagaagaaag

SEQ ID NO: 7239948 - DNA, 22 bp, Homo sapiens
catctggttagttgatgaaact

SEQ ID NO: 7239949 - DNA, 22 bp, Homo sapiens
catgaaatttgaagtacagcaa

SEQ ID NO: 7239950 - DNA, 22 bp, Homo sapiens
catgaaattgtattggcctcaa

SEQ ID NO: 7239951 - DNA, 22 bp, Homo sapiens
catgaacagctaacattttggg

SEQ ID NO: 7239952 - DNA, 22 bp, Homo sapiens
catggcaggatctgggcccaca

SEQ ID NO: 7239953 - DNA, 19 bp, Homo sapiens
ccctcttgcacaaagcaaa

SEQ ID NO: 7239954 - DNA, 18 bp, Homo sapiens
cccggctaatttttggta

SEQ ID NO: 7239955 - DNA, 19 bp, Homo sapiens
tggctctgtcgaaggcaca

SEQ ID NO: 7239956 - DNA, 22 bp, Homo sapiens
cctgagcatcagcgcctcctta

SEQ ID NO: 7239957 - DNA, 22 bp, Homo sapiens
tggctctgtcaaactgcacaca

SEQ ID NO: 7239958 - DNA, 21 bp, Homo sapiens
tggctctgggtaggagagtgc

SEQ ID NO: 7239959 - DNA, 22 bp, Homo sapiens
tggctctggggacagtaagtcc

SEQ ID NO: 7239960 - DNA, 22 bp, Homo sapiens
tggctctgaccaggtagaggag

SEQ ID NO: 7239961 - DNA, 22 bp, Homo sapiens
cctcatttatagccaaagtaaa

SEQ ID NO: 7239962 - DNA, 22 bp, Homo sapiens
tggcagggttggccaccttacc

SEQ ID NO: 7239963 - DNA, 22 bp, Homo sapiens
tggcagggtgggcttcagcccc

SEQ ID NO: 7239964 - DNA, 22 bp, Homo sapiens
tggcaggtacccattggctgta

SEQ ID NO: 7239965 - DNA, 18 bp, Homo sapiens
tggcaggtagactcaggt

SEQ ID NO: 7239966 - DNA, 22 bp, Homo sapiens
tggcaggtagagttctgagatg

SEQ ID NO: 7239967 - DNA, 22 bp, Homo sapiens
tggcaggtagtcagaggcgaca

SEQ ID NO: 7239968 - DNA, 22 bp, Homo sapiens
tctgctttcttgcgcagatgtg

SEQ ID NO: 7239969 - DNA, 22 bp, Homo sapiens
tctgctttcttactaaaaatga

SEQ ID NO: 7239970 - DNA, 22 bp, Homo sapiens
tctgctttcaaattcacttagt

SEQ ID NO: 7239971 - DNA, 22 bp, Homo sapiens
tctgctttattacactagccaa

SEQ ID NO: 7239972 - DNA, 22 bp, Homo sapiens
tctgctttatggctcagagact

SEQ ID NO: 7239973 - DNA, 22 bp, Homo sapiens
tctgctttagtgcaaagtctta

SEQ ID NO: 7239974 - DNA, 22 bp, Homo sapiens
tctgctttagacataaaaggta

SEQ ID NO: 7239975 - DNA, 22 bp, Homo sapiens
tctgctttagaatccagtagct

SEQ ID NO: 7239976 - DNA, 22 bp, Homo sapiens
tctgctttgaccttcttgatgc

SEQ ID NO: 7239977 - DNA, 22 bp, Homo sapiens
tctgctttgctgcctcctgatc

SEQ ID NO: 7239978 - DNA, 22 bp, Homo sapiens
tctgctttttcattgactgaaa

SEQ ID NO: 7239979 - DNA, 22 bp, Homo sapiens
tctggttgtcgaccaccaatgc

SEQ ID NO: 7239980 - DNA, 22 bp, Homo sapiens
tctggtgtcagtattctttgaa

SEQ ID NO: 7239981 - DNA, 22 bp, Homo sapiens
ccagggcttcagaggttttggc

SEQ ID NO: 7239982 - DNA, 22 bp, Homo sapiens
ccaggtgggcgtgtcttcacct

SEQ ID NO: 7239983 - DNA, 22 bp, Homo sapiens
ccaggtgtaagacatggtccta

SEQ ID NO: 7239984 - DNA, 22 bp, Homo sapiens
ccaggtgtagcactgctcacag

SEQ ID NO: 7239985 - DNA, 22 bp, Homo sapiens
ccaggtgtcatggataatgggt

SEQ ID NO: 7239986 - DNA, 22 bp, Homo sapiens
ccaggtgtcatggataatgggt

SEQ ID NO: 7239987 - DNA, 22 bp, Homo sapiens
ccaggtgtcatgcgtgtgaccc

SEQ ID NO: 7239988 - DNA, 22 bp, Homo sapiens
ccaggtgtaggacaccaaggga

SEQ ID NO: 7239989 - DNA, 22 bp, Homo sapiens
ccaggtgtccccgtcactgcag

SEQ ID NO: 7239990 - DNA, 22 bp, Homo sapiens
ccaggtgtctgtctctttttca

SEQ ID NO: 7239991 - DNA, 22 bp, Homo sapiens
ccaggtgtccccgtcactgcag

SEQ ID NO: 7239992 - DNA, 22 bp, Homo sapiens
ccaggtgtgagcattctgtctt

SEQ ID NO: 7239993 - DNA, 22 bp, Homo sapiens
ccaggtgtctgtctctttttca

SEQ ID NO: 7239994 - DNA, 22 bp, Homo sapiens
ccaggtgtctgtggccagccct

SEQ ID NO: 7239995 - DNA, 22 bp, Homo sapiens
ccaggtgtgatttggcagtgtc

SEQ ID NO: 7239996 - DNA, 22 bp, Homo sapiens
ccaggtgtgatttcatctgagg

SEQ ID NO: 7239997 - DNA, 22 bp, Homo sapiens
ccaggtgtgatttcatctgagg

SEQ ID NO: 7239998 - DNA, 22 bp, Homo sapiens
ccaggtgtgccagcagggactg

SEQ ID NO: 7239999 - DNA, 22 bp, Homo sapiens
ccaggtgtgctctgcagtggat

SEQ ID NO: 7240000 - DNA, 22 bp, Homo sapiens
ccaggtgtggccacatggctgg

SEQ ID NO: 7240001 - DNA, 22 bp, Homo sapiens
ccaggtgtggggaggactcaca

SEQ ID NO: 7240002 - DNA, 22 bp, Homo sapiens
ccaggtgtggccacatggctgg

SEQ ID NO: 7240003 - DNA, 22 bp, Homo sapiens
ccaggtgtgtacagaacagcac

SEQ ID NO: 7240004 - DNA, 22 bp, Homo sapiens
ccaggtgtggtggcatacacct

SEQ ID NO: 7240005 - DNA, 22 bp, Homo sapiens
ccaggtgtggtggcatacacct

SEQ ID NO: 7240006 - DNA, 19 bp, Homo sapiens
ccaggtggaactgaggtag

SEQ ID NO: 7240007 - DNA, 22 bp, Homo sapiens
ccaggtggaaggtctgtgctct

SEQ ID NO: 7240008 - DNA, 17 bp, Homo sapiens
ccaggtggaatcgtgga

SEQ ID NO: 7240009 - DNA, 22 bp, Homo sapiens
ccaggtggacaaggctttcaca

SEQ ID NO: 7240010 - DNA, 22 bp, Homo sapiens
ccaggtggacggcgagtacagg

SEQ ID NO: 7240011 - DNA, 17 bp, Homo sapiens
tgagaagtaggcatcat

SEQ ID NO: 7240012 - DNA, 22 bp, Homo sapiens
ccatgtgttgattctctgcaga

SEQ ID NO: 7240013 - DNA, 22 bp, Homo sapiens
ccatgtgttgagattccagcct

SEQ ID NO: 7240014 - DNA, 18 bp, Homo sapiens
ccatgtgttccttttggg

SEQ ID NO: 7240015 - DNA, 22 bp, Homo sapiens
ccatgtgttcaataagggagtt

SEQ ID NO: 7240016 - DNA, 22 bp, Homo sapiens
ccatgtgtctcccctggaagta

SEQ ID NO: 7240017 - DNA, 22 bp, Homo sapiens
ccatgtgtcgggcctgcagtgg

SEQ ID NO: 7240018 - DNA, 22 bp, Homo sapiens
ccatgtgtaaattagataactc

SEQ ID NO: 7240019 - DNA, 22 bp, Homo sapiens
tgtttataaattttcttgccat

SEQ ID NO: 7240020 - DNA, 20 bp, Homo sapiens
ttactaatctcaatgacctg

SEQ ID NO: 7240021 - DNA, 22 bp, Homo sapiens
tgttcattagtggaagtaagtt

SEQ ID NO: 7240022 - DNA, 22 bp, Homo sapiens
tgttcattaaactactgtgtgg

SEQ ID NO: 7240023 - DNA, 22 bp, Homo sapiens
tgttcattctgtatatgctgta

SEQ ID NO: 7240024 - DNA, 21 bp, Homo sapiens
cctggttggcgtagctcagtc

SEQ ID NO: 7240025 - DNA, 22 bp, Homo sapiens
cctggttgagggaggtgtggac

SEQ ID NO: 7240026 - DNA, 21 bp, Homo sapiens
tgggggagaattggttgcttt

SEQ ID NO: 7240027 - DNA, 22 bp, Homo sapiens
ttcaagtttttaaaggcagtta

SEQ ID NO: 7240028 - DNA, 22 bp, Homo sapiens
cgcaggtgttcagtaaatgtat

SEQ ID NO: 7240029 - DNA, 22 bp, Homo sapiens
cgcaggtgtgttttcaggacta

SEQ ID NO: 7240030 - DNA, 22 bp, Homo sapiens
cgcaggtgggcccttcattgat

SEQ ID NO: 7240031 - DNA, 19 bp, Homo sapiens
cgcaggtggaaggagccgc

SEQ ID NO: 7240032 - DNA, 22 bp, Homo sapiens
cgcaggtgccggcagatggggt

SEQ ID NO: 7240033 - DNA, 22 bp, Homo sapiens
ttcagaggttagagcagtggga

SEQ ID NO: 7240034 - DNA, 22 bp, Homo sapiens
ctagatgccaatttttatggat

SEQ ID NO: 7240035 - DNA, 22 bp, Homo sapiens
ctcatttaacagattaaaaagt

SEQ ID NO: 7240036 - DNA, 22 bp, Homo sapiens
ttgtggggtgatttgccacggg

SEQ ID NO: 7240037 - DNA, 22 bp, Homo sapiens
ttgtgggggctgccctgtacgg

SEQ ID NO: 7240038 - DNA, 22 bp, Homo sapiens
ttgtggggttggcagttcttta

SEQ ID NO: 7240039 - DNA, 20 bp, Homo sapiens
ttgtgggggcaatggtatgc

SEQ ID NO: 7240040 - DNA, 22 bp, Homo sapiens
ttgtggggccccaatgttgctg

SEQ ID NO: 7240041 - DNA, 22 bp, Homo sapiens
ttgtggggcaacagcaggtgaa

SEQ ID NO: 7240042 - DNA, 22 bp, Homo sapiens
ttgtggggaggatttgatgaga

SEQ ID NO: 7240043 - DNA, 22 bp, Homo sapiens
ttgtggggaacccctgtcccac

SEQ ID NO: 7240044 - DNA, 22 bp, Homo sapiens
ttgtggggaaacactgtttctt

SEQ ID NO: 7240045 - DNA, 22 bp, Homo sapiens
ttgtgggcttgcctggctcttg

SEQ ID NO: 7240046 - DNA, 22 bp, Homo sapiens
ttgtctttcccagcttctagag

SEQ ID NO: 7240047 - DNA, 22 bp, Homo sapiens
tttatttaaagtcgtgtgttaa

SEQ ID NO: 7240048 - DNA, 21 bp, Homo sapiens
tttagagaatactcactattt

SEQ ID NO: 7240049 - DNA, 22 bp, Homo sapiens
ctgaggccggagcactgaagag

SEQ ID NO: 7240050 - DNA, 22 bp, Homo sapiens
ctgcaccgtgtctcgggctgcc

SEQ ID NO: 7240051 - DNA, 22 bp, Homo sapiens
ctgacagatgctgctggcagta

SEQ ID NO: 7240052 - DNA, 22 bp, Homo sapiens
ctgacatttactgagcacttac

SEQ ID NO: 7240053 - DNA, 22 bp, Homo sapiens
tttgggaaccagaagttcaaaa

SEQ ID NO: 7240054 - DNA, 22 bp, Homo sapiens
tttgggaacaatgaggatctga

SEQ ID NO: 7240055 - DNA, 22 bp, Homo sapiens
tttgggaacaatgaggatctga

SEQ ID NO: 7240056 - DNA, 20 bp, Homo sapiens
tttgggaaatgcaggtttca

SEQ ID NO: 7240057 - DNA, 20 bp, Homo sapiens
tttgggaaatgcaggtttca

SEQ ID NO: 7240058 - DNA, 22 bp, Homo sapiens
tttgggaaatattgtgttcaag

SEQ ID NO: 7240059 - DNA, 22 bp, Homo sapiens
tttgggaaataaacctagagga

SEQ ID NO: 7240060 - DNA, 22 bp, Homo sapiens
tttgggaaatagtagaaaatgt

SEQ ID NO: 7240061 - DNA, 22 bp, Homo sapiens
tttgggaaatattgtgttcaag

SEQ ID NO: 7240062 - DNA, 22 bp, Homo sapiens
tttgggaaatagtagaaaatgt

SEQ ID NO: 7240063 - DNA, 22 bp, Homo sapiens
tttgggaagtgggagcaaggtg

SEQ ID NO: 7240064 - DNA, 23 bp, Homo sapiens
tttgggaagggagagagtaagca

SEQ ID NO: 7240065 - DNA, 22 bp, Homo sapiens
tttgggaaggcagacatcccac

SEQ ID NO: 7240066 - DNA, 19 bp, Homo sapiens
tttgggaagcccagagtgt

SEQ ID NO: 7240067 - DNA, 22 bp, Homo sapiens
tttgggaactggacttcctgct

SEQ ID NO: 7240068 - DNA, 22 bp, Homo sapiens
tttgggaagaggaatctctgga

SEQ ID NO: 7240069 - DNA, 22 bp, Homo sapiens
tttgggaacttaattatgtctg

SEQ ID NO: 7240070 - DNA, 22 bp, Homo sapiens
tttgggaattgtagctgtcttg

SEQ ID NO: 7240071 - DNA, 22 bp, Homo sapiens
tttgggaataattgcacagatt

SEQ ID NO: 7240072 - DNA, 22 bp, Homo sapiens
tttgggaagtttaaaataagta

SEQ ID NO: 7240073 - DNA, 22 bp, Homo sapiens
ttttagtaccaaccagaagatg

SEQ ID NO: 7240074 - DNA, 20 bp, Homo sapiens
ctcttcaaatattttattct

SEQ ID NO: 7240075 - DNA, 22 bp, Homo sapiens
ctggctgcgtctgctctgacag

SEQ ID NO: 7240076 - DNA, 22 bp, Homo sapiens
ctgtgtccttttagttgctgtg

SEQ ID NO: 7240077 - DNA, 22 bp, Homo sapiens
ctgtgtcctttaaaaaagacac

SEQ ID NO: 7240078 - DNA, 22 bp, Homo sapiens
ctgtgtcctgtctcctaaggtg

SEQ ID NO: 7240079 - DNA, 22 bp, Homo sapiens
ctgtgtcctgcgtcaagccaat

SEQ ID NO: 7240080 - DNA, 22 bp, Homo sapiens
ctgtgtcctcccgctgcaccca

SEQ ID NO: 7240081 - DNA, 22 bp, Homo sapiens
ctgttgcagaggggcggagagg

SEQ ID NO: 7240082 - DNA, 22 bp, Homo sapiens
cttattggtgctttttctcata

SEQ ID NO: 7240083 - DNA, 22 bp, Homo sapiens
cttattgaaagcccctgtgcct

SEQ ID NO: 7240084 - DNA, 22 bp, Homo sapiens
cttcaaaagccagaagcctgcg

SEQ ID NO: 7240085 - DNA, 22 bp, Homo sapiens
gaggcactgcagtacagtgact

SEQ ID NO: 7240086 - DNA, 22 bp, Homo sapiens
gagatgaatgtaaacaaaggca

SEQ ID NO: 7240087 - DNA, 22 bp, Homo sapiens
gagatgaatcattccatggtca

SEQ ID NO: 7240088 - DNA, 22 bp, Homo sapiens
gacaggctgtgatggccgggag

SEQ ID NO: 7240089 - DNA, 22 bp, Homo sapiens
gacaggcttcatgatggcagga

SEQ ID NO: 7240090 - DNA, 22 bp, Homo sapiens
gacagtagtaaagctaggacca

SEQ ID NO: 7240091 - DNA, 18 bp, Homo sapiens
gacaggtgggtgagacca

SEQ ID NO: 7240092 - DNA, 22 bp, Homo sapiens
gacaggtgggtacctttatgga

SEQ ID NO: 7240093 - DNA, 22 bp, Homo sapiens
gacaggtggggaaactaaggta

SEQ ID NO: 7240094 - DNA, 22 bp, Homo sapiens
gacaggtgctaagggacctggc

SEQ ID NO: 7240095 - DNA, 22 bp, Homo sapiens
gacaggtgtgtgtatattaggg

SEQ ID NO: 7240096 - DNA, 22 bp, Homo sapiens
gacaggtgtgatgatttaggct

SEQ ID NO: 7240097 - DNA, 22 bp, Homo sapiens
gacaggtgggttctcgtatctg

SEQ ID NO: 7240098 - DNA, 22 bp, Homo sapiens
gacaggtgagatgaggaacacc

SEQ ID NO: 7240099 - DNA, 22 bp, Homo sapiens
gacaggtgaaacagcaaggtaa

SEQ ID NO: 7240100 - DNA, 20 bp, Homo sapiens
gacaggtgctaaagaggggc

SEQ ID NO: 7240101 - DNA, 21 bp, Homo sapiens
gacaggtgattcagagcaggg

SEQ ID NO: 7240102 - DNA, 22 bp, Homo sapiens
gacagggtccaaaggcagggga

SEQ ID NO: 7240103 - DNA, 20 bp, Homo sapiens
gcagagtgtgagagggtgaa

SEQ ID NO: 7240104 - DNA, 22 bp, Homo sapiens
gcagaggcagggccctcctcca

SEQ ID NO: 7240105 - DNA, 19 bp, Homo sapiens
gcagacaggtccagagagg

SEQ ID NO: 7240106 - DNA, 22 bp, Homo sapiens
gcagggacaaggcaggtgttct

SEQ ID NO: 7240107 - DNA, 20 bp, Homo sapiens
gcctgagctccgcctcctgt

SEQ ID NO: 7240108 - DNA, 22 bp, Homo sapiens
gcctctgggtgacgaaaggtga

SEQ ID NO: 7240109 - DNA, 22 bp, Homo sapiens
gcgtctcaaggcccccaggcca

SEQ ID NO: 7240110 - DNA, 22 bp, Homo sapiens
gctctgggaattcagaaagcct

SEQ ID NO: 7240111 - DNA, 22 bp, Homo sapiens
gctgctttacaggtgggggagc

SEQ ID NO: 7240112 - DNA, 22 bp, Homo sapiens
gctgctttaactggacggctcc

SEQ ID NO: 7240113 - DNA, 22 bp, Homo sapiens
gctgctttaaaatcagcatagc

SEQ ID NO: 7240114 - DNA, 22 bp, Homo sapiens
gctgctttagaattgaaacaga

SEQ ID NO: 7240115 - DNA, 22 bp, Homo sapiens
gctgctttactgaagagatatg

SEQ ID NO: 7240116 - DNA, 22 bp, Homo sapiens
gctgctttaggttgagctcagc

SEQ ID NO: 7240117 - DNA, 22 bp, Homo sapiens
gctgctttagacaggagaagca

SEQ ID NO: 7240118 - DNA, 22 bp, Homo sapiens
gctgctttataatctcggcaga

SEQ ID NO: 7240119 - DNA, 20 bp, Homo sapiens
gctgctttcaaatgacacgt

SEQ ID NO: 7240120 - DNA, 18 bp, Homo sapiens
gctttatttcttggggaa

SEQ ID NO: 7240121 - DNA, 22 bp, Homo sapiens
ggacacagtggaagacagcttg

SEQ ID NO: 7240122 - DNA, 22 bp, Homo sapiens
ggacaggtgactgcccagagtg

SEQ ID NO: 7240123 - DNA, 23 bp, Homo sapiens
ggacacaggccttgtctgcgcct

SEQ ID NO: 7240124 - DNA, 22 bp, Homo sapiens
ggacaggtgtgaggctggcaca

SEQ ID NO: 7240125 - DNA, 22 bp, Homo sapiens
ggacaggtgcaaagggcacatg

SEQ ID NO: 7240126 - DNA, 22 bp, Homo sapiens
ggacaggttcagcagtttataa

SEQ ID NO: 7240127 - DNA, 22 bp, Homo sapiens
ggaatgtgttcttactgtattt

SEQ ID NO: 7240128 - DNA, 22 bp, Homo sapiens
ggaatgctcagttcttggtgct

SEQ ID NO: 7240129 - DNA, 22 bp, Homo sapiens
ggacacagctgcagccacaccc

SEQ ID NO: 7240130 - DNA, 22 bp, Homo sapiens
gctttattttgtgagggattac

SEQ ID NO: 7240131 - DNA, 15 bp, Homo sapiens
ggcaggtggatcact

SEQ ID NO: 7240132 - DNA, 22 bp, Homo sapiens
ggcaggtggacgtgctaaagct

SEQ ID NO: 7240133 - DNA, 22 bp, Homo sapiens
ggcaggtggattttctactcta

SEQ ID NO: 7240134 - DNA, 22 bp, Homo sapiens
ggcaggtggcactgctgctccc

SEQ ID NO: 7240135 - DNA, 22 bp, Homo sapiens
ggcaggtgtgagatcgaggcca

SEQ ID NO: 7240136 - DNA, 22 bp, Homo sapiens
ggcaggtggccaagtgtctaag

SEQ ID NO: 7240137 - DNA, 22 bp, Homo sapiens
ggcaggtgggaaccctccccac

SEQ ID NO: 7240138 - DNA, 22 bp, Homo sapiens
ggcaggtggtaaggatttcata

SEQ ID NO: 7240139 - DNA, 21 bp, Homo sapiens
ggcaggtgggtctctgttgct

SEQ ID NO: 7240140 - DNA, 23 bp, Homo sapiens
ggagtgcaatggcgccatctcgg

SEQ ID NO: 7240141 - DNA, 22 bp, Homo sapiens
ggctctgggaaatggtcttcct

SEQ ID NO: 7240142 - DNA, 22 bp, Homo sapiens
ggctctggctcctggctttgtg

SEQ ID NO: 7240143 - DNA, 22 bp, Homo sapiens
ggctctggctactccaccctgt

SEQ ID NO: 7240144 - DNA, 22 bp, Homo sapiens
ggctctgggcatagaaggaagc

SEQ ID NO: 7240145 - DNA, 19 bp, Homo sapiens
ggctctggcggctgtagcc

SEQ ID NO: 7240146 - DNA, 22 bp, Homo sapiens
ggctctggcgtccaatggagcg

SEQ ID NO: 7240147 - DNA, 22 bp, Homo sapiens
ggctctggcaaggggaggctac

SEQ ID NO: 7240148 - DNA, 22 bp, Homo sapiens
ggctctggcggctctttcaata

SEQ ID NO: 7240149 - DNA, 22 bp, Homo sapiens
ggctctggcgagctttagtaca

SEQ ID NO: 7240150 - DNA, 22 bp, Homo sapiens
ggctctggagacatgtggagag

SEQ ID NO: 7240151 - DNA, 22 bp, Homo sapiens
ggctctggagcacagacgtctg

SEQ ID NO: 7240152 - DNA, 22 bp, Homo sapiens
ggctctggagatgtccgacctg

SEQ ID NO: 7240153 - DNA, 22 bp, Homo sapiens
ggctctgggccagagttggctt

SEQ ID NO: 7240154 - DNA, 23 bp, Homo sapiens
gggagctgtggtgaaaagaggtg

SEQ ID NO: 7240155 - DNA, 22 bp, Homo sapiens
gggagctgtgggattggttgag

SEQ ID NO: 7240156 - DNA, 19 bp, Homo sapiens
gggagctgtctgcccgtgg

SEQ ID NO: 7240157 - DNA, 22 bp, Homo sapiens
ggctttatagggtagaggatca

SEQ ID NO: 7240158 - DNA, 22 bp, Homo sapiens
gggacatggctaggattccaat

SEQ ID NO: 7240159 - DNA, 22 bp, Homo sapiens
gggacatggaggcgcgcaggca

SEQ ID NO: 7240160 - DNA, 22 bp, Homo sapiens
gggacatgaagcatcggaggca

SEQ ID NO: 7240161 - DNA, 22 bp, Homo sapiens
gggacatgcccctcagtgggtg

SEQ ID NO: 7240162 - DNA, 22 bp, Homo sapiens
gggacatgaggccatagtgatt

SEQ ID NO: 7240163 - DNA, 22 bp, Homo sapiens
gggagctggcggattccccagg

SEQ ID NO: 7240164 - DNA, 22 bp, Homo sapiens
gggagctggttcctgccctcca

SEQ ID NO: 7240165 - DNA, 22 bp, Homo sapiens
gggagctggggcatttataccc

SEQ ID NO: 7240166 - DNA, 22 bp, Homo sapiens
gggagctgggctggttttgctg

SEQ ID NO: 7240167 - DNA, 18 bp, Homo sapiens
gggagctgggaagctggt

SEQ ID NO: 7240168 - DNA, 22 bp, Homo sapiens
gggagctgtcatcagtgttgtc

SEQ ID NO: 7240169 - DNA, 22 bp, Homo sapiens
gggagctgtagtccagataccg

SEQ ID NO: 7240170 - DNA, 22 bp, Homo sapiens
gggagctgtaagggacaggtag

SEQ ID NO: 7240171 - DNA, 22 bp, Homo sapiens
ggtctggataattccagtacct

SEQ ID NO: 7240172 - DNA, 22 bp, Homo sapiens
ggtgtttaaaggctcagcagga

SEQ ID NO: 7240173 - DNA, 20 bp, Homo sapiens
ggtgtgttggttcagcatgg

SEQ ID NO: 7240174 - DNA, 22 bp, Homo sapiens
ggtgtccttgctccttcagctt

SEQ ID NO: 7240175 - DNA, 22 bp, Homo sapiens
ggtgtccttgcagaaggcggcg

SEQ ID NO: 7240176 - DNA, 22 bp, Homo sapiens
ggtgtccttcgtccgctggcat

SEQ ID NO: 7240177 - DNA, 22 bp, Homo sapiens
ggtgtccttagaaagcagacct

SEQ ID NO: 7240178 - DNA, 22 bp, Homo sapiens
ggtccttctgtaggggtcccct

SEQ ID NO: 7240179 - DNA, 22 bp, Homo sapiens
ggtagtcatggatagctatgag

SEQ ID NO: 7240180 - DNA, 22 bp, Homo sapiens
ggggctcttagagagcctagtg

SEQ ID NO: 7240181 - DNA, 22 bp, Homo sapiens
ggggctctgtgacagtaaccct

SEQ ID NO: 7240182 - DNA, 22 bp, Homo sapiens
ggggctctggagaaaggccagt

SEQ ID NO: 7240183 - DNA, 22 bp, Homo sapiens
ggggctctgctctgagccgtgt

SEQ ID NO: 7240184 - DNA, 22 bp, Homo sapiens
ggggctctgcctctcccacgcc

SEQ ID NO: 7240185 - DNA, 22 bp, Homo sapiens
ggggctctcaggtctccccaaa

SEQ ID NO: 7240186 - DNA, 22 bp, Homo sapiens
ggggctctaggtaaagcaacat

SEQ ID NO: 7240187 - DNA, 22 bp, Homo sapiens
ggggccgaccgcggttcaggcc

SEQ ID NO: 7240188 - DNA, 22 bp, Homo sapiens
ggggtgggcgtgcagggacacc

SEQ ID NO: 7240189 - DNA, 22 bp, Homo sapiens
gtccaaaagagccagccgggcg

SEQ ID NO: 7240190 - DNA, 22 bp, Homo sapiens
gtaaaacatgttttaactagga

SEQ ID NO: 7240191 - DNA, 22 bp, Homo sapiens
gtaaaacaagctttatggttcc

SEQ ID NO: 7240192 - DNA, 22 bp, Homo sapiens
gtgagcagctcagggtggtctc

SEQ ID NO: 7240193 - DNA, 22 bp, Homo sapiens
gtgagcaggatttcatggtgta

SEQ ID NO: 7240194 - DNA, 22 bp, Homo sapiens
gtgaagcacgctgccgcactgg

SEQ ID NO: 7240195 - DNA, 22 bp, Homo sapiens
gtgaagcacatgggcgttgggt

SEQ ID NO: 7240196 - DNA, 22 bp, Homo sapiens
gtgaagcatatgcttctctgcc

SEQ ID NO: 7240197 - DNA, 22 bp, Homo sapiens
gtgaagcataactgaaggattt

SEQ ID NO: 7240198 - DNA, 22 bp, Homo sapiens
gtgaagcagttgcgtgggttcc

SEQ ID NO: 7240199 - DNA, 22 bp, Homo sapiens
gtgaagcagggaaggaaaggat

SEQ ID NO: 7240200 - DNA, 22 bp, Homo sapiens
gtgaagcagagtgtggaagcaa

SEQ ID NO: 7240201 - DNA, 22 bp, Homo sapiens
gtgaagaccagggaacgctggc

SEQ ID NO: 7240202 - DNA, 22 bp, Homo sapiens
gtgaaatattttgtttatgtca

SEQ ID NO: 7240203 - DNA, 22 bp, Homo sapiens
gtctgctgtgccttggggaaaa

SEQ ID NO: 7240204 - DNA, 22 bp, Homo sapiens
gtctgctggcacgtcacagata

SEQ ID NO: 7240205 - DNA, 22 bp, Homo sapiens
tcccacaggagcctgagtccca

SEQ ID NO: 7240206 - DNA, 22 bp, Homo sapiens
tcactgtgtcctttctgcgtag

SEQ ID NO: 7240207 - DNA, 20 bp, Homo sapiens
tcagacagtcgcagttctgg

SEQ ID NO: 7240208 - DNA, 22 bp, Homo sapiens
tcagacagtcatcagagcttgt

SEQ ID NO: 7240209 - DNA, 22 bp, Homo sapiens
tcagacagggcttctcaaactt

SEQ ID NO: 7240210 - DNA, 22 bp, Homo sapiens
tcagacagggagtcagaaaata

SEQ ID NO: 7240211 - DNA, 22 bp, Homo sapiens
tcagacaggcttctttctccct

SEQ ID NO: 7240212 - DNA, 22 bp, Homo sapiens
tcagacaggctggacagcttgc

SEQ ID NO: 7240213 - DNA, 22 bp, Homo sapiens
tcagacaggcctctccagcctc

SEQ ID NO: 7240214 - DNA, 22 bp, Homo sapiens
tcagacagcttgggataactga

SEQ ID NO: 7240215 - DNA, 22 bp, Homo sapiens
tcagacagcttgcagggaggtg

SEQ ID NO: 7240216 - DNA, 22 bp, Homo sapiens
tcagacagtttgcagtgtgcct

SEQ ID NO: 7240217 - DNA, 22 bp, Homo sapiens
tcagacagtgtgatcagtctct

SEQ ID NO: 7240218 - DNA, 22 bp, Homo sapiens
tcagagaagacatcattgtgaa

SEQ ID NO: 7240219 - DNA, 22 bp, Homo sapiens
tcagagctaaggggagagcaaa

SEQ ID NO: 7240220 - DNA, 22 bp, Homo sapiens
tcacaagatggctgctgcagcc

SEQ ID NO: 7240221 - DNA, 22 bp, Homo sapiens
tcaggtggccaaatgggagcgc

SEQ ID NO: 7240222 - DNA, 22 bp, Homo sapiens
tcaggtgtcaagcagggagctg

SEQ ID NO: 7240223 - DNA, 22 bp, Homo sapiens
tcaggtgtattgatgtctgtga

SEQ ID NO: 7240224 - DNA, 21 bp, Homo sapiens
tcaggtggcagagtgtttatg

SEQ ID NO: 7240225 - DNA, 22 bp, Homo sapiens
tcaggtgtgggcagagaaacca

SEQ ID NO: 7240226 - DNA, 22 bp, Homo sapiens
tcaggtgtggaccgaggtcaga

SEQ ID NO: 7240227 - DNA, 23 bp, Homo sapiens
tcaggtgtgcggactgctgagtc

SEQ ID NO: 7240228 - DNA, 23 bp, Homo sapiens
tcaggtgtgcggactgctgagtc

SEQ ID NO: 7240229 - DNA, 16 bp, Homo sapiens
tcaggtgtgacttttt

SEQ ID NO: 7240230 - DNA, 16 bp, Homo sapiens
tcaggtgtgacttttt

SEQ ID NO: 7240231 - DNA, 22 bp, Homo sapiens
tcaggtgtgaactatttggaaa

SEQ ID NO: 7240232 - DNA, 22 bp, Homo sapiens
tcaggtgtgaactatttggaaa

SEQ ID NO: 7240233 - DNA, 22 bp, Homo sapiens
tcaggtgtcttgtgggatttta

SEQ ID NO: 7240234 - DNA, 22 bp, Homo sapiens
tcaggtgtcttgtgggatttta

SEQ ID NO: 7240235 - DNA, 22 bp, Homo sapiens
tcaggtgtctgcctctttgagt

SEQ ID NO: 7240236 - DNA, 22 bp, Homo sapiens
tcaggtgtctgcctctttgagt

SEQ ID NO: 7240237 - DNA, 22 bp, Homo sapiens
tcaggtgtctatctaacctggt

SEQ ID NO: 7240238 - DNA, 22 bp, Homo sapiens
tcaggtgtctatctaacctggt

SEQ ID NO: 7240239 - DNA, 22 bp, Homo sapiens
tcaggtgtcaagcagggagctg

SEQ ID NO: 7240240 - DNA, 22 bp, Homo sapiens
tcaggtgtgtggtggaaggcag

SEQ ID NO: 7240241 - DNA, 22 bp, Homo sapiens
tcaggtgtgtggtggaaggcag

SEQ ID NO: 7240242 - DNA, 22 bp, Homo sapiens
tcaggtgtgtggctctggacca

SEQ ID NO: 7240243 - DNA, 22 bp, Homo sapiens
tcaggtgtgtggctctggacca

SEQ ID NO: 7240244 - DNA, 22 bp, Homo sapiens
tcaggtgtggtcaccacagggt

SEQ ID NO: 7240245 - DNA, 22 bp, Homo sapiens
tcaggtgtggtcaccacagggt

SEQ ID NO: 7240246 - DNA, 22 bp, Homo sapiens
tcaggtgtgggcagagaaacca

SEQ ID NO: 7240247 - DNA, 22 bp, Homo sapiens
tcaggtgtggaccgaggtcaga

SEQ ID NO: 7240248 - DNA, 22 bp, Homo sapiens
tcaggtgtttaaggatagtgat

SEQ ID NO: 7240249 - DNA, 22 bp, Homo sapiens
tcaggtgttctccactcagttt

SEQ ID NO: 7240250 - DNA, 22 bp, Homo sapiens
tcaggtgttctccactcagttt

SEQ ID NO: 7240251 - DNA, 22 bp, Homo sapiens
tcaggtgttagaagaaatttca

SEQ ID NO: 7240252 - DNA, 22 bp, Homo sapiens
tcaggtgtgttgtattttacca

SEQ ID NO: 7240253 - DNA, 22 bp, Homo sapiens
tcaggtgtgttgtattttacca

SEQ ID NO: 7240254 - DNA, 22 bp, Homo sapiens
tcaggtgttagaagaaatttca

SEQ ID NO: 7240255 - DNA, 18 bp, Homo sapiens
tcaggtgttttctgtata

SEQ ID NO: 7240256 - DNA, 18 bp, Homo sapiens
tcaggtgttttctgtata

SEQ ID NO: 7240257 - DNA, 22 bp, Homo sapiens
tcaggtgtttctggagaagtaa

SEQ ID NO: 7240258 - DNA, 22 bp, Homo sapiens
tcaggtgtttctggagaagtaa

SEQ ID NO: 7240259 - DNA, 22 bp, Homo sapiens
tcaggtgtttaaggatagtgat

SEQ ID NO: 7240260 - DNA, 22 bp, Homo sapiens
tagaaacattcagttgcagtcc

SEQ ID NO: 7240261 - DNA, 22 bp, Homo sapiens
tagaaatgagccatggtagagc

SEQ ID NO: 7240262 - DNA, 22 bp, Homo sapiens
tagctttaatgagttggtaaga

SEQ ID NO: 7240263 - DNA, 22 bp, Homo sapiens
tagctgaatgccttggattttt

SEQ ID NO: 7240264 - DNA, 22 bp, Homo sapiens
taggcactagacatggttacca

SEQ ID NO: 7240265 - DNA, 22 bp, Homo sapiens
tagggcagagcttgtacacgat

SEQ ID NO: 7240266 - DNA, 22 bp, Homo sapiens
tagggcagagtccaggatgggc

SEQ ID NO: 7240267 - DNA, 22 bp, Homo sapiens
tataagaaacaaggcaaatttt

SEQ ID NO: 7240268 - DNA, 22 bp, Homo sapiens
tataaatgccaggactttagat

SEQ ID NO: 7240269 - DNA, 22 bp, Homo sapiens
taggtgtctttctgtccttgtt

SEQ ID NO: 7240270 - DNA, 22 bp, Homo sapiens
taggtgtcttgtgtatggtaca

SEQ ID NO: 7240271 - DNA, 22 bp, Homo sapiens
tataaatgcacttttgaaatat

SEQ ID NO: 7240272 - DNA, 22 bp, Homo sapiens
taggtggttgtctgctttccta

SEQ ID NO: 7240273 - DNA, 17 bp, Homo sapiens
taggtggttgctggtct

SEQ ID NO: 7240274 - DNA, 22 bp, Homo sapiens
taggtggttatgtcagcctaga

SEQ ID NO: 7240275 - DNA, 22 bp, Homo sapiens
taggtggttataaattcaaggc

SEQ ID NO: 7240276 - DNA, 22 bp, Homo sapiens
taggtggtgtgcgaagagcgtg

SEQ ID NO: 7240277 - DNA, 22 bp, Homo sapiens
taggtggtgggatatgagcatc

SEQ ID NO: 7240278 - DNA, 22 bp, Homo sapiens
taggtggtagagcctggcttgc

SEQ ID NO: 7240279 - DNA, 22 bp, Homo sapiens
taggtgtctaacaataagtgta

SEQ ID NO: 7240280 - DNA, 22 bp, Homo sapiens
taggtgtcctcgtccaaagatt

SEQ ID NO: 7240281 - DNA, 19 bp, Homo sapiens
taggtgtccgccggaggtg

SEQ ID NO: 7240282 - DNA, 22 bp, Homo sapiens
taggtgtccatatatgtgtgta

SEQ ID NO: 7240283 - DNA, 22 bp, Homo sapiens
taggtgtcaggtatagaattta

SEQ ID NO: 7240284 - DNA, 22 bp, Homo sapiens
taggtgtcaggcctcctccagc

SEQ ID NO: 7240285 - DNA, 22 bp, Homo sapiens
taggtgtcttgtcactaccgtt

SEQ ID NO: 7240286 - DNA, 22 bp, Homo sapiens
taggtgtctgtcctgggctgtg

SEQ ID NO: 7240287 - DNA, 22 bp, Homo sapiens
taggtgtctggacaactttgta

SEQ ID NO: 7240288 - DNA, 22 bp, Homo sapiens
taggtgtctgctcttatttaac

SEQ ID NO: 7240289 - DNA, 23 bp, Homo sapiens
taggtgtctagtgtccactatgt

SEQ ID NO: 7240290 - DNA, 22 bp, Homo sapiens
tatgagaaaataaatatctgtt

SEQ ID NO: 7240291 - DNA, 22 bp, Homo sapiens
tatccaattcaccattgatggg

SEQ ID NO: 7240292 - DNA, 22 bp, Homo sapiens
tatttataatctgccaaagaga

SEQ ID NO: 7240293 - DNA, 22 bp, Homo sapiens
tattgaagattttgtggttgct

SEQ ID NO: 7240294 - DNA, 22 bp, Homo sapiens
tatgaggtaggtattatactta

SEQ ID NO: 7240295 - DNA, 22 bp, Homo sapiens
tatgtcctgctactctctcatg

SEQ ID NO: 7240296 - DNA, 22 bp, Homo sapiens
tatgtgaatacagcagtggatg

SEQ ID NO: 7240297 - DNA, 18 bp, Homo sapiens
tatgtgtctgttacaact

SEQ ID NO: 7240298 - DNA, 22 bp, Homo sapiens
tatgtgtctttatctggctctt

SEQ ID NO: 7240299 - DNA, 18 bp, Homo sapiens
tatgtgtctgttacaact

SEQ ID NO: 7240300 - DNA, 22 bp, Homo sapiens
tatgtgtctgtcgtgcataaat

SEQ ID NO: 7240301 - DNA, 21 bp, Homo sapiens
tatgtgtctgtggaaaactag

SEQ ID NO: 7240302 - DNA, 16 bp, Homo sapiens
tatgtgtctcatctac

SEQ ID NO: 7240303 - DNA, 22 bp, Homo sapiens
tatgtgtctgtcgtgcataaat

SEQ ID NO: 7240304 - DNA, 16 bp, Homo sapiens
tatgtgtctcatctac

SEQ ID NO: 7240305 - DNA, 22 bp, Homo sapiens
tatgtgtctcagttgtgattga

SEQ ID NO: 7240306 - DNA, 22 bp, Homo sapiens
tatgtgtctcagttgtgattga

SEQ ID NO: 7240307 - DNA, 22 bp, Homo sapiens
tatgtgtcctgttaccggcagc

SEQ ID NO: 7240308 - DNA, 22 bp, Homo sapiens
tatgtgtcctaagcaatcatcc

SEQ ID NO: 7240309 - DNA, 23 bp, Homo sapiens
taaattgatggtatgggttaagc

SEQ ID NO: 7240310 - DNA, 22 bp, Homo sapiens
taaattgagattattagggtaa

SEQ ID NO: 7240311 - DNA, 22 bp, Homo sapiens
taaattgatcgtttgggatgaa

SEQ ID NO: 7240312 - DNA, 22 bp, Homo sapiens
taaattgttttctagaagttgt

SEQ ID NO: 7240313 - DNA, 22 bp, Homo sapiens
taaccatattttccattaagtt

SEQ ID NO: 7240314 - DNA, 22 bp, Homo sapiens
taaaatgtagcttctaggctgg

SEQ ID NO: 7240315 - DNA, 22 bp, Homo sapiens
gttttgctcatttggtccaagg

SEQ ID NO: 7240316 - DNA, 22 bp, Homo sapiens
tacagatagaattagtgagtta

SEQ ID NO: 7240317 - DNA, 22 bp, Homo sapiens
tacaggcactgaaatgcttatt

SEQ ID NO: 7240318 - DNA, 22 bp, Homo sapiens
tacaggcatgtagcatggtgat

SEQ ID NO: 7240319 - DNA, 22 bp, Homo sapiens
tacaggcatgaatgaaatctgt

SEQ ID NO: 7240320 - DNA, 22 bp, Homo sapiens
tacatagctcctagtgatgcat

SEQ ID NO: 7240321 - DNA, 22 bp, Homo sapiens
tacattctggaaaggcacagac

SEQ ID NO: 7240322 - DNA, 22 bp, Homo sapiens
taatgtttttctcaacattgct

SEQ ID NO: 7240323 - DNA, 22 bp, Homo sapiens
taatgtttgggaaggtgctttg

SEQ ID NO: 7240324 - DNA, 22 bp, Homo sapiens
taatgtttccagtctatgatgg

SEQ ID NO: 7240325 - DNA, 22 bp, Homo sapiens
ttagagaaaagcttgcttgctt

SEQ ID NO: 7240326 - DNA, 22 bp, Homo sapiens
ttactgttcctctctcaaagag

SEQ ID NO: 7240327 - DNA, 22 bp, Homo sapiens
ttactgttggtgtatccatagc

SEQ ID NO: 7240328 - DNA, 21 bp, Homo sapiens
ttaatttattcatgatagcta

SEQ ID NO: 7240329 - DNA, 22 bp, Homo sapiens
ttaacacatatttatcaattgc

SEQ ID NO: 7240330 - DNA, 22 bp, Homo sapiens
ttaaatgatgcatatcatttag

SEQ ID NO: 7240331 - DNA, 22 bp, Homo sapiens
ttaaatgaacgagatatgcaac

SEQ ID NO: 7240332 - DNA, 22 bp, Homo sapiens
ttaaatgacgggactgggtttt

SEQ ID NO: 7240333 - DNA, 22 bp, Homo sapiens
ttaaatgacttttattattctc

SEQ ID NO: 7240334 - DNA, 22 bp, Homo sapiens
ttaaatgacttttattattctc

SEQ ID NO: 7240335 - DNA, 22 bp, Homo sapiens
ttaatttatacataatcacagg

SEQ ID NO: 7240336 - DNA, 22 bp, Homo sapiens
tgtgtcctcatgaggtttgcag

SEQ ID NO: 7240337 - DNA, 22 bp, Homo sapiens
tgtgtcctcagggaagcagaga

SEQ ID NO: 7240338 - DNA, 22 bp, Homo sapiens
tgtgtcctcactgtatgcaagg

SEQ ID NO: 7240339 - DNA, 22 bp, Homo sapiens
tgtgtcctatgaaagagggtta

SEQ ID NO: 7240340 - DNA, 19 bp, Homo sapiens
tgtgtcctagcagccagtc

SEQ ID NO: 7240341 - DNA, 22 bp, Homo sapiens
tgtgtcctactgaggagctcct

SEQ ID NO: 7240342 - DNA, 21 bp, Homo sapiens
tgtgtcagtctttggaagcaa

SEQ ID NO: 7240343 - DNA, 22 bp, Homo sapiens
tgtgtcaggccttatcggtggc

SEQ ID NO: 7240344 - DNA, 22 bp, Homo sapiens
tgtgtcctttggaggatcagcg

SEQ ID NO: 7240345 - DNA, 22 bp, Homo sapiens
tgtgtcctttcttaagagtgag

SEQ ID NO: 7240346 - DNA, 22 bp, Homo sapiens
tgtgtcctttctaatgcccaga

SEQ ID NO: 7240347 - DNA, 22 bp, Homo sapiens
tgtgtccttctgggagtcccag

SEQ ID NO: 7240348 - DNA, 22 bp, Homo sapiens
tgtgtccttccagtttttcctg

SEQ ID NO: 7240349 - DNA, 22 bp, Homo sapiens
tgtgtccttatgaaaatactgt

SEQ ID NO: 7240350 - DNA, 23 bp, Homo sapiens
tgtgtccttaactgtatatacta

SEQ ID NO: 7240351 - DNA, 22 bp, Homo sapiens
tgtgtcctgcaggtgctgcctg

SEQ ID NO: 7240352 - DNA, 22 bp, Homo sapiens
tgtgtcctgcagacagactcag

SEQ ID NO: 7240353 - DNA, 22 bp, Homo sapiens
tgtgtcctcttacctctgaccc

SEQ ID NO: 7240354 - DNA, 22 bp, Homo sapiens
tgtgtcctccagggagatgtaa

SEQ ID NO: 7240355 - DNA, 22 bp, Homo sapiens
tgtgtcctcatgtggcagagag

SEQ ID NO: 7240356 - DNA, 22 bp, Homo sapiens
tgtgtcctgtccccttgctgct

SEQ ID NO: 7240357 - DNA, 22 bp, Homo sapiens
tgtgtcctggtgttaattttat

SEQ ID NO: 7240358 - DNA, 22 bp, Homo sapiens
tgtgtcctgtgatctctagggt

SEQ ID NO: 7240359 - DNA, 22 bp, Homo sapiens
tgtgtcctgtgcaaggggatga

SEQ ID NO: 7240360 - DNA, 22 bp, Homo sapiens
tgtgtcaggccttatcggtggc

SEQ ID NO: 7240361 - DNA, 20 bp, Homo sapiens
tgtgtcaggccctgattaaa

SEQ ID NO: 7240362 - DNA, 20 bp, Homo sapiens
tgtgtcaggccctgattaaa

SEQ ID NO: 7240363 - DNA, 22 bp, Homo sapiens
tgtgtcaggagatagcaaaggg

SEQ ID NO: 7240364 - DNA, 22 bp, Homo sapiens
tgtgtcagcatcctttgggaca

SEQ ID NO: 7240365 - DNA, 19 bp, Homo sapiens
tgtgtcagcagggggcttc

SEQ ID NO: 7240366 - DNA, 22 bp, Homo sapiens
tgtgtcagcaggggagggaact

SEQ ID NO: 7240367 - DNA, 22 bp, Homo sapiens
tgtgtcagcacagtatcaatta

SEQ ID NO: 7240368 - DNA, 19 bp, Homo sapiens
tgtgtcagatttgctcctt

SEQ ID NO: 7240369 - DNA, 22 bp, Homo sapiens
tgtgtcagatttaggctcaaac

SEQ ID NO: 7240370 - DNA, 22 bp, Homo sapiens
tgtggtggctattctggtctca

SEQ ID NO: 7240371 - DNA, 22 bp, Homo sapiens
tgtggcagaggaggcagcgtcc

SEQ ID NO: 7240372 - DNA, 22 bp, Homo sapiens
tgtggcagctgctgcaggagct

SEQ ID NO: 7240373 - DNA, 22 bp, Homo sapiens
tgtggacatagaagcatgtgga

SEQ ID NO: 7240374 - DNA, 22 bp, Homo sapiens
tgtggacagagcagaaggtcat

SEQ ID NO: 7240375 - DNA, 22 bp, Homo sapiens
tgtttcttgggtgctcacatca

SEQ ID NO: 7240376 - DNA, 22 bp, Homo sapiens
tgtttctttgtagatattcttt

SEQ ID NO: 7240377 - DNA, 22 bp, Homo sapiens
tgtttcagtccctgtgttcaat

SEQ ID NO: 7240378 - DNA, 22 bp, Homo sapiens
tgtttcatgattgctgtcattt

SEQ ID NO: 7240379 - DNA, 22 bp, Homo sapiens
tgtttaattcaccatcatgttc

SEQ ID NO: 7240380 - DNA, 22 bp, Homo sapiens
tgtgtttatagtgtatcttcca

SEQ ID NO: 7240381 - DNA, 22 bp, Homo sapiens
tgtgtttagagagcacattcag

SEQ ID NO: 7240382 - DNA, 22 bp, Homo sapiens
tgtgtttacttctatgcagttt

SEQ ID NO: 7240383 - DNA, 23 bp, Homo sapiens
tgtgtttacctgaggatcttgtt

SEQ ID NO: 7240384 - DNA, 22 bp, Homo sapiens
tgtgtgcacaggagtgtttgaa

SEQ ID NO: 7240385 - DNA, 22 bp, Homo sapiens
tgttatttgggaaagttgtaca

SEQ ID NO: 7240386 - DNA, 22 bp, Homo sapiens
tgttcagaacaaaggtaaatga

SEQ ID NO: 7240387 - DNA, 22 bp, Homo sapiens
ttcctcaacaacttccctacag

SEQ ID NO: 7240388 - DNA, 22 bp, Homo sapiens
ttctaggggagaggaagaagtg

SEQ ID NO: 7240389 - DNA, 22 bp, Homo sapiens
ttcaggtgggccttttgagcat

SEQ ID NO: 7240390 - DNA, 21 bp, Homo sapiens
ttcaggtgagatcatgttgac

SEQ ID NO: 7240391 - DNA, 20 bp, Homo sapiens
ttcatgggagcaaagaggcc

SEQ ID NO: 7240392 - DNA, 22 bp, Homo sapiens
ttcacaaagctggagcatttcc

SEQ ID NO: 7240393 - DNA, 22 bp, Homo sapiens
ttcacaagtcattagctgcata

SEQ ID NO: 7240394 - DNA, 22 bp, Homo sapiens
ttcacaaaatggtttgttgatg

SEQ ID NO: 7240395 - DNA, 22 bp, Homo sapiens
ttctgttttgcacagacttgaa

SEQ ID NO: 7240396 - DNA, 22 bp, Homo sapiens
ttctgtttcctgccttcccatt

SEQ ID NO: 7240397 - DNA, 22 bp, Homo sapiens
ttctggtttaagaaagtgctgg

SEQ ID NO: 7240398 - DNA, 22 bp, Homo sapiens
ttctggttctcaggaatgctaa

SEQ ID NO: 7240399 - DNA, 22 bp, Homo sapiens
ttgaagcatttgctatagcatt

SEQ ID NO: 7240400 - DNA, 22 bp, Homo sapiens
ttgaagcatttctttgagcttc

SEQ ID NO: 7240401 - DNA, 22 bp, Homo sapiens
ttgaagcattgtggcttgtatt

SEQ ID NO: 7240402 - DNA, 22 bp, Homo sapiens
ttgaagcatggtacttgttcaa

SEQ ID NO: 7240403 - DNA, 22 bp, Homo sapiens
ttgaagcaggaaaatttctatt

SEQ ID NO: 7240404 - DNA, 22 bp, Homo sapiens
ttgaagcagctcaggaggctta

SEQ ID NO: 7240405 - DNA, 22 bp, Homo sapiens
ttgaagcagagaaatacttgaa

SEQ ID NO: 7240406 - DNA, 22 bp, Homo sapiens
ttgaagcacaatgtcttttatc

SEQ ID NO: 7240407 - DNA, 21 bp, Homo sapiens
ttgaagcaagggtggctctga

SEQ ID NO: 7240408 - DNA, 22 bp, Homo sapiens
ttgaagcaaggcgaatcttgtg

SEQ ID NO: 7240409 - DNA, 22 bp, Homo sapiens
ttgaagcaaattctgtgcagta

SEQ ID NO: 7240410 - DNA, 22 bp, Homo sapiens
ttgagcaatgtcactgaggctt

SEQ ID NO: 7240411 - DNA, 22 bp, Homo sapiens
ttgagcaatgctgcaaagagat

SEQ ID NO: 7240412 - DNA, 20 bp, Homo sapiens
ttgagcaatcagtaaaggat

SEQ ID NO: 7240413 - DNA, 22 bp, Homo sapiens
ttgattctgatcctttgctagc

SEQ ID NO: 7240414 - DNA, 22 bp, Homo sapiens
ttgattctgggctcatttcttt

SEQ ID NO: 7240415 - DNA, 22 bp, Homo sapiens
ttttgatatcatgatgaacaga

SEQ ID NO: 7240416 - DNA, 22 bp, Homo sapiens
tttgcaatttgtgctgcaaatg

SEQ ID NO: 7240417 - DNA, 22 bp, Homo sapiens
tttggaagtaaatgagtgtttt

SEQ ID NO: 7240418 - DNA, 22 bp, Homo sapiens
tttggaagggaaccaaaacatg

SEQ ID NO: 7240419 - DNA, 22 bp, Homo sapiens
tttggaagatagttcggcagtt

SEQ ID NO: 7240420 - DNA, 22 bp, Homo sapiens
tttggaacaagacaaaacatta

SEQ ID NO: 7240421 - DNA, 19 bp, Homo sapiens
tttggcaggagataggatg

SEQ ID NO: 7240422 - DNA, 22 bp, Homo sapiens
ttttatcaatcattaagacatt

SEQ ID NO: 7240423 - DNA, 22 bp, Homo sapiens
ttttatcagcagggataacaag

SEQ ID NO: 7240424 - DNA, 22 bp, Homo sapiens
tttctactgttatgacactggg

SEQ ID NO: 7240425 - DNA, 22 bp, Homo sapiens
tttccaaataaggtcacactca

SEQ ID NO: 7240426 - DNA, 22 bp, Homo sapiens
tttccaaaggtggcaggaacaa

SEQ ID NO: 7240427 - DNA, 22 bp, Homo sapiens
tttccaaaggaggaaccagttt

SEQ ID NO: 7240428 - DNA, 22 bp, Homo sapiens
ttggttcagtaggcatgcctgg

SEQ ID NO: 7240429 - DNA, 20 bp, Homo sapiens
ttgtttctgctattttctaa

SEQ ID NO: 7240430 - DNA, 22 bp, Homo sapiens
ttgtttctctggtcttgagtga

SEQ ID NO: 7240431 - DNA, 22 bp, Homo sapiens
tttaaaatttagacctctccac

SEQ ID NO: 7240432 - DNA, 22 bp, Homo sapiens
tttaaaatcagatgggagttgg

SEQ ID NO: 7240433 - DNA, 22 bp, Homo sapiens
tttactaagcccagttatatgc

SEQ ID NO: 7240434 - DNA, 22 bp, Homo sapiens
tttactaacaccatacatgctg

SEQ ID NO: 7240435 - DNA, 22 bp, Homo sapiens
tttactttgtgtcaagtcaaga

SEQ ID NO: 7240436 - DNA, 22 bp, Homo sapiens
tttattaagatgcgaatgctga

SEQ ID NO: 7240437 - DNA, 22 bp, Homo sapiens
tttattatgtacaggcactata

SEQ ID NO: 7240438 - DNA, 22 bp, Homo sapiens
tttattatgatggacaccttcg

SEQ ID NO: 7240439 - DNA, 22 bp, Homo sapiens
tttattatccagtgttgtcatg

SEQ ID NO: 7240440 - DNA, 22 bp, Homo sapiens
tttattatagtggtggggactg

SEQ ID NO: 7240441 - DNA, 22 bp, Homo sapiens
ggtctggaagcgtcccaaaggt

SEQ ID NO: 7240442 - DNA, 22 bp, Homo sapiens
ggtctggaagcgcagtaggctg

SEQ ID NO: 7240443 - DNA, 22 bp, Homo sapiens
ggtctggaacgaggtctaagcc

SEQ ID NO: 7240444 - DNA, 22 bp, Homo sapiens
ggtctggaacccctcaagtgac

SEQ ID NO: 7240445 - DNA, 22 bp, Homo sapiens
ggtgacagtggttaaaatttgt

SEQ ID NO: 7240446 - DNA, 22 bp, Homo sapiens
ggtctgagcttgagcccatgct

SEQ ID NO: 7240447 - DNA, 22 bp, Homo sapiens
ggtctgcgatggcaagggtctt

SEQ ID NO: 7240448 - DNA, 22 bp, Homo sapiens
cagcaagacaaggaacaaactg

SEQ ID NO: 7240449 - DNA, 22 bp, Homo sapiens
cagcacagtttgcttggcagag

SEQ ID NO: 7240450 - DNA, 22 bp, Homo sapiens
cagcacagtttctggcccgccg

SEQ ID NO: 7240451 - DNA, 22 bp, Homo sapiens
cagcacagtttcccccatgagc

SEQ ID NO: 7240452 - DNA, 22 bp, Homo sapiens
cagcacagtgttaggtaatttg

SEQ ID NO: 7240453 - DNA, 22 bp, Homo sapiens
cagcacagtgcagatgctgact

SEQ ID NO: 7240454 - DNA, 22 bp, Homo sapiens
cagcacagtgaccagacccact

SEQ ID NO: 7240455 - DNA, 22 bp, Homo sapiens
cagcacagtcctttgcttactg

SEQ ID NO: 7240456 - DNA, 22 bp, Homo sapiens
cagcacagtagagtagttgtaa

SEQ ID NO: 7240457 - DNA, 21 bp, Homo sapiens
cagcacagtactgggtcttgc

SEQ ID NO: 7240458 - DNA, 23 bp, Homo sapiens
cagcacagtacatttcctgtctc

SEQ ID NO: 7240459 - DNA, 22 bp, Homo sapiens
ggtgctgggaacgaggaattca

SEQ ID NO: 7240460 - DNA, 22 bp, Homo sapiens
ggtgctgctgctgaacccagct

SEQ ID NO: 7240461 - DNA, 22 bp, Homo sapiens
ggtgctgatttgttgctgagat

SEQ ID NO: 7240462 - DNA, 22 bp, Homo sapiens
ggtgctgactctgtcgtgagca

SEQ ID NO: 7240463 - DNA, 22 bp, Homo sapiens
cagagggttgtcaggcgccttg

SEQ ID NO: 7240464 - DNA, 22 bp, Homo sapiens
cagagggttgtcaggcgccttg

SEQ ID NO: 7240465 - DNA, 22 bp, Homo sapiens
cagagggttgatgtgaggctta

SEQ ID NO: 7240466 - DNA, 22 bp, Homo sapiens
cagagtctgcgagcagaggggc

SEQ ID NO: 7240467 - DNA, 22 bp, Homo sapiens
ggtccaaggctcggtggcgggg

SEQ ID NO: 7240468 - DNA, 22 bp, Homo sapiens
ggggagctgggaggtgagttac

SEQ ID NO: 7240469 - DNA, 22 bp, Homo sapiens
ggggagcttagggtctctgaat

SEQ ID NO: 7240470 - DNA, 22 bp, Homo sapiens
ggggagcttcaggtggcttaca

SEQ ID NO: 7240471 - DNA, 22 bp, Homo sapiens
ggggagcttggttattcatgca

SEQ ID NO: 7240472 - DNA, 22 bp, Homo sapiens
ggggagctgccacagttctctg

SEQ ID NO: 7240473 - DNA, 22 bp, Homo sapiens
ggggagctgagacactgccctc

SEQ ID NO: 7240474 - DNA, 22 bp, Homo sapiens
ggggagctgacaaccacatcct

SEQ ID NO: 7240475 - DNA, 22 bp, Homo sapiens
ggggagctcatgatgtctttgt

SEQ ID NO: 7240476 - DNA, 22 bp, Homo sapiens
ggggagagtcctttccagttcc

SEQ ID NO: 7240477 - DNA, 22 bp, Homo sapiens
ggggagagtcctttccagttcc

SEQ ID NO: 7240478 - DNA, 22 bp, Homo sapiens
ggggagagtattttattcaagt

SEQ ID NO: 7240479 - DNA, 22 bp, Homo sapiens
cagaggcacagtgcgggccact

SEQ ID NO: 7240480 - DNA, 22 bp, Homo sapiens
cagagggctgccctgagttcgt

SEQ ID NO: 7240481 - DNA, 22 bp, Homo sapiens
cagaggggataacaggtgtaga

SEQ ID NO: 7240482 - DNA, 21 bp, Homo sapiens
cagaggggctagcctggctgc

SEQ ID NO: 7240483 - DNA, 22 bp, Homo sapiens
cagaggggtgtagagatcactg

SEQ ID NO: 7240484 - DNA, 23 bp, Homo sapiens
cagagggttccatggagcatggt

SEQ ID NO: 7240485 - DNA, 22 bp, Homo sapiens
gggccagcctactgctagaccc

SEQ ID NO: 7240486 - DNA, 22 bp, Homo sapiens
gggctctgtgttctagctctcg

SEQ ID NO: 7240487 - DNA, 22 bp, Homo sapiens
gggccagcctactgctagaccc

SEQ ID NO: 7240488 - DNA, 22 bp, Homo sapiens
gggccagagcacagaggatgtt

SEQ ID NO: 7240489 - DNA, 22 bp, Homo sapiens
gggccagagcacagaggatgtt

SEQ ID NO: 7240490 - DNA, 22 bp, Homo sapiens
gggcagtgtctggcccccaggc

SEQ ID NO: 7240491 - DNA, 22 bp, Homo sapiens
gggcagtgtcggggcccaggga

SEQ ID NO: 7240492 - DNA, 22 bp, Homo sapiens
gggcagtgtcgaggtctggtcc

SEQ ID NO: 7240493 - DNA, 22 bp, Homo sapiens
gggccactcagattgtcccctt

SEQ ID NO: 7240494 - DNA, 22 bp, Homo sapiens
gggccactgggtcctgctggcc

SEQ ID NO: 7240495 - DNA, 22 bp, Homo sapiens
gggccactcctggctgctgagt

SEQ ID NO: 7240496 - DNA, 22 bp, Homo sapiens
gggctgaaaggccgcctcagat

SEQ ID NO: 7240497 - DNA, 22 bp, Homo sapiens
gggctgacaaccatctgacaag

SEQ ID NO: 7240498 - DNA, 22 bp, Homo sapiens
gggctgaccccacccctcactc

SEQ ID NO: 7240499 - DNA, 22 bp, Homo sapiens
gggctgacatatttggtgctct

SEQ ID NO: 7240500 - DNA, 22 bp, Homo sapiens
gggctgacagtttcccctgaaa

SEQ ID NO: 7240501 - DNA, 22 bp, Homo sapiens
gggctgacaccacccaggcgca

SEQ ID NO: 7240502 - DNA, 22 bp, Homo sapiens
gggctgacaccacccaggcgca

SEQ ID NO: 7240503 - DNA, 22 bp, Homo sapiens
gggctgactcaaccttgcaaag

SEQ ID NO: 7240504 - DNA, 22 bp, Homo sapiens
gggctgagaagttgatcccaag

SEQ ID NO: 7240505 - DNA, 22 bp, Homo sapiens
cagagctgggatcccatgggcg

SEQ ID NO: 7240506 - DNA, 22 bp, Homo sapiens
cagagctgggtttgggaaacct

SEQ ID NO: 7240507 - DNA, 22 bp, Homo sapiens
cagagctggctctgcatgtaca

SEQ ID NO: 7240508 - DNA, 23 bp, Homo sapiens
cagagctggctcagagctgcctg

SEQ ID NO: 7240509 - DNA, 22 bp, Homo sapiens
cagagctgcttcccagtttgtg

SEQ ID NO: 7240510 - DNA, 22 bp, Homo sapiens
gggctgagtgacctcaggccaa

SEQ ID NO: 7240511 - DNA, 22 bp, Homo sapiens
gggctgagtctgctgcctgtca

SEQ ID NO: 7240512 - DNA, 22 bp, Homo sapiens
gggctgagtcatctggggcctc

SEQ ID NO: 7240513 - DNA, 22 bp, Homo sapiens
gggctgaggggtatctcatggg

SEQ ID NO: 7240514 - DNA, 22 bp, Homo sapiens
cagaggagttcagtacacagcc

SEQ ID NO: 7240515 - DNA, 22 bp, Homo sapiens
cagaggagaattgcgggatcat

SEQ ID NO: 7240516 - DNA, 22 bp, Homo sapiens
gggctgagtgggcctcttactt

SEQ ID NO: 7240517 - DNA, 22 bp, Homo sapiens
cagaccagtagggctcatccca

SEQ ID NO: 7240518 - DNA, 22 bp, Homo sapiens
cagaccagccatttgcctcttc

SEQ ID NO: 7240519 - DNA, 22 bp, Homo sapiens
cagacctcaattatgtaagtaa

SEQ ID NO: 7240520 - DNA, 17 bp, Homo sapiens
cagacctctgtgaagcc

SEQ ID NO: 7240521 - DNA, 22 bp, Homo sapiens
gggcagagaaatggacagttgg

SEQ ID NO: 7240522 - DNA, 22 bp, Homo sapiens
gggcagagaaatggacagttgg

SEQ ID NO: 7240523 - DNA, 22 bp, Homo sapiens
cagactgagggcatcacatacg

SEQ ID NO: 7240524 - DNA, 22 bp, Homo sapiens
cagacgggtggtctgcgaggcc

SEQ ID NO: 7240525 - DNA, 22 bp, Homo sapiens
cagacctctttttagcactccc

SEQ ID NO: 7240526 - DNA, 22 bp, Homo sapiens
cagacctctatggggtaaatct

SEQ ID NO: 7240527 - DNA, 22 bp, Homo sapiens
cagagacagggcagggagtgtg

SEQ ID NO: 7240528 - DNA, 22 bp, Homo sapiens
cagagacaggatctcgaagact

SEQ ID NO: 7240529 - DNA, 22 bp, Homo sapiens
gggcagtggctcacgcctgtaa

SEQ ID NO: 7240530 - DNA, 19 bp, Homo sapiens
gggcagtggcactagggag

SEQ ID NO: 7240531 - DNA, 22 bp, Homo sapiens
gggcagtgggaccaggcaccag

SEQ ID NO: 7240532 - DNA, 22 bp, Homo sapiens
gggcagtgggtggctgcagcct

SEQ ID NO: 7240533 - DNA, 22 bp, Homo sapiens
gggcagtgggtggctgcagcct

SEQ ID NO: 7240534 - DNA, 22 bp, Homo sapiens
gggcagtggttacacagctgag

SEQ ID NO: 7240535 - DNA, 22 bp, Homo sapiens
gggcagcattctgtgggcaggt

SEQ ID NO: 7240536 - DNA, 22 bp, Homo sapiens
cagagacagcctgggagggaca

SEQ ID NO: 7240537 - DNA, 22 bp, Homo sapiens
gggcagcatcaggaggggcttt

SEQ ID NO: 7240538 - DNA, 22 bp, Homo sapiens
cagcctgcagggctgcctgttg

SEQ ID NO: 7240539 - DNA, 22 bp, Homo sapiens
cagcctgcagggctgcctgttg

SEQ ID NO: 7240540 - DNA, 22 bp, Homo sapiens
cagcctgcaggaggccgtcagc

SEQ ID NO: 7240541 - DNA, 22 bp, Homo sapiens
cagccctgcttccccgctagtt

SEQ ID NO: 7240542 - DNA, 23 bp, Homo sapiens
cagccctggagatgtgggaggca

SEQ ID NO: 7240543 - DNA, 20 bp, Homo sapiens
cagcctccactcactcagct

SEQ ID NO: 7240544 - DNA, 22 bp, Homo sapiens
cagccctgcagctggatctcac

SEQ ID NO: 7240545 - DNA, 17 bp, Homo sapiens
cagccctgccgttccca

SEQ ID NO: 7240546 - DNA, 22 bp, Homo sapiens
cagccctgccatggagcctcct

SEQ ID NO: 7240547 - DNA, 22 bp, Homo sapiens
cagccctgccatggagcctcct

SEQ ID NO: 7240548 - DNA, 22 bp, Homo sapiens
cagccctgcttccccgctagtt

SEQ ID NO: 7240549 - DNA, 22 bp, Homo sapiens
cagctagaaatgggattggtat

SEQ ID NO: 7240550 - DNA, 22 bp, Homo sapiens
cagctagaaatgggattggtat

SEQ ID NO: 7240551 - DNA, 22 bp, Homo sapiens
cagctagaaagtctgttaggga

SEQ ID NO: 7240552 - DNA, 22 bp, Homo sapiens
cagcctggattgcagaatgcta

SEQ ID NO: 7240553 - DNA, 22 bp, Homo sapiens
cagcctggagccacagcccagg

SEQ ID NO: 7240554 - DNA, 21 bp, Homo sapiens
cagcctgctgctccagggcca

SEQ ID NO: 7240555 - DNA, 22 bp, Homo sapiens
cagcctggacagcgaccagagt

SEQ ID NO: 7240556 - DNA, 22 bp, Homo sapiens
cagcctggtccccggctcaccc

SEQ ID NO: 7240557 - DNA, 22 bp, Homo sapiens
cagcctgggctccagagtccct

SEQ ID NO: 7240558 - DNA, 22 bp, Homo sapiens
cagcctggcctgggactgctga

SEQ ID NO: 7240559 - DNA, 22 bp, Homo sapiens
cagcctggcctgggactgctga

SEQ ID NO: 7240560 - DNA, 22 bp, Homo sapiens
cagcctgtagtctggtccaggt

SEQ ID NO: 7240561 - DNA, 20 bp, Homo sapiens
gtgcccagttggtgacagac

SEQ ID NO: 7240562 - DNA, 22 bp, Homo sapiens
gtgctgagtagaatgaatgcct

SEQ ID NO: 7240563 - DNA, 22 bp, Homo sapiens
gtcatgagttctcggggcagac

SEQ ID NO: 7240564 - DNA, 22 bp, Homo sapiens
cagcaggcggcccgcgggcccg

SEQ ID NO: 7240565 - DNA, 22 bp, Homo sapiens
cagcaggctctgagtggctgcc

SEQ ID NO: 7240566 - DNA, 22 bp, Homo sapiens
cagcagcttctgttgatcagaa

SEQ ID NO: 7240567 - DNA, 20 bp, Homo sapiens
cagcaggaaaagtgcctcag

SEQ ID NO: 7240568 - DNA, 22 bp, Homo sapiens
gtcataaagacagaaacattcc

SEQ ID NO: 7240569 - DNA, 22 bp, Homo sapiens
gtctgtggtccctgctggggac

SEQ ID NO: 7240570 - DNA, 22 bp, Homo sapiens
gtctgtggtagacaggaaggca

SEQ ID NO: 7240571 - DNA, 22 bp, Homo sapiens
gtctgtggtagacaggaaggca

SEQ ID NO: 7240572 - DNA, 22 bp, Homo sapiens
gtctgtggcaggggagaagttt

SEQ ID NO: 7240573 - DNA, 22 bp, Homo sapiens
gtctgtggcaggggagaagttt

SEQ ID NO: 7240574 - DNA, 22 bp, Homo sapiens
cagccagggtcaggcagcttct

SEQ ID NO: 7240575 - DNA, 22 bp, Homo sapiens
cagccaggtatgggcgtgcggg

SEQ ID NO: 7240576 - DNA, 22 bp, Homo sapiens
cagccccttcctggcatctgga

SEQ ID NO: 7240577 - DNA, 22 bp, Homo sapiens
cagccccatggtgtgctccagc

SEQ ID NO: 7240578 - DNA, 22 bp, Homo sapiens
gtctggagccccagtcaatgag

SEQ ID NO: 7240579 - DNA, 22 bp, Homo sapiens
gtctggagccactgctgctgct

SEQ ID NO: 7240580 - DNA, 22 bp, Homo sapiens
gtctggagccaccctaagcatt

SEQ ID NO: 7240581 - DNA, 22 bp, Homo sapiens
gtctggagagctgagcagagtt

SEQ ID NO: 7240582 - DNA, 22 bp, Homo sapiens
gtctggagacttgggtcatcaa

SEQ ID NO: 7240583 - DNA, 22 bp, Homo sapiens
gtctggaatatagcaagctctt

SEQ ID NO: 7240584 - DNA, 22 bp, Homo sapiens
gtctggaagtgtcttgttaagt

SEQ ID NO: 7240585 - DNA, 22 bp, Homo sapiens
gtctggaagggagtgcattttc

SEQ ID NO: 7240586 - DNA, 22 bp, Homo sapiens
gtctggaaggaggagatggagc

SEQ ID NO: 7240587 - DNA, 22 bp, Homo sapiens
gtctggaagctctaggggagaa

SEQ ID NO: 7240588 - DNA, 22 bp, Homo sapiens
gtctggaagagcaggaataaac

SEQ ID NO: 7240589 - DNA, 22 bp, Homo sapiens
gtctggaagaactagggatgtt

SEQ ID NO: 7240590 - DNA, 22 bp, Homo sapiens
gtctggaaattcaatttaatgc

SEQ ID NO: 7240591 - DNA, 22 bp, Homo sapiens
gtctggaaattaagaggaggtt

SEQ ID NO: 7240592 - DNA, 22 bp, Homo sapiens
gtctggaaatattgacttcaga

SEQ ID NO: 7240593 - DNA, 22 bp, Homo sapiens
gtctggaaaggtatttgtctca

SEQ ID NO: 7240594 - DNA, 22 bp, Homo sapiens
gtctggaaaggggcttttatct

SEQ ID NO: 7240595 - DNA, 22 bp, Homo sapiens
gtctggaaagagctgaggttca

SEQ ID NO: 7240596 - DNA, 22 bp, Homo sapiens
gtctggaaccaagacgtgtagc

SEQ ID NO: 7240597 - DNA, 22 bp, Homo sapiens
gtctggaaatttaaggtatgag

SEQ ID NO: 7240598 - DNA, 22 bp, Homo sapiens
gtctggaaccaatatttgaggg

SEQ ID NO: 7240599 - DNA, 22 bp, Homo sapiens
gtctggaagaacctgtgccagt

SEQ ID NO: 7240600 - DNA, 22 bp, Homo sapiens
gtctcttttatggtgagttgat

SEQ ID NO: 7240601 - DNA, 22 bp, Homo sapiens
gtctgcttttctgaattgcctg

SEQ ID NO: 7240602 - DNA, 22 bp, Homo sapiens
gtccctggtctaccgtggcttc

SEQ ID NO: 7240603 - DNA, 22 bp, Homo sapiens
gtccctgggggtttaggactca

SEQ ID NO: 7240604 - DNA, 22 bp, Homo sapiens
gtcccaggcttatgtggagctt

SEQ ID NO: 7240605 - DNA, 22 bp, Homo sapiens
gtccctggggaatcagctggag

SEQ ID NO: 7240606 - DNA, 22 bp, Homo sapiens
ggcattgttctaggtggttgga

SEQ ID NO: 7240607 - DNA, 22 bp, Homo sapiens
ggcaggtgcccagagagcacga

SEQ ID NO: 7240608 - DNA, 22 bp, Homo sapiens
ggcaggtgccagttggcttggg

SEQ ID NO: 7240609 - DNA, 22 bp, Homo sapiens
ggcaggtgcacctgagccatct

SEQ ID NO: 7240610 - DNA, 22 bp, Homo sapiens
ggcagggcaggaaagtcaggaa

SEQ ID NO: 7240611 - DNA, 22 bp, Homo sapiens
ggccactgacctacatctgggg

SEQ ID NO: 7240612 - DNA, 23 bp, Homo sapiens
ggccactgaattttctgcatctt

SEQ ID NO: 7240613 - DNA, 22 bp, Homo sapiens
ggccactgctctccagcctggg

SEQ ID NO: 7240614 - DNA, 22 bp, Homo sapiens
ggccctgtccccttcagttttg

SEQ ID NO: 7240615 - DNA, 22 bp, Homo sapiens
ggccctgtccccttcagttttg

SEQ ID NO: 7240616 - DNA, 19 bp, Homo sapiens
ggccctgtaggatgtgagt

SEQ ID NO: 7240617 - DNA, 21 bp, Homo sapiens
ggccctggttacgcctcctct

SEQ ID NO: 7240618 - DNA, 22 bp, Homo sapiens
ggccccaggtagaagatataga

SEQ ID NO: 7240619 - DNA, 22 bp, Homo sapiens
ggccccagggattaggccaacc

SEQ ID NO: 7240620 - DNA, 22 bp, Homo sapiens
ggccctgtctgtctgcccagct

SEQ ID NO: 7240621 - DNA, 22 bp, Homo sapiens
ggccctgtcctggctgtctccg

SEQ ID NO: 7240622 - DNA, 22 bp, Homo sapiens
ggccctgtcctggctgtctccg

SEQ ID NO: 7240623 - DNA, 22 bp, Homo sapiens
ggccctgtccctggccgtctgt

SEQ ID NO: 7240624 - DNA, 22 bp, Homo sapiens
ggccctgtccctggccgtctgt

SEQ ID NO: 7240625 - DNA, 22 bp, Homo sapiens
ggccctgttccacgtggggtgt

SEQ ID NO: 7240626 - DNA, 22 bp, Homo sapiens
ggccctgttccacgtggggtgt

SEQ ID NO: 7240627 - DNA, 22 bp, Homo sapiens
ggccctgtggttttgcaaagtc

SEQ ID NO: 7240628 - DNA, 22 bp, Homo sapiens
ggccctgttagagctcccacaa

SEQ ID NO: 7240629 - DNA, 22 bp, Homo sapiens
ggccctgtgatggatgtattag

SEQ ID NO: 7240630 - DNA, 22 bp, Homo sapiens
ggcccttcctgctctcttagct

SEQ ID NO: 7240631 - DNA, 22 bp, Homo sapiens
ggcccttgcagcaggcgctggc

SEQ ID NO: 7240632 - DNA, 22 bp, Homo sapiens
cacgcacgctgggtggaggcgc

SEQ ID NO: 7240633 - DNA, 22 bp, Homo sapiens
cacgcacgctgggtggaggcgc

SEQ ID NO: 7240634 - DNA, 22 bp, Homo sapiens
caccttactccctctggatgcc

SEQ ID NO: 7240635 - DNA, 22 bp, Homo sapiens
ggccggggcctgctcgcctgtg

SEQ ID NO: 7240636 - DNA, 20 bp, Homo sapiens
ggccggggagctctccaggg

SEQ ID NO: 7240637 - DNA, 22 bp, Homo sapiens
ggccgctgcgcctccaaccgag

SEQ ID NO: 7240638 - DNA, 19 bp, Homo sapiens
ggccgcggcccgcagtggg

SEQ ID NO: 7240639 - DNA, 22 bp, Homo sapiens
ggcaggcagtgtggtgtgaaac

SEQ ID NO: 7240640 - DNA, 22 bp, Homo sapiens
cacatttagaggttagcatggt

SEQ ID NO: 7240641 - DNA, 22 bp, Homo sapiens
cacattcttggtcaccttgtgg

SEQ ID NO: 7240642 - DNA, 22 bp, Homo sapiens
cacatagataggcagaagaaca

SEQ ID NO: 7240643 - DNA, 22 bp, Homo sapiens
ggaggtgctgatcccagtcaac

SEQ ID NO: 7240644 - DNA, 22 bp, Homo sapiens
cacagggaaccaaggctgggcc

SEQ ID NO: 7240645 - DNA, 22 bp, Homo sapiens
ggaggtggaggttgcagtgagc

SEQ ID NO: 7240646 - DNA, 22 bp, Homo sapiens
ggaggtgctggcggccagctct

SEQ ID NO: 7240647 - DNA, 22 bp, Homo sapiens
cacataattgaacgtgatgagt

SEQ ID NO: 7240648 - DNA, 22 bp, Homo sapiens
cacataagtgggttccattgca

SEQ ID NO: 7240649 - DNA, 22 bp, Homo sapiens
cacataagaaatgaatatgaga

SEQ ID NO: 7240650 - DNA, 19 bp, Homo sapiens
cacatacagaaaagagtaa

SEQ ID NO: 7240651 - DNA, 23 bp, Homo sapiens
cagaaataaactggtttgtagat

SEQ ID NO: 7240652 - DNA, 23 bp, Homo sapiens
cagaaataaactggtttgtagat

SEQ ID NO: 7240653 - DNA, 22 bp, Homo sapiens
cagaaataaagtggacagagta

SEQ ID NO: 7240654 - DNA, 22 bp, Homo sapiens
cagaaagcttaggcaagttgga

SEQ ID NO: 7240655 - DNA, 22 bp, Homo sapiens
cagaaagcttggtacaatatgc

SEQ ID NO: 7240656 - DNA, 22 bp, Homo sapiens
ggctgtctgtggtggagcgttg

SEQ ID NO: 7240657 - DNA, 19 bp, Homo sapiens
ggctgtctggcgtgtggat

SEQ ID NO: 7240658 - DNA, 22 bp, Homo sapiens
ggctgtctctgtgactgccacc

SEQ ID NO: 7240659 - DNA, 22 bp, Homo sapiens
ggctgtgaaccctggcagtgtg

SEQ ID NO: 7240660 - DNA, 22 bp, Homo sapiens
ggcttaacttgtagcaatagat

SEQ ID NO: 7240661 - DNA, 22 bp, Homo sapiens
ggcttaaatcacagtgactttt

SEQ ID NO: 7240662 - DNA, 22 bp, Homo sapiens
ggcttaaagttttctagaataa

SEQ ID NO: 7240663 - DNA, 22 bp, Homo sapiens
ggcttaaagaattaacagagat

SEQ ID NO: 7240664 - DNA, 22 bp, Homo sapiens
ggcttaaaaggaaaatgagagt

SEQ ID NO: 7240665 - DNA, 22 bp, Homo sapiens
ggcttaaaactttgaaagtgtt

SEQ ID NO: 7240666 - DNA, 22 bp, Homo sapiens
ggctgtccttggccaaggcact

SEQ ID NO: 7240667 - DNA, 20 bp, Homo sapiens
ggctgtcccgcggctgccgg

SEQ ID NO: 7240668 - DNA, 22 bp, Homo sapiens
ggctgtccacctaccatgccgg

SEQ ID NO: 7240669 - DNA, 21 bp, Homo sapiens
cactttaatggatatttgttt

SEQ ID NO: 7240670 - DNA, 22 bp, Homo sapiens
cacttttaacaggagaattccc

SEQ ID NO: 7240671 - DNA, 20 bp, Homo sapiens
ggctgcccactccagagtac

SEQ ID NO: 7240672 - DNA, 22 bp, Homo sapiens
ggctgccccagtgctcatggct

SEQ ID NO: 7240673 - DNA, 22 bp, Homo sapiens
cagaaaataaacatttgtggaa

SEQ ID NO: 7240674 - DNA, 22 bp, Homo sapiens
cagaaaataaagtttctacgca

SEQ ID NO: 7240675 - DNA, 22 bp, Homo sapiens
cagaaagcaaaatggatctctg

SEQ ID NO: 7240676 - DNA, 22 bp, Homo sapiens
ggctgcctactttcccagagtt

SEQ ID NO: 7240677 - DNA, 22 bp, Homo sapiens
ggctgccctgggaggcaagggt

SEQ ID NO: 7240678 - DNA, 22 bp, Homo sapiens
ggctgccctcgtctactgccca

SEQ ID NO: 7240679 - DNA, 22 bp, Homo sapiens
cagaaagccctatgtacagtgg

SEQ ID NO: 7240680 - DNA, 22 bp, Homo sapiens
cagaaagccaactccaactgtc

SEQ ID NO: 7240681 - DNA, 20 bp, Homo sapiens
cagaaagcatgttccagggc

SEQ ID NO: 7240682 - DNA, 22 bp, Homo sapiens
cagaaagcagttgtcaatgggc

SEQ ID NO: 7240683 - DNA, 22 bp, Homo sapiens
cagaaagcagagctgagccttt

SEQ ID NO: 7240684 - DNA, 22 bp, Homo sapiens
cagaaagcaagccattcactgt

SEQ ID NO: 7240685 - DNA, 22 bp, Homo sapiens
cagaaagcgggatgcagcatgt

SEQ ID NO: 7240686 - DNA, 22 bp, Homo sapiens
cagaaagctctttcaatcttgc

SEQ ID NO: 7240687 - DNA, 23 bp, Homo sapiens
cagaaagccctttccccacagta

SEQ ID NO: 7240688 - DNA, 22 bp, Homo sapiens
cagaaagccgacttacaatgga

SEQ ID NO: 7240689 - DNA, 22 bp, Homo sapiens
ggctctggtcagtgaggggcct

SEQ ID NO: 7240690 - DNA, 20 bp, Homo sapiens
ggctctggaatctggtgggc

SEQ ID NO: 7240691 - DNA, 22 bp, Homo sapiens
ggctcaggttgggtcacatgac

SEQ ID NO: 7240692 - DNA, 22 bp, Homo sapiens
ggctcaggttaccagtccctcc

SEQ ID NO: 7240693 - DNA, 22 bp, Homo sapiens
ggctcaggttaccagtccctcc

SEQ ID NO: 7240694 - DNA, 22 bp, Homo sapiens
ggctccaggtgcatgccaggct

SEQ ID NO: 7240695 - DNA, 22 bp, Homo sapiens
ggctccagggtacccctggatg

SEQ ID NO: 7240696 - DNA, 22 bp, Homo sapiens
ggctgagccccctctgcgtagg

SEQ ID NO: 7240697 - DNA, 22 bp, Homo sapiens
ggctctggtgccctggctccca

SEQ ID NO: 7240698 - DNA, 22 bp, Homo sapiens
ggctgaggctcatgccatcttg

SEQ ID NO: 7240699 - DNA, 22 bp, Homo sapiens
ggctgagcctggagcatctggt

SEQ ID NO: 7240700 - DNA, 22 bp, Homo sapiens
ggctgagcgtggctgccgtggg

SEQ ID NO: 7240701 - DNA, 19 bp, Homo sapiens
ggctcagggcgctgccgcc

SEQ ID NO: 7240702 - DNA, 22 bp, Homo sapiens
ggctcaggggccaggcctgtcc

SEQ ID NO: 7240703 - DNA, 22 bp, Homo sapiens
ggctcaggggccaggcctgtcc

SEQ ID NO: 7240704 - DNA, 22 bp, Homo sapiens
ggctcaggctggagtgcagtgg

SEQ ID NO: 7240705 - DNA, 22 bp, Homo sapiens
ggcctgtaatcccagctactca

SEQ ID NO: 7240706 - DNA, 22 bp, Homo sapiens
ggcctgaggccaccagcagccc

SEQ ID NO: 7240707 - DNA, 22 bp, Homo sapiens
ggcctgaggcgtcccagctgtg

SEQ ID NO: 7240708 - DNA, 22 bp, Homo sapiens
cacagagaaaatgttggtgctt

SEQ ID NO: 7240709 - DNA, 22 bp, Homo sapiens
ggactgggagaatggaggcaag

SEQ ID NO: 7240710 - DNA, 22 bp, Homo sapiens
cacagagaccccttctggggcc

SEQ ID NO: 7240711 - DNA, 22 bp, Homo sapiens
ggactgggccaggggttggact

SEQ ID NO: 7240712 - DNA, 17 bp, Homo sapiens
ggactgggcggggcagg

SEQ ID NO: 7240713 - DNA, 22 bp, Homo sapiens
ggactgggcatgggtgctctgc

SEQ ID NO: 7240714 - DNA, 22 bp, Homo sapiens
ggactgggattctggatctgct

SEQ ID NO: 7240715 - DNA, 21 bp, Homo sapiens
cacagaggcgctgtatggctg

SEQ ID NO: 7240716 - DNA, 22 bp, Homo sapiens
cacagaggctcaaagccaggtg

SEQ ID NO: 7240717 - DNA, 18 bp, Homo sapiens
caatgttttagatctcta

SEQ ID NO: 7240718 - DNA, 22 bp, Homo sapiens
caatgtttgttagagctctaga

SEQ ID NO: 7240719 - DNA, 22 bp, Homo sapiens
caatgtttgtgatctactgact

SEQ ID NO: 7240720 - DNA, 22 bp, Homo sapiens
cacacagacagctctctgaaga

SEQ ID NO: 7240721 - DNA, 22 bp, Homo sapiens
cacacagatggtaagggaggga

SEQ ID NO: 7240722 - DNA, 22 bp, Homo sapiens
cacacagctagtgacaggagaa

SEQ ID NO: 7240723 - DNA, 22 bp, Homo sapiens
ggaaggggagctggaaagggta

SEQ ID NO: 7240724 - DNA, 22 bp, Homo sapiens
ggaaggggagctaaatctactg

SEQ ID NO: 7240725 - DNA, 22 bp, Homo sapiens
ggaagggcctcgggcgtgggac

SEQ ID NO: 7240726 - DNA, 21 bp, Homo sapiens
ggaagggctctgaggacggct

SEQ ID NO: 7240727 - DNA, 22 bp, Homo sapiens
cacagaatggaccagttttaga

SEQ ID NO: 7240728 - DNA, 22 bp, Homo sapiens
cacagaagtttcatagtctcga

SEQ ID NO: 7240729 - DNA, 22 bp, Homo sapiens
cacactgttgaggacgagatgt

SEQ ID NO: 7240730 - DNA, 20 bp, Homo sapiens
ggaaggggcaaagtgtgtga

SEQ ID NO: 7240731 - DNA, 22 bp, Homo sapiens
ggagctggaatatattgaaacc

SEQ ID NO: 7240732 - DNA, 23 bp, Homo sapiens
ggagctggacccttacacctttc

SEQ ID NO: 7240733 - DNA, 22 bp, Homo sapiens
ggagctggagagctagcctagg

SEQ ID NO: 7240734 - DNA, 22 bp, Homo sapiens
ggagctggagagtacagagttt

SEQ ID NO: 7240735 - DNA, 20 bp, Homo sapiens
ggagctggcatccagcctct

SEQ ID NO: 7240736 - DNA, 22 bp, Homo sapiens
ggagctggcagcgcaacccaga

SEQ ID NO: 7240737 - DNA, 22 bp, Homo sapiens
ggagctgctccttcagccaagt

SEQ ID NO: 7240738 - DNA, 21 bp, Homo sapiens
ggagcctctggcagggggcca

SEQ ID NO: 7240739 - DNA, 22 bp, Homo sapiens
cacagatagaccttatgagatt

SEQ ID NO: 7240740 - DNA, 22 bp, Homo sapiens
cacagatacctagtgaaacata

SEQ ID NO: 7240741 - DNA, 22 bp, Homo sapiens
cacagagttgaatattgacatt

SEQ ID NO: 7240742 - DNA, 22 bp, Homo sapiens
cacagatttcctaagcatcaat

SEQ ID NO: 7240743 - DNA, 19 bp, Homo sapiens
ggagccgccgcccttcatt

SEQ ID NO: 7240744 - DNA, 22 bp, Homo sapiens
ggaggcagaatagagtgtgggt

SEQ ID NO: 7240745 - DNA, 22 bp, Homo sapiens
ggaggcattatggggaagactt

SEQ ID NO: 7240746 - DNA, 22 bp, Homo sapiens
caagggggagatttagggtaat

SEQ ID NO: 7240747 - DNA, 22 bp, Homo sapiens
caagggggcaggatcacacttg

SEQ ID NO: 7240748 - DNA, 22 bp, Homo sapiens
caagggggcaggatcacacttg

SEQ ID NO: 7240749 - DNA, 22 bp, Homo sapiens
gctggctgtatcacctggccag

SEQ ID NO: 7240750 - DNA, 20 bp, Homo sapiens
caaggcctggatctagttgc

SEQ ID NO: 7240751 - DNA, 22 bp, Homo sapiens
caaggcagcttaatagaatttg

SEQ ID NO: 7240752 - DNA, 22 bp, Homo sapiens
caaggcagcttaatagaatttg

SEQ ID NO: 7240753 - DNA, 22 bp, Homo sapiens
caaggcagcttaatagaatttg

SEQ ID NO: 7240754 - DNA, 22 bp, Homo sapiens
gctggaggcagttcagacacca

SEQ ID NO: 7240755 - DNA, 22 bp, Homo sapiens
gctggaggatggactggaagaa

SEQ ID NO: 7240756 - DNA, 22 bp, Homo sapiens
gctggaggatggactggaagaa

SEQ ID NO: 7240757 - DNA, 22 bp, Homo sapiens
caaggcaggaagcctgtcttat

SEQ ID NO: 7240758 - DNA, 22 bp, Homo sapiens
gctggaggaggaagtgtgaggg

SEQ ID NO: 7240759 - DNA, 22 bp, Homo sapiens
gctggaggaggaagtgtgaggg

SEQ ID NO: 7240760 - DNA, 22 bp, Homo sapiens
caagccagtttgtagttctctc

SEQ ID NO: 7240761 - DNA, 22 bp, Homo sapiens
gctggagcttgagaggacaggg

SEQ ID NO: 7240762 - DNA, 22 bp, Homo sapiens
gctggaggatcacttgagccca

SEQ ID NO: 7240763 - DNA, 22 bp, Homo sapiens
gctggaggatggactggaagaa

SEQ ID NO: 7240764 - DNA, 22 bp, Homo sapiens
caagccaggtgaacataacaag

SEQ ID NO: 7240765 - DNA, 22 bp, Homo sapiens
caagcatactgtgagagtttta

SEQ ID NO: 7240766 - DNA, 22 bp, Homo sapiens
caagattatcttcttcttgtta

SEQ ID NO: 7240767 - DNA, 22 bp, Homo sapiens
caagattatcttcttcttgtta

SEQ ID NO: 7240768 - DNA, 22 bp, Homo sapiens
caaatgtaaattcttttgaagc

SEQ ID NO: 7240769 - DNA, 22 bp, Homo sapiens
gctgtggcggcagcagctggtg

SEQ ID NO: 7240770 - DNA, 22 bp, Homo sapiens
caagtattttaaggactagtgg

SEQ ID NO: 7240771 - DNA, 22 bp, Homo sapiens
caagtattctgtaaaaagtcaa

SEQ ID NO: 7240772 - DNA, 22 bp, Homo sapiens
caaggtcccagcccctcttggc

SEQ ID NO: 7240773 - DNA, 22 bp, Homo sapiens
caaggtgccatgctgggcgggg

SEQ ID NO: 7240774 - DNA, 22 bp, Homo sapiens
caatgtttcttgtaaccagtga

SEQ ID NO: 7240775 - DNA, 22 bp, Homo sapiens
caatgtttgagtaggagcataa

SEQ ID NO: 7240776 - DNA, 22 bp, Homo sapiens
caatgtttactggggacccaga

SEQ ID NO: 7240777 - DNA, 17 bp, Homo sapiens
gcttgggctgcctgttg

SEQ ID NO: 7240778 - DNA, 22 bp, Homo sapiens
caataaagtggaggcccgggct

SEQ ID NO: 7240779 - DNA, 22 bp, Homo sapiens
caataaagaagatttttgcaat

SEQ ID NO: 7240780 - DNA, 22 bp, Homo sapiens
gcatatcatgacttctatctta

SEQ ID NO: 7240781 - DNA, 22 bp, Homo sapiens
gcatatcagcatcaaaacacag

SEQ ID NO: 7240782 - DNA, 15 bp, Homo sapiens
gcatatcacattcat

SEQ ID NO: 7240783 - DNA, 17 bp, Homo sapiens
gcatcacagataacacg

SEQ ID NO: 7240784 - DNA, 22 bp, Homo sapiens
attgtctaattgacttggtgtg

SEQ ID NO: 7240785 - DNA, 22 bp, Homo sapiens
attgtcgtcaatggacacatag

SEQ ID NO: 7240786 - DNA, 22 bp, Homo sapiens
gcagtgtggccccagtatcacg

SEQ ID NO: 7240787 - DNA, 22 bp, Homo sapiens
gcatagaatttagagacaaaag

SEQ ID NO: 7240788 - DNA, 22 bp, Homo sapiens
gcatagaaggttttggtatcaa

SEQ ID NO: 7240789 - DNA, 22 bp, Homo sapiens
gcattctgtgctacagccattc

SEQ ID NO: 7240790 - DNA, 22 bp, Homo sapiens
gccaagaaatgcccctcacaga

SEQ ID NO: 7240791 - DNA, 22 bp, Homo sapiens
gccaagcctgggaagagcccat

SEQ ID NO: 7240792 - DNA, 22 bp, Homo sapiens
attccttgcacatcagatagtt

SEQ ID NO: 7240793 - DNA, 22 bp, Homo sapiens
attcttgatatagatagttaat

SEQ ID NO: 7240794 - DNA, 22 bp, Homo sapiens
attcttcttgagtcttggactc

SEQ ID NO: 7240795 - DNA, 22 bp, Homo sapiens
gcaggcctgtaatgaagggaca

SEQ ID NO: 7240796 - DNA, 22 bp, Homo sapiens
gcaggcctgggagtcatcttgt

SEQ ID NO: 7240797 - DNA, 22 bp, Homo sapiens
gcaggcctgcccagcaggatgg

SEQ ID NO: 7240798 - DNA, 22 bp, Homo sapiens
attgattgaagtaaaataacct

SEQ ID NO: 7240799 - DNA, 22 bp, Homo sapiens
attgcaaagaaatacatgctta

SEQ ID NO: 7240800 - DNA, 22 bp, Homo sapiens
gcactagaatcccttcaagaag

SEQ ID NO: 7240801 - DNA, 22 bp, Homo sapiens
gcacctggtttatataatcata

SEQ ID NO: 7240802 - DNA, 22 bp, Homo sapiens
gcacggctaatttttgtatttt

SEQ ID NO: 7240803 - DNA, 22 bp, Homo sapiens
attcaagagcccatgtttcctg

SEQ ID NO: 7240804 - DNA, 22 bp, Homo sapiens
attcacattctagggccctact

SEQ ID NO: 7240805 - DNA, 22 bp, Homo sapiens
attcacatgcccaagcagcacc

SEQ ID NO: 7240806 - DNA, 22 bp, Homo sapiens
attcatccttaccagtccccgg

SEQ ID NO: 7240807 - DNA, 22 bp, Homo sapiens
gcagcagaggccctactctttg

SEQ ID NO: 7240808 - DNA, 22 bp, Homo sapiens
attacagttctacacatccttt

SEQ ID NO: 7240809 - DNA, 22 bp, Homo sapiens
gatattctacctgctgaccaag

SEQ ID NO: 7240810 - DNA, 22 bp, Homo sapiens
gatattcaagtggaattattct

SEQ ID NO: 7240811 - DNA, 22 bp, Homo sapiens
attacaatcgagagaaacaaat

SEQ ID NO: 7240812 - DNA, 23 bp, Homo sapiens
attagaaaggctttctggtgaaa

SEQ ID NO: 7240813 - DNA, 22 bp, Homo sapiens
attagaaaaactcaagggctct

SEQ ID NO: 7240814 - DNA, 22 bp, Homo sapiens
gatttcagggtgtcttccagct

SEQ ID NO: 7240815 - DNA, 22 bp, Homo sapiens
gatttcagtggctgtctcaaat

SEQ ID NO: 7240816 - DNA, 22 bp, Homo sapiens
gatttcacgggaggtggctgga

SEQ ID NO: 7240817 - DNA, 22 bp, Homo sapiens
gatttcccagaaaagtgatctc

SEQ ID NO: 7240818 - DNA, 22 bp, Homo sapiens
gatttctctgcacccactcagg

SEQ ID NO: 7240819 - DNA, 22 bp, Homo sapiens
gatttctcaatcctagtactat

SEQ ID NO: 7240820 - DNA, 22 bp, Homo sapiens
attagttggggtggagaaggat

SEQ ID NO: 7240821 - DNA, 22 bp, Homo sapiens
attagttgatctatatccaaag

SEQ ID NO: 7240822 - DNA, 22 bp, Homo sapiens
attagttgaacaagttaagtaa

SEQ ID NO: 7240823 - DNA, 22 bp, Homo sapiens
attcaacttataagatattaat

SEQ ID NO: 7240824 - DNA, 22 bp, Homo sapiens
attcaacttacaaaggagaaga

SEQ ID NO: 7240825 - DNA, 22 bp, Homo sapiens
attcaactagtgattgtgttat

SEQ ID NO: 7240826 - DNA, 21 bp, Homo sapiens
attcaactagatgattatttc

SEQ ID NO: 7240827 - DNA, 22 bp, Homo sapiens
gccaggtggctgagcagctgca

SEQ ID NO: 7240828 - DNA, 22 bp, Homo sapiens
gccaggtggaggttgcagtgag

SEQ ID NO: 7240829 - DNA, 22 bp, Homo sapiens
gccaggctggccagcaccttct

SEQ ID NO: 7240830 - DNA, 17 bp, Homo sapiens
gcccacccttaggagct

SEQ ID NO: 7240831 - DNA, 23 bp, Homo sapiens
gcccaccctcagcgtcctcacgg

SEQ ID NO: 7240832 - DNA, 23 bp, Homo sapiens
gcccaccctcagcgtcctcacgg

SEQ ID NO: 7240833 - DNA, 22 bp, Homo sapiens
gcccacagttaatgggggctct

SEQ ID NO: 7240834 - DNA, 21 bp, Homo sapiens
gcccacagtgaggaggatccc

SEQ ID NO: 7240835 - DNA, 22 bp, Homo sapiens
gcccacagtgtagcaggtactc

SEQ ID NO: 7240836 - DNA, 22 bp, Homo sapiens
gcccacagttaatgggggctct

SEQ ID NO: 7240837 - DNA, 21 bp, Homo sapiens
gcccacagtgaggaggatccc

SEQ ID NO: 7240838 - DNA, 22 bp, Homo sapiens
gcccacagtctatcagtttgcg

SEQ ID NO: 7240839 - DNA, 22 bp, Homo sapiens
atttccatagagcgtctcacag

SEQ ID NO: 7240840 - DNA, 22 bp, Homo sapiens
atttccatgaaggcagatttta

SEQ ID NO: 7240841 - DNA, 22 bp, Homo sapiens
atttcccaatacgctaagtgga

SEQ ID NO: 7240842 - DNA, 22 bp, Homo sapiens
gcccccacaggcgggctcgggt

SEQ ID NO: 7240843 - DNA, 22 bp, Homo sapiens
atttctgctctgacctgaaagt

SEQ ID NO: 7240844 - DNA, 22 bp, Homo sapiens
atttctgtaacttatgaaagtt

SEQ ID NO: 7240845 - DNA, 22 bp, Homo sapiens
atttctcagttcctactgttta

SEQ ID NO: 7240846 - DNA, 22 bp, Homo sapiens
gcctcttgtttccttacatgga

SEQ ID NO: 7240847 - DNA, 22 bp, Homo sapiens
gcctatggattggagaaggagc

SEQ ID NO: 7240848 - DNA, 22 bp, Homo sapiens
atttggaacaaatattagtaaa

SEQ ID NO: 7240849 - DNA, 22 bp, Homo sapiens
atttggaactgggcatgcaaac

SEQ ID NO: 7240850 - DNA, 22 bp, Homo sapiens
atttggaacttataataagttt

SEQ ID NO: 7240851 - DNA, 22 bp, Homo sapiens
atttggaagaaatctgtcacag

SEQ ID NO: 7240852 - DNA, 22 bp, Homo sapiens
gcctaggagtacagaatggttt

SEQ ID NO: 7240853 - DNA, 22 bp, Homo sapiens
gcctaggagtggggatggcggt

SEQ ID NO: 7240854 - DNA, 22 bp, Homo sapiens
gcctaggatcaaccacatgaaa

SEQ ID NO: 7240855 - DNA, 21 bp, Homo sapiens
gcctagggagatgggactgcc

SEQ ID NO: 7240856 - DNA, 21 bp, Homo sapiens
gcctagggagatgggactgcc

SEQ ID NO: 7240857 - DNA, 22 bp, Homo sapiens
gcctaggattgtaaaagagctt

SEQ ID NO: 7240858 - DNA, 22 bp, Homo sapiens
atttggaaaagcggtaacttgc

SEQ ID NO: 7240859 - DNA, 22 bp, Homo sapiens
atttggaaaagtttcttcaact

SEQ ID NO: 7240860 - DNA, 22 bp, Homo sapiens
atttggaaaatctggttataga

SEQ ID NO: 7240861 - DNA, 22 bp, Homo sapiens
atttggaaacaaatggtttcgc

SEQ ID NO: 7240862 - DNA, 22 bp, Homo sapiens
atttggaaacatgctgaccatg

SEQ ID NO: 7240863 - DNA, 22 bp, Homo sapiens
atttggaaacaattatattctt

SEQ ID NO: 7240864 - DNA, 22 bp, Homo sapiens
atttggaaatacgcgcttttgg

SEQ ID NO: 7240865 - DNA, 19 bp, Homo sapiens
atttggaaataaggtcttc

SEQ ID NO: 7240866 - DNA, 19 bp, Homo sapiens
atttggaaataaggtcttc

SEQ ID NO: 7240867 - DNA, 22 bp, Homo sapiens
atttggaaatgtaagaatgcaa

SEQ ID NO: 7240868 - DNA, 22 bp, Homo sapiens
atttggaaatgcatctcttgag

SEQ ID NO: 7240869 - DNA, 22 bp, Homo sapiens
gccccctcaaagaggaagctct

SEQ ID NO: 7240870 - DNA, 22 bp, Homo sapiens
gcccccgtagtagatgaggcgc

SEQ ID NO: 7240871 - DNA, 22 bp, Homo sapiens
gcctggagttgtggtgaagcca

SEQ ID NO: 7240872 - DNA, 22 bp, Homo sapiens
gcctggagttgtggtgaagcca

SEQ ID NO: 7240873 - DNA, 22 bp, Homo sapiens
gcctggagttgaaactattatt

SEQ ID NO: 7240874 - DNA, 22 bp, Homo sapiens
atttggaatgctagtgaatgta

SEQ ID NO: 7240875 - DNA, 22 bp, Homo sapiens
atttggaatgggagcctggcat

SEQ ID NO: 7240876 - DNA, 22 bp, Homo sapiens
atttggaatggtctggcatttg

SEQ ID NO: 7240877 - DNA, 22 bp, Homo sapiens
atttggaatgtgtttgatcacc

SEQ ID NO: 7240878 - DNA, 22 bp, Homo sapiens
atttggaagcatttccaaagca

SEQ ID NO: 7240879 - DNA, 22 bp, Homo sapiens
gcctgagattctgcatttctaa

SEQ ID NO: 7240880 - DNA, 22 bp, Homo sapiens
atttggaagcttgaagattatt

SEQ ID NO: 7240881 - DNA, 22 bp, Homo sapiens
atttggaagcttgaagattatt

SEQ ID NO: 7240882 - DNA, 22 bp, Homo sapiens
atttggaaggagctgcacagca

SEQ ID NO: 7240883 - DNA, 22 bp, Homo sapiens
atttggaaggcgtttctctgta

SEQ ID NO: 7240884 - DNA, 22 bp, Homo sapiens
atttggaaggtttacaaagaga

SEQ ID NO: 7240885 - DNA, 22 bp, Homo sapiens
atttggaagtttggagtgaagg

SEQ ID NO: 7240886 - DNA, 22 bp, Homo sapiens
atttggaagtttttgtgggaat

SEQ ID NO: 7240887 - DNA, 22 bp, Homo sapiens
atttggaatagctgtagaaata

SEQ ID NO: 7240888 - DNA, 22 bp, Homo sapiens
gcctgagagtctgcatttctaa

SEQ ID NO: 7240889 - DNA, 22 bp, Homo sapiens
gctcttttcacagtccaaaatg

SEQ ID NO: 7240890 - DNA, 22 bp, Homo sapiens
gctgacagagtgcctggcctca

SEQ ID NO: 7240891 - DNA, 22 bp, Homo sapiens
gctgacagcgtttccagtgatg

SEQ ID NO: 7240892 - DNA, 22 bp, Homo sapiens
gctgacagttgtacctgcccct

SEQ ID NO: 7240893 - DNA, 22 bp, Homo sapiens
gctgacagttactgctgtaaca

SEQ ID NO: 7240894 - DNA, 22 bp, Homo sapiens
gctgacccctacaggttgtgtt

SEQ ID NO: 7240895 - DNA, 20 bp, Homo sapiens
gctgaccataaatcacactg

SEQ ID NO: 7240896 - DNA, 23 bp, Homo sapiens
gctgacgtttatccataaatata

SEQ ID NO: 7240897 - DNA, 22 bp, Homo sapiens
caaatgcatagtttataagaag

SEQ ID NO: 7240898 - DNA, 22 bp, Homo sapiens
caaatagaactcacagacaaga

SEQ ID NO: 7240899 - DNA, 22 bp, Homo sapiens
caaatagaaggtactcagagaa

SEQ ID NO: 7240900 - DNA, 21 bp, Homo sapiens
caaagctcattctttggtcat

SEQ ID NO: 7240901 - DNA, 22 bp, Homo sapiens
caaagctcgccacctctgaggg

SEQ ID NO: 7240902 - DNA, 22 bp, Homo sapiens
caaagctcatgctcttagccat

SEQ ID NO: 7240903 - DNA, 18 bp, Homo sapiens
caaagctcacgttccatc

SEQ ID NO: 7240904 - DNA, 22 bp, Homo sapiens
caaagctcagccctccaatgaa

SEQ ID NO: 7240905 - DNA, 22 bp, Homo sapiens
caaaggaggtgataggccctct

SEQ ID NO: 7240906 - DNA, 22 bp, Homo sapiens
caaaggaggtaatgggtgtgag

SEQ ID NO: 7240907 - DNA, 22 bp, Homo sapiens
caaaggcaacatatacttgttt

SEQ ID NO: 7240908 - DNA, 21 bp, Homo sapiens
caaagccaggcaactctctcc

SEQ ID NO: 7240909 - DNA, 22 bp, Homo sapiens
caaagccatagagtagataaga

SEQ ID NO: 7240910 - DNA, 21 bp, Homo sapiens
caaagccaggcaactctctcc

SEQ ID NO: 7240911 - DNA, 21 bp, Homo sapiens
caaagccaggcaactctctcc

SEQ ID NO: 7240912 - DNA, 22 bp, Homo sapiens
caaagccaggctttctaatgta

SEQ ID NO: 7240913 - DNA, 18 bp, Homo sapiens
caaagcaggtgacagtgt

SEQ ID NO: 7240914 - DNA, 20 bp, Homo sapiens
caaagcagtaggataaaaat

SEQ ID NO: 7240915 - DNA, 22 bp, Homo sapiens
caaagcaggaagaatattgaaa

SEQ ID NO: 7240916 - DNA, 22 bp, Homo sapiens
caaaatgtgagtcccacctcaa

SEQ ID NO: 7240917 - DNA, 22 bp, Homo sapiens
caaaatgttctggcacctttaa

SEQ ID NO: 7240918 - DNA, 22 bp, Homo sapiens
atttttgagctgtgaacatagc

SEQ ID NO: 7240919 - DNA, 22 bp, Homo sapiens
attttactttgtgaatattgac

SEQ ID NO: 7240920 - DNA, 22 bp, Homo sapiens
gacataaatgaagtttgactat

SEQ ID NO: 7240921 - DNA, 22 bp, Homo sapiens
gaccacagactggaaagagggc

SEQ ID NO: 7240922 - DNA, 22 bp, Homo sapiens
gaccaaggaagaggggagccag

SEQ ID NO: 7240923 - DNA, 22 bp, Homo sapiens
gaccacacgtcccagagagccc

SEQ ID NO: 7240924 - DNA, 22 bp, Homo sapiens
gaccaaggccctcagtgggagg

SEQ ID NO: 7240925 - DNA, 22 bp, Homo sapiens
gacaatgtgcaattgcagctag

SEQ ID NO: 7240926 - DNA, 22 bp, Homo sapiens
gacacactgtttggactagggt

SEQ ID NO: 7240927 - DNA, 22 bp, Homo sapiens
gacacaaagtttgtcagaaatt

SEQ ID NO: 7240928 - DNA, 22 bp, Homo sapiens
atgctattttacataggaatgg

SEQ ID NO: 7240929 - DNA, 22 bp, Homo sapiens
atgctattttacataggaatgg

SEQ ID NO: 7240930 - DNA, 22 bp, Homo sapiens
atgctatttaccacacatcatt

SEQ ID NO: 7240931 - DNA, 22 bp, Homo sapiens
gacgggtgtatgctcccagcca

SEQ ID NO: 7240932 - DNA, 22 bp, Homo sapiens
gacggggcagccagctggtggc

SEQ ID NO: 7240933 - DNA, 22 bp, Homo sapiens
gacgggtgtccctatgtccatt

SEQ ID NO: 7240934 - DNA, 22 bp, Homo sapiens
gacgggtgtatgctcccagcca

SEQ ID NO: 7240935 - DNA, 22 bp, Homo sapiens
gactacaacaataagaacagct

SEQ ID NO: 7240936 - DNA, 22 bp, Homo sapiens
gacctttttactgtgtacgctg

SEQ ID NO: 7240937 - DNA, 22 bp, Homo sapiens
gacctttagtgtccaatattca

SEQ ID NO: 7240938 - DNA, 22 bp, Homo sapiens
gacctttaatgtttctaccact

SEQ ID NO: 7240939 - DNA, 22 bp, Homo sapiens
gacggagctggttgctgcggct

SEQ ID NO: 7240940 - DNA, 22 bp, Homo sapiens
gactggagtcaatgagcagcac

SEQ ID NO: 7240941 - DNA, 22 bp, Homo sapiens
gactggagtcaatgagcagcac

SEQ ID NO: 7240942 - DNA, 22 bp, Homo sapiens
gactggagtcaatgagcagcac

SEQ ID NO: 7240943 - DNA, 22 bp, Homo sapiens
gactggagcccccaaggacacc

SEQ ID NO: 7240944 - DNA, 22 bp, Homo sapiens
gaacaaactgggtcccaatgat

SEQ ID NO: 7240945 - DNA, 22 bp, Homo sapiens
gaaggctgctgggaagtgtggt

SEQ ID NO: 7240946 - DNA, 22 bp, Homo sapiens
gaaggctggaaggcaagtagga

SEQ ID NO: 7240947 - DNA, 22 bp, Homo sapiens
gaaggctggctttctgagagca

SEQ ID NO: 7240948 - DNA, 22 bp, Homo sapiens
gaaggctgtcagagaggagggc

SEQ ID NO: 7240949 - DNA, 22 bp, Homo sapiens
gaaggctgtttctggtagtgat

SEQ ID NO: 7240950 - DNA, 22 bp, Homo sapiens
atgcacagacccaaaggccatc

SEQ ID NO: 7240951 - DNA, 22 bp, Homo sapiens
gaatcagatgcggtttagctta

SEQ ID NO: 7240952 - DNA, 22 bp, Homo sapiens
gaatcagataataagcaagcat

SEQ ID NO: 7240953 - DNA, 22 bp, Homo sapiens
gaatcagaatctgcatttttaa

SEQ ID NO: 7240954 - DNA, 22 bp, Homo sapiens
gaatcagaatctgcatgttaag

SEQ ID NO: 7240955 - DNA, 22 bp, Homo sapiens
gaatcagaatctctaaggtggg

SEQ ID NO: 7240956 - DNA, 22 bp, Homo sapiens
gaatacaaacttaaggctttac

SEQ ID NO: 7240957 - DNA, 22 bp, Homo sapiens
gaataatattgactttgcaggc

SEQ ID NO: 7240958 - DNA, 22 bp, Homo sapiens
atctggagatcagctggtggca

SEQ ID NO: 7240959 - DNA, 22 bp, Homo sapiens
atctggagagctggcagcccag

SEQ ID NO: 7240960 - DNA, 22 bp, Homo sapiens
atctggagagatcttcacaaaa

SEQ ID NO: 7240961 - DNA, 22 bp, Homo sapiens
atctggagaatgtttgtctccg

SEQ ID NO: 7240962 - DNA, 22 bp, Homo sapiens
atctggagaataaatgtccaag

SEQ ID NO: 7240963 - DNA, 22 bp, Homo sapiens
atctggccctctcagccctgtt

SEQ ID NO: 7240964 - DNA, 22 bp, Homo sapiens
atctggagtttcagttttctgg

SEQ ID NO: 7240965 - DNA, 23 bp, Homo sapiens
atctggagtgttgagtaggtact

SEQ ID NO: 7240966 - DNA, 22 bp, Homo sapiens
atctggagtgggacacagaaat

SEQ ID NO: 7240967 - DNA, 22 bp, Homo sapiens
atctggagtagaaaaatcgctt

SEQ ID NO: 7240968 - DNA, 22 bp, Homo sapiens
atctggaggtcatcgtttgttc

SEQ ID NO: 7240969 - DNA, 22 bp, Homo sapiens
atctggaggctaagtcatttgc

SEQ ID NO: 7240970 - DNA, 22 bp, Homo sapiens
atctggaggcctgtcttatccc

SEQ ID NO: 7240971 - DNA, 22 bp, Homo sapiens
atctggaggcattactctgtct

SEQ ID NO: 7240972 - DNA, 22 bp, Homo sapiens
atctggaggcaaaggggcgtga

SEQ ID NO: 7240973 - DNA, 22 bp, Homo sapiens
atctggaggattctgggacttg

SEQ ID NO: 7240974 - DNA, 22 bp, Homo sapiens
atctggagcttgttagatgttt

SEQ ID NO: 7240975 - DNA, 22 bp, Homo sapiens
atctggagcttaagcttatata

SEQ ID NO: 7240976 - DNA, 22 bp, Homo sapiens
atctggagctctgcacacctgg

SEQ ID NO: 7240977 - DNA, 22 bp, Homo sapiens
atctggagcagggccacaaggc

SEQ ID NO: 7240978 - DNA, 22 bp, Homo sapiens
atctggagcaagattaagagat

SEQ ID NO: 7240979 - DNA, 22 bp, Homo sapiens
atctggagatttcttttcaata

SEQ ID NO: 7240980 - DNA, 22 bp, Homo sapiens
atctggagatgggtctgtcacc

SEQ ID NO: 7240981 - DNA, 22 bp, Homo sapiens
atctggagatctgaattttgtg

SEQ ID NO: 7240982 - DNA, 22 bp, Homo sapiens
ctttcccttttgccttgcgtgg

SEQ ID NO: 7240983 - DNA, 23 bp, Homo sapiens
atgaacattagtttcagatattg

SEQ ID NO: 7240984 - DNA, 22 bp, Homo sapiens
ctttcttcaacctcattctgca

SEQ ID NO: 7240985 - DNA, 22 bp, Homo sapiens
atgaaacaaacctctatggagt

SEQ ID NO: 7240986 - DNA, 22 bp, Homo sapiens
atgaaaatactgtggttgatag

SEQ ID NO: 7240987 - DNA, 22 bp, Homo sapiens
atgaaattcatctgagaatgct

SEQ ID NO: 7240988 - DNA, 22 bp, Homo sapiens
atgaaacagtgtgtatagcaaa

SEQ ID NO: 7240989 - DNA, 20 bp, Homo sapiens
atgaaattcctgttttctga

SEQ ID NO: 7240990 - DNA, 18 bp, Homo sapiens
atgatcttagcaaatatt

SEQ ID NO: 7240991 - DNA, 22 bp, Homo sapiens
atgatgaaattttctatcatgt

SEQ ID NO: 7240992 - DNA, 22 bp, Homo sapiens
gaaatagaggacagctggatca

SEQ ID NO: 7240993 - DNA, 22 bp, Homo sapiens
gaaaggtttcatctacttttca

SEQ ID NO: 7240994 - DNA, 22 bp, Homo sapiens
gaaatagacactttctatgaat

SEQ ID NO: 7240995 - DNA, 22 bp, Homo sapiens
gaaatagacactttctatgaat

SEQ ID NO: 7240996 - DNA, 22 bp, Homo sapiens
atgacagctctagcacacagta

SEQ ID NO: 7240997 - DNA, 22 bp, Homo sapiens
atgacagcattttcttctaagg

SEQ ID NO: 7240998 - DNA, 22 bp, Homo sapiens
atgacagatgctgtggggaggt

SEQ ID NO: 7240999 - DNA, 17 bp, Homo sapiens
atgacagcattaaggta

SEQ ID NO: 7241000 - DNA, 21 bp, Homo sapiens
atgacagatgctgcagatcgt

SEQ ID NO: 7241001 - DNA, 22 bp, Homo sapiens
atgacagtgggtcttgcaaaga

SEQ ID NO: 7241002 - DNA, 22 bp, Homo sapiens
atgacagtactggtgacaatac

SEQ ID NO: 7241003 - DNA, 22 bp, Homo sapiens
ctttcttcatctgtaatatgga

SEQ ID NO: 7241004 - DNA, 22 bp, Homo sapiens
gagggcgcttcagagagatgaa

SEQ ID NO: 7241005 - DNA, 22 bp, Homo sapiens
gagggctctgaaaggaggtcac

SEQ ID NO: 7241006 - DNA, 22 bp, Homo sapiens
gagggctctgtctggaagggaa

SEQ ID NO: 7241007 - DNA, 22 bp, Homo sapiens
gagggctcactgagaaagcagt

SEQ ID NO: 7241008 - DNA, 22 bp, Homo sapiens
gagggctccattccccgtgccc

SEQ ID NO: 7241009 - DNA, 20 bp, Homo sapiens
gagggctcgtggatggataa

SEQ ID NO: 7241010 - DNA, 22 bp, Homo sapiens
gagggctgaagattgtggcccc

SEQ ID NO: 7241011 - DNA, 22 bp, Homo sapiens
atgtgagggctcaggctgactg

SEQ ID NO: 7241012 - DNA, 22 bp, Homo sapiens
gaggtggatgttgcagtgagct

SEQ ID NO: 7241013 - DNA, 22 bp, Homo sapiens
atgtccttttatttaaagcagg

SEQ ID NO: 7241014 - DNA, 22 bp, Homo sapiens
atgtccttccattttgatctgt

SEQ ID NO: 7241015 - DNA, 22 bp, Homo sapiens
atgtccttcggacaaaattctt

SEQ ID NO: 7241016 - DNA, 22 bp, Homo sapiens
gaggtggcactgtgaggagcac

SEQ ID NO: 7241017 - DNA, 22 bp, Homo sapiens
gaggtggccaagcgaggaaggg

SEQ ID NO: 7241018 - DNA, 22 bp, Homo sapiens
gaggtggcccttgctcagcctt

SEQ ID NO: 7241019 - DNA, 20 bp, Homo sapiens
atgttcttcatttaatgttc

SEQ ID NO: 7241020 - DNA, 22 bp, Homo sapiens
atgttcttatcattctttcgga

SEQ ID NO: 7241021 - DNA, 22 bp, Homo sapiens
atgttcttagcaaagtacttgc

SEQ ID NO: 7241022 - DNA, 22 bp, Homo sapiens
atgttcttcctctgcacagcta

SEQ ID NO: 7241023 - DNA, 22 bp, Homo sapiens
atgttcttgactttcctgcctg

SEQ ID NO: 7241024 - DNA, 22 bp, Homo sapiens
atgttctttcagccagtgcatc

SEQ ID NO: 7241025 - DNA, 22 bp, Homo sapiens
atgttctttgtgattctgagct

SEQ ID NO: 7241026 - DNA, 22 bp, Homo sapiens
atgttctttggaatttatgaaa

SEQ ID NO: 7241027 - DNA, 20 bp, Homo sapiens
atgtgtctgtaaacaactct

SEQ ID NO: 7241028 - DNA, 22 bp, Homo sapiens
atgttattttggaaaatacaaa

SEQ ID NO: 7241029 - DNA, 22 bp, Homo sapiens
gatatgaagtggcattgtgaag

SEQ ID NO: 7241030 - DNA, 22 bp, Homo sapiens
gatatcagagacttggctacca

SEQ ID NO: 7241031 - DNA, 22 bp, Homo sapiens
atgtttaaaggagtcagagact

SEQ ID NO: 7241032 - DNA, 22 bp, Homo sapiens
atgttgttttttcataaagtat

SEQ ID NO: 7241033 - DNA, 22 bp, Homo sapiens
atgttggactaggctcttaatt

SEQ ID NO: 7241034 - DNA, 22 bp, Homo sapiens
atgttgtactgagaattaggag

SEQ ID NO: 7241035 - DNA, 22 bp, Homo sapiens
atgttgtagcatatgaaatata

SEQ ID NO: 7241036 - DNA, 22 bp, Homo sapiens
atgtttaaatttatagacagtg

SEQ ID NO: 7241037 - DNA, 22 bp, Homo sapiens
atgtttaaggaactggtttgct

SEQ ID NO: 7241038 - DNA, 22 bp, Homo sapiens
atgtttaatcggctgcctttcc

SEQ ID NO: 7241039 - DNA, 20 bp, Homo sapiens
gagttccccatttctcctgg

SEQ ID NO: 7241040 - DNA, 22 bp, Homo sapiens
gaggagaagctattggaaggac

SEQ ID NO: 7241041 - DNA, 21 bp, Homo sapiens
atggtctgaggatagcaaaaa

SEQ ID NO: 7241042 - DNA, 22 bp, Homo sapiens
gaggagaaatttggggacctga

SEQ ID NO: 7241043 - DNA, 22 bp, Homo sapiens
gaggagaaatttggggacctga

SEQ ID NO: 7241044 - DNA, 22 bp, Homo sapiens
gaggagaagctaagaaacacag

SEQ ID NO: 7241045 - DNA, 22 bp, Homo sapiens
gaggagaagctattggaaggac

SEQ ID NO: 7241046 - DNA, 22 bp, Homo sapiens
gaggagaagctattggaaggac

SEQ ID NO: 7241047 - DNA, 22 bp, Homo sapiens
gaggcagcatctatggtgggaa

SEQ ID NO: 7241048 - DNA, 22 bp, Homo sapiens
gaggcagcatggtaccttggag

SEQ ID NO: 7241049 - DNA, 22 bp, Homo sapiens
gaggcagcctcagtggacctcg

SEQ ID NO: 7241050 - DNA, 22 bp, Homo sapiens
gaggcagcctcagtggacctcg

SEQ ID NO: 7241051 - DNA, 18 bp, Homo sapiens
atgggcaggtaagatcca

SEQ ID NO: 7241052 - DNA, 22 bp, Homo sapiens
atgggcagggcagtgtataaga

SEQ ID NO: 7241053 - DNA, 22 bp, Homo sapiens
atgggcagtaacagtggcagtc

SEQ ID NO: 7241054 - DNA, 22 bp, Homo sapiens
atgggcaggcctctcatttctg

SEQ ID NO: 7241055 - DNA, 22 bp, Homo sapiens
atgggaaagaagccactgccca

SEQ ID NO: 7241056 - DNA, 22 bp, Homo sapiens
atgggctgcttctccagcacct

SEQ ID NO: 7241057 - DNA, 22 bp, Homo sapiens
atgggctgtcctagtccagccc

SEQ ID NO: 7241058 - DNA, 22 bp, Homo sapiens
atggggagagaagggctgagct

SEQ ID NO: 7241059 - DNA, 22 bp, Homo sapiens
atggggaagagccagtgagctg

SEQ ID NO: 7241060 - DNA, 22 bp, Homo sapiens
atggggagagaagggctgagct

SEQ ID NO: 7241061 - DNA, 22 bp, Homo sapiens
gagaggttgaacaacatactct

SEQ ID NO: 7241062 - DNA, 22 bp, Homo sapiens
atggagggtggtaagacagaga

SEQ ID NO: 7241063 - DNA, 22 bp, Homo sapiens
atggagggaaaagtggagagcc

SEQ ID NO: 7241064 - DNA, 21 bp, Homo sapiens
atggagggaccagggaagcag

SEQ ID NO: 7241065 - DNA, 21 bp, Homo sapiens
atggagggaccagggaagcag

SEQ ID NO: 7241066 - DNA, 18 bp, Homo sapiens
atggaggcagagagctga

SEQ ID NO: 7241067 - DNA, 17 bp, Homo sapiens
atggaggcagacaggtc

SEQ ID NO: 7241068 - DNA, 22 bp, Homo sapiens
gagagagaggtgctgccaggca

SEQ ID NO: 7241069 - DNA, 22 bp, Homo sapiens
gagagagagctaatattaagct

SEQ ID NO: 7241070 - DNA, 22 bp, Homo sapiens
gagagagacatgtaaacgcggt

SEQ ID NO: 7241071 - DNA, 22 bp, Homo sapiens
gagagagaagtgggtgtcacct

SEQ ID NO: 7241072 - DNA, 22 bp, Homo sapiens
gagagagaaggcctgtgggtgt

SEQ ID NO: 7241073 - DNA, 22 bp, Homo sapiens
gagagataggttgcaggaagct

SEQ ID NO: 7241074 - DNA, 23 bp, Homo sapiens
gagagagattgctaaaccactcc

SEQ ID NO: 7241075 - DNA, 22 bp, Homo sapiens
atggccagagaggccagcctgg

SEQ ID NO: 7241076 - DNA, 22 bp, Homo sapiens
atggcttaagaatgcttttgtg

SEQ ID NO: 7241077 - DNA, 22 bp, Homo sapiens
atggcttttaactttgatggca

SEQ ID NO: 7241078 - DNA, 22 bp, Homo sapiens
atggctttgactgtaagtggta

SEQ ID NO: 7241079 - DNA, 22 bp, Homo sapiens
atggctttccggactttggcca

SEQ ID NO: 7241080 - DNA, 22 bp, Homo sapiens
atggcattatagcaatggtttg

SEQ ID NO: 7241081 - DNA, 22 bp, Homo sapiens
atggcatttatgttgacaatgg

SEQ ID NO: 7241082 - DNA, 22 bp, Homo sapiens
atggccagagagagcacacctg

SEQ ID NO: 7241083 - DNA, 22 bp, Homo sapiens
atcaaaatggaagaatttggct

SEQ ID NO: 7241084 - DNA, 22 bp, Homo sapiens
atattttggggtgatgtgcatc

SEQ ID NO: 7241085 - DNA, 22 bp, Homo sapiens
atcaaagggattgggggctgct

SEQ ID NO: 7241086 - DNA, 22 bp, Homo sapiens
atcaaaggtatctatgctgtct

SEQ ID NO: 7241087 - DNA, 23 bp, Homo sapiens
atcaaaggatgtagagaagaagc

SEQ ID NO: 7241088 - DNA, 22 bp, Homo sapiens
atcaaagagcttgacaatccta

SEQ ID NO: 7241089 - DNA, 22 bp, Homo sapiens
atcagaaaaacataatgttatt

SEQ ID NO: 7241090 - DNA, 22 bp, Homo sapiens
atcaacatgtcataaagtgaaa

SEQ ID NO: 7241091 - DNA, 22 bp, Homo sapiens
atcaacatgaatttctctgaag

SEQ ID NO: 7241092 - DNA, 22 bp, Homo sapiens
atcaacatatgcatgggaaagt

SEQ ID NO: 7241093 - DNA, 22 bp, Homo sapiens
atcagaaactcttagagcaggg

SEQ ID NO: 7241094 - DNA, 22 bp, Homo sapiens
atcagaagttgtgcatgcatgg

SEQ ID NO: 7241095 - DNA, 20 bp, Homo sapiens
atcagaagtgatattaacca

SEQ ID NO: 7241096 - DNA, 22 bp, Homo sapiens
atcagaaggggaggtaaagaag

SEQ ID NO: 7241097 - DNA, 22 bp, Homo sapiens
atcagaagaaatggatgtgact

SEQ ID NO: 7241098 - DNA, 22 bp, Homo sapiens
atatgcagtctcttgcccttct

SEQ ID NO: 7241099 - DNA, 22 bp, Homo sapiens
atatgcacgcatacacacataa

SEQ ID NO: 7241100 - DNA, 22 bp, Homo sapiens
ctgggctcagatgagaggaagg

SEQ ID NO: 7241101 - DNA, 22 bp, Homo sapiens
ctgggctcacctgtggctggca

SEQ ID NO: 7241102 - DNA, 22 bp, Homo sapiens
ctggctgggagcgagctgctca

SEQ ID NO: 7241103 - DNA, 22 bp, Homo sapiens
atatgctatgtatgtaaatgag

SEQ ID NO: 7241104 - DNA, 22 bp, Homo sapiens
atatgctagtgtgcttatactt

SEQ ID NO: 7241105 - DNA, 22 bp, Homo sapiens
atatgctacaaataaactttta

SEQ ID NO: 7241106 - DNA, 22 bp, Homo sapiens
atatgctacaaataaactttta

SEQ ID NO: 7241107 - DNA, 20 bp, Homo sapiens
atatgctaatttttagtggg

SEQ ID NO: 7241108 - DNA, 22 bp, Homo sapiens
atatgctaattagagggcatta

SEQ ID NO: 7241109 - DNA, 22 bp, Homo sapiens
atatgctatgttgaataatttg

SEQ ID NO: 7241110 - DNA, 22 bp, Homo sapiens
atatgctatgttgaataatttg

SEQ ID NO: 7241111 - DNA, 22 bp, Homo sapiens
atattatggccccatctaagct

SEQ ID NO: 7241112 - DNA, 22 bp, Homo sapiens
atattcttgaagggagattata

SEQ ID NO: 7241113 - DNA, 22 bp, Homo sapiens
ctgtgggagaagctagcacagg

SEQ ID NO: 7241114 - DNA, 21 bp, Homo sapiens
ctgtgggaccaagcactggga

SEQ ID NO: 7241115 - DNA, 22 bp, Homo sapiens
ctgtgggagaagggctttttct

SEQ ID NO: 7241116 - DNA, 23 bp, Homo sapiens
ctgtgggaagtcggggagcgcgc

SEQ ID NO: 7241117 - DNA, 22 bp, Homo sapiens
ctgtggctaggattattcctga

SEQ ID NO: 7241118 - DNA, 22 bp, Homo sapiens
ctgtgggaaaggatgagattgc

SEQ ID NO: 7241119 - DNA, 22 bp, Homo sapiens
atcagacagggagttctgtgtc

SEQ ID NO: 7241120 - DNA, 22 bp, Homo sapiens
atcagagattgtagtatgtgca

SEQ ID NO: 7241121 - DNA, 23 bp, Homo sapiens
ctgtggccctgcttcatgcagcc

SEQ ID NO: 7241122 - DNA, 22 bp, Homo sapiens
ctgtggccttggaccagcatct

SEQ ID NO: 7241123 - DNA, 22 bp, Homo sapiens
atccactcggagggaatgttta

SEQ ID NO: 7241124 - DNA, 22 bp, Homo sapiens
atccactcctggaggtgcccca

SEQ ID NO: 7241125 - DNA, 22 bp, Homo sapiens
atccactccctaacaccatgtt

SEQ ID NO: 7241126 - DNA, 22 bp, Homo sapiens
atccagggataaaagtaaggtt

SEQ ID NO: 7241127 - DNA, 22 bp, Homo sapiens
atccagggtgtggagagagctc

SEQ ID NO: 7241128 - DNA, 22 bp, Homo sapiens
atccagtccatgacattctgtt

SEQ ID NO: 7241129 - DNA, 22 bp, Homo sapiens
atccagtgagtgcagctgttgt

SEQ ID NO: 7241130 - DNA, 22 bp, Homo sapiens
atctgacaagttgtgtgtatag

SEQ ID NO: 7241131 - DNA, 22 bp, Homo sapiens
atctctgccaacagttaatgtt

SEQ ID NO: 7241132 - DNA, 22 bp, Homo sapiens
atctgaagggaagtggaaggca

SEQ ID NO: 7241133 - DNA, 19 bp, Homo sapiens
atctgaagtaggtgcagct

SEQ ID NO: 7241134 - DNA, 22 bp, Homo sapiens
cttagatgaagtcacagaaccc

SEQ ID NO: 7241135 - DNA, 22 bp, Homo sapiens
cttcattaatgtctataagttt

SEQ ID NO: 7241136 - DNA, 23 bp, Homo sapiens
cttccagtactgcacactcaagg

SEQ ID NO: 7241137 - DNA, 22 bp, Homo sapiens
cttcccaagactgtattgcaag

SEQ ID NO: 7241138 - DNA, 22 bp, Homo sapiens
agttatttactcctttgtctct

SEQ ID NO: 7241139 - DNA, 22 bp, Homo sapiens
agttatttaaaatgattgtcct

SEQ ID NO: 7241140 - DNA, 22 bp, Homo sapiens
agttatctgttagtattccagg

SEQ ID NO: 7241141 - DNA, 22 bp, Homo sapiens
agttatattccatagattcaga

SEQ ID NO: 7241142 - DNA, 22 bp, Homo sapiens
ctgaggagatgataatgtcatt

SEQ ID NO: 7241143 - DNA, 22 bp, Homo sapiens
ctgaggagaggtggcctgtgtt

SEQ ID NO: 7241144 - DNA, 22 bp, Homo sapiens
ctgaggagcagctggcccgcta

SEQ ID NO: 7241145 - DNA, 22 bp, Homo sapiens
ctgaggagcagctggcccgcta

SEQ ID NO: 7241146 - DNA, 22 bp, Homo sapiens
agttatttcagtaacataatag

SEQ ID NO: 7241147 - DNA, 22 bp, Homo sapiens
ctgcagggttcggagagttccc

SEQ ID NO: 7241148 - DNA, 20 bp, Homo sapiens
ctgcagggttagaggctcca

SEQ ID NO: 7241149 - DNA, 20 bp, Homo sapiens
ctgcagggttagaggctcca

SEQ ID NO: 7241150 - DNA, 20 bp, Homo sapiens
ctgcagggtgagtgggcgat

SEQ ID NO: 7241151 - DNA, 22 bp, Homo sapiens
ctgcagggagaggggacagcct

SEQ ID NO: 7241152 - DNA, 23 bp, Homo sapiens
ctgcagagaactgagggacagcc

SEQ ID NO: 7241153 - DNA, 22 bp, Homo sapiens
ctgcagagatgaagaaggtggc

SEQ ID NO: 7241154 - DNA, 22 bp, Homo sapiens
ctgcagagagtgccgggcagcc

SEQ ID NO: 7241155 - DNA, 22 bp, Homo sapiens
ataaatgaacattcacagagct

SEQ ID NO: 7241156 - DNA, 22 bp, Homo sapiens
ctgccctgtttggacagcccgg

SEQ ID NO: 7241157 - DNA, 22 bp, Homo sapiens
ctgcatttcacatttaaacttt

SEQ ID NO: 7241158 - DNA, 22 bp, Homo sapiens
ctgcctctcagcctgaccgcca

SEQ ID NO: 7241159 - DNA, 22 bp, Homo sapiens
ctgcctctcaggtccctgagat

SEQ ID NO: 7241160 - DNA, 22 bp, Homo sapiens
ataaatgtgaattagagctttg

SEQ ID NO: 7241161 - DNA, 22 bp, Homo sapiens
ataacagatactctctgtgagg

SEQ ID NO: 7241162 - DNA, 22 bp, Homo sapiens
ataacagatgtgaagtgctaat

SEQ ID NO: 7241163 - DNA, 22 bp, Homo sapiens
ataacagtgacctctcagcacc

SEQ ID NO: 7241164 - DNA, 22 bp, Homo sapiens
ataacatgagccagattgaaag

SEQ ID NO: 7241165 - DNA, 22 bp, Homo sapiens
ataaccttggctagtattgtgc

SEQ ID NO: 7241166 - DNA, 23 bp, Homo sapiens
ataagaaaacagtaggctcagag

SEQ ID NO: 7241167 - DNA, 22 bp, Homo sapiens
atacaaagctaaatatggtttc

SEQ ID NO: 7241168 - DNA, 17 bp, Homo sapiens
atacaaagccataaacc

SEQ ID NO: 7241169 - DNA, 22 bp, Homo sapiens
atacaaagctaaatatggtttc

SEQ ID NO: 7241170 - DNA, 22 bp, Homo sapiens
ataatttggcttcctagatgta

SEQ ID NO: 7241171 - DNA, 22 bp, Homo sapiens
ataatttactaagctctacctt

SEQ ID NO: 7241172 - DNA, 21 bp, Homo sapiens
ataagcatgctgattacattt

SEQ ID NO: 7241173 - DNA, 22 bp, Homo sapiens
ataagatataaatccacagagt

SEQ ID NO: 7241174 - DNA, 22 bp, Homo sapiens
atacaaagctttctgtctggta

SEQ ID NO: 7241175 - DNA, 22 bp, Homo sapiens
atacaaaggaacacaggcatgt

SEQ ID NO: 7241176 - DNA, 22 bp, Homo sapiens
atacaaagtattaatcctggat

SEQ ID NO: 7241177 - DNA, 22 bp, Homo sapiens
atacaacagaaaatgattattc

SEQ ID NO: 7241178 - DNA, 22 bp, Homo sapiens
atacagatgttaaagcaatttc

SEQ ID NO: 7241179 - DNA, 22 bp, Homo sapiens
atacagtagacaatctcatgaa

SEQ ID NO: 7241180 - DNA, 22 bp, Homo sapiens
atacagtaatttgtaactcatc

SEQ ID NO: 7241181 - DNA, 22 bp, Homo sapiens
ctgctgcaggatgggcactctg

SEQ ID NO: 7241182 - DNA, 22 bp, Homo sapiens
ctgctgcagatgacagacccaa

SEQ ID NO: 7241183 - DNA, 22 bp, Homo sapiens
ctggaagttggaactgatatga

SEQ ID NO: 7241184 - DNA, 22 bp, Homo sapiens
ctggaataaacgatcttcagca

SEQ ID NO: 7241185 - DNA, 22 bp, Homo sapiens
atacgcataatgtttattcctg

SEQ ID NO: 7241186 - DNA, 22 bp, Homo sapiens
ataccctttacaggaacagcaa

SEQ ID NO: 7241187 - DNA, 22 bp, Homo sapiens
atacatatatggtacttcctgg

SEQ ID NO: 7241188 - DNA, 22 bp, Homo sapiens
atacagtggctgtgagctgggc

SEQ ID NO: 7241189 - DNA, 22 bp, Homo sapiens
atacatacatgtatgcacatac

SEQ ID NO: 7241190 - DNA, 22 bp, Homo sapiens
atacagttatagtcagggctaa

SEQ ID NO: 7241191 - DNA, 22 bp, Homo sapiens
ctggcccatggtgagctctggg

SEQ ID NO: 7241192 - DNA, 22 bp, Homo sapiens
ctggccccaggcagcctgctgg

SEQ ID NO: 7241193 - DNA, 22 bp, Homo sapiens
ctggcccccacacctgtcaggg

SEQ ID NO: 7241194 - DNA, 22 bp, Homo sapiens
atagagatgggtttagttataa

SEQ ID NO: 7241195 - DNA, 22 bp, Homo sapiens
atagagctataagaattttgtg

SEQ ID NO: 7241196 - DNA, 22 bp, Homo sapiens
ctggctgcagctccgaggaaga

SEQ ID NO: 7241197 - DNA, 19 bp, Homo sapiens
ctggctgcaatgccagggt

SEQ ID NO: 7241198 - DNA, 22 bp, Homo sapiens
atagcagtaacactgacatttt

SEQ ID NO: 7241199 - DNA, 22 bp, Homo sapiens
atagcagggatgtcagcaagta

SEQ ID NO: 7241200 - DNA, 22 bp, Homo sapiens
ctggctggccatgcagcgccag

SEQ ID NO: 7241201 - DNA, 23 bp, Homo sapiens
aggtaggttattgctgctacctg

SEQ ID NO: 7241202 - DNA, 22 bp, Homo sapiens
aggtagggctaggctgcgtctg

SEQ ID NO: 7241203 - DNA, 22 bp, Homo sapiens
cctgccagctgtgggccagcct

SEQ ID NO: 7241204 - DNA, 22 bp, Homo sapiens
aggtaggatgggtggagatgat

SEQ ID NO: 7241205 - DNA, 22 bp, Homo sapiens
aggtaggatagataggaagacc

SEQ ID NO: 7241206 - DNA, 22 bp, Homo sapiens
cctgcagccgtcctgtttgtct

SEQ ID NO: 7241207 - DNA, 23 bp, Homo sapiens
cctgcagctgccacgccctgctc

SEQ ID NO: 7241208 - DNA, 22 bp, Homo sapiens
cctgcagagggactggcaggaa

SEQ ID NO: 7241209 - DNA, 22 bp, Homo sapiens
cctgcagaccacactcagtcct

SEQ ID NO: 7241210 - DNA, 19 bp, Homo sapiens
aggtcctcaggatgaccct

SEQ ID NO: 7241211 - DNA, 22 bp, Homo sapiens
aggtcctcctcctccaggaagg

SEQ ID NO: 7241212 - DNA, 21 bp, Homo sapiens
aggtcccaggtttgggcagca

SEQ ID NO: 7241213 - DNA, 22 bp, Homo sapiens
aggtccatcttaaatgcactca

SEQ ID NO: 7241214 - DNA, 22 bp, Homo sapiens
aggtccatcgtggatgaactgc

SEQ ID NO: 7241215 - DNA, 22 bp, Homo sapiens
cctggaggtggaggttgcagtg

SEQ ID NO: 7241216 - DNA, 22 bp, Homo sapiens
cctggaggtggaggttgcagtg

SEQ ID NO: 7241217 - DNA, 22 bp, Homo sapiens
aggtagtgtagctgagtgggat

SEQ ID NO: 7241218 - DNA, 22 bp, Homo sapiens
aggtggggaggagtgtctcttt

SEQ ID NO: 7241219 - DNA, 22 bp, Homo sapiens
aggtggggccaaatgctacagt

SEQ ID NO: 7241220 - DNA, 22 bp, Homo sapiens
aggtgggcacacctcccttctc

SEQ ID NO: 7241221 - DNA, 22 bp, Homo sapiens
aggtgggcaatgaggcctgagt

SEQ ID NO: 7241222 - DNA, 20 bp, Homo sapiens
cctgtccaagctccacccca

SEQ ID NO: 7241223 - DNA, 22 bp, Homo sapiens
cctgtgacttggcaaacctcca

SEQ ID NO: 7241224 - DNA, 22 bp, Homo sapiens
cctgtgagtcaacccctccttg

SEQ ID NO: 7241225 - DNA, 22 bp, Homo sapiens
cctggtgcttaccagagctttt

SEQ ID NO: 7241226 - DNA, 22 bp, Homo sapiens
cctggtgccggtagacgcgcag

SEQ ID NO: 7241227 - DNA, 22 bp, Homo sapiens
cctggtgcccccaagccagctg

SEQ ID NO: 7241228 - DNA, 22 bp, Homo sapiens
cctggtgctgctatcaggggta

SEQ ID NO: 7241229 - DNA, 22 bp, Homo sapiens
cctggtgccggtagacgcgcag

SEQ ID NO: 7241230 - DNA, 22 bp, Homo sapiens
cctgggcttgcatctgtgctgg

SEQ ID NO: 7241231 - DNA, 22 bp, Homo sapiens
cctgggctcaggcttgggcagc

SEQ ID NO: 7241232 - DNA, 22 bp, Homo sapiens
agtccacagctcatagtttttt

SEQ ID NO: 7241233 - DNA, 22 bp, Homo sapiens
ctagaatctatgtcaggaactc

SEQ ID NO: 7241234 - DNA, 22 bp, Homo sapiens
ctagaatactcgtattattccc

SEQ ID NO: 7241235 - DNA, 22 bp, Homo sapiens
ctagaaggtctgggcctgggaa

SEQ ID NO: 7241236 - DNA, 22 bp, Homo sapiens
ctagtattaagtgtgagtaaaa

SEQ ID NO: 7241237 - DNA, 22 bp, Homo sapiens
ctaggtggtggtgggttgacat

SEQ ID NO: 7241238 - DNA, 22 bp, Homo sapiens
ctaagcatccatctcttcttca

SEQ ID NO: 7241239 - DNA, 22 bp, Homo sapiens
ctagaacagaaagtacaggaaa

SEQ ID NO: 7241240 - DNA, 22 bp, Homo sapiens
ctagaaattctgattcagtagg

SEQ ID NO: 7241241 - DNA, 22 bp, Homo sapiens
ctagaaatgtagattcttagtg

SEQ ID NO: 7241242 - DNA, 22 bp, Homo sapiens
ctagaaatctctgtttacatca

SEQ ID NO: 7241243 - DNA, 22 bp, Homo sapiens
cgcaggggaggaaggtacacct

SEQ ID NO: 7241244 - DNA, 18 bp, Homo sapiens
aggttttcaggatatgtg

SEQ ID NO: 7241245 - DNA, 22 bp, Homo sapiens
agtaaaaagttcagaatggttg

SEQ ID NO: 7241246 - DNA, 22 bp, Homo sapiens
agtaaaaagttcagaatggttg

SEQ ID NO: 7241247 - DNA, 22 bp, Homo sapiens
aggttttcacaggaagtatgtt

SEQ ID NO: 7241248 - DNA, 15 bp, Homo sapiens
aggttttcagagtaa

SEQ ID NO: 7241249 - DNA, 18 bp, Homo sapiens
aggttttcagagtttcca

SEQ ID NO: 7241250 - DNA, 22 bp, Homo sapiens
aggttttcagctgtatcctgag

SEQ ID NO: 7241251 - DNA, 22 bp, Homo sapiens
agtaaaaatatgcttgtggcta

SEQ ID NO: 7241252 - DNA, 22 bp, Homo sapiens
agtaaaaatatgcttgtggcta

SEQ ID NO: 7241253 - DNA, 20 bp, Homo sapiens
cggctcagcctctccctccc

SEQ ID NO: 7241254 - DNA, 22 bp, Homo sapiens
cctgtgttctaatccatctcag

SEQ ID NO: 7241255 - DNA, 22 bp, Homo sapiens
agtacagtagatgtaggaatag

SEQ ID NO: 7241256 - DNA, 22 bp, Homo sapiens
agtacagatttagacacgatag

SEQ ID NO: 7241257 - DNA, 22 bp, Homo sapiens
ctaagaaatgttgtgaatgcca

SEQ ID NO: 7241258 - DNA, 22 bp, Homo sapiens
ctaagacatgccctgcatgata

SEQ ID NO: 7241259 - DNA, 22 bp, Homo sapiens
cgggctgctctggaccgacagc

SEQ ID NO: 7241260 - DNA, 18 bp, Homo sapiens
cgggcgggcgcctggccc

SEQ ID NO: 7241261 - DNA, 22 bp, Homo sapiens
agtacaagtattagagttattc

SEQ ID NO: 7241262 - DNA, 22 bp, Homo sapiens
cgggccgttaggaaggtggggc

SEQ ID NO: 7241263 - DNA, 22 bp, Homo sapiens
cgggcccgagcacggcacccac

SEQ ID NO: 7241264 - DNA, 22 bp, Homo sapiens
cggctcagctagcttggcccca

SEQ ID NO: 7241265 - DNA, 22 bp, Homo sapiens
cgggcagattgggaaggttcat

SEQ ID NO: 7241266 - DNA, 22 bp, Homo sapiens
cgggcagatcacacagggcttg

SEQ ID NO: 7241267 - DNA, 22 bp, Homo sapiens
cgggcagcggcgtggccatggt

SEQ ID NO: 7241268 - DNA, 22 bp, Homo sapiens
cgggcagtgtggctccagagtc

SEQ ID NO: 7241269 - DNA, 22 bp, Homo sapiens
cgggcagcggcgtggccatggt

SEQ ID NO: 7241270 - DNA, 22 bp, Homo sapiens
ctcattgcagctgcattactgt

SEQ ID NO: 7241271 - DNA, 22 bp, Homo sapiens
agtccgcctgctgccgtggcag

SEQ ID NO: 7241272 - DNA, 22 bp, Homo sapiens
ctccagctagggctggcttact

SEQ ID NO: 7241273 - DNA, 22 bp, Homo sapiens
ctccagcctcatctcctggctg

SEQ ID NO: 7241274 - DNA, 22 bp, Homo sapiens
ctcctagatgtcttcagagaaa

SEQ ID NO: 7241275 - DNA, 22 bp, Homo sapiens
ctcctcacacccactgcaacca

SEQ ID NO: 7241276 - DNA, 22 bp, Homo sapiens
ctcctcacacccactgcaacca

SEQ ID NO: 7241277 - DNA, 22 bp, Homo sapiens
ctcctacataacccagcgaact

SEQ ID NO: 7241278 - DNA, 22 bp, Homo sapiens
ctccggccgcggtgcccagcgc

SEQ ID NO: 7241279 - DNA, 21 bp, Homo sapiens
ctccggagtgagctgtgggta

SEQ ID NO: 7241280 - DNA, 22 bp, Homo sapiens
ctccggaggggcgctcatgctt

SEQ ID NO: 7241281 - DNA, 22 bp, Homo sapiens
ctccctctgaggctttgagcct

SEQ ID NO: 7241282 - DNA, 22 bp, Homo sapiens
ctccctctgtccgaggccggct

SEQ ID NO: 7241283 - DNA, 22 bp, Homo sapiens
ctccctctctaaggcaaagaga

SEQ ID NO: 7241284 - DNA, 22 bp, Homo sapiens
ctcctcagaacagccttggctg

SEQ ID NO: 7241285 - DNA, 22 bp, Homo sapiens
ctcctcagaagagggtaacaca

SEQ ID NO: 7241286 - DNA, 22 bp, Homo sapiens
ctcctcagaagagggtaacaca

SEQ ID NO: 7241287 - DNA, 22 bp, Homo sapiens
ctccctctcaccggagccctgg

SEQ ID NO: 7241288 - DNA, 20 bp, Homo sapiens
ctcctggtccaggagcctga

SEQ ID NO: 7241289 - DNA, 22 bp, Homo sapiens
ctcctgggtcattgccagcaaa

SEQ ID NO: 7241290 - DNA, 22 bp, Homo sapiens
ctcctggtgactcccagataaa

SEQ ID NO: 7241291 - DNA, 23 bp, Homo sapiens
ctcctggtgctgctatcaggggt

SEQ ID NO: 7241292 - DNA, 22 bp, Homo sapiens
ctcctggtgctggggctgccgc

SEQ ID NO: 7241293 - DNA, 22 bp, Homo sapiens
agtggcagaggttgactgcagt

SEQ ID NO: 7241294 - DNA, 22 bp, Homo sapiens
agtggcagagtgcactcaggca

SEQ ID NO: 7241295 - DNA, 22 bp, Homo sapiens
agtggcagatctctggtctgga

SEQ ID NO: 7241296 - DNA, 19 bp, Homo sapiens
agtggcagatctggaagta

SEQ ID NO: 7241297 - DNA, 22 bp, Homo sapiens
ctctcagactgaagggcctgtg

SEQ ID NO: 7241298 - DNA, 22 bp, Homo sapiens
ctcctgggggacagcggcaggg

SEQ ID NO: 7241299 - DNA, 22 bp, Homo sapiens
ctcctgggaatttagttgtgag

SEQ ID NO: 7241300 - DNA, 22 bp, Homo sapiens
ctctggggtgcttcgacacttc

SEQ ID NO: 7241301 - DNA, 22 bp, Homo sapiens
ctctggggttaagcttccatgg

SEQ ID NO: 7241302 - DNA, 22 bp, Homo sapiens
ctctttggttaatcacacagat

SEQ ID NO: 7241303 - DNA, 22 bp, Homo sapiens
ctctggggtggaggaggctgac

SEQ ID NO: 7241304 - DNA, 17 bp, Homo sapiens
ctgaaatattatgataa

SEQ ID NO: 7241305 - DNA, 22 bp, Homo sapiens
ctctccaagttatcaagatgaa

SEQ ID NO: 7241306 - DNA, 22 bp, Homo sapiens
ctctgcctgccactgttcaggc

SEQ ID NO: 7241307 - DNA, 22 bp, Homo sapiens
ctctggcttctaccttgcagtt

SEQ ID NO: 7241308 - DNA, 22 bp, Homo sapiens
ctctggatggttctgcacattc

SEQ ID NO: 7241309 - DNA, 22 bp, Homo sapiens
ctctgctgatatagcttttcaa

SEQ ID NO: 7241310 - DNA, 22 bp, Homo sapiens
ctctgctcaccagccatgtgat

SEQ ID NO: 7241311 - DNA, 22 bp, Homo sapiens
ctctgcgccaccctcgcctgct

SEQ ID NO: 7241312 - DNA, 22 bp, Homo sapiens
ctgagaaaagacatttctagat

SEQ ID NO: 7241313 - DNA, 22 bp, Homo sapiens
ctgagaaaagctttcttataca

SEQ ID NO: 7241314 - DNA, 22 bp, Homo sapiens
ctgacaaaggcaaggcaggggg

SEQ ID NO: 7241315 - DNA, 22 bp, Homo sapiens
ctgacaaacttaattttctgaa

SEQ ID NO: 7241316 - DNA, 22 bp, Homo sapiens
ctgacaaaccactgctccagct

SEQ ID NO: 7241317 - DNA, 22 bp, Homo sapiens
ctgaaattattgtttaatcaaa

SEQ ID NO: 7241318 - DNA, 22 bp, Homo sapiens
ctgaaattactggccctggagc

SEQ ID NO: 7241319 - DNA, 22 bp, Homo sapiens
ctgaaattccatttcagccaca

SEQ ID NO: 7241320 - DNA, 23 bp, Homo sapiens
ctgaaattcagatgctaaagata

SEQ ID NO: 7241321 - DNA, 22 bp, Homo sapiens
ctgaaattctgcctctgcacaa

SEQ ID NO: 7241322 - DNA, 22 bp, Homo sapiens
agtgtctgcgggcagaggagcg

SEQ ID NO: 7241323 - DNA, 22 bp, Homo sapiens
agtgtctgctaggttcatcaac

SEQ ID NO: 7241324 - DNA, 22 bp, Homo sapiens
agtgtctgctcagacagctaca

SEQ ID NO: 7241325 - DNA, 22 bp, Homo sapiens
ctgagaaacaatgaattgtgat

SEQ ID NO: 7241326 - DNA, 22 bp, Homo sapiens
agttataatctgctactgatat

SEQ ID NO: 7241327 - DNA, 22 bp, Homo sapiens
agttatataactatctagatgc

SEQ ID NO: 7241328 - DNA, 22 bp, Homo sapiens
ctgagcagccccaccagccatt

SEQ ID NO: 7241329 - DNA, 22 bp, Homo sapiens
ctgagcagcacagggcgccagg

SEQ ID NO: 7241330 - DNA, 22 bp, Homo sapiens
ctgagcagcaacccagagcctc

SEQ ID NO: 7241331 - DNA, 22 bp, Homo sapiens
ctgagcagcaacccagagcctc

SEQ ID NO: 7241332 - DNA, 22 bp, Homo sapiens
ctgagcagcaattgctggccca

SEQ ID NO: 7241333 - DNA, 22 bp, Homo sapiens
ctgagcagatgaccagccccag

SEQ ID NO: 7241334 - DNA, 22 bp, Homo sapiens
ctgagcagaggtcaagatactt

SEQ ID NO: 7241335 - DNA, 19 bp, Homo sapiens
ctgagcagagggaggaact

SEQ ID NO: 7241336 - DNA, 22 bp, Homo sapiens
ctgagcagcaacccagagcctc

SEQ ID NO: 7241337 - DNA, 22 bp, Homo sapiens
cagctgggtttagtggggtgtg

SEQ ID NO: 7241338 - DNA, 22 bp, Homo sapiens
caggactgaagggcacagggaa

SEQ ID NO: 7241339 - DNA, 22 bp, Homo sapiens
caggacagagcccagactgtgt

SEQ ID NO: 7241340 - DNA, 22 bp, Homo sapiens
caggagaaatgtggctgctacc

SEQ ID NO: 7241341 - DNA, 22 bp, Homo sapiens
caggagaaacataattttctgg

SEQ ID NO: 7241342 - DNA, 22 bp, Homo sapiens
caggagaaacataattttctgg

SEQ ID NO: 7241343 - DNA, 22 bp, Homo sapiens
caggatgggatgtagtgggccc

SEQ ID NO: 7241344 - DNA, 22 bp, Homo sapiens
caggagccacattccaccttga

SEQ ID NO: 7241345 - DNA, 22 bp, Homo sapiens
caggagcagagggtggtcagca

SEQ ID NO: 7241346 - DNA, 22 bp, Homo sapiens
caggagcccagagtcctcagct

SEQ ID NO: 7241347 - DNA, 22 bp, Homo sapiens
caggagccagctgtcccaacca

SEQ ID NO: 7241348 - DNA, 22 bp, Homo sapiens
caggcccatctgctcccaggct

SEQ ID NO: 7241349 - DNA, 22 bp, Homo sapiens
caggcccagtgatcagggctct

SEQ ID NO: 7241350 - DNA, 22 bp, Homo sapiens
caggcccagtgatcagggctct

SEQ ID NO: 7241351 - DNA, 22 bp, Homo sapiens
agcttcctcacctcagaggtct

SEQ ID NO: 7241352 - DNA, 21 bp, Homo sapiens
caggctctgctagaggagcct

SEQ ID NO: 7241353 - DNA, 22 bp, Homo sapiens
caggcagcgctcgtggcctggc

SEQ ID NO: 7241354 - DNA, 22 bp, Homo sapiens
caggcagcgctcgtggcctggc

SEQ ID NO: 7241355 - DNA, 22 bp, Homo sapiens
caggcagggagctggaaaggat

SEQ ID NO: 7241356 - DNA, 22 bp, Homo sapiens
caggcagctcaaccttgggagc

SEQ ID NO: 7241357 - DNA, 22 bp, Homo sapiens
caggtgtcaaaatactaagtgg

SEQ ID NO: 7241358 - DNA, 20 bp, Homo sapiens
caggtgtacagtgagctgag

SEQ ID NO: 7241359 - DNA, 22 bp, Homo sapiens
caggtgtctaattctcaccccc

SEQ ID NO: 7241360 - DNA, 22 bp, Homo sapiens
aggaagtggataaaatagcttt

SEQ ID NO: 7241361 - DNA, 21 bp, Homo sapiens
aggaagtggccagattgggaa

SEQ ID NO: 7241362 - DNA, 22 bp, Homo sapiens
caggtgggattttgctgcttga

SEQ ID NO: 7241363 - DNA, 22 bp, Homo sapiens
cagggctgttagctgctgctct

SEQ ID NO: 7241364 - DNA, 22 bp, Homo sapiens
aggaatctgtggttttaacagg

SEQ ID NO: 7241365 - DNA, 22 bp, Homo sapiens
aggacagaatctatattcagtt

SEQ ID NO: 7241366 - DNA, 22 bp, Homo sapiens
aggacaagctaaaggacttcct

SEQ ID NO: 7241367 - DNA, 22 bp, Homo sapiens
aggacagacctaggactggagc

SEQ ID NO: 7241368 - DNA, 22 bp, Homo sapiens
aggacagagcctgtgcagaccg

SEQ ID NO: 7241369 - DNA, 22 bp, Homo sapiens
aggacagagccctagtttcata

SEQ ID NO: 7241370 - DNA, 22 bp, Homo sapiens
cagtatttaggattaggagaga

SEQ ID NO: 7241371 - DNA, 22 bp, Homo sapiens
cagtatgagagttgaatcaagg

SEQ ID NO: 7241372 - DNA, 22 bp, Homo sapiens
cagtatgactacaaacagcttt

SEQ ID NO: 7241373 - DNA, 22 bp, Homo sapiens
cagtaacatttcaaggtagagg

SEQ ID NO: 7241374 - DNA, 22 bp, Homo sapiens
cagggatgtgatgagctgagcc

SEQ ID NO: 7241375 - DNA, 21 bp, Homo sapiens
agctttgctttgtactcattt

SEQ ID NO: 7241376 - DNA, 22 bp, Homo sapiens
agctttgctcgggtctcccgcc

SEQ ID NO: 7241377 - DNA, 22 bp, Homo sapiens
agctttgcctgctgacattctg

SEQ ID NO: 7241378 - DNA, 22 bp, Homo sapiens
agctttgcactgagacagctca

SEQ ID NO: 7241379 - DNA, 22 bp, Homo sapiens
agctttgcactgagacagctca

SEQ ID NO: 7241380 - DNA, 22 bp, Homo sapiens
cagggctctgccttgagggatg

SEQ ID NO: 7241381 - DNA, 22 bp, Homo sapiens
cagggctggctcatgaaaagtt

SEQ ID NO: 7241382 - DNA, 22 bp, Homo sapiens
cagggctggctgtggcaatctc

SEQ ID NO: 7241383 - DNA, 22 bp, Homo sapiens
cagggctggctcatgaaaagtt

SEQ ID NO: 7241384 - DNA, 22 bp, Homo sapiens
aggaagaaacctactagagttt

SEQ ID NO: 7241385 - DNA, 22 bp, Homo sapiens
aggaaaggcctttgcatttggt

SEQ ID NO: 7241386 - DNA, 21 bp, Homo sapiens
aggaaaggccagcacgtaggg

SEQ ID NO: 7241387 - DNA, 22 bp, Homo sapiens
aggaaaggcctcagcagaaacc

SEQ ID NO: 7241388 - DNA, 21 bp, Homo sapiens
aggaaaggccagcacgtaggg

SEQ ID NO: 7241389 - DNA, 22 bp, Homo sapiens
cagggctggctgtggcaatctc

SEQ ID NO: 7241390 - DNA, 22 bp, Homo sapiens
cagggctggcttccaagttgtt

SEQ ID NO: 7241391 - DNA, 22 bp, Homo sapiens
cagggctgggttaaaagcaggg

SEQ ID NO: 7241392 - DNA, 19 bp, Homo sapiens
aggaaaggatcaaaatagc

SEQ ID NO: 7241393 - DNA, 22 bp, Homo sapiens
aggaaaggattggcttctctgt

SEQ ID NO: 7241394 - DNA, 22 bp, Homo sapiens
aggaagagcattcacatggtag

SEQ ID NO: 7241395 - DNA, 22 bp, Homo sapiens
aggaagagctggaccagaggac

SEQ ID NO: 7241396 - DNA, 22 bp, Homo sapiens
aggaagagctggaccagaggac

SEQ ID NO: 7241397 - DNA, 22 bp, Homo sapiens
aggaagagctggaccagaggac

SEQ ID NO: 7241398 - DNA, 22 bp, Homo sapiens
aggcaaggtgctacagacagtg

SEQ ID NO: 7241399 - DNA, 22 bp, Homo sapiens
cattccttaacgtggggagtct

SEQ ID NO: 7241400 - DNA, 22 bp, Homo sapiens
cattgcactctggctggaacgg

SEQ ID NO: 7241401 - DNA, 22 bp, Homo sapiens
cattctaaagtgttttatacct

SEQ ID NO: 7241402 - DNA, 20 bp, Homo sapiens
cattgcatatttcattgagg

SEQ ID NO: 7241403 - DNA, 22 bp, Homo sapiens
cattggaagacatatcatgcta

SEQ ID NO: 7241404 - DNA, 22 bp, Homo sapiens
aggcactttacaatgtgtgaca

SEQ ID NO: 7241405 - DNA, 22 bp, Homo sapiens
aggcaggaaccctgtgtgcgcc

SEQ ID NO: 7241406 - DNA, 22 bp, Homo sapiens
catttgaaatagttcattcttg

SEQ ID NO: 7241407 - DNA, 22 bp, Homo sapiens
catttctgggagacatgctaga

SEQ ID NO: 7241408 - DNA, 22 bp, Homo sapiens
ccacagagacagggtccttgct

SEQ ID NO: 7241409 - DNA, 22 bp, Homo sapiens
ccacagagacagagcccagggt

SEQ ID NO: 7241410 - DNA, 22 bp, Homo sapiens
ccacagaccttggcttccacct

SEQ ID NO: 7241411 - DNA, 19 bp, Homo sapiens
ccacagagcatgctgaggc

SEQ ID NO: 7241412 - DNA, 21 bp, Homo sapiens
ccaccaggtcttctgctcggg

SEQ ID NO: 7241413 - DNA, 22 bp, Homo sapiens
ccacatctaagccttcatgata

SEQ ID NO: 7241414 - DNA, 21 bp, Homo sapiens
ccaccaggtcttctgctcggg

SEQ ID NO: 7241415 - DNA, 22 bp, Homo sapiens
ccaccaggcactcacagggaag

SEQ ID NO: 7241416 - DNA, 20 bp, Homo sapiens
ccacagtggagactggagac

SEQ ID NO: 7241417 - DNA, 22 bp, Homo sapiens
ccacccagaccagggatctggg

SEQ ID NO: 7241418 - DNA, 22 bp, Homo sapiens
ccacgtccagctaattttcgta

SEQ ID NO: 7241419 - DNA, 22 bp, Homo sapiens
ccacgaggctatcctgctaggg

SEQ ID NO: 7241420 - DNA, 22 bp, Homo sapiens
ccacgagggaaccaggtggggt

SEQ ID NO: 7241421 - DNA, 23 bp, Homo sapiens
aggaggcctgaaactgaggctga

SEQ ID NO: 7241422 - DNA, 22 bp, Homo sapiens
aggaggcctctatccagagaga

SEQ ID NO: 7241423 - DNA, 22 bp, Homo sapiens
aggaggccgctgatgggctccc

SEQ ID NO: 7241424 - DNA, 22 bp, Homo sapiens
aggagctgtgaatgggaggggt

SEQ ID NO: 7241425 - DNA, 22 bp, Homo sapiens
cataagaatcttccagggcatg

SEQ ID NO: 7241426 - DNA, 22 bp, Homo sapiens
aggagccagttccaccccagga

SEQ ID NO: 7241427 - DNA, 22 bp, Homo sapiens
cataacatctgtgaagcaggaa

SEQ ID NO: 7241428 - DNA, 22 bp, Homo sapiens
cagtccaggcctggaggagcca

SEQ ID NO: 7241429 - DNA, 22 bp, Homo sapiens
cagtccagctcatcagtggcac

SEQ ID NO: 7241430 - DNA, 22 bp, Homo sapiens
cagtgtgggtttgggaggagta

SEQ ID NO: 7241431 - DNA, 22 bp, Homo sapiens
aggagccagcgttcctcaggat

SEQ ID NO: 7241432 - DNA, 22 bp, Homo sapiens
aggagccagaatccagactcgg

SEQ ID NO: 7241433 - DNA, 22 bp, Homo sapiens
aggaggctctcaggtcctcccc

SEQ ID NO: 7241434 - DNA, 22 bp, Homo sapiens
aggaggctgaactagggtctgg

SEQ ID NO: 7241435 - DNA, 23 bp, Homo sapiens
aggaggcctgaaactgaggctga

SEQ ID NO: 7241436 - DNA, 22 bp, Homo sapiens
aggaggccttggggcttagagc

SEQ ID NO: 7241437 - DNA, 19 bp, Homo sapiens
catacaattaccataggat

SEQ ID NO: 7241438 - DNA, 22 bp, Homo sapiens
catctcctttggtctacttcca

SEQ ID NO: 7241439 - DNA, 22 bp, Homo sapiens
catctctccacggcagctctcg

SEQ ID NO: 7241440 - DNA, 22 bp, Homo sapiens
aggatggggtctgcagcctggt

SEQ ID NO: 7241441 - DNA, 22 bp, Homo sapiens
aggatggcttgcaggaggctgt

SEQ ID NO: 7241442 - DNA, 22 bp, Homo sapiens
aggatgagagatacatggagca

SEQ ID NO: 7241443 - DNA, 22 bp, Homo sapiens
aggatgtctgctgctgtgggct

SEQ ID NO: 7241444 - DNA, 23 bp, Homo sapiens
aggatgtcgaatgttagagtgag

SEQ ID NO: 7241445 - DNA, 22 bp, Homo sapiens
aggatgtcagtcagcttggatt

SEQ ID NO: 7241446 - DNA, 22 bp, Homo sapiens
catgagggttggggtggagctt

SEQ ID NO: 7241447 - DNA, 19 bp, Homo sapiens
catgaggcagctgcacccc

SEQ ID NO: 7241448 - DNA, 20 bp, Homo sapiens
agggcacttttgctggagca

SEQ ID NO: 7241449 - DNA, 22 bp, Homo sapiens
agggcagaaaccaccttgatgg

SEQ ID NO: 7241450 - DNA, 22 bp, Homo sapiens
agggatgggtctaacccagaac

SEQ ID NO: 7241451 - DNA, 22 bp, Homo sapiens
agggcagaagtacagacactta

SEQ ID NO: 7241452 - DNA, 22 bp, Homo sapiens
agggcagaaatcgattacacct

SEQ ID NO: 7241453 - DNA, 22 bp, Homo sapiens
agggcagaaatattgatactgt

SEQ ID NO: 7241454 - DNA, 22 bp, Homo sapiens
agggcagactaggatggaagtg

SEQ ID NO: 7241455 - DNA, 22 bp, Homo sapiens
agggcagactaggatggaagtg

SEQ ID NO: 7241456 - DNA, 22 bp, Homo sapiens
agggcagaccacgtgcaaggat

SEQ ID NO: 7241457 - DNA, 22 bp, Homo sapiens
cccctgccagctatccctgaac

SEQ ID NO: 7241458 - DNA, 22 bp, Homo sapiens
cccctgccatagtcaaatctaa

SEQ ID NO: 7241459 - DNA, 22 bp, Homo sapiens
agggcccacagttcctatggcc

SEQ ID NO: 7241460 - DNA, 22 bp, Homo sapiens
agggcccaccttggtgctgagg

SEQ ID NO: 7241461 - DNA, 22 bp, Homo sapiens
agggcccagcccttgctggtct

SEQ ID NO: 7241462 - DNA, 22 bp, Homo sapiens
agggcccagcagcatttcagtg

SEQ ID NO: 7241463 - DNA, 20 bp, Homo sapiens
agggcccaggaagagagtta

SEQ ID NO: 7241464 - DNA, 20 bp, Homo sapiens
agggcccaggaagagagtta

SEQ ID NO: 7241465 - DNA, 22 bp, Homo sapiens
agggcccaggacagcatcaggg

SEQ ID NO: 7241466 - DNA, 23 bp, Homo sapiens
agggccaggtgcggaaacagctc

SEQ ID NO: 7241467 - DNA, 23 bp, Homo sapiens
agggcccaagcctggacagcagg

SEQ ID NO: 7241468 - DNA, 23 bp, Homo sapiens
agggcccaagcctggacagcagg

SEQ ID NO: 7241469 - DNA, 22 bp, Homo sapiens
ccctgaggcaaaggctagagtt

SEQ ID NO: 7241470 - DNA, 22 bp, Homo sapiens
agggccaccagagcagggcagt

SEQ ID NO: 7241471 - DNA, 22 bp, Homo sapiens
agggccacagtggggcctgaga

SEQ ID NO: 7241472 - DNA, 22 bp, Homo sapiens
ccctgaggatagggcaggaccc

SEQ ID NO: 7241473 - DNA, 22 bp, Homo sapiens
agggccacctctctgggttccc

SEQ ID NO: 7241474 - DNA, 23 bp, Homo sapiens
agggccactgggaaggattactg

SEQ ID NO: 7241475 - DNA, 22 bp, Homo sapiens
agggcatgctggaggagagaca

SEQ ID NO: 7241476 - DNA, 22 bp, Homo sapiens
agggcatgtgggagaggagcct

SEQ ID NO: 7241477 - DNA, 22 bp, Homo sapiens
cccctgggtccaggcttctctg

SEQ ID NO: 7241478 - DNA, 22 bp, Homo sapiens
cccctggggatcagctggaatt

SEQ ID NO: 7241479 - DNA, 21 bp, Homo sapiens
cccctgggagccctgtcagta

SEQ ID NO: 7241480 - DNA, 22 bp, Homo sapiens
agggagccttcctggctgtggt

SEQ ID NO: 7241481 - DNA, 22 bp, Homo sapiens
agggacccatagagagaccagt

SEQ ID NO: 7241482 - DNA, 22 bp, Homo sapiens
agggacagttacatcatcagac

SEQ ID NO: 7241483 - DNA, 22 bp, Homo sapiens
agggacagttacatcatcagac

SEQ ID NO: 7241484 - DNA, 22 bp, Homo sapiens
agggacagtctactgttcactg

SEQ ID NO: 7241485 - DNA, 23 bp, Homo sapiens
agggaaagtagtaatggcctttg

SEQ ID NO: 7241486 - DNA, 22 bp, Homo sapiens
agggaaagtaagcatttcatta

SEQ ID NO: 7241487 - DNA, 22 bp, Homo sapiens
agggaaagtaagcatttcatta

SEQ ID NO: 7241488 - DNA, 22 bp, Homo sapiens
agggaaaggtagtgaggtcaca

SEQ ID NO: 7241489 - DNA, 22 bp, Homo sapiens
aggctttggggcattctgtgtt

SEQ ID NO: 7241490 - DNA, 22 bp, Homo sapiens
agggaaaggtagtgaggtcaca

SEQ ID NO: 7241491 - DNA, 22 bp, Homo sapiens
agggaaaggctgatgctgtggg

SEQ ID NO: 7241492 - DNA, 21 bp, Homo sapiens
agggaaagaaaatgagctaat

SEQ ID NO: 7241493 - DNA, 21 bp, Homo sapiens
agggaaaaggctgagtgaggg

SEQ ID NO: 7241494 - DNA, 22 bp, Homo sapiens
aggggtcttgggagtcctggct

SEQ ID NO: 7241495 - DNA, 22 bp, Homo sapiens
aggggtcttgaggactccagca

SEQ ID NO: 7241496 - DNA, 22 bp, Homo sapiens
aggggtagagattgctggtgta

SEQ ID NO: 7241497 - DNA, 22 bp, Homo sapiens
aggggtctatcctgagatggtc

SEQ ID NO: 7241498 - DNA, 20 bp, Homo sapiens
aggggtctagcagcagtgct

SEQ ID NO: 7241499 - DNA, 22 bp, Homo sapiens
aggggtctatcctgagatggtc

SEQ ID NO: 7241500 - DNA, 22 bp, Homo sapiens
agggggtgctacttccagagtt

SEQ ID NO: 7241501 - DNA, 22 bp, Homo sapiens
agggggtgcccagatgaaggat

SEQ ID NO: 7241502 - DNA, 22 bp, Homo sapiens
agggggtgtctctgattgggtt

SEQ ID NO: 7241503 - DNA, 22 bp, Homo sapiens
agggggtgtctctgattgggtt

SEQ ID NO: 7241504 - DNA, 22 bp, Homo sapiens
agggggtgcatttgtgaatgaa

SEQ ID NO: 7241505 - DNA, 22 bp, Homo sapiens
agggggtgatcaaggtgcggcg

SEQ ID NO: 7241506 - DNA, 22 bp, Homo sapiens
agggggtgcatttgtgaatgaa

SEQ ID NO: 7241507 - DNA, 22 bp, Homo sapiens
cctctgtgtctccaagaggcct

SEQ ID NO: 7241508 - DNA, 22 bp, Homo sapiens
agggggctccttggtgtgcaga

SEQ ID NO: 7241509 - DNA, 22 bp, Homo sapiens
agggggctccttggtgtgcaga

SEQ ID NO: 7241510 - DNA, 22 bp, Homo sapiens
agggggagacatgtgtgtgttt

SEQ ID NO: 7241511 - DNA, 22 bp, Homo sapiens
agggggtgatcaaggtgcggcg

SEQ ID NO: 7241512 - DNA, 22 bp, Homo sapiens
agggggtgaatgtctgtctaca

SEQ ID NO: 7241513 - DNA, 22 bp, Homo sapiens
aggggggtggatcacctgaggt

SEQ ID NO: 7241514 - DNA, 22 bp, Homo sapiens
agggggtctcctatcatggaag

SEQ ID NO: 7241515 - DNA, 22 bp, Homo sapiens
cctcctggtgacaaggcaaagc

SEQ ID NO: 7241516 - DNA, 22 bp, Homo sapiens
cctcctggtccagcatctcttt

SEQ ID NO: 7241517 - DNA, 22 bp, Homo sapiens
aggggaagattatacttttgaa

SEQ ID NO: 7241518 - DNA, 22 bp, Homo sapiens
aggggaaggccagcctgtagag

SEQ ID NO: 7241519 - DNA, 22 bp, Homo sapiens
cctccttctggggccttctgct

SEQ ID NO: 7241520 - DNA, 22 bp, Homo sapiens
cctccttcctgggacagagctg

SEQ ID NO: 7241521 - DNA, 22 bp, Homo sapiens
aggggcggcctgcctgaagcag

SEQ ID NO: 7241522 - DNA, 22 bp, Homo sapiens
aggggcctggttggcctctgtt

SEQ ID NO: 7241523 - DNA, 18 bp, Homo sapiens
aggggcagcttgtgtgga

SEQ ID NO: 7241524 - DNA, 18 bp, Homo sapiens
aggggcagcttgtgtgga

SEQ ID NO: 7241525 - DNA, 22 bp, Homo sapiens
aggggcctggttggcctctgtt

SEQ ID NO: 7241526 - DNA, 22 bp, Homo sapiens
aggggctcagttactttggcag

SEQ ID NO: 7241527 - DNA, 22 bp, Homo sapiens
aggggctcaagcagtgtggtct

SEQ ID NO: 7241528 - DNA, 22 bp, Homo sapiens
aggggctcaaagtgtgcaggga

SEQ ID NO: 7241529 - DNA, 22 bp, Homo sapiens
aggggctcaaagtgtgcaggga

SEQ ID NO: 7241530 - DNA, 22 bp, Homo sapiens
aggggctcctggcctggagagc

SEQ ID NO: 7241531 - DNA, 22 bp, Homo sapiens
aggggctcctctctgagagtag

SEQ ID NO: 7241532 - DNA, 22 bp, Homo sapiens
aggggctcctttgtgctgcgtc

SEQ ID NO: 7241533 - DNA, 22 bp, Homo sapiens
aggggctgactggaaagtgcca

SEQ ID NO: 7241534 - DNA, 22 bp, Homo sapiens
aggggctgcctggcttggcact

SEQ ID NO: 7241535 - DNA, 22 bp, Homo sapiens
aggggctctgagtgggccagga

SEQ ID NO: 7241536 - DNA, 22 bp, Homo sapiens
agggcccatgtgggagcacttg

SEQ ID NO: 7241537 - DNA, 22 bp, Homo sapiens
agggcccatgtcgggcgctctg

SEQ ID NO: 7241538 - DNA, 22 bp, Homo sapiens
agggcccatagatcgtcagctt

SEQ ID NO: 7241539 - DNA, 22 bp, Homo sapiens
agggcccaggacagcatcaggg

SEQ ID NO: 7241540 - DNA, 22 bp, Homo sapiens
agggcccagtggagagctgagc

SEQ ID NO: 7241541 - DNA, 22 bp, Homo sapiens
agggcccatagatcgtcagctt

SEQ ID NO: 7241542 - DNA, 22 bp, Homo sapiens
agggcccagtggagagctgagc

SEQ ID NO: 7241543 - DNA, 22 bp, Homo sapiens
agggcccatgtgggagcacttg

SEQ ID NO: 7241544 - DNA, 22 bp, Homo sapiens
ccctggccagggcacagggagg

SEQ ID NO: 7241545 - DNA, 21 bp, Homo sapiens
agggcctgtgctctccaggtc

SEQ ID NO: 7241546 - DNA, 22 bp, Homo sapiens
agggcctgtccgctcccgcccg

SEQ ID NO: 7241547 - DNA, 22 bp, Homo sapiens
agggcctgtccgctcccgcccg

SEQ ID NO: 7241548 - DNA, 22 bp, Homo sapiens
cctaatttgattttaaatagcc

SEQ ID NO: 7241549 - DNA, 22 bp, Homo sapiens
cctaattatctcccaaagatcc

SEQ ID NO: 7241550 - DNA, 23 bp, Homo sapiens
cctcagggtctagcagagagaag

SEQ ID NO: 7241551 - DNA, 22 bp, Homo sapiens
cctcaggggtgcccacagctgc

SEQ ID NO: 7241552 - DNA, 22 bp, Homo sapiens
cctcagggtctgaggagaccgt

SEQ ID NO: 7241553 - DNA, 22 bp, Homo sapiens
cctcagggtctctcacagcacc

SEQ ID NO: 7241554 - DNA, 22 bp, Homo sapiens
cctcagggttcggatgagaaca

SEQ ID NO: 7241555 - DNA, 22 bp, Homo sapiens
cctcaggttctggagaagggcc

SEQ ID NO: 7241556 - DNA, 22 bp, Homo sapiens
agggctgagtgggagagagttg

SEQ ID NO: 7241557 - DNA, 22 bp, Homo sapiens
agggctgagcccaggcatgtag

SEQ ID NO: 7241558 - DNA, 22 bp, Homo sapiens
agggctgagactaaggccagat

SEQ ID NO: 7241559 - DNA, 22 bp, Homo sapiens
agggctgacagtggcgtggcgt

SEQ ID NO: 7241560 - DNA, 22 bp, Homo sapiens
agggctgaaacataatccttct

SEQ ID NO: 7241561 - DNA, 22 bp, Homo sapiens
agggctgacctaagctccactt

SEQ ID NO: 7241562 - DNA, 19 bp, Homo sapiens
cctacttgtttgagggaag

SEQ ID NO: 7241563 - DNA, 22 bp, Homo sapiens
cctactctgtgagccactttgc

SEQ ID NO: 7241564 - DNA, 22 bp, Homo sapiens
ccactcccttccggtccagggc

SEQ ID NO: 7241565 - DNA, 22 bp, Homo sapiens
ccagaggatgctggtcagcctc

SEQ ID NO: 7241566 - DNA, 22 bp, Homo sapiens
ccagaggatgctggtcagcctc

SEQ ID NO: 7241567 - DNA, 22 bp, Homo sapiens
ccagccagctggttggacgcct

SEQ ID NO: 7241568 - DNA, 22 bp, Homo sapiens
ccagcaggcagtcatatccttt

SEQ ID NO: 7241569 - DNA, 22 bp, Homo sapiens
ccagccagatgataagctctat

SEQ ID NO: 7241570 - DNA, 23 bp, Homo sapiens
aggccctgcctgtccctcttttt

SEQ ID NO: 7241571 - DNA, 22 bp, Homo sapiens
aggccctgcccagtgccacaag

SEQ ID NO: 7241572 - DNA, 22 bp, Homo sapiens
aggccctgcggaaatgatcatt

SEQ ID NO: 7241573 - DNA, 22 bp, Homo sapiens
aggccctgcccagagctcctcg

SEQ ID NO: 7241574 - DNA, 22 bp, Homo sapiens
aggccctgcccagtgccacaag

SEQ ID NO: 7241575 - DNA, 18 bp, Homo sapiens
ccagccctgcagcacctg

SEQ ID NO: 7241576 - DNA, 22 bp, Homo sapiens
aggccctgacctgggagatcta

SEQ ID NO: 7241577 - DNA, 22 bp, Homo sapiens
ccaggcacaggtgggcctcaga

SEQ ID NO: 7241578 - DNA, 22 bp, Homo sapiens
aggctcagaggtgagcatctgc

SEQ ID NO: 7241579 - DNA, 16 bp, Homo sapiens
aggctcagaggctgga

SEQ ID NO: 7241580 - DNA, 20 bp, Homo sapiens
aggctcagagcagtagtaca

SEQ ID NO: 7241581 - DNA, 22 bp, Homo sapiens
aggctcagaggtgagcatctgc

SEQ ID NO: 7241582 - DNA, 16 bp, Homo sapiens
aggctcagaggctgga

SEQ ID NO: 7241583 - DNA, 22 bp, Homo sapiens
ccaggcacggtggctcatgcct

SEQ ID NO: 7241584 - DNA, 22 bp, Homo sapiens
ccaggcactcacggggcactgg

SEQ ID NO: 7241585 - DNA, 22 bp, Homo sapiens
ccaggcactcagagactgggac

SEQ ID NO: 7241586 - DNA, 22 bp, Homo sapiens
aggctcagagatgagtaagcac

SEQ ID NO: 7241587 - DNA, 22 bp, Homo sapiens
aggctcagagagctgtgtccat

SEQ ID NO: 7241588 - DNA, 21 bp, Homo sapiens
aggctcagagagaaactcttg

SEQ ID NO: 7241589 - DNA, 22 bp, Homo sapiens
aggcctgggtctcgtgcctacc

SEQ ID NO: 7241590 - DNA, 22 bp, Homo sapiens
ccagctcccattcttcacctgt

SEQ ID NO: 7241591 - DNA, 23 bp, Homo sapiens
ccagctcccaggtctgaggactg

SEQ ID NO: 7241592 - DNA, 22 bp, Homo sapiens
ccagctccgggagttgctgctg

SEQ ID NO: 7241593 - DNA, 22 bp, Homo sapiens
ccagctccctgaagcctggtct

SEQ ID NO: 7241594 - DNA, 22 bp, Homo sapiens
ccagctccctgaagcctggtct

SEQ ID NO: 7241595 - DNA, 22 bp, Homo sapiens
ccagctcccgcaggctgcacag

SEQ ID NO: 7241596 - DNA, 22 bp, Homo sapiens
ccagctcccctcagcaggtaat

SEQ ID NO: 7241597 - DNA, 22 bp, Homo sapiens
aggccctgctgaggcctccctc

SEQ ID NO: 7241598 - DNA, 22 bp, Homo sapiens
aggccctgctgaggcctccctc

SEQ ID NO: 7241599 - DNA, 22 bp, Homo sapiens
aggccctgctttccagagctca

SEQ ID NO: 7241600 - DNA, 22 bp, Homo sapiens
aggccctggacactcaagccgg

SEQ ID NO: 7241601 - DNA, 22 bp, Homo sapiens
ccagctccattgcttagtgtaa

SEQ ID NO: 7241602 - DNA, 22 bp, Homo sapiens
ccagctccaggtagatgggcag

SEQ ID NO: 7241603 - DNA, 21 bp, Homo sapiens
aggccctggaggtcagagaaa

SEQ ID NO: 7241604 - DNA, 22 bp, Homo sapiens
ccagctccggtgtgcttatttc

SEQ ID NO: 7241605 - DNA, 22 bp, Homo sapiens
ccaggaggtctgagtgtggaca

SEQ ID NO: 7241606 - DNA, 22 bp, Homo sapiens
ccaggaggttgaggctgcagtg

SEQ ID NO: 7241607 - DNA, 19 bp, Homo sapiens
aggctctgtaggagagggc

SEQ ID NO: 7241608 - DNA, 22 bp, Homo sapiens
ccagggcagaaaaagagggaat

SEQ ID NO: 7241609 - DNA, 22 bp, Homo sapiens
ccagggcagccaacccagatgc

SEQ ID NO: 7241610 - DNA, 20 bp, Homo sapiens
ccaggtggtgcctggagagg

SEQ ID NO: 7241611 - DNA, 20 bp, Homo sapiens
ccaggtggtgcctggagagg

SEQ ID NO: 7241612 - DNA, 22 bp, Homo sapiens
ccaggtggtgaaagtgggccct

SEQ ID NO: 7241613 - DNA, 18 bp, Homo sapiens
ccaggtggtgacagagat

SEQ ID NO: 7241614 - DNA, 17 bp, Homo sapiens
ccagtcacaccaccctt

SEQ ID NO: 7241615 - DNA, 22 bp, Homo sapiens
aggctgagtgctcccctagatg

SEQ ID NO: 7241616 - DNA, 22 bp, Homo sapiens
aggctctggttggcaagtaaag

SEQ ID NO: 7241617 - DNA, 22 bp, Homo sapiens
aggctctgggaacagacgggtg

SEQ ID NO: 7241618 - DNA, 22 bp, Homo sapiens
aggctcagcccctgggaggaga

SEQ ID NO: 7241619 - DNA, 22 bp, Homo sapiens
aggctcagcccctgggaggaga

SEQ ID NO: 7241620 - DNA, 22 bp, Homo sapiens
aggctcagcccaaggtggagag

SEQ ID NO: 7241621 - DNA, 22 bp, Homo sapiens
aggctcagcccaaggtggagag

SEQ ID NO: 7241622 - DNA, 22 bp, Homo sapiens
aggctcagcatctgattcatat

SEQ ID NO: 7241623 - DNA, 20 bp, Homo sapiens
ccaggcctgggcctgctcta

SEQ ID NO: 7241624 - DNA, 19 bp, Homo sapiens
ccaggcctggcgtctccgc

SEQ ID NO: 7241625 - DNA, 22 bp, Homo sapiens
ccaggccttctgaggacactct

SEQ ID NO: 7241626 - DNA, 22 bp, Homo sapiens
ccaggccttccagtacgcagaa

SEQ ID NO: 7241627 - DNA, 22 bp, Homo sapiens
aggctcagatccttgtgtcctg

SEQ ID NO: 7241628 - DNA, 20 bp, Homo sapiens
aggctcagatacccagggaa

SEQ ID NO: 7241629 - DNA, 22 bp, Homo sapiens
aggctgtgcacagggcacctgc

SEQ ID NO: 7241630 - DNA, 22 bp, Homo sapiens
cccactcctggagctagggctc

SEQ ID NO: 7241631 - DNA, 22 bp, Homo sapiens
cccactcctggagctagggctc

SEQ ID NO: 7241632 - DNA, 22 bp, Homo sapiens
cccactccctgcacgcctgccg

SEQ ID NO: 7241633 - DNA, 22 bp, Homo sapiens
cccactctggctcccttctagt

SEQ ID NO: 7241634 - DNA, 22 bp, Homo sapiens
cccactccctacgacacgctcc

SEQ ID NO: 7241635 - DNA, 18 bp, Homo sapiens
cccacggtgctgtagggc

SEQ ID NO: 7241636 - DNA, 22 bp, Homo sapiens
cccacctctcagagagccttgc

SEQ ID NO: 7241637 - DNA, 22 bp, Homo sapiens
cccaccctgggaagctaggcag

SEQ ID NO: 7241638 - DNA, 22 bp, Homo sapiens
ccattttgtctcctgaaatcta

SEQ ID NO: 7241639 - DNA, 22 bp, Homo sapiens
ccagtgtgcaatctctggctta

SEQ ID NO: 7241640 - DNA, 22 bp, Homo sapiens
cccacacacatttatgatagga

SEQ ID NO: 7241641 - DNA, 22 bp, Homo sapiens
cccaattttgggcacaacgaaa

SEQ ID NO: 7241642 - DNA, 22 bp, Homo sapiens
cccaatttcttcctcatttgcc

SEQ ID NO: 7241643 - DNA, 18 bp, Homo sapiens
cccacacagcagtagctc

SEQ ID NO: 7241644 - DNA, 20 bp, Homo sapiens
cccacacccttcccacttgg

SEQ ID NO: 7241645 - DNA, 22 bp, Homo sapiens
aggctgccagaagccttcagga

SEQ ID NO: 7241646 - DNA, 22 bp, Homo sapiens
aggctgccctgccgccagtggg

SEQ ID NO: 7241647 - DNA, 19 bp, Homo sapiens
aggctgcccagtctctgcc

SEQ ID NO: 7241648 - DNA, 22 bp, Homo sapiens
aggctgccatagggaactgcat

SEQ ID NO: 7241649 - DNA, 22 bp, Homo sapiens
aggactggcagtgtgaggggtc

SEQ ID NO: 7241650 - DNA, 22 bp, Homo sapiens
aggactggccctgaggggaggc

SEQ ID NO: 7241651 - DNA, 22 bp, Homo sapiens
aggacagtgtggaagagggtgc

SEQ ID NO: 7241652 - DNA, 22 bp, Homo sapiens
aggacagtggacactagtccct

SEQ ID NO: 7241653 - DNA, 22 bp, Homo sapiens
aggacaggtgtagtgggctctg

SEQ ID NO: 7241654 - DNA, 22 bp, Homo sapiens
aggacagtccggggtcctccac

SEQ ID NO: 7241655 - DNA, 22 bp, Homo sapiens
aggacacagtggtggggaaaag

SEQ ID NO: 7241656 - DNA, 22 bp, Homo sapiens
aggacaggattgagctgaactg

SEQ ID NO: 7241657 - DNA, 22 bp, Homo sapiens
acagggcacctgaggtaggaag

SEQ ID NO: 7241658 - DNA, 19 bp, Homo sapiens
acagggcagcaataggata

SEQ ID NO: 7241659 - DNA, 22 bp, Homo sapiens
acaggctcgtgcgcgcacgtgt

SEQ ID NO: 7241660 - DNA, 22 bp, Homo sapiens
aggaaaggtagcgtgccagcag

SEQ ID NO: 7241661 - DNA, 22 bp, Homo sapiens
aggaaaggtagcgtgccagcag

SEQ ID NO: 7241662 - DNA, 22 bp, Homo sapiens
aggaaaggtgagagcggccgcg

SEQ ID NO: 7241663 - DNA, 19 bp, Homo sapiens
aggaaaggtggccttagca

SEQ ID NO: 7241664 - DNA, 22 bp, Homo sapiens
aggaaaggttcagtgattgaaa

SEQ ID NO: 7241665 - DNA, 22 bp, Homo sapiens
acaggcctgtgtgcacacgagg

SEQ ID NO: 7241666 - DNA, 22 bp, Homo sapiens
aggaaataagggacaagacaaa

SEQ ID NO: 7241667 - DNA, 22 bp, Homo sapiens
acaggacatggcttctgtgacg

SEQ ID NO: 7241668 - DNA, 22 bp, Homo sapiens
acaggcaagtacacaggctcat

SEQ ID NO: 7241669 - DNA, 22 bp, Homo sapiens
acaggcaacttcaaatctcact

SEQ ID NO: 7241670 - DNA, 22 bp, Homo sapiens
acaggcaattagcaagctgtta

SEQ ID NO: 7241671 - DNA, 23 bp, Homo sapiens
acaggcaataaagggagtctcca

SEQ ID NO: 7241672 - DNA, 22 bp, Homo sapiens
acagcattgagagctaaattta

SEQ ID NO: 7241673 - DNA, 22 bp, Homo sapiens
acagtgaaaagaatattagaat

SEQ ID NO: 7241674 - DNA, 23 bp, Homo sapiens
acagtgaaacacgcagtaagagt

SEQ ID NO: 7241675 - DNA, 22 bp, Homo sapiens
acagtgaaaattctattgattt

SEQ ID NO: 7241676 - DNA, 22 bp, Homo sapiens
acagtgagatccaagggcaggc

SEQ ID NO: 7241677 - DNA, 22 bp, Homo sapiens
acagtgaatgcccaagaaaagt

SEQ ID NO: 7241678 - DNA, 21 bp, Homo sapiens
acagtgagaaataaatggaaa

SEQ ID NO: 7241679 - DNA, 17 bp, Homo sapiens
aggaggccctggcgttt

SEQ ID NO: 7241680 - DNA, 22 bp, Homo sapiens
aggaggccgatttcagaggtcg

SEQ ID NO: 7241681 - DNA, 17 bp, Homo sapiens
aggaggccctggcgttt

SEQ ID NO: 7241682 - DNA, 22 bp, Homo sapiens
acagtggaaagaaacgaattag

SEQ ID NO: 7241683 - DNA, 22 bp, Homo sapiens
acagtggaaagaacatggattt

SEQ ID NO: 7241684 - DNA, 22 bp, Homo sapiens
aggaggccctagagctctagag

SEQ ID NO: 7241685 - DNA, 22 bp, Homo sapiens
acagtgttctgaaagttgaggg

SEQ ID NO: 7241686 - DNA, 20 bp, Homo sapiens
acagtgttaggtttttcctt

SEQ ID NO: 7241687 - DNA, 20 bp, Homo sapiens
aggcacctgtcacaggtgag

SEQ ID NO: 7241688 - DNA, 22 bp, Homo sapiens
aggcaccttgagagcaggagct

SEQ ID NO: 7241689 - DNA, 22 bp, Homo sapiens
aggcacagcacacctggccccc

SEQ ID NO: 7241690 - DNA, 22 bp, Homo sapiens
acagtggaaatgtgggagggga

SEQ ID NO: 7241691 - DNA, 20 bp, Homo sapiens
acagtggaaattgatgtctg

SEQ ID NO: 7241692 - DNA, 22 bp, Homo sapiens
acagtggaagaagcactgaact

SEQ ID NO: 7241693 - DNA, 22 bp, Homo sapiens
acagtggaagcatgatgctatc

SEQ ID NO: 7241694 - DNA, 22 bp, Homo sapiens
acagtggaatggtgggcctgca

SEQ ID NO: 7241695 - DNA, 22 bp, Homo sapiens
acagtggaatttgtagatgtgt

SEQ ID NO: 7241696 - DNA, 22 bp, Homo sapiens
acagtggagaagcaaatgcagt

SEQ ID NO: 7241697 - DNA, 22 bp, Homo sapiens
acagtggagaaggcatgaggct

SEQ ID NO: 7241698 - DNA, 22 bp, Homo sapiens
acagtggagaaggcatgaggct

SEQ ID NO: 7241699 - DNA, 22 bp, Homo sapiens
acagtggagctcagatgaaaat

SEQ ID NO: 7241700 - DNA, 22 bp, Homo sapiens
acagtggaggccatatggtcct

SEQ ID NO: 7241701 - DNA, 22 bp, Homo sapiens
acagtggagttggggtagccct

SEQ ID NO: 7241702 - DNA, 22 bp, Homo sapiens
acagtggatatattaaatgaga

SEQ ID NO: 7241703 - DNA, 22 bp, Homo sapiens
acagtggatgacatccttttgc

SEQ ID NO: 7241704 - DNA, 22 bp, Homo sapiens
acagtggatgtgatgtccaggt

SEQ ID NO: 7241705 - DNA, 22 bp, Homo sapiens
aggcagagaaaaaccagatatg

SEQ ID NO: 7241706 - DNA, 22 bp, Homo sapiens
aggcagatgggagctggaagtt

SEQ ID NO: 7241707 - DNA, 22 bp, Homo sapiens
aggcagatttaggagaaaagaa

SEQ ID NO: 7241708 - DNA, 18 bp, Homo sapiens
aggcagacactagaggtc

SEQ ID NO: 7241709 - DNA, 22 bp, Homo sapiens
acatctctgggtcctccatgca

SEQ ID NO: 7241710 - DNA, 22 bp, Homo sapiens
acatatatgtgcacatgtgcag

SEQ ID NO: 7241711 - DNA, 22 bp, Homo sapiens
acatatatgtaaagtactttgt

SEQ ID NO: 7241712 - DNA, 22 bp, Homo sapiens
acatataagggatcagtgacag

SEQ ID NO: 7241713 - DNA, 22 bp, Homo sapiens
aggcagtgtgtagctggaagag

SEQ ID NO: 7241714 - DNA, 22 bp, Homo sapiens
aggggcagttccaagttttgtg

SEQ ID NO: 7241715 - DNA, 22 bp, Homo sapiens
aggggcaggtgctgcacttaga

SEQ ID NO: 7241716 - DNA, 22 bp, Homo sapiens
agggctgacagtaaaagtatga

SEQ ID NO: 7241717 - DNA, 22 bp, Homo sapiens
agggctgacagtgaggagtcaa

SEQ ID NO: 7241718 - DNA, 22 bp, Homo sapiens
agggctgacacaccttatcctc

SEQ ID NO: 7241719 - DNA, 23 bp, Homo sapiens
agggctgaatgcagagaagcaga

SEQ ID NO: 7241720 - DNA, 22 bp, Homo sapiens
agggctgacaaatggcagtgac

SEQ ID NO: 7241721 - DNA, 22 bp, Homo sapiens
agggctgaagggaggtgctcat

SEQ ID NO: 7241722 - DNA, 22 bp, Homo sapiens
agggctcagtaaacggtggatt

SEQ ID NO: 7241723 - DNA, 22 bp, Homo sapiens
acctcagagacctctcaggtgc

SEQ ID NO: 7241724 - DNA, 22 bp, Homo sapiens
acctccagctttttagagacat

SEQ ID NO: 7241725 - DNA, 22 bp, Homo sapiens
acctcagaggccagggatctag

SEQ ID NO: 7241726 - DNA, 22 bp, Homo sapiens
aggggccacctgtggcaccctg

SEQ ID NO: 7241727 - DNA, 22 bp, Homo sapiens
aggggccacctgtggcaccctg

SEQ ID NO: 7241728 - DNA, 22 bp, Homo sapiens
aggggccaccaccaaggaaggt

SEQ ID NO: 7241729 - DNA, 22 bp, Homo sapiens
aggggccaccaccaaggaaggt

SEQ ID NO: 7241730 - DNA, 22 bp, Homo sapiens
aggggccattgttctgcccgct

SEQ ID NO: 7241731 - DNA, 22 bp, Homo sapiens
aggggccattgttctgcccgct

SEQ ID NO: 7241732 - DNA, 22 bp, Homo sapiens
aggggccatgtaagtgtatcac

SEQ ID NO: 7241733 - DNA, 22 bp, Homo sapiens
aggggcctcgcaggaccgctcc

SEQ ID NO: 7241734 - DNA, 22 bp, Homo sapiens
aggggcctcctcattggagtgt

SEQ ID NO: 7241735 - DNA, 22 bp, Homo sapiens
accctttcttactcacacgctc

SEQ ID NO: 7241736 - DNA, 18 bp, Homo sapiens
accctttccaaactgcag

SEQ ID NO: 7241737 - DNA, 22 bp, Homo sapiens
aggggcctggacatggacgcgc

SEQ ID NO: 7241738 - DNA, 23 bp, Homo sapiens
aggggtggtcagtacccgcagtg

SEQ ID NO: 7241739 - DNA, 23 bp, Homo sapiens
aggggtggtcagtacccgcagtg

SEQ ID NO: 7241740 - DNA, 23 bp, Homo sapiens
aggggtggtcagtacccgcagtg

SEQ ID NO: 7241741 - DNA, 22 bp, Homo sapiens
aggggtgtgcatcctggaggat

SEQ ID NO: 7241742 - DNA, 22 bp, Homo sapiens
aggggtgtgcatcctggaggat

SEQ ID NO: 7241743 - DNA, 22 bp, Homo sapiens
aggggttggatttggcctagag

SEQ ID NO: 7241744 - DNA, 22 bp, Homo sapiens
aggggtggcctgccttactccc

SEQ ID NO: 7241745 - DNA, 22 bp, Homo sapiens
aggggtggcctgccttactccc

SEQ ID NO: 7241746 - DNA, 22 bp, Homo sapiens
aggggtggagagtgttgccagt

SEQ ID NO: 7241747 - DNA, 22 bp, Homo sapiens
aggggtggagagtgttgccagt

SEQ ID NO: 7241748 - DNA, 22 bp, Homo sapiens
aggggtggagagtgttgccagt

SEQ ID NO: 7241749 - DNA, 20 bp, Homo sapiens
aggggtgatcgggtgacact

SEQ ID NO: 7241750 - DNA, 22 bp, Homo sapiens
aggggtgatttgggacaggaca

SEQ ID NO: 7241751 - DNA, 20 bp, Homo sapiens
aggggtgatcgggtgacact

SEQ ID NO: 7241752 - DNA, 20 bp, Homo sapiens
aggggtgatcgggtgacact

SEQ ID NO: 7241753 - DNA, 22 bp, Homo sapiens
agggaggcaggaaagttgtctg

SEQ ID NO: 7241754 - DNA, 18 bp, Homo sapiens
accagagccctgttctgg

SEQ ID NO: 7241755 - DNA, 22 bp, Homo sapiens
accagagctcttcagcacagga

SEQ ID NO: 7241756 - DNA, 20 bp, Homo sapiens
accagagatagcaatagtgc

SEQ ID NO: 7241757 - DNA, 22 bp, Homo sapiens
accagagaaaacacagcaggct

SEQ ID NO: 7241758 - DNA, 22 bp, Homo sapiens
agggaggtctggctgccctgag

SEQ ID NO: 7241759 - DNA, 20 bp, Homo sapiens
agggaggtgctgggcctgag

SEQ ID NO: 7241760 - DNA, 17 bp, Homo sapiens
agggagtcagaggatcg

SEQ ID NO: 7241761 - DNA, 22 bp, Homo sapiens
agggaggcattagctactgcga

SEQ ID NO: 7241762 - DNA, 19 bp, Homo sapiens
agggcacagggacagaagg

SEQ ID NO: 7241763 - DNA, 22 bp, Homo sapiens
agggcactccttggcagctctg

SEQ ID NO: 7241764 - DNA, 18 bp, Homo sapiens
agggcacggtgccagcct

SEQ ID NO: 7241765 - DNA, 22 bp, Homo sapiens
agggcactgaacagctgtagca

SEQ ID NO: 7241766 - DNA, 23 bp, Homo sapiens
agggcactgaagctggaattggg

SEQ ID NO: 7241767 - DNA, 22 bp, Homo sapiens
agggcactgcaagggttgaagg

SEQ ID NO: 7241768 - DNA, 23 bp, Homo sapiens
agggcactgttgggtgttgagga

SEQ ID NO: 7241769 - DNA, 22 bp, Homo sapiens
agggcatgctggaggagagaca

SEQ ID NO: 7241770 - DNA, 22 bp, Homo sapiens
agggccagcactcctggcagga

SEQ ID NO: 7241771 - DNA, 22 bp, Homo sapiens
agggccagcccataatgccaaa

SEQ ID NO: 7241772 - DNA, 22 bp, Homo sapiens
agggccagcagcttggccaacc

SEQ ID NO: 7241773 - DNA, 22 bp, Homo sapiens
agggccagcccataatgccaaa

SEQ ID NO: 7241774 - DNA, 22 bp, Homo sapiens
agggccagcactcctggcagga

SEQ ID NO: 7241775 - DNA, 22 bp, Homo sapiens
agggccagcactcctggcagga

SEQ ID NO: 7241776 - DNA, 22 bp, Homo sapiens
agggccagtattaaggtaatta

SEQ ID NO: 7241777 - DNA, 22 bp, Homo sapiens
agggccagtgggttgaaaggca

SEQ ID NO: 7241778 - DNA, 22 bp, Homo sapiens
agggccagtgggttgaaaggca

SEQ ID NO: 7241779 - DNA, 22 bp, Homo sapiens
agggccagtaccaggtgggtgg

SEQ ID NO: 7241780 - DNA, 22 bp, Homo sapiens
agggccagtaccaggtgggtgg

SEQ ID NO: 7241781 - DNA, 22 bp, Homo sapiens
agggccagtaaatgtttcctca

SEQ ID NO: 7241782 - DNA, 22 bp, Homo sapiens
agggctcaatggtgggcatgta

SEQ ID NO: 7241783 - DNA, 22 bp, Homo sapiens
agggccagttcagaggacatgg

SEQ ID NO: 7241784 - DNA, 22 bp, Homo sapiens
aggctctgacccatgggaccca

SEQ ID NO: 7241785 - DNA, 22 bp, Homo sapiens
aggctctggagtgtggtgctgg

SEQ ID NO: 7241786 - DNA, 22 bp, Homo sapiens
aggctcaggtctcaggtctggc

SEQ ID NO: 7241787 - DNA, 22 bp, Homo sapiens
aggctcaggtctcaggtctggc

SEQ ID NO: 7241788 - DNA, 22 bp, Homo sapiens
aggctcgcatgccctgcaccac

SEQ ID NO: 7241789 - DNA, 22 bp, Homo sapiens
acattaaatttcatagtgatta

SEQ ID NO: 7241790 - DNA, 22 bp, Homo sapiens
acattaaagagtaaggttagtt

SEQ ID NO: 7241791 - DNA, 22 bp, Homo sapiens
aggctcagggacggggcccctt

SEQ ID NO: 7241792 - DNA, 22 bp, Homo sapiens
aggctcaggcaggaatggcgga

SEQ ID NO: 7241793 - DNA, 22 bp, Homo sapiens
aggctcaggaggagctgccgga

SEQ ID NO: 7241794 - DNA, 22 bp, Homo sapiens
aggctcagctggtggtgatcgc

SEQ ID NO: 7241795 - DNA, 20 bp, Homo sapiens
aggctcagctgagctcttgg

SEQ ID NO: 7241796 - DNA, 22 bp, Homo sapiens
accacttcctttaggaccttgt

SEQ ID NO: 7241797 - DNA, 22 bp, Homo sapiens
accactggctcaggagctggga

SEQ ID NO: 7241798 - DNA, 22 bp, Homo sapiens
aggctgtgagcaagaacaccta

SEQ ID NO: 7241799 - DNA, 19 bp, Homo sapiens
aggctgtgagggaggactc

SEQ ID NO: 7241800 - DNA, 22 bp, Homo sapiens
aggctgggaaacctgaagttgt

SEQ ID NO: 7241801 - DNA, 22 bp, Homo sapiens
aggctgggaaatgtagtcttcc

SEQ ID NO: 7241802 - DNA, 22 bp, Homo sapiens
aggctgggaaatgtattccagc

SEQ ID NO: 7241803 - DNA, 22 bp, Homo sapiens
acatttctcaggtaagtcattt

SEQ ID NO: 7241804 - DNA, 22 bp, Homo sapiens
aggctggctggggatgcgtctt

SEQ ID NO: 7241805 - DNA, 22 bp, Homo sapiens
aggctgctgaggccaccacgct

SEQ ID NO: 7241806 - DNA, 22 bp, Homo sapiens
aggctctggagttagccaggca

SEQ ID NO: 7241807 - DNA, 22 bp, Homo sapiens
aggctctggcaacagctggtgt

SEQ ID NO: 7241808 - DNA, 22 bp, Homo sapiens
agaagcagggcagggaaaagca

SEQ ID NO: 7241809 - DNA, 22 bp, Homo sapiens
agaaattaggaaagtaacactt

SEQ ID NO: 7241810 - DNA, 22 bp, Homo sapiens
agaaatgttgaatacatcagga

SEQ ID NO: 7241811 - DNA, 22 bp, Homo sapiens
agaagccaaatgccagtgacct

SEQ ID NO: 7241812 - DNA, 22 bp, Homo sapiens
agaagccaacagggcaggagag

SEQ ID NO: 7241813 - DNA, 22 bp, Homo sapiens
agaagctgcctacatgaccagc

SEQ ID NO: 7241814 - DNA, 22 bp, Homo sapiens
agaagccatgtttagtaggatg

SEQ ID NO: 7241815 - DNA, 22 bp, Homo sapiens
agaagccattccctgtaggctc

SEQ ID NO: 7241816 - DNA, 22 bp, Homo sapiens
agaagccaccagctgaggaaga

SEQ ID NO: 7241817 - DNA, 22 bp, Homo sapiens
agaagccaccagctgaggaaga

SEQ ID NO: 7241818 - DNA, 22 bp, Homo sapiens
agaagccatagtatctcagggt

SEQ ID NO: 7241819 - DNA, 22 bp, Homo sapiens
agaagccatagtctgggaggca

SEQ ID NO: 7241820 - DNA, 22 bp, Homo sapiens
agaagccatggtatgcaactac

SEQ ID NO: 7241821 - DNA, 21 bp, Homo sapiens
agaagccatgtggtggagaac

SEQ ID NO: 7241822 - DNA, 20 bp, Homo sapiens
agaaatattgagttcagagg

SEQ ID NO: 7241823 - DNA, 22 bp, Homo sapiens
agaaatcaatatctatatgttg

SEQ ID NO: 7241824 - DNA, 22 bp, Homo sapiens
agaaatatgctgattagatgaa

SEQ ID NO: 7241825 - DNA, 22 bp, Homo sapiens
atcaagaattgggagctattga

SEQ ID NO: 7241826 - DNA, 22 bp, Homo sapiens
agaaagaacgttggttatctta

SEQ ID NO: 7241827 - DNA, 22 bp, Homo sapiens
atatagaaggtgctatttacat

SEQ ID NO: 7241828 - DNA, 22 bp, Homo sapiens
atatagaatacacagggaaagt

SEQ ID NO: 7241829 - DNA, 22 bp, Homo sapiens
agaaactgtgttactagaatgt

SEQ ID NO: 7241830 - DNA, 22 bp, Homo sapiens
agaaagaacgcacttgtgctgc

SEQ ID NO: 7241831 - DNA, 22 bp, Homo sapiens
atacacaattgtgtttttatga

SEQ ID NO: 7241832 - DNA, 22 bp, Homo sapiens
atacaatgagtgagtgaatggg

SEQ ID NO: 7241833 - DNA, 22 bp, Homo sapiens
atacaatcaaccacttgcgagc

SEQ ID NO: 7241834 - DNA, 22 bp, Homo sapiens
ataaggcttaaaccttgttgcc

SEQ ID NO: 7241835 - DNA, 22 bp, Homo sapiens
ataaggcagtcactggaatgtt

SEQ ID NO: 7241836 - DNA, 22 bp, Homo sapiens
atacaaagacaaatctcaatct

SEQ ID NO: 7241837 - DNA, 20 bp, Homo sapiens
atacaaagagattgatgtat

SEQ ID NO: 7241838 - DNA, 22 bp, Homo sapiens
agttctttggcagctgggctgg

SEQ ID NO: 7241839 - DNA, 22 bp, Homo sapiens
agttctttgtgagtaatacaga

SEQ ID NO: 7241840 - DNA, 22 bp, Homo sapiens
agttctttgtcatctctggagt

SEQ ID NO: 7241841 - DNA, 22 bp, Homo sapiens
agttctttggtcctaaccctgc

SEQ ID NO: 7241842 - DNA, 22 bp, Homo sapiens
agttctttgtaaaaggtctcta

SEQ ID NO: 7241843 - DNA, 22 bp, Homo sapiens
agttcttttctagattctggat

SEQ ID NO: 7241844 - DNA, 22 bp, Homo sapiens
agttcttttgtgaacatatgct

SEQ ID NO: 7241845 - DNA, 22 bp, Homo sapiens
agttgaatgttacagttctaaa

SEQ ID NO: 7241846 - DNA, 22 bp, Homo sapiens
agttgaagtcctcatcaaatat

SEQ ID NO: 7241847 - DNA, 22 bp, Homo sapiens
agttgaaggttggctgatccat

SEQ ID NO: 7241848 - DNA, 22 bp, Homo sapiens
agttgaaggttggctgatccat

SEQ ID NO: 7241849 - DNA, 19 bp, Homo sapiens
ataaataaaaagtgggaga

SEQ ID NO: 7241850 - DNA, 22 bp, Homo sapiens
atagaatagcatagaaaattga

SEQ ID NO: 7241851 - DNA, 22 bp, Homo sapiens
atagaataaggcacagattctt

SEQ ID NO: 7241852 - DNA, 22 bp, Homo sapiens
atagaataaggcacagattctt

SEQ ID NO: 7241853 - DNA, 22 bp, Homo sapiens
atagaatacatttcatggagat

SEQ ID NO: 7241854 - DNA, 20 bp, Homo sapiens
atagaagtattatgtaatgt

SEQ ID NO: 7241855 - DNA, 22 bp, Homo sapiens
atagaagctgataaactacttc

SEQ ID NO: 7241856 - DNA, 22 bp, Homo sapiens
atagaagcaagaacagaatgga

SEQ ID NO: 7241857 - DNA, 22 bp, Homo sapiens
atagaagaggaaactgaggttg

SEQ ID NO: 7241858 - DNA, 21 bp, Homo sapiens
atagaacaccaggcatatata

SEQ ID NO: 7241859 - DNA, 22 bp, Homo sapiens
atagaacaaggtagacagcttt

SEQ ID NO: 7241860 - DNA, 23 bp, Homo sapiens
atagttatgctgcatgcatgtac

SEQ ID NO: 7241861 - DNA, 22 bp, Homo sapiens
atagttctagacctatagttct

SEQ ID NO: 7241862 - DNA, 22 bp, Homo sapiens
ataggagccataaataaaatct

SEQ ID NO: 7241863 - DNA, 22 bp, Homo sapiens
agtggcagagcaggtgctggaa

SEQ ID NO: 7241864 - DNA, 22 bp, Homo sapiens
agtggcagacacaatgtgggca

SEQ ID NO: 7241865 - DNA, 22 bp, Homo sapiens
agtggcagacacaatgtgggca

SEQ ID NO: 7241866 - DNA, 22 bp, Homo sapiens
agtggcagagccaagtagagcc

SEQ ID NO: 7241867 - DNA, 22 bp, Homo sapiens
agtgggaggcggctgacgggcg

SEQ ID NO: 7241868 - DNA, 22 bp, Homo sapiens
agtgggaggaagtggtgatatt

SEQ ID NO: 7241869 - DNA, 22 bp, Homo sapiens
agtgcaaaattcagaagcaatt

SEQ ID NO: 7241870 - DNA, 23 bp, Homo sapiens
agtgctgaattgaaagctccagg

SEQ ID NO: 7241871 - DNA, 23 bp, Homo sapiens
agtgagcagctgtagggcaagga

SEQ ID NO: 7241872 - DNA, 22 bp, Homo sapiens
agtgagcattcgtttggaaccc

SEQ ID NO: 7241873 - DNA, 20 bp, Homo sapiens
agtgaggcagttcagtgggc

SEQ ID NO: 7241874 - DNA, 22 bp, Homo sapiens
agtgagagtattaatgtgaact

SEQ ID NO: 7241875 - DNA, 17 bp, Homo sapiens
agtgagaatgtcatgta

SEQ ID NO: 7241876 - DNA, 22 bp, Homo sapiens
agtccttcttttagttgcttgg

SEQ ID NO: 7241877 - DNA, 23 bp, Homo sapiens
agtcctttttataaaattgagga

SEQ ID NO: 7241878 - DNA, 22 bp, Homo sapiens
agtccttttgttttgagatgag

SEQ ID NO: 7241879 - DNA, 22 bp, Homo sapiens
agtggggccggtgaggccgagg

SEQ ID NO: 7241880 - DNA, 22 bp, Homo sapiens
agtggggcggacaggaccagga

SEQ ID NO: 7241881 - DNA, 22 bp, Homo sapiens
agtgggggcagagcctctctcg

SEQ ID NO: 7241882 - DNA, 22 bp, Homo sapiens
agtgggggccaacgagggcagc

SEQ ID NO: 7241883 - DNA, 22 bp, Homo sapiens
agtggggtccatcccttccctc

SEQ ID NO: 7241884 - DNA, 22 bp, Homo sapiens
agtgggggctggctctgtctgt

SEQ ID NO: 7241885 - DNA, 22 bp, Homo sapiens
agtggggtctcctccagccccc

SEQ ID NO: 7241886 - DNA, 22 bp, Homo sapiens
agtgtctgaacctgcagtggga

SEQ ID NO: 7241887 - DNA, 22 bp, Homo sapiens
agtgtctgtgatgaggtcagga

SEQ ID NO: 7241888 - DNA, 22 bp, Homo sapiens
agtgtgggttttatggagccct

SEQ ID NO: 7241889 - DNA, 22 bp, Homo sapiens
actggtgttgatttggaagggg

SEQ ID NO: 7241890 - DNA, 22 bp, Homo sapiens
agttacaaacactatcagttct

SEQ ID NO: 7241891 - DNA, 22 bp, Homo sapiens
agttacaaacactatcagttct

SEQ ID NO: 7241892 - DNA, 22 bp, Homo sapiens
actggggcagtgggcagtggtt

SEQ ID NO: 7241893 - DNA, 22 bp, Homo sapiens
actggggcaggaaagtatgctg

SEQ ID NO: 7241894 - DNA, 22 bp, Homo sapiens
actggggcctcctccatgctct

SEQ ID NO: 7241895 - DNA, 22 bp, Homo sapiens
actggggctgatgcgttcgtgt

SEQ ID NO: 7241896 - DNA, 22 bp, Homo sapiens
actggggctgatgcgttcgtgt

SEQ ID NO: 7241897 - DNA, 22 bp, Homo sapiens
actggggtgaaattggagtgtc

SEQ ID NO: 7241898 - DNA, 22 bp, Homo sapiens
agttattttggaaaatgagtca

SEQ ID NO: 7241899 - DNA, 22 bp, Homo sapiens
agttattttacatggaagtttg

SEQ ID NO: 7241900 - DNA, 22 bp, Homo sapiens
agttatttggctatagatggta

SEQ ID NO: 7241901 - DNA, 22 bp, Homo sapiens
agtcagtgaatctgaaggctaa

SEQ ID NO: 7241902 - DNA, 22 bp, Homo sapiens
agtaataaactctttttatctc

SEQ ID NO: 7241903 - DNA, 22 bp, Homo sapiens
agtaagacccagtcacttgaga

SEQ ID NO: 7241904 - DNA, 22 bp, Homo sapiens
actcagaggaaaccctcctagg

SEQ ID NO: 7241905 - DNA, 22 bp, Homo sapiens
aggttctccttatcaatgaaga

SEQ ID NO: 7241906 - DNA, 22 bp, Homo sapiens
aggtgtctggacttgtgaagca

SEQ ID NO: 7241907 - DNA, 21 bp, Homo sapiens
aggttccagcagccagagaat

SEQ ID NO: 7241908 - DNA, 20 bp, Homo sapiens
aggttccagccacaaccagc

SEQ ID NO: 7241909 - DNA, 22 bp, Homo sapiens
aggtggaacgttcaggtgctag

SEQ ID NO: 7241910 - DNA, 22 bp, Homo sapiens
aggtggagaagagatgggcagt

SEQ ID NO: 7241911 - DNA, 22 bp, Homo sapiens
aggtggagaagagatgggcagt

SEQ ID NO: 7241912 - DNA, 16 bp, Homo sapiens
aggtggagaagttcac

SEQ ID NO: 7241913 - DNA, 22 bp, Homo sapiens
aggtggagacccagagaaggcg

SEQ ID NO: 7241914 - DNA, 22 bp, Homo sapiens
aggtggagacccagagaaggcg

SEQ ID NO: 7241915 - DNA, 22 bp, Homo sapiens
aggtggggaaaccagcgatccc

SEQ ID NO: 7241916 - DNA, 22 bp, Homo sapiens
aggtggggttcagtctcagccg

SEQ ID NO: 7241917 - DNA, 22 bp, Homo sapiens
agggtcagttctgtgaggtgtt

SEQ ID NO: 7241918 - DNA, 22 bp, Homo sapiens
agggtcagttctgtgaggtgtt

SEQ ID NO: 7241919 - DNA, 22 bp, Homo sapiens
agggtcagtgatgagggagccc

SEQ ID NO: 7241920 - DNA, 23 bp, Homo sapiens
agggtgagcaagctatggagacc

SEQ ID NO: 7241921 - DNA, 22 bp, Homo sapiens
agggtgcaggggaagctgccct

SEQ ID NO: 7241922 - DNA, 22 bp, Homo sapiens
agggtgcagggacaggtgtgca

SEQ ID NO: 7241923 - DNA, 22 bp, Homo sapiens
agggtgcagggacaggtgtgca

SEQ ID NO: 7241924 - DNA, 22 bp, Homo sapiens
agggtgcagaaggagcctagga

SEQ ID NO: 7241925 - DNA, 22 bp, Homo sapiens
aggtggaaatggctttcctagg

SEQ ID NO: 7241926 - DNA, 21 bp, Homo sapiens
aggtgcaggcctcaagcccca

SEQ ID NO: 7241927 - DNA, 19 bp, Homo sapiens
aggtgcaggtcacagggga

SEQ ID NO: 7241928 - DNA, 21 bp, Homo sapiens
aggtgcaggcctcaagcccca

SEQ ID NO: 7241929 - DNA, 22 bp, Homo sapiens
aggtgcaggagctgtgcaggga

SEQ ID NO: 7241930 - DNA, 22 bp, Homo sapiens
aggtgaggataggtggccaagg

SEQ ID NO: 7241931 - DNA, 22 bp, Homo sapiens
agggtgcatgtttgcaagagtg

SEQ ID NO: 7241932 - DNA, 22 bp, Homo sapiens
cactgcactccagcccgggcaa

SEQ ID NO: 7241933 - DNA, 22 bp, Homo sapiens
cactgcactccagcactccagc

SEQ ID NO: 7241934 - DNA, 22 bp, Homo sapiens
cactgcaccctcaaactcctgg

SEQ ID NO: 7241935 - DNA, 22 bp, Homo sapiens
cactgcactccagcccgggcaa

SEQ ID NO: 7241936 - DNA, 22 bp, Homo sapiens
cactgcactccagcccgggcaa

SEQ ID NO: 7241937 - DNA, 22 bp, Homo sapiens
cactgcactccatcctgggaaa

SEQ ID NO: 7241938 - DNA, 22 bp, Homo sapiens
agcattttctgagagtatagat

SEQ ID NO: 7241939 - DNA, 22 bp, Homo sapiens
cactgggcgtgtcctgggtgag

SEQ ID NO: 7241940 - DNA, 22 bp, Homo sapiens
cactggggtgggcctggtagag

SEQ ID NO: 7241941 - DNA, 22 bp, Homo sapiens
cactggggaaaacaggcttctt

SEQ ID NO: 7241942 - DNA, 22 bp, Homo sapiens
cacatgggtgtgcctggaggaa

SEQ ID NO: 7241943 - DNA, 22 bp, Homo sapiens
cacatggcctgtgtggccagac

SEQ ID NO: 7241944 - DNA, 22 bp, Homo sapiens
cacatgggcttagcaggcaggg

SEQ ID NO: 7241945 - DNA, 18 bp, Homo sapiens
agcaggcgttgcctggga

SEQ ID NO: 7241946 - DNA, 22 bp, Homo sapiens
agcaggcctcatgcaccagcta

SEQ ID NO: 7241947 - DNA, 19 bp, Homo sapiens
agcaggccaggcaggtggc

SEQ ID NO: 7241948 - DNA, 22 bp, Homo sapiens
cacattgataattaaggcctcc

SEQ ID NO: 7241949 - DNA, 23 bp, Homo sapiens
cacattgaacactctctttcctg

SEQ ID NO: 7241950 - DNA, 22 bp, Homo sapiens
cacattgaacttgtctggtggg

SEQ ID NO: 7241951 - DNA, 22 bp, Homo sapiens
agcaggtgggcatgaaagctga

SEQ ID NO: 7241952 - DNA, 22 bp, Homo sapiens
cactagaaccaatgacatttct

SEQ ID NO: 7241953 - DNA, 22 bp, Homo sapiens
cactagaaaggtacagattatg

SEQ ID NO: 7241954 - DNA, 22 bp, Homo sapiens
cactagaaaggtacagattatg

SEQ ID NO: 7241955 - DNA, 22 bp, Homo sapiens
caagtccatgttagatgctggc

SEQ ID NO: 7241956 - DNA, 22 bp, Homo sapiens
caagtccatcctactgccttct

SEQ ID NO: 7241957 - DNA, 22 bp, Homo sapiens
caagtccatcagataagcaaga

SEQ ID NO: 7241958 - DNA, 22 bp, Homo sapiens
caagtccatataagtctgtttc

SEQ ID NO: 7241959 - DNA, 22 bp, Homo sapiens
caagtccaggtgggcaaataaa

SEQ ID NO: 7241960 - DNA, 22 bp, Homo sapiens
caagtccaggtcaatttaaagc

SEQ ID NO: 7241961 - DNA, 22 bp, Homo sapiens
caagtccaagatcaagaagcca

SEQ ID NO: 7241962 - DNA, 22 bp, Homo sapiens
caagtccaacagtttttcagac

SEQ ID NO: 7241963 - DNA, 22 bp, Homo sapiens
caagggagttactgagggcggg

SEQ ID NO: 7241964 - DNA, 22 bp, Homo sapiens
caagggagttactgagggcggg

SEQ ID NO: 7241965 - DNA, 22 bp, Homo sapiens
caattatatttagaatgataca

SEQ ID NO: 7241966 - DNA, 22 bp, Homo sapiens
caattaaagaagacctgcctca

SEQ ID NO: 7241967 - DNA, 22 bp, Homo sapiens
caatgtttttccttccttaata

SEQ ID NO: 7241968 - DNA, 22 bp, Homo sapiens
caagtgaagatatacagaaaat

SEQ ID NO: 7241969 - DNA, 22 bp, Homo sapiens
caatgttttgttgaatgaatag

SEQ ID NO: 7241970 - DNA, 22 bp, Homo sapiens
caagtctgacctctgggtgaag

SEQ ID NO: 7241971 - DNA, 22 bp, Homo sapiens
caaggaaaagaagtatttcaga

SEQ ID NO: 7241972 - DNA, 22 bp, Homo sapiens
agcagagacatgaaatatgctt

SEQ ID NO: 7241973 - DNA, 22 bp, Homo sapiens
agcagacatggcttggatgtgg

SEQ ID NO: 7241974 - DNA, 22 bp, Homo sapiens
cacagcagccagaacatttttg

SEQ ID NO: 7241975 - DNA, 22 bp, Homo sapiens
cacagcagcgttcctccgtgtg

SEQ ID NO: 7241976 - DNA, 22 bp, Homo sapiens
cacagctgccatggctgcactt

SEQ ID NO: 7241977 - DNA, 22 bp, Homo sapiens
cacacatgtgagcagagaggcg

SEQ ID NO: 7241978 - DNA, 22 bp, Homo sapiens
cacactgttgaggacgagatgt

SEQ ID NO: 7241979 - DNA, 22 bp, Homo sapiens
caatttcttgttaattctcagg

SEQ ID NO: 7241980 - DNA, 22 bp, Homo sapiens
caatttctctttatatctcaca

SEQ ID NO: 7241981 - DNA, 22 bp, Homo sapiens
caatttttaaactatgaagttg

SEQ ID NO: 7241982 - DNA, 22 bp, Homo sapiens
agccagggaagaggcctacctc

SEQ ID NO: 7241983 - DNA, 22 bp, Homo sapiens
agccaggctgcagttggctggc

SEQ ID NO: 7241984 - DNA, 16 bp, Homo sapiens
agccaggctgcctcgg

SEQ ID NO: 7241985 - DNA, 22 bp, Homo sapiens
agccaagacatttagaaaagct

SEQ ID NO: 7241986 - DNA, 22 bp, Homo sapiens
agccaggccttttctcaaggtt

SEQ ID NO: 7241987 - DNA, 22 bp, Homo sapiens
agccaggcgcagtggcttatgc

SEQ ID NO: 7241988 - DNA, 22 bp, Homo sapiens
agccagggctgcgagcagacag

SEQ ID NO: 7241989 - DNA, 22 bp, Homo sapiens
cagagccagggttgcacccctg

SEQ ID NO: 7241990 - DNA, 22 bp, Homo sapiens
cagagccaggcctgccctcttt

SEQ ID NO: 7241991 - DNA, 22 bp, Homo sapiens
cagagcagtaaatctggggcac

SEQ ID NO: 7241992 - DNA, 22 bp, Homo sapiens
cagagctgtccaaaccctgaca

SEQ ID NO: 7241993 - DNA, 21 bp, Homo sapiens
cagagctgtccaaaccctgac

SEQ ID NO: 7241994 - DNA, 22 bp, Homo sapiens
agcctaggaggttggggctgca

SEQ ID NO: 7241995 - DNA, 22 bp, Homo sapiens
agccgctgtctcttgggccgcg

SEQ ID NO: 7241996 - DNA, 22 bp, Homo sapiens
cagcactgcttcgcagccaggg

SEQ ID NO: 7241997 - DNA, 22 bp, Homo sapiens
cagatgaagatcatagaatagt

SEQ ID NO: 7241998 - DNA, 18 bp, Homo sapiens
cagagtgggccaagagac

SEQ ID NO: 7241999 - DNA, 22 bp, Homo sapiens
agccctcctggggccacgctgg

SEQ ID NO: 7242000 - DNA, 22 bp, Homo sapiens
agccctctctttagagatctga

SEQ ID NO: 7242001 - DNA, 22 bp, Homo sapiens
cagaggagtgggccgttatggt

SEQ ID NO: 7242002 - DNA, 20 bp, Homo sapiens
cagaggagtacatatgttca

SEQ ID NO: 7242003 - DNA, 22 bp, Homo sapiens
cagaggagttcagtacacagcc

SEQ ID NO: 7242004 - DNA, 22 bp, Homo sapiens
cagagtgaaataggggatcaag

SEQ ID NO: 7242005 - DNA, 22 bp, Homo sapiens
cagagtgaaaactgagctcaaa

SEQ ID NO: 7242006 - DNA, 22 bp, Homo sapiens
cagagtgaaataggggatcaag

SEQ ID NO: 7242007 - DNA, 22 bp, Homo sapiens
cagagtgaacagtgggatgtgc

SEQ ID NO: 7242008 - DNA, 22 bp, Homo sapiens
cagagtgaacagtgggatgtgc

SEQ ID NO: 7242009 - DNA, 22 bp, Homo sapiens
cagagtgaaataggggatcaag

SEQ ID NO: 7242010 - DNA, 22 bp, Homo sapiens
cagagtgattatggaggattgc

SEQ ID NO: 7242011 - DNA, 22 bp, Homo sapiens
cagagtggagaaacgcttcgtc

SEQ ID NO: 7242012 - DNA, 22 bp, Homo sapiens
cagagtgataaatatagaaatt

SEQ ID NO: 7242013 - DNA, 22 bp, Homo sapiens
cagagtgatggcacctgctggg

SEQ ID NO: 7242014 - DNA, 17 bp, Homo sapiens
cagaggagctttggggg

SEQ ID NO: 7242015 - DNA, 22 bp, Homo sapiens
cagaggaggccaccgcataggc

SEQ ID NO: 7242016 - DNA, 22 bp, Homo sapiens
cagaggaggccaccgcataggc

SEQ ID NO: 7242017 - DNA, 22 bp, Homo sapiens
cagaggaggcggtatacactgc

SEQ ID NO: 7242018 - DNA, 18 bp, Homo sapiens
cagaggagagacattcag

SEQ ID NO: 7242019 - DNA, 17 bp, Homo sapiens
cagaggagctttggggg

SEQ ID NO: 7242020 - DNA, 17 bp, Homo sapiens
cagaggagctttggggg

SEQ ID NO: 7242021 - DNA, 22 bp, Homo sapiens
cagaggagaattgcgggatcat

SEQ ID NO: 7242022 - DNA, 22 bp, Homo sapiens
cagaggagaattgcgggatcat

SEQ ID NO: 7242023 - DNA, 22 bp, Homo sapiens
agcgagggaggtctgaggacag

SEQ ID NO: 7242024 - DNA, 22 bp, Homo sapiens
agcgccactgcactccagcctg

SEQ ID NO: 7242025 - DNA, 22 bp, Homo sapiens
cagcatggtggagctgctcttt

SEQ ID NO: 7242026 - DNA, 22 bp, Homo sapiens
cagcactgttcccagaccactg

SEQ ID NO: 7242027 - DNA, 22 bp, Homo sapiens
cagcactgtgataactgagcca

SEQ ID NO: 7242028 - DNA, 22 bp, Homo sapiens
cagcactggggccactggagtt

SEQ ID NO: 7242029 - DNA, 22 bp, Homo sapiens
cagcccagagaaggggcccgtg

SEQ ID NO: 7242030 - DNA, 20 bp, Homo sapiens
agcggaccaggccattgttg

SEQ ID NO: 7242031 - DNA, 22 bp, Homo sapiens
agcggaaggcctggctgatccg

SEQ ID NO: 7242032 - DNA, 22 bp, Homo sapiens
agcgcttgccgcactccaagca

SEQ ID NO: 7242033 - DNA, 22 bp, Homo sapiens
cagccagtgtgaccgaggagga

SEQ ID NO: 7242034 - DNA, 22 bp, Homo sapiens
cagcctctaagcacagcctctc

SEQ ID NO: 7242035 - DNA, 22 bp, Homo sapiens
cagcctcctgggacactcaccg

SEQ ID NO: 7242036 - DNA, 22 bp, Homo sapiens
cagccctgggtccctgccctgg

SEQ ID NO: 7242037 - DNA, 22 bp, Homo sapiens
agctctggaagccctggtagtt

SEQ ID NO: 7242038 - DNA, 18 bp, Homo sapiens
cagctgccagctcatgga

SEQ ID NO: 7242039 - DNA, 22 bp, Homo sapiens
cagccttcgacagttggagtag

SEQ ID NO: 7242040 - DNA, 22 bp, Homo sapiens
cagccttcgacagttggagtag

SEQ ID NO: 7242041 - DNA, 22 bp, Homo sapiens
cagccttctgaatgaacgtact

SEQ ID NO: 7242042 - DNA, 22 bp, Homo sapiens
cagcggaggacagatgggagct

SEQ ID NO: 7242043 - DNA, 22 bp, Homo sapiens
cagcggaggacagatgggagct

SEQ ID NO: 7242044 - DNA, 22 bp, Homo sapiens
cagcggggcctgtgctggggag

SEQ ID NO: 7242045 - DNA, 22 bp, Homo sapiens
cagcgagagacaaagagctgtg

SEQ ID NO: 7242046 - DNA, 22 bp, Homo sapiens
agctctggcactggcgcgggat

SEQ ID NO: 7242047 - DNA, 22 bp, Homo sapiens
agctctggagccggaggatttc

SEQ ID NO: 7242048 - DNA, 23 bp, Homo sapiens
agctctggcgttggggaggtagt

SEQ ID NO: 7242049 - DNA, 22 bp, Homo sapiens
cagctggcatacctgggcccgg

SEQ ID NO: 7242050 - DNA, 22 bp, Homo sapiens
agataatttgagtaaattaatt

SEQ ID NO: 7242051 - DNA, 22 bp, Homo sapiens
agatacaaaggcctacagagca

SEQ ID NO: 7242052 - DNA, 22 bp, Homo sapiens
agatacaaaaagggagaagatt

SEQ ID NO: 7242053 - DNA, 22 bp, Homo sapiens
agatacaactgtttaaacatta

SEQ ID NO: 7242054 - DNA, 22 bp, Homo sapiens
agatacaaaggcctacagagca

SEQ ID NO: 7242055 - DNA, 22 bp, Homo sapiens
agatacaagttaagagaaagga

SEQ ID NO: 7242056 - DNA, 22 bp, Homo sapiens
agatacaactgtttaaacatta

SEQ ID NO: 7242057 - DNA, 22 bp, Homo sapiens
agatacagacctcttattaagg

SEQ ID NO: 7242058 - DNA, 22 bp, Homo sapiens
attgaaaccctggattgtccta

SEQ ID NO: 7242059 - DNA, 22 bp, Homo sapiens
attgaaacctgctcaggctctc

SEQ ID NO: 7242060 - DNA, 22 bp, Homo sapiens
agaggaaatggataaagggtga

SEQ ID NO: 7242061 - DNA, 22 bp, Homo sapiens
agaggcctctttgcaagtaggt

SEQ ID NO: 7242062 - DNA, 22 bp, Homo sapiens
agaggcctctgttgttcagacg

SEQ ID NO: 7242063 - DNA, 22 bp, Homo sapiens
agaggcctctagggcccctcag

SEQ ID NO: 7242064 - DNA, 22 bp, Homo sapiens
attatttgtgtccacagaatac

SEQ ID NO: 7242065 - DNA, 22 bp, Homo sapiens
agaggcctcaaaccagacctga

SEQ ID NO: 7242066 - DNA, 22 bp, Homo sapiens
agaggcctaaccaagatgtcct

SEQ ID NO: 7242067 - DNA, 19 bp, Homo sapiens
agaggcctcagcagctggc

SEQ ID NO: 7242068 - DNA, 22 bp, Homo sapiens
agaggccggccgagcccatggg

SEQ ID NO: 7242069 - DNA, 22 bp, Homo sapiens
attcttctgcctactttcatcc

SEQ ID NO: 7242070 - DNA, 22 bp, Homo sapiens
attctacaacccaataataatt

SEQ ID NO: 7242071 - DNA, 20 bp, Homo sapiens
attctacaagaataagcatg

SEQ ID NO: 7242072 - DNA, 20 bp, Homo sapiens
attctccctatactcacttt

SEQ ID NO: 7242073 - DNA, 22 bp, Homo sapiens
attcccagatttatattgatag

SEQ ID NO: 7242074 - DNA, 22 bp, Homo sapiens
attctacaacccaataataatt

SEQ ID NO: 7242075 - DNA, 20 bp, Homo sapiens
attctaaagctctgctcttt

SEQ ID NO: 7242076 - DNA, 22 bp, Homo sapiens
agcaataacagaaaactttcct

SEQ ID NO: 7242077 - DNA, 22 bp, Homo sapiens
caaagtggctggccgggagatc

SEQ ID NO: 7242078 - DNA, 22 bp, Homo sapiens
caaagtgggtgccctgatgctc

SEQ ID NO: 7242079 - DNA, 22 bp, Homo sapiens
caaagttttagtaaacatatat

SEQ ID NO: 7242080 - DNA, 22 bp, Homo sapiens
agcaatgtaaaccctgaagttg

SEQ ID NO: 7242081 - DNA, 22 bp, Homo sapiens
agcaatagataaaacatttacc

SEQ ID NO: 7242082 - DNA, 23 bp, Homo sapiens
atttacagctgtgtgagcaagtt

SEQ ID NO: 7242083 - DNA, 22 bp, Homo sapiens
atttgaagtaagtaatgagtat

SEQ ID NO: 7242084 - DNA, 22 bp, Homo sapiens
atttgaatggcttaacacaacg

SEQ ID NO: 7242085 - DNA, 22 bp, Homo sapiens
agatgacaatgaggttgttatt

SEQ ID NO: 7242086 - DNA, 22 bp, Homo sapiens
agatgagaatttttagagtgct

SEQ ID NO: 7242087 - DNA, 22 bp, Homo sapiens
agattgacaaaacagaagattt

SEQ ID NO: 7242088 - DNA, 22 bp, Homo sapiens
agatgtttgtaaacacactgct

SEQ ID NO: 7242089 - DNA, 22 bp, Homo sapiens
agagcggggatagttaatattc

SEQ ID NO: 7242090 - DNA, 22 bp, Homo sapiens
agagcggggatagttaatattc

SEQ ID NO: 7242091 - DNA, 22 bp, Homo sapiens
agagcgagtctggggctcggat

SEQ ID NO: 7242092 - DNA, 22 bp, Homo sapiens
atgttctatatcattattgtga

SEQ ID NO: 7242093 - DNA, 22 bp, Homo sapiens
atgttccttgctctcaggtaag

SEQ ID NO: 7242094 - DNA, 22 bp, Homo sapiens
agagccaggaagtggcgtgggg

SEQ ID NO: 7242095 - DNA, 18 bp, Homo sapiens
agagatggtgtagagttt

SEQ ID NO: 7242096 - DNA, 22 bp, Homo sapiens
atgtgcagcttttctagagaag

SEQ ID NO: 7242097 - DNA, 17 bp, Homo sapiens
agagagaaaagggccat

SEQ ID NO: 7242098 - DNA, 18 bp, Homo sapiens
agagatgggagttggaaa

SEQ ID NO: 7242099 - DNA, 22 bp, Homo sapiens
atgtatatgtgaaagatgttta

SEQ ID NO: 7242100 - DNA, 22 bp, Homo sapiens
atgggcagttaggaggccagga

SEQ ID NO: 7242101 - DNA, 16 bp, Homo sapiens
atgggcagtgaggaag

SEQ ID NO: 7242102 - DNA, 22 bp, Homo sapiens
atgggcagtaacagtggcagtc

SEQ ID NO: 7242103 - DNA, 22 bp, Homo sapiens
atgggcagtgtattggaaggaa

SEQ ID NO: 7242104 - DNA, 22 bp, Homo sapiens
atgggcagttaggaggccagga

SEQ ID NO: 7242105 - DNA, 22 bp, Homo sapiens
atggacaggtactgcagtgggt

SEQ ID NO: 7242106 - DNA, 22 bp, Homo sapiens
atggacagagctgagctccacc

SEQ ID NO: 7242107 - DNA, 22 bp, Homo sapiens
atggacagctgacactcacatt

SEQ ID NO: 7242108 - DNA, 22 bp, Homo sapiens
atgaggagctgttttaactgct

SEQ ID NO: 7242109 - DNA, 22 bp, Homo sapiens
atgagaaagagttgtatctaga

SEQ ID NO: 7242110 - DNA, 22 bp, Homo sapiens
atgagaaagagttgtatctaga

SEQ ID NO: 7242111 - DNA, 22 bp, Homo sapiens
atgaggagaccaaggcctgatg

SEQ ID NO: 7242112 - DNA, 22 bp, Homo sapiens
atgacttaatcatacttgcatt

SEQ ID NO: 7242113 - DNA, 22 bp, Homo sapiens
atcttacaattacaagacactc

SEQ ID NO: 7242114 - DNA, 22 bp, Homo sapiens
atcttaagcttcatcaaccctg

SEQ ID NO: 7242115 - DNA, 22 bp, Homo sapiens
atctgggtgaagtttaaaaatc

SEQ ID NO: 7242116 - DNA, 22 bp, Homo sapiens
atctgggtgtggaatatatagg

SEQ ID NO: 7242117 - DNA, 22 bp, Homo sapiens
atctgggttcaccatgctcctg

SEQ ID NO: 7242118 - DNA, 22 bp, Homo sapiens
atctgggttccctcccccaatt

SEQ ID NO: 7242119 - DNA, 22 bp, Homo sapiens
atctgggtttaaatctcagctt

SEQ ID NO: 7242120 - DNA, 22 bp, Homo sapiens
atctgttttgatacagttttat

SEQ ID NO: 7242121 - DNA, 22 bp, Homo sapiens
atctgggtctggctcttaagtc

SEQ ID NO: 7242122 - DNA, 22 bp, Homo sapiens
atctgggtccaagttctgagca

SEQ ID NO: 7242123 - DNA, 22 bp, Homo sapiens
atctgggtcacagtggcatcta

SEQ ID NO: 7242124 - DNA, 22 bp, Homo sapiens
atctgggtctgaagataatgat

SEQ ID NO: 7242125 - DNA, 22 bp, Homo sapiens
atctgggtcagtatgttcttgg

SEQ ID NO: 7242126 - DNA, 22 bp, Homo sapiens
atctgggtagtgcaagacatga

SEQ ID NO: 7242127 - DNA, 22 bp, Homo sapiens
atctgggtaaagtggtatattt

SEQ ID NO: 7242128 - DNA, 22 bp, Homo sapiens
atgcaaattgccataaagtggg

SEQ ID NO: 7242129 - DNA, 22 bp, Homo sapiens
atgccacttctctaagtcatgt

SEQ ID NO: 7242130 - DNA, 22 bp, Homo sapiens
atgccagaaaatgatggctgca

SEQ ID NO: 7242131 - DNA, 22 bp, Homo sapiens
atgccaggaacaaacagtggtg

SEQ ID NO: 7242132 - DNA, 22 bp, Homo sapiens
agacagttgatatactataaaa

SEQ ID NO: 7242133 - DNA, 22 bp, Homo sapiens
agacataattaattagttctac

SEQ ID NO: 7242134 - DNA, 22 bp, Homo sapiens
agagaacaaattaaaggtggtt

SEQ ID NO: 7242135 - DNA, 22 bp, Homo sapiens
atgctgaagagtgcacaggcta

SEQ ID NO: 7242136 - DNA, 22 bp, Homo sapiens
atgctgaattgatgcgagggag

SEQ ID NO: 7242137 - DNA, 22 bp, Homo sapiens
aaggcactgaaaaattgtgtgt

SEQ ID NO: 7242138 - DNA, 22 bp, Homo sapiens
aaggagtgatatatgggtgcta

SEQ ID NO: 7242139 - DNA, 22 bp, Homo sapiens
aaggagtgatatatgggtgcta

SEQ ID NO: 7242140 - DNA, 22 bp, Homo sapiens
aaggagggttcccaggtcctgg

SEQ ID NO: 7242141 - DNA, 22 bp, Homo sapiens
aaggagggttcccaggtcctgg

SEQ ID NO: 7242142 - DNA, 22 bp, Homo sapiens
aaatggaagaagtgcaatactg

SEQ ID NO: 7242143 - DNA, 16 bp, Homo sapiens
aaggagggaagagaat

SEQ ID NO: 7242144 - DNA, 22 bp, Homo sapiens
aaggagggaaagcagtgcttct

SEQ ID NO: 7242145 - DNA, 22 bp, Homo sapiens
aagggcaggagaagacggatat

SEQ ID NO: 7242146 - DNA, 22 bp, Homo sapiens
aagggaggccagaggttttgca

SEQ ID NO: 7242147 - DNA, 22 bp, Homo sapiens
aaggccattgtaatgtaaatat

SEQ ID NO: 7242148 - DNA, 22 bp, Homo sapiens
aaggccattattctgatatatt

SEQ ID NO: 7242149 - DNA, 22 bp, Homo sapiens
aaggccatgaccacttgctgtg

SEQ ID NO: 7242150 - DNA, 22 bp, Homo sapiens
aaggctgaattcaagggtaggc

SEQ ID NO: 7242151 - DNA, 22 bp, Homo sapiens
aagtctgagtgtcagtgcaagt

SEQ ID NO: 7242152 - DNA, 22 bp, Homo sapiens
aagtacaacgcatacagagaaa

SEQ ID NO: 7242153 - DNA, 22 bp, Homo sapiens
aagtacaacgcatacagagaaa

SEQ ID NO: 7242154 - DNA, 20 bp, Homo sapiens
aagtaatatttgtgtaactg

SEQ ID NO: 7242155 - DNA, 22 bp, Homo sapiens
aagtaatatctggcaccaggaa

SEQ ID NO: 7242156 - DNA, 22 bp, Homo sapiens
aagtaatataattgttgttgtt

SEQ ID NO: 7242157 - DNA, 22 bp, Homo sapiens
aaggtgtgaagagatgggaaga

SEQ ID NO: 7242158 - DNA, 22 bp, Homo sapiens
aaggtgtcgggttagctcagcc

SEQ ID NO: 7242159 - DNA, 22 bp, Homo sapiens
aaggtgtcggcagagccgcttc

SEQ ID NO: 7242160 - DNA, 22 bp, Homo sapiens
aagggctgcatttgatgtgtca

SEQ ID NO: 7242161 - DNA, 22 bp, Homo sapiens
aagggctgccagggggtgccag

SEQ ID NO: 7242162 - DNA, 22 bp, Homo sapiens
aagggctgctgtagaagcagag

SEQ ID NO: 7242163 - DNA, 22 bp, Homo sapiens
aagggctggaatatctcttaga

SEQ ID NO: 7242164 - DNA, 22 bp, Homo sapiens
aagtcttaaccaaataaatgtt

SEQ ID NO: 7242165 - DNA, 22 bp, Homo sapiens
aacagttattatcacattagtg

SEQ ID NO: 7242166 - DNA, 22 bp, Homo sapiens
aacagtgcttcattcacacatt

SEQ ID NO: 7242167 - DNA, 22 bp, Homo sapiens
aagtgctgtttctgatgaatgc

SEQ ID NO: 7242168 - DNA, 18 bp, Homo sapiens
aatgaaatgtacaccttt

SEQ ID NO: 7242169 - DNA, 22 bp, Homo sapiens
aatgaaatgtagcttatccata

SEQ ID NO: 7242170 - DNA, 18 bp, Homo sapiens
aatgaaatgtacaccttt

SEQ ID NO: 7242171 - DNA, 19 bp, Homo sapiens
aatgcagagtgtggtcttt

SEQ ID NO: 7242172 - DNA, 22 bp, Homo sapiens
aatgcagattcttattctgtag

SEQ ID NO: 7242173 - DNA, 22 bp, Homo sapiens
aatgcacatgttgtaataaata

SEQ ID NO: 7242174 - DNA, 22 bp, Homo sapiens
aatgaaatgaagatatgatcag

SEQ ID NO: 7242175 - DNA, 22 bp, Homo sapiens
aatgaaatctgctgggtaaaga

SEQ ID NO: 7242176 - DNA, 22 bp, Homo sapiens
aatgaaatagttggctgtagag

SEQ ID NO: 7242177 - DNA, 22 bp, Homo sapiens
aatctgtaacattcaataaaga

SEQ ID NO: 7242178 - DNA, 22 bp, Homo sapiens
aatctggagttaatgttttcgc

SEQ ID NO: 7242179 - DNA, 22 bp, Homo sapiens
aatctggacacagttctcatgc

SEQ ID NO: 7242180 - DNA, 22 bp, Homo sapiens
aatgtacaaaccttctttgtag

SEQ ID NO: 7242181 - DNA, 22 bp, Homo sapiens
aactttaaggctataaattatg

SEQ ID NO: 7242182 - DNA, 22 bp, Homo sapiens
aacttgttagaaatgcagaatc

SEQ ID NO: 7242183 - DNA, 22 bp, Homo sapiens
aatgcttattattaatagaatg

SEQ ID NO: 7242184 - DNA, 22 bp, Homo sapiens
aatgcttaattcaatactgtgt

SEQ ID NO: 7242185 - DNA, 22 bp, Homo sapiens
aatgcaggcacgtgcaagcaag

SEQ ID NO: 7242186 - DNA, 22 bp, Homo sapiens
aatccagatgagcaatcatact

SEQ ID NO: 7242187 - DNA, 22 bp, Homo sapiens
aatatctgtctctaatgcatat

SEQ ID NO: 7242188 - DNA, 19 bp, Homo sapiens
aatacagtgttatagaatt

SEQ ID NO: 7242189 - DNA, 19 bp, Homo sapiens
aatacagtgttatagaatt

SEQ ID NO: 7242190 - DNA, 21 bp, Homo sapiens
aatacagtgaagaatttcttt

SEQ ID NO: 7242191 - DNA, 22 bp, Homo sapiens
aatacagtcttactagaaaatc

SEQ ID NO: 7242192 - DNA, 22 bp, Homo sapiens
aatacagtcttactagaaaatc

SEQ ID NO: 7242193 - DNA, 22 bp, Homo sapiens
aatacagtcttactagaaaatc

SEQ ID NO: 7242194 - DNA, 22 bp, Homo sapiens
aatacagtaattttgatgagtt

SEQ ID NO: 7242195 - DNA, 22 bp, Homo sapiens
aatatctggagatgctttttgt

SEQ ID NO: 7242196 - DNA, 22 bp, Homo sapiens
aacagtttatgagatatgctat

SEQ ID NO: 7242197 - DNA, 21 bp, Homo sapiens
aacagttctctttgaaggtgt

SEQ ID NO: 7242198 - DNA, 22 bp, Homo sapiens
aataatcttgactactgaatca

SEQ ID NO: 7242199 - DNA, 22 bp, Homo sapiens
aataatctccctttttgtatgt

SEQ ID NO: 7242200 - DNA, 22 bp, Homo sapiens
aataatctcactttatgtggaa

SEQ ID NO: 7242201 - DNA, 22 bp, Homo sapiens
aatacagaggggtcacaattca

SEQ ID NO: 7242202 - DNA, 22 bp, Homo sapiens
aatacagatggcatgtgaagat

SEQ ID NO: 7242203 - DNA, 22 bp, Homo sapiens
acacttggagcaacacttatgg

SEQ ID NO: 7242204 - DNA, 22 bp, Homo sapiens
acacttgttaagaagaggatat

SEQ ID NO: 7242205 - DNA, 22 bp, Homo sapiens
aagatacacgttgtattgaata

SEQ ID NO: 7242206 - DNA, 22 bp, Homo sapiens
aagatacatatttgttctagtg

SEQ ID NO: 7242207 - DNA, 22 bp, Homo sapiens
acagaaataactttttatgttt

SEQ ID NO: 7242208 - DNA, 22 bp, Homo sapiens
acagagcaactttatttcatgg

SEQ ID NO: 7242209 - DNA, 22 bp, Homo sapiens
acagagatgtggatgagggatt

SEQ ID NO: 7242210 - DNA, 22 bp, Homo sapiens
acagagcaatgcgtgttctcta

SEQ ID NO: 7242211 - DNA, 22 bp, Homo sapiens
acagagatgagtcaacacagct

SEQ ID NO: 7242212 - DNA, 22 bp, Homo sapiens
acagagatgaattagacagggt

SEQ ID NO: 7242213 - DNA, 22 bp, Homo sapiens
acagagatggcacagagaaggt

SEQ ID NO: 7242214 - DNA, 22 bp, Homo sapiens
acagagatggcacagagaaggt

SEQ ID NO: 7242215 - DNA, 22 bp, Homo sapiens
acagagatgaataatacaggtg

SEQ ID NO: 7242216 - DNA, 22 bp, Homo sapiens
acagagatgaataatacaggtg

SEQ ID NO: 7242217 - DNA, 22 bp, Homo sapiens
acagccaggagccatgggcagg

SEQ ID NO: 7242218 - DNA, 23 bp, Homo sapiens
aagccccaaggaacttcctggga

SEQ ID NO: 7242219 - DNA, 22 bp, Homo sapiens
aagcagttaatgttttgtcaat

SEQ ID NO: 7242220 - DNA, 22 bp, Homo sapiens
aagcagtgttcccagctggccc

SEQ ID NO: 7242221 - DNA, 22 bp, Homo sapiens
aagcagtagggccaacttgcag

SEQ ID NO: 7242222 - DNA, 22 bp, Homo sapiens
aagcagtagaatgcattgcttt

SEQ ID NO: 7242223 - DNA, 22 bp, Homo sapiens
aagcagtaatgaggtactattt

SEQ ID NO: 7242224 - DNA, 22 bp, Homo sapiens
acagagcacagtcgggatggga

SEQ ID NO: 7242225 - DNA, 22 bp, Homo sapiens
aatgtacaataagacaaagagg

SEQ ID NO: 7242226 - DNA, 22 bp, Homo sapiens
aagaacattttgtagaatgaca

SEQ ID NO: 7242227 - DNA, 22 bp, Homo sapiens
aagaagatggttaactttcagt

SEQ ID NO: 7242228 - DNA, 22 bp, Homo sapiens
aagaagcactttcctacatgtt

SEQ ID NO: 7242229 - DNA, 22 bp, Homo sapiens
aagaatatttcctgcacttggg

SEQ ID NO: 7242230 - DNA, 22 bp, Homo sapiens
aagaatatctgttttatttagg

SEQ ID NO: 7242231 - DNA, 22 bp, Homo sapiens
acaaaagtgagtgtgtctcaga

SEQ ID NO: 7242232 - DNA, 22 bp, Homo sapiens
acaaaagtagttgcggtttttg

SEQ ID NO: 7242233 - DNA, 22 bp, Homo sapiens
acaatatagtccatgagcatgc

SEQ ID NO: 7242234 - DNA, 22 bp, Homo sapiens
acaatatacacatcctaatggg

SEQ ID NO: 7242235 - DNA, 22 bp, Homo sapiens
aagatacaccaagagcctagta

SEQ ID NO: 7242236 - DNA, 22 bp, Homo sapiens
aagagtttccagttgtggctca

SEQ ID NO: 7242237 - DNA, 22 bp, Homo sapiens
aagagtttccatgctctgtgct

SEQ ID NO: 7242238 - DNA, 17 bp, Homo sapiens
acacagacaggcagaca

SEQ ID NO: 7242239 - DNA, 17 bp, Homo sapiens
acacagacaggcagaca

SEQ ID NO: 7242240 - DNA, 20 bp, Homo sapiens
acacagactcagcttggatg

SEQ ID NO: 7242241 - DNA, 22 bp, Homo sapiens
acacagagcaaatcatgacaga

SEQ ID NO: 7242242 - DNA, 22 bp, Homo sapiens
acacagcaacttgcagtatgga

SEQ ID NO: 7242243 - DNA, 22 bp, Homo sapiens
aaagtccagggaaagagcgtct

SEQ ID NO: 7242244 - DNA, 22 bp, Homo sapiens
aaagtccagagggcacactgaa

SEQ ID NO: 7242245 - DNA, 22 bp, Homo sapiens
aaagtcacgctgatgggaaatg

SEQ ID NO: 7242246 - DNA, 22 bp, Homo sapiens
aaagtccaggggctggaggcgg

SEQ ID NO: 7242247 - DNA, 20 bp, Homo sapiens
aaagtctcaacagctgagaa

SEQ ID NO: 7242248 - DNA, 22 bp, Homo sapiens
aaagttcttcatttttattgga

SEQ ID NO: 7242249 - DNA, 22 bp, Homo sapiens
aacttcttggtcctgagctgtt

SEQ ID NO: 7242250 - DNA, 22 bp, Homo sapiens
aacttctttgagctccagtttt

SEQ ID NO: 7242251 - DNA, 22 bp, Homo sapiens
aacatgcaaagctatgatgtat

SEQ ID NO: 7242252 - DNA, 22 bp, Homo sapiens
aaaggctgccaggtaaaatatt

SEQ ID NO: 7242253 - DNA, 18 bp, Homo sapiens
aaaggctgaatatagaag

SEQ ID NO: 7242254 - DNA, 22 bp, Homo sapiens
aaaggctctattgttttcatat

SEQ ID NO: 7242255 - DNA, 22 bp, Homo sapiens
aaaggcttctttgctccatgtc

SEQ ID NO: 7242256 - DNA, 22 bp, Homo sapiens
aaagggaggggcgataagccgg

SEQ ID NO: 7242257 - DNA, 22 bp, Homo sapiens
aaagggagcatggctgcaggga

SEQ ID NO: 7242258 - DNA, 22 bp, Homo sapiens
aaagggagcatggctgcaggga

SEQ ID NO: 7242259 - DNA, 22 bp, Homo sapiens
aaagccaaatgaaagatggttc

SEQ ID NO: 7242260 - DNA, 22 bp, Homo sapiens
aaaggaagtgccactcttcttc

SEQ ID NO: 7242261 - DNA, 22 bp, Homo sapiens
aaagcatagaattagagttagg

SEQ ID NO: 7242262 - DNA, 22 bp, Homo sapiens
aaagcagtgctgtgagaacact

SEQ ID NO: 7242263 - DNA, 22 bp, Homo sapiens
aacatgaaagttgctaagtgca

SEQ ID NO: 7242264 - DNA, 22 bp, Homo sapiens
aaattccagaaactcagtatat

SEQ ID NO: 7242265 - DNA, 22 bp, Homo sapiens
aaatcagagtctgattttaagg

SEQ ID NO: 7242266 - DNA, 22 bp, Homo sapiens
aaatcagaggtcagctgtacca

SEQ ID NO: 7242267 - DNA, 22 bp, Homo sapiens
aaatcagacttgaattttcatc

SEQ ID NO: 7242268 - DNA, 22 bp, Homo sapiens
aaatcagagaatatatttagaa

SEQ ID NO: 7242269 - DNA, 22 bp, Homo sapiens
aaatatttgtctgaggcggttg

SEQ ID NO: 7242270 - DNA, 20 bp, Homo sapiens
aaatgcttttgacacatatt

SEQ ID NO: 7242271 - DNA, 22 bp, Homo sapiens
aaatggaactgggctactaggt

SEQ ID NO: 7242272 - DNA, 22 bp, Homo sapiens
aaatgcttattagtgtcacaaa

SEQ ID NO: 7242273 - DNA, 22 bp, Homo sapiens
aaatgcacacaccaggaaacta

SEQ ID NO: 7242274 - DNA, 22 bp, Homo sapiens
aaatgattgtcaaagttctgtt

SEQ ID NO: 7242275 - DNA, 22 bp, Homo sapiens
aaatgcaaggccatgtgaagga

SEQ ID NO: 7242276 - DNA, 22 bp, Homo sapiens
aaatgcaaggccatgtgaagga

SEQ ID NO: 7242277 - DNA, 22 bp, Homo sapiens
aagaagcaggtcacagacaggg

SEQ ID NO: 7242278 - DNA, 22 bp, Homo sapiens
aaagttctttctcttatttggt

SEQ ID NO: 7242279 - DNA, 22 bp, Homo sapiens
aaatacagtgtgtgttctttga

SEQ ID NO: 7242280 - DNA, 22 bp, Homo sapiens
aaatacagtgtgtgttctttga

SEQ ID NO: 7242281 - DNA, 22 bp, Homo sapiens
aaatacagtggcagcagataat

SEQ ID NO: 7242282 - DNA, 22 bp, Homo sapiens
aaatacagtggcagcagataat

SEQ ID NO: 7242283 - DNA, 22 bp, Homo sapiens
aagagagaactcccttcgccag

SEQ ID NO: 7242284 - DNA, 22 bp, Homo sapiens
aaatacatacactgtacgtggc

SEQ ID NO: 7242285 - DNA, 22 bp, Homo sapiens
aaatacaggagtttggacttct

SEQ ID NO: 7242286 - DNA, 22 bp, Homo sapiens
aaatacaggagtttggacttct

SEQ ID NO: 7242287 - DNA, 19 bp, Homo sapiens
aaatacagcagctgtttcc

SEQ ID NO: 7242288 - DNA, 22 bp, Homo sapiens
aaatacagcagactcctgttgt

SEQ ID NO: 7242289 - DNA, 22 bp, Homo sapiens
aaatacagattcttgtgtctat

SEQ ID NO: 7242290 - DNA, 22 bp, Homo sapiens
aaatacagattctgactcagag

SEQ ID NO: 7242291 - DNA, 22 bp, Homo sapiens
aagaaggtgtggaaagatgctc

SEQ ID NO: 7242292 - DNA, 22 bp, Homo sapiens
aaatatagtaaatgcatagttc

SEQ ID NO: 7242293 - DNA, 22 bp, Homo sapiens
aaatataatttctgcctcaata

SEQ ID NO: 7242294 - DNA, 22 bp, Homo sapiens
aagagagacaataggtagcatt

SEQ ID NO: 7242295 - DNA, 22 bp, Homo sapiens
aagagagaagtctctctggttc

SEQ ID NO: 7242296 - DNA, 22 bp, Homo sapiens
aagagagagcattcttctgtta

SEQ ID NO: 7242297 - DNA, 22 bp, Homo sapiens
aagagagaccatgggggacagg

SEQ ID NO: 7242298 - DNA, 22 bp, Homo sapiens
aagagagagtgcgctcacagaa

SEQ ID NO: 7242299 - DNA, 22 bp, Homo sapiens
aagagttttctctgatggcatt

SEQ ID NO: 7242300 - DNA, 22 bp, Homo sapiens
aagagtttttggagtgtgagtt

SEQ ID NO: 7242301 - DNA, 22 bp, Homo sapiens
aagagtttttaatgggtactgg

SEQ ID NO: 7242302 - DNA, 23 bp, Homo sapiens
aaatattcttttttagtaagtgc

SEQ ID NO: 7242303 - DNA, 22 bp, Homo sapiens
aagagtttgacctgtgccatcc

SEQ ID NO: 7242304 - DNA, 22 bp, Homo sapiens
aagagtttgggcaagtcataaa

SEQ ID NO: 7242305 - DNA, 22 bp, Homo sapiens
aagagtttgtcagatctgcacg

SEQ ID NO: 7242306 - DNA, 22 bp, Homo sapiens
aagagttttagacaaactgatt

SEQ ID NO: 7242307 - DNA, 22 bp, Homo sapiens
aagagttttctataatcttggc

SEQ ID NO: 7242308 - DNA, 22 bp, Homo sapiens
aaatatagtgacacttatagtc

SEQ ID NO: 7242309 - DNA, 22 bp, Homo sapiens
aaatatagtgacacttatagtc

SEQ ID NO: 7242310 - DNA, 22 bp, Homo sapiens
aagagtttctgattcagtaggt

SEQ ID NO: 7242311 - DNA, 22 bp, Homo sapiens
aagagtttctgggtcaaggatt

SEQ ID NO: 7242312 - DNA, 22 bp, Homo sapiens
aagagtttctttattaaccttt

SEQ ID NO: 7242313 - DNA, 22 bp, Homo sapiens
aagagtttcttactggcatcta

SEQ ID NO: 7242314 - DNA, 22 bp, Homo sapiens
aaatccagtgttcaaagtttga

SEQ ID NO: 7242315 - DNA, 22 bp, Homo sapiens
aaatgacagttctctctgagta

SEQ ID NO: 7242316 - DNA, 22 bp, Homo sapiens
aaactgtttccctccataacct

SEQ ID NO: 7242317 - DNA, 21 bp, Homo sapiens
aaatacagatgcaaatctgtt

SEQ ID NO: 7242318 - DNA, 21 bp, Homo sapiens
aaatacagatgcaaatctgtt

SEQ ID NO: 7242319 - DNA, 22 bp, Homo sapiens
aaatacagatagatttaaccca

SEQ ID NO: 7242320 - DNA, 22 bp, Homo sapiens
aaatacagagttgcttaaaagc

SEQ ID NO: 7242321 - DNA, 21 bp, Homo sapiens
aaatacagaaacttgttttca

SEQ ID NO: 7242322 - DNA, 21 bp, Homo sapiens
aaatacagaaacttgttttca

SEQ ID NO: 7242323 - DNA, 22 bp, Homo sapiens
aaataaaggtccactttagggc

SEQ ID NO: 7242324 - DNA, 22 bp, Homo sapiens
aaataaaggtccactttagggc

SEQ ID NO: 7242325 - DNA, 22 bp, Homo sapiens
aaataaaggaactgttttccca

SEQ ID NO: 7242326 - DNA, 22 bp, Homo sapiens
aaataaaggtccactttagggc

SEQ ID NO: 7242327 - DNA, 22 bp, Homo sapiens
aaataaaggaactgttttccca

SEQ ID NO: 7242328 - DNA, 22 bp, Homo sapiens
aaagacagatggcaaggatgat

SEQ ID NO: 7242329 - DNA, 22 bp, Homo sapiens
aaagacagatggcaaggatgat

SEQ ID NO: 7242330 - DNA, 22 bp, Homo sapiens
aaatgtgagttatagcaataga

SEQ ID NO: 7242331 - DNA, 22 bp, Homo sapiens
aaagctcttaatgagattatcc

SEQ ID NO: 7242332 - DNA, 22 bp, Homo sapiens
aaagctcttactgtactagtga

SEQ ID NO: 7242333 - DNA, 22 bp, Homo sapiens
aaagctcttaaattgacctgct

SEQ ID NO: 7242334 - DNA, 22 bp, Homo sapiens
aaagctctctgaacaccagacc

SEQ ID NO: 7242335 - DNA, 22 bp, Homo sapiens
aaagctctgagaagcactgcaa

SEQ ID NO: 7242336 - DNA, 23 bp, Homo sapiens
aaagctctgctgcatgtagaata

SEQ ID NO: 7242337 - DNA, 22 bp, Homo sapiens
aaagctctggaagattaggtaa

SEQ ID NO: 7242338 - DNA, 22 bp, Homo sapiens
aaagctctgggaatgcttatct

SEQ ID NO: 7242339 - DNA, 22 bp, Homo sapiens
aaagctctggtttggagcattt

SEQ ID NO: 7242340 - DNA, 22 bp, Homo sapiens
aaagctcacagtaatacaaggc

SEQ ID NO: 7242341 - DNA, 22 bp, Homo sapiens
aaagctctaagagaggtaggta

SEQ ID NO: 7242342 - DNA, 22 bp, Homo sapiens
aaagctctcccactgtatgaag

SEQ ID NO: 7242343 - DNA, 22 bp, Homo sapiens
aaagctatgaggcatgcatttc

SEQ ID NO: 7242344 - DNA, 22 bp, Homo sapiens
aaagtcattgtaatatatgcta

SEQ ID NO: 7242345 - DNA, 22 bp, Homo sapiens
aaagtacatgtttggccatttg

SEQ ID NO: 7242346 - DNA, 22 bp, Homo sapiens
aaagtacagatggtgaggttgg

SEQ ID NO: 7242347 - DNA, 22 bp, Homo sapiens
aaagtacaatattgagattgat

SEQ ID NO: 7242348 - DNA, 22 bp, Homo sapiens
aaagtacaaggaaaggatctga

SEQ ID NO: 7242349 - DNA, 22 bp, Homo sapiens
aaaatctggcaacactaagttt

SEQ ID NO: 7242350 - DNA, 22 bp, Homo sapiens
aaaatctggcaacactaagttt

SEQ ID NO: 7242351 - DNA, 22 bp, Homo sapiens
aaaataacttctactatttgca

SEQ ID NO: 7242352 - DNA, 22 bp, Homo sapiens
aaaatacacatactaggggaaa

SEQ ID NO: 7242353 - DNA, 22 bp, Homo sapiens
aaaagctttgttaataggtttg

SEQ ID NO: 7242354 - DNA, 22 bp, Homo sapiens
aaaagctcattgataaaaagtc

SEQ ID NO: 7242355 - DNA, 22 bp, Homo sapiens
aaaagctttgccagatgagttg

SEQ ID NO: 7242356 - DNA, 22 bp, Homo sapiens
aaaagctctttctgctgtagat

SEQ ID NO: 7242357 - DNA, 22 bp, Homo sapiens
aaagcagcagcacctgcatttc

SEQ ID NO: 7242358 - DNA, 22 bp, Homo sapiens
aaagcagcagcacgtggaagag

SEQ ID NO: 7242359 - DNA, 22 bp, Homo sapiens
aaaatgcatgagaatgtgctcg

SEQ ID NO: 7242360 - DNA, 22 bp, Homo sapiens
aaaacagttataaacagagtca

SEQ ID NO: 7242361 - DNA, 22 bp, Homo sapiens
aaaagagcttggttgattttgc

SEQ ID NO: 7242362 - DNA, 23 bp, Homo sapiens
aaaacagcttcctccagtggctc

SEQ ID NO: 7242363 - DNA, 22 bp, Homo sapiens
aaaagccaaggtcctcttcaga

SEQ ID NO: 7242364 - DNA, 22 bp, Homo sapiens
aaaagcagttatctgggaggaa

SEQ ID NO: 7242365 - DNA, 22 bp, Homo sapiens
aaaagcagagactctggagcta

SEQ ID NO: 7242366 - DNA, 20 bp, Homo sapiens
aaaagcagccagagatggta

SEQ ID NO: 7242367 - DNA, 22 bp, Homo sapiens
aaaaccaggcgtttcctattat

SEQ ID NO: 7242368 - DNA, 22 bp, Homo sapiens
aaaacatgtccatacagaaact

SEQ ID NO: 7242369 - DNA, 22 bp, Homo sapiens
aaaacatgtccatacagaaact

SEQ ID NO: 7242370 - DNA, 22 bp, Homo sapiens
aatgaagattatggtgattaag

SEQ ID NO: 7242371 - DNA, 22 bp, Homo sapiens
agaagccagaatattcatggat

SEQ ID NO: 7242372 - DNA, 22 bp, Homo sapiens
agaagccagaggcagtgggtac

SEQ ID NO: 7242373 - DNA, 22 bp, Homo sapiens
agaagccactggaggttgagat

SEQ ID NO: 7242374 - DNA, 18 bp, Homo sapiens
agaagccacgaggagtcc

SEQ ID NO: 7242375 - DNA, 22 bp, Homo sapiens
agaactatacattactcattga

SEQ ID NO: 7242376 - DNA, 22 bp, Homo sapiens
aatctatatgcttttcacatac

SEQ ID NO: 7242377 - DNA, 22 bp, Homo sapiens
aatgcattagctacatatgtct

SEQ ID NO: 7242378 - DNA, 23 bp, Homo sapiens
aatgcattaatttgggagagtac

SEQ ID NO: 7242379 - DNA, 21 bp, Homo sapiens
aatgcattaacataaagctga

SEQ ID NO: 7242380 - DNA, 22 bp, Homo sapiens
aatgcattctcggtttgtgtgt

SEQ ID NO: 7242381 - DNA, 22 bp, Homo sapiens
aatgcattccactgagatttgt

SEQ ID NO: 7242382 - DNA, 22 bp, Homo sapiens
aatgcattgattgctggaaata

SEQ ID NO: 7242383 - DNA, 22 bp, Homo sapiens
aatgcattctttcatggacctg

SEQ ID NO: 7242384 - DNA, 18 bp, Homo sapiens
aatgcatttatggagatg

SEQ ID NO: 7242385 - DNA, 22 bp, Homo sapiens
aatgcattgttgatttggagtg

SEQ ID NO: 7242386 - DNA, 22 bp, Homo sapiens
aatgcattaaagttagagactt

SEQ ID NO: 7242387 - DNA, 22 bp, Homo sapiens
aatgccttcccatttatacttt

SEQ ID NO: 7242388 - DNA, 22 bp, Homo sapiens
aatgcccccaggcctggaggag

SEQ ID NO: 7242389 - DNA, 22 bp, Homo sapiens
aatgcattttattatatgtgac

SEQ ID NO: 7242390 - DNA, 22 bp, Homo sapiens
aatgcacaaaaattgtatgtaa

SEQ ID NO: 7242391 - DNA, 22 bp, Homo sapiens
agaaggaaacagctgtgctttg

SEQ ID NO: 7242392 - DNA, 22 bp, Homo sapiens
agaaggaaaacctgtcttatgt

SEQ ID NO: 7242393 - DNA, 22 bp, Homo sapiens
agaagccagcttcagctgcccg

SEQ ID NO: 7242394 - DNA, 22 bp, Homo sapiens
agaagccagtcgctctcccgca

SEQ ID NO: 7242395 - DNA, 22 bp, Homo sapiens
agaagccagattgtagtgggac

SEQ ID NO: 7242396 - DNA, 22 bp, Homo sapiens
acttttaaatgagtttcagttg

SEQ ID NO: 7242397 - DNA, 22 bp, Homo sapiens
aatcaagagttgtgtaatattt

SEQ ID NO: 7242398 - DNA, 22 bp, Homo sapiens
acttttatgataatcaatgttc

SEQ ID NO: 7242399 - DNA, 22 bp, Homo sapiens
acttttatcaaggaagtgatct

SEQ ID NO: 7242400 - DNA, 22 bp, Homo sapiens
acttttatgataatcaatgttc

SEQ ID NO: 7242401 - DNA, 22 bp, Homo sapiens
acttttatcaaggaagtgatct

SEQ ID NO: 7242402 - DNA, 22 bp, Homo sapiens
aatagctcacggttagtgtagg

SEQ ID NO: 7242403 - DNA, 22 bp, Homo sapiens
aatagcttattgacagtgaatt

SEQ ID NO: 7242404 - DNA, 22 bp, Homo sapiens
aataggtagccagatatataaa

SEQ ID NO: 7242405 - DNA, 22 bp, Homo sapiens
aatcacagagtccagcagatga

SEQ ID NO: 7242406 - DNA, 22 bp, Homo sapiens
aatcacagtttcaagtaatgca

SEQ ID NO: 7242407 - DNA, 22 bp, Homo sapiens
aatcacagccagcttccgctat

SEQ ID NO: 7242408 - DNA, 22 bp, Homo sapiens
aatcacatctcattcaacagcc

SEQ ID NO: 7242409 - DNA, 22 bp, Homo sapiens
agaaaggacatctccctttaag

SEQ ID NO: 7242410 - DNA, 22 bp, Homo sapiens
agaaaggaagggaggagtttat

SEQ ID NO: 7242411 - DNA, 22 bp, Homo sapiens
agaaaggagaccagctctgccc

SEQ ID NO: 7242412 - DNA, 22 bp, Homo sapiens
agaaaggacatctccctttaag

SEQ ID NO: 7242413 - DNA, 22 bp, Homo sapiens
agaaaggagcaccgtgggggat

SEQ ID NO: 7242414 - DNA, 22 bp, Homo sapiens
agaaaggattagtttggtataa

SEQ ID NO: 7242415 - DNA, 22 bp, Homo sapiens
agaaaggaggaagaatgacctc

SEQ ID NO: 7242416 - DNA, 22 bp, Homo sapiens
aatctagagttcccagcataaa

SEQ ID NO: 7242417 - DNA, 19 bp, Homo sapiens
aatctagaaatatgtgttc

SEQ ID NO: 7242418 - DNA, 22 bp, Homo sapiens
agaaagggaactggcaaagcca

SEQ ID NO: 7242419 - DNA, 22 bp, Homo sapiens
agaaagggagagccagcacacg

SEQ ID NO: 7242420 - DNA, 22 bp, Homo sapiens
agaaagggaccagttcttttga

SEQ ID NO: 7242421 - DNA, 22 bp, Homo sapiens
agaaagggatgaggtagctgct

SEQ ID NO: 7242422 - DNA, 22 bp, Homo sapiens
aagtgtttacttaaagtcatgg

SEQ ID NO: 7242423 - DNA, 22 bp, Homo sapiens
actgcatgctttacatgacatg

SEQ ID NO: 7242424 - DNA, 22 bp, Homo sapiens
actgcagttggtgacaataacc

SEQ ID NO: 7242425 - DNA, 22 bp, Homo sapiens
actgcagtggcaggaacttatc

SEQ ID NO: 7242426 - DNA, 18 bp, Homo sapiens
actgcaggagaggtgagg

SEQ ID NO: 7242427 - DNA, 22 bp, Homo sapiens
aagttcaatcagatgaaaaagc

SEQ ID NO: 7242428 - DNA, 22 bp, Homo sapiens
actcttttataaagcatcttga

SEQ ID NO: 7242429 - DNA, 22 bp, Homo sapiens
actcttttatgcattccttcag

SEQ ID NO: 7242430 - DNA, 19 bp, Homo sapiens
actcttttccttttgaatc

SEQ ID NO: 7242431 - DNA, 22 bp, Homo sapiens
actgtctctctagcagttcagg

SEQ ID NO: 7242432 - DNA, 22 bp, Homo sapiens
actgtcctgaatactgcatgac

SEQ ID NO: 7242433 - DNA, 22 bp, Homo sapiens
actgtcctagaacctgcagctc

SEQ ID NO: 7242434 - DNA, 22 bp, Homo sapiens
aatagcagaagactagtagaca

SEQ ID NO: 7242435 - DNA, 20 bp, Homo sapiens
aataaaagaagccttcaccc

SEQ ID NO: 7242436 - DNA, 22 bp, Homo sapiens
actgggaggcatctggagctga

SEQ ID NO: 7242437 - DNA, 22 bp, Homo sapiens
actgggagtcatgaggaaggag

SEQ ID NO: 7242438 - DNA, 22 bp, Homo sapiens
aagggcagaatagagaagatgg

SEQ ID NO: 7242439 - DNA, 22 bp, Homo sapiens
aagggaggtaaagctatttaaa

SEQ ID NO: 7242440 - DNA, 22 bp, Homo sapiens
aagggaggggatgtaagcctgg

SEQ ID NO: 7242441 - DNA, 22 bp, Homo sapiens
acatgcatgttgtgtagggggg

SEQ ID NO: 7242442 - DNA, 22 bp, Homo sapiens
acatgcatgttgtgtagggggg

SEQ ID NO: 7242443 - DNA, 22 bp, Homo sapiens
acatgcatgtgaatatggacac

SEQ ID NO: 7242444 - DNA, 22 bp, Homo sapiens
acatgcatgtgaatatggacac

SEQ ID NO: 7242445 - DNA, 20 bp, Homo sapiens
aagggcagagggaacagact

SEQ ID NO: 7242446 - DNA, 22 bp, Homo sapiens
aagggctgcaatccaaaacact

SEQ ID NO: 7242447 - DNA, 22 bp, Homo sapiens
aagggctggatctctctgagca

SEQ ID NO: 7242448 - DNA, 22 bp, Homo sapiens
aagggctgggtctggttaaccc

SEQ ID NO: 7242449 - DNA, 22 bp, Homo sapiens
aagggctggccctgggaagagt

SEQ ID NO: 7242450 - DNA, 22 bp, Homo sapiens
aaggggtgagcagaggcttcgc

SEQ ID NO: 7242451 - DNA, 22 bp, Homo sapiens
aaggggggcacctgcatgcccg

SEQ ID NO: 7242452 - DNA, 22 bp, Homo sapiens
accagcacctgataggcagtaa

SEQ ID NO: 7242453 - DNA, 22 bp, Homo sapiens
accagagtaatgtgtggaaatt

SEQ ID NO: 7242454 - DNA, 22 bp, Homo sapiens
aagggtggtgtaggagatcaaa

SEQ ID NO: 7242455 - DNA, 22 bp, Homo sapiens
aagggttgaagataaataaggt

SEQ ID NO: 7242456 - DNA, 22 bp, Homo sapiens
aagggtgggcaccgccaggtca

SEQ ID NO: 7242457 - DNA, 22 bp, Homo sapiens
aagggtgggccctggcagccat

SEQ ID NO: 7242458 - DNA, 22 bp, Homo sapiens
aagggtgggcaccgccaggtca

SEQ ID NO: 7242459 - DNA, 22 bp, Homo sapiens
aagggtgggccctggcagccat

SEQ ID NO: 7242460 - DNA, 22 bp, Homo sapiens
aagggtgcgacctaggagtgag

SEQ ID NO: 7242461 - DNA, 22 bp, Homo sapiens
aaggggtgggcattagagcagt

SEQ ID NO: 7242462 - DNA, 19 bp, Homo sapiens
acccaggggtttatgtgtg

SEQ ID NO: 7242463 - DNA, 22 bp, Homo sapiens
acccaggggcagccttgctgtg

SEQ ID NO: 7242464 - DNA, 22 bp, Homo sapiens
acccagggagtgctcctgttct

SEQ ID NO: 7242465 - DNA, 22 bp, Homo sapiens
acccagggctcaagcgtaggca

SEQ ID NO: 7242466 - DNA, 22 bp, Homo sapiens
acccagggcttaaggcggtgca

SEQ ID NO: 7242467 - DNA, 22 bp, Homo sapiens
acccagggcttaaggcggtgca

SEQ ID NO: 7242468 - DNA, 22 bp, Homo sapiens
aaggtgtcaccagattggcagg

SEQ ID NO: 7242469 - DNA, 22 bp, Homo sapiens
aaggtgtcactgggacaggaaa

SEQ ID NO: 7242470 - DNA, 22 bp, Homo sapiens
acctatgtacagttttactagt

SEQ ID NO: 7242471 - DNA, 22 bp, Homo sapiens
acctctggacactgcatccttc

SEQ ID NO: 7242472 - DNA, 22 bp, Homo sapiens
acctctgaggtgaggaggagct

SEQ ID NO: 7242473 - DNA, 22 bp, Homo sapiens
acctctgagccatggaaggtga

SEQ ID NO: 7242474 - DNA, 20 bp, Homo sapiens
acctctgacccagagcaggc

SEQ ID NO: 7242475 - DNA, 22 bp, Homo sapiens
acctctcttgtagctgctggtg

SEQ ID NO: 7242476 - DNA, 22 bp, Homo sapiens
aagtccattcttccagccagct

SEQ ID NO: 7242477 - DNA, 22 bp, Homo sapiens
aagtatatactaaatgttaatc

SEQ ID NO: 7242478 - DNA, 22 bp, Homo sapiens
aagtataagctattcttcatga

SEQ ID NO: 7242479 - DNA, 19 bp, Homo sapiens
aagtatagtcagccttcta

SEQ ID NO: 7242480 - DNA, 18 bp, Homo sapiens
aagtagatcatgagccac

SEQ ID NO: 7242481 - DNA, 22 bp, Homo sapiens
aagtagatgatctttctgcata

SEQ ID NO: 7242482 - DNA, 22 bp, Homo sapiens
aagtccgaaggctggagtggac

SEQ ID NO: 7242483 - DNA, 22 bp, Homo sapiens
aagtcccatctgcctccatgta

SEQ ID NO: 7242484 - DNA, 22 bp, Homo sapiens
aaggaagggaaatagtgatgtc

SEQ ID NO: 7242485 - DNA, 22 bp, Homo sapiens
aaggacagaaacagattgctgg

SEQ ID NO: 7242486 - DNA, 22 bp, Homo sapiens
aaggacagagagccattccaga

SEQ ID NO: 7242487 - DNA, 23 bp, Homo sapiens
aagcttattgccaccttggggag

SEQ ID NO: 7242488 - DNA, 22 bp, Homo sapiens
aagcttatatcagaacaatgct

SEQ ID NO: 7242489 - DNA, 22 bp, Homo sapiens
aagcttcttagaatgcatgtgc

SEQ ID NO: 7242490 - DNA, 22 bp, Homo sapiens
acatgcatactgctgccaacgc

SEQ ID NO: 7242491 - DNA, 22 bp, Homo sapiens
acatgcatactgctgccaacgc

SEQ ID NO: 7242492 - DNA, 22 bp, Homo sapiens
acatgcatacgtgtgtttaaaa

SEQ ID NO: 7242493 - DNA, 22 bp, Homo sapiens
acatgcatacgtgtgtttaaaa

SEQ ID NO: 7242494 - DNA, 22 bp, Homo sapiens
acatgcatacacgtacatacct

SEQ ID NO: 7242495 - DNA, 22 bp, Homo sapiens
acatgcatacacgtacatacct

SEQ ID NO: 7242496 - DNA, 22 bp, Homo sapiens
acatgcatgtctatgggcaggt

SEQ ID NO: 7242497 - DNA, 22 bp, Homo sapiens
acatgcatgtctatgggcaggt

SEQ ID NO: 7242498 - DNA, 22 bp, Homo sapiens
acatgcatgtcatcagcccttt

SEQ ID NO: 7242499 - DNA, 22 bp, Homo sapiens
acatgcatgtcatcagcccttt

SEQ ID NO: 7242500 - DNA, 22 bp, Homo sapiens
acatgcatggtgttgggttgga

SEQ ID NO: 7242501 - DNA, 22 bp, Homo sapiens
acatgcatggtgttgggttgga

SEQ ID NO: 7242502 - DNA, 22 bp, Homo sapiens
acatgcatggggtaatggtatt

SEQ ID NO: 7242503 - DNA, 22 bp, Homo sapiens
acatgcatggggtaatggtatt

SEQ ID NO: 7242504 - DNA, 22 bp, Homo sapiens
acatgcatggctgcttaaatta

SEQ ID NO: 7242505 - DNA, 22 bp, Homo sapiens
acatgcatggctgcttaaatta

SEQ ID NO: 7242506 - DNA, 22 bp, Homo sapiens
acatgcatggagggaaaatgtc

SEQ ID NO: 7242507 - DNA, 22 bp, Homo sapiens
acatgcatggagggaaaatgtc

SEQ ID NO: 7242508 - DNA, 22 bp, Homo sapiens
acatgcatggacatgtatatat

SEQ ID NO: 7242509 - DNA, 22 bp, Homo sapiens
acatgcatggacatgtatatat

SEQ ID NO: 7242510 - DNA, 22 bp, Homo sapiens
acatgcatgctttggtgggtgt

SEQ ID NO: 7242511 - DNA, 22 bp, Homo sapiens
acatgcatgctttggtgggtgt

SEQ ID NO: 7242512 - DNA, 22 bp, Homo sapiens
acatgcataggagaagtcttta

SEQ ID NO: 7242513 - DNA, 21 bp, Homo sapiens
acatgcatagagagatttctg

SEQ ID NO: 7242514 - DNA, 21 bp, Homo sapiens
acatgcatagagagatttctg

SEQ ID NO: 7242515 - DNA, 22 bp, Homo sapiens
acatgcatatacttaaatatgt

SEQ ID NO: 7242516 - DNA, 22 bp, Homo sapiens
acatgcataggagaagtcttta

SEQ ID NO: 7242517 - DNA, 22 bp, Homo sapiens
acatgcatgaaatccataaaca

SEQ ID NO: 7242518 - DNA, 22 bp, Homo sapiens
acatgcatgaaatccataaaca

SEQ ID NO: 7242519 - DNA, 22 bp, Homo sapiens
acatgcatctctgggacacatg

SEQ ID NO: 7242520 - DNA, 22 bp, Homo sapiens
acatgcatctctgggacacatg

SEQ ID NO: 7242521 - DNA, 22 bp, Homo sapiens
acatgcatctccaggctcattt

SEQ ID NO: 7242522 - DNA, 22 bp, Homo sapiens
acatgcatctccaggctcattt

SEQ ID NO: 7242523 - DNA, 19 bp, Homo sapiens
acatgcatatggacagttg

SEQ ID NO: 7242524 - DNA, 22 bp, Homo sapiens
acatgcatatacttaaatatgt

SEQ ID NO: 7242525 - DNA, 19 bp, Homo sapiens
acatgcatatggacagttg

SEQ ID NO: 7242526 - DNA, 22 bp, Homo sapiens
acatgaatgaagactttacaat

SEQ ID NO: 7242527 - DNA, 22 bp, Homo sapiens
aaggcattcaagatggaagttg

SEQ ID NO: 7242528 - DNA, 22 bp, Homo sapiens
aaggcattacctaagtttggga

SEQ ID NO: 7242529 - DNA, 22 bp, Homo sapiens
agagctgagcaccaagcatggt

SEQ ID NO: 7242530 - DNA, 22 bp, Homo sapiens
agagctgagcaccaagcatggt

SEQ ID NO: 7242531 - DNA, 21 bp, Homo sapiens
aattacagatggaattacaga

SEQ ID NO: 7242532 - DNA, 22 bp, Homo sapiens
aattacagtcggagcagcactg

SEQ ID NO: 7242533 - DNA, 21 bp, Homo sapiens
aattacagatggaattacaga

SEQ ID NO: 7242534 - DNA, 21 bp, Homo sapiens
agaggaagtgattggtctggc

SEQ ID NO: 7242535 - DNA, 22 bp, Homo sapiens
agaggaagtaatcaggacctgc

SEQ ID NO: 7242536 - DNA, 22 bp, Homo sapiens
agaggagtgggaagcagtgcaa

SEQ ID NO: 7242537 - DNA, 22 bp, Homo sapiens
agaggagtgggaagcagtgcaa

SEQ ID NO: 7242538 - DNA, 22 bp, Homo sapiens
agaggagtattttctaagggaa

SEQ ID NO: 7242539 - DNA, 22 bp, Homo sapiens
agaggaggtggtgatgctttaa

SEQ ID NO: 7242540 - DNA, 22 bp, Homo sapiens
agaggaggtccttttctgatgt

SEQ ID NO: 7242541 - DNA, 22 bp, Homo sapiens
agaggatgttctaggcactcat

SEQ ID NO: 7242542 - DNA, 22 bp, Homo sapiens
agacagggtgatcgcttgagcc

SEQ ID NO: 7242543 - DNA, 22 bp, Homo sapiens
agacatgtcaccaattcttact

SEQ ID NO: 7242544 - DNA, 22 bp, Homo sapiens
agacatggagaaggagccagtg

SEQ ID NO: 7242545 - DNA, 22 bp, Homo sapiens
aatgtatgtgtatatcaaatca

SEQ ID NO: 7242546 - DNA, 22 bp, Homo sapiens
agagaagggggaaagatctcac

SEQ ID NO: 7242547 - DNA, 22 bp, Homo sapiens
agagaagggaagggattcaccc

SEQ ID NO: 7242548 - DNA, 22 bp, Homo sapiens
agagaaggcatagaacttgagt

SEQ ID NO: 7242549 - DNA, 21 bp, Homo sapiens
agagaagggactcttccagtc

SEQ ID NO: 7242550 - DNA, 22 bp, Homo sapiens
agagaagggcctgtatgtaatc

SEQ ID NO: 7242551 - DNA, 22 bp, Homo sapiens
agagatgaaaagggtactgagg

SEQ ID NO: 7242552 - DNA, 22 bp, Homo sapiens
agagatgaaaagggtactgagg

SEQ ID NO: 7242553 - DNA, 22 bp, Homo sapiens
acaacagtagcctttacaaggc

SEQ ID NO: 7242554 - DNA, 22 bp, Homo sapiens
agatgctgattgaatagatttc

SEQ ID NO: 7242555 - DNA, 22 bp, Homo sapiens
agatgctgaattattgtgcttt

SEQ ID NO: 7242556 - DNA, 20 bp, Homo sapiens
agatctttgggttgtcatat

SEQ ID NO: 7242557 - DNA, 22 bp, Homo sapiens
aatttctctctcatgcttcatg

SEQ ID NO: 7242558 - DNA, 22 bp, Homo sapiens
aatttctcactctcttgatcac

SEQ ID NO: 7242559 - DNA, 22 bp, Homo sapiens
aatttctcatggattcagttat

SEQ ID NO: 7242560 - DNA, 22 bp, Homo sapiens
aatttctccaagaatgcttaga

SEQ ID NO: 7242561 - DNA, 22 bp, Homo sapiens
aatttggagagaaacaagtagg

SEQ ID NO: 7242562 - DNA, 22 bp, Homo sapiens
aatttggagagagattaatgtt

SEQ ID NO: 7242563 - DNA, 22 bp, Homo sapiens
agcaaataaagacaattatgtc

SEQ ID NO: 7242564 - DNA, 22 bp, Homo sapiens
acaacagtccagtatagactgt

SEQ ID NO: 7242565 - DNA, 22 bp, Homo sapiens
acaatagaaataattaagcaca

SEQ ID NO: 7242566 - DNA, 20 bp, Homo sapiens
acaatacaggttgtgtctga

SEQ ID NO: 7242567 - DNA, 19 bp, Homo sapiens
acaataactcattgattgc

SEQ ID NO: 7242568 - DNA, 22 bp, Homo sapiens
agcacaaatataaaaatgtctg

SEQ ID NO: 7242569 - DNA, 23 bp, Homo sapiens
agcacaaagtgttttccttgtag

SEQ ID NO: 7242570 - DNA, 22 bp, Homo sapiens
agcacaaaagcagccacagatg

SEQ ID NO: 7242571 - DNA, 23 bp, Homo sapiens
agcacaaagtgttttccttgtag

SEQ ID NO: 7242572 - DNA, 22 bp, Homo sapiens
agcacactggcattgggaagct

SEQ ID NO: 7242573 - DNA, 22 bp, Homo sapiens
agccagagatccatccctagga

SEQ ID NO: 7242574 - DNA, 22 bp, Homo sapiens
agccagaggaagcctggccctc

SEQ ID NO: 7242575 - DNA, 22 bp, Homo sapiens
agccagctggtgggtcagctgg

SEQ ID NO: 7242576 - DNA, 22 bp, Homo sapiens
agccagctgtgtggtcaggcaa

SEQ ID NO: 7242577 - DNA, 22 bp, Homo sapiens
agccagctgtgggctcaggcgg

SEQ ID NO: 7242578 - DNA, 22 bp, Homo sapiens
agccagaggccagcctgcctca

SEQ ID NO: 7242579 - DNA, 22 bp, Homo sapiens
agcaggtgtagggctctttgta

SEQ ID NO: 7242580 - DNA, 22 bp, Homo sapiens
agccaaggtatcatgagaggca

SEQ ID NO: 7242581 - DNA, 22 bp, Homo sapiens
acactgtgtgacttctgagact

SEQ ID NO: 7242582 - DNA, 18 bp, Homo sapiens
agccaaggaggaggagga

SEQ ID NO: 7242583 - DNA, 22 bp, Homo sapiens
agccaaggcagctagagctctg

SEQ ID NO: 7242584 - DNA, 22 bp, Homo sapiens
acacagtttaaacgattagtac

SEQ ID NO: 7242585 - DNA, 22 bp, Homo sapiens
acacagtattgtgactataact

SEQ ID NO: 7242586 - DNA, 19 bp, Homo sapiens
acacagggctagagttaca

SEQ ID NO: 7242587 - DNA, 22 bp, Homo sapiens
acacagggcggaaagcatgaga

SEQ ID NO: 7242588 - DNA, 22 bp, Homo sapiens
acacaatttcctgtccatatgt

SEQ ID NO: 7242589 - DNA, 22 bp, Homo sapiens
acacaagattgtgtattgaatt

SEQ ID NO: 7242590 - DNA, 22 bp, Homo sapiens
acacaagattgtgtattgaatt

SEQ ID NO: 7242591 - DNA, 22 bp, Homo sapiens
acagcagcgtgaagtgtgttat

SEQ ID NO: 7242592 - DNA, 22 bp, Homo sapiens
acagcagcgtcaacttaaaatt

SEQ ID NO: 7242593 - DNA, 17 bp, Homo sapiens
acagcaggcccggaggg

SEQ ID NO: 7242594 - DNA, 22 bp, Homo sapiens
acagcaggttattgttatggca

SEQ ID NO: 7242595 - DNA, 22 bp, Homo sapiens
acagcagtcagtgaatatttaa

SEQ ID NO: 7242596 - DNA, 22 bp, Homo sapiens
acagatagatttgagggaggct

SEQ ID NO: 7242597 - DNA, 22 bp, Homo sapiens
acagatagtatgtaaattaagc

SEQ ID NO: 7242598 - DNA, 22 bp, Homo sapiens
acagatataaactatagtagtg

SEQ ID NO: 7242599 - DNA, 22 bp, Homo sapiens
acagatatatgattgtgtaaat

SEQ ID NO: 7242600 - DNA, 21 bp, Homo sapiens
acagatatttcattgaacatt

SEQ ID NO: 7242601 - DNA, 22 bp, Homo sapiens
acagcagagtggagatgagcac

SEQ ID NO: 7242602 - DNA, 22 bp, Homo sapiens
acagcagagtggagatgagcac

SEQ ID NO: 7242603 - DNA, 22 bp, Homo sapiens
acagcagagtgtgagatagcca

SEQ ID NO: 7242604 - DNA, 22 bp, Homo sapiens
acagcagagtgtgagatagcca

SEQ ID NO: 7242605 - DNA, 22 bp, Homo sapiens
acagcagatctggctacaggtt

SEQ ID NO: 7242606 - DNA, 22 bp, Homo sapiens
acagcagcaatagcagtgacat

SEQ ID NO: 7242607 - DNA, 22 bp, Homo sapiens
acagcagcactattgacatttt

SEQ ID NO: 7242608 - DNA, 21 bp, Homo sapiens
acagcagcaatctgtctttcc

SEQ ID NO: 7242609 - DNA, 22 bp, Homo sapiens
acagcagccagccactgtgagc

SEQ ID NO: 7242610 - DNA, 22 bp, Homo sapiens
acagcagcatcctatttcactc

SEQ ID NO: 7242611 - DNA, 22 bp, Homo sapiens
acagcagcagaccagcatatgt

SEQ ID NO: 7242612 - DNA, 22 bp, Homo sapiens
acagcagcataaactgactaag

SEQ ID NO: 7242613 - DNA, 22 bp, Homo sapiens
acagcagcctgcagccctgtgt

SEQ ID NO: 7242614 - DNA, 22 bp, Homo sapiens
acagcagcctgcagccctgtgt

SEQ ID NO: 7242615 - DNA, 20 bp, Homo sapiens
acagcagccttgctagaaac

SEQ ID NO: 7242616 - DNA, 22 bp, Homo sapiens
acagcagccttgttggtttcga

SEQ ID NO: 7242617 - DNA, 22 bp, Homo sapiens
agcgtggactgctgggcaaggt

SEQ ID NO: 7242618 - DNA, 22 bp, Homo sapiens
agcgtgggtccaaggctctggt

SEQ ID NO: 7242619 - DNA, 22 bp, Homo sapiens
agcgggctcaagtggccagcag

SEQ ID NO: 7242620 - DNA, 22 bp, Homo sapiens
agcggctgtcggccagccggag

SEQ ID NO: 7242621 - DNA, 22 bp, Homo sapiens
agcgggcaccctttgagggttt

SEQ ID NO: 7242622 - DNA, 22 bp, Homo sapiens
acagaggctgatcttcaagccc

SEQ ID NO: 7242623 - DNA, 19 bp, Homo sapiens
acagagggcaactgagaaa

SEQ ID NO: 7242624 - DNA, 22 bp, Homo sapiens
acagagggtctgggcacaggac

SEQ ID NO: 7242625 - DNA, 19 bp, Homo sapiens
acagagggcaactgagaaa

SEQ ID NO: 7242626 - DNA, 22 bp, Homo sapiens
acagagggtgtggaggaagacg

SEQ ID NO: 7242627 - DNA, 22 bp, Homo sapiens
acagagggtgtggaggaagacg

SEQ ID NO: 7242628 - DNA, 22 bp, Homo sapiens
acagagggtctgggcacaggac

SEQ ID NO: 7242629 - DNA, 22 bp, Homo sapiens
acagagggtctgggcacaggac

SEQ ID NO: 7242630 - DNA, 22 bp, Homo sapiens
acagagggtttctaaggatttg

SEQ ID NO: 7242631 - DNA, 22 bp, Homo sapiens
acagaattaacatttgatgaat

SEQ ID NO: 7242632 - DNA, 22 bp, Homo sapiens
acagaagtggcttcaaagagca

SEQ ID NO: 7242633 - DNA, 22 bp, Homo sapiens
acagaagtgagtggcaagaact

SEQ ID NO: 7242634 - DNA, 22 bp, Homo sapiens
acagaagttggaattagatact

SEQ ID NO: 7242635 - DNA, 22 bp, Homo sapiens
acagaagttggaattagatact

SEQ ID NO: 7242636 - DNA, 22 bp, Homo sapiens
acagaataactcttgcttgagt

SEQ ID NO: 7242637 - DNA, 22 bp, Homo sapiens
acagaataactcttgcttgagt

SEQ ID NO: 7242638 - DNA, 22 bp, Homo sapiens
acagaagtttcaagtaagaagt

SEQ ID NO: 7242639 - DNA, 22 bp, Homo sapiens
acagaagtttcaagtaagaagt

SEQ ID NO: 7242640 - DNA, 22 bp, Homo sapiens
acagaatactcataagaagggg

SEQ ID NO: 7242641 - DNA, 22 bp, Homo sapiens
acagaatactacagactggtta

SEQ ID NO: 7242642 - DNA, 22 bp, Homo sapiens
acagaagtccccatgaagaagc

SEQ ID NO: 7242643 - DNA, 22 bp, Homo sapiens
acagaacttggaacttttcaca

SEQ ID NO: 7242644 - DNA, 22 bp, Homo sapiens
taatgtttagaagcagacagct

SEQ ID NO: 7242645 - DNA, 22 bp, Homo sapiens
taatagctgtgggaaataaaag

SEQ ID NO: 7242646 - DNA, 23 bp, Homo sapiens
taatagctgatgttggttttaat

SEQ ID NO: 7242647 - DNA, 22 bp, Homo sapiens
taatagaatagtggaaacattg

SEQ ID NO: 7242648 - DNA, 22 bp, Homo sapiens
taatgtttgagatgttggattt

SEQ ID NO: 7242649 - DNA, 22 bp, Homo sapiens
taatgtttccagtctatgatgg

SEQ ID NO: 7242650 - DNA, 22 bp, Homo sapiens
taatgtttgggaaggtgctttg

SEQ ID NO: 7242651 - DNA, 22 bp, Homo sapiens
taatgtttttctcaacattgct

SEQ ID NO: 7242652 - DNA, 22 bp, Homo sapiens
tacaaaggcggtttttctgggc

SEQ ID NO: 7242653 - DNA, 22 bp, Homo sapiens
tacaaaggcaggtttcccagga

SEQ ID NO: 7242654 - DNA, 22 bp, Homo sapiens
tacaaaggaggtgcatagaaca

SEQ ID NO: 7242655 - DNA, 22 bp, Homo sapiens
tacaaaggagtagagaaggctt

SEQ ID NO: 7242656 - DNA, 22 bp, Homo sapiens
tacaaaggtatctttcctagat

SEQ ID NO: 7242657 - DNA, 22 bp, Homo sapiens
tacaaagggggaagagattctg

SEQ ID NO: 7242658 - DNA, 22 bp, Homo sapiens
tacaaagggattggggtggata

SEQ ID NO: 7242659 - DNA, 21 bp, Homo sapiens
tacaaagggaaattctggctc

SEQ ID NO: 7242660 - DNA, 22 bp, Homo sapiens
tacaaaggagaatagggtagca

SEQ ID NO: 7242661 - DNA, 22 bp, Homo sapiens
taatacagtagcttttacacag

SEQ ID NO: 7242662 - DNA, 22 bp, Homo sapiens
taagtaaatttataatgtgatt

SEQ ID NO: 7242663 - DNA, 22 bp, Homo sapiens
taagtacaaatgtatacataag

SEQ ID NO: 7242664 - DNA, 22 bp, Homo sapiens
taagtaatttgtgcagagatac

SEQ ID NO: 7242665 - DNA, 22 bp, Homo sapiens
taaggctttgtagtgattgctt

SEQ ID NO: 7242666 - DNA, 22 bp, Homo sapiens
taaggcttagaagctatctgct

SEQ ID NO: 7242667 - DNA, 17 bp, Homo sapiens
taagggggaaacggagc

SEQ ID NO: 7242668 - DNA, 22 bp, Homo sapiens
taagggggcacttactctcagg

SEQ ID NO: 7242669 - DNA, 22 bp, Homo sapiens
taagggggaagatcatatttta

SEQ ID NO: 7242670 - DNA, 22 bp, Homo sapiens
taagggggaactcagttcagaa

SEQ ID NO: 7242671 - DNA, 22 bp, Homo sapiens
taagggttcagaatgcagtggt

SEQ ID NO: 7242672 - DNA, 22 bp, Homo sapiens
taaggtcatggtgaataataag

SEQ ID NO: 7242673 - DNA, 22 bp, Homo sapiens
taaggtgagctgtataacaggg

SEQ ID NO: 7242674 - DNA, 22 bp, Homo sapiens
taaggccaagttcatatacaac

SEQ ID NO: 7242675 - DNA, 23 bp, Homo sapiens
taaggcattttttctgtatcagt

SEQ ID NO: 7242676 - DNA, 18 bp, Homo sapiens
taaggcattcttatgtga

SEQ ID NO: 7242677 - DNA, 22 bp, Homo sapiens
taaggcattctcatgctgtgaa

SEQ ID NO: 7242678 - DNA, 22 bp, Homo sapiens
taaggcatgctagcagtatgaa

SEQ ID NO: 7242679 - DNA, 22 bp, Homo sapiens
taaggcatgagtttatttcata

SEQ ID NO: 7242680 - DNA, 22 bp, Homo sapiens
taactgcatttttggttggagc

SEQ ID NO: 7242681 - DNA, 22 bp, Homo sapiens
taactgcaccatcaaattagag

SEQ ID NO: 7242682 - DNA, 22 bp, Homo sapiens
tacattgaaatcaatggatgtg

SEQ ID NO: 7242683 - DNA, 22 bp, Homo sapiens
tacattgaactatgagttcagt

SEQ ID NO: 7242684 - DNA, 22 bp, Homo sapiens
tacattgaaagtcatttaatcc

SEQ ID NO: 7242685 - DNA, 22 bp, Homo sapiens
tacattgaaagtcatttaatcc

SEQ ID NO: 7242686 - DNA, 22 bp, Homo sapiens
tacattgagaaccactgcttag

SEQ ID NO: 7242687 - DNA, 22 bp, Homo sapiens
tacattgagcacgtactatgtg

SEQ ID NO: 7242688 - DNA, 22 bp, Homo sapiens
tacattgactgtgtgcatcaca

SEQ ID NO: 7242689 - DNA, 22 bp, Homo sapiens
tacattgaattttttagcatgt

SEQ ID NO: 7242690 - DNA, 22 bp, Homo sapiens
tacattgacctttgttaggttg

SEQ ID NO: 7242691 - DNA, 21 bp, Homo sapiens
tacattgactacaaataaagc

SEQ ID NO: 7242692 - DNA, 22 bp, Homo sapiens
tacattgactctctgtccctaa

SEQ ID NO: 7242693 - DNA, 22 bp, Homo sapiens
tacattgaggcagtagctggag

SEQ ID NO: 7242694 - DNA, 22 bp, Homo sapiens
tacattgagtattatttagcca

SEQ ID NO: 7242695 - DNA, 22 bp, Homo sapiens
tacattgatggagtacctagct

SEQ ID NO: 7242696 - DNA, 19 bp, Homo sapiens
tacatcctcttcctctttg

SEQ ID NO: 7242697 - DNA, 22 bp, Homo sapiens
tacagtaagatgaaatagcaat

SEQ ID NO: 7242698 - DNA, 22 bp, Homo sapiens
tacatactccataatgacagca

SEQ ID NO: 7242699 - DNA, 22 bp, Homo sapiens
tacatagagaagttacagtgga

SEQ ID NO: 7242700 - DNA, 22 bp, Homo sapiens
tacatagagggtaatagcatca

SEQ ID NO: 7242701 - DNA, 21 bp, Homo sapiens
tacatagaggtgatatctgtt

SEQ ID NO: 7242702 - DNA, 22 bp, Homo sapiens
tacagtaccctgatgaactaaa

SEQ ID NO: 7242703 - DNA, 22 bp, Homo sapiens
tacagatacagatctagataca

SEQ ID NO: 7242704 - DNA, 22 bp, Homo sapiens
tacagataactgaatgcagact

SEQ ID NO: 7242705 - DNA, 22 bp, Homo sapiens
tacagataaattttaagtagaa

SEQ ID NO: 7242706 - DNA, 22 bp, Homo sapiens
tacagagttttcctgccaagaa

SEQ ID NO: 7242707 - DNA, 22 bp, Homo sapiens
tacagagttttcctgccaagaa

SEQ ID NO: 7242708 - DNA, 22 bp, Homo sapiens
tacagagtgttattacagaatc

SEQ ID NO: 7242709 - DNA, 22 bp, Homo sapiens
tacagaagctgagacactgaga

SEQ ID NO: 7242710 - DNA, 22 bp, Homo sapiens
tacagaagctgagacactgaga

SEQ ID NO: 7242711 - DNA, 23 bp, Homo sapiens
tacagcaaggacaacataggtgg

SEQ ID NO: 7242712 - DNA, 22 bp, Homo sapiens
tacagcaaagaaaccctcagtc

SEQ ID NO: 7242713 - DNA, 22 bp, Homo sapiens
tacagatgaggaaactgaggca

SEQ ID NO: 7242714 - DNA, 22 bp, Homo sapiens
tacagatatagagatttataga

SEQ ID NO: 7242715 - DNA, 22 bp, Homo sapiens
tacagataggaggaatctgaaa

SEQ ID NO: 7242716 - DNA, 22 bp, Homo sapiens
tacagatatagagatttataga

SEQ ID NO: 7242717 - DNA, 22 bp, Homo sapiens
tacagatatagagatttataga

SEQ ID NO: 7242718 - DNA, 22 bp, Homo sapiens
tacaacataacgggcattcagt

SEQ ID NO: 7242719 - DNA, 22 bp, Homo sapiens
tacactttttactacagattct

SEQ ID NO: 7242720 - DNA, 22 bp, Homo sapiens
tacaacaatttccacattagaa

SEQ ID NO: 7242721 - DNA, 21 bp, Homo sapiens
gttttgctggtatctggggat

SEQ ID NO: 7242722 - DNA, 22 bp, Homo sapiens
gttttgcagagtgcaataaatc

SEQ ID NO: 7242723 - DNA, 22 bp, Homo sapiens
gttttgttcatgaacattgggt

SEQ ID NO: 7242724 - DNA, 18 bp, Homo sapiens
gttttgaattgtcttaca

SEQ ID NO: 7242725 - DNA, 22 bp, Homo sapiens
gttttgaatcactgcgcttcac

SEQ ID NO: 7242726 - DNA, 22 bp, Homo sapiens
gttttgaatactactagaactt

SEQ ID NO: 7242727 - DNA, 22 bp, Homo sapiens
gttttgaagaagaccttgaaac

SEQ ID NO: 7242728 - DNA, 22 bp, Homo sapiens
gttttgaaatgaaagaaccaag

SEQ ID NO: 7242729 - DNA, 21 bp, Homo sapiens
gttttctttgatagagggaag

SEQ ID NO: 7242730 - DNA, 22 bp, Homo sapiens
gtttcccaaattgttcacaggg

SEQ ID NO: 7242731 - DNA, 22 bp, Homo sapiens
taaacagaattcaggcaagata

SEQ ID NO: 7242732 - DNA, 22 bp, Homo sapiens
taaagggtaggttttactgtaa

SEQ ID NO: 7242733 - DNA, 22 bp, Homo sapiens
taaaatttgtccctgagtgttg

SEQ ID NO: 7242734 - DNA, 22 bp, Homo sapiens
taaattcagtgagtaatttctg

SEQ ID NO: 7242735 - DNA, 22 bp, Homo sapiens
taacctttgttcaatgtaagat

SEQ ID NO: 7242736 - DNA, 22 bp, Homo sapiens
taactagatgtgagaatattca

SEQ ID NO: 7242737 - DNA, 22 bp, Homo sapiens
taactagaatggctattttgag

SEQ ID NO: 7242738 - DNA, 22 bp, Homo sapiens
taaaggtagtgtgacatattgt

SEQ ID NO: 7242739 - DNA, 22 bp, Homo sapiens
taaaggtatgtcttaatcaaac

SEQ ID NO: 7242740 - DNA, 22 bp, Homo sapiens
taaaggtctgaacacagtgagg

SEQ ID NO: 7242741 - DNA, 22 bp, Homo sapiens
taaaggtccaaagagggctacg

SEQ ID NO: 7242742 - DNA, 22 bp, Homo sapiens
taaaggtcatcagattagcggg

SEQ ID NO: 7242743 - DNA, 22 bp, Homo sapiens
taaaggtcaagagatgctgtct

SEQ ID NO: 7242744 - DNA, 22 bp, Homo sapiens
taaagtaatccttcataaggag

SEQ ID NO: 7242745 - DNA, 22 bp, Homo sapiens
taaaggttgaaaactgactgcc

SEQ ID NO: 7242746 - DNA, 22 bp, Homo sapiens
taaagtatccagttattcttct

SEQ ID NO: 7242747 - DNA, 22 bp, Homo sapiens
taaagtatattttttctcaata

SEQ ID NO: 7242748 - DNA, 22 bp, Homo sapiens
gtgctcaggttcccatgagtgc

SEQ ID NO: 7242749 - DNA, 22 bp, Homo sapiens
gtgctcaggggcaatcctggga

SEQ ID NO: 7242750 - DNA, 22 bp, Homo sapiens
gtgctcagggcctggctgggga

SEQ ID NO: 7242751 - DNA, 22 bp, Homo sapiens
gtgctcagggcctggctgggga

SEQ ID NO: 7242752 - DNA, 22 bp, Homo sapiens
gtgctcagcccggatgagatca

SEQ ID NO: 7242753 - DNA, 22 bp, Homo sapiens
gtgctccaggataggctgacct

SEQ ID NO: 7242754 - DNA, 22 bp, Homo sapiens
gtgctccaacattagtgtgctt

SEQ ID NO: 7242755 - DNA, 22 bp, Homo sapiens
gtgctcctcacagtgtggccct

SEQ ID NO: 7242756 - DNA, 22 bp, Homo sapiens
gtgctctccagccccacgtgga

SEQ ID NO: 7242757 - DNA, 21 bp, Homo sapiens
gtgctctgggcagcagagggc

SEQ ID NO: 7242758 - DNA, 18 bp, Homo sapiens
gtgtgcagttgcaggggt

SEQ ID NO: 7242759 - DNA, 18 bp, Homo sapiens
gtgtgcagttgcaggggt

SEQ ID NO: 7242760 - DNA, 23 bp, Homo sapiens
gtgtgccaagcactgtgccagga

SEQ ID NO: 7242761 - DNA, 22 bp, Homo sapiens
gtgtgccaacaaaagacagtgc

SEQ ID NO: 7242762 - DNA, 22 bp, Homo sapiens
gtgtgccactgcctgaggaccc

SEQ ID NO: 7242763 - DNA, 22 bp, Homo sapiens
gtgtgccaccagtcaaggtgaa

SEQ ID NO: 7242764 - DNA, 22 bp, Homo sapiens
gtgtgccaccactgacaggatt

SEQ ID NO: 7242765 - DNA, 22 bp, Homo sapiens
gtgtgccaccagtcaaggtgaa

SEQ ID NO: 7242766 - DNA, 22 bp, Homo sapiens
gtgtgggaatggcggtcgtgca

SEQ ID NO: 7242767 - DNA, 22 bp, Homo sapiens
gtgtgggaaggctaggatgctg

SEQ ID NO: 7242768 - DNA, 22 bp, Homo sapiens
gtgtgggacgggtgagtggcca

SEQ ID NO: 7242769 - DNA, 22 bp, Homo sapiens
gtgtgggaaggctaggatgctg

SEQ ID NO: 7242770 - DNA, 22 bp, Homo sapiens
gtgtggcttgggtgaggcgcct

SEQ ID NO: 7242771 - DNA, 22 bp, Homo sapiens
gtttcattacctgacccatgag

SEQ ID NO: 7242772 - DNA, 22 bp, Homo sapiens
gtttcagatttggtttcagaag

SEQ ID NO: 7242773 - DNA, 22 bp, Homo sapiens
gtttcagatatatttgtactta

SEQ ID NO: 7242774 - DNA, 22 bp, Homo sapiens
gtttcagatatatttgtactta

SEQ ID NO: 7242775 - DNA, 22 bp, Homo sapiens
gtttcagagttagtgctggctg

SEQ ID NO: 7242776 - DNA, 22 bp, Homo sapiens
gtttcagaggtgttcattttca

SEQ ID NO: 7242777 - DNA, 22 bp, Homo sapiens
gtttcagaaatgttctcctgct

SEQ ID NO: 7242778 - DNA, 22 bp, Homo sapiens
gttggggtaccttgaggctggg

SEQ ID NO: 7242779 - DNA, 22 bp, Homo sapiens
gttgggcagaagcttgttgtgc

SEQ ID NO: 7242780 - DNA, 22 bp, Homo sapiens
gttggggtccaatgaagcgagc

SEQ ID NO: 7242781 - DNA, 22 bp, Homo sapiens
gttgatttagtgagtgagcagt

SEQ ID NO: 7242782 - DNA, 22 bp, Homo sapiens
gttacaaaggtcataaaagtgt

SEQ ID NO: 7242783 - DNA, 22 bp, Homo sapiens
gttacaaaggactgggggccac

SEQ ID NO: 7242784 - DNA, 22 bp, Homo sapiens
gttcacaaagtactgtatgcat

SEQ ID NO: 7242785 - DNA, 22 bp, Homo sapiens
tattacagggctagttatgagt

SEQ ID NO: 7242786 - DNA, 22 bp, Homo sapiens
tattacagaatcaggcataact

SEQ ID NO: 7242787 - DNA, 22 bp, Homo sapiens
tattagaaagcttaatatcgtg

SEQ ID NO: 7242788 - DNA, 22 bp, Homo sapiens
tatgtcctgctactctctcatg

SEQ ID NO: 7242789 - DNA, 22 bp, Homo sapiens
tatgagcttccagtgttgcatg

SEQ ID NO: 7242790 - DNA, 23 bp, Homo sapiens
tatgagaattaagtgcgagtgcc

SEQ ID NO: 7242791 - DNA, 22 bp, Homo sapiens
tatgagaatttgctaattggct

SEQ ID NO: 7242792 - DNA, 22 bp, Homo sapiens
tattcttgtatactacaatctt

SEQ ID NO: 7242793 - DNA, 22 bp, Homo sapiens
tattcttgtaccttaaatgatt

SEQ ID NO: 7242794 - DNA, 22 bp, Homo sapiens
tattcttgactgcttactatgt

SEQ ID NO: 7242795 - DNA, 22 bp, Homo sapiens
tattattttagcactgaggatt

SEQ ID NO: 7242796 - DNA, 20 bp, Homo sapiens
tatttacaacttagagcctc

SEQ ID NO: 7242797 - DNA, 22 bp, Homo sapiens
tatttataatctgccaaagaga

SEQ ID NO: 7242798 - DNA, 22 bp, Homo sapiens
tatttataatctgccaaagaga

SEQ ID NO: 7242799 - DNA, 22 bp, Homo sapiens
tatttatattctgccttctgct

SEQ ID NO: 7242800 - DNA, 22 bp, Homo sapiens
tatttataccaggtgatcggag

SEQ ID NO: 7242801 - DNA, 22 bp, Homo sapiens
tatttatgtggaccataagcct

SEQ ID NO: 7242802 - DNA, 22 bp, Homo sapiens
tatttatgtctctgcagagaat

SEQ ID NO: 7242803 - DNA, 22 bp, Homo sapiens
tatttatgtatgtggatgtgtt

SEQ ID NO: 7242804 - DNA, 22 bp, Homo sapiens
tatttatgtggaccataagcct

SEQ ID NO: 7242805 - DNA, 22 bp, Homo sapiens
tatttctcagcattttacatcc

SEQ ID NO: 7242806 - DNA, 22 bp, Homo sapiens
tatttctctcacggttgcctgg

SEQ ID NO: 7242807 - DNA, 22 bp, Homo sapiens
tatttctcttcaaaattgatgt

SEQ ID NO: 7242808 - DNA, 22 bp, Homo sapiens
tatttctcttcaaaattgatgt

SEQ ID NO: 7242809 - DNA, 22 bp, Homo sapiens
tatttctctttgtagggatata

SEQ ID NO: 7242810 - DNA, 22 bp, Homo sapiens
tatttctctttgtagggatata

SEQ ID NO: 7242811 - DNA, 22 bp, Homo sapiens
tatatgactgtattatgctttt

SEQ ID NO: 7242812 - DNA, 22 bp, Homo sapiens
tatccagtgtgaactcctctac

SEQ ID NO: 7242813 - DNA, 22 bp, Homo sapiens
tatatcagagttaaaagaatgt

SEQ ID NO: 7242814 - DNA, 21 bp, Homo sapiens
tatagcagcatgatttataat

SEQ ID NO: 7242815 - DNA, 22 bp, Homo sapiens
tatagctttgctgagaaaaaga

SEQ ID NO: 7242816 - DNA, 22 bp, Homo sapiens
tatagcttcaaatgctatagct

SEQ ID NO: 7242817 - DNA, 22 bp, Homo sapiens
tataggctgatggcttcctgag

SEQ ID NO: 7242818 - DNA, 22 bp, Homo sapiens
tataggctcttgttaacctttt

SEQ ID NO: 7242819 - DNA, 22 bp, Homo sapiens
tatagtgcattatttacagtaa

SEQ ID NO: 7242820 - DNA, 22 bp, Homo sapiens
tatagtatacttaaagtctatt

SEQ ID NO: 7242821 - DNA, 21 bp, Homo sapiens
tatgagaaaactgaggtgcat

SEQ ID NO: 7242822 - DNA, 22 bp, Homo sapiens
tatgacttttcccaattcagga

SEQ ID NO: 7242823 - DNA, 22 bp, Homo sapiens
tatgagaaaataaatatctgtt

SEQ ID NO: 7242824 - DNA, 22 bp, Homo sapiens
tatgagaaagtcgtatgtctcc

SEQ ID NO: 7242825 - DNA, 22 bp, Homo sapiens
tatgagaataatctggtaaata

SEQ ID NO: 7242826 - DNA, 22 bp, Homo sapiens
tatgagaactgacagagtgcca

SEQ ID NO: 7242827 - DNA, 18 bp, Homo sapiens
tatgagaagattagcaat

SEQ ID NO: 7242828 - DNA, 22 bp, Homo sapiens
tatgagaacaagaacaatctcc

SEQ ID NO: 7242829 - DNA, 22 bp, Homo sapiens
tatgaccttaggaagcaagaag

SEQ ID NO: 7242830 - DNA, 22 bp, Homo sapiens
tatgacattttgccagcattgc

SEQ ID NO: 7242831 - DNA, 22 bp, Homo sapiens
tatgacattttgccagcattgc

SEQ ID NO: 7242832 - DNA, 22 bp, Homo sapiens
tatgacagtgaaaaaaatcaga

SEQ ID NO: 7242833 - DNA, 22 bp, Homo sapiens
tatgacattgctttttagaact

SEQ ID NO: 7242834 - DNA, 22 bp, Homo sapiens
tatgacattatgtattacatgt

SEQ ID NO: 7242835 - DNA, 22 bp, Homo sapiens
tatccccctttctcaggaagct

SEQ ID NO: 7242836 - DNA, 22 bp, Homo sapiens
taggtgtctgctcttatttaac

SEQ ID NO: 7242837 - DNA, 22 bp, Homo sapiens
taggtgagtttggggaagatag

SEQ ID NO: 7242838 - DNA, 22 bp, Homo sapiens
taggggtggagctaagagtccc

SEQ ID NO: 7242839 - DNA, 22 bp, Homo sapiens
taggggtgaggccaggcatcag

SEQ ID NO: 7242840 - DNA, 22 bp, Homo sapiens
taggggtggagctaagagtccc

SEQ ID NO: 7242841 - DNA, 22 bp, Homo sapiens
taggggtgggatccaggaatta

SEQ ID NO: 7242842 - DNA, 22 bp, Homo sapiens
taggtcatcagattgacaaggg

SEQ ID NO: 7242843 - DNA, 22 bp, Homo sapiens
taggggtgtttcgagagaggtt

SEQ ID NO: 7242844 - DNA, 22 bp, Homo sapiens
taggggtgtttcgagagaggtt

SEQ ID NO: 7242845 - DNA, 22 bp, Homo sapiens
taggtgaggttacaagagttca

SEQ ID NO: 7242846 - DNA, 20 bp, Homo sapiens
taggtgagggcagatagagg

SEQ ID NO: 7242847 - DNA, 22 bp, Homo sapiens
taggtgagggagcattgtgaga

SEQ ID NO: 7242848 - DNA, 22 bp, Homo sapiens
tataaagtttcgaaagatgtat

SEQ ID NO: 7242849 - DNA, 22 bp, Homo sapiens
tatacacatatacgtttgtgtg

SEQ ID NO: 7242850 - DNA, 22 bp, Homo sapiens
tataatttttctgtggccagtt

SEQ ID NO: 7242851 - DNA, 22 bp, Homo sapiens
tataattttagaagagatggaa

SEQ ID NO: 7242852 - DNA, 22 bp, Homo sapiens
tataattttaagtggtaaatta

SEQ ID NO: 7242853 - DNA, 22 bp, Homo sapiens
tataattttaagtggtaaatta

SEQ ID NO: 7242854 - DNA, 22 bp, Homo sapiens
tataatttggggaaagtggtgt

SEQ ID NO: 7242855 - DNA, 22 bp, Homo sapiens
tataatttatcatgtcacagtt

SEQ ID NO: 7242856 - DNA, 22 bp, Homo sapiens
tagggaggagggttttcaaatc

SEQ ID NO: 7242857 - DNA, 22 bp, Homo sapiens
tagggaggctacttcttgtagg

SEQ ID NO: 7242858 - DNA, 22 bp, Homo sapiens
taggacagtggagataaccaga

SEQ ID NO: 7242859 - DNA, 22 bp, Homo sapiens
taggacagtagctggtgcacag

SEQ ID NO: 7242860 - DNA, 22 bp, Homo sapiens
taggacaggtgaggggctgtgg

SEQ ID NO: 7242861 - DNA, 22 bp, Homo sapiens
taggacagtttactttggttac

SEQ ID NO: 7242862 - DNA, 22 bp, Homo sapiens
taggagggccctgaaaatggca

SEQ ID NO: 7242863 - DNA, 22 bp, Homo sapiens
taggagggggaacaaggcatac

SEQ ID NO: 7242864 - DNA, 22 bp, Homo sapiens
taggagggttagagggaaatat

SEQ ID NO: 7242865 - DNA, 22 bp, Homo sapiens
tagctgaagggcatttaataaa

SEQ ID NO: 7242866 - DNA, 22 bp, Homo sapiens
tagctctttgagattggttctt

SEQ ID NO: 7242867 - DNA, 22 bp, Homo sapiens
tagctctttgtacaagtagatg

SEQ ID NO: 7242868 - DNA, 22 bp, Homo sapiens
tagctcttttaatccttaggac

SEQ ID NO: 7242869 - DNA, 22 bp, Homo sapiens
tagctcttttataggaactctg

SEQ ID NO: 7242870 - DNA, 22 bp, Homo sapiens
tagctctttattaaggcccaga

SEQ ID NO: 7242871 - DNA, 22 bp, Homo sapiens
tagctcttgtgttttacatata

SEQ ID NO: 7242872 - DNA, 18 bp, Homo sapiens
tagctcttgttggtccat

SEQ ID NO: 7242873 - DNA, 22 bp, Homo sapiens
tagctcttggaacgtgttaatt

SEQ ID NO: 7242874 - DNA, 22 bp, Homo sapiens
tagctcttgccagatcctcgat

SEQ ID NO: 7242875 - DNA, 22 bp, Homo sapiens
tagctcttgccatctgtcttat

SEQ ID NO: 7242876 - DNA, 22 bp, Homo sapiens
tagctcttcaggtgcctttcac

SEQ ID NO: 7242877 - DNA, 22 bp, Homo sapiens
tagctcttcatttcatctgatt

SEQ ID NO: 7242878 - DNA, 22 bp, Homo sapiens
tagctcttctaatggtaaagag

SEQ ID NO: 7242879 - DNA, 22 bp, Homo sapiens
tagctcttgatgctggcaggac

SEQ ID NO: 7242880 - DNA, 22 bp, Homo sapiens
tagctcttaggtgcgtggctct

SEQ ID NO: 7242881 - DNA, 22 bp, Homo sapiens
tagctcttaccaggtggccatg

SEQ ID NO: 7242882 - DNA, 22 bp, Homo sapiens
tagctcttaagtctgtgataga

SEQ ID NO: 7242883 - DNA, 22 bp, Homo sapiens
tagctcttcaatcactgtctcc

SEQ ID NO: 7242884 - DNA, 22 bp, Homo sapiens
tagctcttcacctctaggcact

SEQ ID NO: 7242885 - DNA, 22 bp, Homo sapiens
tagccccagctactcggaagct

SEQ ID NO: 7242886 - DNA, 22 bp, Homo sapiens
tagcagcatcctgtggtgatgg

SEQ ID NO: 7242887 - DNA, 18 bp, Homo sapiens
tagagggggcctgggcat

SEQ ID NO: 7242888 - DNA, 22 bp, Homo sapiens
tagagggttattaggacagaag

SEQ ID NO: 7242889 - DNA, 22 bp, Homo sapiens
tagaaatcatttagaagtattg

SEQ ID NO: 7242890 - DNA, 20 bp, Homo sapiens
tagaaatcttataaaagact

SEQ ID NO: 7242891 - DNA, 22 bp, Homo sapiens
tagaaatcagcaggcatatgta

SEQ ID NO: 7242892 - DNA, 22 bp, Homo sapiens
tagaaatcacagaaaatcaggg

SEQ ID NO: 7242893 - DNA, 22 bp, Homo sapiens
tagaaataaatctgcagctggg

SEQ ID NO: 7242894 - DNA, 22 bp, Homo sapiens
tagaaagcgttaaatctacaga

SEQ ID NO: 7242895 - DNA, 22 bp, Homo sapiens
tagaaagctgagtaatacattt

SEQ ID NO: 7242896 - DNA, 19 bp, Homo sapiens
tagaaagccagaaaacaga

SEQ ID NO: 7242897 - DNA, 22 bp, Homo sapiens
tagaaagccctgtgttcactgc

SEQ ID NO: 7242898 - DNA, 22 bp, Homo sapiens
tagaaagctggaggaattcttt

SEQ ID NO: 7242899 - DNA, 22 bp, Homo sapiens
tagaaagcttggggtgtttaaa

SEQ ID NO: 7242900 - DNA, 22 bp, Homo sapiens
tagaaaggatattgagatgaat

SEQ ID NO: 7242901 - DNA, 22 bp, Homo sapiens
tagaaaggatattgagatgaat

SEQ ID NO: 7242902 - DNA, 22 bp, Homo sapiens
tagacacatcttcatccacaat

SEQ ID NO: 7242903 - DNA, 22 bp, Homo sapiens
tagaatgttaagaatatgtata

SEQ ID NO: 7242904 - DNA, 22 bp, Homo sapiens
tagaatgtggaggtaacagact

SEQ ID NO: 7242905 - DNA, 22 bp, Homo sapiens
tagaatgtgcctggaatacagt

SEQ ID NO: 7242906 - DNA, 23 bp, Homo sapiens
tagaatgtcattcaatgatatgg

SEQ ID NO: 7242907 - DNA, 22 bp, Homo sapiens
tagaatgttcacctttaaatga

SEQ ID NO: 7242908 - DNA, 22 bp, Homo sapiens
tagaatgtagtgcttcaagatt

SEQ ID NO: 7242909 - DNA, 22 bp, Homo sapiens
tagaatctttaaaattcatagt

SEQ ID NO: 7242910 - DNA, 22 bp, Homo sapiens
tagaattttctgctttgatagt

SEQ ID NO: 7242911 - DNA, 22 bp, Homo sapiens
tagaatttcatgtatgttgggg

SEQ ID NO: 7242912 - DNA, 22 bp, Homo sapiens
tagaattgggcctaacttccat

SEQ ID NO: 7242913 - DNA, 22 bp, Homo sapiens
tagacaaaagggggcagatatg

SEQ ID NO: 7242914 - DNA, 22 bp, Homo sapiens
tagaaactactagaataagaga

SEQ ID NO: 7242915 - DNA, 22 bp, Homo sapiens
tagaaagaaattcagattggct

SEQ ID NO: 7242916 - DNA, 22 bp, Homo sapiens
tagaaacatgttctgttctgtt

SEQ ID NO: 7242917 - DNA, 22 bp, Homo sapiens
tagaaacattcagttgcagtcc

SEQ ID NO: 7242918 - DNA, 22 bp, Homo sapiens
tagaaacatgttctgttctgtt

SEQ ID NO: 7242919 - DNA, 22 bp, Homo sapiens
tagaaacatgagagaaactctt

SEQ ID NO: 7242920 - DNA, 22 bp, Homo sapiens
tagaaacagatgtttttgaaga

SEQ ID NO: 7242921 - DNA, 22 bp, Homo sapiens
tagaaacagcatatattagccc

SEQ ID NO: 7242922 - DNA, 22 bp, Homo sapiens
tagaaacatataggatggcagg

SEQ ID NO: 7242923 - DNA, 22 bp, Homo sapiens
tagaaacatatgtttgagacat

SEQ ID NO: 7242924 - DNA, 22 bp, Homo sapiens
tagaaacaatgacatgcttgta

SEQ ID NO: 7242925 - DNA, 22 bp, Homo sapiens
tagaaacaatgacatgcttgta

SEQ ID NO: 7242926 - DNA, 22 bp, Homo sapiens
tagaaaagccccagctggaggg

SEQ ID NO: 7242927 - DNA, 22 bp, Homo sapiens
tagaaacagaatatgagtgaga

SEQ ID NO: 7242928 - DNA, 22 bp, Homo sapiens
tagaaacacagatctggtgtca

SEQ ID NO: 7242929 - DNA, 22 bp, Homo sapiens
tagaaacagaaaactgtaatag

SEQ ID NO: 7242930 - DNA, 22 bp, Homo sapiens
tactttttgtctctttgaatgt

SEQ ID NO: 7242931 - DNA, 22 bp, Homo sapiens
tactttgagatgatgctgatcg

SEQ ID NO: 7242932 - DNA, 22 bp, Homo sapiens
tacttttagcctatttgattct

SEQ ID NO: 7242933 - DNA, 22 bp, Homo sapiens
tcaggtttaggaatttggaaag

SEQ ID NO: 7242934 - DNA, 17 bp, Homo sapiens
tcagtctctgtcctgga

SEQ ID NO: 7242935 - DNA, 22 bp, Homo sapiens
tcaggtggccaaatgggagcgc

SEQ ID NO: 7242936 - DNA, 21 bp, Homo sapiens
tcagtgtatttaagaatgttg

SEQ ID NO: 7242937 - DNA, 19 bp, Homo sapiens
tcatgcatttctaagtgca

SEQ ID NO: 7242938 - DNA, 22 bp, Homo sapiens
tcatgcattggaatcttcctag

SEQ ID NO: 7242939 - DNA, 22 bp, Homo sapiens
tcatgcattgcagcacattcag

SEQ ID NO: 7242940 - DNA, 22 bp, Homo sapiens
tcatgcattaacacttcatttt

SEQ ID NO: 7242941 - DNA, 22 bp, Homo sapiens
tcatgcatgttgtactggccca

SEQ ID NO: 7242942 - DNA, 21 bp, Homo sapiens
tcatgcatgagtttatatata

SEQ ID NO: 7242943 - DNA, 21 bp, Homo sapiens
tcatgcatgagtttatatata

SEQ ID NO: 7242944 - DNA, 22 bp, Homo sapiens
tcatatgcatatgaaatttttg

SEQ ID NO: 7242945 - DNA, 22 bp, Homo sapiens
tcatatgcatatgaaatttttg

SEQ ID NO: 7242946 - DNA, 22 bp, Homo sapiens
tcatatattttggcagtgatca

SEQ ID NO: 7242947 - DNA, 22 bp, Homo sapiens
tcatatatctgcaaagcagtat

SEQ ID NO: 7242948 - DNA, 22 bp, Homo sapiens
tcatatactgccttgtagatta

SEQ ID NO: 7242949 - DNA, 22 bp, Homo sapiens
tcatataactggatattttcaa

SEQ ID NO: 7242950 - DNA, 22 bp, Homo sapiens
tcatataagagctttagagtca

SEQ ID NO: 7242951 - DNA, 22 bp, Homo sapiens
tcatataagtttaaaactatct

SEQ ID NO: 7242952 - DNA, 16 bp, Homo sapiens
tcattgaagacagtac

SEQ ID NO: 7242953 - DNA, 22 bp, Homo sapiens
tcattgaacgaagagctccatt

SEQ ID NO: 7242954 - DNA, 22 bp, Homo sapiens
tcattactttttttgtgtctac

SEQ ID NO: 7242955 - DNA, 22 bp, Homo sapiens
tcatggaatagagcagtggcaa

SEQ ID NO: 7242956 - DNA, 22 bp, Homo sapiens
tcaggcctgcaaggagagtccc

SEQ ID NO: 7242957 - DNA, 22 bp, Homo sapiens
tcagggaaacctaaggaagcca

SEQ ID NO: 7242958 - DNA, 22 bp, Homo sapiens
tcagcctgctccaagtgctgcc

SEQ ID NO: 7242959 - DNA, 22 bp, Homo sapiens
tcagcaggcacggacaggctgc

SEQ ID NO: 7242960 - DNA, 22 bp, Homo sapiens
tcagcaggcaccggaagtgttt

SEQ ID NO: 7242961 - DNA, 22 bp, Homo sapiens
tcagcaggcacaccaaaaactg

SEQ ID NO: 7242962 - DNA, 21 bp, Homo sapiens
tcagcagcttttgcagtccct

SEQ ID NO: 7242963 - DNA, 22 bp, Homo sapiens
tcagcagaaaggcactagatga

SEQ ID NO: 7242964 - DNA, 22 bp, Homo sapiens
tcagcactttttaaagcagcat

SEQ ID NO: 7242965 - DNA, 22 bp, Homo sapiens
tcagctcctcagagcctcagtt

SEQ ID NO: 7242966 - DNA, 22 bp, Homo sapiens
tcagctcctatactttgtcctg

SEQ ID NO: 7242967 - DNA, 22 bp, Homo sapiens
tcagctccatccctgcttttgc

SEQ ID NO: 7242968 - DNA, 22 bp, Homo sapiens
tcagctcggcctaggcccacgg

SEQ ID NO: 7242969 - DNA, 22 bp, Homo sapiens
tcagctcctcatgcaggggata

SEQ ID NO: 7242970 - DNA, 22 bp, Homo sapiens
tcagctccacagctcctctgcc

SEQ ID NO: 7242971 - DNA, 22 bp, Homo sapiens
tcagctccagagttgcacagtg

SEQ ID NO: 7242972 - DNA, 22 bp, Homo sapiens
tcagctccacagctcctctgcc

SEQ ID NO: 7242973 - DNA, 18 bp, Homo sapiens
tcagcctgttgtctgcct

SEQ ID NO: 7242974 - DNA, 22 bp, Homo sapiens
tcagcctggtgattcctctgtc

SEQ ID NO: 7242975 - DNA, 22 bp, Homo sapiens
tcagcctggcaggatggcctgg

SEQ ID NO: 7242976 - DNA, 22 bp, Homo sapiens
tcacaaagggagggatagctgg

SEQ ID NO: 7242977 - DNA, 20 bp, Homo sapiens
tcacagaaacaaatagagaa

SEQ ID NO: 7242978 - DNA, 22 bp, Homo sapiens
tcacagtaaatccagaagaaat

SEQ ID NO: 7242979 - DNA, 22 bp, Homo sapiens
tcacaggcctggggcagagggc

SEQ ID NO: 7242980 - DNA, 22 bp, Homo sapiens
tcacaggctggtctccgaggac

SEQ ID NO: 7242981 - DNA, 22 bp, Homo sapiens
tcaatttatgtggctattcatt

SEQ ID NO: 7242982 - DNA, 22 bp, Homo sapiens
tcaagtcttcacgtgatatctc

SEQ ID NO: 7242983 - DNA, 22 bp, Homo sapiens
tatttcttgagtggtcagtttc

SEQ ID NO: 7242984 - DNA, 22 bp, Homo sapiens
tcaagaatagctgcaaacaggg

SEQ ID NO: 7242985 - DNA, 22 bp, Homo sapiens
tcaagaatttggataagaaatg

SEQ ID NO: 7242986 - DNA, 22 bp, Homo sapiens
tatttctgtcagccagatatgg

SEQ ID NO: 7242987 - DNA, 22 bp, Homo sapiens
tcaagctgcatcagtgcagtga

SEQ ID NO: 7242988 - DNA, 20 bp, Homo sapiens
tcaagacagacatggagttt

SEQ ID NO: 7242989 - DNA, 22 bp, Homo sapiens
tcagaggaaacaatctttagta

SEQ ID NO: 7242990 - DNA, 22 bp, Homo sapiens
tcagagaggcaatactgtttaa

SEQ ID NO: 7242991 - DNA, 23 bp, Homo sapiens
tcagagaggccccctgcagagat

SEQ ID NO: 7242992 - DNA, 22 bp, Homo sapiens
tcagagaggttaaatatcttgt

SEQ ID NO: 7242993 - DNA, 22 bp, Homo sapiens
tcagaggaaaggtcagatggct

SEQ ID NO: 7242994 - DNA, 22 bp, Homo sapiens
tcagaggaaaggtcagatggct

SEQ ID NO: 7242995 - DNA, 22 bp, Homo sapiens
tcagaggaagccttggtgggag

SEQ ID NO: 7242996 - DNA, 22 bp, Homo sapiens
tcagcacttactagtggccttt

SEQ ID NO: 7242997 - DNA, 22 bp, Homo sapiens
tcagagaagcttaagctgtaat

SEQ ID NO: 7242998 - DNA, 22 bp, Homo sapiens
tcagacagtgtgatcagtctct

SEQ ID NO: 7242999 - DNA, 22 bp, Homo sapiens
tcagaaaagagaaaatcttata

SEQ ID NO: 7243000 - DNA, 22 bp, Homo sapiens
tcactttagaggaaacattgag

SEQ ID NO: 7243001 - DNA, 22 bp, Homo sapiens
tcactctgttttactcactgtt

SEQ ID NO: 7243002 - DNA, 22 bp, Homo sapiens
tcaccaggattcctatcagtag

SEQ ID NO: 7243003 - DNA, 22 bp, Homo sapiens
tcaccaggattgggctgtaggc

SEQ ID NO: 7243004 - DNA, 22 bp, Homo sapiens
tcaccaggcaactatgtactcc

SEQ ID NO: 7243005 - DNA, 22 bp, Homo sapiens
tcaccaggctagagtgcagtgg

SEQ ID NO: 7243006 - DNA, 22 bp, Homo sapiens
tcactctgacttggcctccaac

SEQ ID NO: 7243007 - DNA, 22 bp, Homo sapiens
tcccacagcttcgtgcttcccc

SEQ ID NO: 7243008 - DNA, 22 bp, Homo sapiens
tcccacaggcccagggcggaaa

SEQ ID NO: 7243009 - DNA, 22 bp, Homo sapiens
tcccacaggtggagcttgcagt

SEQ ID NO: 7243010 - DNA, 22 bp, Homo sapiens
tcccacagtgaagttcatgata

SEQ ID NO: 7243011 - DNA, 22 bp, Homo sapiens
tcccattctgccaaggacattg

SEQ ID NO: 7243012 - DNA, 23 bp, Homo sapiens
tcccatgggctcactgccctgca

SEQ ID NO: 7243013 - DNA, 22 bp, Homo sapiens
tccccaggggcatctctctgct

SEQ ID NO: 7243014 - DNA, 22 bp, Homo sapiens
tccccagggctgcagagggtgt

SEQ ID NO: 7243015 - DNA, 22 bp, Homo sapiens
tccccactcaccactggccaaa

SEQ ID NO: 7243016 - DNA, 21 bp, Homo sapiens
tccccacatttctaaacagac

SEQ ID NO: 7243017 - DNA, 22 bp, Homo sapiens
tccccacatctctgcatcaggc

SEQ ID NO: 7243018 - DNA, 22 bp, Homo sapiens
tccccacactttcactcctggc

SEQ ID NO: 7243019 - DNA, 22 bp, Homo sapiens
tccagcaggttggtcaggtgca

SEQ ID NO: 7243020 - DNA, 22 bp, Homo sapiens
tccagcctttctactcactgag

SEQ ID NO: 7243021 - DNA, 22 bp, Homo sapiens
tccagctcccactctcactgct

SEQ ID NO: 7243022 - DNA, 20 bp, Homo sapiens
tccagctcagtttttttgtc

SEQ ID NO: 7243023 - DNA, 22 bp, Homo sapiens
tccagaggctctgagggagagt

SEQ ID NO: 7243024 - DNA, 22 bp, Homo sapiens
tccagagggcgatggctggggg

SEQ ID NO: 7243025 - DNA, 22 bp, Homo sapiens
tccagaggtatgtagagagtat

SEQ ID NO: 7243026 - DNA, 22 bp, Homo sapiens
tccagagctgggtctgtgctca

SEQ ID NO: 7243027 - DNA, 23 bp, Homo sapiens
tccagagctcatgctctcaacca

SEQ ID NO: 7243028 - DNA, 19 bp, Homo sapiens
tccagaactgccctggcct

SEQ ID NO: 7243029 - DNA, 22 bp, Homo sapiens
tcattgaattctgggggttgag

SEQ ID NO: 7243030 - DNA, 22 bp, Homo sapiens
tcattgaatgctctgcaggttg

SEQ ID NO: 7243031 - DNA, 22 bp, Homo sapiens
tcattgaatgctctgcaggttg

SEQ ID NO: 7243032 - DNA, 22 bp, Homo sapiens
tcattgaatgagatgcaataga

SEQ ID NO: 7243033 - DNA, 22 bp, Homo sapiens
tcattgaatatggggccataca

SEQ ID NO: 7243034 - DNA, 22 bp, Homo sapiens
tcattgaatgagatgcaataga

SEQ ID NO: 7243035 - DNA, 22 bp, Homo sapiens
tcattgaatacatatttgggat

SEQ ID NO: 7243036 - DNA, 22 bp, Homo sapiens
tcattgaagtgactgaaagatt

SEQ ID NO: 7243037 - DNA, 22 bp, Homo sapiens
tcattgaagcccttgacaagcc

SEQ ID NO: 7243038 - DNA, 22 bp, Homo sapiens
tcattgaagtgactgaaagatt

SEQ ID NO: 7243039 - DNA, 22 bp, Homo sapiens
tcattgaagcattttgtgtatt

SEQ ID NO: 7243040 - DNA, 22 bp, Homo sapiens
tcattgaagacttactggcttc

SEQ ID NO: 7243041 - DNA, 22 bp, Homo sapiens
tcattgaagacttactggcttc

SEQ ID NO: 7243042 - DNA, 22 bp, Homo sapiens
tcattgaatttggttcaatatg

SEQ ID NO: 7243043 - DNA, 22 bp, Homo sapiens
tcattgaatttcacagctttat

SEQ ID NO: 7243044 - DNA, 22 bp, Homo sapiens
tccagagatccaaagaatatga

SEQ ID NO: 7243045 - DNA, 22 bp, Homo sapiens
tccagagcaggtgtctacacag

SEQ ID NO: 7243046 - DNA, 22 bp, Homo sapiens
tccagagcctttccacccactt

SEQ ID NO: 7243047 - DNA, 22 bp, Homo sapiens
tccatgccaggcagtcgatgca

SEQ ID NO: 7243048 - DNA, 22 bp, Homo sapiens
tcccacacttgaaacaaggctg

SEQ ID NO: 7243049 - DNA, 21 bp, Homo sapiens
tcccacagaaactgcgaaatt

SEQ ID NO: 7243050 - DNA, 22 bp, Homo sapiens
tcccacagatgctgtccagagt

SEQ ID NO: 7243051 - DNA, 21 bp, Homo sapiens
tcccacagcgccagctcctgt

SEQ ID NO: 7243052 - DNA, 22 bp, Homo sapiens
tccatccatgtaggaagatggt

SEQ ID NO: 7243053 - DNA, 22 bp, Homo sapiens
tccatccctgactcctcctgga

SEQ ID NO: 7243054 - DNA, 22 bp, Homo sapiens
tccaggctggaaatgtcaaact

SEQ ID NO: 7243055 - DNA, 22 bp, Homo sapiens
tccagggctacaaggcaccaga

SEQ ID NO: 7243056 - DNA, 22 bp, Homo sapiens
tccagggctccccaacatccag

SEQ ID NO: 7243057 - DNA, 22 bp, Homo sapiens
tccagtttacagggttgctttt

SEQ ID NO: 7243058 - DNA, 22 bp, Homo sapiens
tccatcaccatttctgcgagct

SEQ ID NO: 7243059 - DNA, 22 bp, Homo sapiens
tccaggcatcccccaggacaga

SEQ ID NO: 7243060 - DNA, 23 bp, Homo sapiens
tccaggcatgagctctggatgga

SEQ ID NO: 7243061 - DNA, 22 bp, Homo sapiens
tccaggccaatgtagcaggccc

SEQ ID NO: 7243062 - DNA, 22 bp, Homo sapiens
tccaggccactgcagaggctct

SEQ ID NO: 7243063 - DNA, 22 bp, Homo sapiens
tccaggctctcaggtgtcagca

SEQ ID NO: 7243064 - DNA, 22 bp, Homo sapiens
tccaggctgatccatgaagaat

SEQ ID NO: 7243065 - DNA, 22 bp, Homo sapiens
gtctggaggcactttctcatga

SEQ ID NO: 7243066 - DNA, 22 bp, Homo sapiens
gtctggaggagggctctgcggc

SEQ ID NO: 7243067 - DNA, 22 bp, Homo sapiens
gtctggaggaggaagaaggcac

SEQ ID NO: 7243068 - DNA, 22 bp, Homo sapiens
gtctggaggaaaaggttaaatg

SEQ ID NO: 7243069 - DNA, 22 bp, Homo sapiens
gtctggagcctgggtccctgct

SEQ ID NO: 7243070 - DNA, 22 bp, Homo sapiens
gtcctgggcggagggctgctgt

SEQ ID NO: 7243071 - DNA, 22 bp, Homo sapiens
gtcctgggcctgctgaggctga

SEQ ID NO: 7243072 - DNA, 22 bp, Homo sapiens
gtgaaattgtatttggcattga

SEQ ID NO: 7243073 - DNA, 22 bp, Homo sapiens
gtgaaatatttaacgtccaggt

SEQ ID NO: 7243074 - DNA, 22 bp, Homo sapiens
gtgaacaggagaaagtgatgga

SEQ ID NO: 7243075 - DNA, 22 bp, Homo sapiens
gtctggagtaccataaaaagga

SEQ ID NO: 7243076 - DNA, 18 bp, Homo sapiens
gtctggaggtcaggagct

SEQ ID NO: 7243077 - DNA, 22 bp, Homo sapiens
gtctggagggtgggtagagacc

SEQ ID NO: 7243078 - DNA, 22 bp, Homo sapiens
gtctggaggggagatttgggtt

SEQ ID NO: 7243079 - DNA, 22 bp, Homo sapiens
gtctggagggaagagatgtcag

SEQ ID NO: 7243080 - DNA, 22 bp, Homo sapiens
gtctggaggcccgtcagcccta

SEQ ID NO: 7243081 - DNA, 22 bp, Homo sapiens
gtctggagtggggcctgagaat

SEQ ID NO: 7243082 - DNA, 17 bp, Homo sapiens
gtctggagtggccttca

SEQ ID NO: 7243083 - DNA, 22 bp, Homo sapiens
gtgaagaaggcaatacaaagaa

SEQ ID NO: 7243084 - DNA, 22 bp, Homo sapiens
gtgaaggactagcatggagggc

SEQ ID NO: 7243085 - DNA, 22 bp, Homo sapiens
gtgcagagaggaccttggggag

SEQ ID NO: 7243086 - DNA, 22 bp, Homo sapiens
gtgcagagaggtggagggactt

SEQ ID NO: 7243087 - DNA, 22 bp, Homo sapiens
gtgcagagaggtggagggactt

SEQ ID NO: 7243088 - DNA, 22 bp, Homo sapiens
gtgagcaggataggggctccct

SEQ ID NO: 7243089 - DNA, 22 bp, Homo sapiens
gtgagacacccaagagtcagat

SEQ ID NO: 7243090 - DNA, 22 bp, Homo sapiens
gtgaccttggcaatctctcaga

SEQ ID NO: 7243091 - DNA, 22 bp, Homo sapiens
gtgagaaatggaacttcatacg

SEQ ID NO: 7243092 - DNA, 22 bp, Homo sapiens
gtgagaaaattgcctaattttg

SEQ ID NO: 7243093 - DNA, 22 bp, Homo sapiens
gtgcatttaggtcacatgatgt

SEQ ID NO: 7243094 - DNA, 22 bp, Homo sapiens
gtgcatttatatttgcctttgg

SEQ ID NO: 7243095 - DNA, 20 bp, Homo sapiens
gtgcatttcacctgtactgt

SEQ ID NO: 7243096 - DNA, 22 bp, Homo sapiens
gtgcatttcaaggcacagctaa

SEQ ID NO: 7243097 - DNA, 22 bp, Homo sapiens
gtgcatttctcatacactaaat

SEQ ID NO: 7243098 - DNA, 22 bp, Homo sapiens
gtgcatttgacgaatactcact

SEQ ID NO: 7243099 - DNA, 22 bp, Homo sapiens
gtgcatttggtgactctcaccc

SEQ ID NO: 7243100 - DNA, 22 bp, Homo sapiens
gtgcatttgtgcatgcacatgt

SEQ ID NO: 7243101 - DNA, 22 bp, Homo sapiens
gtgccacatggtccatgtatca

SEQ ID NO: 7243102 - DNA, 22 bp, Homo sapiens
gtgctagggacaaagcagtgaa

SEQ ID NO: 7243103 - DNA, 22 bp, Homo sapiens
gtgctaggtgttggagatacag

SEQ ID NO: 7243104 - DNA, 22 bp, Homo sapiens
gtgctaggtactttgatcggtt

SEQ ID NO: 7243105 - DNA, 22 bp, Homo sapiens
gtgctagggttggagtggggct

SEQ ID NO: 7243106 - DNA, 22 bp, Homo sapiens
gtgcagggtagcgacggcagga

SEQ ID NO: 7243107 - DNA, 22 bp, Homo sapiens
gtgcagtgaccctggagagctg

SEQ ID NO: 7243108 - DNA, 20 bp, Homo sapiens
gtgcagaggcagcctgtggg

SEQ ID NO: 7243109 - DNA, 22 bp, Homo sapiens
gtgcagagtgtctgtggactga

SEQ ID NO: 7243110 - DNA, 22 bp, Homo sapiens
gtgcagagcaagggctgagggc

SEQ ID NO: 7243111 - DNA, 22 bp, Homo sapiens
gtgcagagcaagggctgagggc

SEQ ID NO: 7243112 - DNA, 22 bp, Homo sapiens
gtgcagaggacgtggcggcctc

SEQ ID NO: 7243113 - DNA, 22 bp, Homo sapiens
gtgcagaggacgtggcggcctc

SEQ ID NO: 7243114 - DNA, 21 bp, Homo sapiens
gtgcagaggaatgtagggggc

SEQ ID NO: 7243115 - DNA, 21 bp, Homo sapiens
gtgcagaggaatgtagggggc

SEQ ID NO: 7243116 - DNA, 22 bp, Homo sapiens
gtaaaacaagctttatggttcc

SEQ ID NO: 7243117 - DNA, 22 bp, Homo sapiens
ggttttattaactttaacatca

SEQ ID NO: 7243118 - DNA, 22 bp, Homo sapiens
ggttttctgctgaagatttcac

SEQ ID NO: 7243119 - DNA, 22 bp, Homo sapiens
ggttttctccccctcttctcag

SEQ ID NO: 7243120 - DNA, 22 bp, Homo sapiens
ggttttctccccctcttctcag

SEQ ID NO: 7243121 - DNA, 22 bp, Homo sapiens
ggtttcacaatttagagcagtg

SEQ ID NO: 7243122 - DNA, 22 bp, Homo sapiens
gtagaattttaataatggagat

SEQ ID NO: 7243123 - DNA, 22 bp, Homo sapiens
gtagaattacctctctatgtcc

SEQ ID NO: 7243124 - DNA, 21 bp, Homo sapiens
gtattgcagagttatgtgctc

SEQ ID NO: 7243125 - DNA, 22 bp, Homo sapiens
gtattgcatagacctgggatga

SEQ ID NO: 7243126 - DNA, 22 bp, Homo sapiens
gtattgcattttaatatgtgca

SEQ ID NO: 7243127 - DNA, 22 bp, Homo sapiens
gtatttaattctgtgcttctag

SEQ ID NO: 7243128 - DNA, 22 bp, Homo sapiens
gtattcaaggattttgttctac

SEQ ID NO: 7243129 - DNA, 22 bp, Homo sapiens
gtccaagagtcaagaagggggc

SEQ ID NO: 7243130 - DNA, 22 bp, Homo sapiens
gtccaagagggagctacagagc

SEQ ID NO: 7243131 - DNA, 22 bp, Homo sapiens
gtccaaggatggggtctcccag

SEQ ID NO: 7243132 - DNA, 22 bp, Homo sapiens
gtccaaggatgcaggatgctgt

SEQ ID NO: 7243133 - DNA, 22 bp, Homo sapiens
gtccaaggtctttggagataga

SEQ ID NO: 7243134 - DNA, 22 bp, Homo sapiens
gtccaagggtgcacaactagta

SEQ ID NO: 7243135 - DNA, 22 bp, Homo sapiens
gtccaaggcaagtgtgcagagt

SEQ ID NO: 7243136 - DNA, 22 bp, Homo sapiens
gtcatttttgactttgaagtga

SEQ ID NO: 7243137 - DNA, 22 bp, Homo sapiens
gtcatttttttcgtaatagtgg

SEQ ID NO: 7243138 - DNA, 22 bp, Homo sapiens
gtccactcccagtgcctgaggc

SEQ ID NO: 7243139 - DNA, 19 bp, Homo sapiens
gtccactccactcggtctc

SEQ ID NO: 7243140 - DNA, 22 bp, Homo sapiens
gtccactcactcttagtcactc

SEQ ID NO: 7243141 - DNA, 22 bp, Homo sapiens
gtccactctagggcagctctcg

SEQ ID NO: 7243142 - DNA, 22 bp, Homo sapiens
gtccactctctgccgtgcctgt

SEQ ID NO: 7243143 - DNA, 22 bp, Homo sapiens
gtccctctgcctgtggttctct

SEQ ID NO: 7243144 - DNA, 22 bp, Homo sapiens
gtccctctcaaatttatatgct

SEQ ID NO: 7243145 - DNA, 22 bp, Homo sapiens
gtccctctgggccatcaggtcc

SEQ ID NO: 7243146 - DNA, 22 bp, Homo sapiens
gtccctctgctctagagagcca

SEQ ID NO: 7243147 - DNA, 22 bp, Homo sapiens
gtccctctgtgtccctgcagtc

SEQ ID NO: 7243148 - DNA, 22 bp, Homo sapiens
gtccccttggtaaccttcagct

SEQ ID NO: 7243149 - DNA, 22 bp, Homo sapiens
gtcctgggcccaggggctgcct

SEQ ID NO: 7243150 - DNA, 22 bp, Homo sapiens
gtcctgggaggggctggtcctg

SEQ ID NO: 7243151 - DNA, 22 bp, Homo sapiens
gtcctgggcatgcagggctttc

SEQ ID NO: 7243152 - DNA, 22 bp, Homo sapiens
gtccctgcatctgcaggccatg

SEQ ID NO: 7243153 - DNA, 22 bp, Homo sapiens
gtccctggaaaagagctggtga

SEQ ID NO: 7243154 - DNA, 22 bp, Homo sapiens
gtcctgggaaggaagccaggga

SEQ ID NO: 7243155 - DNA, 22 bp, Homo sapiens
ggggtgggcgtgcagggacacc

SEQ ID NO: 7243156 - DNA, 22 bp, Homo sapiens
ggggctgggatttgaacccagg

SEQ ID NO: 7243157 - DNA, 22 bp, Homo sapiens
ggggtgtgtctgacaatggtat

SEQ ID NO: 7243158 - DNA, 22 bp, Homo sapiens
ggggtgtgagtagagctgggga

SEQ ID NO: 7243159 - DNA, 22 bp, Homo sapiens
ggggtggggttactcattgtgc

SEQ ID NO: 7243160 - DNA, 22 bp, Homo sapiens
ggggtgtcagcaccagcccctg

SEQ ID NO: 7243161 - DNA, 22 bp, Homo sapiens
ggggtgggcgtgcagggacacc

SEQ ID NO: 7243162 - DNA, 22 bp, Homo sapiens
ggggtgggcgtgcagggacacc

SEQ ID NO: 7243163 - DNA, 22 bp, Homo sapiens
ggggtggggttactcattgtgc

SEQ ID NO: 7243164 - DNA, 22 bp, Homo sapiens
gggtggagtgtgaaatctggct

SEQ ID NO: 7243165 - DNA, 22 bp, Homo sapiens
gggtggagtagaaagatgaatt

SEQ ID NO: 7243166 - DNA, 22 bp, Homo sapiens
gggtggagtagaaagatgaatt

SEQ ID NO: 7243167 - DNA, 22 bp, Homo sapiens
gggtggaggtgggttttgagat

SEQ ID NO: 7243168 - DNA, 22 bp, Homo sapiens
gggtggaggagaacaggcccca

SEQ ID NO: 7243169 - DNA, 22 bp, Homo sapiens
gggtggagcctgagaatttgca

SEQ ID NO: 7243170 - DNA, 22 bp, Homo sapiens
gggtggagccagttgactctgt

SEQ ID NO: 7243171 - DNA, 22 bp, Homo sapiens
gggtggagcttggacaccagta

SEQ ID NO: 7243172 - DNA, 22 bp, Homo sapiens
gggtggagcttggacaccagta

SEQ ID NO: 7243173 - DNA, 22 bp, Homo sapiens
gggtggagcttggacaccagta

SEQ ID NO: 7243174 - DNA, 22 bp, Homo sapiens
gggtggaggagaacaggcccca

SEQ ID NO: 7243175 - DNA, 22 bp, Homo sapiens
gggtggaggagaacaggcccca

SEQ ID NO: 7243176 - DNA, 22 bp, Homo sapiens
gggtaggctctgcaggctgggt

SEQ ID NO: 7243177 - DNA, 22 bp, Homo sapiens
gggtaggccagaagggcctgga

SEQ ID NO: 7243178 - DNA, 22 bp, Homo sapiens
gggtaggcagtgcgtcctgcct

SEQ ID NO: 7243179 - DNA, 22 bp, Homo sapiens
gggtaggctgctcctggggccc

SEQ ID NO: 7243180 - DNA, 22 bp, Homo sapiens
ggggccgaccgcggttcaggcc

SEQ ID NO: 7243181 - DNA, 22 bp, Homo sapiens
ggggccgaccgcggttcaggcc

SEQ ID NO: 7243182 - DNA, 22 bp, Homo sapiens
ggggcggggctctgagaagcat

SEQ ID NO: 7243183 - DNA, 22 bp, Homo sapiens
ggggcctcgccgccgcctctgc

SEQ ID NO: 7243184 - DNA, 22 bp, Homo sapiens
ggggctcaggggaagtgtccag

SEQ ID NO: 7243185 - DNA, 22 bp, Homo sapiens
ggggcctccagcactaggcagc

SEQ ID NO: 7243186 - DNA, 22 bp, Homo sapiens
ggggaagaatggcagaaaacat

SEQ ID NO: 7243187 - DNA, 22 bp, Homo sapiens
ggggaagatggccctccatgtg

SEQ ID NO: 7243188 - DNA, 22 bp, Homo sapiens
ggggaagaggcgtgatggatcc

SEQ ID NO: 7243189 - DNA, 22 bp, Homo sapiens
ggggaagaggcgtgatggatcc

SEQ ID NO: 7243190 - DNA, 22 bp, Homo sapiens
ggggctctcaggtctccccaaa

SEQ ID NO: 7243191 - DNA, 22 bp, Homo sapiens
ggggctctgcctctcccacgcc

SEQ ID NO: 7243192 - DNA, 22 bp, Homo sapiens
ggggctcagttcggacagcctg

SEQ ID NO: 7243193 - DNA, 22 bp, Homo sapiens
ggggctcagttcggacagcctg

SEQ ID NO: 7243194 - DNA, 22 bp, Homo sapiens
ggggctcagttcggacagcctg

SEQ ID NO: 7243195 - DNA, 22 bp, Homo sapiens
ggggctctggagaaaggccagt

SEQ ID NO: 7243196 - DNA, 22 bp, Homo sapiens
ggggctgaacctggaggtggtc

SEQ ID NO: 7243197 - DNA, 20 bp, Homo sapiens
ggggctgcatgcagagaaga

SEQ ID NO: 7243198 - DNA, 22 bp, Homo sapiens
ggggctgctcccacccctgagg

SEQ ID NO: 7243199 - DNA, 20 bp, Homo sapiens
ggggctgcatgcagagaaga

SEQ ID NO: 7243200 - DNA, 22 bp, Homo sapiens
ggggctgctggtatttccagtt

SEQ ID NO: 7243201 - DNA, 22 bp, Homo sapiens
ggggctgctcgccgcgcgtttc

SEQ ID NO: 7243202 - DNA, 22 bp, Homo sapiens
ggggctgctcgccgcgcgtttc

SEQ ID NO: 7243203 - DNA, 22 bp, Homo sapiens
ggggctggctcactaagagact

SEQ ID NO: 7243204 - DNA, 22 bp, Homo sapiens
ggggctgcttcacctttttacg

SEQ ID NO: 7243205 - DNA, 22 bp, Homo sapiens
gggctgctataacaagatacct

SEQ ID NO: 7243206 - DNA, 22 bp, Homo sapiens
gggctgcgtgtggaggatgtaa

SEQ ID NO: 7243207 - DNA, 22 bp, Homo sapiens
gggctgccttttaattcttccc

SEQ ID NO: 7243208 - DNA, 22 bp, Homo sapiens
gggctgcctttcttctgggagc

SEQ ID NO: 7243209 - DNA, 22 bp, Homo sapiens
gggctgcctgagcatctcctcc

SEQ ID NO: 7243210 - DNA, 22 bp, Homo sapiens
gggctgccaagcctgcctgcct

SEQ ID NO: 7243211 - DNA, 22 bp, Homo sapiens
gggctgccaagcctgcctgcct

SEQ ID NO: 7243212 - DNA, 22 bp, Homo sapiens
gggctgcacgtattctgctcac

SEQ ID NO: 7243213 - DNA, 22 bp, Homo sapiens
gggctgagtgtcccaggccgaa

SEQ ID NO: 7243214 - DNA, 22 bp, Homo sapiens
gggctgagttcctgcctcactc

SEQ ID NO: 7243215 - DNA, 22 bp, Homo sapiens
gggctgagtgtcccaggccgaa

SEQ ID NO: 7243216 - DNA, 22 bp, Homo sapiens
gggctgagggccaattcctact

SEQ ID NO: 7243217 - DNA, 22 bp, Homo sapiens
gggcttgctaagaagagcgcat

SEQ ID NO: 7243218 - DNA, 22 bp, Homo sapiens
gggcttcttgagctgccggccc

SEQ ID NO: 7243219 - DNA, 22 bp, Homo sapiens
gggctgctgtagagaacatgtt

SEQ ID NO: 7243220 - DNA, 22 bp, Homo sapiens
gggctgctgctgccagcgacac

SEQ ID NO: 7243221 - DNA, 22 bp, Homo sapiens
gggctgctgctgccagcgacac

SEQ ID NO: 7243222 - DNA, 22 bp, Homo sapiens
gggctgctgcccaggaggcacc

SEQ ID NO: 7243223 - DNA, 22 bp, Homo sapiens
gggctgctgccaatcacagcct

SEQ ID NO: 7243224 - DNA, 22 bp, Homo sapiens
gggctgctgccaccaggtggat

SEQ ID NO: 7243225 - DNA, 22 bp, Homo sapiens
gggcttgcttaaggtcacccgg

SEQ ID NO: 7243226 - DNA, 22 bp, Homo sapiens
gggctgaggctaccactggtct

SEQ ID NO: 7243227 - DNA, 22 bp, Homo sapiens
gggctgaggaacatattttgtt

SEQ ID NO: 7243228 - DNA, 22 bp, Homo sapiens
gggctgagctgttctgagttta

SEQ ID NO: 7243229 - DNA, 22 bp, Homo sapiens
gggctgagccatttgaaccttg

SEQ ID NO: 7243230 - DNA, 22 bp, Homo sapiens
gggctgagctaagctgggttga

SEQ ID NO: 7243231 - DNA, 22 bp, Homo sapiens
gggctgagccacagcttttgtt

SEQ ID NO: 7243232 - DNA, 22 bp, Homo sapiens
gggctgagattggtgccctgtc

SEQ ID NO: 7243233 - DNA, 22 bp, Homo sapiens
gggctgagcacatactgacagc

SEQ ID NO: 7243234 - DNA, 22 bp, Homo sapiens
gggctgagagtgactgttctgt

SEQ ID NO: 7243235 - DNA, 22 bp, Homo sapiens
gggctgagagctggaatctgag

SEQ ID NO: 7243236 - DNA, 22 bp, Homo sapiens
gggccaaggggagctggaaggg

SEQ ID NO: 7243237 - DNA, 22 bp, Homo sapiens
gggcatgtctctaggctggcta

SEQ ID NO: 7243238 - DNA, 22 bp, Homo sapiens
gggcatgtaggaatccatggag

SEQ ID NO: 7243239 - DNA, 20 bp, Homo sapiens
gggtggagttgcggtctgtg

SEQ ID NO: 7243240 - DNA, 20 bp, Homo sapiens
gggtggagttgcggtctgtg

SEQ ID NO: 7243241 - DNA, 20 bp, Homo sapiens
gggtggagttgcggtctgtg

SEQ ID NO: 7243242 - DNA, 22 bp, Homo sapiens
gggtggcacaggtgcagagggt

SEQ ID NO: 7243243 - DNA, 21 bp, Homo sapiens
gggtggccgcatgggtgcgtg

SEQ ID NO: 7243244 - DNA, 22 bp, Homo sapiens
ggtagggcaaagtagggcacct

SEQ ID NO: 7243245 - DNA, 22 bp, Homo sapiens
gggtggctaggtatcccccatt

SEQ ID NO: 7243246 - DNA, 22 bp, Homo sapiens
gggtggccttcatagctcaggg

SEQ ID NO: 7243247 - DNA, 22 bp, Homo sapiens
ggtccctggttccctctgagct

SEQ ID NO: 7243248 - DNA, 22 bp, Homo sapiens
ggtcagcagtgcagggcagagc

SEQ ID NO: 7243249 - DNA, 22 bp, Homo sapiens
ggtctcagactggcaggcagtg

SEQ ID NO: 7243250 - DNA, 22 bp, Homo sapiens
ggtcgctgagctagcatctgca

SEQ ID NO: 7243251 - DNA, 22 bp, Homo sapiens
ggtcgggcactctccagggctg

SEQ ID NO: 7243252 - DNA, 22 bp, Homo sapiens
ggtctcctgggttgaccagctg

SEQ ID NO: 7243253 - DNA, 22 bp, Homo sapiens
ggtctctgtcactgagtggccc

SEQ ID NO: 7243254 - DNA, 22 bp, Homo sapiens
ggtctctggccttggagattga

SEQ ID NO: 7243255 - DNA, 22 bp, Homo sapiens
ggtctctgcagctcccggcccc

SEQ ID NO: 7243256 - DNA, 22 bp, Homo sapiens
ggtctctgagtgaggacctggg

SEQ ID NO: 7243257 - DNA, 22 bp, Homo sapiens
ggtctctgacttagagatggat

SEQ ID NO: 7243258 - DNA, 22 bp, Homo sapiens
ggtctctgacttagagatggat

SEQ ID NO: 7243259 - DNA, 22 bp, Homo sapiens
ggtctcagtgaaggagtgtgct

SEQ ID NO: 7243260 - DNA, 22 bp, Homo sapiens
ggtctcaggagactggagagca

SEQ ID NO: 7243261 - DNA, 19 bp, Homo sapiens
ggtggctctccctcaggga

SEQ ID NO: 7243262 - DNA, 17 bp, Homo sapiens
ggtggctcgggcgcggc

SEQ ID NO: 7243263 - DNA, 22 bp, Homo sapiens
ggtgtgggtccttgtgcttgct

SEQ ID NO: 7243264 - DNA, 22 bp, Homo sapiens
ggtgtgggggcaagtttgagat

SEQ ID NO: 7243265 - DNA, 22 bp, Homo sapiens
ggtgtgggaactacaggttttt

SEQ ID NO: 7243266 - DNA, 22 bp, Homo sapiens
ggtgtggatcatctgaggtcag

SEQ ID NO: 7243267 - DNA, 22 bp, Homo sapiens
ggtgtggatcatctgaggtcag

SEQ ID NO: 7243268 - DNA, 22 bp, Homo sapiens
ggtttaattacctgcatctcaa

SEQ ID NO: 7243269 - DNA, 22 bp, Homo sapiens
ggtgttggtctacaccagcact

SEQ ID NO: 7243270 - DNA, 22 bp, Homo sapiens
ggtgttgggctcactggtcctt

SEQ ID NO: 7243271 - DNA, 22 bp, Homo sapiens
ggtgttgggagagctggttttg

SEQ ID NO: 7243272 - DNA, 22 bp, Homo sapiens
ggtgttggaacatggtgagatt

SEQ ID NO: 7243273 - DNA, 22 bp, Homo sapiens
ggtttaattggtccaggatggg

SEQ ID NO: 7243274 - DNA, 22 bp, Homo sapiens
ggtctggagtaggatgatggct

SEQ ID NO: 7243275 - DNA, 22 bp, Homo sapiens
ggtctggagtagatgagtcatg

SEQ ID NO: 7243276 - DNA, 16 bp, Homo sapiens
ggtctggaggatgtct

SEQ ID NO: 7243277 - DNA, 22 bp, Homo sapiens
ggtctggagcttggctaaggga

SEQ ID NO: 7243278 - DNA, 22 bp, Homo sapiens
ggtctggattttatctactgta

SEQ ID NO: 7243279 - DNA, 22 bp, Homo sapiens
ggtctggatttctgcttctttc

SEQ ID NO: 7243280 - DNA, 22 bp, Homo sapiens
ggtctggatgctgaggttccca

SEQ ID NO: 7243281 - DNA, 22 bp, Homo sapiens
ggtctggatattcaccagggcc

SEQ ID NO: 7243282 - DNA, 22 bp, Homo sapiens
ggtctggataattccagtacct

SEQ ID NO: 7243283 - DNA, 22 bp, Homo sapiens
ggtctggattttgaacaaaatt

SEQ ID NO: 7243284 - DNA, 20 bp, Homo sapiens
ggtggccgtagcgggcggcg

SEQ ID NO: 7243285 - DNA, 22 bp, Homo sapiens
ggtctggcctccgggcaggtgg

SEQ ID NO: 7243286 - DNA, 22 bp, Homo sapiens
ggtctcttcaggagcttgagcg

SEQ ID NO: 7243287 - DNA, 22 bp, Homo sapiens
ggtctctgtttggggctggcaa

SEQ ID NO: 7243288 - DNA, 22 bp, Homo sapiens
ggtctggagctaatcttgttgg

SEQ ID NO: 7243289 - DNA, 22 bp, Homo sapiens
ggtctggaccctcctggagtgg

SEQ ID NO: 7243290 - DNA, 22 bp, Homo sapiens
ggtctggaccatggacgccggg

SEQ ID NO: 7243291 - DNA, 22 bp, Homo sapiens
ggtctggacagaatgtgacact

SEQ ID NO: 7243292 - DNA, 23 bp, Homo sapiens
ggtctggaattcgcggagttaac

SEQ ID NO: 7243293 - DNA, 22 bp, Homo sapiens
ggtctggaatggagtaggggtg

SEQ ID NO: 7243294 - DNA, 22 bp, Homo sapiens
ggtctggaataaggtccaggaa

SEQ ID NO: 7243295 - DNA, 22 bp, Homo sapiens
ggtggcctcgccgcggctctgc

SEQ ID NO: 7243296 - DNA, 22 bp, Homo sapiens
ggtggctcagtgtcaggccctg

SEQ ID NO: 7243297 - DNA, 19 bp, Homo sapiens
ggtggctcagggcccagcc

SEQ ID NO: 7243298 - DNA, 18 bp, Homo sapiens
ggtggcggggatggaggt

SEQ ID NO: 7243299 - DNA, 22 bp, Homo sapiens
gggagctgtagtccagataccg

SEQ ID NO: 7243300 - DNA, 22 bp, Homo sapiens
gggagctgtaagggacaggtag

SEQ ID NO: 7243301 - DNA, 22 bp, Homo sapiens
gggagctgtcatcagtgttgtc

SEQ ID NO: 7243302 - DNA, 19 bp, Homo sapiens
gggagctgtctgcccgtgg

SEQ ID NO: 7243303 - DNA, 22 bp, Homo sapiens
gggagctgggctggttttgctg

SEQ ID NO: 7243304 - DNA, 22 bp, Homo sapiens
gggagctggggcatttataccc

SEQ ID NO: 7243305 - DNA, 22 bp, Homo sapiens
gggagctggttcctgccctcca

SEQ ID NO: 7243306 - DNA, 22 bp, Homo sapiens
gggagctgtaagggacaggtag

SEQ ID NO: 7243307 - DNA, 18 bp, Homo sapiens
gggagctgggaagctggt

SEQ ID NO: 7243308 - DNA, 22 bp, Homo sapiens
gggagatgaatcagaagtgatc

SEQ ID NO: 7243309 - DNA, 22 bp, Homo sapiens
gggagaggttacccgagcaact

SEQ ID NO: 7243310 - DNA, 22 bp, Homo sapiens
gggagaggttacccgagcaact

SEQ ID NO: 7243311 - DNA, 22 bp, Homo sapiens
gggagacccccaatgccaggtc

SEQ ID NO: 7243312 - DNA, 19 bp, Homo sapiens
gggagagccaggctcaccc

SEQ ID NO: 7243313 - DNA, 22 bp, Homo sapiens
gggagagcgcgctagggccgag

SEQ ID NO: 7243314 - DNA, 22 bp, Homo sapiens
gggagagcgggaggtgccacag

SEQ ID NO: 7243315 - DNA, 22 bp, Homo sapiens
gggagaggttacccgagcaact

SEQ ID NO: 7243316 - DNA, 22 bp, Homo sapiens
gggagagaattattgccagacc

SEQ ID NO: 7243317 - DNA, 22 bp, Homo sapiens
gggagagagaaaacgtggcgca

SEQ ID NO: 7243318 - DNA, 22 bp, Homo sapiens
gggacaggctgagacttgagct

SEQ ID NO: 7243319 - DNA, 22 bp, Homo sapiens
gggacaggcccctcgctagctt

SEQ ID NO: 7243320 - DNA, 22 bp, Homo sapiens
gggacaggcaaaggtatgcttc

SEQ ID NO: 7243321 - DNA, 22 bp, Homo sapiens
gggacaggcccctcgctagctt

SEQ ID NO: 7243322 - DNA, 22 bp, Homo sapiens
gggaccagaggctgtgcacaat

SEQ ID NO: 7243323 - DNA, 22 bp, Homo sapiens
gggagaagtggaaatctcatta

SEQ ID NO: 7243324 - DNA, 22 bp, Homo sapiens
gggagaagtggaaatctcatta

SEQ ID NO: 7243325 - DNA, 22 bp, Homo sapiens
gggagaagtggaaatctcatta

SEQ ID NO: 7243326 - DNA, 23 bp, Homo sapiens
gggaccagctagggctgtgacct

SEQ ID NO: 7243327 - DNA, 22 bp, Homo sapiens
gggacagcagaaagaaggcaag

SEQ ID NO: 7243328 - DNA, 22 bp, Homo sapiens
gggacagctggtctacctggta

SEQ ID NO: 7243329 - DNA, 22 bp, Homo sapiens
gggagctgtgggattggttgag

SEQ ID NO: 7243330 - DNA, 23 bp, Homo sapiens
gggagctgtggtgaaaagaggtg

SEQ ID NO: 7243331 - DNA, 22 bp, Homo sapiens
gggagcttctggaaggcaggaa

SEQ ID NO: 7243332 - DNA, 22 bp, Homo sapiens
gggaggaaatgtgcagcgaatt

SEQ ID NO: 7243333 - DNA, 22 bp, Homo sapiens
gggaggaaatgtgcagcgaatt

SEQ ID NO: 7243334 - DNA, 22 bp, Homo sapiens
gggaggaaggcttgggtgagta

SEQ ID NO: 7243335 - DNA, 22 bp, Homo sapiens
gggaggaaggcttgggtgagta

SEQ ID NO: 7243336 - DNA, 22 bp, Homo sapiens
gggaggaaggcttgggtgagta

SEQ ID NO: 7243337 - DNA, 22 bp, Homo sapiens
gggatggggagctggaaagggg

SEQ ID NO: 7243338 - DNA, 22 bp, Homo sapiens
gggatggggagctggaaagggg

SEQ ID NO: 7243339 - DNA, 22 bp, Homo sapiens
gggaggagctgagtgtgtgtgc

SEQ ID NO: 7243340 - DNA, 22 bp, Homo sapiens
gggaggacggtccagggcaaag

SEQ ID NO: 7243341 - DNA, 22 bp, Homo sapiens
gggcacagcccagtggggtccc

SEQ ID NO: 7243342 - DNA, 22 bp, Homo sapiens
gggcaagcacagcgagcgtgcg

SEQ ID NO: 7243343 - DNA, 22 bp, Homo sapiens
gggcagctgcagggatggtgac

SEQ ID NO: 7243344 - DNA, 22 bp, Homo sapiens
gggcacaggaatttgggatgtg

SEQ ID NO: 7243345 - DNA, 22 bp, Homo sapiens
gggcaggagagaacagtcatgg

SEQ ID NO: 7243346 - DNA, 22 bp, Homo sapiens
gggcaggagagggccacctgga

SEQ ID NO: 7243347 - DNA, 22 bp, Homo sapiens
gggcaggaggctaattctgcat

SEQ ID NO: 7243348 - DNA, 19 bp, Homo sapiens
gggcatgctggctctagag

SEQ ID NO: 7243349 - DNA, 22 bp, Homo sapiens
ggctctttggcgggccttgaac

SEQ ID NO: 7243350 - DNA, 22 bp, Homo sapiens
ggctctttaacttgtctaaatt

SEQ ID NO: 7243351 - DNA, 22 bp, Homo sapiens
ggctgaaggatgaaagctgcag

SEQ ID NO: 7243352 - DNA, 22 bp, Homo sapiens
ggctgagactagagtgaggcat

SEQ ID NO: 7243353 - DNA, 22 bp, Homo sapiens
ggctgagactagagtgaggcat

SEQ ID NO: 7243354 - DNA, 22 bp, Homo sapiens
ggctgaagtgtagtggctcact

SEQ ID NO: 7243355 - DNA, 22 bp, Homo sapiens
ggctctggagacatgtggagag

SEQ ID NO: 7243356 - DNA, 22 bp, Homo sapiens
ggctctggcaaggggaggctac

SEQ ID NO: 7243357 - DNA, 22 bp, Homo sapiens
ggctctggctactccaccctgt

SEQ ID NO: 7243358 - DNA, 22 bp, Homo sapiens
ggctctgggaaatggtcttcct

SEQ ID NO: 7243359 - DNA, 22 bp, Homo sapiens
ggctctgctcctggtgccagtg

SEQ ID NO: 7243360 - DNA, 22 bp, Homo sapiens
ggctctgctcacagcccgcagc

SEQ ID NO: 7243361 - DNA, 22 bp, Homo sapiens
ggctctgctgcacccttggctc

SEQ ID NO: 7243362 - DNA, 22 bp, Homo sapiens
ggctctgctgcaagtcttcctc

SEQ ID NO: 7243363 - DNA, 23 bp, Homo sapiens
ggctccaggcctgacgggcgcgg

SEQ ID NO: 7243364 - DNA, 22 bp, Homo sapiens
ggctccaggagggccttggcca

SEQ ID NO: 7243365 - DNA, 22 bp, Homo sapiens
ggctccaggagatgctgggcag

SEQ ID NO: 7243366 - DNA, 22 bp, Homo sapiens
ggctccaggagatgctgggcag

SEQ ID NO: 7243367 - DNA, 18 bp, Homo sapiens
ggctccaggacctaccca

SEQ ID NO: 7243368 - DNA, 22 bp, Homo sapiens
ggctccagatgtctcctggcaa

SEQ ID NO: 7243369 - DNA, 22 bp, Homo sapiens
ggctccagatgtcccctggcaa

SEQ ID NO: 7243370 - DNA, 22 bp, Homo sapiens
ggctccagatgtcccctggcaa

SEQ ID NO: 7243371 - DNA, 22 bp, Homo sapiens
ggctccagaaacttcagtccat

SEQ ID NO: 7243372 - DNA, 22 bp, Homo sapiens
ggcggggcctcgcgaacggcct

SEQ ID NO: 7243373 - DNA, 22 bp, Homo sapiens
ggcgggcagatgcggacacgcg

SEQ ID NO: 7243374 - DNA, 22 bp, Homo sapiens
ggcgggaggctgaggagttggt

SEQ ID NO: 7243375 - DNA, 22 bp, Homo sapiens
ggcgggaggctgaggagttggt

SEQ ID NO: 7243376 - DNA, 22 bp, Homo sapiens
ggcgggacggggcgtgcacaga

SEQ ID NO: 7243377 - DNA, 21 bp, Homo sapiens
ggcggcgcagagctgcggctc

SEQ ID NO: 7243378 - DNA, 22 bp, Homo sapiens
ggcggccgccttcggccacggc

SEQ ID NO: 7243379 - DNA, 22 bp, Homo sapiens
ggctgggctgcggctgtacctg

SEQ ID NO: 7243380 - DNA, 22 bp, Homo sapiens
ggctgggctgctgggtcagagc

SEQ ID NO: 7243381 - DNA, 22 bp, Homo sapiens
ggcttctgctcagcctgcacgc

SEQ ID NO: 7243382 - DNA, 22 bp, Homo sapiens
ggcttctgccacgagagggaag

SEQ ID NO: 7243383 - DNA, 22 bp, Homo sapiens
ggctgggctccgggagcatgcg

SEQ ID NO: 7243384 - DNA, 22 bp, Homo sapiens
ggctgggctccgggagcatgcg

SEQ ID NO: 7243385 - DNA, 22 bp, Homo sapiens
ggctgggctcgctgattggctg

SEQ ID NO: 7243386 - DNA, 22 bp, Homo sapiens
ggctgggcctctccctcagctg

SEQ ID NO: 7243387 - DNA, 22 bp, Homo sapiens
ggctgggccgcggctacccaga

SEQ ID NO: 7243388 - DNA, 22 bp, Homo sapiens
ggctgggccgcggctacccaga

SEQ ID NO: 7243389 - DNA, 22 bp, Homo sapiens
ggctgggcctctccctcagctg

SEQ ID NO: 7243390 - DNA, 19 bp, Homo sapiens
ggctgggccctgtttctcc

SEQ ID NO: 7243391 - DNA, 22 bp, Homo sapiens
ggctgggccagggcctgtggac

SEQ ID NO: 7243392 - DNA, 22 bp, Homo sapiens
ggctgggccagggcctgtggac

SEQ ID NO: 7243393 - DNA, 22 bp, Homo sapiens
ggctgggcatccatccatgaga

SEQ ID NO: 7243394 - DNA, 21 bp, Homo sapiens
ggctgggcaggacccacccct

SEQ ID NO: 7243395 - DNA, 22 bp, Homo sapiens
ggctgggcaggtctgcacaggg

SEQ ID NO: 7243396 - DNA, 22 bp, Homo sapiens
ggctgagcaattttgatgacat

SEQ ID NO: 7243397 - DNA, 22 bp, Homo sapiens
ggctgctgacttcatccagctt

SEQ ID NO: 7243398 - DNA, 22 bp, Homo sapiens
ggctgctgagtcacgacagtga

SEQ ID NO: 7243399 - DNA, 22 bp, Homo sapiens
ggctgctgagtcacgacagtga

SEQ ID NO: 7243400 - DNA, 22 bp, Homo sapiens
ggctgctgagttggccaggaga

SEQ ID NO: 7243401 - DNA, 22 bp, Homo sapiens
ggctgctgccctcctaagtgca

SEQ ID NO: 7243402 - DNA, 22 bp, Homo sapiens
ggctgctgcccacccctgcatg

SEQ ID NO: 7243403 - DNA, 22 bp, Homo sapiens
ggctgctggagttgggtctctc

SEQ ID NO: 7243404 - DNA, 22 bp, Homo sapiens
ggctgctggcattgaggtaggt

SEQ ID NO: 7243405 - DNA, 22 bp, Homo sapiens
ggctgctggccagcctaggagt

SEQ ID NO: 7243406 - DNA, 22 bp, Homo sapiens
ggctgctgggaatatgccagct

SEQ ID NO: 7243407 - DNA, 21 bp, Homo sapiens
ggctgctgggagagctgcgtg

SEQ ID NO: 7243408 - DNA, 21 bp, Homo sapiens
ggctgctgggagagctgcgtg

SEQ ID NO: 7243409 - DNA, 21 bp, Homo sapiens
ggctgggcaggacccacccct

SEQ ID NO: 7243410 - DNA, 22 bp, Homo sapiens
ggctgggcaaacaagactcttc

SEQ ID NO: 7243411 - DNA, 22 bp, Homo sapiens
ggctgggcagcagctgttaagc

SEQ ID NO: 7243412 - DNA, 22 bp, Homo sapiens
ggctgggaggccgtgctgacct

SEQ ID NO: 7243413 - DNA, 22 bp, Homo sapiens
ggctgggcaaacaagactcttc

SEQ ID NO: 7243414 - DNA, 22 bp, Homo sapiens
ggcacagcaggagctatgtgaa

SEQ ID NO: 7243415 - DNA, 22 bp, Homo sapiens
ggcaaaggaaccaggccacact

SEQ ID NO: 7243416 - DNA, 22 bp, Homo sapiens
ggcaacctgagcttgtggagaa

SEQ ID NO: 7243417 - DNA, 22 bp, Homo sapiens
ggagccagagcactggggagcc

SEQ ID NO: 7243418 - DNA, 22 bp, Homo sapiens
ggagccagagtctgcagtgtaa

SEQ ID NO: 7243419 - DNA, 22 bp, Homo sapiens
ggagccagaggctgctgctgtg

SEQ ID NO: 7243420 - DNA, 23 bp, Homo sapiens
ggagccagcctgtggggagcggg

SEQ ID NO: 7243421 - DNA, 19 bp, Homo sapiens
ggagccagctgtggaaggc

SEQ ID NO: 7243422 - DNA, 22 bp, Homo sapiens
ggagtaggccccgggagagagt

SEQ ID NO: 7243423 - DNA, 22 bp, Homo sapiens
ggagtcaccaagtaggagtctt

SEQ ID NO: 7243424 - DNA, 22 bp, Homo sapiens
ggagtctgagcttgtgtcctgg

SEQ ID NO: 7243425 - DNA, 22 bp, Homo sapiens
ggagtctgattttttatgggtg

SEQ ID NO: 7243426 - DNA, 22 bp, Homo sapiens
ggcagaggtagctggaaccagg

SEQ ID NO: 7243427 - DNA, 22 bp, Homo sapiens
ggcaggaggtgagtggcgggtg

SEQ ID NO: 7243428 - DNA, 20 bp, Homo sapiens
ggcagagggcctgggagaag

SEQ ID NO: 7243429 - DNA, 20 bp, Homo sapiens
ggcagagggcctgggagaag

SEQ ID NO: 7243430 - DNA, 22 bp, Homo sapiens
ggcagaggtagctggaaccagg

SEQ ID NO: 7243431 - DNA, 22 bp, Homo sapiens
ggcagaggtagctggaaccagg

SEQ ID NO: 7243432 - DNA, 22 bp, Homo sapiens
ggcaggaggtgagtggcgggtg

SEQ ID NO: 7243433 - DNA, 22 bp, Homo sapiens
ggcaggcactgtgctaggcgct

SEQ ID NO: 7243434 - DNA, 22 bp, Homo sapiens
ggcaggcagaggctgagacagg

SEQ ID NO: 7243435 - DNA, 22 bp, Homo sapiens
ggcacagctcaggtcccagctc

SEQ ID NO: 7243436 - DNA, 22 bp, Homo sapiens
ggcacagctacttgctcactct

SEQ ID NO: 7243437 - DNA, 22 bp, Homo sapiens
ggcacagcgactaccatcgaaa

SEQ ID NO: 7243438 - DNA, 22 bp, Homo sapiens
ggcacagccactttggagaact

SEQ ID NO: 7243439 - DNA, 21 bp, Homo sapiens
ggcacagcctgaaatgcctca

SEQ ID NO: 7243440 - DNA, 22 bp, Homo sapiens
ggcacagccctctctgtggaca

SEQ ID NO: 7243441 - DNA, 22 bp, Homo sapiens
ggcacagccctctctgtggaca

SEQ ID NO: 7243442 - DNA, 17 bp, Homo sapiens
ggcaccagacggagagt

SEQ ID NO: 7243443 - DNA, 22 bp, Homo sapiens
ggcacagctgatgcagacacac

SEQ ID NO: 7243444 - DNA, 22 bp, Homo sapiens
ggcagaggaaggatgaattcac

SEQ ID NO: 7243445 - DNA, 22 bp, Homo sapiens
ggcagaggaaggatgaattcac

SEQ ID NO: 7243446 - DNA, 22 bp, Homo sapiens
ggcagaggaagctggaagtggg

SEQ ID NO: 7243447 - DNA, 22 bp, Homo sapiens
ggcagaggaaggatgaattcac

SEQ ID NO: 7243448 - DNA, 20 bp, Homo sapiens
ggcaccaggctaggattgga

SEQ ID NO: 7243449 - DNA, 22 bp, Homo sapiens
ggcaccaggctgggcataggcc

SEQ ID NO: 7243450 - DNA, 23 bp, Homo sapiens
ggcaccaggccatggagcgggag

SEQ ID NO: 7243451 - DNA, 22 bp, Homo sapiens
ggcagaggagctggaaacatgg

SEQ ID NO: 7243452 - DNA, 22 bp, Homo sapiens
ggcagaggagctggaaacatgg

SEQ ID NO: 7243453 - DNA, 22 bp, Homo sapiens
ggcagaggagctggaaacatgg

SEQ ID NO: 7243454 - DNA, 22 bp, Homo sapiens
ggcagaggagctggaaacatgg

SEQ ID NO: 7243455 - DNA, 22 bp, Homo sapiens
ggcagaggaggggtgaatttgc

SEQ ID NO: 7243456 - DNA, 20 bp, Homo sapiens
ggcagagggcctgggagaag

SEQ ID NO: 7243457 - DNA, 20 bp, Homo sapiens
ggcagagggcctgggagaag

SEQ ID NO: 7243458 - DNA, 22 bp, Homo sapiens
ggcaggtgggaaccctccccac

SEQ ID NO: 7243459 - DNA, 22 bp, Homo sapiens
ggcaggtggcactgctgctccc

SEQ ID NO: 7243460 - DNA, 22 bp, Homo sapiens
ggcaggtggattttctactcta

SEQ ID NO: 7243461 - DNA, 22 bp, Homo sapiens
ggcagtctagtgtccttgggcc

SEQ ID NO: 7243462 - DNA, 22 bp, Homo sapiens
ggcagtctagctaggatgtcac

SEQ ID NO: 7243463 - DNA, 22 bp, Homo sapiens
ggcagtcttatcagcattggac

SEQ ID NO: 7243464 - DNA, 22 bp, Homo sapiens
ggcagtgaacagaaatgcagaa

SEQ ID NO: 7243465 - DNA, 22 bp, Homo sapiens
ggcagtgaatgaaacagaggct

SEQ ID NO: 7243466 - DNA, 22 bp, Homo sapiens
ggcatgggccgaggtgcctcct

SEQ ID NO: 7243467 - DNA, 22 bp, Homo sapiens
ggccatgcctggtctggcacca

SEQ ID NO: 7243468 - DNA, 22 bp, Homo sapiens
ggccatgccaggctgcctggga

SEQ ID NO: 7243469 - DNA, 22 bp, Homo sapiens
ggccagtctgggccacggtcgg

SEQ ID NO: 7243470 - DNA, 22 bp, Homo sapiens
ggccagggcctggggactgtcc

SEQ ID NO: 7243471 - DNA, 22 bp, Homo sapiens
ggccagggcctggggactgtcc

SEQ ID NO: 7243472 - DNA, 19 bp, Homo sapiens
ggccaggctgactgtggtc

SEQ ID NO: 7243473 - DNA, 19 bp, Homo sapiens
ggccaggctgactgtggtc

SEQ ID NO: 7243474 - DNA, 22 bp, Homo sapiens
ggccacagaacagctacaggac

SEQ ID NO: 7243475 - DNA, 22 bp, Homo sapiens
ggccacactctggtagaggtga

SEQ ID NO: 7243476 - DNA, 19 bp, Homo sapiens
ggccaggctgactgtggtc

SEQ ID NO: 7243477 - DNA, 22 bp, Homo sapiens
ggccaattccaggagccggcgg

SEQ ID NO: 7243478 - DNA, 22 bp, Homo sapiens
ggccacacggagaggctggtct

SEQ ID NO: 7243479 - DNA, 22 bp, Homo sapiens
ggccacacagatgactgctttc

SEQ ID NO: 7243480 - DNA, 22 bp, Homo sapiens
ggcatggtttaagtggtgggga

SEQ ID NO: 7243481 - DNA, 20 bp, Homo sapiens
ggcatgggtggggctcccag

SEQ ID NO: 7243482 - DNA, 22 bp, Homo sapiens
ggcctctggttcgtggtgacct

SEQ ID NO: 7243483 - DNA, 22 bp, Homo sapiens
ggcctctggttcgtggtgacct

SEQ ID NO: 7243484 - DNA, 21 bp, Homo sapiens
ggcctctgtcatcctgggaag

SEQ ID NO: 7243485 - DNA, 22 bp, Homo sapiens
ggcctctgtttggagccaggat

SEQ ID NO: 7243486 - DNA, 22 bp, Homo sapiens
ggcctctgtttggagccaggat

SEQ ID NO: 7243487 - DNA, 22 bp, Homo sapiens
ggcctcagtgggccgctgcagg

SEQ ID NO: 7243488 - DNA, 18 bp, Homo sapiens
ggcctcagcctggccgga

SEQ ID NO: 7243489 - DNA, 18 bp, Homo sapiens
ggcctcagcctggccgga

SEQ ID NO: 7243490 - DNA, 21 bp, Homo sapiens
ggcctcagccacctggctctg

SEQ ID NO: 7243491 - DNA, 22 bp, Homo sapiens
ggcctcagaggaggtgtgagtc

SEQ ID NO: 7243492 - DNA, 22 bp, Homo sapiens
ggcctcagagaaggctgtgcgg

SEQ ID NO: 7243493 - DNA, 22 bp, Homo sapiens
ggcctcagaggaggtgtgagtc

SEQ ID NO: 7243494 - DNA, 22 bp, Homo sapiens
ggccatgctgttgcctgctggt

SEQ ID NO: 7243495 - DNA, 22 bp, Homo sapiens
ggccatgctcgtggctggactg

SEQ ID NO: 7243496 - DNA, 22 bp, Homo sapiens
ggccttttgtgtccttgcccgt

SEQ ID NO: 7243497 - DNA, 22 bp, Homo sapiens
ggccttgtggaaggtatgagca

SEQ ID NO: 7243498 - DNA, 21 bp, Homo sapiens
ggccttgtaacagagttgacc

SEQ ID NO: 7243499 - DNA, 22 bp, Homo sapiens
ggaagacaagcagtggctgagc

SEQ ID NO: 7243500 - DNA, 22 bp, Homo sapiens
ggacaaagcctggtggcaggtg

SEQ ID NO: 7243501 - DNA, 18 bp, Homo sapiens
ggacacagataggtacag

SEQ ID NO: 7243502 - DNA, 22 bp, Homo sapiens
ggaagagtaacaggaggtggaa

SEQ ID NO: 7243503 - DNA, 22 bp, Homo sapiens
ggaagagtaacaggaggtggaa

SEQ ID NO: 7243504 - DNA, 22 bp, Homo sapiens
ggaagagggaaccacgactgta

SEQ ID NO: 7243505 - DNA, 22 bp, Homo sapiens
ggaagaggctggtagtgcccgt

SEQ ID NO: 7243506 - DNA, 22 bp, Homo sapiens
ggaagcaggaggctggggtaaa

SEQ ID NO: 7243507 - DNA, 22 bp, Homo sapiens
ggaatccacgaatgtgcatttc

SEQ ID NO: 7243508 - DNA, 22 bp, Homo sapiens
ggaatcatgccatttatgacgt

SEQ ID NO: 7243509 - DNA, 22 bp, Homo sapiens
ggacagtgtgggccatctcact

SEQ ID NO: 7243510 - DNA, 22 bp, Homo sapiens
ggacagtgcgagacacagtaac

SEQ ID NO: 7243511 - DNA, 22 bp, Homo sapiens
ggacagggttggggcatataaa

SEQ ID NO: 7243512 - DNA, 22 bp, Homo sapiens
ggacagggtaagtactagtgtg

SEQ ID NO: 7243513 - DNA, 22 bp, Homo sapiens
ggacagggtaagtactagtgtg

SEQ ID NO: 7243514 - DNA, 22 bp, Homo sapiens
ggaccaggctgagcacctgcct

SEQ ID NO: 7243515 - DNA, 22 bp, Homo sapiens
ggaccaggccagcctccctgcg

SEQ ID NO: 7243516 - DNA, 22 bp, Homo sapiens
ggagagaaattgaggtagcaag

SEQ ID NO: 7243517 - DNA, 22 bp, Homo sapiens
ggagagaattcagcttaagatt

SEQ ID NO: 7243518 - DNA, 22 bp, Homo sapiens
ggagacatattccagagctggg

SEQ ID NO: 7243519 - DNA, 22 bp, Homo sapiens
ggagactacctagcaggctgtt

SEQ ID NO: 7243520 - DNA, 22 bp, Homo sapiens
ggagacagtgacttagagactg

SEQ ID NO: 7243521 - DNA, 22 bp, Homo sapiens
ggagacagtgacttagagactg

SEQ ID NO: 7243522 - DNA, 22 bp, Homo sapiens
ggagacagtgacttagagactg

SEQ ID NO: 7243523 - DNA, 22 bp, Homo sapiens
ggagcagggaattacagcgcag

SEQ ID NO: 7243524 - DNA, 22 bp, Homo sapiens
ggagagagacctccatgcccag

SEQ ID NO: 7243525 - DNA, 22 bp, Homo sapiens
ggagagagacctccatgcccag

SEQ ID NO: 7243526 - DNA, 22 bp, Homo sapiens
ggagcaggcagggccgtgtctg

SEQ ID NO: 7243527 - DNA, 22 bp, Homo sapiens
gctttatgtgagtagcactgtc

SEQ ID NO: 7243528 - DNA, 22 bp, Homo sapiens
gcttgctggtgcctgcaggctc

SEQ ID NO: 7243529 - DNA, 20 bp, Homo sapiens
gcttcttttctggcccatga

SEQ ID NO: 7243530 - DNA, 19 bp, Homo sapiens
gctgtgtcatttcttagga

SEQ ID NO: 7243531 - DNA, 22 bp, Homo sapiens
gctgtgtcagaaactctgggga

SEQ ID NO: 7243532 - DNA, 22 bp, Homo sapiens
gctgtgtccaggtgggggtgac

SEQ ID NO: 7243533 - DNA, 22 bp, Homo sapiens
gctgtgtcctcacacagccttt

SEQ ID NO: 7243534 - DNA, 22 bp, Homo sapiens
gctgtgtctgttttacgtcaag

SEQ ID NO: 7243535 - DNA, 22 bp, Homo sapiens
gcttctggtgaggcctcaggaa

SEQ ID NO: 7243536 - DNA, 22 bp, Homo sapiens
gctggggcctctgtgaggttaa

SEQ ID NO: 7243537 - DNA, 22 bp, Homo sapiens
gctggggaggcagcagagaaca

SEQ ID NO: 7243538 - DNA, 22 bp, Homo sapiens
gctggggcctctgtgaggttaa

SEQ ID NO: 7243539 - DNA, 22 bp, Homo sapiens
gctggggcctgaacagtcagct

SEQ ID NO: 7243540 - DNA, 19 bp, Homo sapiens
gctggggcctgaccagaca

SEQ ID NO: 7243541 - DNA, 22 bp, Homo sapiens
gctgtgggtgctggctccaccc

SEQ ID NO: 7243542 - DNA, 22 bp, Homo sapiens
gctgtgggtgctggctccaccc

SEQ ID NO: 7243543 - DNA, 22 bp, Homo sapiens
gctgtgggtacaaatacacaat

SEQ ID NO: 7243544 - DNA, 22 bp, Homo sapiens
gctgtgggtccggaccccacgg

SEQ ID NO: 7243545 - DNA, 22 bp, Homo sapiens
gctgtgggtttccaatcctgga

SEQ ID NO: 7243546 - DNA, 22 bp, Homo sapiens
gctgtgggttcctggcatttga

SEQ ID NO: 7243547 - DNA, 22 bp, Homo sapiens
gctgtggggagagaacacacaa

SEQ ID NO: 7243548 - DNA, 22 bp, Homo sapiens
gctgtgggccatggccaagtga

SEQ ID NO: 7243549 - DNA, 22 bp, Homo sapiens
gctgtgggtaaacgctgagggt

SEQ ID NO: 7243550 - DNA, 22 bp, Homo sapiens
gctgtgggccacacggctgagt

SEQ ID NO: 7243551 - DNA, 22 bp, Homo sapiens
gctgtgggacaggtccagccag

SEQ ID NO: 7243552 - DNA, 22 bp, Homo sapiens
gctgtgggccacacggctgagt

SEQ ID NO: 7243553 - DNA, 22 bp, Homo sapiens
gctgtggcggcagcagctggtg

SEQ ID NO: 7243554 - DNA, 19 bp, Homo sapiens
gctgtgggacagcagggtg

SEQ ID NO: 7243555 - DNA, 22 bp, Homo sapiens
gctggagaaactgcagctgagg

SEQ ID NO: 7243556 - DNA, 22 bp, Homo sapiens
gctggctggcacgttcgcacgt

SEQ ID NO: 7243557 - DNA, 22 bp, Homo sapiens
gctggctggagtgagctaccct

SEQ ID NO: 7243558 - DNA, 22 bp, Homo sapiens
gctggctgtgggctccacgctc

SEQ ID NO: 7243559 - DNA, 22 bp, Homo sapiens
gctggctggcgggtgcgtcctc

SEQ ID NO: 7243560 - DNA, 22 bp, Homo sapiens
gctggctgttggaggtacctgc

SEQ ID NO: 7243561 - DNA, 19 bp, Homo sapiens
gctgctcctggctgaccac

SEQ ID NO: 7243562 - DNA, 21 bp, Homo sapiens
gctgctcgagatccagtgctt

SEQ ID NO: 7243563 - DNA, 22 bp, Homo sapiens
gctgctccagtgttctgtctag

SEQ ID NO: 7243564 - DNA, 22 bp, Homo sapiens
gctgctccagctgtgctgcaga

SEQ ID NO: 7243565 - DNA, 22 bp, Homo sapiens
gctgctccgcagagtgtgtgtg

SEQ ID NO: 7243566 - DNA, 22 bp, Homo sapiens
gctgctcctgagtcccgcgcgc

SEQ ID NO: 7243567 - DNA, 22 bp, Homo sapiens
gctgctccgtctgagctctggt

SEQ ID NO: 7243568 - DNA, 22 bp, Homo sapiens
gctgccctgtggtccagcaggt

SEQ ID NO: 7243569 - DNA, 22 bp, Homo sapiens
gctgccctgtggtagagggtgg

SEQ ID NO: 7243570 - DNA, 22 bp, Homo sapiens
gctgccctgtctgcagcaggac

SEQ ID NO: 7243571 - DNA, 18 bp, Homo sapiens
gctgccctagctcccctc

SEQ ID NO: 7243572 - DNA, 22 bp, Homo sapiens
gctgccctagaagtacagagag

SEQ ID NO: 7243573 - DNA, 22 bp, Homo sapiens
gctgccctacccgaggcactct

SEQ ID NO: 7243574 - DNA, 22 bp, Homo sapiens
gctgccctacccgaggcactct

SEQ ID NO: 7243575 - DNA, 22 bp, Homo sapiens
gctgccctaatatcacatgtta

SEQ ID NO: 7243576 - DNA, 22 bp, Homo sapiens
gctgccccccggactcggcggg

SEQ ID NO: 7243577 - DNA, 22 bp, Homo sapiens
gctgccccagctgggggctgga

SEQ ID NO: 7243578 - DNA, 22 bp, Homo sapiens
gctgcctcaggcacctcctggc

SEQ ID NO: 7243579 - DNA, 22 bp, Homo sapiens
gctgcccttcgtcatctataaa

SEQ ID NO: 7243580 - DNA, 22 bp, Homo sapiens
gctgccctgtggtccagcaggt

SEQ ID NO: 7243581 - DNA, 22 bp, Homo sapiens
gctgccctgtttagccagggtt

SEQ ID NO: 7243582 - DNA, 22 bp, Homo sapiens
gctgcccagttctgctgctgcc

SEQ ID NO: 7243583 - DNA, 22 bp, Homo sapiens
gctgcccagtgtgctcatgcag

SEQ ID NO: 7243584 - DNA, 22 bp, Homo sapiens
gctgcccaggagaggtggggct

SEQ ID NO: 7243585 - DNA, 22 bp, Homo sapiens
gctgcccagcaggccccagggg

SEQ ID NO: 7243586 - DNA, 22 bp, Homo sapiens
gctgagggccgcatagggtcat

SEQ ID NO: 7243587 - DNA, 22 bp, Homo sapiens
gctgagggccgcatagggtcat

SEQ ID NO: 7243588 - DNA, 22 bp, Homo sapiens
gctgcccaattacagggccgtg

SEQ ID NO: 7243589 - DNA, 22 bp, Homo sapiens
gctgagggcatgtgtggcgact

SEQ ID NO: 7243590 - DNA, 22 bp, Homo sapiens
gctgagggcatgtgtggcgact

SEQ ID NO: 7243591 - DNA, 22 bp, Homo sapiens
gctgagggatagctgctcactg

SEQ ID NO: 7243592 - DNA, 22 bp, Homo sapiens
gctgagggcagcctcctaggtc

SEQ ID NO: 7243593 - DNA, 22 bp, Homo sapiens
gctctgggccatcctggccggg

SEQ ID NO: 7243594 - DNA, 22 bp, Homo sapiens
gctctggggatgcttctgccgt

SEQ ID NO: 7243595 - DNA, 22 bp, Homo sapiens
gctctggggttggaaagtgatc

SEQ ID NO: 7243596 - DNA, 22 bp, Homo sapiens
gctctgggctgccctctggaca

SEQ ID NO: 7243597 - DNA, 22 bp, Homo sapiens
gctccgggggttccagatcatc

SEQ ID NO: 7243598 - DNA, 22 bp, Homo sapiens
gctccggcttggtgtgcagggt

SEQ ID NO: 7243599 - DNA, 22 bp, Homo sapiens
gctcctccctgtgcagacccag

SEQ ID NO: 7243600 - DNA, 22 bp, Homo sapiens
gctcctccaatatggactcctc

SEQ ID NO: 7243601 - DNA, 22 bp, Homo sapiens
gctctgggaattcagaaagcct

SEQ ID NO: 7243602 - DNA, 22 bp, Homo sapiens
gctctgggaactgactgccttc

SEQ ID NO: 7243603 - DNA, 22 bp, Homo sapiens
gctgagaatcaagatggagagg

SEQ ID NO: 7243604 - DNA, 22 bp, Homo sapiens
gctgagactggcagcaggaagt

SEQ ID NO: 7243605 - DNA, 22 bp, Homo sapiens
gctgagagatcaaggcaggatt

SEQ ID NO: 7243606 - DNA, 22 bp, Homo sapiens
gctgagagaaaagtgaggttct

SEQ ID NO: 7243607 - DNA, 22 bp, Homo sapiens
gctgagagcaaagcatgtctag

SEQ ID NO: 7243608 - DNA, 22 bp, Homo sapiens
gctgagagcggccagctgggaa

SEQ ID NO: 7243609 - DNA, 17 bp, Homo sapiens
gctgagaggcagcacag

SEQ ID NO: 7243610 - DNA, 17 bp, Homo sapiens
gctgagaggcagcacag

SEQ ID NO: 7243611 - DNA, 22 bp, Homo sapiens
gctgagaggcagccagaccctc

SEQ ID NO: 7243612 - DNA, 22 bp, Homo sapiens
gctgagagtccaggaaaacatc

SEQ ID NO: 7243613 - DNA, 22 bp, Homo sapiens
gctgagagtgagcactggatat

SEQ ID NO: 7243614 - DNA, 22 bp, Homo sapiens
gctgaggccaggccccaccgga

SEQ ID NO: 7243615 - DNA, 22 bp, Homo sapiens
gctgagagtgggtgcagtgctt

SEQ ID NO: 7243616 - DNA, 22 bp, Homo sapiens
gctgaggccccagggtgatggg

SEQ ID NO: 7243617 - DNA, 22 bp, Homo sapiens
gctgaggcctcagaaggctgag

SEQ ID NO: 7243618 - DNA, 22 bp, Homo sapiens
gctgaggcggaaggattgctag

SEQ ID NO: 7243619 - DNA, 22 bp, Homo sapiens
gctgaggctcaagtcatgggtc

SEQ ID NO: 7243620 - DNA, 22 bp, Homo sapiens
gctgaggctcaatccccttctg

SEQ ID NO: 7243621 - DNA, 22 bp, Homo sapiens
gctgaggctgggagcagcctgt

SEQ ID NO: 7243622 - DNA, 22 bp, Homo sapiens
gctgaggcttagctaaaaattt

SEQ ID NO: 7243623 - DNA, 22 bp, Homo sapiens
gctgagggaggctgaactgagt

SEQ ID NO: 7243624 - DNA, 22 bp, Homo sapiens
gctgagggaccatgtttcagga

SEQ ID NO: 7243625 - DNA, 23 bp, Homo sapiens
gcgtccggcctctctcgctcccg

SEQ ID NO: 7243626 - DNA, 22 bp, Homo sapiens
gcggtgggggaaaggagcggtt

SEQ ID NO: 7243627 - DNA, 22 bp, Homo sapiens
gcggtggggaaaggaggtgctg

SEQ ID NO: 7243628 - DNA, 22 bp, Homo sapiens
gcggtggatggcccccggagag

SEQ ID NO: 7243629 - DNA, 22 bp, Homo sapiens
gcgggttttgtgaatgtaggtt

SEQ ID NO: 7243630 - DNA, 22 bp, Homo sapiens
gcggtggggaaaggaggtgctg

SEQ ID NO: 7243631 - DNA, 22 bp, Homo sapiens
gcggtgggggaaaggagcggtt

SEQ ID NO: 7243632 - DNA, 22 bp, Homo sapiens
gctacaggtgacagcctctgca

SEQ ID NO: 7243633 - DNA, 18 bp, Homo sapiens
gcgtggagcgggctcggt

SEQ ID NO: 7243634 - DNA, 18 bp, Homo sapiens
gcgtggagcgggctcggt

SEQ ID NO: 7243635 - DNA, 22 bp, Homo sapiens
gcgtggagacaactctggggtg

SEQ ID NO: 7243636 - DNA, 22 bp, Homo sapiens
gcgtggagacaactctggggtg

SEQ ID NO: 7243637 - DNA, 18 bp, Homo sapiens
gcgtggagcgggctcggt

SEQ ID NO: 7243638 - DNA, 17 bp, Homo sapiens
gcgtggagttggtgcgc

SEQ ID NO: 7243639 - DNA, 22 bp, Homo sapiens
gcgtggcttagagtggggtacc

SEQ ID NO: 7243640 - DNA, 22 bp, Homo sapiens
gcgtggggcagcccagggcttc

SEQ ID NO: 7243641 - DNA, 22 bp, Homo sapiens
gcgtgggctggactgggatgaa

SEQ ID NO: 7243642 - DNA, 22 bp, Homo sapiens
gcgggttgaagggcgcatcgaa

SEQ ID NO: 7243643 - DNA, 22 bp, Homo sapiens
gcgggtttgatgtgctaatgag

SEQ ID NO: 7243644 - DNA, 22 bp, Homo sapiens
gcgggtggtgtccctgctcctc

SEQ ID NO: 7243645 - DNA, 22 bp, Homo sapiens
gcgggtggatcatgaggtcagg

SEQ ID NO: 7243646 - DNA, 22 bp, Homo sapiens
gcgggtggaacggctccacgtg

SEQ ID NO: 7243647 - DNA, 22 bp, Homo sapiens
gcggggggcagcagtcgctcag

SEQ ID NO: 7243648 - DNA, 22 bp, Homo sapiens
gccttttgaaatagaaatctga

SEQ ID NO: 7243649 - DNA, 22 bp, Homo sapiens
gcctctggggcagctgagtcat

SEQ ID NO: 7243650 - DNA, 22 bp, Homo sapiens
gcctctgggggctcagacctgt

SEQ ID NO: 7243651 - DNA, 22 bp, Homo sapiens
gcctctgtaggagtgagagcat

SEQ ID NO: 7243652 - DNA, 20 bp, Homo sapiens
gcctgagctccgcctcctgt

SEQ ID NO: 7243653 - DNA, 22 bp, Homo sapiens
gccttggctgccaagctgctga

SEQ ID NO: 7243654 - DNA, 22 bp, Homo sapiens
gccttggctccagccctttccg

SEQ ID NO: 7243655 - DNA, 22 bp, Homo sapiens
gccttggccaacaccttgcaaa

SEQ ID NO: 7243656 - DNA, 22 bp, Homo sapiens
gccttggccttcctaggcctga

SEQ ID NO: 7243657 - DNA, 22 bp, Homo sapiens
gctccaggtgaatcctctcacc

SEQ ID NO: 7243658 - DNA, 19 bp, Homo sapiens
gctcagagtccccctgcgg

SEQ ID NO: 7243659 - DNA, 22 bp, Homo sapiens
gctccaggaggctcccgcgtct

SEQ ID NO: 7243660 - DNA, 22 bp, Homo sapiens
gctcagcgtggacctggagctt

SEQ ID NO: 7243661 - DNA, 23 bp, Homo sapiens
gctcagcctcagcaggcccagga

SEQ ID NO: 7243662 - DNA, 22 bp, Homo sapiens
gctcagccgaacttcagagcag

SEQ ID NO: 7243663 - DNA, 22 bp, Homo sapiens
gctcagagttaattggatgggt

SEQ ID NO: 7243664 - DNA, 22 bp, Homo sapiens
gcagggacaactgtgcacctga

SEQ ID NO: 7243665 - DNA, 18 bp, Homo sapiens
gcagggacacagggtcac

SEQ ID NO: 7243666 - DNA, 22 bp, Homo sapiens
gcagggacatcttcagatcact

SEQ ID NO: 7243667 - DNA, 22 bp, Homo sapiens
gcagggaccaaaagaggcagta

SEQ ID NO: 7243668 - DNA, 22 bp, Homo sapiens
gcaggcagaggtggaggagaca

SEQ ID NO: 7243669 - DNA, 22 bp, Homo sapiens
gcaggcagatcacctgtcagga

SEQ ID NO: 7243670 - DNA, 22 bp, Homo sapiens
gcaggcaggtggcatcttgtga

SEQ ID NO: 7243671 - DNA, 21 bp, Homo sapiens
gcagggacaaagcttcaggag

SEQ ID NO: 7243672 - DNA, 22 bp, Homo sapiens
gcaggaagaggctcgaagcccc

SEQ ID NO: 7243673 - DNA, 22 bp, Homo sapiens
gcagcccttcaggtgaggggca

SEQ ID NO: 7243674 - DNA, 22 bp, Homo sapiens
gcagccctttctgggcagggga

SEQ ID NO: 7243675 - DNA, 22 bp, Homo sapiens
gcagatggatgtggacggcgcc

SEQ ID NO: 7243676 - DNA, 22 bp, Homo sapiens
gcagatggatcacctgaggtcg

SEQ ID NO: 7243677 - DNA, 23 bp, Homo sapiens
gcagatggccccagagtgctgcc

SEQ ID NO: 7243678 - DNA, 22 bp, Homo sapiens
gcagatgggagccccaggggag

SEQ ID NO: 7243679 - DNA, 22 bp, Homo sapiens
gcagaggatcaggctctggaaa

SEQ ID NO: 7243680 - DNA, 22 bp, Homo sapiens
gcagaggatcaggctctggaaa

SEQ ID NO: 7243681 - DNA, 22 bp, Homo sapiens
gcagaggatagcatatgaacct

SEQ ID NO: 7243682 - DNA, 22 bp, Homo sapiens
gcagaggatcaggctctggaaa

SEQ ID NO: 7243683 - DNA, 22 bp, Homo sapiens
gcagaggaggacccaggaatta

SEQ ID NO: 7243684 - DNA, 22 bp, Homo sapiens
gcagaggatagcatatgaacct

SEQ ID NO: 7243685 - DNA, 22 bp, Homo sapiens
gcagaggagtgattatgccgtg

SEQ ID NO: 7243686 - DNA, 20 bp, Homo sapiens
gcagagtgtgagagggtgaa

SEQ ID NO: 7243687 - DNA, 19 bp, Homo sapiens
gcagagtggggtggagggt

SEQ ID NO: 7243688 - DNA, 22 bp, Homo sapiens
gcagaggtgagaagggcctccc

SEQ ID NO: 7243689 - DNA, 22 bp, Homo sapiens
gcagagggggtacttcggccct

SEQ ID NO: 7243690 - DNA, 22 bp, Homo sapiens
gcagaggggaagctgaggaatt

SEQ ID NO: 7243691 - DNA, 22 bp, Homo sapiens
gcagaggccaggccaccagcaa

SEQ ID NO: 7243692 - DNA, 22 bp, Homo sapiens
gcagagggtcctgtgccagcag

SEQ ID NO: 7243693 - DNA, 22 bp, Homo sapiens
gcagagggggtacttcggccct

SEQ ID NO: 7243694 - DNA, 22 bp, Homo sapiens
gcacacagaacatttggatcct

SEQ ID NO: 7243695 - DNA, 22 bp, Homo sapiens
gcacacagtagggattcaatga

SEQ ID NO: 7243696 - DNA, 19 bp, Homo sapiens
gcacaccctgcaccaccat

SEQ ID NO: 7243697 - DNA, 22 bp, Homo sapiens
gcacaccctctcaccagcactg

SEQ ID NO: 7243698 - DNA, 22 bp, Homo sapiens
gcacaggtaatccgaatcattc

SEQ ID NO: 7243699 - DNA, 22 bp, Homo sapiens
gcacagggctgccaggcggctt

SEQ ID NO: 7243700 - DNA, 22 bp, Homo sapiens
gcacagggctgccaggcggctt

SEQ ID NO: 7243701 - DNA, 22 bp, Homo sapiens
gcacagggctgccaggcggctt

SEQ ID NO: 7243702 - DNA, 22 bp, Homo sapiens
gaggccaggaggatctctctaa

SEQ ID NO: 7243703 - DNA, 22 bp, Homo sapiens
gaggccaggaggatctctctaa

SEQ ID NO: 7243704 - DNA, 22 bp, Homo sapiens
gaggcccagcagcgcaggtctt

SEQ ID NO: 7243705 - DNA, 22 bp, Homo sapiens
gcccaggaaataaaagtgggct

SEQ ID NO: 7243706 - DNA, 22 bp, Homo sapiens
gcccaggaaagatagggcctca

SEQ ID NO: 7243707 - DNA, 22 bp, Homo sapiens
gcccaggaaatgccccgtggtg

SEQ ID NO: 7243708 - DNA, 17 bp, Homo sapiens
gcccaggaaggacggcc

SEQ ID NO: 7243709 - DNA, 22 bp, Homo sapiens
gcccaggaagtgactcagatgt

SEQ ID NO: 7243710 - DNA, 22 bp, Homo sapiens
gcccaggaagttgaggctgccg

SEQ ID NO: 7243711 - DNA, 16 bp, Homo sapiens
gcccaggacgggaggc

SEQ ID NO: 7243712 - DNA, 22 bp, Homo sapiens
gccccactttcctaggcagtat

SEQ ID NO: 7243713 - DNA, 22 bp, Homo sapiens
gccccactttcctaggcagtat

SEQ ID NO: 7243714 - DNA, 22 bp, Homo sapiens
gccccactgtggaacctaagtc

SEQ ID NO: 7243715 - DNA, 22 bp, Homo sapiens
gccccactgtggaacctaagtc

SEQ ID NO: 7243716 - DNA, 22 bp, Homo sapiens
gccccacagcctgcggtctcag

SEQ ID NO: 7243717 - DNA, 22 bp, Homo sapiens
gcccatggtcagggaggcaggg

SEQ ID NO: 7243718 - DNA, 22 bp, Homo sapiens
gcccaggagaggccagggctga

SEQ ID NO: 7243719 - DNA, 22 bp, Homo sapiens
gcccaggagcctggagatgtgt

SEQ ID NO: 7243720 - DNA, 22 bp, Homo sapiens
gcccatggcagaactgtgagca

SEQ ID NO: 7243721 - DNA, 22 bp, Homo sapiens
gcccagcctccaagctccaagg

SEQ ID NO: 7243722 - DNA, 22 bp, Homo sapiens
gcccagccctgaggtcacagct

SEQ ID NO: 7243723 - DNA, 22 bp, Homo sapiens
gcccagcactcctctctgacat

SEQ ID NO: 7243724 - DNA, 22 bp, Homo sapiens
gcccagcactaaaagctttgct

SEQ ID NO: 7243725 - DNA, 22 bp, Homo sapiens
gcccagcacctctctcagggtt

SEQ ID NO: 7243726 - DNA, 22 bp, Homo sapiens
gcccagcagctccacttggctt

SEQ ID NO: 7243727 - DNA, 22 bp, Homo sapiens
gcccagcagatctcagtgtctc

SEQ ID NO: 7243728 - DNA, 22 bp, Homo sapiens
gcccagcagctggtggagaagg

SEQ ID NO: 7243729 - DNA, 22 bp, Homo sapiens
gcccagcccctgggtggacgtg

SEQ ID NO: 7243730 - DNA, 22 bp, Homo sapiens
gccagggtgtgcagggacagga

SEQ ID NO: 7243731 - DNA, 22 bp, Homo sapiens
gcccagcacattgctgaggacc

SEQ ID NO: 7243732 - DNA, 22 bp, Homo sapiens
gcccagcacattgctgaggacc

SEQ ID NO: 7243733 - DNA, 22 bp, Homo sapiens
gcccagcacatctggccttgaa

SEQ ID NO: 7243734 - DNA, 22 bp, Homo sapiens
gcccagcacagctggaagagtc

SEQ ID NO: 7243735 - DNA, 21 bp, Homo sapiens
gcccagcaaggtgagaaggcc

SEQ ID NO: 7243736 - DNA, 22 bp, Homo sapiens
gcctctggcttctgcatcagtg

SEQ ID NO: 7243737 - DNA, 22 bp, Homo sapiens
gcctctgggctctgcccctggc

SEQ ID NO: 7243738 - DNA, 22 bp, Homo sapiens
gcctcctgacttacactgagct

SEQ ID NO: 7243739 - DNA, 22 bp, Homo sapiens
gcctcctgcccagatgagtgat

SEQ ID NO: 7243740 - DNA, 22 bp, Homo sapiens
gcctcctcacaatgtacccacg

SEQ ID NO: 7243741 - DNA, 22 bp, Homo sapiens
gcctcctatggggccatcgcag

SEQ ID NO: 7243742 - DNA, 22 bp, Homo sapiens
gcctcctagagctccagggact

SEQ ID NO: 7243743 - DNA, 22 bp, Homo sapiens
gcctcctaccacaccctcagtc

SEQ ID NO: 7243744 - DNA, 22 bp, Homo sapiens
gccctggatgtacaggcatgtt

SEQ ID NO: 7243745 - DNA, 22 bp, Homo sapiens
gccctgggattgggtggaggct

SEQ ID NO: 7243746 - DNA, 22 bp, Homo sapiens
gccctgggcaaggttctggcca

SEQ ID NO: 7243747 - DNA, 22 bp, Homo sapiens
gccccagctctgccacaactag

SEQ ID NO: 7243748 - DNA, 22 bp, Homo sapiens
gccccagcgtggctgtgttagg

SEQ ID NO: 7243749 - DNA, 22 bp, Homo sapiens
gccccagcctgggaactggagg

SEQ ID NO: 7243750 - DNA, 22 bp, Homo sapiens
gccccagcctcccgagtagctg

SEQ ID NO: 7243751 - DNA, 22 bp, Homo sapiens
gccccagcctagttttctttca

SEQ ID NO: 7243752 - DNA, 22 bp, Homo sapiens
gccccagccctgtggaccatgg

SEQ ID NO: 7243753 - DNA, 22 bp, Homo sapiens
gccccagccaaggtgacacgaa

SEQ ID NO: 7243754 - DNA, 22 bp, Homo sapiens
gccccagccaaggtgacacgaa

SEQ ID NO: 7243755 - DNA, 22 bp, Homo sapiens
gccccagcagcaatgcggttga

SEQ ID NO: 7243756 - DNA, 23 bp, Homo sapiens
gcagtggaatgtctctgtttgga

SEQ ID NO: 7243757 - DNA, 17 bp, Homo sapiens
gcagtggaggggtagtt

SEQ ID NO: 7243758 - DNA, 22 bp, Homo sapiens
gcagtggatccaatggtatctt

SEQ ID NO: 7243759 - DNA, 22 bp, Homo sapiens
gcagtggatggccagcaggggc

SEQ ID NO: 7243760 - DNA, 22 bp, Homo sapiens
gcaggggagtggatgatggatt

SEQ ID NO: 7243761 - DNA, 22 bp, Homo sapiens
gcaggggagtggcaggcccgga

SEQ ID NO: 7243762 - DNA, 22 bp, Homo sapiens
gcagtgaatctggcaagaattt

SEQ ID NO: 7243763 - DNA, 22 bp, Homo sapiens
gcagtgattggatcagagatgg

SEQ ID NO: 7243764 - DNA, 22 bp, Homo sapiens
gcagtggaagcctctttaagca

SEQ ID NO: 7243765 - DNA, 22 bp, Homo sapiens
gcagtgggaaggttggcacatg

SEQ ID NO: 7243766 - DNA, 22 bp, Homo sapiens
gcagtggctaggagtctggcgt

SEQ ID NO: 7243767 - DNA, 22 bp, Homo sapiens
gccacatccttcagaaagcttt

SEQ ID NO: 7243768 - DNA, 22 bp, Homo sapiens
gccacatgcaattgcagcacgt

SEQ ID NO: 7243769 - DNA, 22 bp, Homo sapiens
gccacatgtcatgtgctcagta

SEQ ID NO: 7243770 - DNA, 22 bp, Homo sapiens
gccaccagcagaaaaggggcca

SEQ ID NO: 7243771 - DNA, 22 bp, Homo sapiens
gccaccaggagcccagtccaaa

SEQ ID NO: 7243772 - DNA, 22 bp, Homo sapiens
gccaccagggggctccagtgag

SEQ ID NO: 7243773 - DNA, 22 bp, Homo sapiens
gccaccagggggtgcaaggtcc

SEQ ID NO: 7243774 - DNA, 22 bp, Homo sapiens
gccaccagtgggggcctgggca

SEQ ID NO: 7243775 - DNA, 22 bp, Homo sapiens
gcatgcatttcactaggtatgt

SEQ ID NO: 7243776 - DNA, 22 bp, Homo sapiens
gcatgcattacatgggatatgc

SEQ ID NO: 7243777 - DNA, 22 bp, Homo sapiens
gcatgcatgtgtgcagacagtc

SEQ ID NO: 7243778 - DNA, 22 bp, Homo sapiens
gcatgcatggtttgtgactgtg

SEQ ID NO: 7243779 - DNA, 22 bp, Homo sapiens
gcatgcatgatgttggcagtgg

SEQ ID NO: 7243780 - DNA, 22 bp, Homo sapiens
gcatgcatctagatatgcagac

SEQ ID NO: 7243781 - DNA, 22 bp, Homo sapiens
gcatgcattttctgagagtcag

SEQ ID NO: 7243782 - DNA, 22 bp, Homo sapiens
gcatgcatttgtacttgatttt

SEQ ID NO: 7243783 - DNA, 22 bp, Homo sapiens
gcatgcatttccattctcacat

SEQ ID NO: 7243784 - DNA, 22 bp, Homo sapiens
gcatggctattctaactcacat

SEQ ID NO: 7243785 - DNA, 22 bp, Homo sapiens
gcatggctgttgaagtcagctc

SEQ ID NO: 7243786 - DNA, 22 bp, Homo sapiens
gccagggaacccaagggcctca

SEQ ID NO: 7243787 - DNA, 22 bp, Homo sapiens
gccagggagtctgggccacaga

SEQ ID NO: 7243788 - DNA, 22 bp, Homo sapiens
gccagggctcgcggtccctcgt

SEQ ID NO: 7243789 - DNA, 22 bp, Homo sapiens
gccagggctcgcggtccctcgt

SEQ ID NO: 7243790 - DNA, 22 bp, Homo sapiens
gccagctgaaatttcagttctg

SEQ ID NO: 7243791 - DNA, 23 bp, Homo sapiens
gccagccttgctctcctgcagcc

SEQ ID NO: 7243792 - DNA, 22 bp, Homo sapiens
gccagccttctgtggcctgcaa

SEQ ID NO: 7243793 - DNA, 21 bp, Homo sapiens
gccagcctgtttacctgtggt

SEQ ID NO: 7243794 - DNA, 21 bp, Homo sapiens
gccagcctgtttacctgtggt

SEQ ID NO: 7243795 - DNA, 22 bp, Homo sapiens
gccagcctgtgggggctctgtg

SEQ ID NO: 7243796 - DNA, 22 bp, Homo sapiens
gccaccatgtattgacttggcc

SEQ ID NO: 7243797 - DNA, 22 bp, Homo sapiens
gccagcctgtgcttggccaggc

SEQ ID NO: 7243798 - DNA, 20 bp, Homo sapiens
gccagccctgacacaggagc

SEQ ID NO: 7243799 - DNA, 23 bp, Homo sapiens
gacaggtaagggttgggagaatc

SEQ ID NO: 7243800 - DNA, 22 bp, Homo sapiens
gacaggtaaagatggtggcagg

SEQ ID NO: 7243801 - DNA, 22 bp, Homo sapiens
gacagggtggctgatagggctc

SEQ ID NO: 7243802 - DNA, 22 bp, Homo sapiens
gacagggttgagtaaactggga

SEQ ID NO: 7243803 - DNA, 22 bp, Homo sapiens
gacagtatccaggtggtgaaga

SEQ ID NO: 7243804 - DNA, 22 bp, Homo sapiens
gacagtatttaactagttcatt

SEQ ID NO: 7243805 - DNA, 22 bp, Homo sapiens
gacaggcttcatcctcagagtt

SEQ ID NO: 7243806 - DNA, 22 bp, Homo sapiens
gacaggcttcctaagtgccaga

SEQ ID NO: 7243807 - DNA, 22 bp, Homo sapiens
gacaggctttctcaggatgagc

SEQ ID NO: 7243808 - DNA, 22 bp, Homo sapiens
gacaggggtccctctgggctgt

SEQ ID NO: 7243809 - DNA, 21 bp, Homo sapiens
gacaggggaagaagcaaggag

SEQ ID NO: 7243810 - DNA, 22 bp, Homo sapiens
gacagggctgtgggaggagcag

SEQ ID NO: 7243811 - DNA, 22 bp, Homo sapiens
gacagggctgtgggaggagcag

SEQ ID NO: 7243812 - DNA, 22 bp, Homo sapiens
gacacagacagttagaggtaat

SEQ ID NO: 7243813 - DNA, 22 bp, Homo sapiens
gacaggccaggggctgaggtgg

SEQ ID NO: 7243814 - DNA, 22 bp, Homo sapiens
gacaggccccctcaggactgat

SEQ ID NO: 7243815 - DNA, 22 bp, Homo sapiens
gacaggcccgagtagctgatga

SEQ ID NO: 7243816 - DNA, 17 bp, Homo sapiens
gacaggctcagtgacga

SEQ ID NO: 7243817 - DNA, 22 bp, Homo sapiens
gacacagaaggtcacatgttca

SEQ ID NO: 7243818 - DNA, 18 bp, Homo sapiens
gacacacttgcagtagtc

SEQ ID NO: 7243819 - DNA, 22 bp, Homo sapiens
gaatatgtgcatttatgagtgt

SEQ ID NO: 7243820 - DNA, 22 bp, Homo sapiens
gaatacaggcaggtggctgtgc

SEQ ID NO: 7243821 - DNA, 22 bp, Homo sapiens
gaatacaggcaggtggctgtgc

SEQ ID NO: 7243822 - DNA, 22 bp, Homo sapiens
gaatacaggcaggtggctgtgc

SEQ ID NO: 7243823 - DNA, 19 bp, Homo sapiens
gaatacagataataagcag

SEQ ID NO: 7243824 - DNA, 19 bp, Homo sapiens
gaatacagataataagcag

SEQ ID NO: 7243825 - DNA, 23 bp, Homo sapiens
gaatacagagataaatagaacac

SEQ ID NO: 7243826 - DNA, 22 bp, Homo sapiens
gaagttttagtcaaaatgtaga

SEQ ID NO: 7243827 - DNA, 22 bp, Homo sapiens
gaagtttattttacacatccat

SEQ ID NO: 7243828 - DNA, 22 bp, Homo sapiens
gaagtttagagtttggagtcct

SEQ ID NO: 7243829 - DNA, 22 bp, Homo sapiens
gaagtttagagtgttgtaattt

SEQ ID NO: 7243830 - DNA, 22 bp, Homo sapiens
gaagtttatttcaatctattca

SEQ ID NO: 7243831 - DNA, 22 bp, Homo sapiens
gaagtttaggttcttatgttta

SEQ ID NO: 7243832 - DNA, 22 bp, Homo sapiens
gaagtttatggtgcttgtaagg

SEQ ID NO: 7243833 - DNA, 22 bp, Homo sapiens
gaagcttagggataataggctg

SEQ ID NO: 7243834 - DNA, 22 bp, Homo sapiens
gaagttgatagagtacatgatt

SEQ ID NO: 7243835 - DNA, 22 bp, Homo sapiens
gaagtttagaagtgacaggttt

SEQ ID NO: 7243836 - DNA, 22 bp, Homo sapiens
gaagtttacctctgccttgctt

SEQ ID NO: 7243837 - DNA, 22 bp, Homo sapiens
gaagttgatagagtacatgatt

SEQ ID NO: 7243838 - DNA, 23 bp, Homo sapiens
gaagagttgcaaagacgggacag

SEQ ID NO: 7243839 - DNA, 22 bp, Homo sapiens
gaagataattcctacttataac

SEQ ID NO: 7243840 - DNA, 22 bp, Homo sapiens
gaagcccagcaaactgtgatca

SEQ ID NO: 7243841 - DNA, 22 bp, Homo sapiens
gaagccagtactgtgctctgca

SEQ ID NO: 7243842 - DNA, 22 bp, Homo sapiens
gaagccagtactgtgctctgca

SEQ ID NO: 7243843 - DNA, 22 bp, Homo sapiens
gaagccagtgtttgaagaattt

SEQ ID NO: 7243844 - DNA, 22 bp, Homo sapiens
gaagccagtgtttgaagaattt

SEQ ID NO: 7243845 - DNA, 22 bp, Homo sapiens
gaagccagccttgtctgcctct

SEQ ID NO: 7243846 - DNA, 22 bp, Homo sapiens
gaagccaggggcctgacaggca

SEQ ID NO: 7243847 - DNA, 22 bp, Homo sapiens
gaagccagcagtggagaaagga

SEQ ID NO: 7243848 - DNA, 22 bp, Homo sapiens
gaagccagcagtggagaaagga

SEQ ID NO: 7243849 - DNA, 22 bp, Homo sapiens
gaagagctccaaaaacagtgag

SEQ ID NO: 7243850 - DNA, 22 bp, Homo sapiens
gaagaggatgacaggagccggt

SEQ ID NO: 7243851 - DNA, 22 bp, Homo sapiens
gaagaggatgacaggagccggt

SEQ ID NO: 7243852 - DNA, 21 bp, Homo sapiens
gaacccagcagcagtgctctg

SEQ ID NO: 7243853 - DNA, 22 bp, Homo sapiens
gaacataactattgtgaatagt

SEQ ID NO: 7243854 - DNA, 22 bp, Homo sapiens
gaacagtttccctgtagaaaat

SEQ ID NO: 7243855 - DNA, 22 bp, Homo sapiens
gaacagtgccagcacacaataa

SEQ ID NO: 7243856 - DNA, 22 bp, Homo sapiens
gaacagggttgggtgagagagg

SEQ ID NO: 7243857 - DNA, 22 bp, Homo sapiens
gaacagggttgggtgagagagg

SEQ ID NO: 7243858 - DNA, 22 bp, Homo sapiens
gaaatgcaggcttggattcagc

SEQ ID NO: 7243859 - DNA, 22 bp, Homo sapiens
gaaatgcatggatcttggcaga

SEQ ID NO: 7243860 - DNA, 20 bp, Homo sapiens
gaaatgtacacattaccaca

SEQ ID NO: 7243861 - DNA, 22 bp, Homo sapiens
ctttcagatagtctgagatata

SEQ ID NO: 7243862 - DNA, 22 bp, Homo sapiens
gagatgacatgcctgttgtagg

SEQ ID NO: 7243863 - DNA, 22 bp, Homo sapiens
gagatgatctttcctgtagtcc

SEQ ID NO: 7243864 - DNA, 22 bp, Homo sapiens
gagagggagccagccaggaacc

SEQ ID NO: 7243865 - DNA, 22 bp, Homo sapiens
gagaggcttgtgtgaagaacaa

SEQ ID NO: 7243866 - DNA, 22 bp, Homo sapiens
gagaggcttaagggctgtgaag

SEQ ID NO: 7243867 - DNA, 22 bp, Homo sapiens
gagaggctggtaaagtctgaac

SEQ ID NO: 7243868 - DNA, 22 bp, Homo sapiens
gagaggctgtgtgccattgttg

SEQ ID NO: 7243869 - DNA, 22 bp, Homo sapiens
gagaggctgggttggagatcga

SEQ ID NO: 7243870 - DNA, 22 bp, Homo sapiens
gagaggctcagggacttgctga

SEQ ID NO: 7243871 - DNA, 22 bp, Homo sapiens
gagaggctatgaggttctgtgt

SEQ ID NO: 7243872 - DNA, 19 bp, Homo sapiens
gagaggcctgtgcttgaag

SEQ ID NO: 7243873 - DNA, 22 bp, Homo sapiens
gagaggcctgagaggctgcgga

SEQ ID NO: 7243874 - DNA, 18 bp, Homo sapiens
gagaggcccggctgtgcc

SEQ ID NO: 7243875 - DNA, 22 bp, Homo sapiens
gagaaggagctccttggggtct

SEQ ID NO: 7243876 - DNA, 22 bp, Homo sapiens
gacctctgaaggcagagcaggg

SEQ ID NO: 7243877 - DNA, 22 bp, Homo sapiens
gagaaggactacggaaaacaga

SEQ ID NO: 7243878 - DNA, 22 bp, Homo sapiens
gagaaggactacacatctggcc

SEQ ID NO: 7243879 - DNA, 22 bp, Homo sapiens
gacctcagctgtggggatgctg

SEQ ID NO: 7243880 - DNA, 22 bp, Homo sapiens
gacctcaggtttgtaatggaca

SEQ ID NO: 7243881 - DNA, 22 bp, Homo sapiens
gagaatgccttggaagaagtcc

SEQ ID NO: 7243882 - DNA, 22 bp, Homo sapiens
gagacaaaagttggagtgcaag

SEQ ID NO: 7243883 - DNA, 22 bp, Homo sapiens
gagaaggctgatccttggagtt

SEQ ID NO: 7243884 - DNA, 22 bp, Homo sapiens
gagaaggctggtcttaagtcga

SEQ ID NO: 7243885 - DNA, 22 bp, Homo sapiens
gagcagcaggtggctgtgatgg

SEQ ID NO: 7243886 - DNA, 22 bp, Homo sapiens
gagcagcaggccaggttgcagg

SEQ ID NO: 7243887 - DNA, 22 bp, Homo sapiens
gagcagcaggccaggttgcagg

SEQ ID NO: 7243888 - DNA, 18 bp, Homo sapiens
gagcagcaggatcaagaa

SEQ ID NO: 7243889 - DNA, 22 bp, Homo sapiens
gagcagcaggtggggctggctt

SEQ ID NO: 7243890 - DNA, 22 bp, Homo sapiens
gagcagcaggtggggctggctt

SEQ ID NO: 7243891 - DNA, 22 bp, Homo sapiens
gagcagcagttgttacaatgat

SEQ ID NO: 7243892 - DNA, 22 bp, Homo sapiens
gagcagcagttgttacaatgat

SEQ ID NO: 7243893 - DNA, 22 bp, Homo sapiens
gagcagcatctccggcttaaag

SEQ ID NO: 7243894 - DNA, 22 bp, Homo sapiens
gagcagcagctgggccaggttc

SEQ ID NO: 7243895 - DNA, 22 bp, Homo sapiens
gagcagcagattgtctccatgg

SEQ ID NO: 7243896 - DNA, 22 bp, Homo sapiens
gagcagcacttgaggcatgtca

SEQ ID NO: 7243897 - DNA, 22 bp, Homo sapiens
gagcagcactgagttagcagct

SEQ ID NO: 7243898 - DNA, 22 bp, Homo sapiens
gagcagcaagcactcaaaggct

SEQ ID NO: 7243899 - DNA, 22 bp, Homo sapiens
gagcagcaagcactcaaaggct

SEQ ID NO: 7243900 - DNA, 22 bp, Homo sapiens
gagcagcaaagggagggtaaat

SEQ ID NO: 7243901 - DNA, 22 bp, Homo sapiens
gagatggaaaactgctggtagt

SEQ ID NO: 7243902 - DNA, 22 bp, Homo sapiens
gagatggaatctgtgtggaggg

SEQ ID NO: 7243903 - DNA, 21 bp, Homo sapiens
gagatttagaaggatcaattt

SEQ ID NO: 7243904 - DNA, 22 bp, Homo sapiens
gagcagctgtggggttgaccat

SEQ ID NO: 7243905 - DNA, 22 bp, Homo sapiens
gagcagctgtccccaaagcttc

SEQ ID NO: 7243906 - DNA, 22 bp, Homo sapiens
gagcagctgtccccaaagcttc

SEQ ID NO: 7243907 - DNA, 22 bp, Homo sapiens
gagccacagaaggaaattgggg

SEQ ID NO: 7243908 - DNA, 22 bp, Homo sapiens
gagccacagcaacctcaaagga

SEQ ID NO: 7243909 - DNA, 22 bp, Homo sapiens
gagccaccttcaactcaggaat

SEQ ID NO: 7243910 - DNA, 22 bp, Homo sapiens
gagccaggtcgggccgcggcga

SEQ ID NO: 7243911 - DNA, 22 bp, Homo sapiens
gagccagcagccggcaccacca

SEQ ID NO: 7243912 - DNA, 22 bp, Homo sapiens
gagccagccgcaagagctgtga

SEQ ID NO: 7243913 - DNA, 22 bp, Homo sapiens
gagccaccttcaactcaggaat

SEQ ID NO: 7243914 - DNA, 22 bp, Homo sapiens
gaggcagaagttgcagtgagca

SEQ ID NO: 7243915 - DNA, 22 bp, Homo sapiens
gaggccagctagtccaggaagt

SEQ ID NO: 7243916 - DNA, 22 bp, Homo sapiens
gaggccaggaagcccaagatca

SEQ ID NO: 7243917 - DNA, 22 bp, Homo sapiens
gaggccaggacatgaaagctga

SEQ ID NO: 7243918 - DNA, 22 bp, Homo sapiens
gaggcagaggttgcagtgagct

SEQ ID NO: 7243919 - DNA, 22 bp, Homo sapiens
gaggaggaaaggagttgaaatg

SEQ ID NO: 7243920 - DNA, 22 bp, Homo sapiens
gaggaggaagttctctgtaggc

SEQ ID NO: 7243921 - DNA, 19 bp, Homo sapiens
gaggaggaaaactagtgta

SEQ ID NO: 7243922 - DNA, 19 bp, Homo sapiens
gaggaggaaaactagtgta

SEQ ID NO: 7243923 - DNA, 22 bp, Homo sapiens
gaggaggaggaagtggaaccca

SEQ ID NO: 7243924 - DNA, 22 bp, Homo sapiens
gaggaggcagcctatcccttag

SEQ ID NO: 7243925 - DNA, 22 bp, Homo sapiens
gaggaggccagtggaaggaagc

SEQ ID NO: 7243926 - DNA, 22 bp, Homo sapiens
gaggaggctaagtgggctctgg

SEQ ID NO: 7243927 - DNA, 18 bp, Homo sapiens
gaggagccgtccctacta

SEQ ID NO: 7243928 - DNA, 22 bp, Homo sapiens
gaggagcttgtgagaagatgtc

SEQ ID NO: 7243929 - DNA, 22 bp, Homo sapiens
gaggagcttgaggctaggagcc

SEQ ID NO: 7243930 - DNA, 22 bp, Homo sapiens
gagcttagacttttcacttcca

SEQ ID NO: 7243931 - DNA, 22 bp, Homo sapiens
gagcttagaactgtcctcgtaa

SEQ ID NO: 7243932 - DNA, 19 bp, Homo sapiens
gagctgagagtagcactgg

SEQ ID NO: 7243933 - DNA, 22 bp, Homo sapiens
gagctctttaccaggtcaggac

SEQ ID NO: 7243934 - DNA, 22 bp, Homo sapiens
gagctcttgtagtatgcggtaa

SEQ ID NO: 7243935 - DNA, 22 bp, Homo sapiens
gagctcttgcttctagtccagg

SEQ ID NO: 7243936 - DNA, 22 bp, Homo sapiens
gagctcttctggttagatgttg

SEQ ID NO: 7243937 - DNA, 22 bp, Homo sapiens
gagctcttctggggtaagggac

SEQ ID NO: 7243938 - DNA, 22 bp, Homo sapiens
gagctcttctaaagatggcaat

SEQ ID NO: 7243939 - DNA, 18 bp, Homo sapiens
gagctcttcccttttctc

SEQ ID NO: 7243940 - DNA, 22 bp, Homo sapiens
gagctcttcctttcaggaggcc

SEQ ID NO: 7243941 - DNA, 22 bp, Homo sapiens
gagctcttcgcctgtcgctgag

SEQ ID NO: 7243942 - DNA, 22 bp, Homo sapiens
gagctcttatagttctagcagt

SEQ ID NO: 7243943 - DNA, 22 bp, Homo sapiens
gagctcttccccatcttacatc

SEQ ID NO: 7243944 - DNA, 22 bp, Homo sapiens
gagctcttttgccagtcactgc

SEQ ID NO: 7243945 - DNA, 22 bp, Homo sapiens
gagctcttttgatgaaggtagt

SEQ ID NO: 7243946 - DNA, 22 bp, Homo sapiens
gagctctttcggttgttttcga

SEQ ID NO: 7243947 - DNA, 22 bp, Homo sapiens
gagctctttgaacctgggcagt

SEQ ID NO: 7243948 - DNA, 22 bp, Homo sapiens
gagctctttcctgcccatactg

SEQ ID NO: 7243949 - DNA, 22 bp, Homo sapiens
gagctctttcagttgactccta

SEQ ID NO: 7243950 - DNA, 22 bp, Homo sapiens
gagctctttcatggttctgtga

SEQ ID NO: 7243951 - DNA, 22 bp, Homo sapiens
gagctgaaatatgaagccaatt

SEQ ID NO: 7243952 - DNA, 22 bp, Homo sapiens
gagcctgagcaatgtgatgttt

SEQ ID NO: 7243953 - DNA, 22 bp, Homo sapiens
gagccctttccactgccctctg

SEQ ID NO: 7243954 - DNA, 22 bp, Homo sapiens
gagccctgttcaggcctcctca

SEQ ID NO: 7243955 - DNA, 22 bp, Homo sapiens
gagcctggattgaagtgggtgg

SEQ ID NO: 7243956 - DNA, 22 bp, Homo sapiens
gagcctggatagccttgttcca

SEQ ID NO: 7243957 - DNA, 22 bp, Homo sapiens
gagcggaggcttggaggccagc

SEQ ID NO: 7243958 - DNA, 22 bp, Homo sapiens
gagcctggattgtcaccgactt

SEQ ID NO: 7243959 - DNA, 22 bp, Homo sapiens
gagcctggagctggaacgaagc

SEQ ID NO: 7243960 - DNA, 22 bp, Homo sapiens
gagcctggacatctcaggccca

SEQ ID NO: 7243961 - DNA, 22 bp, Homo sapiens
gagctctgttctcgtcctgctg

SEQ ID NO: 7243962 - DNA, 22 bp, Homo sapiens
gagctcttagatagggcaggaa

SEQ ID NO: 7243963 - DNA, 22 bp, Homo sapiens
gagctctgtgtagcctgagggt

SEQ ID NO: 7243964 - DNA, 22 bp, Homo sapiens
gagctctctggggagatgggat

SEQ ID NO: 7243965 - DNA, 22 bp, Homo sapiens
gagcgggggctgccgggatttg

SEQ ID NO: 7243966 - DNA, 22 bp, Homo sapiens
gagcgggaggaacggctcgggc

SEQ ID NO: 7243967 - DNA, 22 bp, Homo sapiens
gagcgggaggaacggctcgggc

SEQ ID NO: 7243968 - DNA, 22 bp, Homo sapiens
cttcaaaccacatgctgaaaat

SEQ ID NO: 7243969 - DNA, 22 bp, Homo sapiens
cttcagaaccagccagaagagg

SEQ ID NO: 7243970 - DNA, 22 bp, Homo sapiens
cttatttgagagaaaagaaact

SEQ ID NO: 7243971 - DNA, 23 bp, Homo sapiens
cttattcattcatgtagcccatt

SEQ ID NO: 7243972 - DNA, 22 bp, Homo sapiens
cttccctttttatgtcttcagc

SEQ ID NO: 7243973 - DNA, 22 bp, Homo sapiens
cttcctctcttgcccataagag

SEQ ID NO: 7243974 - DNA, 22 bp, Homo sapiens
cttcctgaacaatgccatcaat

SEQ ID NO: 7243975 - DNA, 18 bp, Homo sapiens
cttcctgactagctctgg

SEQ ID NO: 7243976 - DNA, 22 bp, Homo sapiens
cttcctgaaggatggcagcctc

SEQ ID NO: 7243977 - DNA, 22 bp, Homo sapiens
cttgaccgattctagtggacat

SEQ ID NO: 7243978 - DNA, 22 bp, Homo sapiens
cttgaccgaatatgatcacttc

SEQ ID NO: 7243979 - DNA, 22 bp, Homo sapiens
cttgacattagttatgcagata

SEQ ID NO: 7243980 - DNA, 22 bp, Homo sapiens
cttcctgggccctgcttaagca

SEQ ID NO: 7243981 - DNA, 20 bp, Homo sapiens
cttgcccagggtctcctgcc

SEQ ID NO: 7243982 - DNA, 22 bp, Homo sapiens
cttgcccgcgaagaagctagga

SEQ ID NO: 7243983 - DNA, 22 bp, Homo sapiens
cttgggtgctggaggctgccgc

SEQ ID NO: 7243984 - DNA, 22 bp, Homo sapiens
cttgtagaattgaaatggtctc

SEQ ID NO: 7243985 - DNA, 22 bp, Homo sapiens
ctgttgcagaggggcggagagg

SEQ ID NO: 7243986 - DNA, 22 bp, Homo sapiens
ctgttcttatcgtcttaatatc

SEQ ID NO: 7243987 - DNA, 22 bp, Homo sapiens
ctgttcttctagtccactgaca

SEQ ID NO: 7243988 - DNA, 22 bp, Homo sapiens
ctgttctttagttccactgcaa

SEQ ID NO: 7243989 - DNA, 22 bp, Homo sapiens
ctgttctttagttccactgcaa

SEQ ID NO: 7243990 - DNA, 22 bp, Homo sapiens
ctgttctgaccagtgcagggat

SEQ ID NO: 7243991 - DNA, 22 bp, Homo sapiens
ctgttctgaactgcctgcatgc

SEQ ID NO: 7243992 - DNA, 22 bp, Homo sapiens
ctgttattttcctctgaactct

SEQ ID NO: 7243993 - DNA, 22 bp, Homo sapiens
ctgtgtctctacctccccatcc

SEQ ID NO: 7243994 - DNA, 22 bp, Homo sapiens
ctgtgtctcgttaaagcattgg

SEQ ID NO: 7243995 - DNA, 22 bp, Homo sapiens
ctgtgtctcgttaaagcattgg

SEQ ID NO: 7243996 - DNA, 22 bp, Homo sapiens
ctgtgtctcccaaggagggtca

SEQ ID NO: 7243997 - DNA, 22 bp, Homo sapiens
ctgtgtctcatccgcctctggc

SEQ ID NO: 7243998 - DNA, 22 bp, Homo sapiens
ctgtgtctgaataactctgtgt

SEQ ID NO: 7243999 - DNA, 22 bp, Homo sapiens
ctgtgtctctccttacaagact

SEQ ID NO: 7244000 - DNA, 22 bp, Homo sapiens
ctgtgtctctccttacaagact

SEQ ID NO: 7244001 - DNA, 22 bp, Homo sapiens
ctgtgtctgcctgggatccatt

SEQ ID NO: 7244002 - DNA, 22 bp, Homo sapiens
ctgtgtcttctgcttacagtct

SEQ ID NO: 7244003 - DNA, 22 bp, Homo sapiens
ctgtgtcttcctctgcccaggc

SEQ ID NO: 7244004 - DNA, 22 bp, Homo sapiens
ctgtgtcttcaatgtactggga

SEQ ID NO: 7244005 - DNA, 22 bp, Homo sapiens
ctgtgtctgtggaatagcgaat

SEQ ID NO: 7244006 - DNA, 22 bp, Homo sapiens
ctgtgtctaatcaggtcagtca

SEQ ID NO: 7244007 - DNA, 22 bp, Homo sapiens
ctgtgtctaatcttatacatca

SEQ ID NO: 7244008 - DNA, 22 bp, Homo sapiens
ctgtgtctaatcttatacatca

SEQ ID NO: 7244009 - DNA, 22 bp, Homo sapiens
ctgtggctgtctctttcccatg

SEQ ID NO: 7244010 - DNA, 22 bp, Homo sapiens
ctgtggctgcgtaggtctggca

SEQ ID NO: 7244011 - DNA, 22 bp, Homo sapiens
ctgtggctggcctgtctgacat

SEQ ID NO: 7244012 - DNA, 22 bp, Homo sapiens
ctgtggctggccttattgctgc

SEQ ID NO: 7244013 - DNA, 22 bp, Homo sapiens
ctgtggctctcagaggctgctg

SEQ ID NO: 7244014 - DNA, 22 bp, Homo sapiens
ctgggtgagctggccagagggt

SEQ ID NO: 7244015 - DNA, 22 bp, Homo sapiens
ctgggtgccacgggcaccctgg

SEQ ID NO: 7244016 - DNA, 22 bp, Homo sapiens
ctgtcctctgtcctcagcagga

SEQ ID NO: 7244017 - DNA, 22 bp, Homo sapiens
ctgtcctgaaagggagattggg

SEQ ID NO: 7244018 - DNA, 20 bp, Homo sapiens
ctgtcctgatcttttcagaa

SEQ ID NO: 7244019 - DNA, 22 bp, Homo sapiens
ctgtcctgcagttgggggcagg

SEQ ID NO: 7244020 - DNA, 22 bp, Homo sapiens
ctgtcctgtagctccatcagtc

SEQ ID NO: 7244021 - DNA, 22 bp, Homo sapiens
ctgtcctgtgcattgtcagatg

SEQ ID NO: 7244022 - DNA, 22 bp, Homo sapiens
ctgtcctgtctgcttttaattt

SEQ ID NO: 7244023 - DNA, 22 bp, Homo sapiens
ctgtgagtcttcagcaagtgtt

SEQ ID NO: 7244024 - DNA, 22 bp, Homo sapiens
ctgtgcagtggcagcgtgtggg

SEQ ID NO: 7244025 - DNA, 22 bp, Homo sapiens
ctgtgcatggccatcagtgccc

SEQ ID NO: 7244026 - DNA, 22 bp, Homo sapiens
ctggctgcgtctgctctgacag

SEQ ID NO: 7244027 - DNA, 22 bp, Homo sapiens
ctggctgcctggagtgagggag

SEQ ID NO: 7244028 - DNA, 22 bp, Homo sapiens
ctggctgcagtagcaagagact

SEQ ID NO: 7244029 - DNA, 22 bp, Homo sapiens
ctggctcatagagcagctccaa

SEQ ID NO: 7244030 - DNA, 22 bp, Homo sapiens
ctggctgcaggatgaggctgcc

SEQ ID NO: 7244031 - DNA, 22 bp, Homo sapiens
ctggctgcaggaaggagtgggc

SEQ ID NO: 7244032 - DNA, 19 bp, Homo sapiens
ctggccaggccaggggccc

SEQ ID NO: 7244033 - DNA, 22 bp, Homo sapiens
ctggccaggcatcccctgatcc

SEQ ID NO: 7244034 - DNA, 22 bp, Homo sapiens
ctggccaggccccttgcagggc

SEQ ID NO: 7244035 - DNA, 22 bp, Homo sapiens
ctggctcacctccgctccagca

SEQ ID NO: 7244036 - DNA, 21 bp, Homo sapiens
ctggccactgcacctcttcct

SEQ ID NO: 7244037 - DNA, 22 bp, Homo sapiens
ctggccagatgttacgtccaat

SEQ ID NO: 7244038 - DNA, 22 bp, Homo sapiens
ctggccagcctgtcgatgccct

SEQ ID NO: 7244039 - DNA, 22 bp, Homo sapiens
ctggccagcctcccaggtaccc

SEQ ID NO: 7244040 - DNA, 22 bp, Homo sapiens
ctggccaggaggtaaccagatg

SEQ ID NO: 7244041 - DNA, 22 bp, Homo sapiens
ctggccagctgacagcagggct

SEQ ID NO: 7244042 - DNA, 22 bp, Homo sapiens
ctggcagggcaggggtttgtgc

SEQ ID NO: 7244043 - DNA, 22 bp, Homo sapiens
ctggccacccatgcctccctga

SEQ ID NO: 7244044 - DNA, 22 bp, Homo sapiens
ctggccactgattcctcccctg

SEQ ID NO: 7244045 - DNA, 22 bp, Homo sapiens
ctggcaggctctctggtcggtt

SEQ ID NO: 7244046 - DNA, 22 bp, Homo sapiens
ctggcaggctctctggtcggtt

SEQ ID NO: 7244047 - DNA, 22 bp, Homo sapiens
ctggcaggcggaggttgcagtg

SEQ ID NO: 7244048 - DNA, 22 bp, Homo sapiens
ctggcaggcggcagagcccagg

SEQ ID NO: 7244049 - DNA, 20 bp, Homo sapiens
ctggcaggagcgagtctacc

SEQ ID NO: 7244050 - DNA, 22 bp, Homo sapiens
ctggcaggagctgtggccgtag

SEQ ID NO: 7244051 - DNA, 22 bp, Homo sapiens
ctggcaggatctaaccagggaa

SEQ ID NO: 7244052 - DNA, 22 bp, Homo sapiens
ctggcaggagttgggattttga

SEQ ID NO: 7244053 - DNA, 22 bp, Homo sapiens
ctggcaggatctaaccagggaa

SEQ ID NO: 7244054 - DNA, 22 bp, Homo sapiens
ctggcaggcaaattggtgggag

SEQ ID NO: 7244055 - DNA, 22 bp, Homo sapiens
ctggcaggcactcatgaaataa

SEQ ID NO: 7244056 - DNA, 22 bp, Homo sapiens
ctggcaggcagacttctgcaag

SEQ ID NO: 7244057 - DNA, 22 bp, Homo sapiens
ctggcaggaagttagatggtaa

SEQ ID NO: 7244058 - DNA, 22 bp, Homo sapiens
ctggcaggaaggcatttagaca

SEQ ID NO: 7244059 - DNA, 22 bp, Homo sapiens
ctggcaggaagaggaaaggtca

SEQ ID NO: 7244060 - DNA, 22 bp, Homo sapiens
ctggcaggagcattcacagagg

SEQ ID NO: 7244061 - DNA, 22 bp, Homo sapiens
ctgccagctcaccggctcagac

SEQ ID NO: 7244062 - DNA, 22 bp, Homo sapiens
ctgccagctcaaagcgcagcta

SEQ ID NO: 7244063 - DNA, 22 bp, Homo sapiens
ctgccagccaggccaggtaggc

SEQ ID NO: 7244064 - DNA, 22 bp, Homo sapiens
ctgccagcaagctaccctggca

SEQ ID NO: 7244065 - DNA, 22 bp, Homo sapiens
ctgccagcagaggccagcgctg

SEQ ID NO: 7244066 - DNA, 22 bp, Homo sapiens
ctgccagccaggccaggtaggc

SEQ ID NO: 7244067 - DNA, 22 bp, Homo sapiens
ctgccaccatgccccagcagag

SEQ ID NO: 7244068 - DNA, 22 bp, Homo sapiens
ctgccacaggggagcaggcaga

SEQ ID NO: 7244069 - DNA, 22 bp, Homo sapiens
ctgccagaaggttcctgctgca

SEQ ID NO: 7244070 - DNA, 21 bp, Homo sapiens
ctgccacctgctccatcagca

SEQ ID NO: 7244071 - DNA, 22 bp, Homo sapiens
ctgggaggattcattgaggtga

SEQ ID NO: 7244072 - DNA, 22 bp, Homo sapiens
ctgggaggcaccgcgtcgtgct

SEQ ID NO: 7244073 - DNA, 22 bp, Homo sapiens
ctgggaaattgacactgataaa

SEQ ID NO: 7244074 - DNA, 22 bp, Homo sapiens
ctgggaaatggcttcgagctca

SEQ ID NO: 7244075 - DNA, 22 bp, Homo sapiens
ctgggaaatataataaagtggt

SEQ ID NO: 7244076 - DNA, 22 bp, Homo sapiens
ctgggaaagtgtgctcccctcc

SEQ ID NO: 7244077 - DNA, 22 bp, Homo sapiens
ctgggaaagcaaggttgtggat

SEQ ID NO: 7244078 - DNA, 22 bp, Homo sapiens
ctgggaaaactgtgacccctgt

SEQ ID NO: 7244079 - DNA, 22 bp, Homo sapiens
ctggctttctgcaaatctccat

SEQ ID NO: 7244080 - DNA, 22 bp, Homo sapiens
ctgggccactccagatgcccac

SEQ ID NO: 7244081 - DNA, 22 bp, Homo sapiens
ctgggccacaagcctgtgtgat

SEQ ID NO: 7244082 - DNA, 22 bp, Homo sapiens
ctgggcagttttacatcattgc

SEQ ID NO: 7244083 - DNA, 22 bp, Homo sapiens
ctgggcagtttattcagttctg

SEQ ID NO: 7244084 - DNA, 22 bp, Homo sapiens
ctgggcaggagaggtggttgga

SEQ ID NO: 7244085 - DNA, 22 bp, Homo sapiens
ctgggcagctgtgcaaacaata

SEQ ID NO: 7244086 - DNA, 22 bp, Homo sapiens
ctgggaggcccacgttgggaag

SEQ ID NO: 7244087 - DNA, 22 bp, Homo sapiens
ctgggaggcggagcttgcagtg

SEQ ID NO: 7244088 - DNA, 22 bp, Homo sapiens
ctgggaggcagtctctctagaa

SEQ ID NO: 7244089 - DNA, 22 bp, Homo sapiens
ctgggaggcccacgttgggaag

SEQ ID NO: 7244090 - DNA, 22 bp, Homo sapiens
ctgggaggcagaggttgtagtg

SEQ ID NO: 7244091 - DNA, 22 bp, Homo sapiens
ctgggaggcagaggttgcagtg

SEQ ID NO: 7244092 - DNA, 22 bp, Homo sapiens
ctgggaggcagaggttgcagtg

SEQ ID NO: 7244093 - DNA, 22 bp, Homo sapiens
ctgggaggcactattcaggagg

SEQ ID NO: 7244094 - DNA, 22 bp, Homo sapiens
ctgggctgcatcaaagaggcat

SEQ ID NO: 7244095 - DNA, 22 bp, Homo sapiens
ctgggccagaccttgtggtctt

SEQ ID NO: 7244096 - DNA, 22 bp, Homo sapiens
ctgggctgcttgctgaaggggt

SEQ ID NO: 7244097 - DNA, 22 bp, Homo sapiens
ctggggtgtgctcagagcaggg

SEQ ID NO: 7244098 - DNA, 22 bp, Homo sapiens
ctggggctgcagcgatcttcat

SEQ ID NO: 7244099 - DNA, 22 bp, Homo sapiens
ctggggctgcggacgggagccc

SEQ ID NO: 7244100 - DNA, 22 bp, Homo sapiens
ctggggcattgggagaggcctg

SEQ ID NO: 7244101 - DNA, 22 bp, Homo sapiens
ctggggccacaacggcgcacgc

SEQ ID NO: 7244102 - DNA, 22 bp, Homo sapiens
ctggggccagtgaggaggcttt

SEQ ID NO: 7244103 - DNA, 22 bp, Homo sapiens
ctggggcccatcgagggctgag

SEQ ID NO: 7244104 - DNA, 22 bp, Homo sapiens
ctggggccctgggtctgccctc

SEQ ID NO: 7244105 - DNA, 22 bp, Homo sapiens
ctggggcccgagccttgggcca

SEQ ID NO: 7244106 - DNA, 23 bp, Homo sapiens
ctggggctcattgcagtagccat

SEQ ID NO: 7244107 - DNA, 22 bp, Homo sapiens
ctggggctcactttggtcaggc

SEQ ID NO: 7244108 - DNA, 22 bp, Homo sapiens
ctcttattttatggcatttgtg

SEQ ID NO: 7244109 - DNA, 22 bp, Homo sapiens
ctcttattcctacagtaacagg

SEQ ID NO: 7244110 - DNA, 22 bp, Homo sapiens
ttttcagagagcttttatgtcc

SEQ ID NO: 7244111 - DNA, 22 bp, Homo sapiens
ttttcagaattagcataccatt

SEQ ID NO: 7244112 - DNA, 22 bp, Homo sapiens
ttttcagaattagcataccatt

SEQ ID NO: 7244113 - DNA, 22 bp, Homo sapiens
ttttcagaaagatgagaaatta

SEQ ID NO: 7244114 - DNA, 22 bp, Homo sapiens
ttttcagaggcctaagaggttt

SEQ ID NO: 7244115 - DNA, 22 bp, Homo sapiens
ctcttcttggaatgctgactgt

SEQ ID NO: 7244116 - DNA, 22 bp, Homo sapiens
ttttagattgggaaatgtaaag

SEQ ID NO: 7244117 - DNA, 22 bp, Homo sapiens
ttttagattgggaaatgtaaag

SEQ ID NO: 7244118 - DNA, 22 bp, Homo sapiens
ttttagatagtttaactgcact

SEQ ID NO: 7244119 - DNA, 22 bp, Homo sapiens
ttttagattataagtctaattc

SEQ ID NO: 7244120 - DNA, 22 bp, Homo sapiens
ttttagattataagtctaattc

SEQ ID NO: 7244121 - DNA, 22 bp, Homo sapiens
ttttaatactgctattgtagga

SEQ ID NO: 7244122 - DNA, 22 bp, Homo sapiens
tttgggaaatattgtgttcaag

SEQ ID NO: 7244123 - DNA, 17 bp, Homo sapiens
tttggaatttaaaggca

SEQ ID NO: 7244124 - DNA, 22 bp, Homo sapiens
tttggaattggtggaggaaggg

SEQ ID NO: 7244125 - DNA, 22 bp, Homo sapiens
tttggaattggcattctattct

SEQ ID NO: 7244126 - DNA, 22 bp, Homo sapiens
ctctggaagtgatggcaggtca

SEQ ID NO: 7244127 - DNA, 22 bp, Homo sapiens
ctctggaagatgacctgggtaa

SEQ ID NO: 7244128 - DNA, 20 bp, Homo sapiens
ctctggaagagtttaaatgg

SEQ ID NO: 7244129 - DNA, 22 bp, Homo sapiens
ctctggaagaatacacttagaa

SEQ ID NO: 7244130 - DNA, 22 bp, Homo sapiens
ctctggaatgggtgtttctaac

SEQ ID NO: 7244131 - DNA, 22 bp, Homo sapiens
ctctggaatgtttacatgccct

SEQ ID NO: 7244132 - DNA, 22 bp, Homo sapiens
ctctggaaaattgtgtgggggt

SEQ ID NO: 7244133 - DNA, 22 bp, Homo sapiens
ctctggaaatggccatagtcat

SEQ ID NO: 7244134 - DNA, 22 bp, Homo sapiens
ctctggaaaaccactagcagga

SEQ ID NO: 7244135 - DNA, 22 bp, Homo sapiens
tttgctcttgctgcttggggca

SEQ ID NO: 7244136 - DNA, 22 bp, Homo sapiens
tttcctttatgacatcaccact

SEQ ID NO: 7244137 - DNA, 22 bp, Homo sapiens
tttcctttatgacatcaccact

SEQ ID NO: 7244138 - DNA, 21 bp, Homo sapiens
ctctgcccagggcctcctgcc

SEQ ID NO: 7244139 - DNA, 21 bp, Homo sapiens
ctctgcccagggcctcctgcc

SEQ ID NO: 7244140 - DNA, 21 bp, Homo sapiens
ctctgcccagggcctcctgcc

SEQ ID NO: 7244141 - DNA, 22 bp, Homo sapiens
ctctgcccagtgcccacaggag

SEQ ID NO: 7244142 - DNA, 20 bp, Homo sapiens
ctctgcccccagactgacag

SEQ ID NO: 7244143 - DNA, 19 bp, Homo sapiens
ctctgccctacagaaagct

SEQ ID NO: 7244144 - DNA, 22 bp, Homo sapiens
ctctgccctcgcacatctgcca

SEQ ID NO: 7244145 - DNA, 22 bp, Homo sapiens
ctgacagtcttgccaagtttct

SEQ ID NO: 7244146 - DNA, 19 bp, Homo sapiens
ctgacccaggacaccacgg

SEQ ID NO: 7244147 - DNA, 18 bp, Homo sapiens
ctgaccctggctctgggt

SEQ ID NO: 7244148 - DNA, 22 bp, Homo sapiens
ctgagcccttgaacccaagtcc

SEQ ID NO: 7244149 - DNA, 22 bp, Homo sapiens
ctgagccctggctcgcctggag

SEQ ID NO: 7244150 - DNA, 22 bp, Homo sapiens
ctgaggcagagggcagaccaga

SEQ ID NO: 7244151 - DNA, 22 bp, Homo sapiens
ctgaggcagagggcagaccaga

SEQ ID NO: 7244152 - DNA, 22 bp, Homo sapiens
ctgagcccctctgacctcagag

SEQ ID NO: 7244153 - DNA, 20 bp, Homo sapiens
ctgagcccagatcccaggtc

SEQ ID NO: 7244154 - DNA, 22 bp, Homo sapiens
ctgcaccgtgtctcgggctgcc

SEQ ID NO: 7244155 - DNA, 22 bp, Homo sapiens
ctgcagggagcagatggcgtgt

SEQ ID NO: 7244156 - DNA, 22 bp, Homo sapiens
ctgcagggagaggggacagcct

SEQ ID NO: 7244157 - DNA, 22 bp, Homo sapiens
ctgcaggcccccttcctggagt

SEQ ID NO: 7244158 - DNA, 22 bp, Homo sapiens
ctgcagggcccgcctgagccct

SEQ ID NO: 7244159 - DNA, 22 bp, Homo sapiens
ctgcagggcccgcctgagccct

SEQ ID NO: 7244160 - DNA, 22 bp, Homo sapiens
ctgcagggcttaccttgctctg

SEQ ID NO: 7244161 - DNA, 22 bp, Homo sapiens
ctgcagggcagaagggcataga

SEQ ID NO: 7244162 - DNA, 19 bp, Homo sapiens
ctgcagggatgtgcagagt

SEQ ID NO: 7244163 - DNA, 22 bp, Homo sapiens
ctgcagggatgtgaggcccgtt

SEQ ID NO: 7244164 - DNA, 22 bp, Homo sapiens
ctgaggccagaacccgaccctg

SEQ ID NO: 7244165 - DNA, 22 bp, Homo sapiens
ctgaggcatgttacaggacata

SEQ ID NO: 7244166 - DNA, 22 bp, Homo sapiens
ctgaggcatgttacaggacata

SEQ ID NO: 7244167 - DNA, 22 bp, Homo sapiens
ctcccgtgccactggctcctgc

SEQ ID NO: 7244168 - DNA, 22 bp, Homo sapiens
ctcccgtgatcctggaggagag

SEQ ID NO: 7244169 - DNA, 22 bp, Homo sapiens
ctcccctccttaggtcttctag

SEQ ID NO: 7244170 - DNA, 22 bp, Homo sapiens
ctccccttccgccagctcttga

SEQ ID NO: 7244171 - DNA, 22 bp, Homo sapiens
ctcccctgagcatagactctgt

SEQ ID NO: 7244172 - DNA, 22 bp, Homo sapiens
ctccccttcttgccagatcctt

SEQ ID NO: 7244173 - DNA, 22 bp, Homo sapiens
ctccccattgtgacctcatcca

SEQ ID NO: 7244174 - DNA, 22 bp, Homo sapiens
tttaggctcaaaagagttggtg

SEQ ID NO: 7244175 - DNA, 22 bp, Homo sapiens
tttagtgagtgtgaatcaaatg

SEQ ID NO: 7244176 - DNA, 22 bp, Homo sapiens
tttatttaaagtcgtgtgttaa

SEQ ID NO: 7244177 - DNA, 22 bp, Homo sapiens
tttattgtttagaagggggctg

SEQ ID NO: 7244178 - DNA, 22 bp, Homo sapiens
tttattgttgggtcttaagctg

SEQ ID NO: 7244179 - DNA, 22 bp, Homo sapiens
tttattgtgttgaaactgaatt

SEQ ID NO: 7244180 - DNA, 22 bp, Homo sapiens
tttattgtgttgaaactgaatt

SEQ ID NO: 7244181 - DNA, 22 bp, Homo sapiens
ctcctccagtgggtccctcagg

SEQ ID NO: 7244182 - DNA, 18 bp, Homo sapiens
ctcctccacagcccctgc

SEQ ID NO: 7244183 - DNA, 16 bp, Homo sapiens
tttatttactagtgtt

SEQ ID NO: 7244184 - DNA, 22 bp, Homo sapiens
tttatttaccttatgtcctcca

SEQ ID NO: 7244185 - DNA, 22 bp, Homo sapiens
tttcacagttagcatgaggact

SEQ ID NO: 7244186 - DNA, 22 bp, Homo sapiens
tttcacatacagtgtatagtag

SEQ ID NO: 7244187 - DNA, 20 bp, Homo sapiens
ctctctctccattcccaggg

SEQ ID NO: 7244188 - DNA, 21 bp, Homo sapiens
ctctccaggtaggataaatgt

SEQ ID NO: 7244189 - DNA, 22 bp, Homo sapiens
ctctcctggggagcacacacac

SEQ ID NO: 7244190 - DNA, 22 bp, Homo sapiens
ctctcctggtgtggaggacagg

SEQ ID NO: 7244191 - DNA, 20 bp, Homo sapiens
ctccagcccctgccctggtc

SEQ ID NO: 7244192 - DNA, 22 bp, Homo sapiens
ctccagccagagtgcctctgtt

SEQ ID NO: 7244193 - DNA, 22 bp, Homo sapiens
ttgtgaaacattcatggatttg

SEQ ID NO: 7244194 - DNA, 22 bp, Homo sapiens
tttaatatccagtggatacaaa

SEQ ID NO: 7244195 - DNA, 22 bp, Homo sapiens
tttaatatctcacacttccatg

SEQ ID NO: 7244196 - DNA, 22 bp, Homo sapiens
tttaatcaggcaaagcataata

SEQ ID NO: 7244197 - DNA, 22 bp, Homo sapiens
ctcccagaaaattctcagacaa

SEQ ID NO: 7244198 - DNA, 22 bp, Homo sapiens
ctcccactcctggctcaccaca

SEQ ID NO: 7244199 - DNA, 22 bp, Homo sapiens
ctcccactcctggctcaccaca

SEQ ID NO: 7244200 - DNA, 22 bp, Homo sapiens
ctcccagacatgtgcctccttg

SEQ ID NO: 7244201 - DNA, 22 bp, Homo sapiens
ttgaaatactgcattgttcagt

SEQ ID NO: 7244202 - DNA, 22 bp, Homo sapiens
ttgaaatactgcattgttcagt

SEQ ID NO: 7244203 - DNA, 22 bp, Homo sapiens
ttcttttcctgtggctcatcca

SEQ ID NO: 7244204 - DNA, 22 bp, Homo sapiens
ctcatttgtaattagttctcag

SEQ ID NO: 7244205 - DNA, 22 bp, Homo sapiens
ttcttttcccaatattttgctg

SEQ ID NO: 7244206 - DNA, 18 bp, Homo sapiens
ttcttttcatgtgatctc

SEQ ID NO: 7244207 - DNA, 22 bp, Homo sapiens
ttcttttcctacacagcgattt

SEQ ID NO: 7244208 - DNA, 22 bp, Homo sapiens
ttcttttcctgtggctcatcca

SEQ ID NO: 7244209 - DNA, 22 bp, Homo sapiens
ttcttttcctacacagcgattt

SEQ ID NO: 7244210 - DNA, 22 bp, Homo sapiens
ttcttttcggcctgtgagaagg

SEQ ID NO: 7244211 - DNA, 23 bp, Homo sapiens
ttgaaaggtagctggcagctaga

SEQ ID NO: 7244212 - DNA, 22 bp, Homo sapiens
ttcttttcaagaggggcaagga

SEQ ID NO: 7244213 - DNA, 22 bp, Homo sapiens
ttcttttcaagaggggcaagga

SEQ ID NO: 7244214 - DNA, 22 bp, Homo sapiens
ttcttttagtcattcagggaag

SEQ ID NO: 7244215 - DNA, 22 bp, Homo sapiens
ttcttttagaatttcctaaggt

SEQ ID NO: 7244216 - DNA, 22 bp, Homo sapiens
ttcttttacattaagatttcag

SEQ ID NO: 7244217 - DNA, 22 bp, Homo sapiens
ttcttttaattgtgggggagtg

SEQ ID NO: 7244218 - DNA, 22 bp, Homo sapiens
ttcttttaatttctgtctgcag

SEQ ID NO: 7244219 - DNA, 20 bp, Homo sapiens
ctccaaattcctgaggataa

SEQ ID NO: 7244220 - DNA, 22 bp, Homo sapiens
ctagcatgtcaacttagagcta

SEQ ID NO: 7244221 - DNA, 22 bp, Homo sapiens
ctagcaggtcaaaccagctgat

SEQ ID NO: 7244222 - DNA, 22 bp, Homo sapiens
ctagcaggctaatgtaagcttg

SEQ ID NO: 7244223 - DNA, 22 bp, Homo sapiens
ctattaaatactcttcaaattg

SEQ ID NO: 7244224 - DNA, 22 bp, Homo sapiens
ctatgttacaaagcagttagtt

SEQ ID NO: 7244225 - DNA, 19 bp, Homo sapiens
ctatgtttatatatccagt

SEQ ID NO: 7244226 - DNA, 22 bp, Homo sapiens
ctatgtttatctgtatttctgt

SEQ ID NO: 7244227 - DNA, 22 bp, Homo sapiens
ctatgctttagtaatattctca

SEQ ID NO: 7244228 - DNA, 23 bp, Homo sapiens
ctatggttttaaaggtggatatc

SEQ ID NO: 7244229 - DNA, 22 bp, Homo sapiens
ctcacagatgttctcctttagg

SEQ ID NO: 7244230 - DNA, 22 bp, Homo sapiens
ctcacagatgtcctggcacttc

SEQ ID NO: 7244231 - DNA, 22 bp, Homo sapiens
ctcacagatgatgtctatgtgg

SEQ ID NO: 7244232 - DNA, 22 bp, Homo sapiens
ctcacagatctgtgcctgaacc

SEQ ID NO: 7244233 - DNA, 22 bp, Homo sapiens
ctcacagatatttgcttcaggt

SEQ ID NO: 7244234 - DNA, 22 bp, Homo sapiens
ctcacagatatttgcttcaggt

SEQ ID NO: 7244235 - DNA, 22 bp, Homo sapiens
ctcacagagcctctgtgtcttc

SEQ ID NO: 7244236 - DNA, 22 bp, Homo sapiens
ctcacactgtgccaaatccttt

SEQ ID NO: 7244237 - DNA, 22 bp, Homo sapiens
ctcacaccagcttacaagactt

SEQ ID NO: 7244238 - DNA, 22 bp, Homo sapiens
ctcacaggcatctcatcaggct

SEQ ID NO: 7244239 - DNA, 22 bp, Homo sapiens
ctacaggtatgtgcatgacatc

SEQ ID NO: 7244240 - DNA, 22 bp, Homo sapiens
ctacagagtatctaaagaggta

SEQ ID NO: 7244241 - DNA, 22 bp, Homo sapiens
ctactgtaatagatgaatttga

SEQ ID NO: 7244242 - DNA, 22 bp, Homo sapiens
ttctctggagagtatcttctta

SEQ ID NO: 7244243 - DNA, 21 bp, Homo sapiens
ctacttaagtaggggattagg

SEQ ID NO: 7244244 - DNA, 22 bp, Homo sapiens
ctacttctgtggctctaagaga

SEQ ID NO: 7244245 - DNA, 22 bp, Homo sapiens
ctagaaaaatactttattgtga

SEQ ID NO: 7244246 - DNA, 19 bp, Homo sapiens
ctactttataatatgcctc

SEQ ID NO: 7244247 - DNA, 22 bp, Homo sapiens
ttcaggcagctgaggagaaagt

SEQ ID NO: 7244248 - DNA, 22 bp, Homo sapiens
ttcaggcaagatattaacttct

SEQ ID NO: 7244249 - DNA, 22 bp, Homo sapiens
ttcaggagtgtcaggagtgcct

SEQ ID NO: 7244250 - DNA, 22 bp, Homo sapiens
ttcagggagagcgggacgggtg

SEQ ID NO: 7244251 - DNA, 22 bp, Homo sapiens
cggggctgtagcacagctgagc

SEQ ID NO: 7244252 - DNA, 22 bp, Homo sapiens
cggtggagtgctcagctgaacc

SEQ ID NO: 7244253 - DNA, 22 bp, Homo sapiens
cgtaggtggctcagcacctggg

SEQ ID NO: 7244254 - DNA, 22 bp, Homo sapiens
ctaaagtccttatcaagtgtaa

SEQ ID NO: 7244255 - DNA, 22 bp, Homo sapiens
ctaaagtcatacaaggtgggag

SEQ ID NO: 7244256 - DNA, 22 bp, Homo sapiens
ctaaataatccctctggtctta

SEQ ID NO: 7244257 - DNA, 22 bp, Homo sapiens
ttcatgaagggtgaatatagtc

SEQ ID NO: 7244258 - DNA, 23 bp, Homo sapiens
cgcccagcctcagtgacctgggc

SEQ ID NO: 7244259 - DNA, 23 bp, Homo sapiens
cgcccagcctcagtgacctgggc

SEQ ID NO: 7244260 - DNA, 22 bp, Homo sapiens
cgccaggcttggtagctcatgc

SEQ ID NO: 7244261 - DNA, 22 bp, Homo sapiens
ttaggattaaaagttaatgcaa

SEQ ID NO: 7244262 - DNA, 22 bp, Homo sapiens
cctttctaagatactgcaactt

SEQ ID NO: 7244263 - DNA, 22 bp, Homo sapiens
cctttctacagatgcctcttgc

SEQ ID NO: 7244264 - DNA, 20 bp, Homo sapiens
cgcccaggagggcccatgtg

SEQ ID NO: 7244265 - DNA, 22 bp, Homo sapiens
cgcccagctgaaatctccaggc

SEQ ID NO: 7244266 - DNA, 22 bp, Homo sapiens
cgcccaggctggagagcagtgg

SEQ ID NO: 7244267 - DNA, 22 bp, Homo sapiens
cgccccagtctgtaggtgcccc

SEQ ID NO: 7244268 - DNA, 22 bp, Homo sapiens
cgccccagccagttgagcggcg

SEQ ID NO: 7244269 - DNA, 22 bp, Homo sapiens
cgccccagatgcaagacaaaga

SEQ ID NO: 7244270 - DNA, 22 bp, Homo sapiens
cgcccagggcaggaggccgctc

SEQ ID NO: 7244271 - DNA, 22 bp, Homo sapiens
cgccccagtctgtaggtgcccc

SEQ ID NO: 7244272 - DNA, 18 bp, Homo sapiens
cgccctgctataaatgac

SEQ ID NO: 7244273 - DNA, 22 bp, Homo sapiens
tgggggactgcactggcgtcag

SEQ ID NO: 7244274 - DNA, 21 bp, Homo sapiens
tgggggagaattggttgcttt

SEQ ID NO: 7244275 - DNA, 19 bp, Homo sapiens
cctgggagtcagctgaagg

SEQ ID NO: 7244276 - DNA, 22 bp, Homo sapiens
cctgggaggtggatgttgcggt

SEQ ID NO: 7244277 - DNA, 22 bp, Homo sapiens
cctgggaggtggaggttgcagt

SEQ ID NO: 7244278 - DNA, 22 bp, Homo sapiens
tgggggaagagcttgttaaagt

SEQ ID NO: 7244279 - DNA, 22 bp, Homo sapiens
tgggggaaattcagccagatat

SEQ ID NO: 7244280 - DNA, 21 bp, Homo sapiens
tgggggagaattggttgcttt

SEQ ID NO: 7244281 - DNA, 22 bp, Homo sapiens
cctgggagtggcactcacagca

SEQ ID NO: 7244282 - DNA, 22 bp, Homo sapiens
tggggctgtgagactacaggat

SEQ ID NO: 7244283 - DNA, 22 bp, Homo sapiens
tggggctgtggattctcacgaa

SEQ ID NO: 7244284 - DNA, 22 bp, Homo sapiens
tggggccaagaaggtctcatgt

SEQ ID NO: 7244285 - DNA, 22 bp, Homo sapiens
tggggcagttaataaacattct

SEQ ID NO: 7244286 - DNA, 22 bp, Homo sapiens
tggggcagttaataaacattct

SEQ ID NO: 7244287 - DNA, 23 bp, Homo sapiens
tggggccaagtgaggaagggtct

SEQ ID NO: 7244288 - DNA, 22 bp, Homo sapiens
tggggccacacatctctttcta

SEQ ID NO: 7244289 - DNA, 22 bp, Homo sapiens
tggggcagtggcttttcaccct

SEQ ID NO: 7244290 - DNA, 22 bp, Homo sapiens
tggggcagtggcttttcaccct

SEQ ID NO: 7244291 - DNA, 22 bp, Homo sapiens
tggggcagggatgggaaactat

SEQ ID NO: 7244292 - DNA, 22 bp, Homo sapiens
tggggcagggatgggaaactat

SEQ ID NO: 7244293 - DNA, 22 bp, Homo sapiens
tggggcagctccatctattcca

SEQ ID NO: 7244294 - DNA, 22 bp, Homo sapiens
tggggcagggatgggaaactat

SEQ ID NO: 7244295 - DNA, 22 bp, Homo sapiens
tggggcagccacatagacaaca

SEQ ID NO: 7244296 - DNA, 22 bp, Homo sapiens
tggggcagctccatctattcca

SEQ ID NO: 7244297 - DNA, 22 bp, Homo sapiens
tggggcagctccatctattcca

SEQ ID NO: 7244298 - DNA, 22 bp, Homo sapiens
tggggaggaagtcagatttcag

SEQ ID NO: 7244299 - DNA, 22 bp, Homo sapiens
tggggcagccacatagacaaca

SEQ ID NO: 7244300 - DNA, 22 bp, Homo sapiens
tggggcagcagacctttcttgg

SEQ ID NO: 7244301 - DNA, 22 bp, Homo sapiens
tggggcagcagacctttcttgg

SEQ ID NO: 7244302 - DNA, 22 bp, Homo sapiens
tgtgtattaatgtttgtatatg

SEQ ID NO: 7244303 - DNA, 22 bp, Homo sapiens
tgtgtctctcctggaagcacgt

SEQ ID NO: 7244304 - DNA, 22 bp, Homo sapiens
tgtgtctccatagccagctagc

SEQ ID NO: 7244305 - DNA, 22 bp, Homo sapiens
tgtgtctcatttcctcctgctg

SEQ ID NO: 7244306 - DNA, 22 bp, Homo sapiens
tgtgtctcaagtcagagcatca

SEQ ID NO: 7244307 - DNA, 23 bp, Homo sapiens
tgtgtctgaggatatatgtgcat

SEQ ID NO: 7244308 - DNA, 22 bp, Homo sapiens
cctgggcaatatagtgaggccc

SEQ ID NO: 7244309 - DNA, 22 bp, Homo sapiens
cctgggcaacatagtgagacct

SEQ ID NO: 7244310 - DNA, 22 bp, Homo sapiens
cctgggcaacatagtgagaccc

SEQ ID NO: 7244311 - DNA, 22 bp, Homo sapiens
cctgggcaacatagggagaccc

SEQ ID NO: 7244312 - DNA, 22 bp, Homo sapiens
cctgggtgtcatgggcagctgg

SEQ ID NO: 7244313 - DNA, 22 bp, Homo sapiens
cctggtgcttaccagagctttt

SEQ ID NO: 7244314 - DNA, 22 bp, Homo sapiens
tgttcattctgtatatgctgta

SEQ ID NO: 7244315 - DNA, 22 bp, Homo sapiens
tgttcagttaacacagacacca

SEQ ID NO: 7244316 - DNA, 22 bp, Homo sapiens
tgtgtctgcccttagtacatct

SEQ ID NO: 7244317 - DNA, 22 bp, Homo sapiens
tgttacaaggaagaatgtaggt

SEQ ID NO: 7244318 - DNA, 22 bp, Homo sapiens
tgttacaaactgttgtttctat

SEQ ID NO: 7244319 - DNA, 22 bp, Homo sapiens
tgttaagttgccagtgtatgac

SEQ ID NO: 7244320 - DNA, 22 bp, Homo sapiens
tgttaaggttatttgttatgtc

SEQ ID NO: 7244321 - DNA, 22 bp, Homo sapiens
tgttaaggctcttgtttatgtc

SEQ ID NO: 7244322 - DNA, 22 bp, Homo sapiens
cctgggctgtacctgtgcgcgg

SEQ ID NO: 7244323 - DNA, 22 bp, Homo sapiens
ttagaaaaaacgtcttctagtg

SEQ ID NO: 7244324 - DNA, 22 bp, Homo sapiens
ttagaaaaaacgtcttctagtg

SEQ ID NO: 7244325 - DNA, 22 bp, Homo sapiens
ccttcctttcagggctatgcct

SEQ ID NO: 7244326 - DNA, 22 bp, Homo sapiens
ccttctagcaaatcaacataaa

SEQ ID NO: 7244327 - DNA, 22 bp, Homo sapiens
ccttctcagccccagctcccgc

SEQ ID NO: 7244328 - DNA, 22 bp, Homo sapiens
ttagaaaatggaggtgggaggg

SEQ ID NO: 7244329 - DNA, 22 bp, Homo sapiens
ttagaaaacataagtggtaaag

SEQ ID NO: 7244330 - DNA, 22 bp, Homo sapiens
ttagaaaacataagtggtaaag

SEQ ID NO: 7244331 - DNA, 22 bp, Homo sapiens
ttagaaaaatgttcagtagttt

SEQ ID NO: 7244332 - DNA, 22 bp, Homo sapiens
ttagaaaaaggctgtggtctta

SEQ ID NO: 7244333 - DNA, 22 bp, Homo sapiens
ttagaaaatggaggtgggaggg

SEQ ID NO: 7244334 - DNA, 22 bp, Homo sapiens
ttagaaaatttgcttctttgga

SEQ ID NO: 7244335 - DNA, 22 bp, Homo sapiens
ttagaatcaggtgttataatca

SEQ ID NO: 7244336 - DNA, 22 bp, Homo sapiens
ttagaatcagaagagaggtatt

SEQ ID NO: 7244337 - DNA, 22 bp, Homo sapiens
ttagaatcttgtatcagaagtt

SEQ ID NO: 7244338 - DNA, 22 bp, Homo sapiens
ttagaatccatggttgcagtgg

SEQ ID NO: 7244339 - DNA, 22 bp, Homo sapiens
ttagaatttctgctcactttga

SEQ ID NO: 7244340 - DNA, 22 bp, Homo sapiens
ttagaattattgtttccttcta

SEQ ID NO: 7244341 - DNA, 22 bp, Homo sapiens
ttagaattattgtttccttcta

SEQ ID NO: 7244342 - DNA, 22 bp, Homo sapiens
ttagaatctttagagtctcact

SEQ ID NO: 7244343 - DNA, 22 bp, Homo sapiens
cctgtgtccttggcagatatcc

SEQ ID NO: 7244344 - DNA, 22 bp, Homo sapiens
cctgtgtcctcccactcagtcc

SEQ ID NO: 7244345 - DNA, 22 bp, Homo sapiens
cctgtgtctgaccatgcacatg

SEQ ID NO: 7244346 - DNA, 16 bp, Homo sapiens
cctgtgtctatcaggt

SEQ ID NO: 7244347 - DNA, 22 bp, Homo sapiens
cctgtgtctttgcctcagggtc

SEQ ID NO: 7244348 - DNA, 22 bp, Homo sapiens
cctgtgtcttccccactggtgt

SEQ ID NO: 7244349 - DNA, 23 bp, Homo sapiens
cctgtgtctgttgctgaataatg

SEQ ID NO: 7244350 - DNA, 22 bp, Homo sapiens
ccttccctaaagcgtcgcttag

SEQ ID NO: 7244351 - DNA, 17 bp, Homo sapiens
ccttcctcatctccttc

SEQ ID NO: 7244352 - DNA, 19 bp, Homo sapiens
ccttcctccccagggccat

SEQ ID NO: 7244353 - DNA, 22 bp, Homo sapiens
ccttcccacattccttacatgc

SEQ ID NO: 7244354 - DNA, 20 bp, Homo sapiens
ccttccccacccgctgaggt

SEQ ID NO: 7244355 - DNA, 22 bp, Homo sapiens
cctgtgggaaaggtctgctctc

SEQ ID NO: 7244356 - DNA, 22 bp, Homo sapiens
cctgtgggaaaggtctgctctc

SEQ ID NO: 7244357 - DNA, 22 bp, Homo sapiens
ttaaatagctcttgtagaagaa

SEQ ID NO: 7244358 - DNA, 22 bp, Homo sapiens
ttaaatagctcttgtagaagaa

SEQ ID NO: 7244359 - DNA, 22 bp, Homo sapiens
ttaaagtaatctgtgtgaattt

SEQ ID NO: 7244360 - DNA, 22 bp, Homo sapiens
ttaaagtatagaggacaaaaac

SEQ ID NO: 7244361 - DNA, 22 bp, Homo sapiens
ttaaagtccctgccttaattcc

SEQ ID NO: 7244362 - DNA, 22 bp, Homo sapiens
ttaaagtatggtttaagggctt

SEQ ID NO: 7244363 - DNA, 22 bp, Homo sapiens
ttaaagtctatgtactacactt

SEQ ID NO: 7244364 - DNA, 22 bp, Homo sapiens
cctgtggtttacgtacagctcc

SEQ ID NO: 7244365 - DNA, 22 bp, Homo sapiens
cctgtgggttttctgtagaaat

SEQ ID NO: 7244366 - DNA, 22 bp, Homo sapiens
cctgtgggttttcaagatgcta

SEQ ID NO: 7244367 - DNA, 22 bp, Homo sapiens
cctgtgggtcacatgggtgact

SEQ ID NO: 7244368 - DNA, 22 bp, Homo sapiens
cctgtgggagcccaggcagata

SEQ ID NO: 7244369 - DNA, 22 bp, Homo sapiens
cctgtgtcatcagctgtggcta

SEQ ID NO: 7244370 - DNA, 22 bp, Homo sapiens
cctgtgtcagcccctgcctcca

SEQ ID NO: 7244371 - DNA, 22 bp, Homo sapiens
cctgtgtcaccggaacggagga

SEQ ID NO: 7244372 - DNA, 22 bp, Homo sapiens
cctgtgtccagttccaggttgt

SEQ ID NO: 7244373 - DNA, 22 bp, Homo sapiens
cctgtgtcatcagctgtggcta

SEQ ID NO: 7244374 - DNA, 19 bp, Homo sapiens
cctgtgtcccacgtagatg

SEQ ID NO: 7244375 - DNA, 22 bp, Homo sapiens
cctgtgtcctaatccatcaggc

SEQ ID NO: 7244376 - DNA, 23 bp, Homo sapiens
ttaaaggcagatgttgagtatta

SEQ ID NO: 7244377 - DNA, 22 bp, Homo sapiens
ttaaagctgctgaatcctattt

SEQ ID NO: 7244378 - DNA, 22 bp, Homo sapiens
ccatgtggtgggaaggagaatg

SEQ ID NO: 7244379 - DNA, 22 bp, Homo sapiens
ccatggcctcgctctacgtggg

SEQ ID NO: 7244380 - DNA, 22 bp, Homo sapiens
ccatgctgtgccattagcagtt

SEQ ID NO: 7244381 - DNA, 22 bp, Homo sapiens
ccatgctgtgacacagtagtta

SEQ ID NO: 7244382 - DNA, 22 bp, Homo sapiens
ccatgctgggatgctccaagtg

SEQ ID NO: 7244383 - DNA, 22 bp, Homo sapiens
ccatgctggagtccctagctgt

SEQ ID NO: 7244384 - DNA, 22 bp, Homo sapiens
ccatgctgaccctgtgcaggca

SEQ ID NO: 7244385 - DNA, 22 bp, Homo sapiens
ccatgcctggactccactctca

SEQ ID NO: 7244386 - DNA, 22 bp, Homo sapiens
ccatcctgtctgtggcctcagg

SEQ ID NO: 7244387 - DNA, 22 bp, Homo sapiens
ccatgcattcctgctctgcgca

SEQ ID NO: 7244388 - DNA, 22 bp, Homo sapiens
ccatgcatggcactggactggg

SEQ ID NO: 7244389 - DNA, 22 bp, Homo sapiens
ccatgcatgcctgaaattgctg

SEQ ID NO: 7244390 - DNA, 22 bp, Homo sapiens
ccatgcatctaccagccccaga

SEQ ID NO: 7244391 - DNA, 22 bp, Homo sapiens
ccatgcatatgcacgtaaatta

SEQ ID NO: 7244392 - DNA, 22 bp, Homo sapiens
ccatgcatataatagtgcctgg

SEQ ID NO: 7244393 - DNA, 20 bp, Homo sapiens
tgagggctaaccagactctg

SEQ ID NO: 7244394 - DNA, 22 bp, Homo sapiens
tgagggcagagcactggggagc

SEQ ID NO: 7244395 - DNA, 20 bp, Homo sapiens
tgagggctaaccagactctg

SEQ ID NO: 7244396 - DNA, 22 bp, Homo sapiens
tgagggctgacaggaggacagc

SEQ ID NO: 7244397 - DNA, 22 bp, Homo sapiens
tgagggctgtggaaggctaacc

SEQ ID NO: 7244398 - DNA, 22 bp, Homo sapiens
tgagggctgcttccagagctag

SEQ ID NO: 7244399 - DNA, 22 bp, Homo sapiens
ccagtcccgcatggtccagaat

SEQ ID NO: 7244400 - DNA, 22 bp, Homo sapiens
ccagtcccgcatggtccagaat

SEQ ID NO: 7244401 - DNA, 22 bp, Homo sapiens
ccattccatgtgctacacataa

SEQ ID NO: 7244402 - DNA, 20 bp, Homo sapiens
ccattctgggtgcagtctgg

SEQ ID NO: 7244403 - DNA, 22 bp, Homo sapiens
ccattgaattagaaggggaagg

SEQ ID NO: 7244404 - DNA, 22 bp, Homo sapiens
ccattgaatcctcagctgctag

SEQ ID NO: 7244405 - DNA, 22 bp, Homo sapiens
ccattgaaggcacttgagcaga

SEQ ID NO: 7244406 - DNA, 22 bp, Homo sapiens
ccattgaacccctctaggccac

SEQ ID NO: 7244407 - DNA, 22 bp, Homo sapiens
tgatttcttctaatttccatca

SEQ ID NO: 7244408 - DNA, 23 bp, Homo sapiens
tgattttaaaaagtaagttatca

SEQ ID NO: 7244409 - DNA, 22 bp, Homo sapiens
tgatttctcatattgttcaaaa

SEQ ID NO: 7244410 - DNA, 21 bp, Homo sapiens
tgatttctgccaagttcacta

SEQ ID NO: 7244411 - DNA, 20 bp, Homo sapiens
tgatttctcttctattcctt

SEQ ID NO: 7244412 - DNA, 22 bp, Homo sapiens
tgatttctcttggcaatatgtt

SEQ ID NO: 7244413 - DNA, 22 bp, Homo sapiens
tgcaaaggaggatgggaaagaa

SEQ ID NO: 7244414 - DNA, 22 bp, Homo sapiens
tgcaaatagcctgatgaaagaa

SEQ ID NO: 7244415 - DNA, 22 bp, Homo sapiens
cccacttcatgggcaggaagga

SEQ ID NO: 7244416 - DNA, 23 bp, Homo sapiens
cccagaccttgtgctgcccttgg

SEQ ID NO: 7244417 - DNA, 22 bp, Homo sapiens
tgcacacattaaggatacacag

SEQ ID NO: 7244418 - DNA, 22 bp, Homo sapiens
tgcacacattctatggggctga

SEQ ID NO: 7244419 - DNA, 22 bp, Homo sapiens
tgagaaggcctgtgtgacaggg

SEQ ID NO: 7244420 - DNA, 19 bp, Homo sapiens
tgagaaggcagtggggagc

SEQ ID NO: 7244421 - DNA, 22 bp, Homo sapiens
ccaggggctctcagggtgtgtg

SEQ ID NO: 7244422 - DNA, 22 bp, Homo sapiens
ccaggtggaaggtctgtgctct

SEQ ID NO: 7244423 - DNA, 19 bp, Homo sapiens
ccaggtggaactgaggtag

SEQ ID NO: 7244424 - DNA, 19 bp, Homo sapiens
ccaggtggaactgaggtag

SEQ ID NO: 7244425 - DNA, 22 bp, Homo sapiens
ccaggggctggtgctgagctgg

SEQ ID NO: 7244426 - DNA, 22 bp, Homo sapiens
ccaggggttggaggttgcagtg

SEQ ID NO: 7244427 - DNA, 22 bp, Homo sapiens
ccaggtgtggggaggactcaca

SEQ ID NO: 7244428 - DNA, 22 bp, Homo sapiens
ccaggtgtgctctgcagtggat

SEQ ID NO: 7244429 - DNA, 22 bp, Homo sapiens
ccaggtgtgccagcagggactg

SEQ ID NO: 7244430 - DNA, 22 bp, Homo sapiens
ccaggtgtgatttggcagtgtc

SEQ ID NO: 7244431 - DNA, 22 bp, Homo sapiens
ccaggtgtctgtggccagccct

SEQ ID NO: 7244432 - DNA, 22 bp, Homo sapiens
ccaggtgtaggacaccaaggga

SEQ ID NO: 7244433 - DNA, 22 bp, Homo sapiens
ccaggtgtcatgcgtgtgaccc

SEQ ID NO: 7244434 - DNA, 22 bp, Homo sapiens
ccaggtgtagcactgctcacag

SEQ ID NO: 7244435 - DNA, 22 bp, Homo sapiens
tgagaccttggggagccctgtt

SEQ ID NO: 7244436 - DNA, 22 bp, Homo sapiens
tgagaccttaaaaggtatgtca

SEQ ID NO: 7244437 - DNA, 22 bp, Homo sapiens
tgagacctgcccaacgcagacc

SEQ ID NO: 7244438 - DNA, 22 bp, Homo sapiens
tgagacctgcctctgcactagg

SEQ ID NO: 7244439 - DNA, 22 bp, Homo sapiens
tgagacagtttttctatttcca

SEQ ID NO: 7244440 - DNA, 22 bp, Homo sapiens
ccaggggaaacagggagcactc

SEQ ID NO: 7244441 - DNA, 22 bp, Homo sapiens
tgacagttaaggtatacattca

SEQ ID NO: 7244442 - DNA, 21 bp, Homo sapiens
ccaggggcaaattgtcgtttc

SEQ ID NO: 7244443 - DNA, 20 bp, Homo sapiens
tgacagtttcatatggttca

SEQ ID NO: 7244444 - DNA, 22 bp, Homo sapiens
tgacatagggcaaaagagtagg

SEQ ID NO: 7244445 - DNA, 22 bp, Homo sapiens
tgaagttgttaaggttgccatt

SEQ ID NO: 7244446 - DNA, 22 bp, Homo sapiens
tgaatgcaaatcatgattgtaa

SEQ ID NO: 7244447 - DNA, 22 bp, Homo sapiens
ccaggctggagtgcagtagtgt

SEQ ID NO: 7244448 - DNA, 22 bp, Homo sapiens
ccaggctggagtgcagtggcac

SEQ ID NO: 7244449 - DNA, 22 bp, Homo sapiens
ccaggctggagtgcagtggcac

SEQ ID NO: 7244450 - DNA, 22 bp, Homo sapiens
ccaggctggagtgtagtcgcat

SEQ ID NO: 7244451 - DNA, 22 bp, Homo sapiens
ccaggctggattttgcagttca

SEQ ID NO: 7244452 - DNA, 22 bp, Homo sapiens
tctggtgtcagtattctttgaa

SEQ ID NO: 7244453 - DNA, 22 bp, Homo sapiens
tctggtcctgaagtcaacttca

SEQ ID NO: 7244454 - DNA, 22 bp, Homo sapiens
tctggtcccttttcctgcagtc

SEQ ID NO: 7244455 - DNA, 22 bp, Homo sapiens
ccaggacttcgaggctacagtg

SEQ ID NO: 7244456 - DNA, 22 bp, Homo sapiens
tctgggagatccaagcagaact

SEQ ID NO: 7244457 - DNA, 22 bp, Homo sapiens
tctggctcaggtcagacaggga

SEQ ID NO: 7244458 - DNA, 22 bp, Homo sapiens
ccaggactcaatgaccacaggg

SEQ ID NO: 7244459 - DNA, 22 bp, Homo sapiens
ccaggaccacacgacaggagag

SEQ ID NO: 7244460 - DNA, 18 bp, Homo sapiens
tctggaacaacttcatgt

SEQ ID NO: 7244461 - DNA, 22 bp, Homo sapiens
ccagagagaaatggatttgagt

SEQ ID NO: 7244462 - DNA, 22 bp, Homo sapiens
ccagagagaaaatggagggcca

SEQ ID NO: 7244463 - DNA, 23 bp, Homo sapiens
tctcagacccgaagccagaggaa

SEQ ID NO: 7244464 - DNA, 22 bp, Homo sapiens
ccagctctgcagggcctggggt

SEQ ID NO: 7244465 - DNA, 22 bp, Homo sapiens
ccagctgattcggtggtggttg

SEQ ID NO: 7244466 - DNA, 22 bp, Homo sapiens
ccagctgcaggtgttccagatg

SEQ ID NO: 7244467 - DNA, 22 bp, Homo sapiens
ccagctgcccaagaggcatcct

SEQ ID NO: 7244468 - DNA, 22 bp, Homo sapiens
tctggaggccatagggaaggat

SEQ ID NO: 7244469 - DNA, 22 bp, Homo sapiens
tctggaggccatagggaaggat

SEQ ID NO: 7244470 - DNA, 22 bp, Homo sapiens
tctggaggcaggctgccaggat

SEQ ID NO: 7244471 - DNA, 22 bp, Homo sapiens
tctttcttcagccctgtaagat

SEQ ID NO: 7244472 - DNA, 22 bp, Homo sapiens
tctttctttatcacctgatatg

SEQ ID NO: 7244473 - DNA, 22 bp, Homo sapiens
ccaggcctgcatctgctgcgca

SEQ ID NO: 7244474 - DNA, 22 bp, Homo sapiens
ccaggcctgcattccctctcag

SEQ ID NO: 7244475 - DNA, 22 bp, Homo sapiens
ccaggcccaccttggccactta

SEQ ID NO: 7244476 - DNA, 22 bp, Homo sapiens
ccaggcccagggtactgaccaa

SEQ ID NO: 7244477 - DNA, 22 bp, Homo sapiens
ccaggccccagggctggctttc

SEQ ID NO: 7244478 - DNA, 22 bp, Homo sapiens
tctttcaatccattcatatgtc

SEQ ID NO: 7244479 - DNA, 22 bp, Homo sapiens
ccaggcccccgagcagaagaca

SEQ ID NO: 7244480 - DNA, 22 bp, Homo sapiens
ccaggcctggaccatgccaggg

SEQ ID NO: 7244481 - DNA, 22 bp, Homo sapiens
ccaggctgaatatgttccaggg

SEQ ID NO: 7244482 - DNA, 22 bp, Homo sapiens
tctttggctatgatttactgtt

SEQ ID NO: 7244483 - DNA, 22 bp, Homo sapiens
ccaggccagagtgcagtggcac

SEQ ID NO: 7244484 - DNA, 22 bp, Homo sapiens
tcttcagaggagctgaatatat

SEQ ID NO: 7244485 - DNA, 22 bp, Homo sapiens
tcttcagagatgtaacatatgg

SEQ ID NO: 7244486 - DNA, 22 bp, Homo sapiens
tcttcagacttccggaaacgtg

SEQ ID NO: 7244487 - DNA, 22 bp, Homo sapiens
tcttcagaaaattatcacttgt

SEQ ID NO: 7244488 - DNA, 22 bp, Homo sapiens
tcttcagaagatcacatcagtg

SEQ ID NO: 7244489 - DNA, 22 bp, Homo sapiens
tcttcagagtgagcagtgtcat

SEQ ID NO: 7244490 - DNA, 22 bp, Homo sapiens
ccaggagtttgaggctgcagtg

SEQ ID NO: 7244491 - DNA, 22 bp, Homo sapiens
ccaggagttggaggctgcagtg

SEQ ID NO: 7244492 - DNA, 22 bp, Homo sapiens
ccaggagttggaagctgccatg

SEQ ID NO: 7244493 - DNA, 22 bp, Homo sapiens
ccaggaggttgaggctgcagtg

SEQ ID NO: 7244494 - DNA, 22 bp, Homo sapiens
ccaggagactgtactgatattt

SEQ ID NO: 7244495 - DNA, 22 bp, Homo sapiens
cctcagaggttctgtgtgggaa

SEQ ID NO: 7244496 - DNA, 22 bp, Homo sapiens
cctcagaggtgtggcatctctg

SEQ ID NO: 7244497 - DNA, 23 bp, Homo sapiens
cctcagaggcctcatagtctggc

SEQ ID NO: 7244498 - DNA, 22 bp, Homo sapiens
cctcagaggcagatggtaagaa

SEQ ID NO: 7244499 - DNA, 22 bp, Homo sapiens
tggcagggtgggcttcagcccc

SEQ ID NO: 7244500 - DNA, 22 bp, Homo sapiens
tggcagggttggccaccttacc

SEQ ID NO: 7244501 - DNA, 22 bp, Homo sapiens
cctaggagttgaggtggccaga

SEQ ID NO: 7244502 - DNA, 22 bp, Homo sapiens
cctaggagttcgaagctgcagt

SEQ ID NO: 7244503 - DNA, 21 bp, Homo sapiens
cctaggaggcttaattaggct

SEQ ID NO: 7244504 - DNA, 22 bp, Homo sapiens
cctaggagaggtaatgaagttc

SEQ ID NO: 7244505 - DNA, 22 bp, Homo sapiens
cctagaggctgcaaggagaggc

SEQ ID NO: 7244506 - DNA, 22 bp, Homo sapiens
cccttcctggagtaccctctgt

SEQ ID NO: 7244507 - DNA, 19 bp, Homo sapiens
tggcagaggacaaggactt

SEQ ID NO: 7244508 - DNA, 22 bp, Homo sapiens
cccttctctttcactcactatt

SEQ ID NO: 7244509 - DNA, 22 bp, Homo sapiens
cctcatgctgcatctctgaggt

SEQ ID NO: 7244510 - DNA, 22 bp, Homo sapiens
tggcctggctcacagtgagatt

SEQ ID NO: 7244511 - DNA, 22 bp, Homo sapiens
cctcagtgagtgtttccttctt

SEQ ID NO: 7244512 - DNA, 18 bp, Homo sapiens
cctcagggagagagacgc

SEQ ID NO: 7244513 - DNA, 18 bp, Homo sapiens
cctcagggagagagacgc

SEQ ID NO: 7244514 - DNA, 22 bp, Homo sapiens
cctcagggactccatgctgcag

SEQ ID NO: 7244515 - DNA, 22 bp, Homo sapiens
tggctctggtgcgggctcctgc

SEQ ID NO: 7244516 - DNA, 22 bp, Homo sapiens
tggcccagcagttctgccccag

SEQ ID NO: 7244517 - DNA, 22 bp, Homo sapiens
tggcccagcactccaagtaggg

SEQ ID NO: 7244518 - DNA, 20 bp, Homo sapiens
tggcccagcacgacgaggac

SEQ ID NO: 7244519 - DNA, 20 bp, Homo sapiens
tggcccagcacgacgaggac

SEQ ID NO: 7244520 - DNA, 22 bp, Homo sapiens
tggcccagatctctgaccttga

SEQ ID NO: 7244521 - DNA, 22 bp, Homo sapiens
tggcccagagcactgctgggca

SEQ ID NO: 7244522 - DNA, 19 bp, Homo sapiens
tggcccagatggtcctggg

SEQ ID NO: 7244523 - DNA, 19 bp, Homo sapiens
tggcccagatggtcctggg

SEQ ID NO: 7244524 - DNA, 22 bp, Homo sapiens
cctcagaggttttcattctgta

SEQ ID NO: 7244525 - DNA, 22 bp, Homo sapiens
cctcagagttatttgaagtgaa

SEQ ID NO: 7244526 - DNA, 22 bp, Homo sapiens
cctcaggctctgggtgcctacc

SEQ ID NO: 7244527 - DNA, 22 bp, Homo sapiens
cctcaggctagctactgtccct

SEQ ID NO: 7244528 - DNA, 22 bp, Homo sapiens
cctcaggctagctactgtccct

SEQ ID NO: 7244529 - DNA, 22 bp, Homo sapiens
cctcaggctgggctgcccctgg

SEQ ID NO: 7244530 - DNA, 22 bp, Homo sapiens
cctcaggctgtcttccttctgg

SEQ ID NO: 7244531 - DNA, 22 bp, Homo sapiens
cctcaggctgggctgcccctgg

SEQ ID NO: 7244532 - DNA, 22 bp, Homo sapiens
cctcaggcttcgtcttccaccc

SEQ ID NO: 7244533 - DNA, 22 bp, Homo sapiens
cctcaggcttaacttgtcttga

SEQ ID NO: 7244534 - DNA, 22 bp, Homo sapiens
cctcagggaatgggaggctggg

SEQ ID NO: 7244535 - DNA, 22 bp, Homo sapiens
cctcagggaatgggaggctggg

SEQ ID NO: 7244536 - DNA, 22 bp, Homo sapiens
cctcagggaatgggaggctggg

SEQ ID NO: 7244537 - DNA, 22 bp, Homo sapiens
cctcaggcttgtgagccttcag

SEQ ID NO: 7244538 - DNA, 22 bp, Homo sapiens
cctgagcatcagcgcctcctta

SEQ ID NO: 7244539 - DNA, 22 bp, Homo sapiens
tgggcccaagagagtctccaac

SEQ ID NO: 7244540 - DNA, 23 bp, Homo sapiens
tgggagtgttgggatctctgctc

SEQ ID NO: 7244541 - DNA, 22 bp, Homo sapiens
cctcttctaggacgtccttgtg

SEQ ID NO: 7244542 - DNA, 22 bp, Homo sapiens
cctcttctaggtttcagcctgc

SEQ ID NO: 7244543 - DNA, 22 bp, Homo sapiens
tgggagtggggcatagaaggta

SEQ ID NO: 7244544 - DNA, 19 bp, Homo sapiens
tgggagtggggaaggtcct

SEQ ID NO: 7244545 - DNA, 22 bp, Homo sapiens
cctcttctcaactccagccaga

SEQ ID NO: 7244546 - DNA, 19 bp, Homo sapiens
tgggagtggggaaggtcct

SEQ ID NO: 7244547 - DNA, 22 bp, Homo sapiens
tgggctgcttctattggtggtc

SEQ ID NO: 7244548 - DNA, 22 bp, Homo sapiens
tgggctgcttcctcagctgaga

SEQ ID NO: 7244549 - DNA, 22 bp, Homo sapiens
tgggctgcttcctcagctgaga

SEQ ID NO: 7244550 - DNA, 22 bp, Homo sapiens
tgggctgctgttacaggggctg

SEQ ID NO: 7244551 - DNA, 22 bp, Homo sapiens
tgggctgcttctcaaatgtctc

SEQ ID NO: 7244552 - DNA, 22 bp, Homo sapiens
cctgagctgcggggcagtgctc

SEQ ID NO: 7244553 - DNA, 22 bp, Homo sapiens
cctgagctgaactaagcagttt

SEQ ID NO: 7244554 - DNA, 22 bp, Homo sapiens
tgggctgctgcggtgctcttgg

SEQ ID NO: 7244555 - DNA, 22 bp, Homo sapiens
tgggctgctgagaatgagagag

SEQ ID NO: 7244556 - DNA, 22 bp, Homo sapiens
tgggctgctgagaatgagagag

SEQ ID NO: 7244557 - DNA, 22 bp, Homo sapiens
tgggctgctgtctgcacatgct

SEQ ID NO: 7244558 - DNA, 22 bp, Homo sapiens
tgggctgctgtctgcacatgct

SEQ ID NO: 7244559 - DNA, 22 bp, Homo sapiens
tgggctgcggataggcctcgga

SEQ ID NO: 7244560 - DNA, 18 bp, Homo sapiens
tgggctgcctggcctctg

SEQ ID NO: 7244561 - DNA, 22 bp, Homo sapiens
tgggcccttatgaagctcaaga

SEQ ID NO: 7244562 - DNA, 22 bp, Homo sapiens
tgggccctggtggccatgcctc

SEQ ID NO: 7244563 - DNA, 22 bp, Homo sapiens
tgggcccgcagctgctgctcca

SEQ ID NO: 7244564 - DNA, 23 bp, Homo sapiens
tgggccctggagtcgccagtctg

SEQ ID NO: 7244565 - DNA, 22 bp, Homo sapiens
tgggcccaggtcctgggagaag

SEQ ID NO: 7244566 - DNA, 21 bp, Homo sapiens
tgggcccagttcccgctgggc

SEQ ID NO: 7244567 - DNA, 21 bp, Homo sapiens
tgggcccagttcccgctgggc

SEQ ID NO: 7244568 - DNA, 22 bp, Homo sapiens
tgggcccatcattgctgtgggc

SEQ ID NO: 7244569 - DNA, 21 bp, Homo sapiens
tgggcccagctctgtctgttt

SEQ ID NO: 7244570 - DNA, 22 bp, Homo sapiens
tgggcccacatgcctttctgcc

SEQ ID NO: 7244571 - DNA, 22 bp, Homo sapiens
tgggcccaagagagtctccaac

SEQ ID NO: 7244572 - DNA, 22 bp, Homo sapiens
tgggcccaagtgcaatgcagtg

SEQ ID NO: 7244573 - DNA, 22 bp, Homo sapiens
tggctgagaatgggatgatgcc

SEQ ID NO: 7244574 - DNA, 22 bp, Homo sapiens
tggctgagaccatcagggtgta

SEQ ID NO: 7244575 - DNA, 22 bp, Homo sapiens
tggctctgtcactgtgagctat

SEQ ID NO: 7244576 - DNA, 16 bp, Homo sapiens
tggctgagagagggtt

SEQ ID NO: 7244577 - DNA, 22 bp, Homo sapiens
tggctgagagaagacggggaag

SEQ ID NO: 7244578 - DNA, 22 bp, Homo sapiens
tggctgagaccttcccaaattc

SEQ ID NO: 7244579 - DNA, 18 bp, Homo sapiens
tggctggctctgtcatct

SEQ ID NO: 7244580 - DNA, 22 bp, Homo sapiens
tggctggctggaccacacctgc

SEQ ID NO: 7244581 - DNA, 22 bp, Homo sapiens
tggctggcttgttcactgactg

SEQ ID NO: 7244582 - DNA, 22 bp, Homo sapiens
tggctgggagctggaactgggc

SEQ ID NO: 7244583 - DNA, 22 bp, Homo sapiens
tggcttcatgtagtttgagttg

SEQ ID NO: 7244584 - DNA, 22 bp, Homo sapiens
tgggaaggaactgcctttagct

SEQ ID NO: 7244585 - DNA, 22 bp, Homo sapiens
cctctgctgctgttgagcaccg

SEQ ID NO: 7244586 - DNA, 22 bp, Homo sapiens
cctctggaggctctaagagaga

SEQ ID NO: 7244587 - DNA, 22 bp, Homo sapiens
tgggaaggacgtgtcagtggca

SEQ ID NO: 7244588 - DNA, 22 bp, Homo sapiens
cctctgagtagactggacatga

SEQ ID NO: 7244589 - DNA, 18 bp, Homo sapiens
cctctgccatagccagca

SEQ ID NO: 7244590 - DNA, 18 bp, Homo sapiens
cctctgccatagccagca

SEQ ID NO: 7244591 - DNA, 20 bp, Homo sapiens
cctctgccccggggctgcta

SEQ ID NO: 7244592 - DNA, 22 bp, Homo sapiens
cctctgcccttttcctgtatca

SEQ ID NO: 7244593 - DNA, 18 bp, Homo sapiens
cctctgcctttgtagagc

SEQ ID NO: 7244594 - DNA, 20 bp, Homo sapiens
cctctgcctttctagtctga

SEQ ID NO: 7244595 - DNA, 20 bp, Homo sapiens
cctctgcctttctagtctga

SEQ ID NO: 7244596 - DNA, 22 bp, Homo sapiens
cctctgcctgcacatcatcctg

SEQ ID NO: 7244597 - DNA, 19 bp, Homo sapiens
cctctgcgctgtcctgctc

SEQ ID NO: 7244598 - DNA, 22 bp, Homo sapiens
tgctgtgtggatgtgaagaatc

SEQ ID NO: 7244599 - DNA, 22 bp, Homo sapiens
tggaagggagctggaatttgga

SEQ ID NO: 7244600 - DNA, 22 bp, Homo sapiens
ccctcggggcctcagtttccct

SEQ ID NO: 7244601 - DNA, 22 bp, Homo sapiens
ccctcctctccctaagagtcac

SEQ ID NO: 7244602 - DNA, 22 bp, Homo sapiens
ccctctcctggctgcatggagc

SEQ ID NO: 7244603 - DNA, 22 bp, Homo sapiens
ccctctccctgcagaatgtggc

SEQ ID NO: 7244604 - DNA, 18 bp, Homo sapiens
ccctctcctgctagtggg

SEQ ID NO: 7244605 - DNA, 22 bp, Homo sapiens
ccctgacccaaaactgtcagaa

SEQ ID NO: 7244606 - DNA, 22 bp, Homo sapiens
ccctgaccatcccgcactgact

SEQ ID NO: 7244607 - DNA, 22 bp, Homo sapiens
tggagcaggacggggagtggta

SEQ ID NO: 7244608 - DNA, 22 bp, Homo sapiens
cccattccctttactgttgcat

SEQ ID NO: 7244609 - DNA, 22 bp, Homo sapiens
ccccacagtccgtgaggagcca

SEQ ID NO: 7244610 - DNA, 22 bp, Homo sapiens
ccccacagcttgtggagagaat

SEQ ID NO: 7244611 - DNA, 22 bp, Homo sapiens
ccccacagccgccagcagggag

SEQ ID NO: 7244612 - DNA, 22 bp, Homo sapiens
ccccaccctcgctccatttcgg

SEQ ID NO: 7244613 - DNA, 22 bp, Homo sapiens
ccccaccagcaccctctctatc

SEQ ID NO: 7244614 - DNA, 22 bp, Homo sapiens
ccccacccacctaagagaaact

SEQ ID NO: 7244615 - DNA, 22 bp, Homo sapiens
tgctggagcccaggcggccttt

SEQ ID NO: 7244616 - DNA, 22 bp, Homo sapiens
tgctggcctggttagaaagggg

SEQ ID NO: 7244617 - DNA, 22 bp, Homo sapiens
tgctggcccagtatggactgca

SEQ ID NO: 7244618 - DNA, 22 bp, Homo sapiens
cccgagggccgaaagctgcttt

SEQ ID NO: 7244619 - DNA, 22 bp, Homo sapiens
cccgagcgggccctggggtgac

SEQ ID NO: 7244620 - DNA, 22 bp, Homo sapiens
ccccttctctgcaagcctgctc

SEQ ID NO: 7244621 - DNA, 22 bp, Homo sapiens
ccccttctgtgtcctgtcagcc

SEQ ID NO: 7244622 - DNA, 22 bp, Homo sapiens
ccccttctggtcttcaatggtg

SEQ ID NO: 7244623 - DNA, 22 bp, Homo sapiens
ccccttctgtgtcctgtcagcc

SEQ ID NO: 7244624 - DNA, 22 bp, Homo sapiens
cccctttctcccgcgactggcc

SEQ ID NO: 7244625 - DNA, 22 bp, Homo sapiens
tgctgggcacacagtaggtgct

SEQ ID NO: 7244626 - DNA, 23 bp, Homo sapiens
cccctctggtggctcagctcctg

SEQ ID NO: 7244627 - DNA, 22 bp, Homo sapiens
tgcctgttgcccacctgataaa

SEQ ID NO: 7244628 - DNA, 22 bp, Homo sapiens
cccaggggttctagaccagctt

SEQ ID NO: 7244629 - DNA, 22 bp, Homo sapiens
cccaggggttcaaggctgcagt

SEQ ID NO: 7244630 - DNA, 22 bp, Homo sapiens
cccagggtagctgagctggcag

SEQ ID NO: 7244631 - DNA, 22 bp, Homo sapiens
cccagggtgcggccctggctgg

SEQ ID NO: 7244632 - DNA, 22 bp, Homo sapiens
cccagggtccctgctctctgtg

SEQ ID NO: 7244633 - DNA, 22 bp, Homo sapiens
cccagggtccctgctctctgtg

SEQ ID NO: 7244634 - DNA, 22 bp, Homo sapiens
cccagggtggatgcaagcagca

SEQ ID NO: 7244635 - DNA, 22 bp, Homo sapiens
cccagggttgcctgcctctgct

SEQ ID NO: 7244636 - DNA, 23 bp, Homo sapiens
cccaggtagccctctagagcctg

SEQ ID NO: 7244637 - DNA, 22 bp, Homo sapiens
tgccctggggagcccagccagg

SEQ ID NO: 7244638 - DNA, 22 bp, Homo sapiens
tgcccagctattcctttcttag

SEQ ID NO: 7244639 - DNA, 22 bp, Homo sapiens
tgcccagcgcccacattctgtc

SEQ ID NO: 7244640 - DNA, 22 bp, Homo sapiens
tgcccagcgcccacattctgtc

SEQ ID NO: 7244641 - DNA, 22 bp, Homo sapiens
tgcccagcctaaacttggcaag

SEQ ID NO: 7244642 - DNA, 22 bp, Homo sapiens
tgcccagcctaaacttggcaag

SEQ ID NO: 7244643 - DNA, 22 bp, Homo sapiens
tgcccagcccctatccctggga

SEQ ID NO: 7244644 - DNA, 22 bp, Homo sapiens
tgcccagcttcttacttttaaa

SEQ ID NO: 7244645 - DNA, 22 bp, Homo sapiens
tgcccagctgtcaaagtagata

SEQ ID NO: 7244646 - DNA, 22 bp, Homo sapiens
tgcccagccagtttatggtaat

SEQ ID NO: 7244647 - DNA, 22 bp, Homo sapiens
cccaggagagaggccagttggc

SEQ ID NO: 7244648 - DNA, 22 bp, Homo sapiens
tgcacagagagatgagacacgt

SEQ ID NO: 7244649 - DNA, 22 bp, Homo sapiens
catggcaggatctgggcccaca

SEQ ID NO: 7244650 - DNA, 22 bp, Homo sapiens
catggccagcccccagttcctc

SEQ ID NO: 7244651 - DNA, 22 bp, Homo sapiens
catggccacatctagctgcaag

SEQ ID NO: 7244652 - DNA, 22 bp, Homo sapiens
catgcattgtaatttttagtct

SEQ ID NO: 7244653 - DNA, 22 bp, Homo sapiens
catgcattcctcctctgcctta

SEQ ID NO: 7244654 - DNA, 22 bp, Homo sapiens
catgcattcagaatctctcaca

SEQ ID NO: 7244655 - DNA, 22 bp, Homo sapiens
catgcattacaattgcatagta

SEQ ID NO: 7244656 - DNA, 22 bp, Homo sapiens
catgcatggagctcaccctccc

SEQ ID NO: 7244657 - DNA, 22 bp, Homo sapiens
catgcatgcctggctcacagag

SEQ ID NO: 7244658 - DNA, 22 bp, Homo sapiens
catgcattttctattcactcag

SEQ ID NO: 7244659 - DNA, 22 bp, Homo sapiens
catgcatttggagttttcaagt

SEQ ID NO: 7244660 - DNA, 22 bp, Homo sapiens
catgcatttctaccaaggaata

SEQ ID NO: 7244661 - DNA, 22 bp, Homo sapiens
catggcagagcctgcaggtggg

SEQ ID NO: 7244662 - DNA, 22 bp, Homo sapiens
catggcagcctgccctgcttgc

SEQ ID NO: 7244663 - DNA, 22 bp, Homo sapiens
catgcagtcaataaacatgtgt

SEQ ID NO: 7244664 - DNA, 22 bp, Homo sapiens
catgcagtgaaattgatatcca

SEQ ID NO: 7244665 - DNA, 22 bp, Homo sapiens
catgcagtgactcagacacagg

SEQ ID NO: 7244666 - DNA, 22 bp, Homo sapiens
catgcagtgactcagacacagg

SEQ ID NO: 7244667 - DNA, 22 bp, Homo sapiens
catgcagtgatgcactgcatca

SEQ ID NO: 7244668 - DNA, 22 bp, Homo sapiens
catgcatagagcagaacttggc

SEQ ID NO: 7244669 - DNA, 22 bp, Homo sapiens
catgcatagaatgaagaggctg

SEQ ID NO: 7244670 - DNA, 21 bp, Homo sapiens
catgcatacatatacaagctt

SEQ ID NO: 7244671 - DNA, 22 bp, Homo sapiens
catgcatacacaggtcaggcag

SEQ ID NO: 7244672 - DNA, 16 bp, Homo sapiens
catgcataaacgatgg

SEQ ID NO: 7244673 - DNA, 22 bp, Homo sapiens
catgcagttgaagcacagagag

SEQ ID NO: 7244674 - DNA, 22 bp, Homo sapiens
catgcagtgcctctggattctt

SEQ ID NO: 7244675 - DNA, 22 bp, Homo sapiens
catgcatattactagcacagca

SEQ ID NO: 7244676 - DNA, 22 bp, Homo sapiens
catgcatagtttttctagaagg

SEQ ID NO: 7244677 - DNA, 22 bp, Homo sapiens
catgcataggaaatgttttttg

SEQ ID NO: 7244678 - DNA, 22 bp, Homo sapiens
catgcatagctttggagctagg

SEQ ID NO: 7244679 - DNA, 22 bp, Homo sapiens
catgcatagccagcattgtatg

SEQ ID NO: 7244680 - DNA, 22 bp, Homo sapiens
catgcatatatgctacatgcaa

SEQ ID NO: 7244681 - DNA, 22 bp, Homo sapiens
catgcatatgtcaaaaaagcta

SEQ ID NO: 7244682 - DNA, 22 bp, Homo sapiens
catgaacagctaacattttggg

SEQ ID NO: 7244683 - DNA, 22 bp, Homo sapiens
catgaacagattcttcatttct

SEQ ID NO: 7244684 - DNA, 22 bp, Homo sapiens
catgaaattgtattggcctcaa

SEQ ID NO: 7244685 - DNA, 22 bp, Homo sapiens
catgaaatttgaagtacagcaa

SEQ ID NO: 7244686 - DNA, 22 bp, Homo sapiens
catgaaattgctcctttggtgc

SEQ ID NO: 7244687 - DNA, 22 bp, Homo sapiens
catctggttagttgatgaaact

SEQ ID NO: 7244688 - DNA, 22 bp, Homo sapiens
catctggtttaaaagaagaaag

SEQ ID NO: 7244689 - DNA, 22 bp, Homo sapiens
catctgctgttccttggactca

SEQ ID NO: 7244690 - DNA, 22 bp, Homo sapiens
catctggacaaaactctgaagg

SEQ ID NO: 7244691 - DNA, 19 bp, Homo sapiens
catctggatgattctcctg

SEQ ID NO: 7244692 - DNA, 20 bp, Homo sapiens
catctgagcccacagaagtc

SEQ ID NO: 7244693 - DNA, 22 bp, Homo sapiens
tcagtcaccttgactatagctg

SEQ ID NO: 7244694 - DNA, 22 bp, Homo sapiens
tcagtcatcccagctttcatct

SEQ ID NO: 7244695 - DNA, 22 bp, Homo sapiens
tcagtgctgagtagcgtgcacc

SEQ ID NO: 7244696 - DNA, 22 bp, Homo sapiens
tcagaggattgcctcagcgagc

SEQ ID NO: 7244697 - DNA, 22 bp, Homo sapiens
tcagaggagcaaaagaggggat

SEQ ID NO: 7244698 - DNA, 22 bp, Homo sapiens
tcagaggagcaaaagaggggat

SEQ ID NO: 7244699 - DNA, 22 bp, Homo sapiens
tcagaggagcaaaagaggggat

SEQ ID NO: 7244700 - DNA, 22 bp, Homo sapiens
tcagaggagccaaagttctgag

SEQ ID NO: 7244701 - DNA, 22 bp, Homo sapiens
tcagaggagctgcagaacgctg

SEQ ID NO: 7244702 - DNA, 22 bp, Homo sapiens
tcagaggatcatgtccctactc

SEQ ID NO: 7244703 - DNA, 17 bp, Homo sapiens
cataaaacagttctatt

SEQ ID NO: 7244704 - DNA, 22 bp, Homo sapiens
cagtttttcaaaattacatgat

SEQ ID NO: 7244705 - DNA, 22 bp, Homo sapiens
tcagagaggttggtgataagaa

SEQ ID NO: 7244706 - DNA, 22 bp, Homo sapiens
cagttgtaatgctttcctctga

SEQ ID NO: 7244707 - DNA, 22 bp, Homo sapiens
tcagagagtcctggtcatttgc

SEQ ID NO: 7244708 - DNA, 21 bp, Homo sapiens
tcagagagtcacagtgaactg

SEQ ID NO: 7244709 - DNA, 22 bp, Homo sapiens
cagttgcagctgtgacattgcg

SEQ ID NO: 7244710 - DNA, 22 bp, Homo sapiens
cagttgcactagccacatttca

SEQ ID NO: 7244711 - DNA, 22 bp, Homo sapiens
tcagagagttttcactagggtg

SEQ ID NO: 7244712 - DNA, 22 bp, Homo sapiens
tcagagagttggaaagaattaa

SEQ ID NO: 7244713 - DNA, 22 bp, Homo sapiens
tcagagagttagtgtcttagct

SEQ ID NO: 7244714 - DNA, 22 bp, Homo sapiens
tcagagagtgcaaaatatagct

SEQ ID NO: 7244715 - DNA, 22 bp, Homo sapiens
tcagagagttacacaaattgtt

SEQ ID NO: 7244716 - DNA, 22 bp, Homo sapiens
cagttagaggaggtaaagatgc

SEQ ID NO: 7244717 - DNA, 22 bp, Homo sapiens
tcaatcacgtgttccatgttct

SEQ ID NO: 7244718 - DNA, 22 bp, Homo sapiens
catagaacagctcctagcacat

SEQ ID NO: 7244719 - DNA, 22 bp, Homo sapiens
catagaatcatagcacatttga

SEQ ID NO: 7244720 - DNA, 22 bp, Homo sapiens
catagaatatgtgtgattgtta

SEQ ID NO: 7244721 - DNA, 22 bp, Homo sapiens
catagaatggattgacaagatt

SEQ ID NO: 7244722 - DNA, 22 bp, Homo sapiens
catagaatgcagcaggaaagtt

SEQ ID NO: 7244723 - DNA, 22 bp, Homo sapiens
tcaggcctagaacacagcagat

SEQ ID NO: 7244724 - DNA, 22 bp, Homo sapiens
tcaggccccatcccagacttat

SEQ ID NO: 7244725 - DNA, 22 bp, Homo sapiens
tcaggccccttgtcagctctgt

SEQ ID NO: 7244726 - DNA, 22 bp, Homo sapiens
tcaggccctttgctgctgcccc

SEQ ID NO: 7244727 - DNA, 22 bp, Homo sapiens
tcaggcccttctcccaggactc

SEQ ID NO: 7244728 - DNA, 22 bp, Homo sapiens
catagaaatcaggtgagaatct

SEQ ID NO: 7244729 - DNA, 22 bp, Homo sapiens
catagaaatcaggtgagaatct

SEQ ID NO: 7244730 - DNA, 22 bp, Homo sapiens
catagaaatcaggtgagaatct

SEQ ID NO: 7244731 - DNA, 22 bp, Homo sapiens
catagaaagtattatggaattt

SEQ ID NO: 7244732 - DNA, 22 bp, Homo sapiens
catagaaagtattatggaattt

SEQ ID NO: 7244733 - DNA, 22 bp, Homo sapiens
catagaaactgagacaaggatt

SEQ ID NO: 7244734 - DNA, 22 bp, Homo sapiens
catagaaacttgcagcaagcac

SEQ ID NO: 7244735 - DNA, 22 bp, Homo sapiens
catagaaacttgcagcaagcac

SEQ ID NO: 7244736 - DNA, 22 bp, Homo sapiens
catagaaactgagacaaggatt

SEQ ID NO: 7244737 - DNA, 22 bp, Homo sapiens
tcaggcccagagtcacggatcc

SEQ ID NO: 7244738 - DNA, 22 bp, Homo sapiens
cataatttgtggtagtggggga

SEQ ID NO: 7244739 - DNA, 22 bp, Homo sapiens
ccacactttgagatgactagga

SEQ ID NO: 7244740 - DNA, 22 bp, Homo sapiens
ccacactgaccagctgtgagac

SEQ ID NO: 7244741 - DNA, 22 bp, Homo sapiens
ccacactgaacctcagtgtctt

SEQ ID NO: 7244742 - DNA, 17 bp, Homo sapiens
ccacaccctttccttcc

SEQ ID NO: 7244743 - DNA, 19 bp, Homo sapiens
ccacacagtgtgcaattta

SEQ ID NO: 7244744 - DNA, 22 bp, Homo sapiens
tcctacagatactaaggagatc

SEQ ID NO: 7244745 - DNA, 22 bp, Homo sapiens
ccaaggccacaaacagcctggc

SEQ ID NO: 7244746 - DNA, 22 bp, Homo sapiens
ccaaggcatatggctgaaacca

SEQ ID NO: 7244747 - DNA, 22 bp, Homo sapiens
ccaaggcaggggatcaaagttt

SEQ ID NO: 7244748 - DNA, 22 bp, Homo sapiens
ccaaggcagaagatggctcttg

SEQ ID NO: 7244749 - DNA, 22 bp, Homo sapiens
ccaaggcacactctgcaaggtt

SEQ ID NO: 7244750 - DNA, 22 bp, Homo sapiens
ccaaggcaatgtgcagctggtg

SEQ ID NO: 7244751 - DNA, 22 bp, Homo sapiens
ccaaggcaacgttggtgtcagg

SEQ ID NO: 7244752 - DNA, 22 bp, Homo sapiens
ccaaggaggccccaggtcagct

SEQ ID NO: 7244753 - DNA, 22 bp, Homo sapiens
ccaaggccacaaacagcctggc

SEQ ID NO: 7244754 - DNA, 22 bp, Homo sapiens
ccagagaattttagacaaaaat

SEQ ID NO: 7244755 - DNA, 22 bp, Homo sapiens
tctaagctagtggctcatgtga

SEQ ID NO: 7244756 - DNA, 22 bp, Homo sapiens
tctaagcctcagaccacgctgc

SEQ ID NO: 7244757 - DNA, 22 bp, Homo sapiens
tctaaggtcaggggaaagtttg

SEQ ID NO: 7244758 - DNA, 22 bp, Homo sapiens
ccactgtctgcaggcctcagca

SEQ ID NO: 7244759 - DNA, 22 bp, Homo sapiens
ccactgtcagaggggctgtgcc

SEQ ID NO: 7244760 - DNA, 22 bp, Homo sapiens
ccactgtcttttccaggctgaa

SEQ ID NO: 7244761 - DNA, 22 bp, Homo sapiens
ccactgtcttttccaggctgaa

SEQ ID NO: 7244762 - DNA, 22 bp, Homo sapiens
ccacttcatcagtgctccattt

SEQ ID NO: 7244763 - DNA, 22 bp, Homo sapiens
tctaagccgcaagcctatctgt

SEQ ID NO: 7244764 - DNA, 22 bp, Homo sapiens
tctaagaaatcagatgatgagg

SEQ ID NO: 7244765 - DNA, 19 bp, Homo sapiens
tcctggggaggggcatggc

SEQ ID NO: 7244766 - DNA, 22 bp, Homo sapiens
tcctgggcttagtggctaggtc

SEQ ID NO: 7244767 - DNA, 22 bp, Homo sapiens
tcccactcccaggcaggcctct

SEQ ID NO: 7244768 - DNA, 22 bp, Homo sapiens
tcccactcactgtctctgacac

SEQ ID NO: 7244769 - DNA, 22 bp, Homo sapiens
tccctctctagcctgttcagta

SEQ ID NO: 7244770 - DNA, 22 bp, Homo sapiens
catttattcatgatctgtagct

SEQ ID NO: 7244771 - DNA, 22 bp, Homo sapiens
catttattgagtggccacagtg

SEQ ID NO: 7244772 - DNA, 22 bp, Homo sapiens
tccctgggtcctgcttgctctc

SEQ ID NO: 7244773 - DNA, 22 bp, Homo sapiens
tccctgggtcattctctggcac

SEQ ID NO: 7244774 - DNA, 22 bp, Homo sapiens
tccctggggttcctccagccac

SEQ ID NO: 7244775 - DNA, 22 bp, Homo sapiens
tccctgggttacctttcaaggt

SEQ ID NO: 7244776 - DNA, 22 bp, Homo sapiens
tccctgggttcccgtggaagtg

SEQ ID NO: 7244777 - DNA, 22 bp, Homo sapiens
tccctggggtatcgctgaggca

SEQ ID NO: 7244778 - DNA, 22 bp, Homo sapiens
tccctggggtaacattagaggg

SEQ ID NO: 7244779 - DNA, 20 bp, Homo sapiens
tccctggggccctacttcct

SEQ ID NO: 7244780 - DNA, 18 bp, Homo sapiens
tccctggggctgccaccc

SEQ ID NO: 7244781 - DNA, 22 bp, Homo sapiens
cattctgggtctggctcaggga

SEQ ID NO: 7244782 - DNA, 22 bp, Homo sapiens
cattctctgatcttcacatacc

SEQ ID NO: 7244783 - DNA, 22 bp, Homo sapiens
tcccaccccttgactctttaag

SEQ ID NO: 7244784 - DNA, 22 bp, Homo sapiens
tcccaccccttgactctttaag

SEQ ID NO: 7244785 - DNA, 22 bp, Homo sapiens
tcccaccccggtcaagggctga

SEQ ID NO: 7244786 - DNA, 22 bp, Homo sapiens
tcccaccccggtcaagggctga

SEQ ID NO: 7244787 - DNA, 22 bp, Homo sapiens
tcccacccatcctgcatctctt

SEQ ID NO: 7244788 - DNA, 22 bp, Homo sapiens
tcccaccccctccaaggaggaa

SEQ ID NO: 7244789 - DNA, 22 bp, Homo sapiens
tcccacccatcctgcatctctt

SEQ ID NO: 7244790 - DNA, 22 bp, Homo sapiens
cattacagtgtcagaggaactg

SEQ ID NO: 7244791 - DNA, 22 bp, Homo sapiens
tcccaaacatttttggccttga

SEQ ID NO: 7244792 - DNA, 22 bp, Homo sapiens
cattagaacctataaaaagcat

SEQ ID NO: 7244793 - DNA, 22 bp, Homo sapiens
cattagaagaacagttatatta

SEQ ID NO: 7244794 - DNA, 22 bp, Homo sapiens
cattagaaggttttaaaggaat

SEQ ID NO: 7244795 - DNA, 22 bp, Homo sapiens
cattagcaatcataaaccttta

SEQ ID NO: 7244796 - DNA, 22 bp, Homo sapiens
catgggcaccttaaaatgaggc

SEQ ID NO: 7244797 - DNA, 22 bp, Homo sapiens
tccattttcatctcatgtataa

SEQ ID NO: 7244798 - DNA, 22 bp, Homo sapiens
tccattttcatctcatgtataa

SEQ ID NO: 7244799 - DNA, 22 bp, Homo sapiens
tccatcaccacagaggacagag

SEQ ID NO: 7244800 - DNA, 22 bp, Homo sapiens
tccatttgaaatgaaagtgata

SEQ ID NO: 7244801 - DNA, 22 bp, Homo sapiens
catgggccagagctcctctggg

SEQ ID NO: 7244802 - DNA, 22 bp, Homo sapiens
catgggcagttggcagggctca

SEQ ID NO: 7244803 - DNA, 22 bp, Homo sapiens
catgggcccgtgagaggcaggg

SEQ ID NO: 7244804 - DNA, 22 bp, Homo sapiens
tagatacaggcaagattatgaa

SEQ ID NO: 7244805 - DNA, 20 bp, Homo sapiens
cagggacagcagtgggtttt

SEQ ID NO: 7244806 - DNA, 22 bp, Homo sapiens
cagggacaaacaaggttgggga

SEQ ID NO: 7244807 - DNA, 22 bp, Homo sapiens
cagggacaatggcagagcctga

SEQ ID NO: 7244808 - DNA, 22 bp, Homo sapiens
tagaaacaagggagaggattct

SEQ ID NO: 7244809 - DNA, 22 bp, Homo sapiens
tagaaacaaagacctgggtgct

SEQ ID NO: 7244810 - DNA, 22 bp, Homo sapiens
tagaaacaaaatctgatgactc

SEQ ID NO: 7244811 - DNA, 22 bp, Homo sapiens
tagaaaatgttccactgccatt

SEQ ID NO: 7244812 - DNA, 22 bp, Homo sapiens
tagaaaatggccaagcaggact

SEQ ID NO: 7244813 - DNA, 22 bp, Homo sapiens
tagaaaatccagtgtggggaga

SEQ ID NO: 7244814 - DNA, 22 bp, Homo sapiens
tagaaaatagggcctgtggagc

SEQ ID NO: 7244815 - DNA, 22 bp, Homo sapiens
caggctggcaatgcgtcaagca

SEQ ID NO: 7244816 - DNA, 22 bp, Homo sapiens
caggctgggaacgccacccgct

SEQ ID NO: 7244817 - DNA, 22 bp, Homo sapiens
tagaaaagtatgggactgacat

SEQ ID NO: 7244818 - DNA, 22 bp, Homo sapiens
tagaaaagctctaaggcctctc

SEQ ID NO: 7244819 - DNA, 22 bp, Homo sapiens
tagaaaagctctaaggcctctc

SEQ ID NO: 7244820 - DNA, 22 bp, Homo sapiens
caggctgccgtgaagcaggcct

SEQ ID NO: 7244821 - DNA, 22 bp, Homo sapiens
caggctggagttcagtggtgtg

SEQ ID NO: 7244822 - DNA, 22 bp, Homo sapiens
caggctgccgtgaagcaggcct

SEQ ID NO: 7244823 - DNA, 22 bp, Homo sapiens
caggctgcagcagcagtggccc

SEQ ID NO: 7244824 - DNA, 22 bp, Homo sapiens
tactgtgtcttaggatgtggaa

SEQ ID NO: 7244825 - DNA, 22 bp, Homo sapiens
tacttgttatcatcttttcctt

SEQ ID NO: 7244826 - DNA, 22 bp, Homo sapiens
tacatttataaggcttctctgt

SEQ ID NO: 7244827 - DNA, 18 bp, Homo sapiens
caggcctttgagacagaa

SEQ ID NO: 7244828 - DNA, 22 bp, Homo sapiens
caggcgggcaggtgcggcccct

SEQ ID NO: 7244829 - DNA, 22 bp, Homo sapiens
caggcgctgtggctcccacctg

SEQ ID NO: 7244830 - DNA, 19 bp, Homo sapiens
caggcctcttaccctctct

SEQ ID NO: 7244831 - DNA, 22 bp, Homo sapiens
caggcctgaccctgagcttcac

SEQ ID NO: 7244832 - DNA, 22 bp, Homo sapiens
tacattgctagaaatgtatttt

SEQ ID NO: 7244833 - DNA, 22 bp, Homo sapiens
tacattgattcaggatataggc

SEQ ID NO: 7244834 - DNA, 22 bp, Homo sapiens
tacattgctcattatattgctt

SEQ ID NO: 7244835 - DNA, 22 bp, Homo sapiens
tacattgctttctaatacatct

SEQ ID NO: 7244836 - DNA, 22 bp, Homo sapiens
tacattgctttctaatacatct

SEQ ID NO: 7244837 - DNA, 22 bp, Homo sapiens
caggcctctccttagtctggca

SEQ ID NO: 7244838 - DNA, 22 bp, Homo sapiens
caggcctctccttagtctggca

SEQ ID NO: 7244839 - DNA, 22 bp, Homo sapiens
caggcctctccttagtctggca

SEQ ID NO: 7244840 - DNA, 22 bp, Homo sapiens
caggcctctatggtcagctgag

SEQ ID NO: 7244841 - DNA, 22 bp, Homo sapiens
caggcctcctatgagcactagc

SEQ ID NO: 7244842 - DNA, 22 bp, Homo sapiens
caggcccagcccagcccttcga

SEQ ID NO: 7244843 - DNA, 22 bp, Homo sapiens
taatcacagaaacagactgttt

SEQ ID NO: 7244844 - DNA, 22 bp, Homo sapiens
taatccagcgggtgattgcaca

SEQ ID NO: 7244845 - DNA, 22 bp, Homo sapiens
taatcatatgggtaatccaatg

SEQ ID NO: 7244846 - DNA, 22 bp, Homo sapiens
taatcagaagttacattagggt

SEQ ID NO: 7244847 - DNA, 22 bp, Homo sapiens
caggcattcctctatgaatatt

SEQ ID NO: 7244848 - DNA, 22 bp, Homo sapiens
caggccattaccgctgagaccc

SEQ ID NO: 7244849 - DNA, 22 bp, Homo sapiens
caggccagtgtgcttcccaggc

SEQ ID NO: 7244850 - DNA, 22 bp, Homo sapiens
taagtccataatggcagtaaat

SEQ ID NO: 7244851 - DNA, 22 bp, Homo sapiens
taagtccagtgttctctctgtg

SEQ ID NO: 7244852 - DNA, 22 bp, Homo sapiens
taagtccactatatccttctct

SEQ ID NO: 7244853 - DNA, 22 bp, Homo sapiens
taagtccacctcattcttcagc

SEQ ID NO: 7244854 - DNA, 22 bp, Homo sapiens
taagtccacaggctgacagcgg

SEQ ID NO: 7244855 - DNA, 22 bp, Homo sapiens
taagtccacaggagttgtgttc

SEQ ID NO: 7244856 - DNA, 22 bp, Homo sapiens
taagtccaagggtatgagttgg

SEQ ID NO: 7244857 - DNA, 22 bp, Homo sapiens
taataattggctaaccctggga

SEQ ID NO: 7244858 - DNA, 22 bp, Homo sapiens
taataattttaaagaaggctag

SEQ ID NO: 7244859 - DNA, 21 bp, Homo sapiens
taataattccactacagagta

SEQ ID NO: 7244860 - DNA, 22 bp, Homo sapiens
taataattggcaatgttgagca

SEQ ID NO: 7244861 - DNA, 22 bp, Homo sapiens
taatacagaagtgtattaaaat

SEQ ID NO: 7244862 - DNA, 22 bp, Homo sapiens
taataattagttattgatcgtg

SEQ ID NO: 7244863 - DNA, 22 bp, Homo sapiens
taataattaacagtgatgggtc

SEQ ID NO: 7244864 - DNA, 22 bp, Homo sapiens
caggcagcagccactctggtat

SEQ ID NO: 7244865 - DNA, 22 bp, Homo sapiens
caggcagagctgaagatagatg

SEQ ID NO: 7244866 - DNA, 22 bp, Homo sapiens
caggcaccccaggtgagcactg

SEQ ID NO: 7244867 - DNA, 22 bp, Homo sapiens
caggtaagaccgtttaggcagt

SEQ ID NO: 7244868 - DNA, 22 bp, Homo sapiens
caggtagaggctgccatcagct

SEQ ID NO: 7244869 - DNA, 22 bp, Homo sapiens
caggtgcctcaggatgagacaa

SEQ ID NO: 7244870 - DNA, 22 bp, Homo sapiens
caggtgctctgctgcaggtaag

SEQ ID NO: 7244871 - DNA, 18 bp, Homo sapiens
caggtgggtctcctgccc

SEQ ID NO: 7244872 - DNA, 22 bp, Homo sapiens
caggtgggtacatcacagagac

SEQ ID NO: 7244873 - DNA, 22 bp, Homo sapiens
caggtggggggcttccgagcct

SEQ ID NO: 7244874 - DNA, 22 bp, Homo sapiens
tattataaaattactggcaggg

SEQ ID NO: 7244875 - DNA, 22 bp, Homo sapiens
tattatgagccaggtgctgtct

SEQ ID NO: 7244876 - DNA, 22 bp, Homo sapiens
tattaaattatggatttaggag

SEQ ID NO: 7244877 - DNA, 22 bp, Homo sapiens
tattaaatgttatttgggttgt

SEQ ID NO: 7244878 - DNA, 22 bp, Homo sapiens
caggtggatctctaaggactga

SEQ ID NO: 7244879 - DNA, 22 bp, Homo sapiens
caggtggcatgactgcctacaa

SEQ ID NO: 7244880 - DNA, 22 bp, Homo sapiens
caggtggcattgtcccgccagc

SEQ ID NO: 7244881 - DNA, 22 bp, Homo sapiens
caggtggcatgactgcctacaa

SEQ ID NO: 7244882 - DNA, 22 bp, Homo sapiens
caggtggccagtactcaaggat

SEQ ID NO: 7244883 - DNA, 22 bp, Homo sapiens
caggtggccttgccatctcctg

SEQ ID NO: 7244884 - DNA, 22 bp, Homo sapiens
cagtatattctgcagagcctta

SEQ ID NO: 7244885 - DNA, 22 bp, Homo sapiens
cagtcacaggtggagaaccgag

SEQ ID NO: 7244886 - DNA, 22 bp, Homo sapiens
cagtcacatttcgacataacta

SEQ ID NO: 7244887 - DNA, 22 bp, Homo sapiens
cagtcaccaccaggtggcagta

SEQ ID NO: 7244888 - DNA, 22 bp, Homo sapiens
cagtcactggaatagctgagga

SEQ ID NO: 7244889 - DNA, 22 bp, Homo sapiens
tatttgaagattcttctgatgt

SEQ ID NO: 7244890 - DNA, 22 bp, Homo sapiens
tatttgaagacagggtctttaa

SEQ ID NO: 7244891 - DNA, 20 bp, Homo sapiens
tatttgaaatggccaagtgt

SEQ ID NO: 7244892 - DNA, 22 bp, Homo sapiens
tcaaaaatgttttatattggta

SEQ ID NO: 7244893 - DNA, 22 bp, Homo sapiens
tcaaaaattttctgaggatgag

SEQ ID NO: 7244894 - DNA, 22 bp, Homo sapiens
tcaatagattaggtattagatt

SEQ ID NO: 7244895 - DNA, 22 bp, Homo sapiens
tcaatagagccttctttcaggt

SEQ ID NO: 7244896 - DNA, 18 bp, Homo sapiens
tcaagccattctcctgcc

SEQ ID NO: 7244897 - DNA, 22 bp, Homo sapiens
tcaaaacccagccatcaggact

SEQ ID NO: 7244898 - DNA, 22 bp, Homo sapiens
cagggctgtggaaaactggtgc

SEQ ID NO: 7244899 - DNA, 17 bp, Homo sapiens
cagggctgtctgcctag

SEQ ID NO: 7244900 - DNA, 22 bp, Homo sapiens
cagggctgtgcccatcttcccc

SEQ ID NO: 7244901 - DNA, 22 bp, Homo sapiens
caggggctgtttgcctcaggcc

SEQ ID NO: 7244902 - DNA, 22 bp, Homo sapiens
caggggggcaggagtcattgat

SEQ ID NO: 7244903 - DNA, 22 bp, Homo sapiens
caggggtggctgcagcagaggt

SEQ ID NO: 7244904 - DNA, 22 bp, Homo sapiens
caggggtggctgcagcagaggt

SEQ ID NO: 7244905 - DNA, 22 bp, Homo sapiens
caggggtgtttttggccaggag

SEQ ID NO: 7244906 - DNA, 22 bp, Homo sapiens
caggggtgtttttggccaggag

SEQ ID NO: 7244907 - DNA, 22 bp, Homo sapiens
cagggtccggctgcctggctgt

SEQ ID NO: 7244908 - DNA, 20 bp, Homo sapiens
cagggctctgggcctggcct

SEQ ID NO: 7244909 - DNA, 22 bp, Homo sapiens
cagggctcttccggagcaggga

SEQ ID NO: 7244910 - DNA, 22 bp, Homo sapiens
cagggctgaagaaattcaaaag

SEQ ID NO: 7244911 - DNA, 22 bp, Homo sapiens
cagggctgagaatttagagaca

SEQ ID NO: 7244912 - DNA, 22 bp, Homo sapiens
tagggaaatatagatttagggc

SEQ ID NO: 7244913 - DNA, 22 bp, Homo sapiens
cagggctgggttaaaagcaggg

SEQ ID NO: 7244914 - DNA, 23 bp, Homo sapiens
cagggctggtagggaagagcgtg

SEQ ID NO: 7244915 - DNA, 23 bp, Homo sapiens
cagggctggtagggaagagcgtg

SEQ ID NO: 7244916 - DNA, 22 bp, Homo sapiens
cagggctggtttgtcgaagaaa

SEQ ID NO: 7244917 - DNA, 22 bp, Homo sapiens
cagggctgtaaattagtgctga

SEQ ID NO: 7244918 - DNA, 22 bp, Homo sapiens
cagggctgtctccaaaggcccc

SEQ ID NO: 7244919 - DNA, 22 bp, Homo sapiens
cagggcctcatcctcagagatt

SEQ ID NO: 7244920 - DNA, 20 bp, Homo sapiens
cagggcctatgattgagctt

SEQ ID NO: 7244921 - DNA, 22 bp, Homo sapiens
cagggccccagggatgtctgct

SEQ ID NO: 7244922 - DNA, 23 bp, Homo sapiens
cagggccctgctcaatttctcca

SEQ ID NO: 7244923 - DNA, 22 bp, Homo sapiens
taggaggctcatgttacaggaa

SEQ ID NO: 7244924 - DNA, 18 bp, Homo sapiens
taggaggctcctgggggc

SEQ ID NO: 7244925 - DNA, 22 bp, Homo sapiens
taggaggccatccagcctgcct

SEQ ID NO: 7244926 - DNA, 22 bp, Homo sapiens
taggcagtagcttgagatataa

SEQ ID NO: 7244927 - DNA, 22 bp, Homo sapiens
cagggccatgaggcacagggtc

SEQ ID NO: 7244928 - DNA, 22 bp, Homo sapiens
cagggccagttctcgcagcagt

SEQ ID NO: 7244929 - DNA, 22 bp, Homo sapiens
cagggagcagcccctagaagta

SEQ ID NO: 7244930 - DNA, 22 bp, Homo sapiens
tagattgattgcaaagacaggc

SEQ ID NO: 7244931 - DNA, 22 bp, Homo sapiens
tagattgagcttgacagtgttg

SEQ ID NO: 7244932 - DNA, 22 bp, Homo sapiens
tagatttctcattcatagattg

SEQ ID NO: 7244933 - DNA, 22 bp, Homo sapiens
tttattatccagtgttgtcatg

SEQ ID NO: 7244934 - DNA, 22 bp, Homo sapiens
tttcaaaagcgtacgtagtgaa

SEQ ID NO: 7244935 - DNA, 22 bp, Homo sapiens
tttcaaaattttgcagtggtaa

SEQ ID NO: 7244936 - DNA, 22 bp, Homo sapiens
tttatttgtcttgccatttagt

SEQ ID NO: 7244937 - DNA, 22 bp, Homo sapiens
tttatttggcatctctgccaag

SEQ ID NO: 7244938 - DNA, 22 bp, Homo sapiens
tttatttggcatccagggagaa

SEQ ID NO: 7244939 - DNA, 22 bp, Homo sapiens
tttatttggcatccagggagaa

SEQ ID NO: 7244940 - DNA, 22 bp, Homo sapiens
tttatttcactctccggatact

SEQ ID NO: 7244941 - DNA, 22 bp, Homo sapiens
tttatttgaatcaggggagaat

SEQ ID NO: 7244942 - DNA, 19 bp, Homo sapiens
tttatttgagacatgcctt

SEQ ID NO: 7244943 - DNA, 22 bp, Homo sapiens
tttatttgaatcaggggagaat

SEQ ID NO: 7244944 - DNA, 22 bp, Homo sapiens
tttattaagatgcgaatgctga

SEQ ID NO: 7244945 - DNA, 22 bp, Homo sapiens
tttatagtcgtctcagtaataa

SEQ ID NO: 7244946 - DNA, 22 bp, Homo sapiens
tttatagtcgtctcagtaataa

SEQ ID NO: 7244947 - DNA, 22 bp, Homo sapiens
tttatagttatatacagatgtt

SEQ ID NO: 7244948 - DNA, 22 bp, Homo sapiens
tttatataacagagactgctat

SEQ ID NO: 7244949 - DNA, 22 bp, Homo sapiens
tttataatagatttggggcggc

SEQ ID NO: 7244950 - DNA, 22 bp, Homo sapiens
tttatactccactctgcaagcg

SEQ ID NO: 7244951 - DNA, 22 bp, Homo sapiens
tttagaaattcatctatggcct

SEQ ID NO: 7244952 - DNA, 22 bp, Homo sapiens
tttaattgattcacagtctgta

SEQ ID NO: 7244953 - DNA, 23 bp, Homo sapiens
ttgtttctttgtattgtctctat

SEQ ID NO: 7244954 - DNA, 22 bp, Homo sapiens
ttgttttattctgcaatttccc

SEQ ID NO: 7244955 - DNA, 22 bp, Homo sapiens
ttgtgttaaggtgcatctagtg

SEQ ID NO: 7244956 - DNA, 19 bp, Homo sapiens
ttgtgactggctctgcata

SEQ ID NO: 7244957 - DNA, 22 bp, Homo sapiens
ttgtgtgtcttcttcactgccc

SEQ ID NO: 7244958 - DNA, 22 bp, Homo sapiens
ttgttacgtgatgtgtcagggt

SEQ ID NO: 7244959 - DNA, 20 bp, Homo sapiens
ttgttagaggaatgccatag

SEQ ID NO: 7244960 - DNA, 22 bp, Homo sapiens
ttgtttaaagaacttctgactt

SEQ ID NO: 7244961 - DNA, 22 bp, Homo sapiens
ttgtctatacatcaataatgat

SEQ ID NO: 7244962 - DNA, 17 bp, Homo sapiens
ttgtctacctagcagaa

SEQ ID NO: 7244963 - DNA, 22 bp, Homo sapiens
ttgtctaatgagctccacttca

SEQ ID NO: 7244964 - DNA, 22 bp, Homo sapiens
ttgtccttgtgatagtttgctg

SEQ ID NO: 7244965 - DNA, 22 bp, Homo sapiens
ttgtccttggatgaagctggga

SEQ ID NO: 7244966 - DNA, 22 bp, Homo sapiens
ttgtctggtcaaatcacttgta

SEQ ID NO: 7244967 - DNA, 22 bp, Homo sapiens
ttgtgaatagtgccgctataaa

SEQ ID NO: 7244968 - DNA, 22 bp, Homo sapiens
ttgtgaatgcttaatatgtttc

SEQ ID NO: 7244969 - DNA, 22 bp, Homo sapiens
ttggggtgtgtgaaattatgtc

SEQ ID NO: 7244970 - DNA, 22 bp, Homo sapiens
ttggggtgttcagggtacttct

SEQ ID NO: 7244971 - DNA, 22 bp, Homo sapiens
ttggggtggaagtgaggatcat

SEQ ID NO: 7244972 - DNA, 22 bp, Homo sapiens
ttggggtgttcagggtacttct

SEQ ID NO: 7244973 - DNA, 22 bp, Homo sapiens
ttggggtgttggatggagcaag

SEQ ID NO: 7244974 - DNA, 19 bp, Homo sapiens
ttggtgcacacatgggccc

SEQ ID NO: 7244975 - DNA, 22 bp, Homo sapiens
ttggtgcaaaattagagaacca

SEQ ID NO: 7244976 - DNA, 22 bp, Homo sapiens
ttggtgggcacaggggagaagt

SEQ ID NO: 7244977 - DNA, 22 bp, Homo sapiens
ttggtgggttaatgagtgactg

SEQ ID NO: 7244978 - DNA, 22 bp, Homo sapiens
ttggtgggagagatgagggttg

SEQ ID NO: 7244979 - DNA, 22 bp, Homo sapiens
tttccaaagctgagttgagcaa

SEQ ID NO: 7244980 - DNA, 22 bp, Homo sapiens
tttccaaaggaggaaccagttt

SEQ ID NO: 7244981 - DNA, 16 bp, Homo sapiens
tttccaaagggcagct

SEQ ID NO: 7244982 - DNA, 22 bp, Homo sapiens
tttccaaaggctaaactcagtt

SEQ ID NO: 7244983 - DNA, 22 bp, Homo sapiens
tttccaaaggagtaccacgcat

SEQ ID NO: 7244984 - DNA, 22 bp, Homo sapiens
tttccaaaggtggcaggaacaa

SEQ ID NO: 7244985 - DNA, 22 bp, Homo sapiens
tttccaaagttgccataagctt

SEQ ID NO: 7244986 - DNA, 22 bp, Homo sapiens
tttccaaacccagcgagctaca

SEQ ID NO: 7244987 - DNA, 22 bp, Homo sapiens
tttccaaaatgaatctaatgca

SEQ ID NO: 7244988 - DNA, 22 bp, Homo sapiens
tttccaaaagtttgttctgtgc

SEQ ID NO: 7244989 - DNA, 22 bp, Homo sapiens
tttcattgtcagagctttgaat

SEQ ID NO: 7244990 - DNA, 22 bp, Homo sapiens
tttcagcactttaggcagcagg

SEQ ID NO: 7244991 - DNA, 20 bp, Homo sapiens
tttcagatttacagaaatgt

SEQ ID NO: 7244992 - DNA, 22 bp, Homo sapiens
tttcagatgtgtgtctctgaag

SEQ ID NO: 7244993 - DNA, 22 bp, Homo sapiens
tttcagatggtatatacagtag

SEQ ID NO: 7244994 - DNA, 22 bp, Homo sapiens
tttcagatggtatatacagtag

SEQ ID NO: 7244995 - DNA, 22 bp, Homo sapiens
tttcagatcattttttaagtac

SEQ ID NO: 7244996 - DNA, 19 bp, Homo sapiens
tttcaggagctatgcaggg

SEQ ID NO: 7244997 - DNA, 22 bp, Homo sapiens
tttctaatctttagttacaaaa

SEQ ID NO: 7244998 - DNA, 22 bp, Homo sapiens
tttctaagtaaacacagcatac

SEQ ID NO: 7244999 - DNA, 16 bp, Homo sapiens
tttctcattgtcatca

SEQ ID NO: 7245000 - DNA, 22 bp, Homo sapiens
tttctcatggacccttcatgat

SEQ ID NO: 7245001 - DNA, 22 bp, Homo sapiens
tttctcatggaacatcgtttag

SEQ ID NO: 7245002 - DNA, 22 bp, Homo sapiens
tttctcatggaacatagctcct

SEQ ID NO: 7245003 - DNA, 23 bp, Homo sapiens
tttctcatccagagagtcagtcc

SEQ ID NO: 7245004 - DNA, 22 bp, Homo sapiens
tttctccccagtctaatctgga

SEQ ID NO: 7245005 - DNA, 22 bp, Homo sapiens
tttctagaaaccaagatattgt

SEQ ID NO: 7245006 - DNA, 22 bp, Homo sapiens
tttctagaaacattatctctat

SEQ ID NO: 7245007 - DNA, 22 bp, Homo sapiens
tttctattttaaaggcatatgg

SEQ ID NO: 7245008 - DNA, 22 bp, Homo sapiens
tttctcagttctctgcaaggag

SEQ ID NO: 7245009 - DNA, 21 bp, Homo sapiens
tttctcataaaatactcatta

SEQ ID NO: 7245010 - DNA, 22 bp, Homo sapiens
tttctgctttctatccttgtca

SEQ ID NO: 7245011 - DNA, 22 bp, Homo sapiens
tttctgctcgctctcaatcagg

SEQ ID NO: 7245012 - DNA, 22 bp, Homo sapiens
tttctgctcatcctagtggagc

SEQ ID NO: 7245013 - DNA, 22 bp, Homo sapiens
tttctgacttttatatgcatat

SEQ ID NO: 7245014 - DNA, 22 bp, Homo sapiens
tttctgaggaattaatacagaa

SEQ ID NO: 7245015 - DNA, 22 bp, Homo sapiens
tttctgacacatcagttgtaaa

SEQ ID NO: 7245016 - DNA, 22 bp, Homo sapiens
tttctgactccagagaggaata

SEQ ID NO: 7245017 - DNA, 22 bp, Homo sapiens
tttctgacctgcaacagtttac

SEQ ID NO: 7245018 - DNA, 22 bp, Homo sapiens
tttctgaaatgctggctttgga

SEQ ID NO: 7245019 - DNA, 22 bp, Homo sapiens
tttctcttgcgatatgctacac

SEQ ID NO: 7245020 - DNA, 22 bp, Homo sapiens
tttctcttcactgtgtgcctca

SEQ ID NO: 7245021 - DNA, 22 bp, Homo sapiens
tttctctttcaatctgcagtac

SEQ ID NO: 7245022 - DNA, 22 bp, Homo sapiens
tttctcttgcgatatgctacac

SEQ ID NO: 7245023 - DNA, 22 bp, Homo sapiens
tttctctttggaggggctgaat

SEQ ID NO: 7245024 - DNA, 22 bp, Homo sapiens
tttctctttgacaggaatcaga

SEQ ID NO: 7245025 - DNA, 22 bp, Homo sapiens
tttctcggcagagatgatgggc

SEQ ID NO: 7245026 - DNA, 22 bp, Homo sapiens
tttcttgtctttagtatctggc

SEQ ID NO: 7245027 - DNA, 22 bp, Homo sapiens
tttcttctctaatctcaatgat

SEQ ID NO: 7245028 - DNA, 22 bp, Homo sapiens
tttcttctctgattaaggctca

SEQ ID NO: 7245029 - DNA, 22 bp, Homo sapiens
tttcttctctgattaaggctca

SEQ ID NO: 7245030 - DNA, 22 bp, Homo sapiens
tttcttctgagatcagggagaa

SEQ ID NO: 7245031 - DNA, 20 bp, Homo sapiens
tttcttgtacttggagaagg

SEQ ID NO: 7245032 - DNA, 22 bp, Homo sapiens
tttcttctatgtgtgatatttt

SEQ ID NO: 7245033 - DNA, 22 bp, Homo sapiens
tttcttctcacccaggacagag

SEQ ID NO: 7245034 - DNA, 22 bp, Homo sapiens
tttcttctcacccaggacagag

SEQ ID NO: 7245035 - DNA, 22 bp, Homo sapiens
tttcttctcgacaccttatccc

SEQ ID NO: 7245036 - DNA, 22 bp, Homo sapiens
tttcttctcgacaccttatccc

SEQ ID NO: 7245037 - DNA, 22 bp, Homo sapiens
tttcttctccatggcaggtcct

SEQ ID NO: 7245038 - DNA, 22 bp, Homo sapiens
tttcttctaagatttcaaacta

SEQ ID NO: 7245039 - DNA, 23 bp, Homo sapiens
tttctgttgggtatatatccaag

SEQ ID NO: 7245040 - DNA, 22 bp, Homo sapiens
tttctgttaggcatcattttaa

SEQ ID NO: 7245041 - DNA, 22 bp, Homo sapiens
tttctgttaggcatcattttaa

SEQ ID NO: 7245042 - DNA, 22 bp, Homo sapiens
tttcttcaattgctaacaagga

SEQ ID NO: 7245043 - DNA, 21 bp, Homo sapiens
tttcttcactttgccccatgt

SEQ ID NO: 7245044 - DNA, 22 bp, Homo sapiens
tttcttcattgatgtcaggtgg

SEQ ID NO: 7245045 - DNA, 22 bp, Homo sapiens
tttcttcattgacaaggaaaaa

SEQ ID NO: 7245046 - DNA, 22 bp, Homo sapiens
ttttatattgagtgagagttcc

SEQ ID NO: 7245047 - DNA, 20 bp, Homo sapiens
ttttatatgtagggtatatg

SEQ ID NO: 7245048 - DNA, 22 bp, Homo sapiens
ttttatatggcacattggttgg

SEQ ID NO: 7245049 - DNA, 22 bp, Homo sapiens
ttttagaatcaggttgtctggg

SEQ ID NO: 7245050 - DNA, 22 bp, Homo sapiens
ttttagaagttcacttgggttt

SEQ ID NO: 7245051 - DNA, 22 bp, Homo sapiens
tttgtagattttctctccagta

SEQ ID NO: 7245052 - DNA, 22 bp, Homo sapiens
tttgtatgaatgcatattttca

SEQ ID NO: 7245053 - DNA, 22 bp, Homo sapiens
tttgtatgggcagaaattagat

SEQ ID NO: 7245054 - DNA, 22 bp, Homo sapiens
tttgtattacaaagtcacagta

SEQ ID NO: 7245055 - DNA, 22 bp, Homo sapiens
tttgtatgtgataagactattc

SEQ ID NO: 7245056 - DNA, 22 bp, Homo sapiens
tttgtagaactatacttacatt

SEQ ID NO: 7245057 - DNA, 22 bp, Homo sapiens
tttgtagaaagggttgtatgaa

SEQ ID NO: 7245058 - DNA, 22 bp, Homo sapiens
tttgtagaataatatctttctg

SEQ ID NO: 7245059 - DNA, 22 bp, Homo sapiens
tttgtagatagaaaaatgatta

SEQ ID NO: 7245060 - DNA, 22 bp, Homo sapiens
tttgtagagggtaattgacaga

SEQ ID NO: 7245061 - DNA, 22 bp, Homo sapiens
tttgttcttgcaacagttatta

SEQ ID NO: 7245062 - DNA, 22 bp, Homo sapiens
tttggcaccaaaggagaagatc

SEQ ID NO: 7245063 - DNA, 22 bp, Homo sapiens
tttggcaccatttttattctct

SEQ ID NO: 7245064 - DNA, 22 bp, Homo sapiens
tttggcacctccaaggactcgc

SEQ ID NO: 7245065 - DNA, 22 bp, Homo sapiens
tttggcactataggtaaatttg

SEQ ID NO: 7245066 - DNA, 22 bp, Homo sapiens
tttggcactcacttatcattgg

SEQ ID NO: 7245067 - DNA, 22 bp, Homo sapiens
tttggcaccaaaggagaagatc

SEQ ID NO: 7245068 - DNA, 22 bp, Homo sapiens
tttggcacattctgtcacattc

SEQ ID NO: 7245069 - DNA, 22 bp, Homo sapiens
tttggcacagtactttttggct

SEQ ID NO: 7245070 - DNA, 22 bp, Homo sapiens
tttggcacagcttcccagactt

SEQ ID NO: 7245071 - DNA, 22 bp, Homo sapiens
tttggcaatggatggtcatcta

SEQ ID NO: 7245072 - DNA, 22 bp, Homo sapiens
tttggcactgttctaggtgcaa

SEQ ID NO: 7245073 - DNA, 20 bp, Homo sapiens
tttggcactgagtggtataa

SEQ ID NO: 7245074 - DNA, 19 bp, Homo sapiens
tttggcactctgaagtgtt

SEQ ID NO: 7245075 - DNA, 22 bp, Homo sapiens
tttggcacttggcagttgagtt

SEQ ID NO: 7245076 - DNA, 22 bp, Homo sapiens
tttggcacttggcagttgagtt

SEQ ID NO: 7245077 - DNA, 22 bp, Homo sapiens
tttggaacccagcccatcggaa

SEQ ID NO: 7245078 - DNA, 22 bp, Homo sapiens
tttggactgcatgatgatctgg

SEQ ID NO: 7245079 - DNA, 22 bp, Homo sapiens
tttggactcaatggtttgctgc

SEQ ID NO: 7245080 - DNA, 22 bp, Homo sapiens
tttggactatctgtgtggcttt

SEQ ID NO: 7245081 - DNA, 22 bp, Homo sapiens
tttggactactgggaccttgtg

SEQ ID NO: 7245082 - DNA, 23 bp, Homo sapiens
tttggacttgtgactcttctcct

SEQ ID NO: 7245083 - DNA, 22 bp, Homo sapiens
tttgcaatagtcctggcctgta

SEQ ID NO: 7245084 - DNA, 22 bp, Homo sapiens
tttgcagaagaaaacatgaaca

SEQ ID NO: 7245085 - DNA, 22 bp, Homo sapiens
tttgcacagatgggatacagca

SEQ ID NO: 7245086 - DNA, 22 bp, Homo sapiens
tttgcagagtacctgaagagga

SEQ ID NO: 7245087 - DNA, 22 bp, Homo sapiens
ttttggcaaaggcattctcttt

SEQ ID NO: 7245088 - DNA, 22 bp, Homo sapiens
ttttgaataattcagaaacagc

SEQ ID NO: 7245089 - DNA, 22 bp, Homo sapiens
ttttgagatggagtcttgctct

SEQ ID NO: 7245090 - DNA, 22 bp, Homo sapiens
tttttcccaaaggcaattgcct

SEQ ID NO: 7245091 - DNA, 22 bp, Homo sapiens
ttttggcactttgtctgattct

SEQ ID NO: 7245092 - DNA, 22 bp, Homo sapiens
ttttctaacatctagtaatttg

SEQ ID NO: 7245093 - DNA, 22 bp, Homo sapiens
ttttctaacatctagtaatttg

SEQ ID NO: 7245094 - DNA, 22 bp, Homo sapiens
ttttgaaagagtcctgctacag

SEQ ID NO: 7245095 - DNA, 22 bp, Homo sapiens
ttttatctgcttcattagttga

SEQ ID NO: 7245096 - DNA, 22 bp, Homo sapiens
ttttatgaagataattttctga

SEQ ID NO: 7245097 - DNA, 22 bp, Homo sapiens
ttttatgaagataattttctga

SEQ ID NO: 7245098 - DNA, 22 bp, Homo sapiens
ttttatgagaatgcgccacttg

SEQ ID NO: 7245099 - DNA, 22 bp, Homo sapiens
tttttgaaggctgatgtgatta

SEQ ID NO: 7245100 - DNA, 22 bp, Homo sapiens
tttttgaaggctgatgtgatta

SEQ ID NO: 7245101 - DNA, 22 bp, Homo sapiens
tttttgggtccaggctgtatct

SEQ ID NO: 7245102 - DNA, 22 bp, Homo sapiens
ttgattatagaatcttggcttt

SEQ ID NO: 7245103 - DNA, 22 bp, Homo sapiens
ttgaggccaaaaagtcctatga

SEQ ID NO: 7245104 - DNA, 22 bp, Homo sapiens
ttgatgaggggatcagggtagc

SEQ ID NO: 7245105 - DNA, 22 bp, Homo sapiens
ttgatgagttatccatttgact

SEQ ID NO: 7245106 - DNA, 22 bp, Homo sapiens
ttgatgagaccattgccgcgtc

SEQ ID NO: 7245107 - DNA, 22 bp, Homo sapiens
ttgcaaattaaagaggatagca

SEQ ID NO: 7245108 - DNA, 22 bp, Homo sapiens
ttgattttaaaatagtgacact

SEQ ID NO: 7245109 - DNA, 22 bp, Homo sapiens
ttgatttcttattaccctagtt

SEQ ID NO: 7245110 - DNA, 22 bp, Homo sapiens
ttgatttctattgagttcctgt

SEQ ID NO: 7245111 - DNA, 22 bp, Homo sapiens
ttgatttcactctctgtccaat

SEQ ID NO: 7245112 - DNA, 22 bp, Homo sapiens
ttgatttctattcagatgtaga

SEQ ID NO: 7245113 - DNA, 23 bp, Homo sapiens
ttgatttcaaatgcagagaacac

SEQ ID NO: 7245114 - DNA, 22 bp, Homo sapiens
ttgatttcaacatcatcccttt

SEQ ID NO: 7245115 - DNA, 21 bp, Homo sapiens
ttgattttaggaagtttgtca

SEQ ID NO: 7245116 - DNA, 22 bp, Homo sapiens
ttgcaaagttccctacacatgt

SEQ ID NO: 7245117 - DNA, 23 bp, Homo sapiens
ttgcaaagggcaaaggtcatgtg

SEQ ID NO: 7245118 - DNA, 20 bp, Homo sapiens
ttgagcaatcagtaaaggat

SEQ ID NO: 7245119 - DNA, 22 bp, Homo sapiens
ttgagcaatgctgcaaagagat

SEQ ID NO: 7245120 - DNA, 22 bp, Homo sapiens
ttgagcaatgtcactgaggctt

SEQ ID NO: 7245121 - DNA, 22 bp, Homo sapiens
ttgagatttggaggtaattccc

SEQ ID NO: 7245122 - DNA, 20 bp, Homo sapiens
ttgagcagcagtgctgtgtc

SEQ ID NO: 7245123 - DNA, 22 bp, Homo sapiens
ttgaggagtgtttagggtgagg

SEQ ID NO: 7245124 - DNA, 23 bp, Homo sapiens
ttgagctcagtagctctgctggt

SEQ ID NO: 7245125 - DNA, 22 bp, Homo sapiens
ttgaagcacaatgtcttttatc

SEQ ID NO: 7245126 - DNA, 22 bp, Homo sapiens
ttgaagcagagaaatacttgaa

SEQ ID NO: 7245127 - DNA, 22 bp, Homo sapiens
ttgaatgagtgttttactcatg

SEQ ID NO: 7245128 - DNA, 17 bp, Homo sapiens
ttgaatgcattacttgg

SEQ ID NO: 7245129 - DNA, 22 bp, Homo sapiens
ttgaatgcatggttcactctgt

SEQ ID NO: 7245130 - DNA, 22 bp, Homo sapiens
ttgaatgcatctttgagctcct

SEQ ID NO: 7245131 - DNA, 22 bp, Homo sapiens
ttgagatgacttaaatttggga

SEQ ID NO: 7245132 - DNA, 22 bp, Homo sapiens
ttctttattagtttagtgagct

SEQ ID NO: 7245133 - DNA, 22 bp, Homo sapiens
ttgaagagaaccgcggcttatt

SEQ ID NO: 7245134 - DNA, 22 bp, Homo sapiens
ttgaagaacataatagctactt

SEQ ID NO: 7245135 - DNA, 22 bp, Homo sapiens
ttgaagagctgcttgataccct

SEQ ID NO: 7245136 - DNA, 22 bp, Homo sapiens
ttgaagagcaccagcattttga

SEQ ID NO: 7245137 - DNA, 22 bp, Homo sapiens
ttgaagagacgatttttccacc

SEQ ID NO: 7245138 - DNA, 22 bp, Homo sapiens
ttgaagagacaatttggaaagc

SEQ ID NO: 7245139 - DNA, 22 bp, Homo sapiens
ttgaagagaatcagaaggttga

SEQ ID NO: 7245140 - DNA, 22 bp, Homo sapiens
ttgaagagtctagattggttat

SEQ ID NO: 7245141 - DNA, 22 bp, Homo sapiens
ttgaagagtcgcttaacctgtg

SEQ ID NO: 7245142 - DNA, 20 bp, Homo sapiens
ttgaagagtcaggtagggcc

SEQ ID NO: 7245143 - DNA, 22 bp, Homo sapiens
ttgaagagtagaaaatgcaaat

SEQ ID NO: 7245144 - DNA, 20 bp, Homo sapiens
ttgaagaggatatatcgctc

SEQ ID NO: 7245145 - DNA, 22 bp, Homo sapiens
ttgaagaggactttgcagctgt

SEQ ID NO: 7245146 - DNA, 22 bp, Homo sapiens
ttgaagagtaaagtgttttctc

SEQ ID NO: 7245147 - DNA, 22 bp, Homo sapiens
ttgaagagttttatgccaacct

SEQ ID NO: 7245148 - DNA, 22 bp, Homo sapiens
ttgaagagtttgatagagttga

SEQ ID NO: 7245149 - DNA, 22 bp, Homo sapiens
ttgaagagtgtccttgtaaaaa

SEQ ID NO: 7245150 - DNA, 22 bp, Homo sapiens
ttgaagagtgcattagcatatt

SEQ ID NO: 7245151 - DNA, 22 bp, Homo sapiens
ttgaagagtgccttccagacat

SEQ ID NO: 7245152 - DNA, 22 bp, Homo sapiens
ttgaagagtctttctttccccc

SEQ ID NO: 7245153 - DNA, 22 bp, Homo sapiens
ttctgtttataatttgcagttg

SEQ ID NO: 7245154 - DNA, 22 bp, Homo sapiens
ttctgtttctggggtctctgac

SEQ ID NO: 7245155 - DNA, 22 bp, Homo sapiens
ttctgtttgccatatatagtag

SEQ ID NO: 7245156 - DNA, 22 bp, Homo sapiens
ttctgtttgtgaactggctgag

SEQ ID NO: 7245157 - DNA, 22 bp, Homo sapiens
ttctgggtggccagtatttaga

SEQ ID NO: 7245158 - DNA, 18 bp, Homo sapiens
ttctgggtgttatgttta

SEQ ID NO: 7245159 - DNA, 23 bp, Homo sapiens
ttctgggttgctgtgcttggaat

SEQ ID NO: 7245160 - DNA, 21 bp, Homo sapiens
ttctgggttgttaatctgaac

SEQ ID NO: 7245161 - DNA, 22 bp, Homo sapiens
ttctgggtttacatctgacttc

SEQ ID NO: 7245162 - DNA, 22 bp, Homo sapiens
ttctgggtgcaactctgttctg

SEQ ID NO: 7245163 - DNA, 22 bp, Homo sapiens
ttctgggtgccacctaagacat

SEQ ID NO: 7245164 - DNA, 17 bp, Homo sapiens
ttctgggtcccagggcc

SEQ ID NO: 7245165 - DNA, 22 bp, Homo sapiens
ttctgggtgactcacgctcccc

SEQ ID NO: 7245166 - DNA, 22 bp, Homo sapiens
ttctgggtaacaaggcaagaat

SEQ ID NO: 7245167 - DNA, 22 bp, Homo sapiens
ttctgggtagtatggttagttt

SEQ ID NO: 7245168 - DNA, 22 bp, Homo sapiens
ttctgggtcacccttctgctca

SEQ ID NO: 7245169 - DNA, 22 bp, Homo sapiens
ttctggggccaattgccactgc

SEQ ID NO: 7245170 - DNA, 22 bp, Homo sapiens
ttctgggcctcctaggacaggc

SEQ ID NO: 7245171 - DNA, 22 bp, Homo sapiens
ttctttatcagttactcatagg

SEQ ID NO: 7245172 - DNA, 19 bp, Homo sapiens
ttcttgagacctcagtctg

SEQ ID NO: 7245173 - DNA, 22 bp, Homo sapiens
ttcttctttcctataattaatt

SEQ ID NO: 7245174 - DNA, 22 bp, Homo sapiens
ttcttctttccaattacatggt

SEQ ID NO: 7245175 - DNA, 22 bp, Homo sapiens
ttcttctttatctcagtatcct

SEQ ID NO: 7245176 - DNA, 22 bp, Homo sapiens
ttctgcttctgtgtgtcccagg

SEQ ID NO: 7245177 - DNA, 22 bp, Homo sapiens
ttctggaaaagaaagttaagat

SEQ ID NO: 7245178 - DNA, 19 bp, Homo sapiens
ttctggaaacccaggtaat

SEQ ID NO: 7245179 - DNA, 22 bp, Homo sapiens
ttctggaaagaaggctaaggtc

SEQ ID NO: 7245180 - DNA, 22 bp, Homo sapiens
ttctggaaaccctcagccagtg

SEQ ID NO: 7245181 - DNA, 22 bp, Homo sapiens
ttctggaaagatttgcgtgtaa

SEQ ID NO: 7245182 - DNA, 22 bp, Homo sapiens
ttctggaaagcatttgaggccc

SEQ ID NO: 7245183 - DNA, 18 bp, Homo sapiens
ttctgcggtgacagatat

SEQ ID NO: 7245184 - DNA, 22 bp, Homo sapiens
ttctgctctaatgtacaccagc

SEQ ID NO: 7245185 - DNA, 22 bp, Homo sapiens
ttctgacaattcagtaacagca

SEQ ID NO: 7245186 - DNA, 22 bp, Homo sapiens
ttctgacagcaaaactcagcct

SEQ ID NO: 7245187 - DNA, 22 bp, Homo sapiens
ttcacagtgctcacagttcagt

SEQ ID NO: 7245188 - DNA, 22 bp, Homo sapiens
ttagagttttctgttcctctaa

SEQ ID NO: 7245189 - DNA, 22 bp, Homo sapiens
ttagagtttttgtaagtacaat

SEQ ID NO: 7245190 - DNA, 22 bp, Homo sapiens
ttcaacatgttctacataaggg

SEQ ID NO: 7245191 - DNA, 22 bp, Homo sapiens
ttcaactttatgcatatgtatt

SEQ ID NO: 7245192 - DNA, 22 bp, Homo sapiens
ttcatgtaccgtgtaccaggca

SEQ ID NO: 7245193 - DNA, 22 bp, Homo sapiens
ttcatgtaggctgcaatgcaca

SEQ ID NO: 7245194 - DNA, 22 bp, Homo sapiens
ttcatgtagtgtaatgtcttca

SEQ ID NO: 7245195 - DNA, 22 bp, Homo sapiens
ttcaggagctagggatgtgaaa

SEQ ID NO: 7245196 - DNA, 22 bp, Homo sapiens
ttcaggagctggctgcgaagga

SEQ ID NO: 7245197 - DNA, 22 bp, Homo sapiens
ttcagtcagtgactaagcagtt

SEQ ID NO: 7245198 - DNA, 20 bp, Homo sapiens
ttcagtctcctgcttccttc

SEQ ID NO: 7245199 - DNA, 22 bp, Homo sapiens
ttcacagtggctaagttctgca

SEQ ID NO: 7245200 - DNA, 22 bp, Homo sapiens
ttcacattccgcggctattttc

SEQ ID NO: 7245201 - DNA, 22 bp, Homo sapiens
ttcacattatcaggattgtttc

SEQ ID NO: 7245202 - DNA, 22 bp, Homo sapiens
ttcacattataatcagttctgc

SEQ ID NO: 7245203 - DNA, 19 bp, Homo sapiens
ttcctgtgctgctgtgtcc

SEQ ID NO: 7245204 - DNA, 22 bp, Homo sapiens
ttcctgtggccttacatctgtg

SEQ ID NO: 7245205 - DNA, 17 bp, Homo sapiens
ttcctgtggtttgatct

SEQ ID NO: 7245206 - DNA, 22 bp, Homo sapiens
ttcctgtggtccagagtcatcc

SEQ ID NO: 7245207 - DNA, 22 bp, Homo sapiens
ttcctatggtgaacatgaatga

SEQ ID NO: 7245208 - DNA, 22 bp, Homo sapiens
ttcctatgtgggcagagacaca

SEQ ID NO: 7245209 - DNA, 22 bp, Homo sapiens
ttcctataagtcacactgttgt

SEQ ID NO: 7245210 - DNA, 22 bp, Homo sapiens
ttcctatggccagagtcaaaga

SEQ ID NO: 7245211 - DNA, 22 bp, Homo sapiens
ttcctcagaaaatactgtccaa

SEQ ID NO: 7245212 - DNA, 22 bp, Homo sapiens
ttcctcagctttagactatgaa

SEQ ID NO: 7245213 - DNA, 20 bp, Homo sapiens
ttcctcaggagaggatgtta

SEQ ID NO: 7245214 - DNA, 22 bp, Homo sapiens
ttcctcaggactgttgacttcc

SEQ ID NO: 7245215 - DNA, 22 bp, Homo sapiens
ttcctcagttagtgcctgaggc

SEQ ID NO: 7245216 - DNA, 22 bp, Homo sapiens
ttcctctggaggctctaggaga

SEQ ID NO: 7245217 - DNA, 22 bp, Homo sapiens
ttcctctgtagttgctgatgaa

SEQ ID NO: 7245218 - DNA, 22 bp, Homo sapiens
ttcctaactggcctttatggat

SEQ ID NO: 7245219 - DNA, 21 bp, Homo sapiens
ttccacagtgagaactgcaag

SEQ ID NO: 7245220 - DNA, 22 bp, Homo sapiens
ttccacactttcacacgaggtc

SEQ ID NO: 7245221 - DNA, 22 bp, Homo sapiens
ttccacacttaaggaatatgat

SEQ ID NO: 7245222 - DNA, 22 bp, Homo sapiens
tgttcctgacggccaaagaggt

SEQ ID NO: 7245223 - DNA, 22 bp, Homo sapiens
tgttatcacttagacatgctag

SEQ ID NO: 7245224 - DNA, 22 bp, Homo sapiens
tgttatttatttcacctccaga

SEQ ID NO: 7245225 - DNA, 22 bp, Homo sapiens
tgttatttatctgagcatttat

SEQ ID NO: 7245226 - DNA, 22 bp, Homo sapiens
tgttatttgggaaagttgtaca

SEQ ID NO: 7245227 - DNA, 22 bp, Homo sapiens
tgttatttctttgccatatctt

SEQ ID NO: 7245228 - DNA, 22 bp, Homo sapiens
tgttattgatatctaatgctct

SEQ ID NO: 7245229 - DNA, 22 bp, Homo sapiens
tgttattgatatctaatgctct

SEQ ID NO: 7245230 - DNA, 22 bp, Homo sapiens
tgtgttcttaaaagcagtgata

SEQ ID NO: 7245231 - DNA, 22 bp, Homo sapiens
tgtttaattcaccatcatgttc

SEQ ID NO: 7245232 - DNA, 22 bp, Homo sapiens
tgtttaatgcattgaccttggg

SEQ ID NO: 7245233 - DNA, 22 bp, Homo sapiens
tgtttaatttttcatgagccaa

SEQ ID NO: 7245234 - DNA, 22 bp, Homo sapiens
tgtttaatttcacaaagttgac

SEQ ID NO: 7245235 - DNA, 22 bp, Homo sapiens
tgtttaattgggccaacagcgg

SEQ ID NO: 7245236 - DNA, 22 bp, Homo sapiens
tgtttaatctataaaatggaga

SEQ ID NO: 7245237 - DNA, 22 bp, Homo sapiens
tgtttaatgaagatggtttttc

SEQ ID NO: 7245238 - DNA, 22 bp, Homo sapiens
tgtttaatcttcaggacagtct

SEQ ID NO: 7245239 - DNA, 21 bp, Homo sapiens
tgtttaatacatatttgtgga

SEQ ID NO: 7245240 - DNA, 22 bp, Homo sapiens
tgtttaataattctatgatagt

SEQ ID NO: 7245241 - DNA, 21 bp, Homo sapiens
tgtttaagtactcctttctgg

SEQ ID NO: 7245242 - DNA, 17 bp, Homo sapiens
tgttctcttcagaaatc

SEQ ID NO: 7245243 - DNA, 20 bp, Homo sapiens
tgtttcttttaatgagcggc

SEQ ID NO: 7245244 - DNA, 22 bp, Homo sapiens
tgtttctttgtagatattcttt

SEQ ID NO: 7245245 - DNA, 20 bp, Homo sapiens
tgtttctttaaggtgagaca

SEQ ID NO: 7245246 - DNA, 22 bp, Homo sapiens
tgtttcttgggtgctcacatca

SEQ ID NO: 7245247 - DNA, 22 bp, Homo sapiens
tgtttcttgataaagcagaaaa

SEQ ID NO: 7245248 - DNA, 22 bp, Homo sapiens
tgtttgaaagcacctacatttt

SEQ ID NO: 7245249 - DNA, 22 bp, Homo sapiens
tgtttgaaactttgatcactaa

SEQ ID NO: 7245250 - DNA, 22 bp, Homo sapiens
tgttttcacaatgatgtcagat

SEQ ID NO: 7245251 - DNA, 22 bp, Homo sapiens
tgttttcagtcatatagcaggt

SEQ ID NO: 7245252 - DNA, 22 bp, Homo sapiens
tgttttctcttgaaaagcagtc

SEQ ID NO: 7245253 - DNA, 22 bp, Homo sapiens
tcccctctttctggaaacacaa

SEQ ID NO: 7245254 - DNA, 22 bp, Homo sapiens
tcccctctggttgacccaggag

SEQ ID NO: 7245255 - DNA, 22 bp, Homo sapiens
tcccctctggaggctgcagggg

SEQ ID NO: 7245256 - DNA, 22 bp, Homo sapiens
tcccctctctgcgctcccaggt

SEQ ID NO: 7245257 - DNA, 22 bp, Homo sapiens
tgtggacatactaggcctaggc

SEQ ID NO: 7245258 - DNA, 22 bp, Homo sapiens
tgtggactctggagtcagacag

SEQ ID NO: 7245259 - DNA, 22 bp, Homo sapiens
tgtggactctgagatccggaga

SEQ ID NO: 7245260 - DNA, 22 bp, Homo sapiens
tgtggactggcgggacgcaatg

SEQ ID NO: 7245261 - DNA, 22 bp, Homo sapiens
tgtggactgaaagaaccggcag

SEQ ID NO: 7245262 - DNA, 22 bp, Homo sapiens
tgtggactgtgctgccacagtg

SEQ ID NO: 7245263 - DNA, 22 bp, Homo sapiens
tccccccagcctttcacatgag

SEQ ID NO: 7245264 - DNA, 22 bp, Homo sapiens
tcccccatcccaaggaggtcat

SEQ ID NO: 7245265 - DNA, 22 bp, Homo sapiens
tcccccactctaaaggagcctt

SEQ ID NO: 7245266 - DNA, 22 bp, Homo sapiens
tcccccaaatgaatgaggaata

SEQ ID NO: 7245267 - DNA, 22 bp, Homo sapiens
tccccagggtccctgcttccat

SEQ ID NO: 7245268 - DNA, 22 bp, Homo sapiens
tgtggcagctgctgcaggagct

SEQ ID NO: 7245269 - DNA, 21 bp, Homo sapiens
tgtggcagatgttgggaggca

SEQ ID NO: 7245270 - DNA, 22 bp, Homo sapiens
tgtggcagaggaggcagcgtcc

SEQ ID NO: 7245271 - DNA, 22 bp, Homo sapiens
tgtggcagaaccagaattcaaa

SEQ ID NO: 7245272 - DNA, 22 bp, Homo sapiens
tgtggcagtaaaattgggcaac

SEQ ID NO: 7245273 - DNA, 18 bp, Homo sapiens
tgtggcaggggtgggaga

SEQ ID NO: 7245274 - DNA, 17 bp, Homo sapiens
tgtgtaagttgcataga

SEQ ID NO: 7245275 - DNA, 22 bp, Homo sapiens
tgtgggtggcatcgtcctggcc

SEQ ID NO: 7245276 - DNA, 22 bp, Homo sapiens
tgtggtgccgagagtctggacg

SEQ ID NO: 7245277 - DNA, 22 bp, Homo sapiens
tgtggtctccccagtgccagct

SEQ ID NO: 7245278 - DNA, 19 bp, Homo sapiens
tgtggggagtcagggggct

SEQ ID NO: 7245279 - DNA, 22 bp, Homo sapiens
tgtgtcctttctaatgcccaga

SEQ ID NO: 7245280 - DNA, 22 bp, Homo sapiens
tgtgtcctcagggaagcagaga

SEQ ID NO: 7245281 - DNA, 22 bp, Homo sapiens
tgtgtgaattacgcgtgtcctg

SEQ ID NO: 7245282 - DNA, 22 bp, Homo sapiens
ttaataaacaggtgcagctgaa

SEQ ID NO: 7245283 - DNA, 22 bp, Homo sapiens
ttaataaagtatgaattggaaa

SEQ ID NO: 7245284 - DNA, 22 bp, Homo sapiens
ttaagtgcaaaaatgaaagtat

SEQ ID NO: 7245285 - DNA, 22 bp, Homo sapiens
ttaagtgcacaatgaggtcaca

SEQ ID NO: 7245286 - DNA, 22 bp, Homo sapiens
ttaagtgcctacttgtgagtta

SEQ ID NO: 7245287 - DNA, 22 bp, Homo sapiens
ttaaggttgagctcacttttat

SEQ ID NO: 7245288 - DNA, 22 bp, Homo sapiens
ttaacattgtccttagcagatt

SEQ ID NO: 7245289 - DNA, 22 bp, Homo sapiens
ttaaatgctcacataaaggtag

SEQ ID NO: 7245290 - DNA, 22 bp, Homo sapiens
ttaaatgtttaatctaacttga

SEQ ID NO: 7245291 - DNA, 22 bp, Homo sapiens
tgtttttatctctgtgtacaac

SEQ ID NO: 7245292 - DNA, 22 bp, Homo sapiens
tgtttttaaataatgatagaaa

SEQ ID NO: 7245293 - DNA, 22 bp, Homo sapiens
ttaaatagtcaaatcagtggca

SEQ ID NO: 7245294 - DNA, 17 bp, Homo sapiens
tgttttctgctaccttt

SEQ ID NO: 7245295 - DNA, 22 bp, Homo sapiens
tgttttctgattctcgtgtggt

SEQ ID NO: 7245296 - DNA, 22 bp, Homo sapiens
tgttttctgatggttaatgagt

SEQ ID NO: 7245297 - DNA, 23 bp, Homo sapiens
tgttttcttgtcctggtataatt

SEQ ID NO: 7245298 - DNA, 22 bp, Homo sapiens
tgttttcttctgtaccgtgcca

SEQ ID NO: 7245299 - DNA, 22 bp, Homo sapiens
tgttttcttcctaattgctcat

SEQ ID NO: 7245300 - DNA, 22 bp, Homo sapiens
tgttttctgtgtagagatcaca

SEQ ID NO: 7245301 - DNA, 22 bp, Homo sapiens
tgttttctgggtggaaggtact

SEQ ID NO: 7245302 - DNA, 22 bp, Homo sapiens
tgttttggtggtacatgctgga

SEQ ID NO: 7245303 - DNA, 22 bp, Homo sapiens
tgttttggaggtcctcactaga

SEQ ID NO: 7245304 - DNA, 22 bp, Homo sapiens
ttacacaacatctgtattatta

SEQ ID NO: 7245305 - DNA, 22 bp, Homo sapiens
ttacaaactgtcatatagtatt

SEQ ID NO: 7245306 - DNA, 22 bp, Homo sapiens
ttacacattgcagatcaaaatg

SEQ ID NO: 7245307 - DNA, 22 bp, Homo sapiens
ttacaggtgtggaaattgagta

SEQ ID NO: 7245308 - DNA, 22 bp, Homo sapiens
ttacaggtgagaaaactgaggc

SEQ ID NO: 7245309 - DNA, 22 bp, Homo sapiens
ttacttaaacagaaatgcagaa

SEQ ID NO: 7245310 - DNA, 22 bp, Homo sapiens
ttacttgatgatgtataaagtc

SEQ ID NO: 7245311 - DNA, 22 bp, Homo sapiens
ttacttgaaggcagaaaagttt

SEQ ID NO: 7245312 - DNA, 22 bp, Homo sapiens
ttagacatgatggtgcagagag

SEQ ID NO: 7245313 - DNA, 22 bp, Homo sapiens
ttagacatcagtgcttctcagc

SEQ ID NO: 7245314 - DNA, 22 bp, Homo sapiens
ttagaaagctttccatagtcaa

SEQ ID NO: 7245315 - DNA, 22 bp, Homo sapiens
ttagaaagaatagcctggctgc

SEQ ID NO: 7245316 - DNA, 20 bp, Homo sapiens
ttagaaagagcgtgataaga

SEQ ID NO: 7245317 - DNA, 21 bp, Homo sapiens
ttagaaagctcactacagtta

SEQ ID NO: 7245318 - DNA, 22 bp, Homo sapiens
ttagaaagaactttagatatca

SEQ ID NO: 7245319 - DNA, 22 bp, Homo sapiens
ttagaaactttggaggatagat

SEQ ID NO: 7245320 - DNA, 22 bp, Homo sapiens
ttagaaacccagactcttaggt

SEQ ID NO: 7245321 - DNA, 22 bp, Homo sapiens
ttagaaacaaaatagttatttg

SEQ ID NO: 7245322 - DNA, 22 bp, Homo sapiens
ttacttttctattcgatatgtg

SEQ ID NO: 7245323 - DNA, 19 bp, Homo sapiens
ggtcctcagcagagcatgc

SEQ ID NO: 7245324 - DNA, 22 bp, Homo sapiens
ggtcctgcattgccagcaagct

SEQ ID NO: 7245325 - DNA, 23 bp, Homo sapiens
cagatgaggttggcagcatggtc

SEQ ID NO: 7245326 - DNA, 22 bp, Homo sapiens
ggtcctgctggctcagctgagc

SEQ ID NO: 7245327 - DNA, 22 bp, Homo sapiens
ggtcctgcgtctggctcgcccg

SEQ ID NO: 7245328 - DNA, 22 bp, Homo sapiens
cagatgaagtaggtgacgagca

SEQ ID NO: 7245329 - DNA, 22 bp, Homo sapiens
cagatgagggctggaggtgagc

SEQ ID NO: 7245330 - DNA, 22 bp, Homo sapiens
ggtcaacttagataagatggag

SEQ ID NO: 7245331 - DNA, 22 bp, Homo sapiens
cagatatgataggattagcaca

SEQ ID NO: 7245332 - DNA, 22 bp, Homo sapiens
ggtcaacttgagaagctagtac

SEQ ID NO: 7245333 - DNA, 22 bp, Homo sapiens
ggtcaacttcttatggtagctt

SEQ ID NO: 7245334 - DNA, 22 bp, Homo sapiens
gggctggaggaccggcctcgga

SEQ ID NO: 7245335 - DNA, 22 bp, Homo sapiens
gggctggaggagatccagaggc

SEQ ID NO: 7245336 - DNA, 19 bp, Homo sapiens
gggctggagggatagagcc

SEQ ID NO: 7245337 - DNA, 22 bp, Homo sapiens
gggctggaggtgagcaggacag

SEQ ID NO: 7245338 - DNA, 22 bp, Homo sapiens
gggctgtgtactatgaggaggg

SEQ ID NO: 7245339 - DNA, 22 bp, Homo sapiens
gggctgtgcctcaggtggggtc

SEQ ID NO: 7245340 - DNA, 22 bp, Homo sapiens
gggctgtgcctcaggtggggtc

SEQ ID NO: 7245341 - DNA, 22 bp, Homo sapiens
gggctgtgagagtggggctgct

SEQ ID NO: 7245342 - DNA, 22 bp, Homo sapiens
gggctgtcacgcccctgcacct

SEQ ID NO: 7245343 - DNA, 22 bp, Homo sapiens
gggctggatctcacgtgagacc

SEQ ID NO: 7245344 - DNA, 22 bp, Homo sapiens
gggctgtaggagctggaatggg

SEQ ID NO: 7245345 - DNA, 22 bp, Homo sapiens
ggggcagagagaaggaagcttg

SEQ ID NO: 7245346 - DNA, 22 bp, Homo sapiens
ggggcagagaataaaaacctaa

SEQ ID NO: 7245347 - DNA, 22 bp, Homo sapiens
ggggcagaagtagtgcccctga

SEQ ID NO: 7245348 - DNA, 22 bp, Homo sapiens
ggggcagagcatagctccaatt

SEQ ID NO: 7245349 - DNA, 21 bp, Homo sapiens
ggggcagagctaggccctgca

SEQ ID NO: 7245350 - DNA, 22 bp, Homo sapiens
ggggcagagtagctggggtgtg

SEQ ID NO: 7245351 - DNA, 21 bp, Homo sapiens
ggggcctctccacacagccgg

SEQ ID NO: 7245352 - DNA, 21 bp, Homo sapiens
ggggcctctccacacagccgg

SEQ ID NO: 7245353 - DNA, 23 bp, Homo sapiens
ggggcctgcaccggtctgcgcgg

SEQ ID NO: 7245354 - DNA, 22 bp, Homo sapiens
ggggcctctgggaacccctgtg

SEQ ID NO: 7245355 - DNA, 22 bp, Homo sapiens
ggggcagatggaacagagcaca

SEQ ID NO: 7245356 - DNA, 22 bp, Homo sapiens
ggggcagcctccaggaaagctg

SEQ ID NO: 7245357 - DNA, 22 bp, Homo sapiens
ggggcagctaccggaagtaggg

SEQ ID NO: 7245358 - DNA, 22 bp, Homo sapiens
ggggcagagtctggactgttgt

SEQ ID NO: 7245359 - DNA, 22 bp, Homo sapiens
ggggcgactgtatcttggggca

SEQ ID NO: 7245360 - DNA, 22 bp, Homo sapiens
ggggcgccccgagggtgcgcac

SEQ ID NO: 7245361 - DNA, 22 bp, Homo sapiens
ggggcctgtagagcttcaggga

SEQ ID NO: 7245362 - DNA, 21 bp, Homo sapiens
ggggttggcaagagcagagac

SEQ ID NO: 7245363 - DNA, 22 bp, Homo sapiens
gggatgactttttgaaatggat

SEQ ID NO: 7245364 - DNA, 22 bp, Homo sapiens
gggatgagagctgggacagaag

SEQ ID NO: 7245365 - DNA, 22 bp, Homo sapiens
cagagcagaaacctgggtgatt

SEQ ID NO: 7245366 - DNA, 22 bp, Homo sapiens
cagagacaacctggtagagaaa

SEQ ID NO: 7245367 - DNA, 22 bp, Homo sapiens
cagagacacttaacaggaatgg

SEQ ID NO: 7245368 - DNA, 22 bp, Homo sapiens
cagacttgaaagagactcagtt

SEQ ID NO: 7245369 - DNA, 17 bp, Homo sapiens
gggcagggactcctggg

SEQ ID NO: 7245370 - DNA, 22 bp, Homo sapiens
gggcaggtactgggtggtgagc

SEQ ID NO: 7245371 - DNA, 22 bp, Homo sapiens
gggcaggggtcagtggccccaa

SEQ ID NO: 7245372 - DNA, 22 bp, Homo sapiens
gggcaggtacaagatgcttctt

SEQ ID NO: 7245373 - DNA, 22 bp, Homo sapiens
gggcaggggtcagtggccccaa

SEQ ID NO: 7245374 - DNA, 20 bp, Homo sapiens
cagagcagtgcccaggcggc

SEQ ID NO: 7245375 - DNA, 22 bp, Homo sapiens
cagagcagtggagagtaggtct

SEQ ID NO: 7245376 - DNA, 22 bp, Homo sapiens
cagagcatcgcgcagagagcct

SEQ ID NO: 7245377 - DNA, 22 bp, Homo sapiens
cagagcataattgacatgaggt

SEQ ID NO: 7245378 - DNA, 22 bp, Homo sapiens
cagagcatttggaagccacgtg

SEQ ID NO: 7245379 - DNA, 22 bp, Homo sapiens
cagagcattgagggtctgccaa

SEQ ID NO: 7245380 - DNA, 22 bp, Homo sapiens
cagagcattaaaaccagctctg

SEQ ID NO: 7245381 - DNA, 22 bp, Homo sapiens
cagagcatgtcaactagcttta

SEQ ID NO: 7245382 - DNA, 22 bp, Homo sapiens
cagagcatgaataaaagttaca

SEQ ID NO: 7245383 - DNA, 21 bp, Homo sapiens
gggagctggaaactgggtgac

SEQ ID NO: 7245384 - DNA, 21 bp, Homo sapiens
gggagctggaaactgggtgac

SEQ ID NO: 7245385 - DNA, 20 bp, Homo sapiens
gggagctggaattgtcttag

SEQ ID NO: 7245386 - DNA, 22 bp, Homo sapiens
gggagctgccttagaccggagg

SEQ ID NO: 7245387 - DNA, 22 bp, Homo sapiens
gggagctgcggtcttgcgaaga

SEQ ID NO: 7245388 - DNA, 22 bp, Homo sapiens
gggagctgctgaacacaagggt

SEQ ID NO: 7245389 - DNA, 22 bp, Homo sapiens
gggaggcacgaggcgcgcagtg

SEQ ID NO: 7245390 - DNA, 22 bp, Homo sapiens
gggaggagtgaagattcacctg

SEQ ID NO: 7245391 - DNA, 22 bp, Homo sapiens
gggaggagtgaagattcacctg

SEQ ID NO: 7245392 - DNA, 22 bp, Homo sapiens
gggaggcagtgctggaggctgg

SEQ ID NO: 7245393 - DNA, 22 bp, Homo sapiens
gggagctgccaccacccctggg

SEQ ID NO: 7245394 - DNA, 22 bp, Homo sapiens
gggagctgcacacgccccggaa

SEQ ID NO: 7245395 - DNA, 22 bp, Homo sapiens
gggagctgatgatgtaagtccc

SEQ ID NO: 7245396 - DNA, 22 bp, Homo sapiens
gggagctgatcaggtggattca

SEQ ID NO: 7245397 - DNA, 22 bp, Homo sapiens
cagacagaaggaaggccaacat

SEQ ID NO: 7245398 - DNA, 22 bp, Homo sapiens
cagacacacaccctggcctagc

SEQ ID NO: 7245399 - DNA, 22 bp, Homo sapiens
cagaatttttcactcaatcttc

SEQ ID NO: 7245400 - DNA, 22 bp, Homo sapiens
cagaaaatagagtttctctgag

SEQ ID NO: 7245401 - DNA, 22 bp, Homo sapiens
cagaaaatagagtttctctgag

SEQ ID NO: 7245402 - DNA, 22 bp, Homo sapiens
gtgagcaattcaaaggcaggaa

SEQ ID NO: 7245403 - DNA, 22 bp, Homo sapiens
gtgagagtgtttggaaatagaa

SEQ ID NO: 7245404 - DNA, 18 bp, Homo sapiens
gtgagcagagagcatcac

SEQ ID NO: 7245405 - DNA, 20 bp, Homo sapiens
cagccctccagtggaggcag

SEQ ID NO: 7245406 - DNA, 22 bp, Homo sapiens
cagccctcctaccctgccaggc

SEQ ID NO: 7245407 - DNA, 22 bp, Homo sapiens
gtgaatttctgactaaaagtgc

SEQ ID NO: 7245408 - DNA, 22 bp, Homo sapiens
cagccctggcccaggtgcctta

SEQ ID NO: 7245409 - DNA, 22 bp, Homo sapiens
cagattactttgtagcagtcag

SEQ ID NO: 7245410 - DNA, 22 bp, Homo sapiens
cagattactttgtagcagtcag

SEQ ID NO: 7245411 - DNA, 22 bp, Homo sapiens
cagatttatgcaaaaaggaaga

SEQ ID NO: 7245412 - DNA, 22 bp, Homo sapiens
cagcagcagccccaggaaggtt

SEQ ID NO: 7245413 - DNA, 22 bp, Homo sapiens
gtagaaatatttatctctgaga

SEQ ID NO: 7245414 - DNA, 22 bp, Homo sapiens
gtagaaaattaggatgaggctt

SEQ ID NO: 7245415 - DNA, 22 bp, Homo sapiens
gtagaaatagtggttgacagga

SEQ ID NO: 7245416 - DNA, 22 bp, Homo sapiens
gtagaaaaagcagtaagtctca

SEQ ID NO: 7245417 - DNA, 22 bp, Homo sapiens
gtaggccatggtggttgtctct

SEQ ID NO: 7245418 - DNA, 22 bp, Homo sapiens
cagcatcctttgctggtttccc

SEQ ID NO: 7245419 - DNA, 22 bp, Homo sapiens
cagcatccctcaggggcctctg

SEQ ID NO: 7245420 - DNA, 22 bp, Homo sapiens
cagcagtgtctccagcatcaca

SEQ ID NO: 7245421 - DNA, 19 bp, Homo sapiens
gtcagcaccatggacaggg

SEQ ID NO: 7245422 - DNA, 22 bp, Homo sapiens
gtcagcacctctttggggagct

SEQ ID NO: 7245423 - DNA, 22 bp, Homo sapiens
gtcagcacttttccgaggcaga

SEQ ID NO: 7245424 - DNA, 22 bp, Homo sapiens
gtattttatggcatgcagtggc

SEQ ID NO: 7245425 - DNA, 21 bp, Homo sapiens
gtcacacaggcctggagctga

SEQ ID NO: 7245426 - DNA, 22 bp, Homo sapiens
gtcagagttccaaattaatcaa

SEQ ID NO: 7245427 - DNA, 19 bp, Homo sapiens
cagcatctgagccgtgtcc

SEQ ID NO: 7245428 - DNA, 22 bp, Homo sapiens
gtccagagaggcaggaggctac

SEQ ID NO: 7245429 - DNA, 22 bp, Homo sapiens
cagccagctggtgcggcagagc

SEQ ID NO: 7245430 - DNA, 22 bp, Homo sapiens
caagaagaggtgattggtaagt

SEQ ID NO: 7245431 - DNA, 22 bp, Homo sapiens
gctggacccggcccctcacctc

SEQ ID NO: 7245432 - DNA, 22 bp, Homo sapiens
caagaattgtacaaactgggtg

SEQ ID NO: 7245433 - DNA, 22 bp, Homo sapiens
caagaattaagaattttgatgt

SEQ ID NO: 7245434 - DNA, 22 bp, Homo sapiens
caagaataaccagacaatagca

SEQ ID NO: 7245435 - DNA, 22 bp, Homo sapiens
caagaataaaatacatgttgat

SEQ ID NO: 7245436 - DNA, 22 bp, Homo sapiens
caagaatcaacattatttagtg

SEQ ID NO: 7245437 - DNA, 22 bp, Homo sapiens
gctgctttggaaagcatggaaa

SEQ ID NO: 7245438 - DNA, 22 bp, Homo sapiens
caagctccttacatccacaggg

SEQ ID NO: 7245439 - DNA, 22 bp, Homo sapiens
caagctctgcgggctccaagat

SEQ ID NO: 7245440 - DNA, 22 bp, Homo sapiens
caagctctgggatagcagagag

SEQ ID NO: 7245441 - DNA, 22 bp, Homo sapiens
caagctctgggatgcagacatc

SEQ ID NO: 7245442 - DNA, 22 bp, Homo sapiens
caagctctttaaacttatgtca

SEQ ID NO: 7245443 - DNA, 22 bp, Homo sapiens
gctggggagcaagagtagtgag

SEQ ID NO: 7245444 - DNA, 22 bp, Homo sapiens
caaagtcccagctgcttagaga

SEQ ID NO: 7245445 - DNA, 22 bp, Homo sapiens
caaagtccatagtttacaatag

SEQ ID NO: 7245446 - DNA, 22 bp, Homo sapiens
caaagtcctagaacagtgcttg

SEQ ID NO: 7245447 - DNA, 22 bp, Homo sapiens
gctctggaggctggaagaccat

SEQ ID NO: 7245448 - DNA, 23 bp, Homo sapiens
gctctggagctgggcctggcagg

SEQ ID NO: 7245449 - DNA, 22 bp, Homo sapiens
gctgccctccagttcccacagt

SEQ ID NO: 7245450 - DNA, 22 bp, Homo sapiens
gctgccctcccagggcaagctt

SEQ ID NO: 7245451 - DNA, 18 bp, Homo sapiens
gctgccctagctcccctc

SEQ ID NO: 7245452 - DNA, 22 bp, Homo sapiens
gctgccctccagttcccacagt

SEQ ID NO: 7245453 - DNA, 22 bp, Homo sapiens
gctgccctgacaagctactccc

SEQ ID NO: 7245454 - DNA, 22 bp, Homo sapiens
gctgccctctgtgacccggccc

SEQ ID NO: 7245455 - DNA, 22 bp, Homo sapiens
gctgccctctgtgtttgtcctt

SEQ ID NO: 7245456 - DNA, 22 bp, Homo sapiens
gctgccctctgtgacccggccc

SEQ ID NO: 7245457 - DNA, 22 bp, Homo sapiens
gctgccctctctggccccacac

SEQ ID NO: 7245458 - DNA, 22 bp, Homo sapiens
gctgccctcccagggcaagctt

SEQ ID NO: 7245459 - DNA, 22 bp, Homo sapiens
gctgccctctctggccccacac

SEQ ID NO: 7245460 - DNA, 21 bp, Homo sapiens
gctgccctggctcagcattca

SEQ ID NO: 7245461 - DNA, 22 bp, Homo sapiens
gctgccctgcctcagactcctc

SEQ ID NO: 7245462 - DNA, 22 bp, Homo sapiens
gctgccctgactccagcagcct

SEQ ID NO: 7245463 - DNA, 22 bp, Homo sapiens
gctgccctgcatctgtgccttc

SEQ ID NO: 7245464 - DNA, 22 bp, Homo sapiens
gctgccctgactccagcagcct

SEQ ID NO: 7245465 - DNA, 22 bp, Homo sapiens
caagaacagtttgccaaattgg

SEQ ID NO: 7245466 - DNA, 22 bp, Homo sapiens
caagaaatttcttaagaactaa

SEQ ID NO: 7245467 - DNA, 22 bp, Homo sapiens
caagaaattctgttcagatagc

SEQ ID NO: 7245468 - DNA, 22 bp, Homo sapiens
gctgcctgatgtccagcaggac

SEQ ID NO: 7245469 - DNA, 22 bp, Homo sapiens
caagaaatctagaagtcagtgg

SEQ ID NO: 7245470 - DNA, 22 bp, Homo sapiens
caagaaactttattctgccata

SEQ ID NO: 7245471 - DNA, 22 bp, Homo sapiens
caactttcacactccacatgct

SEQ ID NO: 7245472 - DNA, 22 bp, Homo sapiens
caacacaggttctgcaaaggaa

SEQ ID NO: 7245473 - DNA, 22 bp, Homo sapiens
gctgccctgtccggctctcctg

SEQ ID NO: 7245474 - DNA, 22 bp, Homo sapiens
gctgccctgtctgcagcaggac

SEQ ID NO: 7245475 - DNA, 22 bp, Homo sapiens
gctgccctgtccggctctcctg

SEQ ID NO: 7245476 - DNA, 19 bp, Homo sapiens
cacaaatgatgaggacctg

SEQ ID NO: 7245477 - DNA, 22 bp, Homo sapiens
cacaaatgactgaaacgactgt

SEQ ID NO: 7245478 - DNA, 22 bp, Homo sapiens
ggaagctgaggcccagtgaagg

SEQ ID NO: 7245479 - DNA, 22 bp, Homo sapiens
ggaccagagaagtgagcacctg

SEQ ID NO: 7245480 - DNA, 22 bp, Homo sapiens
cacaacttagcagcttgaaaca

SEQ ID NO: 7245481 - DNA, 19 bp, Homo sapiens
cacaacttcgcttgattcc

SEQ ID NO: 7245482 - DNA, 22 bp, Homo sapiens
ggagaaggcgaagtcattcttt

SEQ ID NO: 7245483 - DNA, 22 bp, Homo sapiens
ggagaagggcatggtagtttta

SEQ ID NO: 7245484 - DNA, 22 bp, Homo sapiens
ggagaagggtatgtgtggcgga

SEQ ID NO: 7245485 - DNA, 22 bp, Homo sapiens
ggagaaggtgctggtcactgtg

SEQ ID NO: 7245486 - DNA, 22 bp, Homo sapiens
ggagagaggagcccactgctgt

SEQ ID NO: 7245487 - DNA, 22 bp, Homo sapiens
caatgttttcaactgacaagta

SEQ ID NO: 7245488 - DNA, 22 bp, Homo sapiens
caatcagatatgtgacatattt

SEQ ID NO: 7245489 - DNA, 22 bp, Homo sapiens
caattgtatgtgagaaataaat

SEQ ID NO: 7245490 - DNA, 22 bp, Homo sapiens
caatttcaatacaaaatacatt

SEQ ID NO: 7245491 - DNA, 22 bp, Homo sapiens
caatagaaggcacagataggta

SEQ ID NO: 7245492 - DNA, 22 bp, Homo sapiens
caatagaaggcacagataggta

SEQ ID NO: 7245493 - DNA, 22 bp, Homo sapiens
caatagcagacctagaaagcaa

SEQ ID NO: 7245494 - DNA, 22 bp, Homo sapiens
gctggggagctagacctcagca

SEQ ID NO: 7245495 - DNA, 22 bp, Homo sapiens
caaggctgtgcagggtccatat

SEQ ID NO: 7245496 - DNA, 22 bp, Homo sapiens
cactctccagcacaccccattt

SEQ ID NO: 7245497 - DNA, 22 bp, Homo sapiens
cactataatcctgttttagaac

SEQ ID NO: 7245498 - DNA, 22 bp, Homo sapiens
cactcagaggtttgattgctca

SEQ ID NO: 7245499 - DNA, 22 bp, Homo sapiens
caccaggctgcccaggacaggg

SEQ ID NO: 7245500 - DNA, 22 bp, Homo sapiens
caccaggctgaaccagagggga

SEQ ID NO: 7245501 - DNA, 22 bp, Homo sapiens
caccaggctggagtgcagaggt

SEQ ID NO: 7245502 - DNA, 22 bp, Homo sapiens
ggccaggctggttccttgacct

SEQ ID NO: 7245503 - DNA, 22 bp, Homo sapiens
ggccaggctggttccttgacct

SEQ ID NO: 7245504 - DNA, 22 bp, Homo sapiens
ggccaggctggtctcagacttc

SEQ ID NO: 7245505 - DNA, 22 bp, Homo sapiens
ggccaggctggtctcagacttc

SEQ ID NO: 7245506 - DNA, 22 bp, Homo sapiens
ggccaggctgccctgggagcag

SEQ ID NO: 7245507 - DNA, 22 bp, Homo sapiens
ggccaggctgccctgggagcag

SEQ ID NO: 7245508 - DNA, 22 bp, Homo sapiens
ggccaggctgctgggaccccgc

SEQ ID NO: 7245509 - DNA, 22 bp, Homo sapiens
ggccaggctggtctcagacttc

SEQ ID NO: 7245510 - DNA, 22 bp, Homo sapiens
cacctgcctgctagagcctgac

SEQ ID NO: 7245511 - DNA, 22 bp, Homo sapiens
cacctgggctaaactatgcagg

SEQ ID NO: 7245512 - DNA, 22 bp, Homo sapiens
cactgcactccagcctgggaga

SEQ ID NO: 7245513 - DNA, 22 bp, Homo sapiens
cactgcactccagcctgggtca

SEQ ID NO: 7245514 - DNA, 22 bp, Homo sapiens
cactgggagagctggacttggg

SEQ ID NO: 7245515 - DNA, 22 bp, Homo sapiens
cactgcactccagcctgggtga

SEQ ID NO: 7245516 - DNA, 22 bp, Homo sapiens
cactgggatttggggtgtctta

SEQ ID NO: 7245517 - DNA, 22 bp, Homo sapiens
ggctctgctggtaagatgcctc

SEQ ID NO: 7245518 - DNA, 22 bp, Homo sapiens
ggctctgctggattgaggccag

SEQ ID NO: 7245519 - DNA, 22 bp, Homo sapiens
ggctctgcttcctggaattgtg

SEQ ID NO: 7245520 - DNA, 22 bp, Homo sapiens
ggctctgcttcagaaggctcat

SEQ ID NO: 7245521 - DNA, 22 bp, Homo sapiens
ggctctgcttgaggccagcctg

SEQ ID NO: 7245522 - DNA, 17 bp, Homo sapiens
ggctgctgtgctggtgc

SEQ ID NO: 7245523 - DNA, 20 bp, Homo sapiens
ggctctgcttgtgagcagcc

SEQ ID NO: 7245524 - DNA, 19 bp, Homo sapiens
cacagtgcagccatttctc

SEQ ID NO: 7245525 - DNA, 22 bp, Homo sapiens
cacagtgcactaagctccgggg

SEQ ID NO: 7245526 - DNA, 22 bp, Homo sapiens
cacagtgcaatcggccacaaat

SEQ ID NO: 7245527 - DNA, 22 bp, Homo sapiens
ggcaagggttgaagataaggta

SEQ ID NO: 7245528 - DNA, 18 bp, Homo sapiens
cacaggcaggtgataggt

SEQ ID NO: 7245529 - DNA, 23 bp, Homo sapiens
cacaggcagaaatcaagacggta

SEQ ID NO: 7245530 - DNA, 22 bp, Homo sapiens
cacaggcacgcctctggccagg

SEQ ID NO: 7245531 - DNA, 22 bp, Homo sapiens
cacaggaggttaggaagtggtc

SEQ ID NO: 7245532 - DNA, 23 bp, Homo sapiens
ggagagctcctcgtgactcactg

SEQ ID NO: 7245533 - DNA, 22 bp, Homo sapiens
ggagagcctccacggcttctgt

SEQ ID NO: 7245534 - DNA, 22 bp, Homo sapiens
ggagagctagtgcctgccagta

SEQ ID NO: 7245535 - DNA, 22 bp, Homo sapiens
ggcacaaaggaataaagagaac

SEQ ID NO: 7245536 - DNA, 22 bp, Homo sapiens
ggcagaggtgacagtgtctttt

SEQ ID NO: 7245537 - DNA, 22 bp, Homo sapiens
ggcagagtggagtgcggcctcc

SEQ ID NO: 7245538 - DNA, 22 bp, Homo sapiens
ggcagagtgctctgggcagggg

SEQ ID NO: 7245539 - DNA, 22 bp, Homo sapiens
ggcagatatattcgtgaaatag

SEQ ID NO: 7245540 - DNA, 22 bp, Homo sapiens
cacattcagctcattaatggtc

SEQ ID NO: 7245541 - DNA, 22 bp, Homo sapiens
atttattggtttgcatggtgaa

SEQ ID NO: 7245542 - DNA, 19 bp, Homo sapiens
atttattgtatgattccat

SEQ ID NO: 7245543 - DNA, 22 bp, Homo sapiens
gccatgcctgtgtctccaggcc

SEQ ID NO: 7245544 - DNA, 23 bp, Homo sapiens
gccatggctgccccacaggcctc

SEQ ID NO: 7245545 - DNA, 23 bp, Homo sapiens
gccatgagttccctttcacttgt

SEQ ID NO: 7245546 - DNA, 19 bp, Homo sapiens
gcccaggggcccgatgctg

SEQ ID NO: 7245547 - DNA, 22 bp, Homo sapiens
gcccagggtgaagtgcagttgt

SEQ ID NO: 7245548 - DNA, 22 bp, Homo sapiens
gcccagtctccaggagactctc

SEQ ID NO: 7245549 - DNA, 22 bp, Homo sapiens
atttctgtttgctactataagt

SEQ ID NO: 7245550 - DNA, 22 bp, Homo sapiens
gccctggttttagaggagcagg

SEQ ID NO: 7245551 - DNA, 22 bp, Homo sapiens
gccctggtgtgcccagcatggg

SEQ ID NO: 7245552 - DNA, 22 bp, Homo sapiens
gccctggggaaggtgtctccaa

SEQ ID NO: 7245553 - DNA, 18 bp, Homo sapiens
gccctggtggagctggtg

SEQ ID NO: 7245554 - DNA, 22 bp, Homo sapiens
gccctgtcctcctgactgagtg

SEQ ID NO: 7245555 - DNA, 22 bp, Homo sapiens
gccctgtatccaagtcccatct

SEQ ID NO: 7245556 - DNA, 22 bp, Homo sapiens
gccctgggctccctgctccaca

SEQ ID NO: 7245557 - DNA, 22 bp, Homo sapiens
gccctgcctgccggtgtgggtc

SEQ ID NO: 7245558 - DNA, 22 bp, Homo sapiens
atttccctccagggaaagctta

SEQ ID NO: 7245559 - DNA, 22 bp, Homo sapiens
gcccagtggtaaaagcaggcct

SEQ ID NO: 7245560 - DNA, 22 bp, Homo sapiens
atttcccactctactacatgct

SEQ ID NO: 7245561 - DNA, 22 bp, Homo sapiens
atttcccagggccctcatagtt

SEQ ID NO: 7245562 - DNA, 22 bp, Homo sapiens
atttcccagggccctcatagtt

SEQ ID NO: 7245563 - DNA, 22 bp, Homo sapiens
atttatgagctgaaccatgaaa

SEQ ID NO: 7245564 - DNA, 22 bp, Homo sapiens
atttatgatagctgcattaaag

SEQ ID NO: 7245565 - DNA, 22 bp, Homo sapiens
atttatgatagctgcattaaag

SEQ ID NO: 7245566 - DNA, 22 bp, Homo sapiens
atttatgattagcctattgttg

SEQ ID NO: 7245567 - DNA, 22 bp, Homo sapiens
atttatagggcattgaaaactg

SEQ ID NO: 7245568 - DNA, 22 bp, Homo sapiens
atttatattttgggagctcctg

SEQ ID NO: 7245569 - DNA, 22 bp, Homo sapiens
atttatgacaaccaaagagtga

SEQ ID NO: 7245570 - DNA, 22 bp, Homo sapiens
atttatgacagaagatatgctg

SEQ ID NO: 7245571 - DNA, 22 bp, Homo sapiens
atttatgacagaagatatgctg

SEQ ID NO: 7245572 - DNA, 22 bp, Homo sapiens
atttatgacagaagatatgctg

SEQ ID NO: 7245573 - DNA, 22 bp, Homo sapiens
atttatgacagaagatatgctg

SEQ ID NO: 7245574 - DNA, 22 bp, Homo sapiens
atttatgactggtgaatagaac

SEQ ID NO: 7245575 - DNA, 22 bp, Homo sapiens
atttatgactggtgaatagaac

SEQ ID NO: 7245576 - DNA, 22 bp, Homo sapiens
atttatgacgtgttcggtcaat

SEQ ID NO: 7245577 - DNA, 22 bp, Homo sapiens
atttagtttaggaaaagtaggt

SEQ ID NO: 7245578 - DNA, 20 bp, Homo sapiens
gcatggcatgtagtgaagtg

SEQ ID NO: 7245579 - DNA, 22 bp, Homo sapiens
gcatggcatttgaaggtagaag

SEQ ID NO: 7245580 - DNA, 21 bp, Homo sapiens
gccagctgcagggcttccttg

SEQ ID NO: 7245581 - DNA, 22 bp, Homo sapiens
gccagctgccctctgctggtcc

SEQ ID NO: 7245582 - DNA, 22 bp, Homo sapiens
gccagctgcatctcctgggctg

SEQ ID NO: 7245583 - DNA, 22 bp, Homo sapiens
gccagctgctcgcgtagggtag

SEQ ID NO: 7245584 - DNA, 22 bp, Homo sapiens
gccagctgctggaacagcgcga

SEQ ID NO: 7245585 - DNA, 22 bp, Homo sapiens
caaagaatgagtgagtacataa

SEQ ID NO: 7245586 - DNA, 22 bp, Homo sapiens
caaagaatcactcatctttagc

SEQ ID NO: 7245587 - DNA, 22 bp, Homo sapiens
caaagaatgagtgagtacataa

SEQ ID NO: 7245588 - DNA, 20 bp, Homo sapiens
caaagacatgctaggggtgg

SEQ ID NO: 7245589 - DNA, 20 bp, Homo sapiens
caaaagcaatgaagttatga

SEQ ID NO: 7245590 - DNA, 22 bp, Homo sapiens
gctcagagaatcagcagacacc

SEQ ID NO: 7245591 - DNA, 22 bp, Homo sapiens
gctcagagaagttgtgcctggc

SEQ ID NO: 7245592 - DNA, 22 bp, Homo sapiens
gctcagagaaaactggggcttg

SEQ ID NO: 7245593 - DNA, 22 bp, Homo sapiens
attttgaatcaccttggaagaa

SEQ ID NO: 7245594 - DNA, 22 bp, Homo sapiens
attttgaatcaccttggaagaa

SEQ ID NO: 7245595 - DNA, 22 bp, Homo sapiens
atttgtcaaaacacagagaaca

SEQ ID NO: 7245596 - DNA, 22 bp, Homo sapiens
atttgtatcttctaatattatc

SEQ ID NO: 7245597 - DNA, 22 bp, Homo sapiens
atttgtcaataagatgaacata

SEQ ID NO: 7245598 - DNA, 22 bp, Homo sapiens
attttcaggttttgccattgta

SEQ ID NO: 7245599 - DNA, 22 bp, Homo sapiens
attttagatttaagaataaggt

SEQ ID NO: 7245600 - DNA, 22 bp, Homo sapiens
atttgtcactgagagagttaga

SEQ ID NO: 7245601 - DNA, 22 bp, Homo sapiens
atttggaattcgagtaattcca

SEQ ID NO: 7245602 - DNA, 22 bp, Homo sapiens
atttggaattctatttcagtag

SEQ ID NO: 7245603 - DNA, 22 bp, Homo sapiens
atttgtaagctagagccatgat

SEQ ID NO: 7245604 - DNA, 22 bp, Homo sapiens
attttcagttgaaaaagttggt

SEQ ID NO: 7245605 - DNA, 22 bp, Homo sapiens
gcagtaaagcctgagatatatg

SEQ ID NO: 7245606 - DNA, 22 bp, Homo sapiens
gcatggcaagatcaggagacca

SEQ ID NO: 7245607 - DNA, 21 bp, Homo sapiens
gcatggcaggtcactggggca

SEQ ID NO: 7245608 - DNA, 22 bp, Homo sapiens
gcatcagtagctatagttacaa

SEQ ID NO: 7245609 - DNA, 22 bp, Homo sapiens
gcagggcagtgtgtctgtgggg

SEQ ID NO: 7245610 - DNA, 20 bp, Homo sapiens
gcaggcagggaatgggggtg

SEQ ID NO: 7245611 - DNA, 22 bp, Homo sapiens
attcttttaaatggcagtagta

SEQ ID NO: 7245612 - DNA, 22 bp, Homo sapiens
attcttttaagccccagggatt

SEQ ID NO: 7245613 - DNA, 22 bp, Homo sapiens
attcttttcccaactgctttaa

SEQ ID NO: 7245614 - DNA, 22 bp, Homo sapiens
attcttttgtcctagcttgata

SEQ ID NO: 7245615 - DNA, 22 bp, Homo sapiens
attcttttgtcctagcttgata

SEQ ID NO: 7245616 - DNA, 22 bp, Homo sapiens
attcttttttaaggaatagaac

SEQ ID NO: 7245617 - DNA, 22 bp, Homo sapiens
attccaaacagtgctgcagact

SEQ ID NO: 7245618 - DNA, 22 bp, Homo sapiens
attcacaaaatgatatagatac

SEQ ID NO: 7245619 - DNA, 22 bp, Homo sapiens
gcaggcaggaaggactaagtaa

SEQ ID NO: 7245620 - DNA, 22 bp, Homo sapiens
gcagcttcctgagtgtggacag

SEQ ID NO: 7245621 - DNA, 22 bp, Homo sapiens
attatataaaattctggaagct

SEQ ID NO: 7245622 - DNA, 22 bp, Homo sapiens
attagttgtgtggttctcaatt

SEQ ID NO: 7245623 - DNA, 22 bp, Homo sapiens
attagttgtacagttcattttg

SEQ ID NO: 7245624 - DNA, 22 bp, Homo sapiens
gcacacagattaggaaacagaa

SEQ ID NO: 7245625 - DNA, 22 bp, Homo sapiens
gcacacagaattgattcactgt

SEQ ID NO: 7245626 - DNA, 22 bp, Homo sapiens
gcacacagctagattaccattc

SEQ ID NO: 7245627 - DNA, 22 bp, Homo sapiens
gcaccagggtgctgtgttctgg

SEQ ID NO: 7245628 - DNA, 22 bp, Homo sapiens
gcaccaggcttagagccccagg

SEQ ID NO: 7245629 - DNA, 22 bp, Homo sapiens
gcacagggctgccaggcggctt

SEQ ID NO: 7245630 - DNA, 22 bp, Homo sapiens
gcaccaggcagctgagcaggcc

SEQ ID NO: 7245631 - DNA, 22 bp, Homo sapiens
gcagacaatttattagcagatt

SEQ ID NO: 7245632 - DNA, 22 bp, Homo sapiens
gcacccagaataaggacaggac

SEQ ID NO: 7245633 - DNA, 22 bp, Homo sapiens
attatgcatttgttagtattaa

SEQ ID NO: 7245634 - DNA, 22 bp, Homo sapiens
attatgaagttgagggaccctg

SEQ ID NO: 7245635 - DNA, 22 bp, Homo sapiens
attatcttgataaaatggcagt

SEQ ID NO: 7245636 - DNA, 22 bp, Homo sapiens
gcagagatattgatatagattt

SEQ ID NO: 7245637 - DNA, 22 bp, Homo sapiens
gcagagatcggacactcagtaa

SEQ ID NO: 7245638 - DNA, 22 bp, Homo sapiens
gcagagaggaatgaagccatcc

SEQ ID NO: 7245639 - DNA, 22 bp, Homo sapiens
gcagagagttgggctgcgccag

SEQ ID NO: 7245640 - DNA, 22 bp, Homo sapiens
gcagagaggatattattgtcca

SEQ ID NO: 7245641 - DNA, 22 bp, Homo sapiens
gcagagaccccgcagtgaggcc

SEQ ID NO: 7245642 - DNA, 22 bp, Homo sapiens
gagtggggaaagccaggacaga

SEQ ID NO: 7245643 - DNA, 22 bp, Homo sapiens
gagtggggcccactgctgggtg

SEQ ID NO: 7245644 - DNA, 22 bp, Homo sapiens
gagtggggaaagccaggacaga

SEQ ID NO: 7245645 - DNA, 21 bp, Homo sapiens
gagtgggctgagatggggctg

SEQ ID NO: 7245646 - DNA, 22 bp, Homo sapiens
gagtggggaaagccaggacaga

SEQ ID NO: 7245647 - DNA, 22 bp, Homo sapiens
atgttattgatgcctgaggctt

SEQ ID NO: 7245648 - DNA, 21 bp, Homo sapiens
atgttattctgttcctccagc

SEQ ID NO: 7245649 - DNA, 22 bp, Homo sapiens
atgttattcaatttgaatccaa

SEQ ID NO: 7245650 - DNA, 23 bp, Homo sapiens
atgttattattagcagtcttgcc

SEQ ID NO: 7245651 - DNA, 22 bp, Homo sapiens
atgttattaaagtacagattct

SEQ ID NO: 7245652 - DNA, 22 bp, Homo sapiens
gagtggggcgaagtcggcgagt

SEQ ID NO: 7245653 - DNA, 22 bp, Homo sapiens
atgttatttcaaaattcccttg

SEQ ID NO: 7245654 - DNA, 22 bp, Homo sapiens
atgttatttattgaaacacttt

SEQ ID NO: 7245655 - DNA, 22 bp, Homo sapiens
atgttatttattatcctcggtt

SEQ ID NO: 7245656 - DNA, 22 bp, Homo sapiens
atgttatttctgaaagatcatt

SEQ ID NO: 7245657 - DNA, 22 bp, Homo sapiens
gatggaggagatggcagggtgc

SEQ ID NO: 7245658 - DNA, 22 bp, Homo sapiens
gatggccaaggaccacgcatcg

SEQ ID NO: 7245659 - DNA, 22 bp, Homo sapiens
gatggccacatacatggctggg

SEQ ID NO: 7245660 - DNA, 23 bp, Homo sapiens
gattcctagtacttctgacattg

SEQ ID NO: 7245661 - DNA, 22 bp, Homo sapiens
ctttattgtccttcttaggtgg

SEQ ID NO: 7245662 - DNA, 22 bp, Homo sapiens
ctttattgtccttcttaggtgg

SEQ ID NO: 7245663 - DNA, 22 bp, Homo sapiens
ctttattagatgtagactttct

SEQ ID NO: 7245664 - DNA, 22 bp, Homo sapiens
ctttattcctacaagattttct

SEQ ID NO: 7245665 - DNA, 22 bp, Homo sapiens
atctttgatctttattgctaag

SEQ ID NO: 7245666 - DNA, 22 bp, Homo sapiens
atctttgatgtgtgcccattca

SEQ ID NO: 7245667 - DNA, 22 bp, Homo sapiens
atctttcaatcaggaaaaatct

SEQ ID NO: 7245668 - DNA, 22 bp, Homo sapiens
atctggaagttaagcttggtgc

SEQ ID NO: 7245669 - DNA, 22 bp, Homo sapiens
atctggaagtctccgaaggcag

SEQ ID NO: 7245670 - DNA, 22 bp, Homo sapiens
atctggaagtcagaggtttgca

SEQ ID NO: 7245671 - DNA, 22 bp, Homo sapiens
atctggaagtaggagagtgggc

SEQ ID NO: 7245672 - DNA, 17 bp, Homo sapiens
atctggaagctagctga

SEQ ID NO: 7245673 - DNA, 22 bp, Homo sapiens
atctggaatagcatggggttga

SEQ ID NO: 7245674 - DNA, 22 bp, Homo sapiens
atctggaatccttgtggacaat

SEQ ID NO: 7245675 - DNA, 22 bp, Homo sapiens
atctggaatcttgctgaccctg

SEQ ID NO: 7245676 - DNA, 22 bp, Homo sapiens
atctggaatgtctcattgggaa

SEQ ID NO: 7245677 - DNA, 22 bp, Homo sapiens
atctggactagagcagaatggg

SEQ ID NO: 7245678 - DNA, 22 bp, Homo sapiens
atctggaattgaagaggtttga

SEQ ID NO: 7245679 - DNA, 22 bp, Homo sapiens
atctggaattaagagaaagtga

SEQ ID NO: 7245680 - DNA, 22 bp, Homo sapiens
atctggagaaaccgccaaggga

SEQ ID NO: 7245681 - DNA, 22 bp, Homo sapiens
atgacagaggagtgcaggtgat

SEQ ID NO: 7245682 - DNA, 21 bp, Homo sapiens
atgagagtaatgctataaatt

SEQ ID NO: 7245683 - DNA, 22 bp, Homo sapiens
atgagaaagttaatcatcatga

SEQ ID NO: 7245684 - DNA, 22 bp, Homo sapiens
atgagaaagttaatcatcatga

SEQ ID NO: 7245685 - DNA, 22 bp, Homo sapiens
atgagaaatttattacaagcta

SEQ ID NO: 7245686 - DNA, 22 bp, Homo sapiens
atgagagacaggaacgagctgg

SEQ ID NO: 7245687 - DNA, 22 bp, Homo sapiens
atgacaaaagaagacatgaggt

SEQ ID NO: 7245688 - DNA, 22 bp, Homo sapiens
gaagagcatatgaagagcatat

SEQ ID NO: 7245689 - DNA, 22 bp, Homo sapiens
gaagagcatttgcccaggctgt

SEQ ID NO: 7245690 - DNA, 22 bp, Homo sapiens
gaagagctaaaggcacaggctt

SEQ ID NO: 7245691 - DNA, 22 bp, Homo sapiens
gaagagagaacattacataaac

SEQ ID NO: 7245692 - DNA, 22 bp, Homo sapiens
atgagcatctgagccagtgact

SEQ ID NO: 7245693 - DNA, 22 bp, Homo sapiens
gaagctctaaggtcattgcatt

SEQ ID NO: 7245694 - DNA, 22 bp, Homo sapiens
gaagctctcaacaatggggagt

SEQ ID NO: 7245695 - DNA, 22 bp, Homo sapiens
gaagctctcaaactctcccctt

SEQ ID NO: 7245696 - DNA, 22 bp, Homo sapiens
gaagctctaaggtcattgcatt

SEQ ID NO: 7245697 - DNA, 22 bp, Homo sapiens
gaagctctggacagtgaagaag

SEQ ID NO: 7245698 - DNA, 22 bp, Homo sapiens
atgcagtacagataattctaca

SEQ ID NO: 7245699 - DNA, 22 bp, Homo sapiens
atgcagtactgatacatgccac

SEQ ID NO: 7245700 - DNA, 22 bp, Homo sapiens
atgcagttaggtaatagtctca

SEQ ID NO: 7245701 - DNA, 22 bp, Homo sapiens
atgcagttagcactacagaaga

SEQ ID NO: 7245702 - DNA, 22 bp, Homo sapiens
atgcagtgtttggaagcttaag

SEQ ID NO: 7245703 - DNA, 22 bp, Homo sapiens
atgcaggagagcatgtttaaga

SEQ ID NO: 7245704 - DNA, 22 bp, Homo sapiens
gaaggcaacaccaggatgcact

SEQ ID NO: 7245705 - DNA, 22 bp, Homo sapiens
gaaggagggagcggcgcggatt

SEQ ID NO: 7245706 - DNA, 22 bp, Homo sapiens
gaaggagggtgcggatctgagc

SEQ ID NO: 7245707 - DNA, 22 bp, Homo sapiens
gaatttcctctaaacccctgag

SEQ ID NO: 7245708 - DNA, 19 bp, Homo sapiens
gaattttaggacttcagca

SEQ ID NO: 7245709 - DNA, 22 bp, Homo sapiens
atgcctggatttgggactcaaa

SEQ ID NO: 7245710 - DNA, 22 bp, Homo sapiens
atgctacagagtttgaatatgt

SEQ ID NO: 7245711 - DNA, 22 bp, Homo sapiens
atgctacagagataggttgggt

SEQ ID NO: 7245712 - DNA, 22 bp, Homo sapiens
atgctacactccgcgaaaatgt

SEQ ID NO: 7245713 - DNA, 22 bp, Homo sapiens
atgctacactatttgctgagca

SEQ ID NO: 7245714 - DNA, 23 bp, Homo sapiens
atgctacaccaacacaggggaat

SEQ ID NO: 7245715 - DNA, 22 bp, Homo sapiens
atgctacaacattatctggggt

SEQ ID NO: 7245716 - DNA, 22 bp, Homo sapiens
atgctaaggcccaggagaaaat

SEQ ID NO: 7245717 - DNA, 22 bp, Homo sapiens
atgctacattttggtttataaa

SEQ ID NO: 7245718 - DNA, 22 bp, Homo sapiens
atgctacatagatacaaaaatg

SEQ ID NO: 7245719 - DNA, 18 bp, Homo sapiens
atgctacaggcaggtgtc

SEQ ID NO: 7245720 - DNA, 22 bp, Homo sapiens
atgctacaggattctccttatc

SEQ ID NO: 7245721 - DNA, 22 bp, Homo sapiens
atgctacaggagccccacttag

SEQ ID NO: 7245722 - DNA, 22 bp, Homo sapiens
atgctacaggaagacgtcaggc

SEQ ID NO: 7245723 - DNA, 22 bp, Homo sapiens
atgctacagccctctttgcata

SEQ ID NO: 7245724 - DNA, 22 bp, Homo sapiens
atgctacagcatctctcatcag

SEQ ID NO: 7245725 - DNA, 22 bp, Homo sapiens
atgctatagaaatatttaaatt

SEQ ID NO: 7245726 - DNA, 22 bp, Homo sapiens
gaagtccagaatactgctctga

SEQ ID NO: 7245727 - DNA, 22 bp, Homo sapiens
gaagtccaagatcaaggcccca

SEQ ID NO: 7245728 - DNA, 22 bp, Homo sapiens
gaagtccagatcaagtcaccag

SEQ ID NO: 7245729 - DNA, 22 bp, Homo sapiens
atgcagtttaaggcacaattag

SEQ ID NO: 7245730 - DNA, 21 bp, Homo sapiens
gaagtacaccaggaaggccac

SEQ ID NO: 7245731 - DNA, 22 bp, Homo sapiens
gaagtacactactccttgagtc

SEQ ID NO: 7245732 - DNA, 22 bp, Homo sapiens
gaagtacaggttgtgagagaat

SEQ ID NO: 7245733 - DNA, 22 bp, Homo sapiens
atgcatttgtaaaatataatcg

SEQ ID NO: 7245734 - DNA, 19 bp, Homo sapiens
gaatttatctcttcagtcc

SEQ ID NO: 7245735 - DNA, 22 bp, Homo sapiens
atgccactgcacttcagcctgg

SEQ ID NO: 7245736 - DNA, 22 bp, Homo sapiens
gaggctccagcgacacctaggc

SEQ ID NO: 7245737 - DNA, 22 bp, Homo sapiens
atgggcaggcaaggtggcgagt

SEQ ID NO: 7245738 - DNA, 22 bp, Homo sapiens
atgggcagctgcagcagtggtg

SEQ ID NO: 7245739 - DNA, 22 bp, Homo sapiens
gaggagctgggtcagggagaca

SEQ ID NO: 7245740 - DNA, 22 bp, Homo sapiens
gaggagctgggtcagggagaca

SEQ ID NO: 7245741 - DNA, 22 bp, Homo sapiens
atgggcaggcactggctctcag

SEQ ID NO: 7245742 - DNA, 22 bp, Homo sapiens
atgggcagcagctgccattcat

SEQ ID NO: 7245743 - DNA, 22 bp, Homo sapiens
atgggcagagtggggacaggaa

SEQ ID NO: 7245744 - DNA, 22 bp, Homo sapiens
atgggcagcagctgtcattttc

SEQ ID NO: 7245745 - DNA, 22 bp, Homo sapiens
atgggcagctgcagcagtggtg

SEQ ID NO: 7245746 - DNA, 22 bp, Homo sapiens
gaggagggagctggaagctctt

SEQ ID NO: 7245747 - DNA, 22 bp, Homo sapiens
gaggagggagctggaagctctt

SEQ ID NO: 7245748 - DNA, 22 bp, Homo sapiens
gaggagggcctggtgtcccttc

SEQ ID NO: 7245749 - DNA, 22 bp, Homo sapiens
gaggagggcagttcctctttta

SEQ ID NO: 7245750 - DNA, 22 bp, Homo sapiens
gaggagggctttgttgatgtta

SEQ ID NO: 7245751 - DNA, 21 bp, Homo sapiens
atgtagcttacaagataaagg

SEQ ID NO: 7245752 - DNA, 22 bp, Homo sapiens
gaggaggggacagtacttgtgc

SEQ ID NO: 7245753 - DNA, 22 bp, Homo sapiens
gaggaggggcacttgtctccta

SEQ ID NO: 7245754 - DNA, 22 bp, Homo sapiens
gaggaggggcacttgtctccta

SEQ ID NO: 7245755 - DNA, 22 bp, Homo sapiens
atgtgaggtagataggatgcag

SEQ ID NO: 7245756 - DNA, 22 bp, Homo sapiens
atgtcagatgtttatctgattt

SEQ ID NO: 7245757 - DNA, 22 bp, Homo sapiens
atgtggaatgaacaaaggaggc

SEQ ID NO: 7245758 - DNA, 22 bp, Homo sapiens
atgttatagttataaaatgagg

SEQ ID NO: 7245759 - DNA, 23 bp, Homo sapiens
gaggtgtgaattctgggtgctgc

SEQ ID NO: 7245760 - DNA, 22 bp, Homo sapiens
gaggtgtgatgcagagtggtgg

SEQ ID NO: 7245761 - DNA, 22 bp, Homo sapiens
gaggttccccattgtactggct

SEQ ID NO: 7245762 - DNA, 22 bp, Homo sapiens
gaggttgccatgcatcctggtt

SEQ ID NO: 7245763 - DNA, 22 bp, Homo sapiens
atgttacagttgagtaaattaa

SEQ ID NO: 7245764 - DNA, 22 bp, Homo sapiens
atggagggtgtcagagagcgaa

SEQ ID NO: 7245765 - DNA, 22 bp, Homo sapiens
atggagggtgtcagagagcgaa

SEQ ID NO: 7245766 - DNA, 22 bp, Homo sapiens
gagacaggcagctagtgggtca

SEQ ID NO: 7245767 - DNA, 22 bp, Homo sapiens
gagacaggcagctagtgggtca

SEQ ID NO: 7245768 - DNA, 22 bp, Homo sapiens
gagacaggcagctagtgggtca

SEQ ID NO: 7245769 - DNA, 22 bp, Homo sapiens
atggatgcttctttctagtttt

SEQ ID NO: 7245770 - DNA, 22 bp, Homo sapiens
gagaataaatctaaagtttctt

SEQ ID NO: 7245771 - DNA, 22 bp, Homo sapiens
gagaagtgcagagtggttaagc

SEQ ID NO: 7245772 - DNA, 22 bp, Homo sapiens
gagaaggggtgatgtgggtaat

SEQ ID NO: 7245773 - DNA, 22 bp, Homo sapiens
gagaaggtggacctgaaggagc

SEQ ID NO: 7245774 - DNA, 23 bp, Homo sapiens
gagaacagccacagagagctgtg

SEQ ID NO: 7245775 - DNA, 23 bp, Homo sapiens
gagaacagccacagagagctgtg

SEQ ID NO: 7245776 - DNA, 22 bp, Homo sapiens
gagcacagctggaggtagcatt

SEQ ID NO: 7245777 - DNA, 22 bp, Homo sapiens
gagcacagctgtcttgcaagct

SEQ ID NO: 7245778 - DNA, 22 bp, Homo sapiens
gagcacaggctgctgtgaactg

SEQ ID NO: 7245779 - DNA, 22 bp, Homo sapiens
gagcacaggctttggtggacac

SEQ ID NO: 7245780 - DNA, 22 bp, Homo sapiens
gagcacagctggaggtagcatt

SEQ ID NO: 7245781 - DNA, 19 bp, Homo sapiens
gagcacagcggcatttggt

SEQ ID NO: 7245782 - DNA, 22 bp, Homo sapiens
gagcacagcgcagtttgtaatt

SEQ ID NO: 7245783 - DNA, 22 bp, Homo sapiens
gagcacagccaaagtaagaagg

SEQ ID NO: 7245784 - DNA, 22 bp, Homo sapiens
gagcacagcagggctctgggtg

SEQ ID NO: 7245785 - DNA, 22 bp, Homo sapiens
gagcacagggaatagacagata

SEQ ID NO: 7245786 - DNA, 22 bp, Homo sapiens
gagcacagattgatttaaaata

SEQ ID NO: 7245787 - DNA, 22 bp, Homo sapiens
atggctcatttatcttgcagcc

SEQ ID NO: 7245788 - DNA, 22 bp, Homo sapiens
atgggcagagctggtgggaggc

SEQ ID NO: 7245789 - DNA, 22 bp, Homo sapiens
atgggcagacagggagctcacg

SEQ ID NO: 7245790 - DNA, 21 bp, Homo sapiens
atgggcagaggcagagaggct

SEQ ID NO: 7245791 - DNA, 22 bp, Homo sapiens
gagccccagccctgcttctata

SEQ ID NO: 7245792 - DNA, 22 bp, Homo sapiens
gagccccaccctagacattctg

SEQ ID NO: 7245793 - DNA, 22 bp, Homo sapiens
gagccccaggacagctctagtt

SEQ ID NO: 7245794 - DNA, 17 bp, Homo sapiens
gagcccgttatcgggga

SEQ ID NO: 7245795 - DNA, 21 bp, Homo sapiens
atgggcagaggcagagaggct

SEQ ID NO: 7245796 - DNA, 22 bp, Homo sapiens
atgggcagagtggggacaggaa

SEQ ID NO: 7245797 - DNA, 22 bp, Homo sapiens
gagctgcagcggctgacgcaac

SEQ ID NO: 7245798 - DNA, 22 bp, Homo sapiens
atagacattttgcattcaagca

SEQ ID NO: 7245799 - DNA, 22 bp, Homo sapiens
atagggcagtcaggccgccact

SEQ ID NO: 7245800 - DNA, 22 bp, Homo sapiens
atagggaggaactgagtcagga

SEQ ID NO: 7245801 - DNA, 22 bp, Homo sapiens
ataggctgtaataattcacatt

SEQ ID NO: 7245802 - DNA, 22 bp, Homo sapiens
atagtacaatcagttaattagt

SEQ ID NO: 7245803 - DNA, 22 bp, Homo sapiens
atagggtgagtgggtgctggct

SEQ ID NO: 7245804 - DNA, 22 bp, Homo sapiens
ataggggcagatgaggaatggg

SEQ ID NO: 7245805 - DNA, 22 bp, Homo sapiens
atagaatgtattatagtacaga

SEQ ID NO: 7245806 - DNA, 22 bp, Homo sapiens
atagaatctttgtaaaacactt

SEQ ID NO: 7245807 - DNA, 22 bp, Homo sapiens
atagaatcctgcagcaagcctt

SEQ ID NO: 7245808 - DNA, 22 bp, Homo sapiens
atagaatcatctgtgcactagt

SEQ ID NO: 7245809 - DNA, 22 bp, Homo sapiens
atagaattcgtgtttgtaattc

SEQ ID NO: 7245810 - DNA, 22 bp, Homo sapiens
atagaattctttgaaatttatg

SEQ ID NO: 7245811 - DNA, 22 bp, Homo sapiens
atagaatttgcactaaatctgc

SEQ ID NO: 7245812 - DNA, 22 bp, Homo sapiens
atagacagcgcattaaaaatgt

SEQ ID NO: 7245813 - DNA, 22 bp, Homo sapiens
atagacatatggctttgtttct

SEQ ID NO: 7245814 - DNA, 22 bp, Homo sapiens
atagacatagccgtaatttatt

SEQ ID NO: 7245815 - DNA, 22 bp, Homo sapiens
atagacatggtcttttgtcatt

SEQ ID NO: 7245816 - DNA, 22 bp, Homo sapiens
atagacattataacacagagct

SEQ ID NO: 7245817 - DNA, 22 bp, Homo sapiens
atagacatttactgagcacgta

SEQ ID NO: 7245818 - DNA, 22 bp, Homo sapiens
atagaatatgacttttagatcc

SEQ ID NO: 7245819 - DNA, 22 bp, Homo sapiens
atagaatatgacttttagatcc

SEQ ID NO: 7245820 - DNA, 20 bp, Homo sapiens
atagaatcacaagtcctgaa

SEQ ID NO: 7245821 - DNA, 22 bp, Homo sapiens
atagaatatgacttttagatcc

SEQ ID NO: 7245822 - DNA, 19 bp, Homo sapiens
atagaaagggttaaagaca

SEQ ID NO: 7245823 - DNA, 19 bp, Homo sapiens
atagaaagggttaaagaca

SEQ ID NO: 7245824 - DNA, 22 bp, Homo sapiens
atagaaaggtctttggcagaca

SEQ ID NO: 7245825 - DNA, 22 bp, Homo sapiens
atagaaaacagatgtccttaaa

SEQ ID NO: 7245826 - DNA, 22 bp, Homo sapiens
atagaaacagggaagcaaagca

SEQ ID NO: 7245827 - DNA, 22 bp, Homo sapiens
atagaaacagggaagcaaagca

SEQ ID NO: 7245828 - DNA, 22 bp, Homo sapiens
ctggccaggctctcacgtggtc

SEQ ID NO: 7245829 - DNA, 22 bp, Homo sapiens
ctggccagaggttcctctgccc

SEQ ID NO: 7245830 - DNA, 22 bp, Homo sapiens
ctggagcttattgggagcagaa

SEQ ID NO: 7245831 - DNA, 22 bp, Homo sapiens
ctggccagtgactgctcacccg

SEQ ID NO: 7245832 - DNA, 22 bp, Homo sapiens
ctggccagtgactgctcacccg

SEQ ID NO: 7245833 - DNA, 22 bp, Homo sapiens
ctggccaggttttgaacagttg

SEQ ID NO: 7245834 - DNA, 22 bp, Homo sapiens
ctggccaggcttgggacagaca

SEQ ID NO: 7245835 - DNA, 22 bp, Homo sapiens
ctggccagggtgcgatcgtggt

SEQ ID NO: 7245836 - DNA, 22 bp, Homo sapiens
atacagaaaatgatgcagagtt

SEQ ID NO: 7245837 - DNA, 21 bp, Homo sapiens
atacagaacattgatccaaga

SEQ ID NO: 7245838 - DNA, 20 bp, Homo sapiens
ataatttaccctgcaccact

SEQ ID NO: 7245839 - DNA, 22 bp, Homo sapiens
ataatttaattttcacagtggt

SEQ ID NO: 7245840 - DNA, 22 bp, Homo sapiens
ataatttacaactgcttttaat

SEQ ID NO: 7245841 - DNA, 22 bp, Homo sapiens
ataatttaaattagtatgtgat

SEQ ID NO: 7245842 - DNA, 22 bp, Homo sapiens
ataattaatttcagtaatctcc

SEQ ID NO: 7245843 - DNA, 22 bp, Homo sapiens
ataatgtaggctcctgggagaa

SEQ ID NO: 7245844 - DNA, 22 bp, Homo sapiens
atacatgatcactgtattataa

SEQ ID NO: 7245845 - DNA, 22 bp, Homo sapiens
ctggagctgtcttcacaggcct

SEQ ID NO: 7245846 - DNA, 22 bp, Homo sapiens
atacatctctttgaagtgcttt

SEQ ID NO: 7245847 - DNA, 22 bp, Homo sapiens
atacatctcatgtaagagataa

SEQ ID NO: 7245848 - DNA, 22 bp, Homo sapiens
atacatgactcacacattctgc

SEQ ID NO: 7245849 - DNA, 22 bp, Homo sapiens
atacatgaggctcatttatgtc

SEQ ID NO: 7245850 - DNA, 22 bp, Homo sapiens
atacatgacagcatagcatcct

SEQ ID NO: 7245851 - DNA, 22 bp, Homo sapiens
atacagaagcctgtatttctgg

SEQ ID NO: 7245852 - DNA, 22 bp, Homo sapiens
ctggaaatcactactagtcaat

SEQ ID NO: 7245853 - DNA, 22 bp, Homo sapiens
ctgcctgctgcctgtggagggt

SEQ ID NO: 7245854 - DNA, 23 bp, Homo sapiens
ctgcctgctggggagacagatct

SEQ ID NO: 7245855 - DNA, 22 bp, Homo sapiens
ctgcctgcttctgagccagagg

SEQ ID NO: 7245856 - DNA, 22 bp, Homo sapiens
ctgcctgcttttctgggagccg

SEQ ID NO: 7245857 - DNA, 22 bp, Homo sapiens
ctgccctgtggctctgagtcat

SEQ ID NO: 7245858 - DNA, 22 bp, Homo sapiens
ctgccctgtggttgtgggttct

SEQ ID NO: 7245859 - DNA, 22 bp, Homo sapiens
ctgccctgtttggacagcccgg

SEQ ID NO: 7245860 - DNA, 22 bp, Homo sapiens
ctgccctgtggctctgagtcat

SEQ ID NO: 7245861 - DNA, 22 bp, Homo sapiens
ctgccctgtgcacaggaaactg

SEQ ID NO: 7245862 - DNA, 22 bp, Homo sapiens
ctgccctgtgagggtccttggg

SEQ ID NO: 7245863 - DNA, 22 bp, Homo sapiens
ctgccctgtctttttctgatga

SEQ ID NO: 7245864 - DNA, 22 bp, Homo sapiens
ctgccctgtctgcagcctggct

SEQ ID NO: 7245865 - DNA, 22 bp, Homo sapiens
ctgccctgtccttcccgccggc

SEQ ID NO: 7245866 - DNA, 22 bp, Homo sapiens
ctgccctgtatcttctcccaat

SEQ ID NO: 7245867 - DNA, 22 bp, Homo sapiens
agttttctttcgcaaaggtaca

SEQ ID NO: 7245868 - DNA, 22 bp, Homo sapiens
agttttctttcatctatcagca

SEQ ID NO: 7245869 - DNA, 22 bp, Homo sapiens
agttttctgttctacaatttga

SEQ ID NO: 7245870 - DNA, 22 bp, Homo sapiens
agttttcttcattttgtggcca

SEQ ID NO: 7245871 - DNA, 21 bp, Homo sapiens
agttttctgagttataaaata

SEQ ID NO: 7245872 - DNA, 22 bp, Homo sapiens
agttttctgatgtgtagtgaga

SEQ ID NO: 7245873 - DNA, 22 bp, Homo sapiens
agttttctgcctctggatgcgt

SEQ ID NO: 7245874 - DNA, 22 bp, Homo sapiens
agttttctgctaaaccagctaa

SEQ ID NO: 7245875 - DNA, 22 bp, Homo sapiens
agttttctgggatcactggaat

SEQ ID NO: 7245876 - DNA, 19 bp, Homo sapiens
agttttctgtgatccattt

SEQ ID NO: 7245877 - DNA, 22 bp, Homo sapiens
agttttcctttattgagtacca

SEQ ID NO: 7245878 - DNA, 22 bp, Homo sapiens
agttttctctgtgttctgctta

SEQ ID NO: 7245879 - DNA, 22 bp, Homo sapiens
agttttctcacatcaaaaatga

SEQ ID NO: 7245880 - DNA, 22 bp, Homo sapiens
agttttctgacccctgctctat

SEQ ID NO: 7245881 - DNA, 22 bp, Homo sapiens
agttttcctctcatttatcaat

SEQ ID NO: 7245882 - DNA, 17 bp, Homo sapiens
agttttgatataatggc

SEQ ID NO: 7245883 - DNA, 22 bp, Homo sapiens
agttttgactaagatggcttgg

SEQ ID NO: 7245884 - DNA, 22 bp, Homo sapiens
ctgcccgtccctttgctctcgc

SEQ ID NO: 7245885 - DNA, 22 bp, Homo sapiens
ctgccctctagaggaggactga

SEQ ID NO: 7245886 - DNA, 22 bp, Homo sapiens
ctgccctgacctgcctcagagt

SEQ ID NO: 7245887 - DNA, 22 bp, Homo sapiens
ctgccctgacctgcctcagagt

SEQ ID NO: 7245888 - DNA, 22 bp, Homo sapiens
ctgccctgactgaccttttgaa

SEQ ID NO: 7245889 - DNA, 22 bp, Homo sapiens
ctgccctgtagctgttctagca

SEQ ID NO: 7245890 - DNA, 22 bp, Homo sapiens
ctgccctggtcccatggctgat

SEQ ID NO: 7245891 - DNA, 22 bp, Homo sapiens
agtttcttggtcacagttttca

SEQ ID NO: 7245892 - DNA, 22 bp, Homo sapiens
agtttcttgccgtgctttccat

SEQ ID NO: 7245893 - DNA, 22 bp, Homo sapiens
agtttcttgaagactgatgttt

SEQ ID NO: 7245894 - DNA, 23 bp, Homo sapiens
agtttctttgagacttgccctgt

SEQ ID NO: 7245895 - DNA, 22 bp, Homo sapiens
agtttctttagatagaaagttc

SEQ ID NO: 7245896 - DNA, 22 bp, Homo sapiens
agtttcttattcttagttatgt

SEQ ID NO: 7245897 - DNA, 22 bp, Homo sapiens
agtttcttcatccaaaaaatgg

SEQ ID NO: 7245898 - DNA, 22 bp, Homo sapiens
agtttctcttaatctagtatct

SEQ ID NO: 7245899 - DNA, 22 bp, Homo sapiens
agtttctatgtaagctacgtga

SEQ ID NO: 7245900 - DNA, 22 bp, Homo sapiens
agttttattccaatgtgcagca

SEQ ID NO: 7245901 - DNA, 22 bp, Homo sapiens
agttttattaaatccacagaag

SEQ ID NO: 7245902 - DNA, 22 bp, Homo sapiens
agtttattctgcttggccctcc

SEQ ID NO: 7245903 - DNA, 22 bp, Homo sapiens
agtttattctctggtcttagta

SEQ ID NO: 7245904 - DNA, 17 bp, Homo sapiens
agtttatttagccttct

SEQ ID NO: 7245905 - DNA, 22 bp, Homo sapiens
agtttattgtatatggtagttt

SEQ ID NO: 7245906 - DNA, 22 bp, Homo sapiens
agtttatttttgataagtcttg

SEQ ID NO: 7245907 - DNA, 22 bp, Homo sapiens
agtttatttctccatttaccta

SEQ ID NO: 7245908 - DNA, 22 bp, Homo sapiens
agtgttctagcgctgtgcttgt

SEQ ID NO: 7245909 - DNA, 19 bp, Homo sapiens
agtttattataggtgattc

SEQ ID NO: 7245910 - DNA, 20 bp, Homo sapiens
agtttattccaggagaactg

SEQ ID NO: 7245911 - DNA, 22 bp, Homo sapiens
ctgtgtcccttgtcccagagcc

SEQ ID NO: 7245912 - DNA, 22 bp, Homo sapiens
ctgtttattgagcaatctgcca

SEQ ID NO: 7245913 - DNA, 22 bp, Homo sapiens
ctgttattttataattcaagaa

SEQ ID NO: 7245914 - DNA, 22 bp, Homo sapiens
ctgttatttggaggatgcttgg

SEQ ID NO: 7245915 - DNA, 22 bp, Homo sapiens
ctgttatttgctggaagagttt

SEQ ID NO: 7245916 - DNA, 22 bp, Homo sapiens
ctgtttatctctaacctgttta

SEQ ID NO: 7245917 - DNA, 22 bp, Homo sapiens
ctgttattttataattcaagaa

SEQ ID NO: 7245918 - DNA, 22 bp, Homo sapiens
ctgttattcaagacaaaggcag

SEQ ID NO: 7245919 - DNA, 22 bp, Homo sapiens
ctgttatttgagagtgttgaat

SEQ ID NO: 7245920 - DNA, 22 bp, Homo sapiens
ctgttatttctgccaggtgagt

SEQ ID NO: 7245921 - DNA, 22 bp, Homo sapiens
ctgttatttagaacatggaatc

SEQ ID NO: 7245922 - DNA, 22 bp, Homo sapiens
ctgttatttatgctgctccatt

SEQ ID NO: 7245923 - DNA, 19 bp, Homo sapiens
ctgttattgtcagagctcc

SEQ ID NO: 7245924 - DNA, 19 bp, Homo sapiens
ctgttattgtcagagctcc

SEQ ID NO: 7245925 - DNA, 22 bp, Homo sapiens
ctgtgggagcacatgacagata

SEQ ID NO: 7245926 - DNA, 22 bp, Homo sapiens
ctgtgcagtaggtcagggctgg

SEQ ID NO: 7245927 - DNA, 22 bp, Homo sapiens
ctgtttcaagtgaagtcagaca

SEQ ID NO: 7245928 - DNA, 22 bp, Homo sapiens
ctgtttcacgtgtttaagccca

SEQ ID NO: 7245929 - DNA, 22 bp, Homo sapiens
atccttggcacagtggaattca

SEQ ID NO: 7245930 - DNA, 22 bp, Homo sapiens
atccttgggtctctggaaattg

SEQ ID NO: 7245931 - DNA, 22 bp, Homo sapiens
atctggaaaacacagtgtagac

SEQ ID NO: 7245932 - DNA, 22 bp, Homo sapiens
atctggaaataaatacgagttc

SEQ ID NO: 7245933 - DNA, 22 bp, Homo sapiens
atctggaacaaagcttaggaat

SEQ ID NO: 7245934 - DNA, 21 bp, Homo sapiens
atctggaaattctgccagaga

SEQ ID NO: 7245935 - DNA, 19 bp, Homo sapiens
atctggaactcgtttgttt

SEQ ID NO: 7245936 - DNA, 21 bp, Homo sapiens
atctggaagaactggtaagtg

SEQ ID NO: 7245937 - DNA, 22 bp, Homo sapiens
atctggaagattgaaggggagt

SEQ ID NO: 7245938 - DNA, 22 bp, Homo sapiens
atctggaagccagatactcagt

SEQ ID NO: 7245939 - DNA, 22 bp, Homo sapiens
atctatttctgctaataacaat

SEQ ID NO: 7245940 - DNA, 22 bp, Homo sapiens
ctggtgggagcagcaggcagct

SEQ ID NO: 7245941 - DNA, 22 bp, Homo sapiens
ctggtgggaagatggaaaacat

SEQ ID NO: 7245942 - DNA, 22 bp, Homo sapiens
ctggtgggagcagcaggcagct

SEQ ID NO: 7245943 - DNA, 22 bp, Homo sapiens
ctggtggaatggcagagggaac

SEQ ID NO: 7245944 - DNA, 22 bp, Homo sapiens
ctggggaggcagggctgcccct

SEQ ID NO: 7245945 - DNA, 22 bp, Homo sapiens
ctggggaggcagggctgcccct

SEQ ID NO: 7245946 - DNA, 21 bp, Homo sapiens
ctgtccacatcacagagcctc

SEQ ID NO: 7245947 - DNA, 22 bp, Homo sapiens
ctgtccagctgaccagagcagc

SEQ ID NO: 7245948 - DNA, 22 bp, Homo sapiens
atattttggcaaatgtctagat

SEQ ID NO: 7245949 - DNA, 20 bp, Homo sapiens
ctgtatcaggttacaaagta

SEQ ID NO: 7245950 - DNA, 22 bp, Homo sapiens
atattttgaagttaataatgtg

SEQ ID NO: 7245951 - DNA, 22 bp, Homo sapiens
atatttgtttggcagagttcag

SEQ ID NO: 7245952 - DNA, 22 bp, Homo sapiens
atatttgttgagttcttatgat

SEQ ID NO: 7245953 - DNA, 22 bp, Homo sapiens
atatcacagctctttcattgct

SEQ ID NO: 7245954 - DNA, 22 bp, Homo sapiens
atatcataaatcggtgcatgaa

SEQ ID NO: 7245955 - DNA, 23 bp, Homo sapiens
atatcacacccagtacagtctcc

SEQ ID NO: 7245956 - DNA, 22 bp, Homo sapiens
atatcaaacgaagttattttaa

SEQ ID NO: 7245957 - DNA, 22 bp, Homo sapiens
atatatgtatgtggcggagagg

SEQ ID NO: 7245958 - DNA, 22 bp, Homo sapiens
ctgggccagtctcggccgctct

SEQ ID NO: 7245959 - DNA, 22 bp, Homo sapiens
ctgggcagtttacattcctacc

SEQ ID NO: 7245960 - DNA, 22 bp, Homo sapiens
ctgggcagtttattcagttctg

SEQ ID NO: 7245961 - DNA, 22 bp, Homo sapiens
ctgggcagttcgctttcgtttt

SEQ ID NO: 7245962 - DNA, 22 bp, Homo sapiens
ctgggcccacaagtggaatcgt

SEQ ID NO: 7245963 - DNA, 22 bp, Homo sapiens
ctgggcccacaagtggaatcgt

SEQ ID NO: 7245964 - DNA, 20 bp, Homo sapiens
ctgggctgggctacagggtc

SEQ ID NO: 7245965 - DNA, 22 bp, Homo sapiens
aggtctggaaacagcagggaga

SEQ ID NO: 7245966 - DNA, 22 bp, Homo sapiens
aggtctggctcttctccacaga

SEQ ID NO: 7245967 - DNA, 22 bp, Homo sapiens
aggtctgggagttcattccctg

SEQ ID NO: 7245968 - DNA, 22 bp, Homo sapiens
aggtctggtgagagcaggtgct

SEQ ID NO: 7245969 - DNA, 22 bp, Homo sapiens
aggtctgtgaattcctgagaaa

SEQ ID NO: 7245970 - DNA, 22 bp, Homo sapiens
aggtctgtgattcactttgagt

SEQ ID NO: 7245971 - DNA, 22 bp, Homo sapiens
aggtctgtgcgctgttgataga

SEQ ID NO: 7245972 - DNA, 19 bp, Homo sapiens
aggtgaggggcaccatgtc

SEQ ID NO: 7245973 - DNA, 19 bp, Homo sapiens
aggtgaggggcaccatgtc

SEQ ID NO: 7245974 - DNA, 22 bp, Homo sapiens
aggtgagggtgccagtgcatgg

SEQ ID NO: 7245975 - DNA, 22 bp, Homo sapiens
aggtggagtgtgcagggagagc

SEQ ID NO: 7245976 - DNA, 22 bp, Homo sapiens
aggtggagtgaaggaaaggcag

SEQ ID NO: 7245977 - DNA, 21 bp, Homo sapiens
aggtggagtgcttagcatcca

SEQ ID NO: 7245978 - DNA, 22 bp, Homo sapiens
aggtggagatcagggactaagg

SEQ ID NO: 7245979 - DNA, 23 bp, Homo sapiens
aggtggagctgtgcagccggggc

SEQ ID NO: 7245980 - DNA, 22 bp, Homo sapiens
aggtggagtgaaggaaaggcag

SEQ ID NO: 7245981 - DNA, 22 bp, Homo sapiens
aggtggagtgtgcagggagagc

SEQ ID NO: 7245982 - DNA, 22 bp, Homo sapiens
aggtggagttaagtgtgaactg

SEQ ID NO: 7245983 - DNA, 22 bp, Homo sapiens
aggtggagttaagtgtgaactg

SEQ ID NO: 7245984 - DNA, 22 bp, Homo sapiens
aggtggagttggctgtagttca

SEQ ID NO: 7245985 - DNA, 22 bp, Homo sapiens
cctgggtgtcatgggcagctgg

SEQ ID NO: 7245986 - DNA, 22 bp, Homo sapiens
aggtgctgtttgtcagcagttt

SEQ ID NO: 7245987 - DNA, 22 bp, Homo sapiens
aggtgctgtttgtcagcagttt

SEQ ID NO: 7245988 - DNA, 22 bp, Homo sapiens
cctgggcagtgctggagttgaa

SEQ ID NO: 7245989 - DNA, 22 bp, Homo sapiens
cctgggcaggccggacgctggg

SEQ ID NO: 7245990 - DNA, 22 bp, Homo sapiens
cctgggcagggagaccaggctc

SEQ ID NO: 7245991 - DNA, 21 bp, Homo sapiens
aggtgcagagccagggaccag

SEQ ID NO: 7245992 - DNA, 22 bp, Homo sapiens
aggtgcagaaaaaagtccttta

SEQ ID NO: 7245993 - DNA, 22 bp, Homo sapiens
cctggagcaggagctgcagagg

SEQ ID NO: 7245994 - DNA, 22 bp, Homo sapiens
cctggagcactctccctggctg

SEQ ID NO: 7245995 - DNA, 22 bp, Homo sapiens
cctggagcccaaggcagtgaga

SEQ ID NO: 7245996 - DNA, 22 bp, Homo sapiens
aggggctgtggaaaccaactct

SEQ ID NO: 7245997 - DNA, 22 bp, Homo sapiens
aggggctgtggaaaccaactct

SEQ ID NO: 7245998 - DNA, 22 bp, Homo sapiens
agggtgctaatctcattcacat

SEQ ID NO: 7245999 - DNA, 22 bp, Homo sapiens
agggtgctgccggacaggtggg

SEQ ID NO: 7246000 - DNA, 22 bp, Homo sapiens
agggtgctctggaaaatgtagt

SEQ ID NO: 7246001 - DNA, 22 bp, Homo sapiens
agggtgctgccggacaggtggg

SEQ ID NO: 7246002 - DNA, 22 bp, Homo sapiens
agggtggaagatggcactatct

SEQ ID NO: 7246003 - DNA, 22 bp, Homo sapiens
agggtggaagatggcactatct

SEQ ID NO: 7246004 - DNA, 19 bp, Homo sapiens
agggtggcaaaggagggtg

SEQ ID NO: 7246005 - DNA, 22 bp, Homo sapiens
agggtggagggagtccctgagc

SEQ ID NO: 7246006 - DNA, 22 bp, Homo sapiens
agggtggagggagtccctgagc

SEQ ID NO: 7246007 - DNA, 19 bp, Homo sapiens
agggtggcaaaggagggtg

SEQ ID NO: 7246008 - DNA, 19 bp, Homo sapiens
agggtggcaaaggagggtg

SEQ ID NO: 7246009 - DNA, 22 bp, Homo sapiens
cctggagcccctctggccagcc

SEQ ID NO: 7246010 - DNA, 22 bp, Homo sapiens
agggtggccatgagggagagat

SEQ ID NO: 7246011 - DNA, 22 bp, Homo sapiens
agggtggccatgagggagagat

SEQ ID NO: 7246012 - DNA, 22 bp, Homo sapiens
agggtggcagttactggagcaa

SEQ ID NO: 7246013 - DNA, 22 bp, Homo sapiens
cctggccagcagccccttcctc

SEQ ID NO: 7246014 - DNA, 22 bp, Homo sapiens
agggtggcttaattccaaaggg

SEQ ID NO: 7246015 - DNA, 22 bp, Homo sapiens
agggtggctgagtagatggaag

SEQ ID NO: 7246016 - DNA, 21 bp, Homo sapiens
agggtggctctgggtcagaac

SEQ ID NO: 7246017 - DNA, 21 bp, Homo sapiens
agggtggctctgggtcagaac

SEQ ID NO: 7246018 - DNA, 22 bp, Homo sapiens
agggtggctgagtagatggaag

SEQ ID NO: 7246019 - DNA, 22 bp, Homo sapiens
cgcgctctccttctggcaccca

SEQ ID NO: 7246020 - DNA, 22 bp, Homo sapiens
cgcgggggtcctcaggcaggcg

SEQ ID NO: 7246021 - DNA, 22 bp, Homo sapiens
cgcggtggcggcctccagcgcc

SEQ ID NO: 7246022 - DNA, 22 bp, Homo sapiens
cgcgggcctccagacccagtat

SEQ ID NO: 7246023 - DNA, 22 bp, Homo sapiens
cgcgggcccctgcgctccgggc

SEQ ID NO: 7246024 - DNA, 22 bp, Homo sapiens
cgcggctctgcgggccgctgag

SEQ ID NO: 7246025 - DNA, 22 bp, Homo sapiens
cgcggaggaggtcaggaggtga

SEQ ID NO: 7246026 - DNA, 22 bp, Homo sapiens
cgcgctgcagacagcggaggcc

SEQ ID NO: 7246027 - DNA, 22 bp, Homo sapiens
cgcggtggcggcctccagcgcc

SEQ ID NO: 7246028 - DNA, 22 bp, Homo sapiens
cgtgatatttgtggtggatgaa

SEQ ID NO: 7246029 - DNA, 22 bp, Homo sapiens
cgtgaggggggtaaggcgtccg

SEQ ID NO: 7246030 - DNA, 22 bp, Homo sapiens
cgtgaggggggtaaggcgtccg

SEQ ID NO: 7246031 - DNA, 22 bp, Homo sapiens
cgtgagggcatggcagtgagga

SEQ ID NO: 7246032 - DNA, 19 bp, Homo sapiens
cgtggagctggcaggcagg

SEQ ID NO: 7246033 - DNA, 19 bp, Homo sapiens
cgtggagctggcaggcagg

SEQ ID NO: 7246034 - DNA, 22 bp, Homo sapiens
cgtggaatattataatggcaca

SEQ ID NO: 7246035 - DNA, 22 bp, Homo sapiens
agtcaccaacatggttcccagg

SEQ ID NO: 7246036 - DNA, 22 bp, Homo sapiens
agtcagagaccctagatctaat

SEQ ID NO: 7246037 - DNA, 21 bp, Homo sapiens
cctttatgcaaggactggcat

SEQ ID NO: 7246038 - DNA, 22 bp, Homo sapiens
aggtttattatagaggatgacg

SEQ ID NO: 7246039 - DNA, 19 bp, Homo sapiens
aggtttctaactattcaag

SEQ ID NO: 7246040 - DNA, 22 bp, Homo sapiens
agtaattggctacagtgtaatt

SEQ ID NO: 7246041 - DNA, 22 bp, Homo sapiens
agtaataatttatattagggag

SEQ ID NO: 7246042 - DNA, 22 bp, Homo sapiens
agtaatcgtgatcgagagatca

SEQ ID NO: 7246043 - DNA, 22 bp, Homo sapiens
cctggtgcaccaagtaagggtg

SEQ ID NO: 7246044 - DNA, 22 bp, Homo sapiens
cctggtgcaccaagtaagggtg

SEQ ID NO: 7246045 - DNA, 22 bp, Homo sapiens
cctggtgcaggtgtgttgccag

SEQ ID NO: 7246046 - DNA, 22 bp, Homo sapiens
cctggtgccactagagaatgtc

SEQ ID NO: 7246047 - DNA, 22 bp, Homo sapiens
cctggtgccactagagaatgtc

SEQ ID NO: 7246048 - DNA, 22 bp, Homo sapiens
cctggtgcccccaagccagctg

SEQ ID NO: 7246049 - DNA, 22 bp, Homo sapiens
aggtgtcttcagggtgagacag

SEQ ID NO: 7246050 - DNA, 22 bp, Homo sapiens
aggtgtctttgcggcccgccgc

SEQ ID NO: 7246051 - DNA, 22 bp, Homo sapiens
aggtgtctgtgatgggagcgat

SEQ ID NO: 7246052 - DNA, 22 bp, Homo sapiens
aggtgtctggatgggtgtcctt

SEQ ID NO: 7246053 - DNA, 22 bp, Homo sapiens
aggtgtcttcagggtgagacag

SEQ ID NO: 7246054 - DNA, 22 bp, Homo sapiens
aggtgtctgtgatgggagcgat

SEQ ID NO: 7246055 - DNA, 22 bp, Homo sapiens
cctggtgcccccaagccagctg

SEQ ID NO: 7246056 - DNA, 22 bp, Homo sapiens
aggtgtctggatgggtgtcctt

SEQ ID NO: 7246057 - DNA, 22 bp, Homo sapiens
aggtgtctgggctttggagtca

SEQ ID NO: 7246058 - DNA, 17 bp, Homo sapiens
aggtgtggtcaagggag

SEQ ID NO: 7246059 - DNA, 19 bp, Homo sapiens
aggtgtgggggctgcagac

SEQ ID NO: 7246060 - DNA, 19 bp, Homo sapiens
aggtgtgggggctgcagac

SEQ ID NO: 7246061 - DNA, 22 bp, Homo sapiens
aggtgtgggaaacgggtgacct

SEQ ID NO: 7246062 - DNA, 22 bp, Homo sapiens
aggtgtggcttgaagtctctat

SEQ ID NO: 7246063 - DNA, 22 bp, Homo sapiens
aggtgtggctggggcagaggcc

SEQ ID NO: 7246064 - DNA, 22 bp, Homo sapiens
aggttcatccagctcattaaaa

SEQ ID NO: 7246065 - DNA, 22 bp, Homo sapiens
aggttattttgctcagggaact

SEQ ID NO: 7246066 - DNA, 22 bp, Homo sapiens
aggttccaagaaatcatcagtg

SEQ ID NO: 7246067 - DNA, 22 bp, Homo sapiens
aggttacagtgattataggttt

SEQ ID NO: 7246068 - DNA, 22 bp, Homo sapiens
aggttatttgcagatggaattc

SEQ ID NO: 7246069 - DNA, 22 bp, Homo sapiens
agtgtctgaactgggtgctgac

SEQ ID NO: 7246070 - DNA, 22 bp, Homo sapiens
agtgtctgagccagaattagaa

SEQ ID NO: 7246071 - DNA, 23 bp, Homo sapiens
agtgtctgagtgcaggctgtgca

SEQ ID NO: 7246072 - DNA, 22 bp, Homo sapiens
agtggggacaatgagagcaggt

SEQ ID NO: 7246073 - DNA, 23 bp, Homo sapiens
agtggggaatcaacagattcttt

SEQ ID NO: 7246074 - DNA, 22 bp, Homo sapiens
agtggggacttatgccagcatt

SEQ ID NO: 7246075 - DNA, 20 bp, Homo sapiens
agtggggagtcaggagtgcc

SEQ ID NO: 7246076 - DNA, 22 bp, Homo sapiens
agtggggaggtccaggccaccc

SEQ ID NO: 7246077 - DNA, 22 bp, Homo sapiens
ctcttaaataacatcattgctt

SEQ ID NO: 7246078 - DNA, 22 bp, Homo sapiens
ctctgtttttcaatagttcttg

SEQ ID NO: 7246079 - DNA, 22 bp, Homo sapiens
ctctgtttttcaatagttcttg

SEQ ID NO: 7246080 - DNA, 21 bp, Homo sapiens
ctctgtttgcctgctgccatc

SEQ ID NO: 7246081 - DNA, 22 bp, Homo sapiens
ctcttaaaattacctttgcaaa

SEQ ID NO: 7246082 - DNA, 22 bp, Homo sapiens
ctcttaaaaacttgatatattt

SEQ ID NO: 7246083 - DNA, 22 bp, Homo sapiens
agtgtctgcaaaatgaaagagc

SEQ ID NO: 7246084 - DNA, 19 bp, Homo sapiens
agtgttaacccagtgttgg

SEQ ID NO: 7246085 - DNA, 22 bp, Homo sapiens
agtgtgtgcatgcattcgtgca

SEQ ID NO: 7246086 - DNA, 21 bp, Homo sapiens
agtgtgtgtggaatgagaata

SEQ ID NO: 7246087 - DNA, 22 bp, Homo sapiens
agtgtgtgcctttggatacctg

SEQ ID NO: 7246088 - DNA, 22 bp, Homo sapiens
ctgaagctgaaaacttccagca

SEQ ID NO: 7246089 - DNA, 22 bp, Homo sapiens
ctgagaggcggagcttgcagtg

SEQ ID NO: 7246090 - DNA, 17 bp, Homo sapiens
agtggcaggcagatggg

SEQ ID NO: 7246091 - DNA, 22 bp, Homo sapiens
agtggcaggcggagatgtagga

SEQ ID NO: 7246092 - DNA, 22 bp, Homo sapiens
ctctctgggcccagttggcacc

SEQ ID NO: 7246093 - DNA, 22 bp, Homo sapiens
ctctctgggggccatgccaaga

SEQ ID NO: 7246094 - DNA, 22 bp, Homo sapiens
agtgcaggccccaggccaggcc

SEQ ID NO: 7246095 - DNA, 22 bp, Homo sapiens
agtgcaggagcctggccagagc

SEQ ID NO: 7246096 - DNA, 22 bp, Homo sapiens
agtgcaggctcgcttgtgaggc

SEQ ID NO: 7246097 - DNA, 22 bp, Homo sapiens
agtgcaggccccaggccaggcc

SEQ ID NO: 7246098 - DNA, 22 bp, Homo sapiens
agtgcaggccccaggccaggcc

SEQ ID NO: 7246099 - DNA, 19 bp, Homo sapiens
agtgcagggagcaccctca

SEQ ID NO: 7246100 - DNA, 22 bp, Homo sapiens
ctctgagaggctgccctgccat

SEQ ID NO: 7246101 - DNA, 22 bp, Homo sapiens
agtgggcccttgtcacactgat

SEQ ID NO: 7246102 - DNA, 22 bp, Homo sapiens
agtgggcccgagccagtggtct

SEQ ID NO: 7246103 - DNA, 22 bp, Homo sapiens
agtgggcatgatctggtgtctg

SEQ ID NO: 7246104 - DNA, 22 bp, Homo sapiens
agtgggcttttttccgttccat

SEQ ID NO: 7246105 - DNA, 22 bp, Homo sapiens
agtgggcttactgagggagtgt

SEQ ID NO: 7246106 - DNA, 22 bp, Homo sapiens
agtgggcttactgagggagtgt

SEQ ID NO: 7246107 - DNA, 22 bp, Homo sapiens
agtgggcttactgagggagtgt

SEQ ID NO: 7246108 - DNA, 22 bp, Homo sapiens
agtgggctggtggcagggagaa

SEQ ID NO: 7246109 - DNA, 22 bp, Homo sapiens
agtgggctggtggcagggagaa

SEQ ID NO: 7246110 - DNA, 22 bp, Homo sapiens
agtgggcaggcagggtgcgcag

SEQ ID NO: 7246111 - DNA, 22 bp, Homo sapiens
agtgggcagcccaggaggtctt

SEQ ID NO: 7246112 - DNA, 22 bp, Homo sapiens
agtgggcaggcagggtgcgcag

SEQ ID NO: 7246113 - DNA, 20 bp, Homo sapiens
agtgggagagggcagactgc

SEQ ID NO: 7246114 - DNA, 22 bp, Homo sapiens
agtgacaggggaggcaggtgtg

SEQ ID NO: 7246115 - DNA, 21 bp, Homo sapiens
ctcaggcatttgaggagagtc

SEQ ID NO: 7246116 - DNA, 22 bp, Homo sapiens
ctccagtgggggtgagcctaga

SEQ ID NO: 7246117 - DNA, 22 bp, Homo sapiens
agtgcactggcaccatctcagc

SEQ ID NO: 7246118 - DNA, 22 bp, Homo sapiens
agtgcagactgaaatgaccttc

SEQ ID NO: 7246119 - DNA, 22 bp, Homo sapiens
agtgcagagagcaatactctac

SEQ ID NO: 7246120 - DNA, 22 bp, Homo sapiens
ctcctctcaggctggatggcgc

SEQ ID NO: 7246121 - DNA, 22 bp, Homo sapiens
ctcctctcaaaagtaggttgac

SEQ ID NO: 7246122 - DNA, 22 bp, Homo sapiens
agtgcaggagcctggccagagc

SEQ ID NO: 7246123 - DNA, 22 bp, Homo sapiens
agtgcagccgagatcaggtgct

SEQ ID NO: 7246124 - DNA, 22 bp, Homo sapiens
agtctggaaaatgcatgtttca

SEQ ID NO: 7246125 - DNA, 21 bp, Homo sapiens
agtctggaaaacacattcatg

SEQ ID NO: 7246126 - DNA, 22 bp, Homo sapiens
agtctggacatgctgaacttgg

SEQ ID NO: 7246127 - DNA, 22 bp, Homo sapiens
agtctggaatttggcctgagca

SEQ ID NO: 7246128 - DNA, 22 bp, Homo sapiens
agtctggaataaaactacttac

SEQ ID NO: 7246129 - DNA, 23 bp, Homo sapiens
agtctggaagtgcagtggctgga

SEQ ID NO: 7246130 - DNA, 22 bp, Homo sapiens
agtctggagtgcggcggcagga

SEQ ID NO: 7246131 - DNA, 22 bp, Homo sapiens
agtctggagtgattatgtggga

SEQ ID NO: 7246132 - DNA, 22 bp, Homo sapiens
agtctggagtagagcctagaaa

SEQ ID NO: 7246133 - DNA, 19 bp, Homo sapiens
agtctggagtaaaaggaat

SEQ ID NO: 7246134 - DNA, 22 bp, Homo sapiens
agtctggaggtggcaggtgtgt

SEQ ID NO: 7246135 - DNA, 22 bp, Homo sapiens
agtctggagctcagacttggga

SEQ ID NO: 7246136 - DNA, 22 bp, Homo sapiens
agtctggagcagcagtattggt

SEQ ID NO: 7246137 - DNA, 22 bp, Homo sapiens
agtctggacctgctgggtctcc

SEQ ID NO: 7246138 - DNA, 22 bp, Homo sapiens
agtctgtggatggactggcaga

SEQ ID NO: 7246139 - DNA, 22 bp, Homo sapiens
agtctggagtttgctactggac

SEQ ID NO: 7246140 - DNA, 22 bp, Homo sapiens
agtctggagtgttttgtagcaa

SEQ ID NO: 7246141 - DNA, 22 bp, Homo sapiens
agtctggattagttgggggcaa

SEQ ID NO: 7246142 - DNA, 18 bp, Homo sapiens
ctcaggcagagaagcttt

SEQ ID NO: 7246143 - DNA, 22 bp, Homo sapiens
ctcaggcacttttgtcacagac

SEQ ID NO: 7246144 - DNA, 22 bp, Homo sapiens
ctcaggcacgggtcagtgagcg

SEQ ID NO: 7246145 - DNA, 22 bp, Homo sapiens
ctcaggcaaggcccgcattctc

SEQ ID NO: 7246146 - DNA, 22 bp, Homo sapiens
agtctgtgtgaatgtgggcttt

SEQ ID NO: 7246147 - DNA, 22 bp, Homo sapiens
agtctgaaagtatgttgtaatg

SEQ ID NO: 7246148 - DNA, 22 bp, Homo sapiens
agtctcttttgcgaagagtgtt

SEQ ID NO: 7246149 - DNA, 22 bp, Homo sapiens
agtcatttcccattcttcatat

SEQ ID NO: 7246150 - DNA, 22 bp, Homo sapiens
agtcattttctgcctgtaatct

SEQ ID NO: 7246151 - DNA, 22 bp, Homo sapiens
agtcattttgccagtcttcagg

SEQ ID NO: 7246152 - DNA, 22 bp, Homo sapiens
agtccaagaccaaggtgtcacc

SEQ ID NO: 7246153 - DNA, 22 bp, Homo sapiens
agtccaagatcaaggtgtcaac

SEQ ID NO: 7246154 - DNA, 22 bp, Homo sapiens
agtccaagatcaaggtgtcagg

SEQ ID NO: 7246155 - DNA, 22 bp, Homo sapiens
ccgcccacactaaatatgagcg

SEQ ID NO: 7246156 - DNA, 22 bp, Homo sapiens
agggccctaaggaaggcacaca

SEQ ID NO: 7246157 - DNA, 22 bp, Homo sapiens
ccgaggctggcctcagggctgt

SEQ ID NO: 7246158 - DNA, 22 bp, Homo sapiens
ccgaggctggagtgcagtggcg

SEQ ID NO: 7246159 - DNA, 22 bp, Homo sapiens
ccgagcccggagaggagctctt

SEQ ID NO: 7246160 - DNA, 22 bp, Homo sapiens
ccgagagcaggtggccgctggt

SEQ ID NO: 7246161 - DNA, 22 bp, Homo sapiens
ccgagaacttttcctgaaaagt

SEQ ID NO: 7246162 - DNA, 22 bp, Homo sapiens
ccctttcttccgtgacttctgc

SEQ ID NO: 7246163 - DNA, 22 bp, Homo sapiens
ccctggaggcaaaggttgcagt

SEQ ID NO: 7246164 - DNA, 22 bp, Homo sapiens
agggccagaatccctcagtcta

SEQ ID NO: 7246165 - DNA, 22 bp, Homo sapiens
agggccagaatccctcagtcta

SEQ ID NO: 7246166 - DNA, 22 bp, Homo sapiens
agggccagagtacatcagggct

SEQ ID NO: 7246167 - DNA, 22 bp, Homo sapiens
agggccagagtacatcagggct

SEQ ID NO: 7246168 - DNA, 22 bp, Homo sapiens
agggctctggggtggcagagat

SEQ ID NO: 7246169 - DNA, 22 bp, Homo sapiens
agggctctggggtggcagagat

SEQ ID NO: 7246170 - DNA, 22 bp, Homo sapiens
agggctctgtccccagaggccc

SEQ ID NO: 7246171 - DNA, 22 bp, Homo sapiens
cctcctctgtgcagctgtgggt

SEQ ID NO: 7246172 - DNA, 22 bp, Homo sapiens
agggctctgttggggtcagcac

SEQ ID NO: 7246173 - DNA, 22 bp, Homo sapiens
agggctctgttggggtcagcac

SEQ ID NO: 7246174 - DNA, 18 bp, Homo sapiens
agggctctctgctgggtt

SEQ ID NO: 7246175 - DNA, 22 bp, Homo sapiens
agggcccttacgcaggcccttc

SEQ ID NO: 7246176 - DNA, 23 bp, Homo sapiens
agggcctcaggagggctgcatgg

SEQ ID NO: 7246177 - DNA, 22 bp, Homo sapiens
agggcccttacgcaggcccttc

SEQ ID NO: 7246178 - DNA, 22 bp, Homo sapiens
agggccctgagttgcagccctg

SEQ ID NO: 7246179 - DNA, 22 bp, Homo sapiens
agggccctctggcaggccaggc

SEQ ID NO: 7246180 - DNA, 22 bp, Homo sapiens
agggccctctggcaggccaggc

SEQ ID NO: 7246181 - DNA, 21 bp, Homo sapiens
aggggacagagtagctccagg

SEQ ID NO: 7246182 - DNA, 22 bp, Homo sapiens
aggggagaatttcaactcaggt

SEQ ID NO: 7246183 - DNA, 22 bp, Homo sapiens
aggggagaatttcaactcaggt

SEQ ID NO: 7246184 - DNA, 17 bp, Homo sapiens
aggggagagtgggaaga

SEQ ID NO: 7246185 - DNA, 22 bp, Homo sapiens
aggggctgcctggcttggcact

SEQ ID NO: 7246186 - DNA, 22 bp, Homo sapiens
aggggctgctgggtccgcccct

SEQ ID NO: 7246187 - DNA, 22 bp, Homo sapiens
aggggctggagttcgaggttac

SEQ ID NO: 7246188 - DNA, 22 bp, Homo sapiens
aggggctggcttatctgagagt

SEQ ID NO: 7246189 - DNA, 22 bp, Homo sapiens
aggggctgggacagagccaagc

SEQ ID NO: 7246190 - DNA, 22 bp, Homo sapiens
aggggctgggacagagccaagc

SEQ ID NO: 7246191 - DNA, 22 bp, Homo sapiens
aggggctgggacagagccaagc

SEQ ID NO: 7246192 - DNA, 16 bp, Homo sapiens
cctctgggcctgcaag

SEQ ID NO: 7246193 - DNA, 22 bp, Homo sapiens
cctctgggcaggtagcagcagc

SEQ ID NO: 7246194 - DNA, 22 bp, Homo sapiens
cctctgggccagcctggaccct

SEQ ID NO: 7246195 - DNA, 22 bp, Homo sapiens
cctctgggcaggtagcagcagc

SEQ ID NO: 7246196 - DNA, 19 bp, Homo sapiens
cctctgccagcccgcctct

SEQ ID NO: 7246197 - DNA, 19 bp, Homo sapiens
cctctgccagcccgcctct

SEQ ID NO: 7246198 - DNA, 22 bp, Homo sapiens
agggctgcaggcaagatatggc

SEQ ID NO: 7246199 - DNA, 22 bp, Homo sapiens
agggctgcaggcaagatatggc

SEQ ID NO: 7246200 - DNA, 22 bp, Homo sapiens
agggctgcaccggggcttcgcg

SEQ ID NO: 7246201 - DNA, 22 bp, Homo sapiens
agggctgcaggcaagatatggc

SEQ ID NO: 7246202 - DNA, 22 bp, Homo sapiens
agggctgcaatgggagataact

SEQ ID NO: 7246203 - DNA, 22 bp, Homo sapiens
agggctgcaccggggcttcgcg

SEQ ID NO: 7246204 - DNA, 22 bp, Homo sapiens
cctctgggaagccagtcctgct

SEQ ID NO: 7246205 - DNA, 22 bp, Homo sapiens
cctcctgcggcgtccgcgctct

SEQ ID NO: 7246206 - DNA, 22 bp, Homo sapiens
agggctgagtggtgcagtcaaa

SEQ ID NO: 7246207 - DNA, 22 bp, Homo sapiens
agggctgatgcaccatgtagcc

SEQ ID NO: 7246208 - DNA, 22 bp, Homo sapiens
agggctgcaatgggagataact

SEQ ID NO: 7246209 - DNA, 22 bp, Homo sapiens
agggctgcaatgggagataact

SEQ ID NO: 7246210 - DNA, 23 bp, Homo sapiens
agggctgatgccattgcagctct

SEQ ID NO: 7246211 - DNA, 18 bp, Homo sapiens
ccctcttgcacaaagcaa

SEQ ID NO: 7246212 - DNA, 22 bp, Homo sapiens
ccctctggctgtgtgttcttag

SEQ ID NO: 7246213 - DNA, 22 bp, Homo sapiens
ccctctgctcaggtgcataggc

SEQ ID NO: 7246214 - DNA, 22 bp, Homo sapiens
ccctctgcctctgagtaggaca

SEQ ID NO: 7246215 - DNA, 22 bp, Homo sapiens
ccctctgcctctgagtaggaca

SEQ ID NO: 7246216 - DNA, 22 bp, Homo sapiens
ccctctgcaggctggacctgcc

SEQ ID NO: 7246217 - DNA, 22 bp, Homo sapiens
ccctctctcggttgctgtggtt

SEQ ID NO: 7246218 - DNA, 22 bp, Homo sapiens
ccctctctgacttctgaacttg

SEQ ID NO: 7246219 - DNA, 22 bp, Homo sapiens
ccctctcttagaagaaacacag

SEQ ID NO: 7246220 - DNA, 22 bp, Homo sapiens
agggatggatcttggccctgga

SEQ ID NO: 7246221 - DNA, 22 bp, Homo sapiens
agggcagagaaatgtagttgag

SEQ ID NO: 7246222 - DNA, 22 bp, Homo sapiens
agggcagagacatgcttcctga

SEQ ID NO: 7246223 - DNA, 22 bp, Homo sapiens
agggcagagagatgaatgggat

SEQ ID NO: 7246224 - DNA, 22 bp, Homo sapiens
agggcagagcactgaattggga

SEQ ID NO: 7246225 - DNA, 22 bp, Homo sapiens
agggcagagattaattaagaca

SEQ ID NO: 7246226 - DNA, 22 bp, Homo sapiens
agggcagagatctgagtgggca

SEQ ID NO: 7246227 - DNA, 22 bp, Homo sapiens
agggcagagatctgagtgggca

SEQ ID NO: 7246228 - DNA, 22 bp, Homo sapiens
agggcagagatctgagtgggca

SEQ ID NO: 7246229 - DNA, 20 bp, Homo sapiens
agggcagagggattacaggc

SEQ ID NO: 7246230 - DNA, 22 bp, Homo sapiens
agggcagaggcggacacggaag

SEQ ID NO: 7246231 - DNA, 22 bp, Homo sapiens
agggcagagctgtctaaatggc

SEQ ID NO: 7246232 - DNA, 22 bp, Homo sapiens
ccctggaggaccccaatgtggc

SEQ ID NO: 7246233 - DNA, 22 bp, Homo sapiens
agggagaaggtttagctgtgag

SEQ ID NO: 7246234 - DNA, 22 bp, Homo sapiens
agggagtctagttgatgtggaa

SEQ ID NO: 7246235 - DNA, 22 bp, Homo sapiens
agggagtccattttagaggtgg

SEQ ID NO: 7246236 - DNA, 22 bp, Homo sapiens
agggagtctggtagtctaagtg

SEQ ID NO: 7246237 - DNA, 22 bp, Homo sapiens
agggagtctggcagtctaagag

SEQ ID NO: 7246238 - DNA, 22 bp, Homo sapiens
agggagtggttaagaaggtgca

SEQ ID NO: 7246239 - DNA, 22 bp, Homo sapiens
agggagaacagttgcagcagac

SEQ ID NO: 7246240 - DNA, 22 bp, Homo sapiens
agggagaacagttgcagcagac

SEQ ID NO: 7246241 - DNA, 22 bp, Homo sapiens
agggagaaaattggatgcacaa

SEQ ID NO: 7246242 - DNA, 22 bp, Homo sapiens
cccaggggttcaaggctgcagt

SEQ ID NO: 7246243 - DNA, 22 bp, Homo sapiens
agggatggaagctcgtctgcaa

SEQ ID NO: 7246244 - DNA, 22 bp, Homo sapiens
agggagtgttacataatgggtt

SEQ ID NO: 7246245 - DNA, 22 bp, Homo sapiens
agggagtgtaaatggtgctcag

SEQ ID NO: 7246246 - DNA, 18 bp, Homo sapiens
agggatctagatggagtc

SEQ ID NO: 7246247 - DNA, 22 bp, Homo sapiens
agggatgatcagggtagaggct

SEQ ID NO: 7246248 - DNA, 22 bp, Homo sapiens
cccaggagttggaggctacggt

SEQ ID NO: 7246249 - DNA, 22 bp, Homo sapiens
aggcttcttgataaaatgcaga

SEQ ID NO: 7246250 - DNA, 22 bp, Homo sapiens
aggctggctgagctgcagcctg

SEQ ID NO: 7246251 - DNA, 22 bp, Homo sapiens
agggaagaagctggtagtaggt

SEQ ID NO: 7246252 - DNA, 23 bp, Homo sapiens
agggaagaaacatgaagggctgt

SEQ ID NO: 7246253 - DNA, 22 bp, Homo sapiens
cccagggccctggacagctaca

SEQ ID NO: 7246254 - DNA, 20 bp, Homo sapiens
cccaggagtttgctcttact

SEQ ID NO: 7246255 - DNA, 23 bp, Homo sapiens
cccaggagtttcactgcaaaggt

SEQ ID NO: 7246256 - DNA, 22 bp, Homo sapiens
aggcaggggagctggaagggta

SEQ ID NO: 7246257 - DNA, 22 bp, Homo sapiens
aggcaggggagctggaagggta

SEQ ID NO: 7246258 - DNA, 22 bp, Homo sapiens
aggcagggtgatgataatgatt

SEQ ID NO: 7246259 - DNA, 22 bp, Homo sapiens
ccagagagggcgccacctggag

SEQ ID NO: 7246260 - DNA, 22 bp, Homo sapiens
ccagagaaagtgaagcaaatgt

SEQ ID NO: 7246261 - DNA, 22 bp, Homo sapiens
ccagagagtaggaggcattatt

SEQ ID NO: 7246262 - DNA, 22 bp, Homo sapiens
ccagagagtaaacattttccgg

SEQ ID NO: 7246263 - DNA, 20 bp, Homo sapiens
ccagagagtaggttagtgat

SEQ ID NO: 7246264 - DNA, 22 bp, Homo sapiens
ccagagaggtagcttaccctct

SEQ ID NO: 7246265 - DNA, 22 bp, Homo sapiens
ccagagaggggaagggcttgcc

SEQ ID NO: 7246266 - DNA, 22 bp, Homo sapiens
ccagagagtcgatgggggacac

SEQ ID NO: 7246267 - DNA, 22 bp, Homo sapiens
ccagagagtatcatggagagta

SEQ ID NO: 7246268 - DNA, 17 bp, Homo sapiens
ccagagagtagttagga

SEQ ID NO: 7246269 - DNA, 22 bp, Homo sapiens
aggcatggatggatccagggct

SEQ ID NO: 7246270 - DNA, 22 bp, Homo sapiens
ccaggagatgggagcatctaaa

SEQ ID NO: 7246271 - DNA, 22 bp, Homo sapiens
aggccctggcactgcctgggag

SEQ ID NO: 7246272 - DNA, 22 bp, Homo sapiens
aggccctggcccccagagattc

SEQ ID NO: 7246273 - DNA, 22 bp, Homo sapiens
aggccctgggagcagagatgca

SEQ ID NO: 7246274 - DNA, 22 bp, Homo sapiens
aggccctggctgggtttcttta

SEQ ID NO: 7246275 - DNA, 22 bp, Homo sapiens
aggccctggcctgactcaatgt

SEQ ID NO: 7246276 - DNA, 18 bp, Homo sapiens
aggccctggcctcgaaca

SEQ ID NO: 7246277 - DNA, 22 bp, Homo sapiens
aggccctggggtctgttaaatt

SEQ ID NO: 7246278 - DNA, 22 bp, Homo sapiens
aggccctgggcagttctgtagc

SEQ ID NO: 7246279 - DNA, 22 bp, Homo sapiens
aggcccagctggacaaactgct

SEQ ID NO: 7246280 - DNA, 19 bp, Homo sapiens
aggcccagcgctgggggct

SEQ ID NO: 7246281 - DNA, 22 bp, Homo sapiens
aggcccagcccgtcctcgtgct

SEQ ID NO: 7246282 - DNA, 22 bp, Homo sapiens
aggcccagcccgtcctcgtgct

SEQ ID NO: 7246283 - DNA, 21 bp, Homo sapiens
aggcccagagtcttgggggga

SEQ ID NO: 7246284 - DNA, 22 bp, Homo sapiens
aggcccagagcaggaaagggtt

SEQ ID NO: 7246285 - DNA, 22 bp, Homo sapiens
aggcccagagagccagttagtg

SEQ ID NO: 7246286 - DNA, 22 bp, Homo sapiens
ccagcctggactgggtcttgtg

SEQ ID NO: 7246287 - DNA, 19 bp, Homo sapiens
ccagctggcctgggacctc

SEQ ID NO: 7246288 - DNA, 22 bp, Homo sapiens
ccagcctgaaatgcctcatcct

SEQ ID NO: 7246289 - DNA, 22 bp, Homo sapiens
ccagggtggaggctggatggag

SEQ ID NO: 7246290 - DNA, 22 bp, Homo sapiens
aggctgaggtaggaggatcgct

SEQ ID NO: 7246291 - DNA, 20 bp, Homo sapiens
aggctgagggtgattgtgtc

SEQ ID NO: 7246292 - DNA, 22 bp, Homo sapiens
aggctctgtgcagcctgcatct

SEQ ID NO: 7246293 - DNA, 22 bp, Homo sapiens
aggctgaggcgggtagatcacc

SEQ ID NO: 7246294 - DNA, 22 bp, Homo sapiens
aggctgaggggcgagggaccct

SEQ ID NO: 7246295 - DNA, 22 bp, Homo sapiens
aggctgagtcaagttagggtga

SEQ ID NO: 7246296 - DNA, 22 bp, Homo sapiens
aggctgagtcgggaggatcact

SEQ ID NO: 7246297 - DNA, 22 bp, Homo sapiens
aggctgaggtgtgctgtgatcg

SEQ ID NO: 7246298 - DNA, 19 bp, Homo sapiens
aggctgcctcaccctccct

SEQ ID NO: 7246299 - DNA, 22 bp, Homo sapiens
aggctgcctcttttgagagggt

SEQ ID NO: 7246300 - DNA, 22 bp, Homo sapiens
aggctgcctctgcaggatccct

SEQ ID NO: 7246301 - DNA, 22 bp, Homo sapiens
aggctgcctcgtgagctcgctg

SEQ ID NO: 7246302 - DNA, 22 bp, Homo sapiens
aggctgcctggctgtgagtgaa

SEQ ID NO: 7246303 - DNA, 22 bp, Homo sapiens
aggctgcctgttccaatctcct

SEQ ID NO: 7246304 - DNA, 22 bp, Homo sapiens
aggctgcgttagcctcactccc

SEQ ID NO: 7246305 - DNA, 20 bp, Homo sapiens
cccagagccatagccagaca

SEQ ID NO: 7246306 - DNA, 22 bp, Homo sapiens
cccactgtctgttcccagggcc

SEQ ID NO: 7246307 - DNA, 21 bp, Homo sapiens
cccagagcctagggagggcac

SEQ ID NO: 7246308 - DNA, 22 bp, Homo sapiens
ccagggagcccacaggacaatg

SEQ ID NO: 7246309 - DNA, 22 bp, Homo sapiens
ccagggagcctggtgtgtcagc

SEQ ID NO: 7246310 - DNA, 22 bp, Homo sapiens
ccagggtgaccagctggcctag

SEQ ID NO: 7246311 - DNA, 22 bp, Homo sapiens
ccagggtgaccctcccggtggc

SEQ ID NO: 7246312 - DNA, 22 bp, Homo sapiens
ccagggtgaggaggctcccacg

SEQ ID NO: 7246313 - DNA, 22 bp, Homo sapiens
ccagggtgagtgtcatgggtta

SEQ ID NO: 7246314 - DNA, 22 bp, Homo sapiens
ccagggtgagtgtcatgggtta

SEQ ID NO: 7246315 - DNA, 22 bp, Homo sapiens
aggctcagtctgttcatgcact

SEQ ID NO: 7246316 - DNA, 22 bp, Homo sapiens
aggctcagtcccggcccgcgcc

SEQ ID NO: 7246317 - DNA, 22 bp, Homo sapiens
aggctcagtatagctggcaagt

SEQ ID NO: 7246318 - DNA, 22 bp, Homo sapiens
aggctcagtatagctggcaagt

SEQ ID NO: 7246319 - DNA, 22 bp, Homo sapiens
aggctcagcctgggcctagagc

SEQ ID NO: 7246320 - DNA, 22 bp, Homo sapiens
aggctcagttcacgtcaacttt

SEQ ID NO: 7246321 - DNA, 22 bp, Homo sapiens
aggctcagtttggtttccattg

SEQ ID NO: 7246322 - DNA, 22 bp, Homo sapiens
aggctcagttctgtggtgagcc

SEQ ID NO: 7246323 - DNA, 22 bp, Homo sapiens
aggctcagttctgtggtgagcc

SEQ ID NO: 7246324 - DNA, 23 bp, Homo sapiens
aggctccacatgggcactttgca

SEQ ID NO: 7246325 - DNA, 23 bp, Homo sapiens
caggaggagaaggcttggttggc

SEQ ID NO: 7246326 - DNA, 22 bp, Homo sapiens
caggaggagcattagcgtctca

SEQ ID NO: 7246327 - DNA, 22 bp, Homo sapiens
caggaggacatactggctcaca

SEQ ID NO: 7246328 - DNA, 22 bp, Homo sapiens
caggaggattgcttgaggccag

SEQ ID NO: 7246329 - DNA, 22 bp, Homo sapiens
agctgctgagccatgtcctgct

SEQ ID NO: 7246330 - DNA, 22 bp, Homo sapiens
caggaggagggtacaccatcag

SEQ ID NO: 7246331 - DNA, 22 bp, Homo sapiens
agctgctgcgcctcaccctggc

SEQ ID NO: 7246332 - DNA, 22 bp, Homo sapiens
caggcactggccagtcagcaca

SEQ ID NO: 7246333 - DNA, 22 bp, Homo sapiens
caggcactggggatgctgggat

SEQ ID NO: 7246334 - DNA, 22 bp, Homo sapiens
caggcactgtgctgagctctgc

SEQ ID NO: 7246335 - DNA, 22 bp, Homo sapiens
caggcactgtgttaggcactgt

SEQ ID NO: 7246336 - DNA, 22 bp, Homo sapiens
caggccaggctgcatttgcccc

SEQ ID NO: 7246337 - DNA, 22 bp, Homo sapiens
caggccagcggcccgcgcgttc

SEQ ID NO: 7246338 - DNA, 22 bp, Homo sapiens
caggccagcagggcctccgtgg

SEQ ID NO: 7246339 - DNA, 22 bp, Homo sapiens
caggccagagtccaactccaga

SEQ ID NO: 7246340 - DNA, 19 bp, Homo sapiens
agctgggcttactcactcg

SEQ ID NO: 7246341 - DNA, 22 bp, Homo sapiens
agctgggctgggctgagctgag

SEQ ID NO: 7246342 - DNA, 19 bp, Homo sapiens
agctgggctgtcacagtga

SEQ ID NO: 7246343 - DNA, 22 bp, Homo sapiens
agctgggcttggccaggtcgct

SEQ ID NO: 7246344 - DNA, 22 bp, Homo sapiens
agctgggctgggctgagctgag

SEQ ID NO: 7246345 - DNA, 22 bp, Homo sapiens
cagctctggtccagggagggca

SEQ ID NO: 7246346 - DNA, 22 bp, Homo sapiens
cagctctgggtgacaggagggc

SEQ ID NO: 7246347 - DNA, 22 bp, Homo sapiens
cagctgacaaactctgagctta

SEQ ID NO: 7246348 - DNA, 22 bp, Homo sapiens
cagctctgtaaattccttcatc

SEQ ID NO: 7246349 - DNA, 22 bp, Homo sapiens
caggaaggcgcggctgtgcctg

SEQ ID NO: 7246350 - DNA, 22 bp, Homo sapiens
cagggatgggatggagtcagtt

SEQ ID NO: 7246351 - DNA, 22 bp, Homo sapiens
cagggatgggatggagtcagtt

SEQ ID NO: 7246352 - DNA, 22 bp, Homo sapiens
cagggagctggctggctgtgcc

SEQ ID NO: 7246353 - DNA, 22 bp, Homo sapiens
cagggagctggctggctgtgcc

SEQ ID NO: 7246354 - DNA, 22 bp, Homo sapiens
cagggagctctgggccggactc

SEQ ID NO: 7246355 - DNA, 22 bp, Homo sapiens
caggctggacattagatacata

SEQ ID NO: 7246356 - DNA, 22 bp, Homo sapiens
caggctggagtgcagtggtgcc

SEQ ID NO: 7246357 - DNA, 22 bp, Homo sapiens
caggctggagtgcagtgtcgcc

SEQ ID NO: 7246358 - DNA, 22 bp, Homo sapiens
caggctggagtgcagttgtgca

SEQ ID NO: 7246359 - DNA, 18 bp, Homo sapiens
agctggggcctctggtcc

SEQ ID NO: 7246360 - DNA, 22 bp, Homo sapiens
agctggggcatttatccactaa

SEQ ID NO: 7246361 - DNA, 22 bp, Homo sapiens
agctgggcttggccaggtcgct

SEQ ID NO: 7246362 - DNA, 22 bp, Homo sapiens
agctgtggaaatcaggcaatga

SEQ ID NO: 7246363 - DNA, 22 bp, Homo sapiens
caggctgcggtcggctctggtc

SEQ ID NO: 7246364 - DNA, 22 bp, Homo sapiens
cagggcctccccggcagtcttt

SEQ ID NO: 7246365 - DNA, 22 bp, Homo sapiens
cagggccaggctgatggcctgg

SEQ ID NO: 7246366 - DNA, 22 bp, Homo sapiens
cagggatgtctctggaagggag

SEQ ID NO: 7246367 - DNA, 22 bp, Homo sapiens
cagggcctctcctccaggaact

SEQ ID NO: 7246368 - DNA, 22 bp, Homo sapiens
cagggcctcgaagcctctgggc

SEQ ID NO: 7246369 - DNA, 22 bp, Homo sapiens
cagggctccatgcagggactcc

SEQ ID NO: 7246370 - DNA, 22 bp, Homo sapiens
cagggctccccgcaccgcagcc

SEQ ID NO: 7246371 - DNA, 22 bp, Homo sapiens
cagggtgcctctgctcccacca

SEQ ID NO: 7246372 - DNA, 22 bp, Homo sapiens
cagggtgcctcccgctcgccgg

SEQ ID NO: 7246373 - DNA, 22 bp, Homo sapiens
cagggtgcgggagatgtgcacc

SEQ ID NO: 7246374 - DNA, 22 bp, Homo sapiens
cagggtgcgccactcagatgta

SEQ ID NO: 7246375 - DNA, 22 bp, Homo sapiens
cagggtgcctgtcctcagcaaa

SEQ ID NO: 7246376 - DNA, 22 bp, Homo sapiens
caggtgagctctatctagggag

SEQ ID NO: 7246377 - DNA, 20 bp, Homo sapiens
caggtgagcagatctgggtg

SEQ ID NO: 7246378 - DNA, 22 bp, Homo sapiens
caggtgagaggcggtcctgcat

SEQ ID NO: 7246379 - DNA, 22 bp, Homo sapiens
caggtgagttttcctccttggt

SEQ ID NO: 7246380 - DNA, 22 bp, Homo sapiens
caggtgagtaacaatgggtgat

SEQ ID NO: 7246381 - DNA, 22 bp, Homo sapiens
caggtgagtttgctattgtaca

SEQ ID NO: 7246382 - DNA, 22 bp, Homo sapiens
caggtgaggctgaacagatgaa

SEQ ID NO: 7246383 - DNA, 22 bp, Homo sapiens
caggggctccctgggtgccagt

SEQ ID NO: 7246384 - DNA, 22 bp, Homo sapiens
caggggctccctgggtgccagt

SEQ ID NO: 7246385 - DNA, 22 bp, Homo sapiens
caggggctctaatgcatgatca

SEQ ID NO: 7246386 - DNA, 22 bp, Homo sapiens
caggggctctgggtgatgtgag

SEQ ID NO: 7246387 - DNA, 22 bp, Homo sapiens
caggggctgaaatgttggggtt

SEQ ID NO: 7246388 - DNA, 22 bp, Homo sapiens
caggggctgaaatgttggggtt

SEQ ID NO: 7246389 - DNA, 22 bp, Homo sapiens
caggggctgtggcacatggtgt

SEQ ID NO: 7246390 - DNA, 22 bp, Homo sapiens
caggggctgtgggcggagcctc

SEQ ID NO: 7246391 - DNA, 22 bp, Homo sapiens
caggggctgtgggcggagcctc

SEQ ID NO: 7246392 - DNA, 22 bp, Homo sapiens
cagggtgagcctctggagccct

SEQ ID NO: 7246393 - DNA, 22 bp, Homo sapiens
cagggtgcagtgtcgctgctag

SEQ ID NO: 7246394 - DNA, 19 bp, Homo sapiens
aggcagcaggccagggatg

SEQ ID NO: 7246395 - DNA, 22 bp, Homo sapiens
catttgttaattactattatct

SEQ ID NO: 7246396 - DNA, 22 bp, Homo sapiens
cattaaaatatctcatggtgtt

SEQ ID NO: 7246397 - DNA, 22 bp, Homo sapiens
cattaaattccttgttctcaaa

SEQ ID NO: 7246398 - DNA, 22 bp, Homo sapiens
cattaaatcttccagacctcac

SEQ ID NO: 7246399 - DNA, 22 bp, Homo sapiens
cattaaatatcaacctagacta

SEQ ID NO: 7246400 - DNA, 23 bp, Homo sapiens
aggcagcaggttgtccagggtga

SEQ ID NO: 7246401 - DNA, 22 bp, Homo sapiens
aggcagcagtcatgaggaaaga

SEQ ID NO: 7246402 - DNA, 22 bp, Homo sapiens
ccaagccgcggctcctcctgcg

SEQ ID NO: 7246403 - DNA, 22 bp, Homo sapiens
ccaagttaccagcaatataagt

SEQ ID NO: 7246404 - DNA, 22 bp, Homo sapiens
ccaatagagtgctgtaagaatt

SEQ ID NO: 7246405 - DNA, 22 bp, Homo sapiens
ccaatacactttatagaagaaa

SEQ ID NO: 7246406 - DNA, 18 bp, Homo sapiens
aggcaggctggagtgact

SEQ ID NO: 7246407 - DNA, 22 bp, Homo sapiens
ccaaggtgggcagatcacgagg

SEQ ID NO: 7246408 - DNA, 22 bp, Homo sapiens
catgtcagggcttcctcctctc

SEQ ID NO: 7246409 - DNA, 21 bp, Homo sapiens
aggatttctgtcatttcagat

SEQ ID NO: 7246410 - DNA, 22 bp, Homo sapiens
catgggggctgaggctgctgta

SEQ ID NO: 7246411 - DNA, 22 bp, Homo sapiens
catgggggctgaggctgctgta

SEQ ID NO: 7246412 - DNA, 22 bp, Homo sapiens
catggaggaccctcagggagct

SEQ ID NO: 7246413 - DNA, 22 bp, Homo sapiens
aggagggcaggctggctgccta

SEQ ID NO: 7246414 - DNA, 22 bp, Homo sapiens
aggagggcaggctggctgccta

SEQ ID NO: 7246415 - DNA, 21 bp, Homo sapiens
aggagggcacaaggccaggaa

SEQ ID NO: 7246416 - DNA, 22 bp, Homo sapiens
aggagggctaggaaaaccagga

SEQ ID NO: 7246417 - DNA, 22 bp, Homo sapiens
aggagggcaggctggctgccta

SEQ ID NO: 7246418 - DNA, 22 bp, Homo sapiens
aggagggagcttaagccaggca

SEQ ID NO: 7246419 - DNA, 22 bp, Homo sapiens
aggagggatagaaaaatacttg

SEQ ID NO: 7246420 - DNA, 21 bp, Homo sapiens
aggagggcacaaggccaggaa

SEQ ID NO: 7246421 - DNA, 21 bp, Homo sapiens
aggagggcacaaggccaggaa

SEQ ID NO: 7246422 - DNA, 22 bp, Homo sapiens
catgcgggttccaggctgcact

SEQ ID NO: 7246423 - DNA, 20 bp, Homo sapiens
aggaggggatagaatcaaag

SEQ ID NO: 7246424 - DNA, 20 bp, Homo sapiens
aggaggggatagaatcaaag

SEQ ID NO: 7246425 - DNA, 22 bp, Homo sapiens
aggaggggcaatgatagtctgg

SEQ ID NO: 7246426 - DNA, 16 bp, Homo sapiens
aggaggggaattagga

SEQ ID NO: 7246427 - DNA, 22 bp, Homo sapiens
aggagggctaggaaaaccagga

SEQ ID NO: 7246428 - DNA, 16 bp, Homo sapiens
aggaggggaattagga

SEQ ID NO: 7246429 - DNA, 22 bp, Homo sapiens
caggtgggagccacagcgtaca

SEQ ID NO: 7246430 - DNA, 22 bp, Homo sapiens
caggtggcttctctgcagcctt

SEQ ID NO: 7246431 - DNA, 22 bp, Homo sapiens
caggtggcttctccctaggcca

SEQ ID NO: 7246432 - DNA, 22 bp, Homo sapiens
aggacccaagcacagttcctgg

SEQ ID NO: 7246433 - DNA, 22 bp, Homo sapiens
aggaccagtatgagagcatctg

SEQ ID NO: 7246434 - DNA, 22 bp, Homo sapiens
aggaccagtatgagagcatctg

SEQ ID NO: 7246435 - DNA, 22 bp, Homo sapiens
cagtggccaacttcctgcctct

SEQ ID NO: 7246436 - DNA, 22 bp, Homo sapiens
cagtggagaggcatgcttggca

SEQ ID NO: 7246437 - DNA, 22 bp, Homo sapiens
aggagaaggaggcccctcacac

SEQ ID NO: 7246438 - DNA, 22 bp, Homo sapiens
aggagaagtaaggctagatgat

SEQ ID NO: 7246439 - DNA, 19 bp, Homo sapiens
aggagaagtagcagaaatt

SEQ ID NO: 7246440 - DNA, 22 bp, Homo sapiens
cagtgcccttccaggactgcag

SEQ ID NO: 7246441 - DNA, 22 bp, Homo sapiens
aggactccatgtgtcctggaga

SEQ ID NO: 7246442 - DNA, 22 bp, Homo sapiens
aggactaaagggagcctagact

SEQ ID NO: 7246443 - DNA, 18 bp, Homo sapiens
aggactcctgggagttgg

SEQ ID NO: 7246444 - DNA, 22 bp, Homo sapiens
aggactcctgctgggaatggct

SEQ ID NO: 7246445 - DNA, 22 bp, Homo sapiens
aggactgacttttgccatgaaa

SEQ ID NO: 7246446 - DNA, 22 bp, Homo sapiens
cagtgcaggtggcagaggacag

SEQ ID NO: 7246447 - DNA, 22 bp, Homo sapiens
cagtgcctgggacccggctgtg

SEQ ID NO: 7246448 - DNA, 22 bp, Homo sapiens
cagtgcctggatagcaacatga

SEQ ID NO: 7246449 - DNA, 22 bp, Homo sapiens
cagtgctcccgctgccgctgtg

SEQ ID NO: 7246450 - DNA, 22 bp, Homo sapiens
aggagaaggaagtgcatcacta

SEQ ID NO: 7246451 - DNA, 22 bp, Homo sapiens
cagttttaggacatgtggatgt

SEQ ID NO: 7246452 - DNA, 22 bp, Homo sapiens
cagttttacccaagcttatttt

SEQ ID NO: 7246453 - DNA, 22 bp, Homo sapiens
cagtttctctcatacatatttg

SEQ ID NO: 7246454 - DNA, 22 bp, Homo sapiens
cagttttaaattttgaatgtct

SEQ ID NO: 7246455 - DNA, 22 bp, Homo sapiens
cagtttctacgaaggtcaaccc

SEQ ID NO: 7246456 - DNA, 22 bp, Homo sapiens
cagtttctacgacttaagcaca

SEQ ID NO: 7246457 - DNA, 22 bp, Homo sapiens
cagtttctatggctgggctctg

SEQ ID NO: 7246458 - DNA, 22 bp, Homo sapiens
cagtttctcagacttcccttgt

SEQ ID NO: 7246459 - DNA, 22 bp, Homo sapiens
cagtttctctcaataagcatcg

SEQ ID NO: 7246460 - DNA, 22 bp, Homo sapiens
cagtttctcaggcctctcccag

SEQ ID NO: 7246461 - DNA, 22 bp, Homo sapiens
cagtttctccaaacgcaggctg

SEQ ID NO: 7246462 - DNA, 22 bp, Homo sapiens
cagtttattgttgcgttcacat

SEQ ID NO: 7246463 - DNA, 22 bp, Homo sapiens
cagtggtatttgagagaatgga

SEQ ID NO: 7246464 - DNA, 22 bp, Homo sapiens
cagttctggaggatagaagtct

SEQ ID NO: 7246465 - DNA, 22 bp, Homo sapiens
aggagggagcactatatgggga

SEQ ID NO: 7246466 - DNA, 22 bp, Homo sapiens
catataaatacaacatgtgtta

SEQ ID NO: 7246467 - DNA, 22 bp, Homo sapiens
cagttttatgaatgcttattag

SEQ ID NO: 7246468 - DNA, 22 bp, Homo sapiens
cagttttatacactgcagctcc

SEQ ID NO: 7246469 - DNA, 22 bp, Homo sapiens
cagacagggttttggtctttgg

SEQ ID NO: 7246470 - DNA, 22 bp, Homo sapiens
agccagagagccccaggttcta

SEQ ID NO: 7246471 - DNA, 22 bp, Homo sapiens
agccagagactgtgtctgtaat

SEQ ID NO: 7246472 - DNA, 22 bp, Homo sapiens
agccagagactgtgtctgtaat

SEQ ID NO: 7246473 - DNA, 22 bp, Homo sapiens
cagacaggttgcaaaacttcaa

SEQ ID NO: 7246474 - DNA, 22 bp, Homo sapiens
cagacatatgttttaacagatt

SEQ ID NO: 7246475 - DNA, 22 bp, Homo sapiens
cagaatccagaattgctgaggt

SEQ ID NO: 7246476 - DNA, 22 bp, Homo sapiens
agcatagattctttcctttgcc

SEQ ID NO: 7246477 - DNA, 22 bp, Homo sapiens
agcatagatacattgagccaca

SEQ ID NO: 7246478 - DNA, 22 bp, Homo sapiens
agccaccaccactgaaaggtta

SEQ ID NO: 7246479 - DNA, 22 bp, Homo sapiens
cagaaatatcagttgaaagtgc

SEQ ID NO: 7246480 - DNA, 22 bp, Homo sapiens
cagaaatatcagttgaaagtgc

SEQ ID NO: 7246481 - DNA, 22 bp, Homo sapiens
cagaaatatttattgagtgaca

SEQ ID NO: 7246482 - DNA, 22 bp, Homo sapiens
cagaaatattccaagtactgca

SEQ ID NO: 7246483 - DNA, 22 bp, Homo sapiens
cagaaggcaaacaaaaggattt

SEQ ID NO: 7246484 - DNA, 22 bp, Homo sapiens
cagaaatatttattgagtgaca

SEQ ID NO: 7246485 - DNA, 22 bp, Homo sapiens
cagagggacagtatgatgaaag

SEQ ID NO: 7246486 - DNA, 22 bp, Homo sapiens
cagagggacagtatgatgaaag

SEQ ID NO: 7246487 - DNA, 22 bp, Homo sapiens
cagagggaaaaggggagtaata

SEQ ID NO: 7246488 - DNA, 22 bp, Homo sapiens
cagagggaaaaggggagtaata

SEQ ID NO: 7246489 - DNA, 22 bp, Homo sapiens
cagagggagccctccaggagca

SEQ ID NO: 7246490 - DNA, 22 bp, Homo sapiens
cagagggaccagaacatactgt

SEQ ID NO: 7246491 - DNA, 22 bp, Homo sapiens
cagagggagtttctgaggttgc

SEQ ID NO: 7246492 - DNA, 22 bp, Homo sapiens
cagagggagccctccaggagca

SEQ ID NO: 7246493 - DNA, 22 bp, Homo sapiens
agcccagccggattcccagttc

SEQ ID NO: 7246494 - DNA, 22 bp, Homo sapiens
cagaggagttcagtacacagcc

SEQ ID NO: 7246495 - DNA, 22 bp, Homo sapiens
cagacatggaaatttagtgtta

SEQ ID NO: 7246496 - DNA, 22 bp, Homo sapiens
cagagaaactcagatagctgat

SEQ ID NO: 7246497 - DNA, 22 bp, Homo sapiens
cagagaaagaagcccattcatt

SEQ ID NO: 7246498 - DNA, 22 bp, Homo sapiens
agcccagcagaaagtccagcct

SEQ ID NO: 7246499 - DNA, 22 bp, Homo sapiens
agcccagcactgggggcccagc

SEQ ID NO: 7246500 - DNA, 22 bp, Homo sapiens
agcccagcaaaggggtttgaga

SEQ ID NO: 7246501 - DNA, 22 bp, Homo sapiens
agcccagcagtaagattagaga

SEQ ID NO: 7246502 - DNA, 23 bp, Homo sapiens
agcccagcagagaacctaggtcc

SEQ ID NO: 7246503 - DNA, 22 bp, Homo sapiens
agcccagccactattaaatgtt

SEQ ID NO: 7246504 - DNA, 22 bp, Homo sapiens
agcccagcccgggctgcgcttt

SEQ ID NO: 7246505 - DNA, 22 bp, Homo sapiens
agcccagcaaagggaggttcag

SEQ ID NO: 7246506 - DNA, 22 bp, Homo sapiens
agcccactgttttcatttctct

SEQ ID NO: 7246507 - DNA, 22 bp, Homo sapiens
cagctctgagactgaggctatg

SEQ ID NO: 7246508 - DNA, 22 bp, Homo sapiens
cagctcaggaaggaaggccggc

SEQ ID NO: 7246509 - DNA, 19 bp, Homo sapiens
cagctcaggactcagcccc

SEQ ID NO: 7246510 - DNA, 22 bp, Homo sapiens
agctcaggcaactctgggcccc

SEQ ID NO: 7246511 - DNA, 22 bp, Homo sapiens
agctcagcttcctctccatgct

SEQ ID NO: 7246512 - DNA, 21 bp, Homo sapiens
agctcagccgggcacagtggc

SEQ ID NO: 7246513 - DNA, 21 bp, Homo sapiens
agctcagcaagatggaggctc

SEQ ID NO: 7246514 - DNA, 22 bp, Homo sapiens
cagccccagcacttagctgagt

SEQ ID NO: 7246515 - DNA, 22 bp, Homo sapiens
cagccccacacggtctagctct

SEQ ID NO: 7246516 - DNA, 22 bp, Homo sapiens
cagccccatggtgtgctccagc

SEQ ID NO: 7246517 - DNA, 22 bp, Homo sapiens
cagccctgagaaggaggatctc

SEQ ID NO: 7246518 - DNA, 22 bp, Homo sapiens
cagccctgcagagggcgctcct

SEQ ID NO: 7246519 - DNA, 22 bp, Homo sapiens
cagccctgcacgctgcctccgc

SEQ ID NO: 7246520 - DNA, 22 bp, Homo sapiens
cagccctgcagagggcgctcct

SEQ ID NO: 7246521 - DNA, 22 bp, Homo sapiens
cagcagttttgaagtgtggaga

SEQ ID NO: 7246522 - DNA, 22 bp, Homo sapiens
cagcagttctgtactttagagt

SEQ ID NO: 7246523 - DNA, 22 bp, Homo sapiens
cagcagttatgagtagaatagt

SEQ ID NO: 7246524 - DNA, 22 bp, Homo sapiens
cagcagggtatacagggaattt

SEQ ID NO: 7246525 - DNA, 22 bp, Homo sapiens
cagcagggtatacagggaattt

SEQ ID NO: 7246526 - DNA, 18 bp, Homo sapiens
agcctctggcagagagaa

SEQ ID NO: 7246527 - DNA, 22 bp, Homo sapiens
agcctctggccctagactgctt

SEQ ID NO: 7246528 - DNA, 22 bp, Homo sapiens
agcctctgctggccctggcact

SEQ ID NO: 7246529 - DNA, 22 bp, Homo sapiens
agcctctgcttatgcaaaggta

SEQ ID NO: 7246530 - DNA, 22 bp, Homo sapiens
agcctctgatggctcccaagga

SEQ ID NO: 7246531 - DNA, 22 bp, Homo sapiens
agcctctgcacgggcacgggtg

SEQ ID NO: 7246532 - DNA, 22 bp, Homo sapiens
agcctctgcacttcttacaggt

SEQ ID NO: 7246533 - DNA, 22 bp, Homo sapiens
agcctctgggggagctgggagc

SEQ ID NO: 7246534 - DNA, 22 bp, Homo sapiens
agcctctggtcctccctcagct

SEQ ID NO: 7246535 - DNA, 22 bp, Homo sapiens
agcctctgtagaaagcagtgtg

SEQ ID NO: 7246536 - DNA, 22 bp, Homo sapiens
cagagggcactcggagtgacat

SEQ ID NO: 7246537 - DNA, 22 bp, Homo sapiens
cagagggcactcggagtgacat

SEQ ID NO: 7246538 - DNA, 22 bp, Homo sapiens
cagaggtgcatacaggtcatta

SEQ ID NO: 7246539 - DNA, 22 bp, Homo sapiens
cagaggtgctggagtgagtcct

SEQ ID NO: 7246540 - DNA, 22 bp, Homo sapiens
cagcagcattgctctggattcc

SEQ ID NO: 7246541 - DNA, 22 bp, Homo sapiens
cagcagctcccatccgctgagc

SEQ ID NO: 7246542 - DNA, 22 bp, Homo sapiens
cagcagctgactccaagagagc

SEQ ID NO: 7246543 - DNA, 22 bp, Homo sapiens
agcctggcactgaggcagggcg

SEQ ID NO: 7246544 - DNA, 22 bp, Homo sapiens
agcctggatcctaggctcagct

SEQ ID NO: 7246545 - DNA, 22 bp, Homo sapiens
agcctggagttcccaggagaag

SEQ ID NO: 7246546 - DNA, 22 bp, Homo sapiens
agcctggcactgccccatccat

SEQ ID NO: 7246547 - DNA, 22 bp, Homo sapiens
cagcagggcccccgggtgcgcc

SEQ ID NO: 7246548 - DNA, 22 bp, Homo sapiens
agcagcaggaggccattgtctt

SEQ ID NO: 7246549 - DNA, 22 bp, Homo sapiens
agcagcaggctgtgtggactga

SEQ ID NO: 7246550 - DNA, 22 bp, Homo sapiens
agcagcaggctgggatgagtct

SEQ ID NO: 7246551 - DNA, 22 bp, Homo sapiens
agcagcatttaagtttcttcta

SEQ ID NO: 7246552 - DNA, 22 bp, Homo sapiens
agcagccacacgcctccttctc

SEQ ID NO: 7246553 - DNA, 22 bp, Homo sapiens
agcagccacagtctgggacagg

SEQ ID NO: 7246554 - DNA, 22 bp, Homo sapiens
agcagccacccagctgctcatt

SEQ ID NO: 7246555 - DNA, 22 bp, Homo sapiens
agcagctcctctaggaacggat

SEQ ID NO: 7246556 - DNA, 22 bp, Homo sapiens
agcagctccctcctcagccacc

SEQ ID NO: 7246557 - DNA, 22 bp, Homo sapiens
agcagccagaaagggcagtcga

SEQ ID NO: 7246558 - DNA, 22 bp, Homo sapiens
agcagccagaaatccagaggtg

SEQ ID NO: 7246559 - DNA, 22 bp, Homo sapiens
caacagctggaggcttggcccg

SEQ ID NO: 7246560 - DNA, 22 bp, Homo sapiens
agcacaggtgaaacagtcaggt

SEQ ID NO: 7246561 - DNA, 22 bp, Homo sapiens
agcacaggtgaaacagtcaggt

SEQ ID NO: 7246562 - DNA, 22 bp, Homo sapiens
agcacagttttcattgcagggt

SEQ ID NO: 7246563 - DNA, 22 bp, Homo sapiens
caaatagattgttcaatcctga

SEQ ID NO: 7246564 - DNA, 22 bp, Homo sapiens
caaataggtaaatgtatgctgt

SEQ ID NO: 7246565 - DNA, 21 bp, Homo sapiens
agcacagctttaagccatgtg

SEQ ID NO: 7246566 - DNA, 22 bp, Homo sapiens
agcacagcttcaccgagcccat

SEQ ID NO: 7246567 - DNA, 22 bp, Homo sapiens
agcaaagctaccaattattgag

SEQ ID NO: 7246568 - DNA, 22 bp, Homo sapiens
caaaagtcttcctattctctta

SEQ ID NO: 7246569 - DNA, 20 bp, Homo sapiens
agcaaactcttcccatcttc

SEQ ID NO: 7246570 - DNA, 22 bp, Homo sapiens
agcagggctttgtctctgtgaa

SEQ ID NO: 7246571 - DNA, 22 bp, Homo sapiens
agcaggggctcctccacagcca

SEQ ID NO: 7246572 - DNA, 22 bp, Homo sapiens
agcaggggtaacagaaggaaag

SEQ ID NO: 7246573 - DNA, 22 bp, Homo sapiens
agcagggggccacagtcacagc

SEQ ID NO: 7246574 - DNA, 20 bp, Homo sapiens
agcaggtaaggcacagcagt

SEQ ID NO: 7246575 - DNA, 22 bp, Homo sapiens
caccaggttccgggcagagctg

SEQ ID NO: 7246576 - DNA, 22 bp, Homo sapiens
agcaggggtggaaggtagcttt

SEQ ID NO: 7246577 - DNA, 20 bp, Homo sapiens
agcatagagcaccagaaggc

SEQ ID NO: 7246578 - DNA, 19 bp, Homo sapiens
agcatagacttctcaggaa

SEQ ID NO: 7246579 - DNA, 22 bp, Homo sapiens
agcatagaataagctgaagtca

SEQ ID NO: 7246580 - DNA, 22 bp, Homo sapiens
agcatagaaaagattcccagag

SEQ ID NO: 7246581 - DNA, 22 bp, Homo sapiens
cactgctcgctgcagcatggcc

SEQ ID NO: 7246582 - DNA, 22 bp, Homo sapiens
caccgcggagtgatggagaaac

SEQ ID NO: 7246583 - DNA, 22 bp, Homo sapiens
cacctagggcatccctgcccca

SEQ ID NO: 7246584 - DNA, 22 bp, Homo sapiens
cactgcacttcagcctgggtga

SEQ ID NO: 7246585 - DNA, 22 bp, Homo sapiens
cacacactcttcctggcaccta

SEQ ID NO: 7246586 - DNA, 22 bp, Homo sapiens
cacacactgttaatgtaggagt

SEQ ID NO: 7246587 - DNA, 22 bp, Homo sapiens
attattcaaattcccactatac

SEQ ID NO: 7246588 - DNA, 22 bp, Homo sapiens
agaggagctgggaggccctcgt

SEQ ID NO: 7246589 - DNA, 22 bp, Homo sapiens
agaggagctgggaggccctcgt

SEQ ID NO: 7246590 - DNA, 22 bp, Homo sapiens
agaggagcctcagtttgcagcc

SEQ ID NO: 7246591 - DNA, 22 bp, Homo sapiens
agaggacaggttttccatgggc

SEQ ID NO: 7246592 - DNA, 22 bp, Homo sapiens
agaggaggaagagctttaaaat

SEQ ID NO: 7246593 - DNA, 22 bp, Homo sapiens
agaggaggaagagctttaaaat

SEQ ID NO: 7246594 - DNA, 20 bp, Homo sapiens
agaggaggattattttattc

SEQ ID NO: 7246595 - DNA, 22 bp, Homo sapiens
agaggaggccaggcccacacct

SEQ ID NO: 7246596 - DNA, 22 bp, Homo sapiens
agaggaggctctgggatcgtcc

SEQ ID NO: 7246597 - DNA, 22 bp, Homo sapiens
agaggaggcagcttaactcagt

SEQ ID NO: 7246598 - DNA, 22 bp, Homo sapiens
agaggaggatttgtaaaggtct

SEQ ID NO: 7246599 - DNA, 21 bp, Homo sapiens
atgtttacactgactactgtg

SEQ ID NO: 7246600 - DNA, 22 bp, Homo sapiens
agaggacaaaatgagaagtgct

SEQ ID NO: 7246601 - DNA, 22 bp, Homo sapiens
attgagggctgagaagggccct

SEQ ID NO: 7246602 - DNA, 22 bp, Homo sapiens
agaggctgtgcagagggagtgc

SEQ ID NO: 7246603 - DNA, 22 bp, Homo sapiens
agaggctgtgcagagggagtgc

SEQ ID NO: 7246604 - DNA, 22 bp, Homo sapiens
agaggctgtctcatattttgta

SEQ ID NO: 7246605 - DNA, 18 bp, Homo sapiens
agagggaatcagttggat

SEQ ID NO: 7246606 - DNA, 22 bp, Homo sapiens
agagggaaatccaggagtgctt

SEQ ID NO: 7246607 - DNA, 22 bp, Homo sapiens
agagggagaagctaaaataact

SEQ ID NO: 7246608 - DNA, 22 bp, Homo sapiens
agagggagaaaagaatcagttg

SEQ ID NO: 7246609 - DNA, 22 bp, Homo sapiens
agaggcctttctgttgagtgaa

SEQ ID NO: 7246610 - DNA, 16 bp, Homo sapiens
agaggccttgaggaag

SEQ ID NO: 7246611 - DNA, 21 bp, Homo sapiens
agaggccttacaggatagacc

SEQ ID NO: 7246612 - DNA, 22 bp, Homo sapiens
agaggcctgtgtgctccagtgg

SEQ ID NO: 7246613 - DNA, 22 bp, Homo sapiens
attcagtaggtctagaataaga

SEQ ID NO: 7246614 - DNA, 22 bp, Homo sapiens
agataaaatggttcaaaggcta

SEQ ID NO: 7246615 - DNA, 22 bp, Homo sapiens
atttattgaagcttattacgtt

SEQ ID NO: 7246616 - DNA, 22 bp, Homo sapiens
atttcacaaagaacagatgcag

SEQ ID NO: 7246617 - DNA, 22 bp, Homo sapiens
atttcacagcgtggttgactgc

SEQ ID NO: 7246618 - DNA, 22 bp, Homo sapiens
agatacattgttctaagcattg

SEQ ID NO: 7246619 - DNA, 22 bp, Homo sapiens
agatacatcatttataccttca

SEQ ID NO: 7246620 - DNA, 22 bp, Homo sapiens
agatacatatagaaaacatcaa

SEQ ID NO: 7246621 - DNA, 22 bp, Homo sapiens
atttcacttagtgtaatgtctt

SEQ ID NO: 7246622 - DNA, 21 bp, Homo sapiens
atttcagaaatattggtggga

SEQ ID NO: 7246623 - DNA, 22 bp, Homo sapiens
atttcactcattcatgttactt

SEQ ID NO: 7246624 - DNA, 22 bp, Homo sapiens
atttcacagctgtcagtgttac

SEQ ID NO: 7246625 - DNA, 22 bp, Homo sapiens
atttcacatctatctcagattt

SEQ ID NO: 7246626 - DNA, 22 bp, Homo sapiens
attgccacctgttgctatggag

SEQ ID NO: 7246627 - DNA, 19 bp, Homo sapiens
attgccacattgggtcagg

SEQ ID NO: 7246628 - DNA, 22 bp, Homo sapiens
attgctgaacttataaatgaat

SEQ ID NO: 7246629 - DNA, 22 bp, Homo sapiens
agaggtctatgctaggggaact

SEQ ID NO: 7246630 - DNA, 22 bp, Homo sapiens
agagttggccaaaaggggcatt

SEQ ID NO: 7246631 - DNA, 22 bp, Homo sapiens
agagtttagggctgagagcttg

SEQ ID NO: 7246632 - DNA, 22 bp, Homo sapiens
agagtttaccactatttttggt

SEQ ID NO: 7246633 - DNA, 22 bp, Homo sapiens
agagtttaccactatttttggt

SEQ ID NO: 7246634 - DNA, 22 bp, Homo sapiens
agagtttacagaaataagctgt

SEQ ID NO: 7246635 - DNA, 22 bp, Homo sapiens
agagtttaacacaagaaaagtt

SEQ ID NO: 7246636 - DNA, 22 bp, Homo sapiens
agagtttaaacactgtcacaga

SEQ ID NO: 7246637 - DNA, 19 bp, Homo sapiens
agagtttaggtctatcagg

SEQ ID NO: 7246638 - DNA, 22 bp, Homo sapiens
agagtttaggggtaagcatagt

SEQ ID NO: 7246639 - DNA, 22 bp, Homo sapiens
agagtttaggggacacagaata

SEQ ID NO: 7246640 - DNA, 22 bp, Homo sapiens
agagttcttgccctagaaaatg

SEQ ID NO: 7246641 - DNA, 22 bp, Homo sapiens
agagttctgtctgccacacgaa

SEQ ID NO: 7246642 - DNA, 22 bp, Homo sapiens
caaaagtaatgtatgctcatcg

SEQ ID NO: 7246643 - DNA, 22 bp, Homo sapiens
atttgttgaataaattagtatt

SEQ ID NO: 7246644 - DNA, 22 bp, Homo sapiens
atttgttaattatgaggcatac

SEQ ID NO: 7246645 - DNA, 22 bp, Homo sapiens
atttgtgcatatcccatccacc

SEQ ID NO: 7246646 - DNA, 22 bp, Homo sapiens
atttggcacagcttttcctacc

SEQ ID NO: 7246647 - DNA, 22 bp, Homo sapiens
atttggcagtataaattctggc

SEQ ID NO: 7246648 - DNA, 22 bp, Homo sapiens
agatacgcggctcttttcttga

SEQ ID NO: 7246649 - DNA, 17 bp, Homo sapiens
atttggaatttctcttc

SEQ ID NO: 7246650 - DNA, 22 bp, Homo sapiens
agaccactaaaactttctctat

SEQ ID NO: 7246651 - DNA, 22 bp, Homo sapiens
agagaagagcaatgataaattt

SEQ ID NO: 7246652 - DNA, 22 bp, Homo sapiens
agagaagacttacagccacagt

SEQ ID NO: 7246653 - DNA, 22 bp, Homo sapiens
atggccagtcaagcctctggct

SEQ ID NO: 7246654 - DNA, 22 bp, Homo sapiens
agagaagagcaatgataaattt

SEQ ID NO: 7246655 - DNA, 22 bp, Homo sapiens
atggccagggtggcactgtggt

SEQ ID NO: 7246656 - DNA, 22 bp, Homo sapiens
atggccaggcacctctggctga

SEQ ID NO: 7246657 - DNA, 22 bp, Homo sapiens
atggccagcaagttcagaattt

SEQ ID NO: 7246658 - DNA, 23 bp, Homo sapiens
agacccagagactggctctgctc

SEQ ID NO: 7246659 - DNA, 22 bp, Homo sapiens
atggccagcccttcccgcagct

SEQ ID NO: 7246660 - DNA, 22 bp, Homo sapiens
atggccagctcagagcactcag

SEQ ID NO: 7246661 - DNA, 22 bp, Homo sapiens
agagatgaaaagtggagactgg

SEQ ID NO: 7246662 - DNA, 22 bp, Homo sapiens
agagatgaaaagtggagactgg

SEQ ID NO: 7246663 - DNA, 22 bp, Homo sapiens
atggctcagcgcctttctgtgg

SEQ ID NO: 7246664 - DNA, 17 bp, Homo sapiens
atggctcacctgtgggc

SEQ ID NO: 7246665 - DNA, 22 bp, Homo sapiens
atggcctttctcagtggtgctt

SEQ ID NO: 7246666 - DNA, 22 bp, Homo sapiens
agagaccttcctgactccagag

SEQ ID NO: 7246667 - DNA, 21 bp, Homo sapiens
agagacagagaaagtaacatt

SEQ ID NO: 7246668 - DNA, 22 bp, Homo sapiens
agagaagattcttatatgtctt

SEQ ID NO: 7246669 - DNA, 22 bp, Homo sapiens
agagacagggttttgtcgtgtt

SEQ ID NO: 7246670 - DNA, 22 bp, Homo sapiens
agagacagggttttgtcgtgtt

SEQ ID NO: 7246671 - DNA, 19 bp, Homo sapiens
agagaccacagagctgcct

SEQ ID NO: 7246672 - DNA, 22 bp, Homo sapiens
atgtggttttggattattcatg

SEQ ID NO: 7246673 - DNA, 22 bp, Homo sapiens
atgtggttgaagaattacatct

SEQ ID NO: 7246674 - DNA, 22 bp, Homo sapiens
agagatgacatgagggacttaa

SEQ ID NO: 7246675 - DNA, 22 bp, Homo sapiens
agagatgaatcttgagactctg

SEQ ID NO: 7246676 - DNA, 22 bp, Homo sapiens
agagatgacatgagggacttaa

SEQ ID NO: 7246677 - DNA, 22 bp, Homo sapiens
atggggtgaccatgagcattta

SEQ ID NO: 7246678 - DNA, 20 bp, Homo sapiens
atggggtgagtgacgccctc

SEQ ID NO: 7246679 - DNA, 22 bp, Homo sapiens
atggggtgagactaggattaaa

SEQ ID NO: 7246680 - DNA, 22 bp, Homo sapiens
agagatggccttaggtgggaat

SEQ ID NO: 7246681 - DNA, 22 bp, Homo sapiens
agagccacggcaggcctaggaa

SEQ ID NO: 7246682 - DNA, 22 bp, Homo sapiens
agagccaaggcctcagtctcaa

SEQ ID NO: 7246683 - DNA, 22 bp, Homo sapiens
agagcatctaacacataagcct

SEQ ID NO: 7246684 - DNA, 22 bp, Homo sapiens
atggggtggagtccgggcagcg

SEQ ID NO: 7246685 - DNA, 22 bp, Homo sapiens
atggggtggagtccgggcagcg

SEQ ID NO: 7246686 - DNA, 22 bp, Homo sapiens
atggggtgcatgcagattggga

SEQ ID NO: 7246687 - DNA, 22 bp, Homo sapiens
agacagctgggaaatggagtgt

SEQ ID NO: 7246688 - DNA, 22 bp, Homo sapiens
agacaggagagggaactgccgg

SEQ ID NO: 7246689 - DNA, 20 bp, Homo sapiens
agacaggagcccccattcag

SEQ ID NO: 7246690 - DNA, 22 bp, Homo sapiens
agacagcgaggacagaggggtg

SEQ ID NO: 7246691 - DNA, 22 bp, Homo sapiens
agacagctatcaacaactttct

SEQ ID NO: 7246692 - DNA, 22 bp, Homo sapiens
agacagcagaaactagagcact

SEQ ID NO: 7246693 - DNA, 22 bp, Homo sapiens
agacagcatgatacatgatgct

SEQ ID NO: 7246694 - DNA, 22 bp, Homo sapiens
atgcacctgaactccatcagct

SEQ ID NO: 7246695 - DNA, 22 bp, Homo sapiens
atgacaaaagaagacatgaggt

SEQ ID NO: 7246696 - DNA, 22 bp, Homo sapiens
atgacaaaattcacaggtgtga

SEQ ID NO: 7246697 - DNA, 22 bp, Homo sapiens
atgacaaaataaatggtctctg

SEQ ID NO: 7246698 - DNA, 22 bp, Homo sapiens
atgacaaaatgaatgcagctag

SEQ ID NO: 7246699 - DNA, 22 bp, Homo sapiens
atgacaaacccaggatgtaaca

SEQ ID NO: 7246700 - DNA, 23 bp, Homo sapiens
atgacaaacaggacatcttgtgc

SEQ ID NO: 7246701 - DNA, 22 bp, Homo sapiens
atgacaaaggctgaaagggaaa

SEQ ID NO: 7246702 - DNA, 22 bp, Homo sapiens
atgacaaattcagaccatagca

SEQ ID NO: 7246703 - DNA, 22 bp, Homo sapiens
agacaaagacagcatctcaggt

SEQ ID NO: 7246704 - DNA, 22 bp, Homo sapiens
agacaaagaaaccgtagaagca

SEQ ID NO: 7246705 - DNA, 22 bp, Homo sapiens
agacaaatggtaattatgtcta

SEQ ID NO: 7246706 - DNA, 22 bp, Homo sapiens
agacaaatggagtatgagcaac

SEQ ID NO: 7246707 - DNA, 22 bp, Homo sapiens
agacaaaggattaatgatgatg

SEQ ID NO: 7246708 - DNA, 22 bp, Homo sapiens
atgaaagcaggaattgttctgt

SEQ ID NO: 7246709 - DNA, 22 bp, Homo sapiens
atgaaagcaacttatttgagat

SEQ ID NO: 7246710 - DNA, 22 bp, Homo sapiens
atgaaagatgatttaaagtact

SEQ ID NO: 7246711 - DNA, 22 bp, Homo sapiens
atgaaactgggataactatagc

SEQ ID NO: 7246712 - DNA, 22 bp, Homo sapiens
atgaaattgatcttgaactttt

SEQ ID NO: 7246713 - DNA, 22 bp, Homo sapiens
atgaaatttgaccaattattta

SEQ ID NO: 7246714 - DNA, 22 bp, Homo sapiens
atgaacaataaaatagatcaca

SEQ ID NO: 7246715 - DNA, 22 bp, Homo sapiens
atgaaatttgctgctaagttcc

SEQ ID NO: 7246716 - DNA, 22 bp, Homo sapiens
atgaaattttaattatacctct

SEQ ID NO: 7246717 - DNA, 22 bp, Homo sapiens
agaagtggtgtgtggccgagct

SEQ ID NO: 7246718 - DNA, 22 bp, Homo sapiens
agaagtttggtcctataaactc

SEQ ID NO: 7246719 - DNA, 23 bp, Homo sapiens
atgaaactcaagccagatccaag

SEQ ID NO: 7246720 - DNA, 22 bp, Homo sapiens
atctttgttatctcagatcttg

SEQ ID NO: 7246721 - DNA, 22 bp, Homo sapiens
agaagtatttggctaaaagaca

SEQ ID NO: 7246722 - DNA, 22 bp, Homo sapiens
agaaggctggccctgggtggcc

SEQ ID NO: 7246723 - DNA, 22 bp, Homo sapiens
agaagtgagactcagttgatga

SEQ ID NO: 7246724 - DNA, 22 bp, Homo sapiens
agaagtgaaactgcaaaagtgt

SEQ ID NO: 7246725 - DNA, 22 bp, Homo sapiens
agaagtgagttgtgactatggg

SEQ ID NO: 7246726 - DNA, 22 bp, Homo sapiens
agaagtgagtgtgactcagcag

SEQ ID NO: 7246727 - DNA, 22 bp, Homo sapiens
agaagtgaggaaatcctcttta

SEQ ID NO: 7246728 - DNA, 22 bp, Homo sapiens
agaagtgagtgtgactcagcag

SEQ ID NO: 7246729 - DNA, 22 bp, Homo sapiens
agaagtgccgaaaggaagacag

SEQ ID NO: 7246730 - DNA, 22 bp, Homo sapiens
agaagtgctccagtgagttggg

SEQ ID NO: 7246731 - DNA, 19 bp, Homo sapiens
agggagaattccaagagga

SEQ ID NO: 7246732 - DNA, 22 bp, Homo sapiens
agggagacacatgaggaagtca

SEQ ID NO: 7246733 - DNA, 22 bp, Homo sapiens
aggcttgtggattggagcgagt

SEQ ID NO: 7246734 - DNA, 22 bp, Homo sapiens
agggacagtatccatctcacag

SEQ ID NO: 7246735 - DNA, 22 bp, Homo sapiens
accagcagttatgaggccagga

SEQ ID NO: 7246736 - DNA, 22 bp, Homo sapiens
accagcagctgccagagtggag

SEQ ID NO: 7246737 - DNA, 22 bp, Homo sapiens
accagagctggctctgagcacc

SEQ ID NO: 7246738 - DNA, 22 bp, Homo sapiens
agggcagcacaaggcatggact

SEQ ID NO: 7246739 - DNA, 22 bp, Homo sapiens
agggcacttcctctgggtccct

SEQ ID NO: 7246740 - DNA, 21 bp, Homo sapiens
agggcagattagctgtaagag

SEQ ID NO: 7246741 - DNA, 22 bp, Homo sapiens
agggcagatggaacttccccga

SEQ ID NO: 7246742 - DNA, 22 bp, Homo sapiens
agggcagcaatgcagctgctgc

SEQ ID NO: 7246743 - DNA, 22 bp, Homo sapiens
accagcctgtctgagtcgtggg

SEQ ID NO: 7246744 - DNA, 22 bp, Homo sapiens
accagcctggccaacatggtga

SEQ ID NO: 7246745 - DNA, 17 bp, Homo sapiens
accagcctctcctgggg

SEQ ID NO: 7246746 - DNA, 22 bp, Homo sapiens
accagcctcctagctgctcctg

SEQ ID NO: 7246747 - DNA, 22 bp, Homo sapiens
accagcctggccaacatggcaa

SEQ ID NO: 7246748 - DNA, 22 bp, Homo sapiens
agggagaggagggtcttgttga

SEQ ID NO: 7246749 - DNA, 22 bp, Homo sapiens
agggagaggagcgtttcacatc

SEQ ID NO: 7246750 - DNA, 22 bp, Homo sapiens
agggagaggagcgtttcacatc

SEQ ID NO: 7246751 - DNA, 16 bp, Homo sapiens
agggagagaggaacat

SEQ ID NO: 7246752 - DNA, 18 bp, Homo sapiens
agggagagaccgcgggtc

SEQ ID NO: 7246753 - DNA, 18 bp, Homo sapiens
agggagagaccgcgggtc

SEQ ID NO: 7246754 - DNA, 22 bp, Homo sapiens
agggagagaagttatacaagat

SEQ ID NO: 7246755 - DNA, 22 bp, Homo sapiens
agggagagacatttccttcttg

SEQ ID NO: 7246756 - DNA, 22 bp, Homo sapiens
agggagagacatttccttcttg

SEQ ID NO: 7246757 - DNA, 22 bp, Homo sapiens
accaggctggagtgcagtggcg

SEQ ID NO: 7246758 - DNA, 22 bp, Homo sapiens
accaggctgtgaagtgagacta

SEQ ID NO: 7246759 - DNA, 22 bp, Homo sapiens
acccagcctacaaagctcacct

SEQ ID NO: 7246760 - DNA, 19 bp, Homo sapiens
acccagcccaggagtggca

SEQ ID NO: 7246761 - DNA, 22 bp, Homo sapiens
acccagcccagaatctggggcc

SEQ ID NO: 7246762 - DNA, 22 bp, Homo sapiens
acccagccatgttcagttctct

SEQ ID NO: 7246763 - DNA, 22 bp, Homo sapiens
acccagccacagcattgaggga

SEQ ID NO: 7246764 - DNA, 22 bp, Homo sapiens
acccagcatgacacctgcacat

SEQ ID NO: 7246765 - DNA, 22 bp, Homo sapiens
acccagcaaagataaacttatg

SEQ ID NO: 7246766 - DNA, 22 bp, Homo sapiens
acccaggaaaacatggtgcaga

SEQ ID NO: 7246767 - DNA, 22 bp, Homo sapiens
agggctgcccagtgtgagagct

SEQ ID NO: 7246768 - DNA, 22 bp, Homo sapiens
agggctgcccagtgtgagagct

SEQ ID NO: 7246769 - DNA, 22 bp, Homo sapiens
agggctgccatttctggcccaa

SEQ ID NO: 7246770 - DNA, 22 bp, Homo sapiens
agggctgccatttctggcccaa

SEQ ID NO: 7246771 - DNA, 22 bp, Homo sapiens
agggctgctgaggaagccttgc

SEQ ID NO: 7246772 - DNA, 22 bp, Homo sapiens
agggctgctcctccttcaggcc

SEQ ID NO: 7246773 - DNA, 22 bp, Homo sapiens
agggctgctatgttgattcaga

SEQ ID NO: 7246774 - DNA, 22 bp, Homo sapiens
agggctgctcctccttcaggcc

SEQ ID NO: 7246775 - DNA, 19 bp, Homo sapiens
agggctgctctggcctggg

SEQ ID NO: 7246776 - DNA, 19 bp, Homo sapiens
agggctgctctggcctggg

SEQ ID NO: 7246777 - DNA, 22 bp, Homo sapiens
agggctgctaccttaatcagtt

SEQ ID NO: 7246778 - DNA, 22 bp, Homo sapiens
agggctgctaccttaatcagtt

SEQ ID NO: 7246779 - DNA, 22 bp, Homo sapiens
agggctgctatgttgattcaga

SEQ ID NO: 7246780 - DNA, 22 bp, Homo sapiens
agggctgcctgctctgcattga

SEQ ID NO: 7246781 - DNA, 22 bp, Homo sapiens
agggctgcctgctctgcattga

SEQ ID NO: 7246782 - DNA, 22 bp, Homo sapiens
agggctgcctgactccagagcc

SEQ ID NO: 7246783 - DNA, 22 bp, Homo sapiens
agggctgccccagtccagccgg

SEQ ID NO: 7246784 - DNA, 22 bp, Homo sapiens
agggctgcctgactccagagcc

SEQ ID NO: 7246785 - DNA, 22 bp, Homo sapiens
agggctgccccagtccagccgg

SEQ ID NO: 7246786 - DNA, 22 bp, Homo sapiens
agggctgcctgactccagagcc

SEQ ID NO: 7246787 - DNA, 22 bp, Homo sapiens
agggggcccttgcaggtgagcg

SEQ ID NO: 7246788 - DNA, 22 bp, Homo sapiens
agggggcccttgcaggtgagcg

SEQ ID NO: 7246789 - DNA, 22 bp, Homo sapiens
agggggcccttgcaggtgagcg

SEQ ID NO: 7246790 - DNA, 22 bp, Homo sapiens
agggggctcagtgactgaagtg

SEQ ID NO: 7246791 - DNA, 22 bp, Homo sapiens
agggggcaggagagacctgctg

SEQ ID NO: 7246792 - DNA, 22 bp, Homo sapiens
agggggcaggagagacctgctg

SEQ ID NO: 7246793 - DNA, 22 bp, Homo sapiens
agggggagtttcagttagaaag

SEQ ID NO: 7246794 - DNA, 22 bp, Homo sapiens
aggggcctggcactgagctggc

SEQ ID NO: 7246795 - DNA, 22 bp, Homo sapiens
agggggaggctgtgctgcgtct

SEQ ID NO: 7246796 - DNA, 22 bp, Homo sapiens
agggggaggctgtgctgcgtct

SEQ ID NO: 7246797 - DNA, 22 bp, Homo sapiens
agggggagcttggctactcctg

SEQ ID NO: 7246798 - DNA, 22 bp, Homo sapiens
aggctgaaaacgagatggcaat

SEQ ID NO: 7246799 - DNA, 22 bp, Homo sapiens
acattgcaataataattctctt

SEQ ID NO: 7246800 - DNA, 22 bp, Homo sapiens
acattgcaataataattctctt

SEQ ID NO: 7246801 - DNA, 22 bp, Homo sapiens
acattgattgagcacccattat

SEQ ID NO: 7246802 - DNA, 22 bp, Homo sapiens
acattgatgatcccacttacag

SEQ ID NO: 7246803 - DNA, 22 bp, Homo sapiens
aggctgagactgtgcattagtg

SEQ ID NO: 7246804 - DNA, 22 bp, Homo sapiens
aggctgagaaagtgggaagatg

SEQ ID NO: 7246805 - DNA, 22 bp, Homo sapiens
aggctgaggatccctgtgttct

SEQ ID NO: 7246806 - DNA, 22 bp, Homo sapiens
aggctgagctggcccttgaaat

SEQ ID NO: 7246807 - DNA, 22 bp, Homo sapiens
aggctgagctggtagtgagtac

SEQ ID NO: 7246808 - DNA, 22 bp, Homo sapiens
aggctgagctggtagtgagtac

SEQ ID NO: 7246809 - DNA, 22 bp, Homo sapiens
aggctgaggagggatgttgctt

SEQ ID NO: 7246810 - DNA, 22 bp, Homo sapiens
aggccagggtcccacactcgca

SEQ ID NO: 7246811 - DNA, 22 bp, Homo sapiens
aggccaggcgagacacccggct

SEQ ID NO: 7246812 - DNA, 22 bp, Homo sapiens
aggccaggcctttctccattcc

SEQ ID NO: 7246813 - DNA, 22 bp, Homo sapiens
aggccaggcgagacacccggct

SEQ ID NO: 7246814 - DNA, 22 bp, Homo sapiens
aggccagggcactgctctttag

SEQ ID NO: 7246815 - DNA, 22 bp, Homo sapiens
aggccagggccagattagccac

SEQ ID NO: 7246816 - DNA, 22 bp, Homo sapiens
aggccagggtagggcccattgt

SEQ ID NO: 7246817 - DNA, 22 bp, Homo sapiens
aggccaggggtgagcacttctg

SEQ ID NO: 7246818 - DNA, 22 bp, Homo sapiens
acatgtttaagtttgttatatg

SEQ ID NO: 7246819 - DNA, 22 bp, Homo sapiens
acatgtttgataaatatttggg

SEQ ID NO: 7246820 - DNA, 22 bp, Homo sapiens
aggcctcttcagggagcatgga

SEQ ID NO: 7246821 - DNA, 21 bp, Homo sapiens
aggcctcttcatggccatgat

SEQ ID NO: 7246822 - DNA, 22 bp, Homo sapiens
aggcctctgtctttatatgact

SEQ ID NO: 7246823 - DNA, 22 bp, Homo sapiens
aggcctctgtagggccctgaag

SEQ ID NO: 7246824 - DNA, 22 bp, Homo sapiens
aggcctcttgtcttcctcacat

SEQ ID NO: 7246825 - DNA, 22 bp, Homo sapiens
acatcatcgtgcacatacataa

SEQ ID NO: 7246826 - DNA, 22 bp, Homo sapiens
acatgcatacaagcacatgtag

SEQ ID NO: 7246827 - DNA, 22 bp, Homo sapiens
acatgcatacaagcacatgtag

SEQ ID NO: 7246828 - DNA, 22 bp, Homo sapiens
acatgcataagcctagccatca

SEQ ID NO: 7246829 - DNA, 22 bp, Homo sapiens
acatgctttgcacttacatcat

SEQ ID NO: 7246830 - DNA, 22 bp, Homo sapiens
agctggaggggccagcaggtgt

SEQ ID NO: 7246831 - DNA, 22 bp, Homo sapiens
acagctgggaactcacacagca

SEQ ID NO: 7246832 - DNA, 22 bp, Homo sapiens
acagctgggaactcacacagca

SEQ ID NO: 7246833 - DNA, 22 bp, Homo sapiens
agctctgggtcacggctgccga

SEQ ID NO: 7246834 - DNA, 22 bp, Homo sapiens
agctctggggtggagcccagga

SEQ ID NO: 7246835 - DNA, 22 bp, Homo sapiens
agctgacaggatggcattatta

SEQ ID NO: 7246836 - DNA, 22 bp, Homo sapiens
acaggagtttctgacagagaca

SEQ ID NO: 7246837 - DNA, 22 bp, Homo sapiens
acaggcacaggtgtgccccacc

SEQ ID NO: 7246838 - DNA, 21 bp, Homo sapiens
acaggcaccatgcctgtgcct

SEQ ID NO: 7246839 - DNA, 22 bp, Homo sapiens
agctggcagagcatttgtggcc

SEQ ID NO: 7246840 - DNA, 22 bp, Homo sapiens
acaggagaaatctggtcaaaag

SEQ ID NO: 7246841 - DNA, 22 bp, Homo sapiens
acaggagtagggctggtggaga

SEQ ID NO: 7246842 - DNA, 23 bp, Homo sapiens
acaggaggggacaggtggccgtg

SEQ ID NO: 7246843 - DNA, 22 bp, Homo sapiens
aggaagaaactgagctctgaca

SEQ ID NO: 7246844 - DNA, 22 bp, Homo sapiens
aggaagaaactgagctctgaca

SEQ ID NO: 7246845 - DNA, 18 bp, Homo sapiens
acagggagggcgctgggg

SEQ ID NO: 7246846 - DNA, 21 bp, Homo sapiens
aggaagaaaggttggaggttg

SEQ ID NO: 7246847 - DNA, 22 bp, Homo sapiens
aggaagaacagataatggacgc

SEQ ID NO: 7246848 - DNA, 22 bp, Homo sapiens
aggaagaacctaagaaagtctc

SEQ ID NO: 7246849 - DNA, 21 bp, Homo sapiens
acagggcttcagggagggtta

SEQ ID NO: 7246850 - DNA, 22 bp, Homo sapiens
aggacacacaaagagtgagaac

SEQ ID NO: 7246851 - DNA, 19 bp, Homo sapiens
acaggggcctttccagggt

SEQ ID NO: 7246852 - DNA, 22 bp, Homo sapiens
aggacacacagaatacaaatcc

SEQ ID NO: 7246853 - DNA, 22 bp, Homo sapiens
aggacacacccagctcacgggg

SEQ ID NO: 7246854 - DNA, 22 bp, Homo sapiens
acaggggcaagggctcacggcc

SEQ ID NO: 7246855 - DNA, 22 bp, Homo sapiens
acaggggcaggcaggacccttt

SEQ ID NO: 7246856 - DNA, 23 bp, Homo sapiens
acaggcaggcatggccaaatgtg

SEQ ID NO: 7246857 - DNA, 22 bp, Homo sapiens
acaggcaggtaatttacatatt

SEQ ID NO: 7246858 - DNA, 22 bp, Homo sapiens
acaggtttgctgctgttttagg

SEQ ID NO: 7246859 - DNA, 22 bp, Homo sapiens
acaggtttagctcttagtagtc

SEQ ID NO: 7246860 - DNA, 22 bp, Homo sapiens
aggacacaggcaggaggagatc

SEQ ID NO: 7246861 - DNA, 22 bp, Homo sapiens
aggagcagaccgtagtcctgca

SEQ ID NO: 7246862 - DNA, 22 bp, Homo sapiens
aggagcaaatgatgagacagca

SEQ ID NO: 7246863 - DNA, 22 bp, Homo sapiens
aggagcagaactgttgtggagg

SEQ ID NO: 7246864 - DNA, 22 bp, Homo sapiens
aggagcagaactgttgtggagg

SEQ ID NO: 7246865 - DNA, 20 bp, Homo sapiens
acagtgggtggggagcactg

SEQ ID NO: 7246866 - DNA, 22 bp, Homo sapiens
acagtctacttgagcttgtata

SEQ ID NO: 7246867 - DNA, 22 bp, Homo sapiens
acagtatgctttaaactttgtt

SEQ ID NO: 7246868 - DNA, 19 bp, Homo sapiens
acagtcagggaataaagac

SEQ ID NO: 7246869 - DNA, 22 bp, Homo sapiens
acagtttatggtgttttatata

SEQ ID NO: 7246870 - DNA, 22 bp, Homo sapiens
acagtttatggtgttttatata

SEQ ID NO: 7246871 - DNA, 22 bp, Homo sapiens
acagtttccccctagggcagca

SEQ ID NO: 7246872 - DNA, 19 bp, Homo sapiens
aggatggagcaggcggtga

SEQ ID NO: 7246873 - DNA, 22 bp, Homo sapiens
acagtttagagcatgatgacca

SEQ ID NO: 7246874 - DNA, 22 bp, Homo sapiens
acagtttaggatgagagaacac

SEQ ID NO: 7246875 - DNA, 22 bp, Homo sapiens
acagtttatcgattcacctacc

SEQ ID NO: 7246876 - DNA, 21 bp, Homo sapiens
aggcagctggaaggcctggct

SEQ ID NO: 7246877 - DNA, 20 bp, Homo sapiens
acatatcatggtagagtcct

SEQ ID NO: 7246878 - DNA, 22 bp, Homo sapiens
acatagaacttcgatgtctttt

SEQ ID NO: 7246879 - DNA, 22 bp, Homo sapiens
acatagaaggaagagtagtagg

SEQ ID NO: 7246880 - DNA, 22 bp, Homo sapiens
acatagcacgtctcaatttgga

SEQ ID NO: 7246881 - DNA, 22 bp, Homo sapiens
acatagaaggaggctggcagct

SEQ ID NO: 7246882 - DNA, 22 bp, Homo sapiens
acatagagtatcatactggatg

SEQ ID NO: 7246883 - DNA, 22 bp, Homo sapiens
acatagagcattggatatggga

SEQ ID NO: 7246884 - DNA, 22 bp, Homo sapiens
atccttttcctttgggtgccct

SEQ ID NO: 7246885 - DNA, 22 bp, Homo sapiens
agaacagatgtgggcagacctg

SEQ ID NO: 7246886 - DNA, 22 bp, Homo sapiens
agaaattatgcagtagttttat

SEQ ID NO: 7246887 - DNA, 22 bp, Homo sapiens
agaaagtgaacgtgttcagttt

SEQ ID NO: 7246888 - DNA, 22 bp, Homo sapiens
agaaaggtcaaaatcgtgacat

SEQ ID NO: 7246889 - DNA, 22 bp, Homo sapiens
agaaagggttctctgaggtgct

SEQ ID NO: 7246890 - DNA, 22 bp, Homo sapiens
agaaagggctattttgaggtag

SEQ ID NO: 7246891 - DNA, 22 bp, Homo sapiens
agaaagggctattttgaggtag

SEQ ID NO: 7246892 - DNA, 22 bp, Homo sapiens
agaaagggtcactgaaagagga

SEQ ID NO: 7246893 - DNA, 22 bp, Homo sapiens
agaaagggtcactgaaagagga

SEQ ID NO: 7246894 - DNA, 22 bp, Homo sapiens
atatttataaggcaggcaagta

SEQ ID NO: 7246895 - DNA, 21 bp, Homo sapiens
atatttctcataaggttatgg

SEQ ID NO: 7246896 - DNA, 22 bp, Homo sapiens
atattcttcttgttcagactat

SEQ ID NO: 7246897 - DNA, 22 bp, Homo sapiens
atatttataagcaagcaggact

SEQ ID NO: 7246898 - DNA, 22 bp, Homo sapiens
atatttataaggcaggcaagta

SEQ ID NO: 7246899 - DNA, 22 bp, Homo sapiens
atattctagccaaagtgtgagc

SEQ ID NO: 7246900 - DNA, 22 bp, Homo sapiens
agaaaagtgctctagtgagagc

SEQ ID NO: 7246901 - DNA, 22 bp, Homo sapiens
agaaaataaattgatggtggaa

SEQ ID NO: 7246902 - DNA, 22 bp, Homo sapiens
atatggaaatagcaatatggtt

SEQ ID NO: 7246903 - DNA, 20 bp, Homo sapiens
actttctcggtttctcacct

SEQ ID NO: 7246904 - DNA, 22 bp, Homo sapiens
actttctcaggaattcacagac

SEQ ID NO: 7246905 - DNA, 22 bp, Homo sapiens
atactgctgctgctgaaatcac

SEQ ID NO: 7246906 - DNA, 22 bp, Homo sapiens
atactgattagttgagaaagca

SEQ ID NO: 7246907 - DNA, 22 bp, Homo sapiens
atactgtacgtcccagatagga

SEQ ID NO: 7246908 - DNA, 22 bp, Homo sapiens
atactgtacgctcctggcattt

SEQ ID NO: 7246909 - DNA, 20 bp, Homo sapiens
atactgtacaactataggta

SEQ ID NO: 7246910 - DNA, 22 bp, Homo sapiens
atactgtaatacctaaatgaac

SEQ ID NO: 7246911 - DNA, 22 bp, Homo sapiens
atactgtgtgtgctcaaggaat

SEQ ID NO: 7246912 - DNA, 22 bp, Homo sapiens
atactgtatcacttgtgagtga

SEQ ID NO: 7246913 - DNA, 22 bp, Homo sapiens
atactgtatatttcacatcttg

SEQ ID NO: 7246914 - DNA, 22 bp, Homo sapiens
atactgtatatctgagagccca

SEQ ID NO: 7246915 - DNA, 22 bp, Homo sapiens
atactgtagttgtccaactatc

SEQ ID NO: 7246916 - DNA, 22 bp, Homo sapiens
atactgtagaggcatagctagt

SEQ ID NO: 7246917 - DNA, 22 bp, Homo sapiens
atacattattgttaaagaacat

SEQ ID NO: 7246918 - DNA, 22 bp, Homo sapiens
acttctgtcctccaagccacgt

SEQ ID NO: 7246919 - DNA, 21 bp, Homo sapiens
acttaaattccttgatattta

SEQ ID NO: 7246920 - DNA, 23 bp, Homo sapiens
acttaaatggttctttatctcag

SEQ ID NO: 7246921 - DNA, 22 bp, Homo sapiens
acttaaatagaactcctcaata

SEQ ID NO: 7246922 - DNA, 22 bp, Homo sapiens
atacagggacatccagtttttc

SEQ ID NO: 7246923 - DNA, 22 bp, Homo sapiens
atacagggacatccagtttttc

SEQ ID NO: 7246924 - DNA, 22 bp, Homo sapiens
atacagattgctatacttacaa

SEQ ID NO: 7246925 - DNA, 22 bp, Homo sapiens
atacagtaaccacattctatag

SEQ ID NO: 7246926 - DNA, 22 bp, Homo sapiens
atacaggttctctagggaacag

SEQ ID NO: 7246927 - DNA, 22 bp, Homo sapiens
ataaacagagtagttgctactg

SEQ ID NO: 7246928 - DNA, 22 bp, Homo sapiens
ataaacagctccatttagtgcc

SEQ ID NO: 7246929 - DNA, 22 bp, Homo sapiens
ataaggtctgctggggagagtg

SEQ ID NO: 7246930 - DNA, 22 bp, Homo sapiens
actgtactcaagcctgggcaat

SEQ ID NO: 7246931 - DNA, 22 bp, Homo sapiens
actgtactccaacctgggcaac

SEQ ID NO: 7246932 - DNA, 22 bp, Homo sapiens
actgtactttagaaagtgtagt

SEQ ID NO: 7246933 - DNA, 22 bp, Homo sapiens
actgtactttagaaagtgtagt

SEQ ID NO: 7246934 - DNA, 22 bp, Homo sapiens
actgtacttacgcatatacagg

SEQ ID NO: 7246935 - DNA, 22 bp, Homo sapiens
actgtactgaaaagtaagcaag

SEQ ID NO: 7246936 - DNA, 22 bp, Homo sapiens
actgtactcttctagccatctg

SEQ ID NO: 7246937 - DNA, 22 bp, Homo sapiens
actgtactgtgtattgtagaat

SEQ ID NO: 7246938 - DNA, 22 bp, Homo sapiens
actgtactccagcctgggagac

SEQ ID NO: 7246939 - DNA, 22 bp, Homo sapiens
actgtactccagcctgggggac

SEQ ID NO: 7246940 - DNA, 22 bp, Homo sapiens
actgtactccagcctggtggca

SEQ ID NO: 7246941 - DNA, 22 bp, Homo sapiens
actgtactccagccttggcgac

SEQ ID NO: 7246942 - DNA, 22 bp, Homo sapiens
actgtactccagccttggggac

SEQ ID NO: 7246943 - DNA, 22 bp, Homo sapiens
actgtactccagctctgggtga

SEQ ID NO: 7246944 - DNA, 22 bp, Homo sapiens
actgtactcggggaaatggggt

SEQ ID NO: 7246945 - DNA, 22 bp, Homo sapiens
actgtactccagcctcggtgac

SEQ ID NO: 7246946 - DNA, 22 bp, Homo sapiens
actgtactccagcctgggaaac

SEQ ID NO: 7246947 - DNA, 22 bp, Homo sapiens
actgtactcttatagccatctg

SEQ ID NO: 7246948 - DNA, 22 bp, Homo sapiens
actgtactttcccaagcacaca

SEQ ID NO: 7246949 - DNA, 22 bp, Homo sapiens
actgtacttttcttggctagat

SEQ ID NO: 7246950 - DNA, 22 bp, Homo sapiens
actgggaatggagcctgggcct

SEQ ID NO: 7246951 - DNA, 22 bp, Homo sapiens
acgcctgtaatcccagcacttt

SEQ ID NO: 7246952 - DNA, 22 bp, Homo sapiens
agtaaaaattgaggtgcaaaat

SEQ ID NO: 7246953 - DNA, 22 bp, Homo sapiens
acggcgggagggtcactggcca

SEQ ID NO: 7246954 - DNA, 22 bp, Homo sapiens
agtaaaattaatggatcagaag

SEQ ID NO: 7246955 - DNA, 23 bp, Homo sapiens
actagacttcatcgaaggttacc

SEQ ID NO: 7246956 - DNA, 22 bp, Homo sapiens
actagacaggttgtactattgg

SEQ ID NO: 7246957 - DNA, 22 bp, Homo sapiens
actagaatgcaggattggtctc

SEQ ID NO: 7246958 - DNA, 22 bp, Homo sapiens
actagaatgcaagctccacaag

SEQ ID NO: 7246959 - DNA, 22 bp, Homo sapiens
agtaaacactgtctttatatat

SEQ ID NO: 7246960 - DNA, 22 bp, Homo sapiens
agtcaacaaaaatgtggagcct

SEQ ID NO: 7246961 - DNA, 22 bp, Homo sapiens
aggtctacatgcttaatatatc

SEQ ID NO: 7246962 - DNA, 22 bp, Homo sapiens
aggtctcactttgtggaagtga

SEQ ID NO: 7246963 - DNA, 22 bp, Homo sapiens
acctggccagtggggccgcgct

SEQ ID NO: 7246964 - DNA, 22 bp, Homo sapiens
aggtggagatcagggactaagg

SEQ ID NO: 7246965 - DNA, 22 bp, Homo sapiens
acctctgggaaaagtatggaaa

SEQ ID NO: 7246966 - DNA, 22 bp, Homo sapiens
acctctggccttcaggcatcat

SEQ ID NO: 7246967 - DNA, 20 bp, Homo sapiens
accctctgaatagtatctgg

SEQ ID NO: 7246968 - DNA, 22 bp, Homo sapiens
accctctgagaggcacactttg

SEQ ID NO: 7246969 - DNA, 22 bp, Homo sapiens
accctctgccttgagcagtgcc

SEQ ID NO: 7246970 - DNA, 22 bp, Homo sapiens
accctctgcatcagcttcttta

SEQ ID NO: 7246971 - DNA, 19 bp, Homo sapiens
accctctgccacaagcctc

SEQ ID NO: 7246972 - DNA, 22 bp, Homo sapiens
actgaggcccgaggatctcctg

SEQ ID NO: 7246973 - DNA, 22 bp, Homo sapiens
actgaggacagtgaggagggct

SEQ ID NO: 7246974 - DNA, 22 bp, Homo sapiens
actgaggcagtgaggtcggtct

SEQ ID NO: 7246975 - DNA, 22 bp, Homo sapiens
actctgtcacctactcactgta

SEQ ID NO: 7246976 - DNA, 22 bp, Homo sapiens
actctgtcttcatatttgcatt

SEQ ID NO: 7246977 - DNA, 21 bp, Homo sapiens
actctgtcttgagccatctgt

SEQ ID NO: 7246978 - DNA, 22 bp, Homo sapiens
agtgcagggggaaagggtgtct

SEQ ID NO: 7246979 - DNA, 22 bp, Homo sapiens
agtgcagggggaaagggtgtct

SEQ ID NO: 7246980 - DNA, 22 bp, Homo sapiens
agtgcaattttgctttcccaat

SEQ ID NO: 7246981 - DNA, 22 bp, Homo sapiens
agtgcaggttaaggaactggcc

SEQ ID NO: 7246982 - DNA, 22 bp, Homo sapiens
agtgcaggttaaggaactggcc

SEQ ID NO: 7246983 - DNA, 17 bp, Homo sapiens
actcctggtctgaaggg

SEQ ID NO: 7246984 - DNA, 22 bp, Homo sapiens
actcctgggttgcagtcctcaa

SEQ ID NO: 7246985 - DNA, 22 bp, Homo sapiens
actggaatgaagttaatctgat

SEQ ID NO: 7246986 - DNA, 21 bp, Homo sapiens
agtgtgtgataggcaggaaga

SEQ ID NO: 7246987 - DNA, 22 bp, Homo sapiens
agtgttctttgcatgaggatag

SEQ ID NO: 7246988 - DNA, 22 bp, Homo sapiens
agtgttggaccgaggtggagcc

SEQ ID NO: 7246989 - DNA, 22 bp, Homo sapiens
agtggcagtagatgagctggtt

SEQ ID NO: 7246990 - DNA, 22 bp, Homo sapiens
agtggcagtggaaagcacacgg

SEQ ID NO: 7246991 - DNA, 22 bp, Homo sapiens
agtggcagtggctgggcagagc

SEQ ID NO: 7246992 - DNA, 22 bp, Homo sapiens
agtgtactgctgcggccgggac

SEQ ID NO: 7246993 - DNA, 22 bp, Homo sapiens
aaagaaggtagggctggtgact

SEQ ID NO: 7246994 - DNA, 22 bp, Homo sapiens
aaactagattaccactgctaga

SEQ ID NO: 7246995 - DNA, 22 bp, Homo sapiens
aaacccagagactagaaagacc

SEQ ID NO: 7246996 - DNA, 22 bp, Homo sapiens
aaaagagcaaacatgtaatagt

SEQ ID NO: 7246997 - DNA, 22 bp, Homo sapiens
aaactagccacacagaatacac

SEQ ID NO: 7246998 - DNA, 22 bp, Homo sapiens
aaactagccaaggagagataga

SEQ ID NO: 7246999 - DNA, 21 bp, Homo sapiens
aaactagcagcaaccatgatc

SEQ ID NO: 7247000 - DNA, 22 bp, Homo sapiens
aaactcagaaggtacagaaggg

SEQ ID NO: 7247001 - DNA, 23 bp, Homo sapiens
aaacaagccctaatgaagagtcc

SEQ ID NO: 7247002 - DNA, 22 bp, Homo sapiens
aaacaagcaagcacataatttt

SEQ ID NO: 7247003 - DNA, 22 bp, Homo sapiens
aaaatccacaacgctcatttca

SEQ ID NO: 7247004 - DNA, 22 bp, Homo sapiens
aaaaatagaaggattgactgag

SEQ ID NO: 7247005 - DNA, 22 bp, Homo sapiens
aaacagaagggtaggtaaacat

SEQ ID NO: 7247006 - DNA, 21 bp, Homo sapiens
aaacagagctgagtaatagat

SEQ ID NO: 7247007 - DNA, 21 bp, Homo sapiens
aaacagagctgagtaatagat

SEQ ID NO: 7247008 - DNA, 22 bp, Homo sapiens
aaaaacagaatgtgtctaactc

SEQ ID NO: 7247009 - DNA, 20 bp, Homo sapiens
aaaaacagtaatgctgaaga

SEQ ID NO: 7247010 - DNA, 23 bp, Homo sapiens
aaaaaaccatgtaggcactcagt

SEQ ID NO: 7247011 - DNA, 22 bp, Homo sapiens
aaaaaattatcatagttcctga

SEQ ID NO: 7247012 - DNA, 22 bp, Homo sapiens
aaaaaattccattctgtgcctt

SEQ ID NO: 7247013 - DNA, 22 bp, Homo sapiens
aaaatagttaacgttcagagta

SEQ ID NO: 7247014 - DNA, 22 bp, Homo sapiens
aaaatagttaacgttcagagta

SEQ ID NO: 7247015 - DNA, 20 bp, Homo sapiens
aaaaacagtaatgctgaaga

SEQ ID NO: 7247016 - DNA, 22 bp, Homo sapiens
aaactagatgattatgaagcat

SEQ ID NO: 7247017 - DNA, 22 bp, Homo sapiens
aaaccttaaaccaagctcttga

SEQ ID NO: 7247018 - DNA, 22 bp, Homo sapiens
aaacccagggttttgtcttccc

SEQ ID NO: 7247019 - DNA, 22 bp, Homo sapiens
aaaggtcaaaatcgtgacattg

SEQ ID NO: 7247020 - DNA, 22 bp, Homo sapiens
aaaggtcattgaaaaggaggaa

SEQ ID NO: 7247021 - DNA, 22 bp, Homo sapiens
aaaggtcagctgccatcgttct

SEQ ID NO: 7247022 - DNA, 22 bp, Homo sapiens
aaaggtcagacttaggctgggc

SEQ ID NO: 7247023 - DNA, 22 bp, Homo sapiens
aaaggtcaagctggactcaggt

SEQ ID NO: 7247024 - DNA, 19 bp, Homo sapiens
aaaggtagtaacctctgat

SEQ ID NO: 7247025 - DNA, 22 bp, Homo sapiens
aaacagtttctaatcatggaga

SEQ ID NO: 7247026 - DNA, 22 bp, Homo sapiens
aaacagtttataacatgatact

SEQ ID NO: 7247027 - DNA, 22 bp, Homo sapiens
aaacagtttcattttcatgacc

SEQ ID NO: 7247028 - DNA, 22 bp, Homo sapiens
aaacaatgtacacatgaatgtt

SEQ ID NO: 7247029 - DNA, 21 bp, Homo sapiens
aaagaggttaatattgtaagt

SEQ ID NO: 7247030 - DNA, 22 bp, Homo sapiens
aaagagggacaggcgcagacac

SEQ ID NO: 7247031 - DNA, 22 bp, Homo sapiens
aaagagttcacggaggccaaag

SEQ ID NO: 7247032 - DNA, 22 bp, Homo sapiens
aaagagttgaggcagttatcca

SEQ ID NO: 7247033 - DNA, 22 bp, Homo sapiens
aaagagtttacaaattaggtaa

SEQ ID NO: 7247034 - DNA, 22 bp, Homo sapiens
aaagagtttacaaattaggtaa

SEQ ID NO: 7247035 - DNA, 22 bp, Homo sapiens
aaagagcatggaaagttcagga

SEQ ID NO: 7247036 - DNA, 22 bp, Homo sapiens
aaagagcaccctcaatgtctga

SEQ ID NO: 7247037 - DNA, 22 bp, Homo sapiens
aaatgcagcagctaattgaaaa

SEQ ID NO: 7247038 - DNA, 22 bp, Homo sapiens
aaagaactaatgtgcaaggttt

SEQ ID NO: 7247039 - DNA, 22 bp, Homo sapiens
aaactgcaatgacaggtaggag

SEQ ID NO: 7247040 - DNA, 22 bp, Homo sapiens
aaagaactacctgtatgatatt

SEQ ID NO: 7247041 - DNA, 22 bp, Homo sapiens
aaagaataccctgggtcataaa

SEQ ID NO: 7247042 - DNA, 22 bp, Homo sapiens
aaagtgcagtaacttgcccaag

SEQ ID NO: 7247043 - DNA, 22 bp, Homo sapiens
aaagtagttagtcatgtgaaaa

SEQ ID NO: 7247044 - DNA, 22 bp, Homo sapiens
aaagtagcagtaattatgaaat

SEQ ID NO: 7247045 - DNA, 22 bp, Homo sapiens
aaagtatttgtgatttttacca

SEQ ID NO: 7247046 - DNA, 22 bp, Homo sapiens
aaagtatttttgacaggcatta

SEQ ID NO: 7247047 - DNA, 22 bp, Homo sapiens
aaaggttttcatcacagcaaga

SEQ ID NO: 7247048 - DNA, 22 bp, Homo sapiens
aaagtaattgtggtttctgtca

SEQ ID NO: 7247049 - DNA, 22 bp, Homo sapiens
aaagtaattgtggttcttgcca

SEQ ID NO: 7247050 - DNA, 22 bp, Homo sapiens
aaagtaattgtggtttctgtca

SEQ ID NO: 7247051 - DNA, 22 bp, Homo sapiens
aaagtagaggcattgatcaggt

SEQ ID NO: 7247052 - DNA, 22 bp, Homo sapiens
aaagagtttccattgacatttc

SEQ ID NO: 7247053 - DNA, 22 bp, Homo sapiens
aaattttgtattctagttctag

SEQ ID NO: 7247054 - DNA, 22 bp, Homo sapiens
aaattttcagagcactagagaa

SEQ ID NO: 7247055 - DNA, 22 bp, Homo sapiens
aaagccagtggtatgagagaaa

SEQ ID NO: 7247056 - DNA, 22 bp, Homo sapiens
aaagccagttcttagagaaagc

SEQ ID NO: 7247057 - DNA, 22 bp, Homo sapiens
aaagccagttcttagagaaagc

SEQ ID NO: 7247058 - DNA, 22 bp, Homo sapiens
aaagccagttcttttatattgg

SEQ ID NO: 7247059 - DNA, 22 bp, Homo sapiens
aaagccacgtggcctggggagc

SEQ ID NO: 7247060 - DNA, 22 bp, Homo sapiens
aaagctcttttccaagtattga

SEQ ID NO: 7247061 - DNA, 22 bp, Homo sapiens
aaagctcttgggagggttaatt

SEQ ID NO: 7247062 - DNA, 22 bp, Homo sapiens
aaagctctttcacttccgttct

SEQ ID NO: 7247063 - DNA, 22 bp, Homo sapiens
aaagctctttcttctttggcat

SEQ ID NO: 7247064 - DNA, 22 bp, Homo sapiens
aaagctctttgtatagtggaat

SEQ ID NO: 7247065 - DNA, 23 bp, Homo sapiens
aaagcttaactgggtaataaagc

SEQ ID NO: 7247066 - DNA, 22 bp, Homo sapiens
aaagcttatttgtatgcatgtt

SEQ ID NO: 7247067 - DNA, 22 bp, Homo sapiens
aaagcttaggatagggaatata

SEQ ID NO: 7247068 - DNA, 22 bp, Homo sapiens
aaagcttagcattttcaaaatg

SEQ ID NO: 7247069 - DNA, 22 bp, Homo sapiens
aaagcttagaggccagtggagg

SEQ ID NO: 7247070 - DNA, 22 bp, Homo sapiens
aaagcttaccttttcagtcttt

SEQ ID NO: 7247071 - DNA, 22 bp, Homo sapiens
aaagcttaaggtaggtacagag

SEQ ID NO: 7247072 - DNA, 22 bp, Homo sapiens
aacagagtttcaaataacatct

SEQ ID NO: 7247073 - DNA, 22 bp, Homo sapiens
aaagctcttggattttagactc

SEQ ID NO: 7247074 - DNA, 22 bp, Homo sapiens
aaagctcttatgtaaacagaaa

SEQ ID NO: 7247075 - DNA, 22 bp, Homo sapiens
aaagctcttatagcagagtgtg

SEQ ID NO: 7247076 - DNA, 22 bp, Homo sapiens
aaatgtattgcataggatattt

SEQ ID NO: 7247077 - DNA, 22 bp, Homo sapiens
aaatgtactgatacttatttta

SEQ ID NO: 7247078 - DNA, 18 bp, Homo sapiens
aaatgtactgtccatggc

SEQ ID NO: 7247079 - DNA, 22 bp, Homo sapiens
aaatgtaccttgatagtttggt

SEQ ID NO: 7247080 - DNA, 22 bp, Homo sapiens
aagctctttccactaaaccact

SEQ ID NO: 7247081 - DNA, 22 bp, Homo sapiens
aagctctttccctcttcagaac

SEQ ID NO: 7247082 - DNA, 22 bp, Homo sapiens
aagctcttttacaatcctaggc

SEQ ID NO: 7247083 - DNA, 22 bp, Homo sapiens
aagctctttgacctgggcctgg

SEQ ID NO: 7247084 - DNA, 22 bp, Homo sapiens
aagctcttttacaatcctaggc

SEQ ID NO: 7247085 - DNA, 22 bp, Homo sapiens
aagctcttttcaccattaaagt

SEQ ID NO: 7247086 - DNA, 22 bp, Homo sapiens
aagctcttttcataagagcaaa

SEQ ID NO: 7247087 - DNA, 22 bp, Homo sapiens
aagctctttaatagtctaaaaa

SEQ ID NO: 7247088 - DNA, 22 bp, Homo sapiens
aagctcttgttgaatcttgtca

SEQ ID NO: 7247089 - DNA, 22 bp, Homo sapiens
aagctcttgagtaaactagttt

SEQ ID NO: 7247090 - DNA, 22 bp, Homo sapiens
aagctcttttctgcctcaccca

SEQ ID NO: 7247091 - DNA, 22 bp, Homo sapiens
aaatgtacactttgcatcttga

SEQ ID NO: 7247092 - DNA, 22 bp, Homo sapiens
aaatgtacaacatccatatata

SEQ ID NO: 7247093 - DNA, 22 bp, Homo sapiens
aaatggcagcccagaggtaagg

SEQ ID NO: 7247094 - DNA, 20 bp, Homo sapiens
aagcatctggatgtagcaat

SEQ ID NO: 7247095 - DNA, 22 bp, Homo sapiens
aagcatcattcacttccttctg

SEQ ID NO: 7247096 - DNA, 22 bp, Homo sapiens
aaatgcagctgggcatgagagg

SEQ ID NO: 7247097 - DNA, 22 bp, Homo sapiens
aagcacagctggaacagcagga

SEQ ID NO: 7247098 - DNA, 22 bp, Homo sapiens
aagcacagccaggttaggggct

SEQ ID NO: 7247099 - DNA, 22 bp, Homo sapiens
aagcacagcagagccttgcttg

SEQ ID NO: 7247100 - DNA, 22 bp, Homo sapiens
aagcacagattgctgcatccat

SEQ ID NO: 7247101 - DNA, 22 bp, Homo sapiens
aagcacagatgcaagggggacc

SEQ ID NO: 7247102 - DNA, 22 bp, Homo sapiens
aaatgcaggttcttgagccaag

SEQ ID NO: 7247103 - DNA, 22 bp, Homo sapiens
aagcacagactccctctgagtg

SEQ ID NO: 7247104 - DNA, 22 bp, Homo sapiens
aagcacagaccagatctccagg

SEQ ID NO: 7247105 - DNA, 22 bp, Homo sapiens
aagcacagacacaaaaggcttt

SEQ ID NO: 7247106 - DNA, 23 bp, Homo sapiens
aagcacagaatggtttaggagtt

SEQ ID NO: 7247107 - DNA, 22 bp, Homo sapiens
aagcacagagaggtaaagtaac

SEQ ID NO: 7247108 - DNA, 22 bp, Homo sapiens
aagcacagagaggtaaagtaac

SEQ ID NO: 7247109 - DNA, 22 bp, Homo sapiens
aagcacagataaaacaggattc

SEQ ID NO: 7247110 - DNA, 22 bp, Homo sapiens
aagcacagagatgggcacgcct

SEQ ID NO: 7247111 - DNA, 22 bp, Homo sapiens
aaatagagctgggttaaacttt

SEQ ID NO: 7247112 - DNA, 22 bp, Homo sapiens
aaatagatttaacatccatccc

SEQ ID NO: 7247113 - DNA, 22 bp, Homo sapiens
aaataggaatgtggtcctggga

SEQ ID NO: 7247114 - DNA, 22 bp, Homo sapiens
aaatcagattatttgattggca

SEQ ID NO: 7247115 - DNA, 22 bp, Homo sapiens
aaatcagatgcttcctagttgg

SEQ ID NO: 7247116 - DNA, 22 bp, Homo sapiens
aaatcagagtggttggtcatcc

SEQ ID NO: 7247117 - DNA, 22 bp, Homo sapiens
aaatcccactcagaaactgcca

SEQ ID NO: 7247118 - DNA, 22 bp, Homo sapiens
aaataagaggacagatgtttgg

SEQ ID NO: 7247119 - DNA, 22 bp, Homo sapiens
aaataagaaattcttctttgca

SEQ ID NO: 7247120 - DNA, 22 bp, Homo sapiens
aaataattatagcgagtctatc

SEQ ID NO: 7247121 - DNA, 22 bp, Homo sapiens
aaataagttaaactagaatgat

SEQ ID NO: 7247122 - DNA, 22 bp, Homo sapiens
aagagattcctcactcagaatg

SEQ ID NO: 7247123 - DNA, 17 bp, Homo sapiens
aagagaggctgagctgg

SEQ ID NO: 7247124 - DNA, 22 bp, Homo sapiens
acaaagatcttgctttcctact

SEQ ID NO: 7247125 - DNA, 22 bp, Homo sapiens
acaaagattcatttgcattatt

SEQ ID NO: 7247126 - DNA, 22 bp, Homo sapiens
aagagagaacacagcttgggca

SEQ ID NO: 7247127 - DNA, 22 bp, Homo sapiens
acaaagagggaccagtgacttg

SEQ ID NO: 7247128 - DNA, 22 bp, Homo sapiens
aagagctgcatctaagccatga

SEQ ID NO: 7247129 - DNA, 22 bp, Homo sapiens
aagagctgattaagtcatgagg

SEQ ID NO: 7247130 - DNA, 20 bp, Homo sapiens
aagagctgactcacagtggt

SEQ ID NO: 7247131 - DNA, 22 bp, Homo sapiens
aagagctggcccaatctgagca

SEQ ID NO: 7247132 - DNA, 22 bp, Homo sapiens
aagagctggaagtgaagataac

SEQ ID NO: 7247133 - DNA, 22 bp, Homo sapiens
aagagctggagtttgcagccct

SEQ ID NO: 7247134 - DNA, 22 bp, Homo sapiens
aagagctggagtttgcagccct

SEQ ID NO: 7247135 - DNA, 22 bp, Homo sapiens
aagagctggctcttgcagcagc

SEQ ID NO: 7247136 - DNA, 22 bp, Homo sapiens
aagagctgtatgccatatgatt

SEQ ID NO: 7247137 - DNA, 22 bp, Homo sapiens
aagagctgtgggtggtagtcct

SEQ ID NO: 7247138 - DNA, 22 bp, Homo sapiens
aacttatacccagggcagaaat

SEQ ID NO: 7247139 - DNA, 22 bp, Homo sapiens
aacttcatgggttcaaagctgg

SEQ ID NO: 7247140 - DNA, 22 bp, Homo sapiens
aagaaagcattagacaggcatt

SEQ ID NO: 7247141 - DNA, 22 bp, Homo sapiens
aagaaatacatggtttttgagt

SEQ ID NO: 7247142 - DNA, 22 bp, Homo sapiens
aagaaatattgggccttataaa

SEQ ID NO: 7247143 - DNA, 22 bp, Homo sapiens
aatgttttatagctcaagcaat

SEQ ID NO: 7247144 - DNA, 22 bp, Homo sapiens
aatgttttaaaagagattgaga

SEQ ID NO: 7247145 - DNA, 22 bp, Homo sapiens
aatgttttcccagtgcagacga

SEQ ID NO: 7247146 - DNA, 22 bp, Homo sapiens
aagaataaattaagatacttag

SEQ ID NO: 7247147 - DNA, 22 bp, Homo sapiens
aagaataagaggatttagaaca

SEQ ID NO: 7247148 - DNA, 22 bp, Homo sapiens
aagaataagaggatttagaaca

SEQ ID NO: 7247149 - DNA, 22 bp, Homo sapiens
aagaatatagattttttgaagt

SEQ ID NO: 7247150 - DNA, 22 bp, Homo sapiens
aagacaggaaaagctccaggcc

SEQ ID NO: 7247151 - DNA, 22 bp, Homo sapiens
aagacaggaaaagctccaggcc

SEQ ID NO: 7247152 - DNA, 22 bp, Homo sapiens
aagacagatgcaacctgctagc

SEQ ID NO: 7247153 - DNA, 22 bp, Homo sapiens
aagatttactttctttgtaata

SEQ ID NO: 7247154 - DNA, 22 bp, Homo sapiens
aagcacaggatcttgaggagcg

SEQ ID NO: 7247155 - DNA, 22 bp, Homo sapiens
aagcacagggactcaggaccgg

SEQ ID NO: 7247156 - DNA, 22 bp, Homo sapiens
aagcacaggatcttgaggagcg

SEQ ID NO: 7247157 - DNA, 22 bp, Homo sapiens
aagcacaggagacgcacagcca

SEQ ID NO: 7247158 - DNA, 22 bp, Homo sapiens
aagcacagaaaaggagcatgga

SEQ ID NO: 7247159 - DNA, 22 bp, Homo sapiens
aagcacaggttgaggattattc

SEQ ID NO: 7247160 - DNA, 18 bp, Homo sapiens
aagcacaggtgtttcagg

SEQ ID NO: 7247161 - DNA, 22 bp, Homo sapiens
aagcacagggtgtctgcattca

SEQ ID NO: 7247162 - DNA, 22 bp, Homo sapiens
aagcacaggggaaataagttgt

SEQ ID NO: 7247163 - DNA, 22 bp, Homo sapiens
aagcacaggggaaataagttgt

SEQ ID NO: 7247164 - DNA, 22 bp, Homo sapiens
aagcacagggactttaggaata

SEQ ID NO: 7247165 - DNA, 22 bp, Homo sapiens
aagcacagtgccaagttctatt

SEQ ID NO: 7247166 - DNA, 22 bp, Homo sapiens
aagcacagtaaaagcagatttt

SEQ ID NO: 7247167 - DNA, 22 bp, Homo sapiens
aagcacagtgggcagagcagcc

SEQ ID NO: 7247168 - DNA, 22 bp, Homo sapiens
acacagggtctagagttaggcc

SEQ ID NO: 7247169 - DNA, 22 bp, Homo sapiens
acacaggggctcggctgggtgc

SEQ ID NO: 7247170 - DNA, 22 bp, Homo sapiens
acacaggggaaagtggagctga

SEQ ID NO: 7247171 - DNA, 22 bp, Homo sapiens
aagcatatattttatatgttgt

SEQ ID NO: 7247172 - DNA, 22 bp, Homo sapiens
acagcagctaacccctgggcca

SEQ ID NO: 7247173 - DNA, 22 bp, Homo sapiens
aagcatttggcatgaaactctt

SEQ ID NO: 7247174 - DNA, 22 bp, Homo sapiens
acagcagcttcctgactgtact

SEQ ID NO: 7247175 - DNA, 22 bp, Homo sapiens
acagcagctgggttcccaccat

SEQ ID NO: 7247176 - DNA, 22 bp, Homo sapiens
acagcagctgccttcaggctct

SEQ ID NO: 7247177 - DNA, 22 bp, Homo sapiens
acagcagcttgcgtgtctggtc

SEQ ID NO: 7247178 - DNA, 22 bp, Homo sapiens
acagcagcttgtctgttcttta

SEQ ID NO: 7247179 - DNA, 22 bp, Homo sapiens
aagccaatcgtgtgaacttagt

SEQ ID NO: 7247180 - DNA, 22 bp, Homo sapiens
acagaattgaaagtataatctg

SEQ ID NO: 7247181 - DNA, 22 bp, Homo sapiens
aagcagctgatttcacagctca

SEQ ID NO: 7247182 - DNA, 22 bp, Homo sapiens
acagagtagctcaagaagattg

SEQ ID NO: 7247183 - DNA, 22 bp, Homo sapiens
acagagtagctcaagaagattg

SEQ ID NO: 7247184 - DNA, 20 bp, Homo sapiens
acagagtagaacatatgcca

SEQ ID NO: 7247185 - DNA, 22 bp, Homo sapiens
acagagtacattcagagactat

SEQ ID NO: 7247186 - DNA, 22 bp, Homo sapiens
acagagtacattcagagactat

SEQ ID NO: 7247187 - DNA, 22 bp, Homo sapiens
acagagtaaatccaagaacgct

SEQ ID NO: 7247188 - DNA, 22 bp, Homo sapiens
aagcatagagacacaaatttgg

SEQ ID NO: 7247189 - DNA, 22 bp, Homo sapiens
acagagtatctatcaggagtat

SEQ ID NO: 7247190 - DNA, 21 bp, Homo sapiens
acagagtagttgaaacagaga

SEQ ID NO: 7247191 - DNA, 22 bp, Homo sapiens
acagagtaggtgctcagtaaat

SEQ ID NO: 7247192 - DNA, 22 bp, Homo sapiens
aacagcttgaggaatatcatca

SEQ ID NO: 7247193 - DNA, 22 bp, Homo sapiens
aacagcttgaggaatatcatca

SEQ ID NO: 7247194 - DNA, 22 bp, Homo sapiens
aacactaaaggtcagttagaag

SEQ ID NO: 7247195 - DNA, 22 bp, Homo sapiens
aaggtcaagacacaggaatcta

SEQ ID NO: 7247196 - DNA, 22 bp, Homo sapiens
aaggtcaacactgattttagtc

SEQ ID NO: 7247197 - DNA, 22 bp, Homo sapiens
aaggtcaaagacagtaactttt

SEQ ID NO: 7247198 - DNA, 22 bp, Homo sapiens
aaatgtgttcctttgctacaga

SEQ ID NO: 7247199 - DNA, 22 bp, Homo sapiens
aaattcactctgttcctcatgg

SEQ ID NO: 7247200 - DNA, 22 bp, Homo sapiens
aaatgttttgctcccatgtggt

SEQ ID NO: 7247201 - DNA, 22 bp, Homo sapiens
aaatgtttaagtgtaggagcaa

SEQ ID NO: 7247202 - DNA, 22 bp, Homo sapiens
aaatgtttaagtgtaggagcaa

SEQ ID NO: 7247203 - DNA, 22 bp, Homo sapiens
aaatgtttctacttgtgagcat

SEQ ID NO: 7247204 - DNA, 22 bp, Homo sapiens
aaattcacttgcctgcttagct

SEQ ID NO: 7247205 - DNA, 22 bp, Homo sapiens
aaatgtgtgcacaaagacagct

SEQ ID NO: 7247206 - DNA, 22 bp, Homo sapiens
aaatgtgtatatgaaacatgat

SEQ ID NO: 7247207 - DNA, 22 bp, Homo sapiens
aagctgaggatacatgaagcct

SEQ ID NO: 7247208 - DNA, 22 bp, Homo sapiens
aaattgcagatgctaaatgact

SEQ ID NO: 7247209 - DNA, 22 bp, Homo sapiens
aacaaagtagctgctgttctta

SEQ ID NO: 7247210 - DNA, 22 bp, Homo sapiens
aacaaaggccgttaataaccac

SEQ ID NO: 7247211 - DNA, 22 bp, Homo sapiens
aacttaaacccactcatgtaga

SEQ ID NO: 7247212 - DNA, 22 bp, Homo sapiens
aactgtttaccatacacagtga

SEQ ID NO: 7247213 - DNA, 22 bp, Homo sapiens
aactgttattattttgcatggt

SEQ ID NO: 7247214 - DNA, 22 bp, Homo sapiens
aactgcatgtgtgtggcatgat

SEQ ID NO: 7247215 - DNA, 22 bp, Homo sapiens
aactgaaacgtatttttgagat

SEQ ID NO: 7247216 - DNA, 22 bp, Homo sapiens
aactgaaacttaggaagtaatc

SEQ ID NO: 7247217 - DNA, 22 bp, Homo sapiens
aatcatgtttacgtgacatgtc

SEQ ID NO: 7247218 - DNA, 22 bp, Homo sapiens
aatcatgacaggaatagaaggg

SEQ ID NO: 7247219 - DNA, 21 bp, Homo sapiens
aactacagttgttccttcatt

SEQ ID NO: 7247220 - DNA, 22 bp, Homo sapiens
aactacagcatctatacaaata

SEQ ID NO: 7247221 - DNA, 22 bp, Homo sapiens
aactacagggggtggcaggcgg

SEQ ID NO: 7247222 - DNA, 22 bp, Homo sapiens
aactacagtagtttgcccttct

SEQ ID NO: 7247223 - DNA, 22 bp, Homo sapiens
aatataatgctgttttatgcca

SEQ ID NO: 7247224 - DNA, 22 bp, Homo sapiens
aactacagaatcatagaaaata

SEQ ID NO: 7247225 - DNA, 22 bp, Homo sapiens
aataagaaagagtcagcttcag

SEQ ID NO: 7247226 - DNA, 22 bp, Homo sapiens
aaccaagagggttttccttgaa

SEQ ID NO: 7247227 - DNA, 22 bp, Homo sapiens
aatagtttgaatttatcagatg

SEQ ID NO: 7247228 - DNA, 22 bp, Homo sapiens
aatagtttgaatttatcagatg

SEQ ID NO: 7247229 - DNA, 22 bp, Homo sapiens
aatataaattcctgggcccagc

SEQ ID NO: 7247230 - DNA, 22 bp, Homo sapiens
aacaggcctcattccagctctc

SEQ ID NO: 7247231 - DNA, 20 bp, Homo sapiens
aacagggcagaagcggagac

SEQ ID NO: 7247232 - DNA, 22 bp, Homo sapiens
aacatgcatataggtaaatgga

SEQ ID NO: 7247233 - DNA, 22 bp, Homo sapiens
aacatgcagtgagccgatgagg

SEQ ID NO: 7247234 - DNA, 22 bp, Homo sapiens
aacatgctatgtgtctgaatca

SEQ ID NO: 7247235 - DNA, 22 bp, Homo sapiens
aacatgcatttgtgggatggaa

SEQ ID NO: 7247236 - DNA, 18 bp, Homo sapiens
aacatgcattagaactgc

SEQ ID NO: 7247237 - DNA, 22 bp, Homo sapiens
aagggccattgctgagagcagt

SEQ ID NO: 7247238 - DNA, 22 bp, Homo sapiens
aaggctgcttttaacatgcata

SEQ ID NO: 7247239 - DNA, 22 bp, Homo sapiens
aaggctcttggagtgaatgcag

SEQ ID NO: 7247240 - DNA, 22 bp, Homo sapiens
aaggctgtccaggagaaaatag

SEQ ID NO: 7247241 - DNA, 22 bp, Homo sapiens
aaggctgtgtcagaagctccct

SEQ ID NO: 7247242 - DNA, 22 bp, Homo sapiens
aaggtggggtcctgtcatctga

SEQ ID NO: 7247243 - DNA, 22 bp, Homo sapiens
accatgcaggctattttcaaat

SEQ ID NO: 7247244 - DNA, 22 bp, Homo sapiens
accatgggtcagccacctcagc

SEQ ID NO: 7247245 - DNA, 22 bp, Homo sapiens
accatgccagtggcagccagac

SEQ ID NO: 7247246 - DNA, 22 bp, Homo sapiens
aaggtgaggattttgttctgct

SEQ ID NO: 7247247 - DNA, 22 bp, Homo sapiens
aaggtgagagggaaattttcca

SEQ ID NO: 7247248 - DNA, 17 bp, Homo sapiens
aaggtgagagctgttct

SEQ ID NO: 7247249 - DNA, 18 bp, Homo sapiens
aaggtctgtctggtaggt

SEQ ID NO: 7247250 - DNA, 22 bp, Homo sapiens
aagggctgaatgaagggttgaa

SEQ ID NO: 7247251 - DNA, 22 bp, Homo sapiens
aagggctgagcacagtgagcca

SEQ ID NO: 7247252 - DNA, 22 bp, Homo sapiens
aaggtagcttgcttcctgagta

SEQ ID NO: 7247253 - DNA, 22 bp, Homo sapiens
aaggtagggatgtattcagctt

SEQ ID NO: 7247254 - DNA, 23 bp, Homo sapiens
accccaggcatcgcattcctctt

SEQ ID NO: 7247255 - DNA, 22 bp, Homo sapiens
aagtacatgttgttcaaaagcc

SEQ ID NO: 7247256 - DNA, 22 bp, Homo sapiens
aagtacatgttgctcaacagcc

SEQ ID NO: 7247257 - DNA, 22 bp, Homo sapiens
aagtacagaatcattggaagca

SEQ ID NO: 7247258 - DNA, 22 bp, Homo sapiens
aagtacagagcctcagtttgac

SEQ ID NO: 7247259 - DNA, 23 bp, Homo sapiens
aagtacatatatttagatagtga

SEQ ID NO: 7247260 - DNA, 23 bp, Homo sapiens
acagggctgtccagggctaggtc

SEQ ID NO: 7247261 - DNA, 22 bp, Homo sapiens
acagtacagctgaaactttagt

SEQ ID NO: 7247262 - DNA, 22 bp, Homo sapiens
aaggaaaggatgagcatgcatt

SEQ ID NO: 7247263 - DNA, 22 bp, Homo sapiens
acaggcagttgaggtttgtgtg

SEQ ID NO: 7247264 - DNA, 22 bp, Homo sapiens
acaggcaggttgagaaacattt

SEQ ID NO: 7247265 - DNA, 22 bp, Homo sapiens
aagctcttgaatgggatcaagg

SEQ ID NO: 7247266 - DNA, 22 bp, Homo sapiens
aagctcttgaagaccaccagga

SEQ ID NO: 7247267 - DNA, 22 bp, Homo sapiens
aagctcttctgtggatttgagt

SEQ ID NO: 7247268 - DNA, 22 bp, Homo sapiens
aagctcttcttgccaccattca

SEQ ID NO: 7247269 - DNA, 21 bp, Homo sapiens
aagctcttctcagggtcacct

SEQ ID NO: 7247270 - DNA, 22 bp, Homo sapiens
aagctcttcctggagcgcccac

SEQ ID NO: 7247271 - DNA, 22 bp, Homo sapiens
aagctcttcctgcagggacctt

SEQ ID NO: 7247272 - DNA, 22 bp, Homo sapiens
aagccaggccattctctggttc

SEQ ID NO: 7247273 - DNA, 22 bp, Homo sapiens
aagccaggctgcacttgctggg

SEQ ID NO: 7247274 - DNA, 22 bp, Homo sapiens
aaggcagaaagggatgtgagtg

SEQ ID NO: 7247275 - DNA, 21 bp, Homo sapiens
aaggcagaagcatggaatgag

SEQ ID NO: 7247276 - DNA, 21 bp, Homo sapiens
aaggcagaagcatggaatgag

SEQ ID NO: 7247277 - DNA, 22 bp, Homo sapiens
aaggcagaaattcaactactgg

SEQ ID NO: 7247278 - DNA, 19 bp, Homo sapiens
aaggcagaagttggatatg

SEQ ID NO: 7247279 - DNA, 22 bp, Homo sapiens
aaggcagagatattcttgatct

SEQ ID NO: 7247280 - DNA, 22 bp, Homo sapiens
acagtagctaatattgcattat

SEQ ID NO: 7247281 - DNA, 22 bp, Homo sapiens
acagtagagtaaaagggagcct

SEQ ID NO: 7247282 - DNA, 22 bp, Homo sapiens
acagtagaccctggataaacat

SEQ ID NO: 7247283 - DNA, 22 bp, Homo sapiens
acagtagaccctggataaacat

SEQ ID NO: 7247284 - DNA, 22 bp, Homo sapiens
acagttctaaatcttggataat

SEQ ID NO: 7247285 - DNA, 23 bp, Homo sapiens
acagttctctgatgggtttaaca

SEQ ID NO: 7247286 - DNA, 22 bp, Homo sapiens
acagttctgcctgtttgagaag

SEQ ID NO: 7247287 - DNA, 22 bp, Homo sapiens
acagttctgagctataattgct

SEQ ID NO: 7247288 - DNA, 22 bp, Homo sapiens
acagttctttgtttatagcttg

SEQ ID NO: 7247289 - DNA, 22 bp, Homo sapiens
acagttgttttccagatatgtt

SEQ ID NO: 7247290 - DNA, 22 bp, Homo sapiens
acagtttacagggatttgagct

SEQ ID NO: 7247291 - DNA, 22 bp, Homo sapiens
acagtttacagggatttgagct

SEQ ID NO: 7247292 - DNA, 22 bp, Homo sapiens
aaggcagatataaagactagag

SEQ ID NO: 7247293 - DNA, 22 bp, Homo sapiens
aaggcagatataaagactagag

SEQ ID NO: 7247294 - DNA, 22 bp, Homo sapiens
aatgaacagatacacataggca

SEQ ID NO: 7247295 - DNA, 22 bp, Homo sapiens
aatgaacaggtgaatgtcagat

SEQ ID NO: 7247296 - DNA, 22 bp, Homo sapiens
agaaataagagctttccttggg

SEQ ID NO: 7247297 - DNA, 18 bp, Homo sapiens
agaaataccagtattgga

SEQ ID NO: 7247298 - DNA, 22 bp, Homo sapiens
aatgagaatgtaagtgaagaga

SEQ ID NO: 7247299 - DNA, 22 bp, Homo sapiens
aatgagaaccttgaaaggaact

SEQ ID NO: 7247300 - DNA, 22 bp, Homo sapiens
aatgagaaaacacagaggaggt

SEQ ID NO: 7247301 - DNA, 22 bp, Homo sapiens
aatgagccaatgtttatgaagt

SEQ ID NO: 7247302 - DNA, 20 bp, Homo sapiens
aatgagttattttgtatatg

SEQ ID NO: 7247303 - DNA, 18 bp, Homo sapiens
agaaggagctatgggcag

SEQ ID NO: 7247304 - DNA, 19 bp, Homo sapiens
aatattttagcctcttcct

SEQ ID NO: 7247305 - DNA, 22 bp, Homo sapiens
acttgagagaatcggaggagtc

SEQ ID NO: 7247306 - DNA, 22 bp, Homo sapiens
acttgagaaaccaagtagaaag

SEQ ID NO: 7247307 - DNA, 22 bp, Homo sapiens
aatatatagaagtacccgttgt

SEQ ID NO: 7247308 - DNA, 21 bp, Homo sapiens
acttgaagttggagtttctgt

SEQ ID NO: 7247309 - DNA, 21 bp, Homo sapiens
aatacagaaatgagtagttgc

SEQ ID NO: 7247310 - DNA, 22 bp, Homo sapiens
aatacagagaatgttatttgga

SEQ ID NO: 7247311 - DNA, 22 bp, Homo sapiens
aatacagagaatgttatttgga

SEQ ID NO: 7247312 - DNA, 22 bp, Homo sapiens
aatcaagaaaatgaggattctt

SEQ ID NO: 7247313 - DNA, 22 bp, Homo sapiens
aatcaacaggatgtgcattgta

SEQ ID NO: 7247314 - DNA, 22 bp, Homo sapiens
aatattttaggctttccaggct

SEQ ID NO: 7247315 - DNA, 22 bp, Homo sapiens
aagtcagcactccaggaagcca

SEQ ID NO: 7247316 - DNA, 22 bp, Homo sapiens
aagtcacagctaaatagctaag

SEQ ID NO: 7247317 - DNA, 21 bp, Homo sapiens
aagtggagaagaaaagctgga

SEQ ID NO: 7247318 - DNA, 22 bp, Homo sapiens
aagtggagagccctggaggtct

SEQ ID NO: 7247319 - DNA, 22 bp, Homo sapiens
aagtggagccagggaaactgaa

SEQ ID NO: 7247320 - DNA, 22 bp, Homo sapiens
aagtggagctataggctcagat

SEQ ID NO: 7247321 - DNA, 22 bp, Homo sapiens
actccagttctcttgtttataa

SEQ ID NO: 7247322 - DNA, 22 bp, Homo sapiens
aagtgttttctccccaccaggc

SEQ ID NO: 7247323 - DNA, 22 bp, Homo sapiens
aataagaattgccagatttgaa

SEQ ID NO: 7247324 - DNA, 22 bp, Homo sapiens
aagtttctcaatggcaactggg

SEQ ID NO: 7247325 - DNA, 22 bp, Homo sapiens
aagtttctacatctccatcata

SEQ ID NO: 7247326 - DNA, 22 bp, Homo sapiens
aagtttctattattacattcgt

SEQ ID NO: 7247327 - DNA, 22 bp, Homo sapiens
aagtttatctttgctgggtact

SEQ ID NO: 7247328 - DNA, 22 bp, Homo sapiens
aagtttatgttggtaagatatc

SEQ ID NO: 7247329 - DNA, 22 bp, Homo sapiens
aagtttatgttctttgaaggca

SEQ ID NO: 7247330 - DNA, 22 bp, Homo sapiens
aagtttacataagtgatgatga

SEQ ID NO: 7247331 - DNA, 22 bp, Homo sapiens
aagttgtagatgaagtaattca

SEQ ID NO: 7247332 - DNA, 22 bp, Homo sapiens
aagtttaacttgaattctttct

SEQ ID NO: 7247333 - DNA, 22 bp, Homo sapiens
aagtttaaggtggaagtggtgg

SEQ ID NO: 7247334 - DNA, 22 bp, Homo sapiens
aataattttagctcagagttgt

SEQ ID NO: 7247335 - DNA, 22 bp, Homo sapiens
aatacaatcaaattcactagca

SEQ ID NO: 7247336 - DNA, 22 bp, Homo sapiens
aataattttgagagcctggaaa

SEQ ID NO: 7247337 - DNA, 22 bp, Homo sapiens
aataatttccagccaactggaa

SEQ ID NO: 7247338 - DNA, 22 bp, Homo sapiens
agacagggccactcatcctcac

SEQ ID NO: 7247339 - DNA, 22 bp, Homo sapiens
agacagggagggagcgcggctg

SEQ ID NO: 7247340 - DNA, 22 bp, Homo sapiens
agacagggagggagcgcggctg

SEQ ID NO: 7247341 - DNA, 22 bp, Homo sapiens
agacagggtcttgatcagagct

SEQ ID NO: 7247342 - DNA, 19 bp, Homo sapiens
agacagagctcagtgggtt

SEQ ID NO: 7247343 - DNA, 19 bp, Homo sapiens
agacagagctcagtgggtt

SEQ ID NO: 7247344 - DNA, 21 bp, Homo sapiens
agacagagtgcagtctacata

SEQ ID NO: 7247345 - DNA, 21 bp, Homo sapiens
agacagagtgcagtctacata

SEQ ID NO: 7247346 - DNA, 22 bp, Homo sapiens
agacaggccactctggtctggt

SEQ ID NO: 7247347 - DNA, 22 bp, Homo sapiens
agaaggggcccaaggatgtcag

SEQ ID NO: 7247348 - DNA, 22 bp, Homo sapiens
agaaggggagaagctaccagga

SEQ ID NO: 7247349 - DNA, 22 bp, Homo sapiens
agaaggggcccaaggatgtcag

SEQ ID NO: 7247350 - DNA, 22 bp, Homo sapiens
agaagggccagctggacacctg

SEQ ID NO: 7247351 - DNA, 23 bp, Homo sapiens
agaagggtccttggcagcgacag

SEQ ID NO: 7247352 - DNA, 22 bp, Homo sapiens
aatgtttgcatctattcacatg

SEQ ID NO: 7247353 - DNA, 22 bp, Homo sapiens
aatgtttgagcatctacatgct

SEQ ID NO: 7247354 - DNA, 22 bp, Homo sapiens
aatgtttgaccaaaaaactgca

SEQ ID NO: 7247355 - DNA, 19 bp, Homo sapiens
aatgtttaagagaaaaagg

SEQ ID NO: 7247356 - DNA, 22 bp, Homo sapiens
aatgttgttctctgcaaacaca

SEQ ID NO: 7247357 - DNA, 22 bp, Homo sapiens
aatgttgtatggtgccttcaga

SEQ ID NO: 7247358 - DNA, 22 bp, Homo sapiens
aatgttcctatttaccccctaa

SEQ ID NO: 7247359 - DNA, 22 bp, Homo sapiens
aatgttcagaggacaatataaa

SEQ ID NO: 7247360 - DNA, 20 bp, Homo sapiens
aatttactcacagaatgaat

SEQ ID NO: 7247361 - DNA, 22 bp, Homo sapiens
aatttataataaatagggcttt

SEQ ID NO: 7247362 - DNA, 22 bp, Homo sapiens
aatttatatgtaattaggcaca

SEQ ID NO: 7247363 - DNA, 22 bp, Homo sapiens
aatttatatgtaattaggcaca

SEQ ID NO: 7247364 - DNA, 22 bp, Homo sapiens
acaagggattgttgagtagtct

SEQ ID NO: 7247365 - DNA, 22 bp, Homo sapiens
acaagttaggttttaatccaaa

SEQ ID NO: 7247366 - DNA, 22 bp, Homo sapiens
agatggggcagaatggagccat

SEQ ID NO: 7247367 - DNA, 22 bp, Homo sapiens
acaattctgatggtttcccagt

SEQ ID NO: 7247368 - DNA, 22 bp, Homo sapiens
acaatgttttgaaacatctagg

SEQ ID NO: 7247369 - DNA, 22 bp, Homo sapiens
agcacaggtaatacagagtaac

SEQ ID NO: 7247370 - DNA, 20 bp, Homo sapiens
acaaaataggtactgggtag

SEQ ID NO: 7247371 - DNA, 22 bp, Homo sapiens
acaaacagctaacatatgttaa

SEQ ID NO: 7247372 - DNA, 22 bp, Homo sapiens
agcagggcagttaaagggtcct

SEQ ID NO: 7247373 - DNA, 22 bp, Homo sapiens
agcagggcatgaataagggttt

SEQ ID NO: 7247374 - DNA, 22 bp, Homo sapiens
acactgcagatgtaatttgagt

SEQ ID NO: 7247375 - DNA, 22 bp, Homo sapiens
acaccaccgtcccagcctcctg

SEQ ID NO: 7247376 - DNA, 22 bp, Homo sapiens
acaccaccgtcccagcctcctg

SEQ ID NO: 7247377 - DNA, 20 bp, Homo sapiens
agcagtgtggggagactgtg

SEQ ID NO: 7247378 - DNA, 22 bp, Homo sapiens
agcagttactagttaaatgcat

SEQ ID NO: 7247379 - DNA, 22 bp, Homo sapiens
agcagtggtgtgaggagggctc

SEQ ID NO: 7247380 - DNA, 22 bp, Homo sapiens
agcaccctggggaagcacaaag

SEQ ID NO: 7247381 - DNA, 22 bp, Homo sapiens
acaatttatccattgtatagtt

SEQ ID NO: 7247382 - DNA, 22 bp, Homo sapiens
acaatttatccattgtatagtt

SEQ ID NO: 7247383 - DNA, 22 bp, Homo sapiens
acaatttcttatagttcaattc

SEQ ID NO: 7247384 - DNA, 22 bp, Homo sapiens
agcagcttggggccgagataga

SEQ ID NO: 7247385 - DNA, 20 bp, Homo sapiens
agcaggaaaagtgccagtct

SEQ ID NO: 7247386 - DNA, 23 bp, Homo sapiens
agcaggaaaccgagggtgatgtt

SEQ ID NO: 7247387 - DNA, 21 bp, Homo sapiens
acacaggcagtgtcccgaggt

SEQ ID NO: 7247388 - DNA, 22 bp, Homo sapiens
agcagcagtgtgtggtcatgtt

SEQ ID NO: 7247389 - DNA, 22 bp, Homo sapiens
agctcaagcgtgggctgggcgc

SEQ ID NO: 7247390 - DNA, 22 bp, Homo sapiens
acagcagctaaaggtgtctcct

SEQ ID NO: 7247391 - DNA, 18 bp, Homo sapiens
agctctggggagatgggc

SEQ ID NO: 7247392 - DNA, 22 bp, Homo sapiens
agctctggggcctgtcccacat

SEQ ID NO: 7247393 - DNA, 22 bp, Homo sapiens
agctctgggggaaagtctgctc

SEQ ID NO: 7247394 - DNA, 22 bp, Homo sapiens
acagattgaagtccagaatggc

SEQ ID NO: 7247395 - DNA, 23 bp, Homo sapiens
acagcaagaggaccagatgtgag

SEQ ID NO: 7247396 - DNA, 23 bp, Homo sapiens
acagcaagaggaccagatgtgag

SEQ ID NO: 7247397 - DNA, 23 bp, Homo sapiens
acagcaagaggaccagatgtgag

SEQ ID NO: 7247398 - DNA, 22 bp, Homo sapiens
acagagagggagtgataaatcc

SEQ ID NO: 7247399 - DNA, 22 bp, Homo sapiens
agcccagctttcacccctctgg

SEQ ID NO: 7247400 - DNA, 22 bp, Homo sapiens
agcccagcttccttctgtctct

SEQ ID NO: 7247401 - DNA, 19 bp, Homo sapiens
agcccagcttatttgtcag

SEQ ID NO: 7247402 - DNA, 22 bp, Homo sapiens
acagagcaggtccagaagtgcc

SEQ ID NO: 7247403 - DNA, 22 bp, Homo sapiens
acagagaggtaaaatatatagt

SEQ ID NO: 7247404 - DNA, 22 bp, Homo sapiens
agcccagcggagcgggcccggg

SEQ ID NO: 7247405 - DNA, 22 bp, Homo sapiens
agcccagctcctccacagaata

SEQ ID NO: 7247406 - DNA, 18 bp, Homo sapiens
agcccagcggagtgaatc

SEQ ID NO: 7247407 - DNA, 22 bp, Homo sapiens
agcccagctgctatgtacctgg

SEQ ID NO: 7247408 - DNA, 22 bp, Homo sapiens
agcccagctgcctgcctgctgt

SEQ ID NO: 7247409 - DNA, 22 bp, Homo sapiens
agccacagtcaacctgtccata

SEQ ID NO: 7247410 - DNA, 22 bp, Homo sapiens
agccatcgccgcaggcatctgc

SEQ ID NO: 7247411 - DNA, 22 bp, Homo sapiens
agcccccaggagtctccacgcc

SEQ ID NO: 7247412 - DNA, 23 bp, Homo sapiens
agcccctcatggtgtctagacag

SEQ ID NO: 7247413 - DNA, 19 bp, Homo sapiens
acagagtgatgaggataga

SEQ ID NO: 7247414 - DNA, 22 bp, Homo sapiens
acagagtttatgtgtgtacaaa

SEQ ID NO: 7247415 - DNA, 22 bp, Homo sapiens
acagagttgtgtttgtacaacg

SEQ ID NO: 7247416 - DNA, 22 bp, Homo sapiens
acagagttgtaaacatttacca

SEQ ID NO: 7247417 - DNA, 22 bp, Homo sapiens
acagagttagcagaaagttgga

SEQ ID NO: 7247418 - DNA, 22 bp, Homo sapiens
acagagtggagttcagtaaata

SEQ ID NO: 7247419 - DNA, 19 bp, Homo sapiens
acagagtgatgaggataga

SEQ ID NO: 7247420 - DNA, 17 bp, Homo sapiens
acagagtgtcccgcagt

SEQ ID NO: 7247421 - DNA, 22 bp, Homo sapiens
tcatgcatctgggctggctggt

SEQ ID NO: 7247422 - DNA, 22 bp, Homo sapiens
tcatgcatcaatttctctttag

SEQ ID NO: 7247423 - DNA, 22 bp, Homo sapiens
tcatgcatatggggtcagccca

SEQ ID NO: 7247424 - DNA, 22 bp, Homo sapiens
tcatgcatatttgtagtagttc

SEQ ID NO: 7247425 - DNA, 22 bp, Homo sapiens
tcatgcataatggtgacaacct

SEQ ID NO: 7247426 - DNA, 22 bp, Homo sapiens
tcatgcataaccttgactttgt

SEQ ID NO: 7247427 - DNA, 22 bp, Homo sapiens
tcatttatagaagtgggcagta

SEQ ID NO: 7247428 - DNA, 22 bp, Homo sapiens
tcatttataaggatgcaattaa

SEQ ID NO: 7247429 - DNA, 22 bp, Homo sapiens
tcatttttgaccatgggtagga

SEQ ID NO: 7247430 - DNA, 22 bp, Homo sapiens
tccaaataccagatgggctaat

SEQ ID NO: 7247431 - DNA, 21 bp, Homo sapiens
tccaaacctgtctctggctct

SEQ ID NO: 7247432 - DNA, 18 bp, Homo sapiens
tccaaaatcatgtatttt

SEQ ID NO: 7247433 - DNA, 22 bp, Homo sapiens
tccaaacgggagccaaatgagc

SEQ ID NO: 7247434 - DNA, 22 bp, Homo sapiens
tccaaagaatagaggtgacatt

SEQ ID NO: 7247435 - DNA, 21 bp, Homo sapiens
tccaaatcccattctgtagtc

SEQ ID NO: 7247436 - DNA, 22 bp, Homo sapiens
tccaactccacctttgtctccc

SEQ ID NO: 7247437 - DNA, 22 bp, Homo sapiens
tccaagaagagcctttctcctc

SEQ ID NO: 7247438 - DNA, 22 bp, Homo sapiens
tccaactttctcctccggcttg

SEQ ID NO: 7247439 - DNA, 22 bp, Homo sapiens
tccaaggccgcaggctgggcct

SEQ ID NO: 7247440 - DNA, 22 bp, Homo sapiens
tccaaggcatggtgggagagag

SEQ ID NO: 7247441 - DNA, 19 bp, Homo sapiens
tccaaggcatggcccagtg

SEQ ID NO: 7247442 - DNA, 22 bp, Homo sapiens
tccaaggcatagacacagtgcc

SEQ ID NO: 7247443 - DNA, 22 bp, Homo sapiens
tccaatcagctcctatgagaat

SEQ ID NO: 7247444 - DNA, 22 bp, Homo sapiens
tccaattttctgatttcacttg

SEQ ID NO: 7247445 - DNA, 22 bp, Homo sapiens
tccaattttacgtctgtataaa

SEQ ID NO: 7247446 - DNA, 22 bp, Homo sapiens
tccaatttgtttgatgatggaa

SEQ ID NO: 7247447 - DNA, 19 bp, Homo sapiens
tccaatttgtatgttttca

SEQ ID NO: 7247448 - DNA, 22 bp, Homo sapiens
tccaatttgaaatggtatatgt

SEQ ID NO: 7247449 - DNA, 19 bp, Homo sapiens
tccaatttctattcatgtt

SEQ ID NO: 7247450 - DNA, 20 bp, Homo sapiens
tccaatttaagaatttagag

SEQ ID NO: 7247451 - DNA, 22 bp, Homo sapiens
tccaaggtcagcgagagtcact

SEQ ID NO: 7247452 - DNA, 22 bp, Homo sapiens
tccaaggctccggccctggcgt

SEQ ID NO: 7247453 - DNA, 22 bp, Homo sapiens
tccaaggcctggcagcacaaag

SEQ ID NO: 7247454 - DNA, 22 bp, Homo sapiens
tccaaggctccggccctggcgt

SEQ ID NO: 7247455 - DNA, 22 bp, Homo sapiens
tcaggagagagttgggtaggct

SEQ ID NO: 7247456 - DNA, 22 bp, Homo sapiens
tcagggctgcagaagaggcagg

SEQ ID NO: 7247457 - DNA, 22 bp, Homo sapiens
tcagggctccggaagtggcctc

SEQ ID NO: 7247458 - DNA, 22 bp, Homo sapiens
tcagtacagcttagtcttctca

SEQ ID NO: 7247459 - DNA, 22 bp, Homo sapiens
tcagtatagcttctaaactaac

SEQ ID NO: 7247460 - DNA, 22 bp, Homo sapiens
tcagtctcctttcctctagaca

SEQ ID NO: 7247461 - DNA, 22 bp, Homo sapiens
tcagtctccatctgcttgtctt

SEQ ID NO: 7247462 - DNA, 23 bp, Homo sapiens
tcataaatattagcacagtagga

SEQ ID NO: 7247463 - DNA, 22 bp, Homo sapiens
tcataaatcatactccatttgc

SEQ ID NO: 7247464 - DNA, 22 bp, Homo sapiens
tcatagaatgagttaatgaact

SEQ ID NO: 7247465 - DNA, 18 bp, Homo sapiens
tcatagaagtgaatcaga

SEQ ID NO: 7247466 - DNA, 22 bp, Homo sapiens
tcatagaagtagtatccacatt

SEQ ID NO: 7247467 - DNA, 22 bp, Homo sapiens
tcatagaaggaactgggagata

SEQ ID NO: 7247468 - DNA, 22 bp, Homo sapiens
tcatagaagcaccagaagatat

SEQ ID NO: 7247469 - DNA, 22 bp, Homo sapiens
tcatagaaatgtggccagaaac

SEQ ID NO: 7247470 - DNA, 22 bp, Homo sapiens
tcatagaaatggaaagtatatt

SEQ ID NO: 7247471 - DNA, 22 bp, Homo sapiens
tcatagaaatggaaagtatatt

SEQ ID NO: 7247472 - DNA, 22 bp, Homo sapiens
tcatacattcagcagatatttg

SEQ ID NO: 7247473 - DNA, 22 bp, Homo sapiens
tcataaatgcagtgtcataaat

SEQ ID NO: 7247474 - DNA, 22 bp, Homo sapiens
tcataaattatctatttggcta

SEQ ID NO: 7247475 - DNA, 22 bp, Homo sapiens
tcagaagttaatatataaattt

SEQ ID NO: 7247476 - DNA, 22 bp, Homo sapiens
tcacatttcgcatcagtccgat

SEQ ID NO: 7247477 - DNA, 22 bp, Homo sapiens
tcacattgccattagttcagtt

SEQ ID NO: 7247478 - DNA, 22 bp, Homo sapiens
tcacatacactaggatattttt

SEQ ID NO: 7247479 - DNA, 22 bp, Homo sapiens
tcaactcacaagaatgagcaag

SEQ ID NO: 7247480 - DNA, 22 bp, Homo sapiens
tcaagaaactgtgctacagagt

SEQ ID NO: 7247481 - DNA, 22 bp, Homo sapiens
tcacagtgacttacagagattg

SEQ ID NO: 7247482 - DNA, 22 bp, Homo sapiens
tcaacaagcattggtggtaaaa

SEQ ID NO: 7247483 - DNA, 22 bp, Homo sapiens
tcaacatacatacatggtcagg

SEQ ID NO: 7247484 - DNA, 22 bp, Homo sapiens
tcaacatatcatatctatcggt

SEQ ID NO: 7247485 - DNA, 22 bp, Homo sapiens
tcaacatataggcaacctgtaa

SEQ ID NO: 7247486 - DNA, 22 bp, Homo sapiens
tcaacactggctacagttatgc

SEQ ID NO: 7247487 - DNA, 22 bp, Homo sapiens
tcagagtgggagaatgtgccaa

SEQ ID NO: 7247488 - DNA, 22 bp, Homo sapiens
tcagagtgcagggagtagcagc

SEQ ID NO: 7247489 - DNA, 22 bp, Homo sapiens
tcagagtgtggtgagatgtgca

SEQ ID NO: 7247490 - DNA, 22 bp, Homo sapiens
tcagaatgtgcagaggaacagt

SEQ ID NO: 7247491 - DNA, 22 bp, Homo sapiens
tcagatgttgaaaaggaaaagt

SEQ ID NO: 7247492 - DNA, 22 bp, Homo sapiens
tcagcagggagaggagaatgca

SEQ ID NO: 7247493 - DNA, 22 bp, Homo sapiens
tcagcagggctgggagctgtga

SEQ ID NO: 7247494 - DNA, 17 bp, Homo sapiens
tcagcaggggccaagct

SEQ ID NO: 7247495 - DNA, 22 bp, Homo sapiens
tcagcaactatttatcaaattc

SEQ ID NO: 7247496 - DNA, 22 bp, Homo sapiens
tcagcaggcggttccttgtggg

SEQ ID NO: 7247497 - DNA, 22 bp, Homo sapiens
tcagcaggctctggttgaccat

SEQ ID NO: 7247498 - DNA, 22 bp, Homo sapiens
tcagcaggcccatcctccaggc

SEQ ID NO: 7247499 - DNA, 22 bp, Homo sapiens
tcagctctgcctgtggaggcac

SEQ ID NO: 7247500 - DNA, 22 bp, Homo sapiens
tcagcatctacagctttgctat

SEQ ID NO: 7247501 - DNA, 19 bp, Homo sapiens
tcagcatcaatttggtcct

SEQ ID NO: 7247502 - DNA, 22 bp, Homo sapiens
tcaggagacaaagggtgcggag

SEQ ID NO: 7247503 - DNA, 22 bp, Homo sapiens
tcctgagttgcatagtgaagat

SEQ ID NO: 7247504 - DNA, 22 bp, Homo sapiens
tcctctggggtcagggcactac

SEQ ID NO: 7247505 - DNA, 22 bp, Homo sapiens
tcctcaggtgactaggtatctt

SEQ ID NO: 7247506 - DNA, 22 bp, Homo sapiens
tcctctggtcttcggtgtggac

SEQ ID NO: 7247507 - DNA, 22 bp, Homo sapiens
tcctcttcagagggacctcggg

SEQ ID NO: 7247508 - DNA, 22 bp, Homo sapiens
tcctctttctcaacattagtta

SEQ ID NO: 7247509 - DNA, 22 bp, Homo sapiens
tcctgcagagccgccctcaggt

SEQ ID NO: 7247510 - DNA, 22 bp, Homo sapiens
tcctgcagctgaagctcatgtg

SEQ ID NO: 7247511 - DNA, 22 bp, Homo sapiens
tcctcagatgctcttggacgcc

SEQ ID NO: 7247512 - DNA, 22 bp, Homo sapiens
tcctcagatataaatgagggtg

SEQ ID NO: 7247513 - DNA, 22 bp, Homo sapiens
tcctcacaagcaagcacaggta

SEQ ID NO: 7247514 - DNA, 22 bp, Homo sapiens
tcctattggtagacatttctgt

SEQ ID NO: 7247515 - DNA, 22 bp, Homo sapiens
tcctataattagaagcaatttg

SEQ ID NO: 7247516 - DNA, 22 bp, Homo sapiens
tcctagttctctgccagtcgct

SEQ ID NO: 7247517 - DNA, 22 bp, Homo sapiens
tcctcacacccataccactgac

SEQ ID NO: 7247518 - DNA, 22 bp, Homo sapiens
tcctcactgcagtgctccgagc

SEQ ID NO: 7247519 - DNA, 22 bp, Homo sapiens
tcctcagaatggatggcagggg

SEQ ID NO: 7247520 - DNA, 22 bp, Homo sapiens
tcctcagaatcacctggcagct

SEQ ID NO: 7247521 - DNA, 22 bp, Homo sapiens
tccggtgctgaaggcccaggtg

SEQ ID NO: 7247522 - DNA, 16 bp, Homo sapiens
tccctgggagtggtgg

SEQ ID NO: 7247523 - DNA, 18 bp, Homo sapiens
tccctgggatataattac

SEQ ID NO: 7247524 - DNA, 22 bp, Homo sapiens
tccctgggactcagacatggaa

SEQ ID NO: 7247525 - DNA, 22 bp, Homo sapiens
tccctgggagatgatgatgagg

SEQ ID NO: 7247526 - DNA, 15 bp, Homo sapiens
tccctgggagatggt

SEQ ID NO: 7247527 - DNA, 22 bp, Homo sapiens
tccctgggacggccttttggag

SEQ ID NO: 7247528 - DNA, 22 bp, Homo sapiens
tccctgggaccggcagctcaca

SEQ ID NO: 7247529 - DNA, 22 bp, Homo sapiens
tcctaggaagtggaggcacctg

SEQ ID NO: 7247530 - DNA, 22 bp, Homo sapiens
tcctaggaatactgcctgaaat

SEQ ID NO: 7247531 - DNA, 22 bp, Homo sapiens
tcctaggatctggggtgttttt

SEQ ID NO: 7247532 - DNA, 22 bp, Homo sapiens
tcctagaatgcacctctgctgt

SEQ ID NO: 7247533 - DNA, 22 bp, Homo sapiens
tccctgggaattaatatttgga

SEQ ID NO: 7247534 - DNA, 22 bp, Homo sapiens
tccctgggaacaaaggatgaga

SEQ ID NO: 7247535 - DNA, 22 bp, Homo sapiens
tccctgggaaatgtcagtttca

SEQ ID NO: 7247536 - DNA, 22 bp, Homo sapiens
tccctgcctcctggcagtgcca

SEQ ID NO: 7247537 - DNA, 22 bp, Homo sapiens
tccctcagatgagctcctagca

SEQ ID NO: 7247538 - DNA, 22 bp, Homo sapiens
tccctcagagggcaagcgcaga

SEQ ID NO: 7247539 - DNA, 22 bp, Homo sapiens
tcccggagcctgcactcctaac

SEQ ID NO: 7247540 - DNA, 22 bp, Homo sapiens
tccctctgttctgttccaagtg

SEQ ID NO: 7247541 - DNA, 22 bp, Homo sapiens
tccctctgtgttgggcatgcct

SEQ ID NO: 7247542 - DNA, 22 bp, Homo sapiens
tccctctgtggttggttctgtc

SEQ ID NO: 7247543 - DNA, 22 bp, Homo sapiens
tccctgccctgccttcatggtt

SEQ ID NO: 7247544 - DNA, 22 bp, Homo sapiens
tccctctggtctggacgccata

SEQ ID NO: 7247545 - DNA, 22 bp, Homo sapiens
tccctctggtcctcggtggaga

SEQ ID NO: 7247546 - DNA, 22 bp, Homo sapiens
tccctctgggctggagcagggt

SEQ ID NO: 7247547 - DNA, 22 bp, Homo sapiens
tccctctgggctccagcacgga

SEQ ID NO: 7247548 - DNA, 22 bp, Homo sapiens
tccctctggaggctctagggga

SEQ ID NO: 7247549 - DNA, 22 bp, Homo sapiens
tccctctggaggctctagggga

SEQ ID NO: 7247550 - DNA, 22 bp, Homo sapiens
tccctctgctagtgcttgagct

SEQ ID NO: 7247551 - DNA, 22 bp, Homo sapiens
tcccagccttatctcccctggc

SEQ ID NO: 7247552 - DNA, 22 bp, Homo sapiens
tcccagccttccagtctggttt

SEQ ID NO: 7247553 - DNA, 22 bp, Homo sapiens
tcccagccttccttgtggtgaa

SEQ ID NO: 7247554 - DNA, 22 bp, Homo sapiens
tcccagccttccagtctggttt

SEQ ID NO: 7247555 - DNA, 22 bp, Homo sapiens
tcccagcctggaccctgccagt

SEQ ID NO: 7247556 - DNA, 22 bp, Homo sapiens
tcccagcctggaccctgccagt

SEQ ID NO: 7247557 - DNA, 22 bp, Homo sapiens
tcccagcctttctttctccagc

SEQ ID NO: 7247558 - DNA, 22 bp, Homo sapiens
tcccagccttccttgtggtgaa

SEQ ID NO: 7247559 - DNA, 22 bp, Homo sapiens
tcccagccggtgcctgggtccc

SEQ ID NO: 7247560 - DNA, 22 bp, Homo sapiens
tcccagccacaggtgtagccct

SEQ ID NO: 7247561 - DNA, 22 bp, Homo sapiens
tcccagcattaatgcctgtcag

SEQ ID NO: 7247562 - DNA, 22 bp, Homo sapiens
tcccagcctgacagtgcatcaa

SEQ ID NO: 7247563 - DNA, 23 bp, Homo sapiens
tcccagcctcttctcttgcatac

SEQ ID NO: 7247564 - DNA, 22 bp, Homo sapiens
tcccagcctcctgacagttttg

SEQ ID NO: 7247565 - DNA, 22 bp, Homo sapiens
tcccagccggtgcctgggtccc

SEQ ID NO: 7247566 - DNA, 22 bp, Homo sapiens
tcccaaatataatgcaagagac

SEQ ID NO: 7247567 - DNA, 22 bp, Homo sapiens
tccattatacttctgattcaaa

SEQ ID NO: 7247568 - DNA, 22 bp, Homo sapiens
tccatgggaagattttgagtgg

SEQ ID NO: 7247569 - DNA, 21 bp, Homo sapiens
tccaatttttaagactatggc

SEQ ID NO: 7247570 - DNA, 22 bp, Homo sapiens
tccaggctaattttgcattgtt

SEQ ID NO: 7247571 - DNA, 22 bp, Homo sapiens
tccaggctagaagtcacaggcc

SEQ ID NO: 7247572 - DNA, 22 bp, Homo sapiens
tccaggctggcctcgcgtgaca

SEQ ID NO: 7247573 - DNA, 22 bp, Homo sapiens
tccagggctgggttggctcagc

SEQ ID NO: 7247574 - DNA, 22 bp, Homo sapiens
tccaggctgggctgaagggtgc

SEQ ID NO: 7247575 - DNA, 19 bp, Homo sapiens
tatgacaagtactagttct

SEQ ID NO: 7247576 - DNA, 20 bp, Homo sapiens
tatggcttggcaaagcttca

SEQ ID NO: 7247577 - DNA, 22 bp, Homo sapiens
tatggcttgagtttcagactat

SEQ ID NO: 7247578 - DNA, 22 bp, Homo sapiens
tatggaaataattagacaagtg

SEQ ID NO: 7247579 - DNA, 22 bp, Homo sapiens
tatggcttttcattcctatgtg

SEQ ID NO: 7247580 - DNA, 22 bp, Homo sapiens
tatggctttctccatagggcag

SEQ ID NO: 7247581 - DNA, 21 bp, Homo sapiens
tatggctttactaagctgcac

SEQ ID NO: 7247582 - DNA, 22 bp, Homo sapiens
tatggctttaaattgaaggagt

SEQ ID NO: 7247583 - DNA, 22 bp, Homo sapiens
tataaagttggggctgaagtaa

SEQ ID NO: 7247584 - DNA, 22 bp, Homo sapiens
tataaagtgtgaactgtgagta

SEQ ID NO: 7247585 - DNA, 22 bp, Homo sapiens
tataaaacagaaagcactacct

SEQ ID NO: 7247586 - DNA, 18 bp, Homo sapiens
tataaacacacttaggtt

SEQ ID NO: 7247587 - DNA, 22 bp, Homo sapiens
tatcacagtaaatctgggtgca

SEQ ID NO: 7247588 - DNA, 22 bp, Homo sapiens
tatcagaagacttacagtatcg

SEQ ID NO: 7247589 - DNA, 22 bp, Homo sapiens
tatcagaaggcacatggagtct

SEQ ID NO: 7247590 - DNA, 21 bp, Homo sapiens
tatcagaagagaaagaatgat

SEQ ID NO: 7247591 - DNA, 22 bp, Homo sapiens
tatgaaattgccatttttatgg

SEQ ID NO: 7247592 - DNA, 22 bp, Homo sapiens
tatgaaatggtagtaggaaggg

SEQ ID NO: 7247593 - DNA, 22 bp, Homo sapiens
tatgaaatgatggggaaaatag

SEQ ID NO: 7247594 - DNA, 22 bp, Homo sapiens
tatgaaatttaaacacagatca

SEQ ID NO: 7247595 - DNA, 22 bp, Homo sapiens
tatgaaatttaaacacagatca

SEQ ID NO: 7247596 - DNA, 22 bp, Homo sapiens
tatgaaatttctagttctgctt

SEQ ID NO: 7247597 - DNA, 22 bp, Homo sapiens
tatgacaaggtggagtatgagt

SEQ ID NO: 7247598 - DNA, 22 bp, Homo sapiens
tatgacaaggtggagtatgagt

SEQ ID NO: 7247599 - DNA, 22 bp, Homo sapiens
tatgacaagaaatacagaggta

SEQ ID NO: 7247600 - DNA, 20 bp, Homo sapiens
tatgacaacgcagcaaggca

SEQ ID NO: 7247601 - DNA, 22 bp, Homo sapiens
tatgaattctcttgtgtatagt

SEQ ID NO: 7247602 - DNA, 19 bp, Homo sapiens
tatgaagttgataaaagtt

SEQ ID NO: 7247603 - DNA, 22 bp, Homo sapiens
tatgaaagaatctcagagcaca

SEQ ID NO: 7247604 - DNA, 22 bp, Homo sapiens
tatcttttgagttctcaagatg

SEQ ID NO: 7247605 - DNA, 23 bp, Homo sapiens
tatctttttcaatgttggaaata

SEQ ID NO: 7247606 - DNA, 18 bp, Homo sapiens
tatcttttccagtggtat

SEQ ID NO: 7247607 - DNA, 22 bp, Homo sapiens
tcaaagtaggggtaagccaggc

SEQ ID NO: 7247608 - DNA, 22 bp, Homo sapiens
tcaaagtaccattatcagtgga

SEQ ID NO: 7247609 - DNA, 22 bp, Homo sapiens
tcaaagtaccattatcagtgga

SEQ ID NO: 7247610 - DNA, 22 bp, Homo sapiens
tcaaatattggctatttcacat

SEQ ID NO: 7247611 - DNA, 22 bp, Homo sapiens
tcaaatctttaacatgtgcaaa

SEQ ID NO: 7247612 - DNA, 22 bp, Homo sapiens
tcaaagagctctatcttcaaaa

SEQ ID NO: 7247613 - DNA, 22 bp, Homo sapiens
tattttgttttgtatccactgt

SEQ ID NO: 7247614 - DNA, 22 bp, Homo sapiens
tattttgtcttctgctcatcac

SEQ ID NO: 7247615 - DNA, 22 bp, Homo sapiens
tcaaaaataagatattctggac

SEQ ID NO: 7247616 - DNA, 22 bp, Homo sapiens
tattttgtatttatgcaagaaa

SEQ ID NO: 7247617 - DNA, 22 bp, Homo sapiens
tattttgagcccctgacatcta

SEQ ID NO: 7247618 - DNA, 22 bp, Homo sapiens
tatttgaataaaggataaggaa

SEQ ID NO: 7247619 - DNA, 22 bp, Homo sapiens
tatttgaaggcatacattttga

SEQ ID NO: 7247620 - DNA, 22 bp, Homo sapiens
tatttcttgttattctcgttga

SEQ ID NO: 7247621 - DNA, 23 bp, Homo sapiens
tatttgctactggtaattctgga

SEQ ID NO: 7247622 - DNA, 22 bp, Homo sapiens
tatttgcaggacatagatatgg

SEQ ID NO: 7247623 - DNA, 22 bp, Homo sapiens
tatttggaaacaattcacatgc

SEQ ID NO: 7247624 - DNA, 22 bp, Homo sapiens
tatttggaaaagggaagggaca

SEQ ID NO: 7247625 - DNA, 22 bp, Homo sapiens
tatttggaaatgataaagtact

SEQ ID NO: 7247626 - DNA, 22 bp, Homo sapiens
tatttggaaatagggctttgta

SEQ ID NO: 7247627 - DNA, 22 bp, Homo sapiens
tatttggaaagtttatctatct

SEQ ID NO: 7247628 - DNA, 22 bp, Homo sapiens
tatttggaaaggacatgtaagt

SEQ ID NO: 7247629 - DNA, 23 bp, Homo sapiens
tatttggaaagagggaagaagac

SEQ ID NO: 7247630 - DNA, 22 bp, Homo sapiens
tatttggaatagcttgctaatg

SEQ ID NO: 7247631 - DNA, 22 bp, Homo sapiens
tatttggaaggtataaacacaa

SEQ ID NO: 7247632 - DNA, 22 bp, Homo sapiens
tatttggacaccaagtagaagt

SEQ ID NO: 7247633 - DNA, 22 bp, Homo sapiens
tatttggaatctgccttaggac

SEQ ID NO: 7247634 - DNA, 22 bp, Homo sapiens
tatttggagatgggatcttcaa

SEQ ID NO: 7247635 - DNA, 22 bp, Homo sapiens
tatttggagataagggctttaa

SEQ ID NO: 7247636 - DNA, 22 bp, Homo sapiens
tatttggagataagatttttag

SEQ ID NO: 7247637 - DNA, 22 bp, Homo sapiens
tatttggagcctatccatagat

SEQ ID NO: 7247638 - DNA, 20 bp, Homo sapiens
taggcagcttgacccttggt

SEQ ID NO: 7247639 - DNA, 22 bp, Homo sapiens
taggccagcccttagtcctgtc

SEQ ID NO: 7247640 - DNA, 22 bp, Homo sapiens
tagctgggagtgtctgatgggt

SEQ ID NO: 7247641 - DNA, 22 bp, Homo sapiens
tagctgggactactggccctgc

SEQ ID NO: 7247642 - DNA, 22 bp, Homo sapiens
tagggcagctgcatcaggcact

SEQ ID NO: 7247643 - DNA, 22 bp, Homo sapiens
tagggcagccacccaggctgct

SEQ ID NO: 7247644 - DNA, 23 bp, Homo sapiens
tagggcagctgggagggacatgc

SEQ ID NO: 7247645 - DNA, 22 bp, Homo sapiens
tagggcagccttatagctccca

SEQ ID NO: 7247646 - DNA, 21 bp, Homo sapiens
tagggctctatttttatttca

SEQ ID NO: 7247647 - DNA, 21 bp, Homo sapiens
tagggctctatttttatttca

SEQ ID NO: 7247648 - DNA, 22 bp, Homo sapiens
tagggcagccacccaggctgct

SEQ ID NO: 7247649 - DNA, 22 bp, Homo sapiens
tagggcagattcggtggagttt

SEQ ID NO: 7247650 - DNA, 22 bp, Homo sapiens
tagggcagccacccaggctgct

SEQ ID NO: 7247651 - DNA, 22 bp, Homo sapiens
tagggctgtttaaaagtgaggt

SEQ ID NO: 7247652 - DNA, 22 bp, Homo sapiens
tagggctgtgtctccaggacca

SEQ ID NO: 7247653 - DNA, 16 bp, Homo sapiens
tagggctgggaaggag

SEQ ID NO: 7247654 - DNA, 19 bp, Homo sapiens
tagggctggccgggcggtg

SEQ ID NO: 7247655 - DNA, 22 bp, Homo sapiens
tagggctgcctatggctagata

SEQ ID NO: 7247656 - DNA, 22 bp, Homo sapiens
tagggctgccatttgcttttct

SEQ ID NO: 7247657 - DNA, 22 bp, Homo sapiens
tagggctgctgcagatgacagg

SEQ ID NO: 7247658 - DNA, 22 bp, Homo sapiens
tagggctgcctatggctagata

SEQ ID NO: 7247659 - DNA, 22 bp, Homo sapiens
tagttacagtgcatagcaagat

SEQ ID NO: 7247660 - DNA, 22 bp, Homo sapiens
tagtttaatggtcaactaatga

SEQ ID NO: 7247661 - DNA, 22 bp, Homo sapiens
tagtttaaaagttagggatgat

SEQ ID NO: 7247662 - DNA, 22 bp, Homo sapiens
tagtttaatggtcaactaatga

SEQ ID NO: 7247663 - DNA, 22 bp, Homo sapiens
tagtttagcactaagaaaaaca

SEQ ID NO: 7247664 - DNA, 18 bp, Homo sapiens
tagtttctaatggccttt

SEQ ID NO: 7247665 - DNA, 21 bp, Homo sapiens
tagtttctacccagttaatgg

SEQ ID NO: 7247666 - DNA, 22 bp, Homo sapiens
tagtttctaaactgaactgtca

SEQ ID NO: 7247667 - DNA, 22 bp, Homo sapiens
tagtttctaaagcttcctaggt

SEQ ID NO: 7247668 - DNA, 22 bp, Homo sapiens
tagtttttaagtgtacaatttc

SEQ ID NO: 7247669 - DNA, 22 bp, Homo sapiens
tagtggagaggatgtggagaaa

SEQ ID NO: 7247670 - DNA, 22 bp, Homo sapiens
tagtggagagttgttttgtgca

SEQ ID NO: 7247671 - DNA, 22 bp, Homo sapiens
tagtggaggcctgttgtgtgca

SEQ ID NO: 7247672 - DNA, 22 bp, Homo sapiens
tagtggaggggatgcaaagctt

SEQ ID NO: 7247673 - DNA, 22 bp, Homo sapiens
tagtggagggtgtagctgctgg

SEQ ID NO: 7247674 - DNA, 22 bp, Homo sapiens
tagtggaggtggtctgtgaact

SEQ ID NO: 7247675 - DNA, 22 bp, Homo sapiens
tagtggagtagaaaccaaagaa

SEQ ID NO: 7247676 - DNA, 19 bp, Homo sapiens
tagtggagtgacaagttct

SEQ ID NO: 7247677 - DNA, 22 bp, Homo sapiens
tagtggagaagtggagtctgtg

SEQ ID NO: 7247678 - DNA, 22 bp, Homo sapiens
tagtctctggagactctagggg

SEQ ID NO: 7247679 - DNA, 22 bp, Homo sapiens
tagtctctgctttgcccttggc

SEQ ID NO: 7247680 - DNA, 22 bp, Homo sapiens
taggggcagaagcggcggtcca

SEQ ID NO: 7247681 - DNA, 22 bp, Homo sapiens
taggggaactggcacagggcag

SEQ ID NO: 7247682 - DNA, 22 bp, Homo sapiens
taggggctcagaacatgtcctt

SEQ ID NO: 7247683 - DNA, 23 bp, Homo sapiens
taggggctggcgtggagcctgcg

SEQ ID NO: 7247684 - DNA, 21 bp, Homo sapiens
taggggctggggctccagctg

SEQ ID NO: 7247685 - DNA, 22 bp, Homo sapiens
taggggcttgtaatttaataga

SEQ ID NO: 7247686 - DNA, 22 bp, Homo sapiens
tagcaggaatgaagttctgagg

SEQ ID NO: 7247687 - DNA, 22 bp, Homo sapiens
tagcaggaatatgaggttaata

SEQ ID NO: 7247688 - DNA, 22 bp, Homo sapiens
tagcaggagtgtgttctatttt

SEQ ID NO: 7247689 - DNA, 21 bp, Homo sapiens
tagcaggagcgaattttgatg

SEQ ID NO: 7247690 - DNA, 22 bp, Homo sapiens
tagcaacaagtgactatctata

SEQ ID NO: 7247691 - DNA, 22 bp, Homo sapiens
tagaaccagtccacagaatttg

SEQ ID NO: 7247692 - DNA, 22 bp, Homo sapiens
tagaacatgacttatttttgga

SEQ ID NO: 7247693 - DNA, 23 bp, Homo sapiens
tagaacatcggtgtcttggagca

SEQ ID NO: 7247694 - DNA, 22 bp, Homo sapiens
tagactgttacagcttttcaga

SEQ ID NO: 7247695 - DNA, 22 bp, Homo sapiens
tagactggtgaattagggggaa

SEQ ID NO: 7247696 - DNA, 21 bp, Homo sapiens
tagagaaaagaagctgttcct

SEQ ID NO: 7247697 - DNA, 22 bp, Homo sapiens
tagagaaacagaaccaacaggg

SEQ ID NO: 7247698 - DNA, 20 bp, Homo sapiens
tagagagatatgggggttcc

SEQ ID NO: 7247699 - DNA, 20 bp, Homo sapiens
tagagagaggatattaaagt

SEQ ID NO: 7247700 - DNA, 22 bp, Homo sapiens
tagagagagctgtggtggctct

SEQ ID NO: 7247701 - DNA, 22 bp, Homo sapiens
tagagagagatatatacacaca

SEQ ID NO: 7247702 - DNA, 22 bp, Homo sapiens
tagagaatggccttgaagtagt

SEQ ID NO: 7247703 - DNA, 22 bp, Homo sapiens
tagatataaggtccttagaaca

SEQ ID NO: 7247704 - DNA, 22 bp, Homo sapiens
tagatagattctcctatagagt

SEQ ID NO: 7247705 - DNA, 22 bp, Homo sapiens
tagatagattctcctatagagt

SEQ ID NO: 7247706 - DNA, 22 bp, Homo sapiens
tagatagataaaatgttgcaga

SEQ ID NO: 7247707 - DNA, 22 bp, Homo sapiens
tagatagactaatccagcaact

SEQ ID NO: 7247708 - DNA, 22 bp, Homo sapiens
tagatagaagagccacattagc

SEQ ID NO: 7247709 - DNA, 22 bp, Homo sapiens
tagatacctgctggacctcatt

SEQ ID NO: 7247710 - DNA, 22 bp, Homo sapiens
tagatacctgctggacctcatt

SEQ ID NO: 7247711 - DNA, 22 bp, Homo sapiens
taaaagctgagatatcctgtac

SEQ ID NO: 7247712 - DNA, 22 bp, Homo sapiens
taaaagtaggaatgaaacgcat

SEQ ID NO: 7247713 - DNA, 22 bp, Homo sapiens
taaaagaagcttcaaggccggc

SEQ ID NO: 7247714 - DNA, 22 bp, Homo sapiens
taacataacttttccttgaccc

SEQ ID NO: 7247715 - DNA, 22 bp, Homo sapiens
taacagtattgaagataaacta

SEQ ID NO: 7247716 - DNA, 20 bp, Homo sapiens
taacagttgaagaacaagga

SEQ ID NO: 7247717 - DNA, 22 bp, Homo sapiens
taacagtgtggacttgagatct

SEQ ID NO: 7247718 - DNA, 22 bp, Homo sapiens
taaatgttgtaagtacatctaa

SEQ ID NO: 7247719 - DNA, 22 bp, Homo sapiens
taaatgttgtaagtacatctaa

SEQ ID NO: 7247720 - DNA, 22 bp, Homo sapiens
taaatgttggcattggaggccg

SEQ ID NO: 7247721 - DNA, 22 bp, Homo sapiens
taaattaaagattggagaagga

SEQ ID NO: 7247722 - DNA, 22 bp, Homo sapiens
taaatgttttgtgggttgagtt

SEQ ID NO: 7247723 - DNA, 22 bp, Homo sapiens
taaatgtttagtcttatttggg

SEQ ID NO: 7247724 - DNA, 22 bp, Homo sapiens
taaatgttatgcccatcatcca

SEQ ID NO: 7247725 - DNA, 22 bp, Homo sapiens
taaatgttactttcctttcaca

SEQ ID NO: 7247726 - DNA, 22 bp, Homo sapiens
taagagcactgaagtcttctta

SEQ ID NO: 7247727 - DNA, 22 bp, Homo sapiens
taacatgctaatttgcagatag

SEQ ID NO: 7247728 - DNA, 22 bp, Homo sapiens
taacatgcattgacaaatattt

SEQ ID NO: 7247729 - DNA, 22 bp, Homo sapiens
taacatgcatagatttgtatta

SEQ ID NO: 7247730 - DNA, 22 bp, Homo sapiens
taagacagggtctattcttagt

SEQ ID NO: 7247731 - DNA, 22 bp, Homo sapiens
taagacaaatactatttcaaga

SEQ ID NO: 7247732 - DNA, 22 bp, Homo sapiens
taagacatcattaaacagcaat

SEQ ID NO: 7247733 - DNA, 21 bp, Homo sapiens
taagacagtatgaatactttc

SEQ ID NO: 7247734 - DNA, 22 bp, Homo sapiens
taagacatccgttgcttataat

SEQ ID NO: 7247735 - DNA, 22 bp, Homo sapiens
taagacatcctggatgttcaaa

SEQ ID NO: 7247736 - DNA, 22 bp, Homo sapiens
taagacatttgaaatgtgatcc

SEQ ID NO: 7247737 - DNA, 22 bp, Homo sapiens
taagacatggttgatctagtgt

SEQ ID NO: 7247738 - DNA, 22 bp, Homo sapiens
gtttctttctattgactgaaca

SEQ ID NO: 7247739 - DNA, 22 bp, Homo sapiens
gtttcagaaatggtttatgcaa

SEQ ID NO: 7247740 - DNA, 22 bp, Homo sapiens
gttcttttggtagagtgtgcat

SEQ ID NO: 7247741 - DNA, 19 bp, Homo sapiens
gttcttttcacctctgtgc

SEQ ID NO: 7247742 - DNA, 22 bp, Homo sapiens
gttcttctcttgtaatggaatc

SEQ ID NO: 7247743 - DNA, 22 bp, Homo sapiens
gttcttcctcattgctttgaag

SEQ ID NO: 7247744 - DNA, 22 bp, Homo sapiens
gttcttcctggaagtggatttc

SEQ ID NO: 7247745 - DNA, 21 bp, Homo sapiens
gttcttcctgactagagtagt

SEQ ID NO: 7247746 - DNA, 22 bp, Homo sapiens
gtttatgaattgcattcccttt

SEQ ID NO: 7247747 - DNA, 21 bp, Homo sapiens
gtttatgaatcttgtcctgct

SEQ ID NO: 7247748 - DNA, 22 bp, Homo sapiens
gtttatgagttacgtaggggtt

SEQ ID NO: 7247749 - DNA, 22 bp, Homo sapiens
gtttatgaggaaaagttatgat

SEQ ID NO: 7247750 - DNA, 22 bp, Homo sapiens
gtttatgaatgttactatagag

SEQ ID NO: 7247751 - DNA, 22 bp, Homo sapiens
gtttatgaatgtgtcagacata

SEQ ID NO: 7247752 - DNA, 22 bp, Homo sapiens
gtttatcagagagcagaggtgg

SEQ ID NO: 7247753 - DNA, 22 bp, Homo sapiens
gtttatgaaatttcaggcattt

SEQ ID NO: 7247754 - DNA, 22 bp, Homo sapiens
gtttatattcaacggagtatct

SEQ ID NO: 7247755 - DNA, 22 bp, Homo sapiens
gttcttccctttggggattgtg

SEQ ID NO: 7247756 - DNA, 22 bp, Homo sapiens
gttattttaacttctcagtaat

SEQ ID NO: 7247757 - DNA, 22 bp, Homo sapiens
gttatattggcagaagagaaga

SEQ ID NO: 7247758 - DNA, 22 bp, Homo sapiens
gttatattgccaagtatattgt

SEQ ID NO: 7247759 - DNA, 22 bp, Homo sapiens
gttatgaaataaatatagatca

SEQ ID NO: 7247760 - DNA, 22 bp, Homo sapiens
gttatgaagtcattcacaaata

SEQ ID NO: 7247761 - DNA, 18 bp, Homo sapiens
gttatagcagcagcattt

SEQ ID NO: 7247762 - DNA, 22 bp, Homo sapiens
gttatagccatgcttatttgtt

SEQ ID NO: 7247763 - DNA, 22 bp, Homo sapiens
gtgttcttgccaaggccaacat

SEQ ID NO: 7247764 - DNA, 22 bp, Homo sapiens
gtgttctttatttagtgatgct

SEQ ID NO: 7247765 - DNA, 22 bp, Homo sapiens
gtgttcttttgcttcacagaaa

SEQ ID NO: 7247766 - DNA, 22 bp, Homo sapiens
gtgctggctgccaggaggctgc

SEQ ID NO: 7247767 - DNA, 22 bp, Homo sapiens
gtgctggcctcagagggtcatg

SEQ ID NO: 7247768 - DNA, 22 bp, Homo sapiens
gtgttattagagcattaatttt

SEQ ID NO: 7247769 - DNA, 21 bp, Homo sapiens
gtgctgggacacagccaggct

SEQ ID NO: 7247770 - DNA, 22 bp, Homo sapiens
taagctctccaggtgatcatga

SEQ ID NO: 7247771 - DNA, 22 bp, Homo sapiens
taagctctgttatccagagccc

SEQ ID NO: 7247772 - DNA, 22 bp, Homo sapiens
taagcattcaatgcttagcact

SEQ ID NO: 7247773 - DNA, 21 bp, Homo sapiens
taagccaccatgtgaaaccag

SEQ ID NO: 7247774 - DNA, 21 bp, Homo sapiens
taagccaccatgtgaaaccag

SEQ ID NO: 7247775 - DNA, 22 bp, Homo sapiens
taagccactagtctgttatgaa

SEQ ID NO: 7247776 - DNA, 22 bp, Homo sapiens
taagccccctcaccctggcttc

SEQ ID NO: 7247777 - DNA, 22 bp, Homo sapiens
taatatatacctttgttaggaa

SEQ ID NO: 7247778 - DNA, 22 bp, Homo sapiens
taaggaggctgctgtgaagaaa

SEQ ID NO: 7247779 - DNA, 22 bp, Homo sapiens
taatttatagaatttcttggat

SEQ ID NO: 7247780 - DNA, 22 bp, Homo sapiens
taatttatagaatttcttggat

SEQ ID NO: 7247781 - DNA, 22 bp, Homo sapiens
taatttatatggaattgttgct

SEQ ID NO: 7247782 - DNA, 22 bp, Homo sapiens
taatttatatggaattgttgct

SEQ ID NO: 7247783 - DNA, 22 bp, Homo sapiens
taatttatgatgcaaagaaaag

SEQ ID NO: 7247784 - DNA, 22 bp, Homo sapiens
taatatatttctgctaagctca

SEQ ID NO: 7247785 - DNA, 22 bp, Homo sapiens
tacaagaatgtcttaaaagctc

SEQ ID NO: 7247786 - DNA, 22 bp, Homo sapiens
taatttatttcaactgccaagg

SEQ ID NO: 7247787 - DNA, 21 bp, Homo sapiens
taatttattcagcacagtgtt

SEQ ID NO: 7247788 - DNA, 22 bp, Homo sapiens
taatttatggtatgtgtgtaat

SEQ ID NO: 7247789 - DNA, 22 bp, Homo sapiens
taatttatgatgcaaagaaaag

SEQ ID NO: 7247790 - DNA, 22 bp, Homo sapiens
taatttatggtatgtgtgtaat

SEQ ID NO: 7247791 - DNA, 21 bp, Homo sapiens
taatttattcagcacagtgtt

SEQ ID NO: 7247792 - DNA, 22 bp, Homo sapiens
taatttatttcaactgccaagg

SEQ ID NO: 7247793 - DNA, 22 bp, Homo sapiens
tacagacagtttttcagatatt

SEQ ID NO: 7247794 - DNA, 22 bp, Homo sapiens
tacagaatgtgtatcattacca

SEQ ID NO: 7247795 - DNA, 21 bp, Homo sapiens
tacagaatgcgcttcagtctg

SEQ ID NO: 7247796 - DNA, 22 bp, Homo sapiens
tacagaattagattattagaga

SEQ ID NO: 7247797 - DNA, 22 bp, Homo sapiens
tacagaatgttatgaagcatag

SEQ ID NO: 7247798 - DNA, 20 bp, Homo sapiens
tacagaatgcaataaaatgg

SEQ ID NO: 7247799 - DNA, 22 bp, Homo sapiens
tacagaatatagaagctggaag

SEQ ID NO: 7247800 - DNA, 22 bp, Homo sapiens
tacatgaagatgaatgtatggc

SEQ ID NO: 7247801 - DNA, 22 bp, Homo sapiens
tacagtgtttcccccaggatag

SEQ ID NO: 7247802 - DNA, 22 bp, Homo sapiens
tacagtgtgaataagcaggcat

SEQ ID NO: 7247803 - DNA, 22 bp, Homo sapiens
tacatgcacatgaacatgtgtg

SEQ ID NO: 7247804 - DNA, 22 bp, Homo sapiens
tacatgcaattaagagggtgaa

SEQ ID NO: 7247805 - DNA, 22 bp, Homo sapiens
tacatgcaattaagagggtgaa

SEQ ID NO: 7247806 - DNA, 22 bp, Homo sapiens
tacatgcaatgaggattctagt

SEQ ID NO: 7247807 - DNA, 22 bp, Homo sapiens
tacatgcaaggatatttgtgcg

SEQ ID NO: 7247808 - DNA, 22 bp, Homo sapiens
tacatgcaaggatatttgtgcg

SEQ ID NO: 7247809 - DNA, 22 bp, Homo sapiens
tacatgcatgtcacagaatgaa

SEQ ID NO: 7247810 - DNA, 22 bp, Homo sapiens
tacatgcatgatacaaagttgc

SEQ ID NO: 7247811 - DNA, 22 bp, Homo sapiens
tacatgcatgatacaaagttgc

SEQ ID NO: 7247812 - DNA, 22 bp, Homo sapiens
tacatgcatacttgtgtgtgta

SEQ ID NO: 7247813 - DNA, 22 bp, Homo sapiens
tacatgcatacttgtgtgtgta

SEQ ID NO: 7247814 - DNA, 18 bp, Homo sapiens
tacatgcataaatgaagc

SEQ ID NO: 7247815 - DNA, 19 bp, Homo sapiens
tacatgcagcaggcacgca

SEQ ID NO: 7247816 - DNA, 19 bp, Homo sapiens
tacatgcacatgtgcgtgc

SEQ ID NO: 7247817 - DNA, 19 bp, Homo sapiens
tacatgcacatgtgcgtgc

SEQ ID NO: 7247818 - DNA, 22 bp, Homo sapiens
tacatgcacatgaacatgtgtg

SEQ ID NO: 7247819 - DNA, 22 bp, Homo sapiens
taccaagagttcttgcctgttt

SEQ ID NO: 7247820 - DNA, 22 bp, Homo sapiens
tacatgtaattttcatagtaag

SEQ ID NO: 7247821 - DNA, 22 bp, Homo sapiens
tacatgcattggatggcaatag

SEQ ID NO: 7247822 - DNA, 22 bp, Homo sapiens
tacatgcattggatggcaatag

SEQ ID NO: 7247823 - DNA, 22 bp, Homo sapiens
tacatgcatgtgtgtaaatata

SEQ ID NO: 7247824 - DNA, 22 bp, Homo sapiens
tacatgcatgtgtgtaaatata

SEQ ID NO: 7247825 - DNA, 22 bp, Homo sapiens
tacatgcatgtcacagaatgaa

SEQ ID NO: 7247826 - DNA, 22 bp, Homo sapiens
tacagacagtttttcagatatt

SEQ ID NO: 7247827 - DNA, 22 bp, Homo sapiens
tacagagagtacagcatccaca

SEQ ID NO: 7247828 - DNA, 22 bp, Homo sapiens
tacagagatactctagatcaaa

SEQ ID NO: 7247829 - DNA, 22 bp, Homo sapiens
tacagagatttattgctaaggc

SEQ ID NO: 7247830 - DNA, 22 bp, Homo sapiens
tacagagatgtgaaaagctcta

SEQ ID NO: 7247831 - DNA, 22 bp, Homo sapiens
tacagagatgccgaagagtgaa

SEQ ID NO: 7247832 - DNA, 22 bp, Homo sapiens
tacagagtaatttgcatgggga

SEQ ID NO: 7247833 - DNA, 22 bp, Homo sapiens
tacagagtaatttgcatgggga

SEQ ID NO: 7247834 - DNA, 22 bp, Homo sapiens
tacagtctttggaaagagatag

SEQ ID NO: 7247835 - DNA, 22 bp, Homo sapiens
tacagtctctttgagtgattgt

SEQ ID NO: 7247836 - DNA, 22 bp, Homo sapiens
tacagtatttgaagaatatgag

SEQ ID NO: 7247837 - DNA, 22 bp, Homo sapiens
tacagtgtctgcaactgcacac

SEQ ID NO: 7247838 - DNA, 22 bp, Homo sapiens
tacagtgtatgtatttgtaggt

SEQ ID NO: 7247839 - DNA, 22 bp, Homo sapiens
tactagaagctgtaatttttca

SEQ ID NO: 7247840 - DNA, 22 bp, Homo sapiens
tactagaacctcacaacaatcc

SEQ ID NO: 7247841 - DNA, 22 bp, Homo sapiens
tactagaaattaccttctcact

SEQ ID NO: 7247842 - DNA, 22 bp, Homo sapiens
tactagaaattaccttctcact

SEQ ID NO: 7247843 - DNA, 22 bp, Homo sapiens
tactagaatgccactgttagtg

SEQ ID NO: 7247844 - DNA, 22 bp, Homo sapiens
tactatctagctctttgcagag

SEQ ID NO: 7247845 - DNA, 22 bp, Homo sapiens
tactagtttctaccttacagaa

SEQ ID NO: 7247846 - DNA, 22 bp, Homo sapiens
tactagaaaaacacatgctctg

SEQ ID NO: 7247847 - DNA, 23 bp, Homo sapiens
tactacagggtcttgctatgaat

SEQ ID NO: 7247848 - DNA, 22 bp, Homo sapiens
tactgaaactcttgtaaatatc

SEQ ID NO: 7247849 - DNA, 22 bp, Homo sapiens
tactgaaactcttgtaaatatc

SEQ ID NO: 7247850 - DNA, 22 bp, Homo sapiens
tactgtgttgtgctgaaaggga

SEQ ID NO: 7247851 - DNA, 22 bp, Homo sapiens
tactgtgtgcccagccgagctg

SEQ ID NO: 7247852 - DNA, 22 bp, Homo sapiens
tactgtgtgcccagccgagctg

SEQ ID NO: 7247853 - DNA, 22 bp, Homo sapiens
gtagggttggagagcacaacca

SEQ ID NO: 7247854 - DNA, 22 bp, Homo sapiens
gtagtctgaacagtaattttgt

SEQ ID NO: 7247855 - DNA, 22 bp, Homo sapiens
gtaggaattggctttggatgtg

SEQ ID NO: 7247856 - DNA, 22 bp, Homo sapiens
gtaggggtgctgagatctggaa

SEQ ID NO: 7247857 - DNA, 22 bp, Homo sapiens
gtaggggccagaaagacttaga

SEQ ID NO: 7247858 - DNA, 22 bp, Homo sapiens
gtaggggtcaggtagggactct

SEQ ID NO: 7247859 - DNA, 22 bp, Homo sapiens
gtccagcccgggctccgccagc

SEQ ID NO: 7247860 - DNA, 22 bp, Homo sapiens
gtcagaggaggctgagtaggaa

SEQ ID NO: 7247861 - DNA, 23 bp, Homo sapiens
gtcctctggagagaaaggcagta

SEQ ID NO: 7247862 - DNA, 22 bp, Homo sapiens
gtcctctgtagggctgggccac

SEQ ID NO: 7247863 - DNA, 22 bp, Homo sapiens
gtcctctgtagggctgggccac

SEQ ID NO: 7247864 - DNA, 22 bp, Homo sapiens
gtcctctgggctttgagcagtc

SEQ ID NO: 7247865 - DNA, 20 bp, Homo sapiens
gtgctggagttaggaaaggt

SEQ ID NO: 7247866 - DNA, 20 bp, Homo sapiens
gtgctggagttaggaaaggt

SEQ ID NO: 7247867 - DNA, 22 bp, Homo sapiens
gtgctggaccctggaaggtggt

SEQ ID NO: 7247868 - DNA, 22 bp, Homo sapiens
gtgctggaccctggaaggtggt

SEQ ID NO: 7247869 - DNA, 22 bp, Homo sapiens
gtgctggccctgtcctcgagct

SEQ ID NO: 7247870 - DNA, 22 bp, Homo sapiens
gtgctgccggcatagcagtgaa

SEQ ID NO: 7247871 - DNA, 22 bp, Homo sapiens
gtgctgcctccatatccgtcag

SEQ ID NO: 7247872 - DNA, 22 bp, Homo sapiens
gtgctgccagacagtgagaggg

SEQ ID NO: 7247873 - DNA, 22 bp, Homo sapiens
gtgctgccggcatagcagtgaa

SEQ ID NO: 7247874 - DNA, 22 bp, Homo sapiens
gtgctgcctgccagcttctggg

SEQ ID NO: 7247875 - DNA, 22 bp, Homo sapiens
gtgccagggggcactgaacaga

SEQ ID NO: 7247876 - DNA, 22 bp, Homo sapiens
gtgccagccgcaccccaggaga

SEQ ID NO: 7247877 - DNA, 22 bp, Homo sapiens
gtgccagcctggtgcgcctggg

SEQ ID NO: 7247878 - DNA, 18 bp, Homo sapiens
gtgccaggaggcgcagcc

SEQ ID NO: 7247879 - DNA, 20 bp, Homo sapiens
gtgccaggcaagacaggtgg

SEQ ID NO: 7247880 - DNA, 22 bp, Homo sapiens
gtgccaggcccagggagcgggg

SEQ ID NO: 7247881 - DNA, 22 bp, Homo sapiens
gtgccaggcccagggagcgggg

SEQ ID NO: 7247882 - DNA, 22 bp, Homo sapiens
gtgccagggagtggaggagctt

SEQ ID NO: 7247883 - DNA, 22 bp, Homo sapiens
gtgcagcaaactagtgcgaggg

SEQ ID NO: 7247884 - DNA, 22 bp, Homo sapiens
gtgaggatcaaatgaaatagca

SEQ ID NO: 7247885 - DNA, 22 bp, Homo sapiens
gtgaggatgtactgagataaat

SEQ ID NO: 7247886 - DNA, 22 bp, Homo sapiens
gtgcaggcaaaagggccaggcc

SEQ ID NO: 7247887 - DNA, 22 bp, Homo sapiens
gtgcaggcattgggctagccat

SEQ ID NO: 7247888 - DNA, 22 bp, Homo sapiens
gtgcagggagcccagaaggtcc

SEQ ID NO: 7247889 - DNA, 22 bp, Homo sapiens
gtgcaggggatcaggttgcagc

SEQ ID NO: 7247890 - DNA, 22 bp, Homo sapiens
gtgcagggtagcgacggcagga

SEQ ID NO: 7247891 - DNA, 22 bp, Homo sapiens
gtgcagggcagccgaatgggct

SEQ ID NO: 7247892 - DNA, 22 bp, Homo sapiens
gtgcagggcagccgaatgggct

SEQ ID NO: 7247893 - DNA, 22 bp, Homo sapiens
gtgcagggctggcaccggaggc

SEQ ID NO: 7247894 - DNA, 17 bp, Homo sapiens
gtgcagggatgaaggat

SEQ ID NO: 7247895 - DNA, 21 bp, Homo sapiens
gtcttttaagtgaagagaggc

SEQ ID NO: 7247896 - DNA, 22 bp, Homo sapiens
gtctttgttctgcactattgtc

SEQ ID NO: 7247897 - DNA, 22 bp, Homo sapiens
gtgagctgggtgaatggtaggg

SEQ ID NO: 7247898 - DNA, 17 bp, Homo sapiens
gtgagctgagtcaggac

SEQ ID NO: 7247899 - DNA, 22 bp, Homo sapiens
gtctagagaggaaggaagtgtg

SEQ ID NO: 7247900 - DNA, 22 bp, Homo sapiens
gtctagaaataggtttcagaaa

SEQ ID NO: 7247901 - DNA, 22 bp, Homo sapiens
gtctactgcccaaatcaatatt

SEQ ID NO: 7247902 - DNA, 22 bp, Homo sapiens
gtctatgtgtaatagcatgtgt

SEQ ID NO: 7247903 - DNA, 22 bp, Homo sapiens
gtctccagttacagcagccagg

SEQ ID NO: 7247904 - DNA, 21 bp, Homo sapiens
ggtgctcgctgatgaggagtg

SEQ ID NO: 7247905 - DNA, 21 bp, Homo sapiens
ggtgctcgctgatgaggagtg

SEQ ID NO: 7247906 - DNA, 22 bp, Homo sapiens
ggtgagggagtggaacgaggtg

SEQ ID NO: 7247907 - DNA, 21 bp, Homo sapiens
ggtgctcctccatgctgctct

SEQ ID NO: 7247908 - DNA, 22 bp, Homo sapiens
ggtggaaggcctggaaggaggc

SEQ ID NO: 7247909 - DNA, 22 bp, Homo sapiens
ggtggaaggcagcagtctcagg

SEQ ID NO: 7247910 - DNA, 22 bp, Homo sapiens
ggtggaaggcctggaaggaggc

SEQ ID NO: 7247911 - DNA, 22 bp, Homo sapiens
ggtggaaggcctggaaggaggc

SEQ ID NO: 7247912 - DNA, 22 bp, Homo sapiens
ggtggacaaatgaatgactgaa

SEQ ID NO: 7247913 - DNA, 22 bp, Homo sapiens
ggtgagggacatcactcagcca

SEQ ID NO: 7247914 - DNA, 18 bp, Homo sapiens
ggtgagggagctggaagc

SEQ ID NO: 7247915 - DNA, 18 bp, Homo sapiens
ggtgaggcggcggccagc

SEQ ID NO: 7247916 - DNA, 22 bp, Homo sapiens
ggtgaggcaggtggctgctgag

SEQ ID NO: 7247917 - DNA, 22 bp, Homo sapiens
ggtgaggctggcttgccttctt

SEQ ID NO: 7247918 - DNA, 22 bp, Homo sapiens
ggtgaggctaagtgacacaggg

SEQ ID NO: 7247919 - DNA, 22 bp, Homo sapiens
ggtgaggaaagatggtgacagt

SEQ ID NO: 7247920 - DNA, 22 bp, Homo sapiens
ggtgaggaattggggactgacc

SEQ ID NO: 7247921 - DNA, 22 bp, Homo sapiens
ggtgaggaaagatggtgacagt

SEQ ID NO: 7247922 - DNA, 22 bp, Homo sapiens
ggtgagcgtggaaggagtggga

SEQ ID NO: 7247923 - DNA, 22 bp, Homo sapiens
ggtgacagcgggtcaagaggag

SEQ ID NO: 7247924 - DNA, 22 bp, Homo sapiens
ggtccctgaagatgcctgagga

SEQ ID NO: 7247925 - DNA, 22 bp, Homo sapiens
gggttgggactgtcatctggag

SEQ ID NO: 7247926 - DNA, 22 bp, Homo sapiens
gggttggattacttagggagaa

SEQ ID NO: 7247927 - DNA, 18 bp, Homo sapiens
gggtggtgtgctcttcgc

SEQ ID NO: 7247928 - DNA, 22 bp, Homo sapiens
gggtggtgtattagagctgcag

SEQ ID NO: 7247929 - DNA, 22 bp, Homo sapiens
gggtgtccttctgtggactctg

SEQ ID NO: 7247930 - DNA, 22 bp, Homo sapiens
ggtcccagctggtcactgtcag

SEQ ID NO: 7247931 - DNA, 22 bp, Homo sapiens
gggttttccttctgcattggag

SEQ ID NO: 7247932 - DNA, 22 bp, Homo sapiens
gggttttcttcaaaagtctaga

SEQ ID NO: 7247933 - DNA, 22 bp, Homo sapiens
ggttcagggatgtgggtgatgc

SEQ ID NO: 7247934 - DNA, 21 bp, Homo sapiens
ggttggtgtgtccagtggcca

SEQ ID NO: 7247935 - DNA, 22 bp, Homo sapiens
ggttggtgctgcatttgcctca

SEQ ID NO: 7247936 - DNA, 22 bp, Homo sapiens
ggttggtgcccaggccatactg

SEQ ID NO: 7247937 - DNA, 22 bp, Homo sapiens
ggttggtgagtgcagggtgtta

SEQ ID NO: 7247938 - DNA, 17 bp, Homo sapiens
ggtttaatccttacctg

SEQ ID NO: 7247939 - DNA, 22 bp, Homo sapiens
ggtttaatgggtgaaggcatga

SEQ ID NO: 7247940 - DNA, 22 bp, Homo sapiens
ggtttaatggagatatttcaga

SEQ ID NO: 7247941 - DNA, 23 bp, Homo sapiens
ggtggtgctcatatctcaggcct

SEQ ID NO: 7247942 - DNA, 23 bp, Homo sapiens
ggtggtgctcatatctcaggcct

SEQ ID NO: 7247943 - DNA, 22 bp, Homo sapiens
ggtggtgactgtcctagggatg

SEQ ID NO: 7247944 - DNA, 22 bp, Homo sapiens
ggttatttttgattctgtggat

SEQ ID NO: 7247945 - DNA, 22 bp, Homo sapiens
ggttattttggttgtctaaggc

SEQ ID NO: 7247946 - DNA, 22 bp, Homo sapiens
ggttatttctgattatatgata

SEQ ID NO: 7247947 - DNA, 19 bp, Homo sapiens
ggttatttgagggttaaga

SEQ ID NO: 7247948 - DNA, 23 bp, Homo sapiens
ggttatttgcatcctgtaattat

SEQ ID NO: 7247949 - DNA, 22 bp, Homo sapiens
ggtgggcaggcgaggcccaggt

SEQ ID NO: 7247950 - DNA, 19 bp, Homo sapiens
ggtggcagaacgtgggtcc

SEQ ID NO: 7247951 - DNA, 19 bp, Homo sapiens
ggtggcagaacgtgggtcc

SEQ ID NO: 7247952 - DNA, 22 bp, Homo sapiens
ggtggatggactctcgggggcc

SEQ ID NO: 7247953 - DNA, 22 bp, Homo sapiens
ggtggagcgcagggtgctggcg

SEQ ID NO: 7247954 - DNA, 22 bp, Homo sapiens
ggtggagctatacgggatggct

SEQ ID NO: 7247955 - DNA, 22 bp, Homo sapiens
ggtggagctggaccaggagagg

SEQ ID NO: 7247956 - DNA, 22 bp, Homo sapiens
ggtggagagctggatgagaggt

SEQ ID NO: 7247957 - DNA, 22 bp, Homo sapiens
ggtggggccctggcactggtat

SEQ ID NO: 7247958 - DNA, 22 bp, Homo sapiens
ggtggggcctgctccagcggcc

SEQ ID NO: 7247959 - DNA, 22 bp, Homo sapiens
ggtgggtgagccctgggagctg

SEQ ID NO: 7247960 - DNA, 22 bp, Homo sapiens
ggtgggtgcagggggcttctta

SEQ ID NO: 7247961 - DNA, 19 bp, Homo sapiens
ggtgggtgacctccccacc

SEQ ID NO: 7247962 - DNA, 22 bp, Homo sapiens
ggtgggccaggaaggccgccag

SEQ ID NO: 7247963 - DNA, 22 bp, Homo sapiens
ggtgggcgactgagaggggttt

SEQ ID NO: 7247964 - DNA, 22 bp, Homo sapiens
ggtgggcaggtcactctgcctc

SEQ ID NO: 7247965 - DNA, 22 bp, Homo sapiens
ggtgggcgactgagaggggttt

SEQ ID NO: 7247966 - DNA, 22 bp, Homo sapiens
gggtggtgagatgtagctgatg

SEQ ID NO: 7247967 - DNA, 22 bp, Homo sapiens
gggtggtggccagcagtgggca

SEQ ID NO: 7247968 - DNA, 22 bp, Homo sapiens
gggtggtctggcaggctggaaa

SEQ ID NO: 7247969 - DNA, 22 bp, Homo sapiens
gggtggtcatctgaaggtctgg

SEQ ID NO: 7247970 - DNA, 22 bp, Homo sapiens
gggtggtgggcacagaatctgg

SEQ ID NO: 7247971 - DNA, 22 bp, Homo sapiens
gggtggtgtattagagctgcag

SEQ ID NO: 7247972 - DNA, 22 bp, Homo sapiens
gggtggtggcggaggctccagg

SEQ ID NO: 7247973 - DNA, 22 bp, Homo sapiens
gggtggtggccagcagtgggca

SEQ ID NO: 7247974 - DNA, 21 bp, Homo sapiens
gggtggggttccagccttttc

SEQ ID NO: 7247975 - DNA, 22 bp, Homo sapiens
gggtggagagaaagaaacgtga

SEQ ID NO: 7247976 - DNA, 22 bp, Homo sapiens
gggtggagccagttgactctgt

SEQ ID NO: 7247977 - DNA, 22 bp, Homo sapiens
gggtggagaggctaagtccagt

SEQ ID NO: 7247978 - DNA, 18 bp, Homo sapiens
gggtgcaggcactgactg

SEQ ID NO: 7247979 - DNA, 18 bp, Homo sapiens
gggtgcaggcactgactg

SEQ ID NO: 7247980 - DNA, 22 bp, Homo sapiens
gggtgcagctttgaaagcatgt

SEQ ID NO: 7247981 - DNA, 18 bp, Homo sapiens
gggtgctggggccccttg

SEQ ID NO: 7247982 - DNA, 22 bp, Homo sapiens
gggtgctgggaggctgacatct

SEQ ID NO: 7247983 - DNA, 23 bp, Homo sapiens
gggtgctgcctgtagtcatgctg

SEQ ID NO: 7247984 - DNA, 22 bp, Homo sapiens
gggtgcaggcagcccaggcagg

SEQ ID NO: 7247985 - DNA, 21 bp, Homo sapiens
gggtgctgtggtcatgcagga

SEQ ID NO: 7247986 - DNA, 21 bp, Homo sapiens
gggtgctgtggtcatgcagga

SEQ ID NO: 7247987 - DNA, 22 bp, Homo sapiens
gggtgaggagctgccagtcatg

SEQ ID NO: 7247988 - DNA, 22 bp, Homo sapiens
gggtgaggagctgccagtcatg

SEQ ID NO: 7247989 - DNA, 22 bp, Homo sapiens
gggtgaggcccatttgaggcca

SEQ ID NO: 7247990 - DNA, 22 bp, Homo sapiens
gggtgaggccttgctgccatca

SEQ ID NO: 7247991 - DNA, 22 bp, Homo sapiens
gggtgagggatgagccttcttc

SEQ ID NO: 7247992 - DNA, 22 bp, Homo sapiens
ggggtgggagtgccatccttga

SEQ ID NO: 7247993 - DNA, 19 bp, Homo sapiens
ggggtggctggggctccag

SEQ ID NO: 7247994 - DNA, 22 bp, Homo sapiens
ggggtgggagtgccatccttga

SEQ ID NO: 7247995 - DNA, 22 bp, Homo sapiens
ggggtggcctgtaggcagcatg

SEQ ID NO: 7247996 - DNA, 22 bp, Homo sapiens
ggggtggctggcacctcctggt

SEQ ID NO: 7247997 - DNA, 22 bp, Homo sapiens
ggggtggccaaggactctgacc

SEQ ID NO: 7247998 - DNA, 22 bp, Homo sapiens
ggggtggccctaccctctggaa

SEQ ID NO: 7247999 - DNA, 22 bp, Homo sapiens
ggggtggatttcaggcggtgtc

SEQ ID NO: 7248000 - DNA, 22 bp, Homo sapiens
ggggtggatttcaggcggtgtc

SEQ ID NO: 7248001 - DNA, 22 bp, Homo sapiens
ggggtggattcctacaggtcca

SEQ ID NO: 7248002 - DNA, 22 bp, Homo sapiens
ggggtggatttcaggcggtgtc

SEQ ID NO: 7248003 - DNA, 22 bp, Homo sapiens
ggggtggatcaggcaggcccag

SEQ ID NO: 7248004 - DNA, 22 bp, Homo sapiens
ggggtggagctaaatgtctact

SEQ ID NO: 7248005 - DNA, 22 bp, Homo sapiens
ggggtggattcctacaggtcca

SEQ ID NO: 7248006 - DNA, 19 bp, Homo sapiens
ggggtgctagggagggatc

SEQ ID NO: 7248007 - DNA, 22 bp, Homo sapiens
ggggtgctgaagatgtcatggt

SEQ ID NO: 7248008 - DNA, 22 bp, Homo sapiens
ggggtgctagagtggggccact

SEQ ID NO: 7248009 - DNA, 22 bp, Homo sapiens
ggggtgagttagcgtcggcttg

SEQ ID NO: 7248010 - DNA, 22 bp, Homo sapiens
ggggtgctgaagatgtcatggt

SEQ ID NO: 7248011 - DNA, 22 bp, Homo sapiens
ggggtggagatggtggcccttt

SEQ ID NO: 7248012 - DNA, 22 bp, Homo sapiens
ggggtggagctaaatgtctact

SEQ ID NO: 7248013 - DNA, 22 bp, Homo sapiens
ggggccagatatcactaaggtt

SEQ ID NO: 7248014 - DNA, 22 bp, Homo sapiens
ggggccaggtccagcttccaaa

SEQ ID NO: 7248015 - DNA, 22 bp, Homo sapiens
ggggccagtaggagtgatgtac

SEQ ID NO: 7248016 - DNA, 22 bp, Homo sapiens
ggggccagcttcgcgtgctctt

SEQ ID NO: 7248017 - DNA, 22 bp, Homo sapiens
ggggcccagcacccctcctcgc

SEQ ID NO: 7248018 - DNA, 20 bp, Homo sapiens
ggggcccaagccctcttgcc

SEQ ID NO: 7248019 - DNA, 22 bp, Homo sapiens
ggggccagtaggagtgatgtac

SEQ ID NO: 7248020 - DNA, 22 bp, Homo sapiens
ggggccagtaggagtgatgtac

SEQ ID NO: 7248021 - DNA, 22 bp, Homo sapiens
ggggcccttgtggctgcaggcc

SEQ ID NO: 7248022 - DNA, 22 bp, Homo sapiens
ggggtagggcgattgctgcttt

SEQ ID NO: 7248023 - DNA, 22 bp, Homo sapiens
ggggtgagtgctcagccccgga

SEQ ID NO: 7248024 - DNA, 22 bp, Homo sapiens
ggggcccagggcagcagtgcag

SEQ ID NO: 7248025 - DNA, 22 bp, Homo sapiens
ggggcccagcacccctcctcgc

SEQ ID NO: 7248026 - DNA, 22 bp, Homo sapiens
ggggcccagggcagcagtgcag

SEQ ID NO: 7248027 - DNA, 19 bp, Homo sapiens
ggggcccggggtctgcgag

SEQ ID NO: 7248028 - DNA, 22 bp, Homo sapiens
ggggcccgggcactggccgtca

SEQ ID NO: 7248029 - DNA, 22 bp, Homo sapiens
ggggcccgggcactggccgtca

SEQ ID NO: 7248030 - DNA, 22 bp, Homo sapiens
ggggcaggaggtgttctctttt

SEQ ID NO: 7248031 - DNA, 22 bp, Homo sapiens
ggggcaggaggtgttctctttt

SEQ ID NO: 7248032 - DNA, 22 bp, Homo sapiens
ggggagttcatgcatttgtgga

SEQ ID NO: 7248033 - DNA, 22 bp, Homo sapiens
ggggagtgacgcagggccatag

SEQ ID NO: 7248034 - DNA, 22 bp, Homo sapiens
ggggaggctgatgtgggcaaag

SEQ ID NO: 7248035 - DNA, 22 bp, Homo sapiens
ggggagtgttttcatgggcttg

SEQ ID NO: 7248036 - DNA, 22 bp, Homo sapiens
ggggagtgttttcatgggcttg

SEQ ID NO: 7248037 - DNA, 22 bp, Homo sapiens
ggggcagggaggttatcgccga

SEQ ID NO: 7248038 - DNA, 22 bp, Homo sapiens
ggggcagggaggttatcgccga

SEQ ID NO: 7248039 - DNA, 22 bp, Homo sapiens
ggggcagtgaggtggcagcccg

SEQ ID NO: 7248040 - DNA, 20 bp, Homo sapiens
ggggcaggtttttatggcta

SEQ ID NO: 7248041 - DNA, 22 bp, Homo sapiens
ggggcatcagaaccctgtggga

SEQ ID NO: 7248042 - DNA, 22 bp, Homo sapiens
ggggcagtttctcgtttgccat

SEQ ID NO: 7248043 - DNA, 22 bp, Homo sapiens
ggggccagagaggacccaggtg

SEQ ID NO: 7248044 - DNA, 22 bp, Homo sapiens
ggggaggagccatgtaactagt

SEQ ID NO: 7248045 - DNA, 22 bp, Homo sapiens
ggggaggacctttccaaggctt

SEQ ID NO: 7248046 - DNA, 22 bp, Homo sapiens
ggggaggctgatgtgggcaaag

SEQ ID NO: 7248047 - DNA, 22 bp, Homo sapiens
ggggaggccagtggaccgtccc

SEQ ID NO: 7248048 - DNA, 22 bp, Homo sapiens
ggggaggcaagatgaagtgagg

SEQ ID NO: 7248049 - DNA, 22 bp, Homo sapiens
ggggaggaagctggaacacggg

SEQ ID NO: 7248050 - DNA, 22 bp, Homo sapiens
gggcttctgttcctttcacttg

SEQ ID NO: 7248051 - DNA, 22 bp, Homo sapiens
gggcttctgtacctacctggaa

SEQ ID NO: 7248052 - DNA, 22 bp, Homo sapiens
ggggagaattaccaaaagcgct

SEQ ID NO: 7248053 - DNA, 22 bp, Homo sapiens
gggctctggggtgccctggcat

SEQ ID NO: 7248054 - DNA, 16 bp, Homo sapiens
gggctgggggattctg

SEQ ID NO: 7248055 - DNA, 16 bp, Homo sapiens
gggctgggggattctg

SEQ ID NO: 7248056 - DNA, 22 bp, Homo sapiens
gggctctgggatgctcttagag

SEQ ID NO: 7248057 - DNA, 22 bp, Homo sapiens
gggctctgggattcagagcaag

SEQ ID NO: 7248058 - DNA, 18 bp, Homo sapiens
gggctctggcatctgggt

SEQ ID NO: 7248059 - DNA, 18 bp, Homo sapiens
gggctctggcatctgggt

SEQ ID NO: 7248060 - DNA, 19 bp, Homo sapiens
gggctctggcctcagtggg

SEQ ID NO: 7248061 - DNA, 22 bp, Homo sapiens
gggcttaattcatcccataaat

SEQ ID NO: 7248062 - DNA, 22 bp, Homo sapiens
gggcttaagatttggcgcggtt

SEQ ID NO: 7248063 - DNA, 22 bp, Homo sapiens
gggcttaaggccagtgtgcttt

SEQ ID NO: 7248064 - DNA, 22 bp, Homo sapiens
gggcttaaggtgcaaagtcata

SEQ ID NO: 7248065 - DNA, 22 bp, Homo sapiens
gggcttctacttgcaaaggata

SEQ ID NO: 7248066 - DNA, 22 bp, Homo sapiens
gggcttcagttctgaccatctt

SEQ ID NO: 7248067 - DNA, 22 bp, Homo sapiens
gggcttctaagtgaaagtgtaa

SEQ ID NO: 7248068 - DNA, 22 bp, Homo sapiens
gggcttctattctggcacaaga

SEQ ID NO: 7248069 - DNA, 22 bp, Homo sapiens
gggcttctctcagaaactatca

SEQ ID NO: 7248070 - DNA, 22 bp, Homo sapiens
gggcttctctcaggggcatgag

SEQ ID NO: 7248071 - DNA, 22 bp, Homo sapiens
gggcttctctgatcaatatttc

SEQ ID NO: 7248072 - DNA, 22 bp, Homo sapiens
gggcttctctgggagtcctggt

SEQ ID NO: 7248073 - DNA, 22 bp, Homo sapiens
gggcttctgggcaccactccct

SEQ ID NO: 7248074 - DNA, 22 bp, Homo sapiens
gggcttctctttagtgagctga

SEQ ID NO: 7248075 - DNA, 22 bp, Homo sapiens
gggcaggtgtgcagagctgttg

SEQ ID NO: 7248076 - DNA, 22 bp, Homo sapiens
gggcaggtggcagggtctctgg

SEQ ID NO: 7248077 - DNA, 22 bp, Homo sapiens
gggcaggtgcccagggccagag

SEQ ID NO: 7248078 - DNA, 22 bp, Homo sapiens
gggcaggtggagggcccagcca

SEQ ID NO: 7248079 - DNA, 22 bp, Homo sapiens
gggccccttgtatctctggctc

SEQ ID NO: 7248080 - DNA, 22 bp, Homo sapiens
gggccccttgctgctctgctgg

SEQ ID NO: 7248081 - DNA, 22 bp, Homo sapiens
gggccccagtcctcccacgtgg

SEQ ID NO: 7248082 - DNA, 22 bp, Homo sapiens
gggccccactggggctgcctgc

SEQ ID NO: 7248083 - DNA, 22 bp, Homo sapiens
gggccccaagaacctcctcctg

SEQ ID NO: 7248084 - DNA, 22 bp, Homo sapiens
gggccccaaaatgccaggctct

SEQ ID NO: 7248085 - DNA, 22 bp, Homo sapiens
gggcccagtaccctctgccaag

SEQ ID NO: 7248086 - DNA, 22 bp, Homo sapiens
gggcccagtaccctctgccaag

SEQ ID NO: 7248087 - DNA, 22 bp, Homo sapiens
gggcccagtaccctctgccaag

SEQ ID NO: 7248088 - DNA, 22 bp, Homo sapiens
gggcaggtgtttccaaggtgag

SEQ ID NO: 7248089 - DNA, 22 bp, Homo sapiens
gggccctgccccgtggctctga

SEQ ID NO: 7248090 - DNA, 22 bp, Homo sapiens
gggccctgatctgtgagcgcag

SEQ ID NO: 7248091 - DNA, 22 bp, Homo sapiens
gggccctgcctaaggaacacac

SEQ ID NO: 7248092 - DNA, 22 bp, Homo sapiens
gggccctgcgactcgcggcgga

SEQ ID NO: 7248093 - DNA, 22 bp, Homo sapiens
gggccctgcctaaggaacacac

SEQ ID NO: 7248094 - DNA, 22 bp, Homo sapiens
gggccctgggattcagagcaag

SEQ ID NO: 7248095 - DNA, 22 bp, Homo sapiens
gggccctggggatgtggacgcg

SEQ ID NO: 7248096 - DNA, 19 bp, Homo sapiens
gggcctcacccacacctcc

SEQ ID NO: 7248097 - DNA, 21 bp, Homo sapiens
gggctatgttggccaccttcc

SEQ ID NO: 7248098 - DNA, 22 bp, Homo sapiens
gggccctggggcctgatttgca

SEQ ID NO: 7248099 - DNA, 22 bp, Homo sapiens
gggccctgtgatttcttgagga

SEQ ID NO: 7248100 - DNA, 22 bp, Homo sapiens
gggccggagctgggtcccgcgc

SEQ ID NO: 7248101 - DNA, 22 bp, Homo sapiens
gggctccaactacatcagcctt

SEQ ID NO: 7248102 - DNA, 22 bp, Homo sapiens
gggctctgaatcccaggtctgc

SEQ ID NO: 7248103 - DNA, 22 bp, Homo sapiens
gggctccaacggtgagcatgga

SEQ ID NO: 7248104 - DNA, 22 bp, Homo sapiens
gggctctggagttctagaaaga

SEQ ID NO: 7248105 - DNA, 22 bp, Homo sapiens
gggctctggatggagcctgcag

SEQ ID NO: 7248106 - DNA, 22 bp, Homo sapiens
gggctctggaaatgggagctcc

SEQ ID NO: 7248107 - DNA, 22 bp, Homo sapiens
gggctctggaaatgggagctcc

SEQ ID NO: 7248108 - DNA, 22 bp, Homo sapiens
gggctctggacccaggcaagag

SEQ ID NO: 7248109 - DNA, 22 bp, Homo sapiens
gggctcagttctgcttcatgct

SEQ ID NO: 7248110 - DNA, 22 bp, Homo sapiens
gggctcagctgggcgtgctggt

SEQ ID NO: 7248111 - DNA, 21 bp, Homo sapiens
gggctcagcgctcggctcctc

SEQ ID NO: 7248112 - DNA, 22 bp, Homo sapiens
gggctcagacatccctcctgga

SEQ ID NO: 7248113 - DNA, 22 bp, Homo sapiens
gggctcagaggagtggcctggg

SEQ ID NO: 7248114 - DNA, 22 bp, Homo sapiens
gggctcagccccattgaaccag

SEQ ID NO: 7248115 - DNA, 23 bp, Homo sapiens
gggctcagatttcattctgtgcc

SEQ ID NO: 7248116 - DNA, 21 bp, Homo sapiens
gggcagaggggcctcctgggt

SEQ ID NO: 7248117 - DNA, 22 bp, Homo sapiens
gggcagaggctctggcccatcc

SEQ ID NO: 7248118 - DNA, 22 bp, Homo sapiens
gggcaggtgccagctccctgtc

SEQ ID NO: 7248119 - DNA, 22 bp, Homo sapiens
gggcaggtctgggtcagcctga

SEQ ID NO: 7248120 - DNA, 22 bp, Homo sapiens
gggcaggtgacctcttgtcctg

SEQ ID NO: 7248121 - DNA, 22 bp, Homo sapiens
gggcaggtgattttggctccat

SEQ ID NO: 7248122 - DNA, 15 bp, Homo sapiens
gggcaggtctggggc

SEQ ID NO: 7248123 - DNA, 22 bp, Homo sapiens
gggcactgtacactgtgcatgg

SEQ ID NO: 7248124 - DNA, 22 bp, Homo sapiens
gggcactgtgctaggtgctgag

SEQ ID NO: 7248125 - DNA, 22 bp, Homo sapiens
gggcagagactcagaaacagaa

SEQ ID NO: 7248126 - DNA, 22 bp, Homo sapiens
gggcagagactcagaaacagaa

SEQ ID NO: 7248127 - DNA, 22 bp, Homo sapiens
gggcagagagctggaactcctt

SEQ ID NO: 7248128 - DNA, 20 bp, Homo sapiens
gggcagagccagccagtccc

SEQ ID NO: 7248129 - DNA, 20 bp, Homo sapiens
gggcagagccagccagtccc

SEQ ID NO: 7248130 - DNA, 20 bp, Homo sapiens
gggcagagccagccagtccc

SEQ ID NO: 7248131 - DNA, 20 bp, Homo sapiens
gggcagagccagccagtccc

SEQ ID NO: 7248132 - DNA, 22 bp, Homo sapiens
gggagctgaatggcaatggaga

SEQ ID NO: 7248133 - DNA, 22 bp, Homo sapiens
gggagtggagagcaatggatga

SEQ ID NO: 7248134 - DNA, 22 bp, Homo sapiens
gggagctgaagtaggggtaaat

SEQ ID NO: 7248135 - DNA, 22 bp, Homo sapiens
gggagctgaaggagccggcggg

SEQ ID NO: 7248136 - DNA, 22 bp, Homo sapiens
gggagctgaaggagccggcggg

SEQ ID NO: 7248137 - DNA, 22 bp, Homo sapiens
gggagctgaactgctgaagttg

SEQ ID NO: 7248138 - DNA, 22 bp, Homo sapiens
gggagctctccctgaggcctgg

SEQ ID NO: 7248139 - DNA, 22 bp, Homo sapiens
gggagcgggactgcgcaggctt

SEQ ID NO: 7248140 - DNA, 22 bp, Homo sapiens
gggagcgggactgcgcaggctt

SEQ ID NO: 7248141 - DNA, 20 bp, Homo sapiens
gggagtggtggtagcctgtg

SEQ ID NO: 7248142 - DNA, 22 bp, Homo sapiens
gggagtgggtttggcctaggcc

SEQ ID NO: 7248143 - DNA, 22 bp, Homo sapiens
gggagtggtcctttcctatctg

SEQ ID NO: 7248144 - DNA, 22 bp, Homo sapiens
gggagtgggtttggcctaggcc

SEQ ID NO: 7248145 - DNA, 22 bp, Homo sapiens
gggagtggggcttaccttgaag

SEQ ID NO: 7248146 - DNA, 22 bp, Homo sapiens
gggagtggttgatggtgaaaat

SEQ ID NO: 7248147 - DNA, 22 bp, Homo sapiens
gggataagagagtatttatgca

SEQ ID NO: 7248148 - DNA, 22 bp, Homo sapiens
ggctgccagtgagtgcagaccg

SEQ ID NO: 7248149 - DNA, 22 bp, Homo sapiens
ggctgccaggagaagctcagtg

SEQ ID NO: 7248150 - DNA, 22 bp, Homo sapiens
ggctgccagcactggtgtagag

SEQ ID NO: 7248151 - DNA, 22 bp, Homo sapiens
ggctgccacgtcgagggtccaa

SEQ ID NO: 7248152 - DNA, 22 bp, Homo sapiens
ggctgcagttgtgtgaaggccg

SEQ ID NO: 7248153 - DNA, 22 bp, Homo sapiens
ggctgcagttgtgtgaaggccg

SEQ ID NO: 7248154 - DNA, 17 bp, Homo sapiens
ggctgcagtccaggagg

SEQ ID NO: 7248155 - DNA, 20 bp, Homo sapiens
ggctgcagtgcacctcatct

SEQ ID NO: 7248156 - DNA, 22 bp, Homo sapiens
ggctgcaggttggttggcagct

SEQ ID NO: 7248157 - DNA, 22 bp, Homo sapiens
ggctgcaggcttccctccagca

SEQ ID NO: 7248158 - DNA, 22 bp, Homo sapiens
ggctctgcgcggtaaagtgact

SEQ ID NO: 7248159 - DNA, 22 bp, Homo sapiens
ggctctgcgcctgcggggactt

SEQ ID NO: 7248160 - DNA, 22 bp, Homo sapiens
ggctctgcggcgtgtgcgcagg

SEQ ID NO: 7248161 - DNA, 21 bp, Homo sapiens
ggctgcagggagccctggggt

SEQ ID NO: 7248162 - DNA, 22 bp, Homo sapiens
ggctgcaggcttccctccagca

SEQ ID NO: 7248163 - DNA, 21 bp, Homo sapiens
ggctgcagggagccctggggt

SEQ ID NO: 7248164 - DNA, 22 bp, Homo sapiens
ggctggagacaacgtcctgccc

SEQ ID NO: 7248165 - DNA, 17 bp, Homo sapiens
ggctggagcagctcccc

SEQ ID NO: 7248166 - DNA, 19 bp, Homo sapiens
ggctggagtggccatctgt

SEQ ID NO: 7248167 - DNA, 22 bp, Homo sapiens
ggctggagtgggctccagagtt

SEQ ID NO: 7248168 - DNA, 22 bp, Homo sapiens
ggctgtggacactgagctcaga

SEQ ID NO: 7248169 - DNA, 22 bp, Homo sapiens
ggctgtggacactgagctcaga

SEQ ID NO: 7248170 - DNA, 22 bp, Homo sapiens
ggctgtgcgggcagccgtggga

SEQ ID NO: 7248171 - DNA, 22 bp, Homo sapiens
ggctgtgcgtcatccggctgca

SEQ ID NO: 7248172 - DNA, 22 bp, Homo sapiens
ggctgtgggatgcataggagct

SEQ ID NO: 7248173 - DNA, 22 bp, Homo sapiens
ggctgtggggaccaacaggact

SEQ ID NO: 7248174 - DNA, 22 bp, Homo sapiens
gggaagagggagctggaatgat

SEQ ID NO: 7248175 - DNA, 23 bp, Homo sapiens
gggagatgggaaatgaaggctct

SEQ ID NO: 7248176 - DNA, 22 bp, Homo sapiens
gggaaggcatacctgagggaga

SEQ ID NO: 7248177 - DNA, 22 bp, Homo sapiens
gggagccagcctttgcctataa

SEQ ID NO: 7248178 - DNA, 23 bp, Homo sapiens
gggagccaggacctcgcgcccca

SEQ ID NO: 7248179 - DNA, 22 bp, Homo sapiens
gggaagagtgtcggttgaagtg

SEQ ID NO: 7248180 - DNA, 22 bp, Homo sapiens
gggaagagtaactagcccatgt

SEQ ID NO: 7248181 - DNA, 22 bp, Homo sapiens
gggaagagtaactagcccatgt

SEQ ID NO: 7248182 - DNA, 22 bp, Homo sapiens
gggaagagggagctggaatgat

SEQ ID NO: 7248183 - DNA, 22 bp, Homo sapiens
gggaagagtgtcggttgaagtg

SEQ ID NO: 7248184 - DNA, 22 bp, Homo sapiens
gggaagcagcattgtgctggct

SEQ ID NO: 7248185 - DNA, 22 bp, Homo sapiens
gggaagcagcattgtgctggct

SEQ ID NO: 7248186 - DNA, 22 bp, Homo sapiens
gggaaggcagtgggaggaactg

SEQ ID NO: 7248187 - DNA, 22 bp, Homo sapiens
gggaaggcagtgggaggaactg

SEQ ID NO: 7248188 - DNA, 22 bp, Homo sapiens
gggaaggcagtgtctggttgaa

SEQ ID NO: 7248189 - DNA, 22 bp, Homo sapiens
gggaaggcaggattctctggtg

SEQ ID NO: 7248190 - DNA, 22 bp, Homo sapiens
gggaaggcaccatggtgttcca

SEQ ID NO: 7248191 - DNA, 22 bp, Homo sapiens
gggaaggcaggattctctggtg

SEQ ID NO: 7248192 - DNA, 22 bp, Homo sapiens
gggaagccatgctcagaggtac

SEQ ID NO: 7248193 - DNA, 18 bp, Homo sapiens
gggaagccgggaagccgg

SEQ ID NO: 7248194 - DNA, 22 bp, Homo sapiens
ggcagggccctgattcctgggg

SEQ ID NO: 7248195 - DNA, 22 bp, Homo sapiens
ggcagggcttgtctctgtgatg

SEQ ID NO: 7248196 - DNA, 22 bp, Homo sapiens
ggcagtggcagagcttggtcta

SEQ ID NO: 7248197 - DNA, 17 bp, Homo sapiens
ggcagtggaggaagaga

SEQ ID NO: 7248198 - DNA, 22 bp, Homo sapiens
ggcagtgcccggtgcctcctct

SEQ ID NO: 7248199 - DNA, 22 bp, Homo sapiens
ggcagtgcaaggcagcctggat

SEQ ID NO: 7248200 - DNA, 22 bp, Homo sapiens
ggcagtgatgtcaaacagtgaa

SEQ ID NO: 7248201 - DNA, 21 bp, Homo sapiens
ggcagtgatgtgaagtgcatc

SEQ ID NO: 7248202 - DNA, 22 bp, Homo sapiens
ggcagtgagtcccggagaggcc

SEQ ID NO: 7248203 - DNA, 22 bp, Homo sapiens
ggcagtgagctggagggaagga

SEQ ID NO: 7248204 - DNA, 22 bp, Homo sapiens
ggcagccatgtcccagggcttc

SEQ ID NO: 7248205 - DNA, 22 bp, Homo sapiens
ggcagccctttctggccagctc

SEQ ID NO: 7248206 - DNA, 21 bp, Homo sapiens
ggcagcctctgtggaagggga

SEQ ID NO: 7248207 - DNA, 22 bp, Homo sapiens
ggcaggcttgatatggggggac

SEQ ID NO: 7248208 - DNA, 22 bp, Homo sapiens
ggcagctcactgattagcaatt

SEQ ID NO: 7248209 - DNA, 21 bp, Homo sapiens
ggcagctcagcagatggggac

SEQ ID NO: 7248210 - DNA, 22 bp, Homo sapiens
ggcagctccaaaaggaaacact

SEQ ID NO: 7248211 - DNA, 20 bp, Homo sapiens
ggcagctcactactttctgt

SEQ ID NO: 7248212 - DNA, 21 bp, Homo sapiens
ggcagctcccagtttgggtgt

SEQ ID NO: 7248213 - DNA, 22 bp, Homo sapiens
ggcagctcccctgggttttatt

SEQ ID NO: 7248214 - DNA, 22 bp, Homo sapiens
ggcagctcctcaaaaaattaaa

SEQ ID NO: 7248215 - DNA, 22 bp, Homo sapiens
ggcagctcctcctagtctgccc

SEQ ID NO: 7248216 - DNA, 22 bp, Homo sapiens
ggcagctcctctcagcaaaaga

SEQ ID NO: 7248217 - DNA, 22 bp, Homo sapiens
ggcagctcgatgacttctgcat

SEQ ID NO: 7248218 - DNA, 20 bp, Homo sapiens
ggcagcgggttcgggcgcag

SEQ ID NO: 7248219 - DNA, 22 bp, Homo sapiens
ggcagctcacctctggtccagg

SEQ ID NO: 7248220 - DNA, 22 bp, Homo sapiens
ggcagctcacgggcatggggtg

SEQ ID NO: 7248221 - DNA, 22 bp, Homo sapiens
ggcacgtgcctaaggagcaggc

SEQ ID NO: 7248222 - DNA, 22 bp, Homo sapiens
ggcagaggtgaagttcacaagg

SEQ ID NO: 7248223 - DNA, 22 bp, Homo sapiens
ggcagaggtgacagtgtctttt

SEQ ID NO: 7248224 - DNA, 22 bp, Homo sapiens
ggcagaggtgacagtgtctttt

SEQ ID NO: 7248225 - DNA, 22 bp, Homo sapiens
ggcagcaactcggagagaagag

SEQ ID NO: 7248226 - DNA, 18 bp, Homo sapiens
ggcagcaagaagggaggg

SEQ ID NO: 7248227 - DNA, 22 bp, Homo sapiens
ggcagcaaatattgtcagctgt

SEQ ID NO: 7248228 - DNA, 22 bp, Homo sapiens
ggcagcacgacaggagtggaag

SEQ ID NO: 7248229 - DNA, 21 bp, Homo sapiens
ggcagcactacctgaagcata

SEQ ID NO: 7248230 - DNA, 22 bp, Homo sapiens
ggcagcactgcagcttgttggg

SEQ ID NO: 7248231 - DNA, 22 bp, Homo sapiens
ggcagcagaactggccctgtat

SEQ ID NO: 7248232 - DNA, 19 bp, Homo sapiens
ggcacctttctgctgtgtc

SEQ ID NO: 7248233 - DNA, 22 bp, Homo sapiens
ggcacctggtaagtgctcagta

SEQ ID NO: 7248234 - DNA, 16 bp, Homo sapiens
ggcaccagtgaacaca

SEQ ID NO: 7248235 - DNA, 22 bp, Homo sapiens
ggcaccaggctgggcataggcc

SEQ ID NO: 7248236 - DNA, 22 bp, Homo sapiens
ggaggcacttcccgtctcagcc

SEQ ID NO: 7248237 - DNA, 17 bp, Homo sapiens
ggaggcaacagacaggg

SEQ ID NO: 7248238 - DNA, 22 bp, Homo sapiens
ggaggatgccaagctgtgcaca

SEQ ID NO: 7248239 - DNA, 22 bp, Homo sapiens
ggaggaggggtgactgaatgct

SEQ ID NO: 7248240 - DNA, 22 bp, Homo sapiens
ggaggaggtgggttaagttgta

SEQ ID NO: 7248241 - DNA, 22 bp, Homo sapiens
ggaggagtcagttgggctgctt

SEQ ID NO: 7248242 - DNA, 22 bp, Homo sapiens
ggaggaggggtttacattggaa

SEQ ID NO: 7248243 - DNA, 22 bp, Homo sapiens
ggaggatgagctacgaggagct

SEQ ID NO: 7248244 - DNA, 22 bp, Homo sapiens
ggaggagtcagttgggctgctt

SEQ ID NO: 7248245 - DNA, 22 bp, Homo sapiens
ggaggagtgtggggcactctgc

SEQ ID NO: 7248246 - DNA, 22 bp, Homo sapiens
ggctcaccatggcctccctgct

SEQ ID NO: 7248247 - DNA, 22 bp, Homo sapiens
ggctcacgcaattatcccggcc

SEQ ID NO: 7248248 - DNA, 23 bp, Homo sapiens
ggctcacacggagtgcctccacc

SEQ ID NO: 7248249 - DNA, 22 bp, Homo sapiens
ggctcaccattttcactctctg

SEQ ID NO: 7248250 - DNA, 18 bp, Homo sapiens
ggcctctggactggcagc

SEQ ID NO: 7248251 - DNA, 22 bp, Homo sapiens
ggcctctggcaggcaggccctc

SEQ ID NO: 7248252 - DNA, 22 bp, Homo sapiens
ggcctctggggtcctgagccca

SEQ ID NO: 7248253 - DNA, 22 bp, Homo sapiens
ggcctctggggtcctgagccca

SEQ ID NO: 7248254 - DNA, 22 bp, Homo sapiens
ggcctctggtgcctgaagcgcc

SEQ ID NO: 7248255 - DNA, 22 bp, Homo sapiens
ggcctctggtcaagacaagcat

SEQ ID NO: 7248256 - DNA, 22 bp, Homo sapiens
ggcctctgcaactggctgtggc

SEQ ID NO: 7248257 - DNA, 19 bp, Homo sapiens
ggcctctgcaggccgcccc

SEQ ID NO: 7248258 - DNA, 22 bp, Homo sapiens
ggcctctgcaactggctgtggc

SEQ ID NO: 7248259 - DNA, 22 bp, Homo sapiens
ggcctctgccccagccacacct

SEQ ID NO: 7248260 - DNA, 19 bp, Homo sapiens
ggcctctgcaggccgcccc

SEQ ID NO: 7248261 - DNA, 22 bp, Homo sapiens
ggcctctgccccgcggggctcg

SEQ ID NO: 7248262 - DNA, 22 bp, Homo sapiens
ggcctctgccctcactcctgtc

SEQ ID NO: 7248263 - DNA, 22 bp, Homo sapiens
ggcctctgccccagccacacct

SEQ ID NO: 7248264 - DNA, 22 bp, Homo sapiens
ggcctctgcctcatctgggcac

SEQ ID NO: 7248265 - DNA, 22 bp, Homo sapiens
ggcctctgcctcatctgggcac

SEQ ID NO: 7248266 - DNA, 21 bp, Homo sapiens
ggcctctgccttgccccactc

SEQ ID NO: 7248267 - DNA, 21 bp, Homo sapiens
ggcctcccggaccgcagcgcc

SEQ ID NO: 7248268 - DNA, 22 bp, Homo sapiens
ggcctctctgagagcagacgtt

SEQ ID NO: 7248269 - DNA, 22 bp, Homo sapiens
ggcctctcttgggacagctgtc

SEQ ID NO: 7248270 - DNA, 22 bp, Homo sapiens
ggctcagcacagggctggcatc

SEQ ID NO: 7248271 - DNA, 22 bp, Homo sapiens
ggctcagcaatgatgagcccct

SEQ ID NO: 7248272 - DNA, 22 bp, Homo sapiens
ggctctgcatgtgagtgggtgg

SEQ ID NO: 7248273 - DNA, 22 bp, Homo sapiens
ggctctgcatgcaggttgtcag

SEQ ID NO: 7248274 - DNA, 22 bp, Homo sapiens
ggctctgcagtgacttgagggg

SEQ ID NO: 7248275 - DNA, 22 bp, Homo sapiens
ggctctgcagagggcccagctt

SEQ ID NO: 7248276 - DNA, 22 bp, Homo sapiens
ggctctgcactcagagtcattc

SEQ ID NO: 7248277 - DNA, 22 bp, Homo sapiens
ggctctgcctgcctgagtgtcc

SEQ ID NO: 7248278 - DNA, 22 bp, Homo sapiens
ggctctgcctgcccagcagcac

SEQ ID NO: 7248279 - DNA, 22 bp, Homo sapiens
ggctctgcctctgaccctctgg

SEQ ID NO: 7248280 - DNA, 22 bp, Homo sapiens
ggctctgcccgcggctgcccac

SEQ ID NO: 7248281 - DNA, 22 bp, Homo sapiens
ggctctgccatttcctagctgc

SEQ ID NO: 7248282 - DNA, 20 bp, Homo sapiens
ggctctgccccaccccgtcc

SEQ ID NO: 7248283 - DNA, 22 bp, Homo sapiens
ggctctgcccaggtggacagca

SEQ ID NO: 7248284 - DNA, 22 bp, Homo sapiens
ggcccagctgggcggggacacg

SEQ ID NO: 7248285 - DNA, 22 bp, Homo sapiens
ggcccagctgggcggggacacg

SEQ ID NO: 7248286 - DNA, 22 bp, Homo sapiens
ggcccagctgtatattacagtt

SEQ ID NO: 7248287 - DNA, 22 bp, Homo sapiens
ggcccagctgtgcttccagccc

SEQ ID NO: 7248288 - DNA, 22 bp, Homo sapiens
ggcccagctttcattccttgct

SEQ ID NO: 7248289 - DNA, 22 bp, Homo sapiens
ggcccagctgtgcttccagccc

SEQ ID NO: 7248290 - DNA, 22 bp, Homo sapiens
ggcccaggatgcaagaactgaa

SEQ ID NO: 7248291 - DNA, 22 bp, Homo sapiens
ggcccaggctggagtgcagtgg

SEQ ID NO: 7248292 - DNA, 22 bp, Homo sapiens
ggcccaggtccagcgagtacct

SEQ ID NO: 7248293 - DNA, 22 bp, Homo sapiens
ggcccaggctggagtgcggtgg

SEQ ID NO: 7248294 - DNA, 22 bp, Homo sapiens
ggcccatgcatcctgtgcagcc

SEQ ID NO: 7248295 - DNA, 22 bp, Homo sapiens
ggcccatccatgctgctggtct

SEQ ID NO: 7248296 - DNA, 22 bp, Homo sapiens
ggccagctgccaccagccctat

SEQ ID NO: 7248297 - DNA, 22 bp, Homo sapiens
ggccagctggagttccgggtgg

SEQ ID NO: 7248298 - DNA, 20 bp, Homo sapiens
ggccagctggaggcgccggg

SEQ ID NO: 7248299 - DNA, 22 bp, Homo sapiens
ggcccagctctattgaattaca

SEQ ID NO: 7248300 - DNA, 19 bp, Homo sapiens
ggccacctctcttcccagg

SEQ ID NO: 7248301 - DNA, 22 bp, Homo sapiens
ggccacctctgccctactgagt

SEQ ID NO: 7248302 - DNA, 22 bp, Homo sapiens
ggccagagtctatatgcagaca

SEQ ID NO: 7248303 - DNA, 22 bp, Homo sapiens
ggccaccagtcctctggcaggg

SEQ ID NO: 7248304 - DNA, 22 bp, Homo sapiens
ggccacatgaattcttggacag

SEQ ID NO: 7248305 - DNA, 22 bp, Homo sapiens
ggcagtggctgtagtctcttgg

SEQ ID NO: 7248306 - DNA, 22 bp, Homo sapiens
ggcagtgggaaataagtgagaa

SEQ ID NO: 7248307 - DNA, 22 bp, Homo sapiens
ggcagtgggtggatctcaggga

SEQ ID NO: 7248308 - DNA, 22 bp, Homo sapiens
ggccacagagggcgggatgctg

SEQ ID NO: 7248309 - DNA, 22 bp, Homo sapiens
ggccacagtctctggaaggatg

SEQ ID NO: 7248310 - DNA, 20 bp, Homo sapiens
ggccacagggtgctggtgga

SEQ ID NO: 7248311 - DNA, 22 bp, Homo sapiens
gctggagctgcagcctgggcct

SEQ ID NO: 7248312 - DNA, 22 bp, Homo sapiens
gctggagcttgagaggacaggg

SEQ ID NO: 7248313 - DNA, 16 bp, Homo sapiens
gctggagggaggggtt

SEQ ID NO: 7248314 - DNA, 22 bp, Homo sapiens
gctggaggggtaataggatggg

SEQ ID NO: 7248315 - DNA, 22 bp, Homo sapiens
gctggaggggtaataggatggg

SEQ ID NO: 7248316 - DNA, 22 bp, Homo sapiens
gctgctgcttgaaggctcggag

SEQ ID NO: 7248317 - DNA, 22 bp, Homo sapiens
gctggcagtttcctcaccgagg

SEQ ID NO: 7248318 - DNA, 22 bp, Homo sapiens
gctggcagtgtgaatgacaagc

SEQ ID NO: 7248319 - DNA, 22 bp, Homo sapiens
gctggcagtgtattgttagctg

SEQ ID NO: 7248320 - DNA, 22 bp, Homo sapiens
gctggcagtcccatcagctggg

SEQ ID NO: 7248321 - DNA, 22 bp, Homo sapiens
gctggcagtcccatcagctggg

SEQ ID NO: 7248322 - DNA, 22 bp, Homo sapiens
gctggcagtaaagggtttggca

SEQ ID NO: 7248323 - DNA, 22 bp, Homo sapiens
gctggcagggtggttgagagag

SEQ ID NO: 7248324 - DNA, 22 bp, Homo sapiens
gctggcaggtaaagccccgggg

SEQ ID NO: 7248325 - DNA, 22 bp, Homo sapiens
gctggcagggttctcactgaaa

SEQ ID NO: 7248326 - DNA, 22 bp, Homo sapiens
gctggcaggtccaagatagagc

SEQ ID NO: 7248327 - DNA, 22 bp, Homo sapiens
gctggaggtggtgagaaaaggt

SEQ ID NO: 7248328 - DNA, 22 bp, Homo sapiens
gctggaggtggtgagaaaaggt

SEQ ID NO: 7248329 - DNA, 22 bp, Homo sapiens
gctggaggtggtgagaaaaggt

SEQ ID NO: 7248330 - DNA, 22 bp, Homo sapiens
gctggaggtagggaggtcctgt

SEQ ID NO: 7248331 - DNA, 22 bp, Homo sapiens
gctggaggtttcacctgagttt

SEQ ID NO: 7248332 - DNA, 22 bp, Homo sapiens
gctgcaggctgtggcaggggag

SEQ ID NO: 7248333 - DNA, 22 bp, Homo sapiens
gctgcaggcggccgtggtggcg

SEQ ID NO: 7248334 - DNA, 22 bp, Homo sapiens
gctgcaggcgcctgcggtctct

SEQ ID NO: 7248335 - DNA, 22 bp, Homo sapiens
gctgcaggctctgcaggaattg

SEQ ID NO: 7248336 - DNA, 22 bp, Homo sapiens
gctgcagggctctcacaggggg

SEQ ID NO: 7248337 - DNA, 22 bp, Homo sapiens
gctgcagggagctggaaggctc

SEQ ID NO: 7248338 - DNA, 22 bp, Homo sapiens
gctgcagggagctggaaggctc

SEQ ID NO: 7248339 - DNA, 22 bp, Homo sapiens
gctgcctcccagagccctgcag

SEQ ID NO: 7248340 - DNA, 22 bp, Homo sapiens
gctgcctcccagagccctgcag

SEQ ID NO: 7248341 - DNA, 22 bp, Homo sapiens
gctgagttgaaagcagaggata

SEQ ID NO: 7248342 - DNA, 22 bp, Homo sapiens
gctctgggtagccactgcctgg

SEQ ID NO: 7248343 - DNA, 22 bp, Homo sapiens
gctctctgccatatgaggatac

SEQ ID NO: 7248344 - DNA, 22 bp, Homo sapiens
gctccctcccaccagcctgcag

SEQ ID NO: 7248345 - DNA, 19 bp, Homo sapiens
gctctccctctcagttgag

SEQ ID NO: 7248346 - DNA, 22 bp, Homo sapiens
gctctctgaggtgctggcagag

SEQ ID NO: 7248347 - DNA, 22 bp, Homo sapiens
gctagaaatcgacttcagaatt

SEQ ID NO: 7248348 - DNA, 22 bp, Homo sapiens
gctagaaaatgaaagataattt

SEQ ID NO: 7248349 - DNA, 22 bp, Homo sapiens
gcctggagtggtcctgctgccc

SEQ ID NO: 7248350 - DNA, 22 bp, Homo sapiens
gcctggagtgttggtatttctc

SEQ ID NO: 7248351 - DNA, 20 bp, Homo sapiens
gcctggagttagttttcctt

SEQ ID NO: 7248352 - DNA, 22 bp, Homo sapiens
gcctggagttcagccaagtccc

SEQ ID NO: 7248353 - DNA, 22 bp, Homo sapiens
gctaggagattgagctctgaag

SEQ ID NO: 7248354 - DNA, 22 bp, Homo sapiens
gctaggagccgctgcactaggt

SEQ ID NO: 7248355 - DNA, 22 bp, Homo sapiens
gctaggaggaagaatgtgaatt

SEQ ID NO: 7248356 - DNA, 22 bp, Homo sapiens
gctagggactagggaaggagca

SEQ ID NO: 7248357 - DNA, 22 bp, Homo sapiens
gctaggagtggtgggtcaagga

SEQ ID NO: 7248358 - DNA, 22 bp, Homo sapiens
gctaggaggccctgcacgctta

SEQ ID NO: 7248359 - DNA, 22 bp, Homo sapiens
gctaggagtgggatggaagtcg

SEQ ID NO: 7248360 - DNA, 22 bp, Homo sapiens
gctcagggaactttttgcaggc

SEQ ID NO: 7248361 - DNA, 22 bp, Homo sapiens
gctcagggaatgagaagatgtt

SEQ ID NO: 7248362 - DNA, 20 bp, Homo sapiens
gctcagggaattcaggaagc

SEQ ID NO: 7248363 - DNA, 22 bp, Homo sapiens
gctcagggagtttcacagtgta

SEQ ID NO: 7248364 - DNA, 22 bp, Homo sapiens
gctcagggagagagggcagccg

SEQ ID NO: 7248365 - DNA, 22 bp, Homo sapiens
gctcagggagagagggcagccg

SEQ ID NO: 7248366 - DNA, 22 bp, Homo sapiens
gctcagggccatggaccagcag

SEQ ID NO: 7248367 - DNA, 22 bp, Homo sapiens
gctcagggcctggctgcggact

SEQ ID NO: 7248368 - DNA, 22 bp, Homo sapiens
gctcagggcctggctgcggact

SEQ ID NO: 7248369 - DNA, 22 bp, Homo sapiens
gctcagggccatggaccagcag

SEQ ID NO: 7248370 - DNA, 20 bp, Homo sapiens
gctcagggcctgggtctgga

SEQ ID NO: 7248371 - DNA, 22 bp, Homo sapiens
gctcagggcgcgagggacgtgg

SEQ ID NO: 7248372 - DNA, 22 bp, Homo sapiens
gctgtactagggctggagcttc

SEQ ID NO: 7248373 - DNA, 22 bp, Homo sapiens
gctgtactatttgagactactg

SEQ ID NO: 7248374 - DNA, 22 bp, Homo sapiens
gctgtactgacttgcttagctg

SEQ ID NO: 7248375 - DNA, 22 bp, Homo sapiens
gctggtccattggcactgctca

SEQ ID NO: 7248376 - DNA, 22 bp, Homo sapiens
gctggccaggaagagtctcaga

SEQ ID NO: 7248377 - DNA, 22 bp, Homo sapiens
gctggccacagatccccaggga

SEQ ID NO: 7248378 - DNA, 22 bp, Homo sapiens
gctggccagccctcttcctcca

SEQ ID NO: 7248379 - DNA, 22 bp, Homo sapiens
gctggccacattgtgccgtcct

SEQ ID NO: 7248380 - DNA, 19 bp, Homo sapiens
gctggccacgccccagttg

SEQ ID NO: 7248381 - DNA, 21 bp, Homo sapiens
gctgtactttgaactgggtgt

SEQ ID NO: 7248382 - DNA, 22 bp, Homo sapiens
gctgtactgggagagaagccgt

SEQ ID NO: 7248383 - DNA, 22 bp, Homo sapiens
gctgtctcatacaaggccctgc

SEQ ID NO: 7248384 - DNA, 22 bp, Homo sapiens
gctgtctgctgtgcactgagca

SEQ ID NO: 7248385 - DNA, 22 bp, Homo sapiens
gctgtccctttcacaaggtttt

SEQ ID NO: 7248386 - DNA, 22 bp, Homo sapiens
gctgtcccgctgacttccagct

SEQ ID NO: 7248387 - DNA, 23 bp, Homo sapiens
gctgtccccatgctccatccctg

SEQ ID NO: 7248388 - DNA, 20 bp, Homo sapiens
gctgtcccaggccaaagggc

SEQ ID NO: 7248389 - DNA, 23 bp, Homo sapiens
gctgtctgtcatctctgcgggag

SEQ ID NO: 7248390 - DNA, 22 bp, Homo sapiens
gctgtctgctgtgcactgagca

SEQ ID NO: 7248391 - DNA, 20 bp, Homo sapiens
gctgtctggattagaagcct

SEQ ID NO: 7248392 - DNA, 22 bp, Homo sapiens
gcttggggtcatgaggctgctg

SEQ ID NO: 7248393 - DNA, 20 bp, Homo sapiens
gcttggcaggttttgttgcc

SEQ ID NO: 7248394 - DNA, 22 bp, Homo sapiens
gcttggcagggcctgctggagc

SEQ ID NO: 7248395 - DNA, 22 bp, Homo sapiens
gcttaaatcccaatgctagacc

SEQ ID NO: 7248396 - DNA, 22 bp, Homo sapiens
gcttaaattgtttgtggatagt

SEQ ID NO: 7248397 - DNA, 22 bp, Homo sapiens
gcttttattgtctttacgacga

SEQ ID NO: 7248398 - DNA, 19 bp, Homo sapiens
gcttttattgctcaggtgc

SEQ ID NO: 7248399 - DNA, 22 bp, Homo sapiens
gcttttatgcacataagggtca

SEQ ID NO: 7248400 - DNA, 22 bp, Homo sapiens
gcttttatttcttcacaaaagt

SEQ ID NO: 7248401 - DNA, 22 bp, Homo sapiens
gcttttctataagaactttcaa

SEQ ID NO: 7248402 - DNA, 22 bp, Homo sapiens
gctttactgtctggaaagtttg

SEQ ID NO: 7248403 - DNA, 22 bp, Homo sapiens
gctttatccgcttgacccttac

SEQ ID NO: 7248404 - DNA, 22 bp, Homo sapiens
ggaaggagccatatcatatcca

SEQ ID NO: 7248405 - DNA, 22 bp, Homo sapiens
ggaaggaggatgctctggcctt

SEQ ID NO: 7248406 - DNA, 22 bp, Homo sapiens
ggaaggaggatgctctggcctt

SEQ ID NO: 7248407 - DNA, 22 bp, Homo sapiens
ggaaggagggcggcaatgatga

SEQ ID NO: 7248408 - DNA, 22 bp, Homo sapiens
ggaaggaggggcaaagcagttc

SEQ ID NO: 7248409 - DNA, 22 bp, Homo sapiens
ggaaggaggggcaaagcagttc

SEQ ID NO: 7248410 - DNA, 22 bp, Homo sapiens
ggaaggagtctttaacacccat

SEQ ID NO: 7248411 - DNA, 22 bp, Homo sapiens
ggaaggaggggcaaagcagttc

SEQ ID NO: 7248412 - DNA, 18 bp, Homo sapiens
ggaaggagtggaccccag

SEQ ID NO: 7248413 - DNA, 19 bp, Homo sapiens
ggaaggcagaggggctgtg

SEQ ID NO: 7248414 - DNA, 19 bp, Homo sapiens
ggaaggagagaaatgcatg

SEQ ID NO: 7248415 - DNA, 22 bp, Homo sapiens
ggaaggagcatttgccagttta

SEQ ID NO: 7248416 - DNA, 22 bp, Homo sapiens
ggacagagggttgacagagtat

SEQ ID NO: 7248417 - DNA, 22 bp, Homo sapiens
ggaaggcagtgaaggggctgat

SEQ ID NO: 7248418 - DNA, 19 bp, Homo sapiens
ggaaggcagaggggctgtg

SEQ ID NO: 7248419 - DNA, 22 bp, Homo sapiens
ggaaggcagaggtgtcgtgggg

SEQ ID NO: 7248420 - DNA, 22 bp, Homo sapiens
ggaaggcagtgaaggggctgat

SEQ ID NO: 7248421 - DNA, 22 bp, Homo sapiens
ggaaggctttgaggggtgctgg

SEQ ID NO: 7248422 - DNA, 22 bp, Homo sapiens
ggacaggcccggggagcctgga

SEQ ID NO: 7248423 - DNA, 22 bp, Homo sapiens
ggacaggccatatggaatacat

SEQ ID NO: 7248424 - DNA, 22 bp, Homo sapiens
ggacaggcaggtgatttccaga

SEQ ID NO: 7248425 - DNA, 22 bp, Homo sapiens
ggacaggcccggggagcctgga

SEQ ID NO: 7248426 - DNA, 22 bp, Homo sapiens
ggacaggccctctggtcagctt

SEQ ID NO: 7248427 - DNA, 22 bp, Homo sapiens
ggacaggctgcatctgagcatg

SEQ ID NO: 7248428 - DNA, 22 bp, Homo sapiens
ggacaggcgcagggccaaggaa

SEQ ID NO: 7248429 - DNA, 22 bp, Homo sapiens
ggacaggccgcctcggtggggg

SEQ ID NO: 7248430 - DNA, 23 bp, Homo sapiens
ggacagggccctgccctatggcc

SEQ ID NO: 7248431 - DNA, 22 bp, Homo sapiens
ggacagggatcattatctgagc

SEQ ID NO: 7248432 - DNA, 22 bp, Homo sapiens
ggacaggctgcatctgagcatg

SEQ ID NO: 7248433 - DNA, 19 bp, Homo sapiens
ggacagggggagcttttat

SEQ ID NO: 7248434 - DNA, 22 bp, Homo sapiens
ggacaggggcgtggggattgtt

SEQ ID NO: 7248435 - DNA, 22 bp, Homo sapiens
ggacagggctcttggcactcct

SEQ ID NO: 7248436 - DNA, 22 bp, Homo sapiens
ggacagggctcttggcactcct

SEQ ID NO: 7248437 - DNA, 22 bp, Homo sapiens
ggacagggctcttggcactcct

SEQ ID NO: 7248438 - DNA, 22 bp, Homo sapiens
ggactgggtcactaagatagta

SEQ ID NO: 7248439 - DNA, 22 bp, Homo sapiens
ggactgggtaggagcccagggc

SEQ ID NO: 7248440 - DNA, 22 bp, Homo sapiens
ggactgggaatcagggagatgc

SEQ ID NO: 7248441 - DNA, 22 bp, Homo sapiens
ggagaaagctgtagtggaatgt

SEQ ID NO: 7248442 - DNA, 22 bp, Homo sapiens
ggagaaaggataggaatgtgct

SEQ ID NO: 7248443 - DNA, 22 bp, Homo sapiens
ggagaaagaaatttttgattgg

SEQ ID NO: 7248444 - DNA, 18 bp, Homo sapiens
ggagaagaacagatgtgg

SEQ ID NO: 7248445 - DNA, 22 bp, Homo sapiens
ggagaactccaaatccatattt

SEQ ID NO: 7248446 - DNA, 22 bp, Homo sapiens
ggagccaggcatatcggggcac

SEQ ID NO: 7248447 - DNA, 17 bp, Homo sapiens
ggagccaggagcccacc

SEQ ID NO: 7248448 - DNA, 22 bp, Homo sapiens
ggagaagcagcttcttgatgaa

SEQ ID NO: 7248449 - DNA, 22 bp, Homo sapiens
ggagaagcaggtgctttgggtc

SEQ ID NO: 7248450 - DNA, 22 bp, Homo sapiens
ggagctggggttggcatcttcc

SEQ ID NO: 7248451 - DNA, 22 bp, Homo sapiens
ggagctggtcagccttgagcat

SEQ ID NO: 7248452 - DNA, 22 bp, Homo sapiens
ggaggaggcggcagaagttcct

SEQ ID NO: 7248453 - DNA, 22 bp, Homo sapiens
ggaggaggcggcagaagttcct

SEQ ID NO: 7248454 - DNA, 22 bp, Homo sapiens
ggaggaggggtgactgaatgct

SEQ ID NO: 7248455 - DNA, 22 bp, Homo sapiens
ggaggaggggcgctttgtctat

SEQ ID NO: 7248456 - DNA, 22 bp, Homo sapiens
ggagctgcatttagggagcctt

SEQ ID NO: 7248457 - DNA, 22 bp, Homo sapiens
ggagctggctacagagaactcc

SEQ ID NO: 7248458 - DNA, 18 bp, Homo sapiens
ggagctgggcctggttcc

SEQ ID NO: 7248459 - DNA, 21 bp, Homo sapiens
ggagctggggagctggcccca

SEQ ID NO: 7248460 - DNA, 18 bp, Homo sapiens
ggagctgggccccactcc

SEQ ID NO: 7248461 - DNA, 22 bp, Homo sapiens
ggagctgggaccctgtcatctg

SEQ ID NO: 7248462 - DNA, 22 bp, Homo sapiens
ggagctgggaactatgtagtat

SEQ ID NO: 7248463 - DNA, 22 bp, Homo sapiens
ggagctgggaattggatcatct

SEQ ID NO: 7248464 - DNA, 22 bp, Homo sapiens
gcaaggagcctggaggtgagtg

SEQ ID NO: 7248465 - DNA, 22 bp, Homo sapiens
gcaaggaggctggtggaggaag

SEQ ID NO: 7248466 - DNA, 22 bp, Homo sapiens
gcaaggagactgtagggccaag

SEQ ID NO: 7248467 - DNA, 22 bp, Homo sapiens
gagtacccagatatctctgctc

SEQ ID NO: 7248468 - DNA, 18 bp, Homo sapiens
gagtagcattgaggaaac

SEQ ID NO: 7248469 - DNA, 22 bp, Homo sapiens
gagtagggtttccaggttagag

SEQ ID NO: 7248470 - DNA, 22 bp, Homo sapiens
gcaaggcagtcctggggccctg

SEQ ID NO: 7248471 - DNA, 18 bp, Homo sapiens
gcaaggctcaggccaggc

SEQ ID NO: 7248472 - DNA, 20 bp, Homo sapiens
gcaaggcacagtgaggaggg

SEQ ID NO: 7248473 - DNA, 20 bp, Homo sapiens
gcaaggcacagtgaggaggg

SEQ ID NO: 7248474 - DNA, 22 bp, Homo sapiens
gcaaggcagcgcggagtagcta

SEQ ID NO: 7248475 - DNA, 22 bp, Homo sapiens
gcacagcagacttggtggggct

SEQ ID NO: 7248476 - DNA, 22 bp, Homo sapiens
gcacagagtgggtgagatgtgg

SEQ ID NO: 7248477 - DNA, 22 bp, Homo sapiens
gcacagagaggctgtgagcgcc

SEQ ID NO: 7248478 - DNA, 22 bp, Homo sapiens
gcacagactttgattgcagtca

SEQ ID NO: 7248479 - DNA, 22 bp, Homo sapiens
gcacagactgtatcttaatcat

SEQ ID NO: 7248480 - DNA, 22 bp, Homo sapiens
gcacagactcaccttaatttga

SEQ ID NO: 7248481 - DNA, 22 bp, Homo sapiens
gcacagacccaccatctatagt

SEQ ID NO: 7248482 - DNA, 22 bp, Homo sapiens
gcacagacatatccatatttac

SEQ ID NO: 7248483 - DNA, 22 bp, Homo sapiens
gcacagacagaatccctactcc

SEQ ID NO: 7248484 - DNA, 22 bp, Homo sapiens
gcacagacaccattaaatattt

SEQ ID NO: 7248485 - DNA, 22 bp, Homo sapiens
gcaatagattatgatctacagt

SEQ ID NO: 7248486 - DNA, 22 bp, Homo sapiens
gcaatagacttggttcttctgt

SEQ ID NO: 7248487 - DNA, 22 bp, Homo sapiens
gcaatagactgtttttattgtt

SEQ ID NO: 7248488 - DNA, 22 bp, Homo sapiens
gcacagaaccagacatgaggca

SEQ ID NO: 7248489 - DNA, 22 bp, Homo sapiens
gcagaagggaataaggagcttt

SEQ ID NO: 7248490 - DNA, 22 bp, Homo sapiens
gcagaagggaataaggagcttt

SEQ ID NO: 7248491 - DNA, 22 bp, Homo sapiens
gcaccactaagagcagggaccg

SEQ ID NO: 7248492 - DNA, 22 bp, Homo sapiens
gcaccaggaggcccttctcatc

SEQ ID NO: 7248493 - DNA, 22 bp, Homo sapiens
gcacccagaggtcagcagtgct

SEQ ID NO: 7248494 - DNA, 22 bp, Homo sapiens
gcagaaggatccgcaggtgcaa

SEQ ID NO: 7248495 - DNA, 22 bp, Homo sapiens
gcagacagggctacagaggtac

SEQ ID NO: 7248496 - DNA, 22 bp, Homo sapiens
gcagaggtgtgggaggggccac

SEQ ID NO: 7248497 - DNA, 22 bp, Homo sapiens
gcagagtgagccgaggctgctc

SEQ ID NO: 7248498 - DNA, 22 bp, Homo sapiens
gcagagtgagccgaggctgctc

SEQ ID NO: 7248499 - DNA, 22 bp, Homo sapiens
gcagagtgaggaagagcttcca

SEQ ID NO: 7248500 - DNA, 18 bp, Homo sapiens
gcagagtgcgtctctgtg

SEQ ID NO: 7248501 - DNA, 22 bp, Homo sapiens
gcagagtgggagcccagggctg

SEQ ID NO: 7248502 - DNA, 19 bp, Homo sapiens
gcagagtggggtggagggt

SEQ ID NO: 7248503 - DNA, 22 bp, Homo sapiens
gcagggcagctcactgtggttc

SEQ ID NO: 7248504 - DNA, 22 bp, Homo sapiens
gcagggcagctgaagctaggtg

SEQ ID NO: 7248505 - DNA, 22 bp, Homo sapiens
gcaggcctcccctgctggagct

SEQ ID NO: 7248506 - DNA, 22 bp, Homo sapiens
gcaggcccttagccttggtggg

SEQ ID NO: 7248507 - DNA, 18 bp, Homo sapiens
gcaggccctgtttctggg

SEQ ID NO: 7248508 - DNA, 19 bp, Homo sapiens
gcaggcccagtcgggctgg

SEQ ID NO: 7248509 - DNA, 20 bp, Homo sapiens
gcaggccctctctctagtct

SEQ ID NO: 7248510 - DNA, 22 bp, Homo sapiens
gcaggccctcctctagcaaggc

SEQ ID NO: 7248511 - DNA, 23 bp, Homo sapiens
gcagctggttagaagggaaggag

SEQ ID NO: 7248512 - DNA, 22 bp, Homo sapiens
gcaggcccagagtcgctggcct

SEQ ID NO: 7248513 - DNA, 22 bp, Homo sapiens
gcagggcagtaagagctagagt

SEQ ID NO: 7248514 - DNA, 22 bp, Homo sapiens
gcagggccagggctcaggctgt

SEQ ID NO: 7248515 - DNA, 22 bp, Homo sapiens
gcagggccagtgcagagaggaa

SEQ ID NO: 7248516 - DNA, 19 bp, Homo sapiens
gcagggtggcagagctctt

SEQ ID NO: 7248517 - DNA, 22 bp, Homo sapiens
gcagggtgtgtctcatacagtt

SEQ ID NO: 7248518 - DNA, 22 bp, Homo sapiens
gcagggtgtgtctcatacagtt

SEQ ID NO: 7248519 - DNA, 22 bp, Homo sapiens
gcagggccaggtacaagaagca

SEQ ID NO: 7248520 - DNA, 22 bp, Homo sapiens
gcaggtgaatgatggactagga

SEQ ID NO: 7248521 - DNA, 19 bp, Homo sapiens
gcagggtgttgactgtccc

SEQ ID NO: 7248522 - DNA, 19 bp, Homo sapiens
gcagcagcatttggtaata

SEQ ID NO: 7248523 - DNA, 22 bp, Homo sapiens
gcagcagcagggagtctgactt

SEQ ID NO: 7248524 - DNA, 22 bp, Homo sapiens
gcagcagcaagaaggttggact

SEQ ID NO: 7248525 - DNA, 22 bp, Homo sapiens
gcagccaccctcaaggctgaat

SEQ ID NO: 7248526 - DNA, 17 bp, Homo sapiens
gcagccagtgcagcagg

SEQ ID NO: 7248527 - DNA, 22 bp, Homo sapiens
gcagctggctcagagaggtggg

SEQ ID NO: 7248528 - DNA, 22 bp, Homo sapiens
gcatttatttctttactgcatc

SEQ ID NO: 7248529 - DNA, 22 bp, Homo sapiens
gcattgtttaagtgggtggggt

SEQ ID NO: 7248530 - DNA, 22 bp, Homo sapiens
gccacctggacagctgtgccct

SEQ ID NO: 7248531 - DNA, 22 bp, Homo sapiens
gccacctgtttcgcttgcccag

SEQ ID NO: 7248532 - DNA, 22 bp, Homo sapiens
gccacccttgcgtcactgacat

SEQ ID NO: 7248533 - DNA, 22 bp, Homo sapiens
gcaggtgattcaccctgggcct

SEQ ID NO: 7248534 - DNA, 22 bp, Homo sapiens
gcagtttactgtcaataactct

SEQ ID NO: 7248535 - DNA, 22 bp, Homo sapiens
gcagtttagtagatgacattat

SEQ ID NO: 7248536 - DNA, 22 bp, Homo sapiens
gcattgaatcctatcaggcaaa

SEQ ID NO: 7248537 - DNA, 22 bp, Homo sapiens
gcattgaaggcattttatctac

SEQ ID NO: 7248538 - DNA, 22 bp, Homo sapiens
gcattgaaggacttccattata

SEQ ID NO: 7248539 - DNA, 22 bp, Homo sapiens
gcattgaagatcttagactagg

SEQ ID NO: 7248540 - DNA, 22 bp, Homo sapiens
gcattgaaccatctagatttct

SEQ ID NO: 7248541 - DNA, 23 bp, Homo sapiens
gcattgaacaaaagaggggagta

SEQ ID NO: 7248542 - DNA, 22 bp, Homo sapiens
gcattgaaatggcaaaaagaga

SEQ ID NO: 7248543 - DNA, 22 bp, Homo sapiens
gcagtttcagacatatctccat

SEQ ID NO: 7248544 - DNA, 22 bp, Homo sapiens
gccacttctgcctggcagggcc

SEQ ID NO: 7248545 - DNA, 22 bp, Homo sapiens
gccagaaggggtggatccaggc

SEQ ID NO: 7248546 - DNA, 22 bp, Homo sapiens
gccagaagactggagtcagctg

SEQ ID NO: 7248547 - DNA, 22 bp, Homo sapiens
gccagctgtaggtggtgggttg

SEQ ID NO: 7248548 - DNA, 22 bp, Homo sapiens
gccagctgaggccgtgcaggct

SEQ ID NO: 7248549 - DNA, 22 bp, Homo sapiens
gccaggcattattccgatccct

SEQ ID NO: 7248550 - DNA, 22 bp, Homo sapiens
gccaggctaagaaaggtgtgat

SEQ ID NO: 7248551 - DNA, 22 bp, Homo sapiens
gccaggctccaggccctcctga

SEQ ID NO: 7248552 - DNA, 22 bp, Homo sapiens
gccaggctccccggatccctgg

SEQ ID NO: 7248553 - DNA, 20 bp, Homo sapiens
gcccaagcgccggccgcaga

SEQ ID NO: 7248554 - DNA, 22 bp, Homo sapiens
gcccaagccggagctgggagag

SEQ ID NO: 7248555 - DNA, 23 bp, Homo sapiens
gccaggctccggtctgtggccac

SEQ ID NO: 7248556 - DNA, 22 bp, Homo sapiens
gccattttctgtcttgtttatt

SEQ ID NO: 7248557 - DNA, 22 bp, Homo sapiens
gcctggagacctgctcctctac

SEQ ID NO: 7248558 - DNA, 22 bp, Homo sapiens
gcctggagacagcagaggcggc

SEQ ID NO: 7248559 - DNA, 22 bp, Homo sapiens
gcctggagacagcagaggcggc

SEQ ID NO: 7248560 - DNA, 22 bp, Homo sapiens
gcctggagagcactgtgcgctt

SEQ ID NO: 7248561 - DNA, 22 bp, Homo sapiens
gcctggagcccagtgtggggct

SEQ ID NO: 7248562 - DNA, 22 bp, Homo sapiens
gcctggagcagacgtgtcccgg

SEQ ID NO: 7248563 - DNA, 22 bp, Homo sapiens
gcctggagaggaagccggtgga

SEQ ID NO: 7248564 - DNA, 22 bp, Homo sapiens
gcctggagaggaagccggtgga

SEQ ID NO: 7248565 - DNA, 22 bp, Homo sapiens
gcctggagaggaagccggtgga

SEQ ID NO: 7248566 - DNA, 16 bp, Homo sapiens
gcctggagtggcaggg

SEQ ID NO: 7248567 - DNA, 22 bp, Homo sapiens
gcctggagtggacttggcccct

SEQ ID NO: 7248568 - DNA, 22 bp, Homo sapiens
gcctggagtgcagtggcgtgat

SEQ ID NO: 7248569 - DNA, 22 bp, Homo sapiens
gcctggagtgcagtggcgtgat

SEQ ID NO: 7248570 - DNA, 22 bp, Homo sapiens
gcctggagtgcagtggcgtgat

SEQ ID NO: 7248571 - DNA, 22 bp, Homo sapiens
gcctggagtagcatggcaagcc

SEQ ID NO: 7248572 - DNA, 22 bp, Homo sapiens
gcctggagacagcagaggcggc

SEQ ID NO: 7248573 - DNA, 22 bp, Homo sapiens
gcctggagacaaggacaaaggg

SEQ ID NO: 7248574 - DNA, 22 bp, Homo sapiens
gcctggagaattaaaaggaagg

SEQ ID NO: 7248575 - DNA, 22 bp, Homo sapiens
gcctggagaagatggaactagc

SEQ ID NO: 7248576 - DNA, 22 bp, Homo sapiens
gcctggagaaaggaaggtggga

SEQ ID NO: 7248577 - DNA, 22 bp, Homo sapiens
gcctggagaaaggaaggtggga

SEQ ID NO: 7248578 - DNA, 23 bp, Homo sapiens
gcctggagaaaagctgcagttca

SEQ ID NO: 7248579 - DNA, 22 bp, Homo sapiens
gcctgcagggcccttgtgggtc

SEQ ID NO: 7248580 - DNA, 18 bp, Homo sapiens
gcctgcaggcacgggggt

SEQ ID NO: 7248581 - DNA, 22 bp, Homo sapiens
gcctccccaggggtgtcatgag

SEQ ID NO: 7248582 - DNA, 22 bp, Homo sapiens
gcctccacttctttagtatgac

SEQ ID NO: 7248583 - DNA, 22 bp, Homo sapiens
gcctccactgatcagacttgac

SEQ ID NO: 7248584 - DNA, 22 bp, Homo sapiens
gcctccaccgaacgctctcttg

SEQ ID NO: 7248585 - DNA, 22 bp, Homo sapiens
gcctcaggtgcatctctcattc

SEQ ID NO: 7248586 - DNA, 20 bp, Homo sapiens
gcctccaccccaggcttcag

SEQ ID NO: 7248587 - DNA, 19 bp, Homo sapiens
gcctcatttccacctcccc

SEQ ID NO: 7248588 - DNA, 22 bp, Homo sapiens
gcctcagggggagaggccagct

SEQ ID NO: 7248589 - DNA, 20 bp, Homo sapiens
gccctggacgtggcctcggc

SEQ ID NO: 7248590 - DNA, 22 bp, Homo sapiens
gccctgcttctggcatgcagaa

SEQ ID NO: 7248591 - DNA, 23 bp, Homo sapiens
gccctgctgggacctcctgctac

SEQ ID NO: 7248592 - DNA, 22 bp, Homo sapiens
gccctgctgcgcagcacgcatg

SEQ ID NO: 7248593 - DNA, 22 bp, Homo sapiens
gccctgctcttttgcccaccca

SEQ ID NO: 7248594 - DNA, 17 bp, Homo sapiens
gccctgcctgctgccct

SEQ ID NO: 7248595 - DNA, 22 bp, Homo sapiens
gccctgcctgtctgctgggagg

SEQ ID NO: 7248596 - DNA, 22 bp, Homo sapiens
gccctgcgccgtcccgctggtg

SEQ ID NO: 7248597 - DNA, 22 bp, Homo sapiens
gccctgctctggtctctgcccg

SEQ ID NO: 7248598 - DNA, 22 bp, Homo sapiens
gcccctctccttgtgcacctgc

SEQ ID NO: 7248599 - DNA, 22 bp, Homo sapiens
gcccacacaccagctcaggagg

SEQ ID NO: 7248600 - DNA, 22 bp, Homo sapiens
gcccacagctcgttcctctcct

SEQ ID NO: 7248601 - DNA, 22 bp, Homo sapiens
gcccacaggggacctggtggct

SEQ ID NO: 7248602 - DNA, 22 bp, Homo sapiens
gccccaggggaggtgccctgca

SEQ ID NO: 7248603 - DNA, 22 bp, Homo sapiens
gccctaggcttttgtgactgcc

SEQ ID NO: 7248604 - DNA, 21 bp, Homo sapiens
gccctaggctacctggagcgc

SEQ ID NO: 7248605 - DNA, 22 bp, Homo sapiens
gccctaggcttttgtgactgcc

SEQ ID NO: 7248606 - DNA, 22 bp, Homo sapiens
gccctagcgccagctcagcacc

SEQ ID NO: 7248607 - DNA, 22 bp, Homo sapiens
gcccgtgtgcagagtgggagct

SEQ ID NO: 7248608 - DNA, 22 bp, Homo sapiens
gccctagccatcctgtgctctg

SEQ ID NO: 7248609 - DNA, 22 bp, Homo sapiens
gccctacctcagtccagatctg

SEQ ID NO: 7248610 - DNA, 22 bp, Homo sapiens
gacatgcataacaagattggaa

SEQ ID NO: 7248611 - DNA, 22 bp, Homo sapiens
gactagaagggcaagagtccct

SEQ ID NO: 7248612 - DNA, 19 bp, Homo sapiens
gactacagggggaagaagt

SEQ ID NO: 7248613 - DNA, 22 bp, Homo sapiens
gactagaatagggggtaggaag

SEQ ID NO: 7248614 - DNA, 22 bp, Homo sapiens
gacatagacaaagtcattgtca

SEQ ID NO: 7248615 - DNA, 22 bp, Homo sapiens
gacatagactgagtttagctga

SEQ ID NO: 7248616 - DNA, 22 bp, Homo sapiens
gacagtcctgcaggttgaactc

SEQ ID NO: 7248617 - DNA, 22 bp, Homo sapiens
gacagcaggtgcttgggaaagg

SEQ ID NO: 7248618 - DNA, 22 bp, Homo sapiens
gacagcagtttttctctagggt

SEQ ID NO: 7248619 - DNA, 22 bp, Homo sapiens
gacagcctcatgaggagcaaaa

SEQ ID NO: 7248620 - DNA, 22 bp, Homo sapiens
gacagcctggcttaatctgtct

SEQ ID NO: 7248621 - DNA, 22 bp, Homo sapiens
gacagctgcctctgtgtagatc

SEQ ID NO: 7248622 - DNA, 19 bp, Homo sapiens
gaatgtttgtattcagcgc

SEQ ID NO: 7248623 - DNA, 22 bp, Homo sapiens
gaatgtttgactaaaggtagct

SEQ ID NO: 7248624 - DNA, 19 bp, Homo sapiens
gaatgggttctgtagggag

SEQ ID NO: 7248625 - DNA, 22 bp, Homo sapiens
gaattaaaatagttttggtcga

SEQ ID NO: 7248626 - DNA, 22 bp, Homo sapiens
gaatgtttttcattggtgactc

SEQ ID NO: 7248627 - DNA, 22 bp, Homo sapiens
gaatgtttttcaaacctgtggc

SEQ ID NO: 7248628 - DNA, 22 bp, Homo sapiens
gaatgtttttataagtgttaca

SEQ ID NO: 7248629 - DNA, 22 bp, Homo sapiens
gaatgtttttaggaatgttatg

SEQ ID NO: 7248630 - DNA, 22 bp, Homo sapiens
gaatgtttgtgcagagtcatct

SEQ ID NO: 7248631 - DNA, 22 bp, Homo sapiens
gaattacaaagtgagacaagct

SEQ ID NO: 7248632 - DNA, 22 bp, Homo sapiens
gaatgcagatggctggtgtatg

SEQ ID NO: 7248633 - DNA, 22 bp, Homo sapiens
gaatgctaagcatgtgggagtt

SEQ ID NO: 7248634 - DNA, 22 bp, Homo sapiens
gaatttatctacgttaagtatg

SEQ ID NO: 7248635 - DNA, 22 bp, Homo sapiens
gacaaatgaatgatgaacacca

SEQ ID NO: 7248636 - DNA, 22 bp, Homo sapiens
gacaaaggatcagaggttggga

SEQ ID NO: 7248637 - DNA, 22 bp, Homo sapiens
gacagcagccacagggagaggg

SEQ ID NO: 7248638 - DNA, 22 bp, Homo sapiens
gagaagcaggtttagcagacaa

SEQ ID NO: 7248639 - DNA, 22 bp, Homo sapiens
gagaagcaatcgtgacatctcc

SEQ ID NO: 7248640 - DNA, 22 bp, Homo sapiens
gagagaagggggatatgagcct

SEQ ID NO: 7248641 - DNA, 22 bp, Homo sapiens
gagaaggaagttgagccagcat

SEQ ID NO: 7248642 - DNA, 22 bp, Homo sapiens
gagaaggactacacatctggcc

SEQ ID NO: 7248643 - DNA, 16 bp, Homo sapiens
gagaagagcccggcag

SEQ ID NO: 7248644 - DNA, 22 bp, Homo sapiens
gactatttttatctaactgggt

SEQ ID NO: 7248645 - DNA, 22 bp, Homo sapiens
gagaaagggaacttacagagtg

SEQ ID NO: 7248646 - DNA, 22 bp, Homo sapiens
gagaaagggaacttacagagtg

SEQ ID NO: 7248647 - DNA, 22 bp, Homo sapiens
gagaaagggaacttacagagtg

SEQ ID NO: 7248648 - DNA, 22 bp, Homo sapiens
gagaaagggataatttgaagag

SEQ ID NO: 7248649 - DNA, 22 bp, Homo sapiens
gagagacagcacacagtgtggg

SEQ ID NO: 7248650 - DNA, 22 bp, Homo sapiens
gagagacagcacacagtgtggg

SEQ ID NO: 7248651 - DNA, 22 bp, Homo sapiens
gagagacagcagaacgtgcagc

SEQ ID NO: 7248652 - DNA, 22 bp, Homo sapiens
gagagacagcagaacgtgcagc

SEQ ID NO: 7248653 - DNA, 22 bp, Homo sapiens
gagagagaaccccgtgcccttc

SEQ ID NO: 7248654 - DNA, 22 bp, Homo sapiens
gagagagaaaatgactccggac

SEQ ID NO: 7248655 - DNA, 22 bp, Homo sapiens
gagagcatgtggtctagtttta

SEQ ID NO: 7248656 - DNA, 22 bp, Homo sapiens
gagagcatactataatggaggt

SEQ ID NO: 7248657 - DNA, 22 bp, Homo sapiens
gagagctgtccggctgagcagc

SEQ ID NO: 7248658 - DNA, 22 bp, Homo sapiens
gagaggagaagcctgcgcttca

SEQ ID NO: 7248659 - DNA, 22 bp, Homo sapiens
gagaggagacttatccagattg

SEQ ID NO: 7248660 - DNA, 18 bp, Homo sapiens
gagaggagccagaatttt

SEQ ID NO: 7248661 - DNA, 18 bp, Homo sapiens
gagaggagccagaatttt

SEQ ID NO: 7248662 - DNA, 22 bp, Homo sapiens
gagaggaggtggctatgacagc

SEQ ID NO: 7248663 - DNA, 22 bp, Homo sapiens
gagaggagtagacactttggtt

SEQ ID NO: 7248664 - DNA, 22 bp, Homo sapiens
gagaggagtagacactttggtt

SEQ ID NO: 7248665 - DNA, 18 bp, Homo sapiens
gagaggagccagaatttt

SEQ ID NO: 7248666 - DNA, 22 bp, Homo sapiens
gagaggaggtggctatgacagc

SEQ ID NO: 7248667 - DNA, 22 bp, Homo sapiens
gagaggagtaggctgatggtgc

SEQ ID NO: 7248668 - DNA, 22 bp, Homo sapiens
gagaggagtagacactttggtt

SEQ ID NO: 7248669 - DNA, 22 bp, Homo sapiens
gagaggagtaggctgatggtgc

SEQ ID NO: 7248670 - DNA, 22 bp, Homo sapiens
gagaggagtaggctgatggtgc

SEQ ID NO: 7248671 - DNA, 22 bp, Homo sapiens
gagcacagaactaaatgctggt

SEQ ID NO: 7248672 - DNA, 22 bp, Homo sapiens
gagcacagaatcttcccatgca

SEQ ID NO: 7248673 - DNA, 22 bp, Homo sapiens
gagcacagaaggagaaatatgg

SEQ ID NO: 7248674 - DNA, 22 bp, Homo sapiens
gagcacagatcctggagccaca

SEQ ID NO: 7248675 - DNA, 22 bp, Homo sapiens
gagaggagtccctatcacagtt

SEQ ID NO: 7248676 - DNA, 22 bp, Homo sapiens
gagaggagtccctatcacagtt

SEQ ID NO: 7248677 - DNA, 22 bp, Homo sapiens
gagaggagtccctatcacagtt

SEQ ID NO: 7248678 - DNA, 22 bp, Homo sapiens
gagaggagttactatttccgag

SEQ ID NO: 7248679 - DNA, 22 bp, Homo sapiens
gagcaggaactgaaaatgagac

SEQ ID NO: 7248680 - DNA, 22 bp, Homo sapiens
gagcaggaaggccagaagggtc

SEQ ID NO: 7248681 - DNA, 23 bp, Homo sapiens
gagcagagcgggcgggggtcctg

SEQ ID NO: 7248682 - DNA, 22 bp, Homo sapiens
gagcactgatttatttttgtct

SEQ ID NO: 7248683 - DNA, 22 bp, Homo sapiens
gagcaccctacctgccactgag

SEQ ID NO: 7248684 - DNA, 22 bp, Homo sapiens
gagcacagtgtgttgtgatttc

SEQ ID NO: 7248685 - DNA, 22 bp, Homo sapiens
gagcacagtgcagtttctgcta

SEQ ID NO: 7248686 - DNA, 22 bp, Homo sapiens
gagcacagtccttttgttaaaa

SEQ ID NO: 7248687 - DNA, 22 bp, Homo sapiens
gagcacagtaaagcagtgtcac

SEQ ID NO: 7248688 - DNA, 20 bp, Homo sapiens
gagcacagtaatgactgcta

SEQ ID NO: 7248689 - DNA, 22 bp, Homo sapiens
gagggccaggcggagacaggcg

SEQ ID NO: 7248690 - DNA, 22 bp, Homo sapiens
gagggccaggcggagacaggcg

SEQ ID NO: 7248691 - DNA, 22 bp, Homo sapiens
gagggccagcagcctcagcatg

SEQ ID NO: 7248692 - DNA, 22 bp, Homo sapiens
gagggccagcagcctcagcatg

SEQ ID NO: 7248693 - DNA, 22 bp, Homo sapiens
gagggctgataacaggaataca

SEQ ID NO: 7248694 - DNA, 22 bp, Homo sapiens
gagggctgataaatgcgcatgg

SEQ ID NO: 7248695 - DNA, 22 bp, Homo sapiens
gagggctgataaatgcgcatgg

SEQ ID NO: 7248696 - DNA, 22 bp, Homo sapiens
gagggccctggctggctccagc

SEQ ID NO: 7248697 - DNA, 22 bp, Homo sapiens
gagggcctggcacagggaggct

SEQ ID NO: 7248698 - DNA, 22 bp, Homo sapiens
gagggcctctgtgggtgctcac

SEQ ID NO: 7248699 - DNA, 22 bp, Homo sapiens
gaggctgtaagtgtggagccta

SEQ ID NO: 7248700 - DNA, 21 bp, Homo sapiens
gaggctgtctgctgctggcct

SEQ ID NO: 7248701 - DNA, 22 bp, Homo sapiens
gagggccacgttcagggctctc

SEQ ID NO: 7248702 - DNA, 22 bp, Homo sapiens
gagggccacgttcagggctctc

SEQ ID NO: 7248703 - DNA, 22 bp, Homo sapiens
gagggccacgttcagggctctc

SEQ ID NO: 7248704 - DNA, 22 bp, Homo sapiens
gagggacagctaaagagaaatt

SEQ ID NO: 7248705 - DNA, 22 bp, Homo sapiens
gagggacagctaaagagaaatt

SEQ ID NO: 7248706 - DNA, 22 bp, Homo sapiens
gaggcgggcagatcacctgagg

SEQ ID NO: 7248707 - DNA, 22 bp, Homo sapiens
gaggcgggcagatcacctgagg

SEQ ID NO: 7248708 - DNA, 22 bp, Homo sapiens
gaggcggccagcgaggccgcaa

SEQ ID NO: 7248709 - DNA, 22 bp, Homo sapiens
gaggcgcagcccggaggagaca

SEQ ID NO: 7248710 - DNA, 22 bp, Homo sapiens
gaggcggtacagccagtcctcc

SEQ ID NO: 7248711 - DNA, 22 bp, Homo sapiens
gaggctggtaggaaaggaaaca

SEQ ID NO: 7248712 - DNA, 22 bp, Homo sapiens
gaggctggtggttagttccatt

SEQ ID NO: 7248713 - DNA, 22 bp, Homo sapiens
gaggctggttctgaagtactgt

SEQ ID NO: 7248714 - DNA, 22 bp, Homo sapiens
gaggcctggtgtgtctcccgct

SEQ ID NO: 7248715 - DNA, 22 bp, Homo sapiens
gaggcctggtgctgtgtccaca

SEQ ID NO: 7248716 - DNA, 22 bp, Homo sapiens
gaggcctgggttggaggtgcat

SEQ ID NO: 7248717 - DNA, 22 bp, Homo sapiens
gaggcgagaagctggagatggt

SEQ ID NO: 7248718 - DNA, 19 bp, Homo sapiens
gaggcgaggcgtgcaggag

SEQ ID NO: 7248719 - DNA, 22 bp, Homo sapiens
gaggcctgtcgctaggcctctg

SEQ ID NO: 7248720 - DNA, 22 bp, Homo sapiens
gaggtgtctgttaggaataggc

SEQ ID NO: 7248721 - DNA, 23 bp, Homo sapiens
gaggtgtgaattctgggtgctgc

SEQ ID NO: 7248722 - DNA, 22 bp, Homo sapiens
gaggttgtttcaacagtagtct

SEQ ID NO: 7248723 - DNA, 22 bp, Homo sapiens
gaggtggatgttgcagtgagct

SEQ ID NO: 7248724 - DNA, 22 bp, Homo sapiens
gaggtggctgcttgctgggaaa

SEQ ID NO: 7248725 - DNA, 22 bp, Homo sapiens
gaggtggctgggagtagggaat

SEQ ID NO: 7248726 - DNA, 22 bp, Homo sapiens
gaggtggctgtcagcttcactt

SEQ ID NO: 7248727 - DNA, 22 bp, Homo sapiens
gaggtgagtggatcacgaggtc

SEQ ID NO: 7248728 - DNA, 22 bp, Homo sapiens
gaggtgagtggatcacgaggtc

SEQ ID NO: 7248729 - DNA, 22 bp, Homo sapiens
gaggtgagaagggggtcagatg

SEQ ID NO: 7248730 - DNA, 22 bp, Homo sapiens
gaggtgagaagggggtcagatg

SEQ ID NO: 7248731 - DNA, 22 bp, Homo sapiens
gagggctgataacaggaataca

SEQ ID NO: 7248732 - DNA, 22 bp, Homo sapiens
gagggctgataacaggaataca

SEQ ID NO: 7248733 - DNA, 22 bp, Homo sapiens
gagggctgatgttgccacctca

SEQ ID NO: 7248734 - DNA, 22 bp, Homo sapiens
gagggtctcttaatgccagggg

SEQ ID NO: 7248735 - DNA, 22 bp, Homo sapiens
gagggtggaaagggtgtacctg

SEQ ID NO: 7248736 - DNA, 22 bp, Homo sapiens
gagggtgcaggcaagagcaaaa

SEQ ID NO: 7248737 - DNA, 22 bp, Homo sapiens
gagggtgcagctgggccccacg

SEQ ID NO: 7248738 - DNA, 22 bp, Homo sapiens
gagggtgcagctgggccccacg

SEQ ID NO: 7248739 - DNA, 22 bp, Homo sapiens
gagggtcttacctaagcagggt

SEQ ID NO: 7248740 - DNA, 22 bp, Homo sapiens
gagggtcttacctaagcagggt

SEQ ID NO: 7248741 - DNA, 22 bp, Homo sapiens
gagggtgcaggaggatggtagt

SEQ ID NO: 7248742 - DNA, 22 bp, Homo sapiens
gagggtggctcctccctgggcc

SEQ ID NO: 7248743 - DNA, 20 bp, Homo sapiens
gagggtgggacttcctaggc

SEQ ID NO: 7248744 - DNA, 22 bp, Homo sapiens
gagggtggcctttagagcccat

SEQ ID NO: 7248745 - DNA, 22 bp, Homo sapiens
gagggtggcctttagagcccat

SEQ ID NO: 7248746 - DNA, 22 bp, Homo sapiens
gagggtggagctccagaatctg

SEQ ID NO: 7248747 - DNA, 22 bp, Homo sapiens
gagggtggaagagctgctgaga

SEQ ID NO: 7248748 - DNA, 22 bp, Homo sapiens
gagggtgggtacaccagccctc

SEQ ID NO: 7248749 - DNA, 22 bp, Homo sapiens
gagggtgggtacaccagccctc

SEQ ID NO: 7248750 - DNA, 22 bp, Homo sapiens
gagggtggggaatagactgcta

SEQ ID NO: 7248751 - DNA, 22 bp, Homo sapiens
gagggtgggccagatatgaggg

SEQ ID NO: 7248752 - DNA, 22 bp, Homo sapiens
gagggtgggccagatatgaggg

SEQ ID NO: 7248753 - DNA, 22 bp, Homo sapiens
gagggtgggccagatatgaggg

SEQ ID NO: 7248754 - DNA, 20 bp, Homo sapiens
gagggtgggacttcctaggc

SEQ ID NO: 7248755 - DNA, 22 bp, Homo sapiens
gagggtgggctcctatctgggt

SEQ ID NO: 7248756 - DNA, 22 bp, Homo sapiens
gagggtgggctttgttcctcca

SEQ ID NO: 7248757 - DNA, 22 bp, Homo sapiens
gagggtgggctttgttcctcca

SEQ ID NO: 7248758 - DNA, 22 bp, Homo sapiens
gagggtggggaatagactgcta

SEQ ID NO: 7248759 - DNA, 22 bp, Homo sapiens
gagggtgggtttcttgcacgtc

SEQ ID NO: 7248760 - DNA, 22 bp, Homo sapiens
gagggtgtctcacgtgaaagta

SEQ ID NO: 7248761 - DNA, 22 bp, Homo sapiens
gagggtggtggcttaaggtgct

SEQ ID NO: 7248762 - DNA, 22 bp, Homo sapiens
gagggtgtctgcgtaactggca

SEQ ID NO: 7248763 - DNA, 18 bp, Homo sapiens
gaggtcctgctctagccc

SEQ ID NO: 7248764 - DNA, 22 bp, Homo sapiens
gaggtctgagtgcggaaagcct

SEQ ID NO: 7248765 - DNA, 22 bp, Homo sapiens
gaggtctgggcttgggcctggt

SEQ ID NO: 7248766 - DNA, 22 bp, Homo sapiens
gaggtctgggatggggcctgaa

SEQ ID NO: 7248767 - DNA, 22 bp, Homo sapiens
gaggtctgccttcaggagagtt

SEQ ID NO: 7248768 - DNA, 22 bp, Homo sapiens
gaggtctgccttcaggagagtt

SEQ ID NO: 7248769 - DNA, 22 bp, Homo sapiens
gaggccagaagtctgagatcag

SEQ ID NO: 7248770 - DNA, 22 bp, Homo sapiens
gaggccacttcctactggagga

SEQ ID NO: 7248771 - DNA, 22 bp, Homo sapiens
gaggccagaagtgcctcgggct

SEQ ID NO: 7248772 - DNA, 22 bp, Homo sapiens
gaggccagatactctcttctgc

SEQ ID NO: 7248773 - DNA, 22 bp, Homo sapiens
gaggccagatactctcttctgc

SEQ ID NO: 7248774 - DNA, 22 bp, Homo sapiens
gaggccagagttccccgagtca

SEQ ID NO: 7248775 - DNA, 22 bp, Homo sapiens
gaggccagaatgagtctctggg

SEQ ID NO: 7248776 - DNA, 22 bp, Homo sapiens
gaggccagaatgagtctctggg

SEQ ID NO: 7248777 - DNA, 22 bp, Homo sapiens
gaggcaacacatttggaaagca

SEQ ID NO: 7248778 - DNA, 22 bp, Homo sapiens
gaggatgtccacatggacggtg

SEQ ID NO: 7248779 - DNA, 22 bp, Homo sapiens
gaggatgtgtctggtctgggca

SEQ ID NO: 7248780 - DNA, 22 bp, Homo sapiens
gaggccacggaagggagctgtg

SEQ ID NO: 7248781 - DNA, 22 bp, Homo sapiens
gaggccacggttttccttgggg

SEQ ID NO: 7248782 - DNA, 22 bp, Homo sapiens
gaggccactgtccctgccttcc

SEQ ID NO: 7248783 - DNA, 21 bp, Homo sapiens
gaggccactaataggggcaga

SEQ ID NO: 7248784 - DNA, 22 bp, Homo sapiens
gaggacgggcttcatggggcct

SEQ ID NO: 7248785 - DNA, 22 bp, Homo sapiens
gaggacctttagtagaagtgca

SEQ ID NO: 7248786 - DNA, 22 bp, Homo sapiens
gaggacagtgtgatctgccagc

SEQ ID NO: 7248787 - DNA, 17 bp, Homo sapiens
gaggacagggaagtagg

SEQ ID NO: 7248788 - DNA, 17 bp, Homo sapiens
gaggacagggaagtagg

SEQ ID NO: 7248789 - DNA, 22 bp, Homo sapiens
gaggacagtgtgatctgccagc

SEQ ID NO: 7248790 - DNA, 22 bp, Homo sapiens
gaggagagaacattcctccata

SEQ ID NO: 7248791 - DNA, 22 bp, Homo sapiens
gaggagaaagcagtgatttgtg

SEQ ID NO: 7248792 - DNA, 22 bp, Homo sapiens
gaggagaaattatccttggtgt

SEQ ID NO: 7248793 - DNA, 22 bp, Homo sapiens
gaggagacggggtgcctggagc

SEQ ID NO: 7248794 - DNA, 18 bp, Homo sapiens
gaggatggaaggagatgc

SEQ ID NO: 7248795 - DNA, 22 bp, Homo sapiens
gaggagtggagttgctgggttg

SEQ ID NO: 7248796 - DNA, 22 bp, Homo sapiens
gaggagtgtattccacaccact

SEQ ID NO: 7248797 - DNA, 22 bp, Homo sapiens
gaggagagaagctaacggtgct

SEQ ID NO: 7248798 - DNA, 22 bp, Homo sapiens
gaggagagaagctaacggtgct

SEQ ID NO: 7248799 - DNA, 22 bp, Homo sapiens
gaggaggttccgggtggagaag

SEQ ID NO: 7248800 - DNA, 22 bp, Homo sapiens
gaggagtgccagccgtggagtc

SEQ ID NO: 7248801 - DNA, 22 bp, Homo sapiens
gaggagtgccagccgtggagtc

SEQ ID NO: 7248802 - DNA, 22 bp, Homo sapiens
gaggagtgccagccgtggagtc

SEQ ID NO: 7248803 - DNA, 22 bp, Homo sapiens
gagctgggtctccaccttggca

SEQ ID NO: 7248804 - DNA, 22 bp, Homo sapiens
gagctgggatttgaacctggga

SEQ ID NO: 7248805 - DNA, 22 bp, Homo sapiens
gagctgggattcatctatgtct

SEQ ID NO: 7248806 - DNA, 22 bp, Homo sapiens
gaggacaggagactcactgttt

SEQ ID NO: 7248807 - DNA, 22 bp, Homo sapiens
gagctgtgcttataccaattca

SEQ ID NO: 7248808 - DNA, 22 bp, Homo sapiens
gagcaggcctggggtgaggcct

SEQ ID NO: 7248809 - DNA, 22 bp, Homo sapiens
gagctcagaggattctggggag

SEQ ID NO: 7248810 - DNA, 22 bp, Homo sapiens
gagcaggacgtgggaatgggaa

SEQ ID NO: 7248811 - DNA, 22 bp, Homo sapiens
gagcaggatgggagctggggcc

SEQ ID NO: 7248812 - DNA, 22 bp, Homo sapiens
gagcaggcaactctgcagtgcc

SEQ ID NO: 7248813 - DNA, 22 bp, Homo sapiens
gagcaggcattctagtggctga

SEQ ID NO: 7248814 - DNA, 22 bp, Homo sapiens
gagctcagcccaaagagcagtg

SEQ ID NO: 7248815 - DNA, 22 bp, Homo sapiens
gagctcagcaaaggtctgtgtg

SEQ ID NO: 7248816 - DNA, 23 bp, Homo sapiens
gagctcaggtagggctcgcccgc

SEQ ID NO: 7248817 - DNA, 23 bp, Homo sapiens
gagctcaggtagggctcgcccgc

SEQ ID NO: 7248818 - DNA, 22 bp, Homo sapiens
gagctcagtgtagtcatggctt

SEQ ID NO: 7248819 - DNA, 22 bp, Homo sapiens
gaaaccagcatttaaaccagga

SEQ ID NO: 7248820 - DNA, 22 bp, Homo sapiens
gaaacttgataattgaaacaga

SEQ ID NO: 7248821 - DNA, 23 bp, Homo sapiens
ctttggcactttacaataaactc

SEQ ID NO: 7248822 - DNA, 22 bp, Homo sapiens
ctttggcacagtgtttactagc

SEQ ID NO: 7248823 - DNA, 22 bp, Homo sapiens
ctttggcacagtctcatttgat

SEQ ID NO: 7248824 - DNA, 22 bp, Homo sapiens
ctttttctgatgttccatgatt

SEQ ID NO: 7248825 - DNA, 22 bp, Homo sapiens
ctttggcaacacatgtgggaca

SEQ ID NO: 7248826 - DNA, 22 bp, Homo sapiens
ctttggcaagggttttaattgt

SEQ ID NO: 7248827 - DNA, 22 bp, Homo sapiens
gaagaaattgaattcatgagct

SEQ ID NO: 7248828 - DNA, 22 bp, Homo sapiens
gaagaactaactgaccatgaat

SEQ ID NO: 7248829 - DNA, 22 bp, Homo sapiens
gaacttcttctttaagagactc

SEQ ID NO: 7248830 - DNA, 22 bp, Homo sapiens
gaagaactgtgacagaagcagt

SEQ ID NO: 7248831 - DNA, 22 bp, Homo sapiens
gaagaactttagggcagaattt

SEQ ID NO: 7248832 - DNA, 22 bp, Homo sapiens
gaagaagacatggaacaatagt

SEQ ID NO: 7248833 - DNA, 22 bp, Homo sapiens
gaagaagcaggagtgtgtagca

SEQ ID NO: 7248834 - DNA, 19 bp, Homo sapiens
gaagaagcttgagaagtag

SEQ ID NO: 7248835 - DNA, 22 bp, Homo sapiens
gaaatgttcctgatccctgatt

SEQ ID NO: 7248836 - DNA, 22 bp, Homo sapiens
gaaatgttatgagatatgtact

SEQ ID NO: 7248837 - DNA, 22 bp, Homo sapiens
gaaatgttgtctctgcagcaat

SEQ ID NO: 7248838 - DNA, 22 bp, Homo sapiens
gaaatgttgtcctgtctcttga

SEQ ID NO: 7248839 - DNA, 22 bp, Homo sapiens
gaaatgttggacacttgaaatt

SEQ ID NO: 7248840 - DNA, 22 bp, Homo sapiens
gaaattaagcaggggtctgtgg

SEQ ID NO: 7248841 - DNA, 22 bp, Homo sapiens
gaaattaagcaggggtctgtgg

SEQ ID NO: 7248842 - DNA, 23 bp, Homo sapiens
gaaatgtttcttgattaatccta

SEQ ID NO: 7248843 - DNA, 22 bp, Homo sapiens
gaaatgtttccttttgtatgct

SEQ ID NO: 7248844 - DNA, 22 bp, Homo sapiens
gaaatgtttgggaggagtcaac

SEQ ID NO: 7248845 - DNA, 22 bp, Homo sapiens
gaaatgttttacaaggcatact

SEQ ID NO: 7248846 - DNA, 22 bp, Homo sapiens
gaaattaaccacctttggcttt

SEQ ID NO: 7248847 - DNA, 20 bp, Homo sapiens
gaaatgtatctcttgattct

SEQ ID NO: 7248848 - DNA, 22 bp, Homo sapiens
gaaatgtatttgacagtccttg

SEQ ID NO: 7248849 - DNA, 22 bp, Homo sapiens
gaaatattgggactcagagctt

SEQ ID NO: 7248850 - DNA, 22 bp, Homo sapiens
gaaagactgtaggattttgaat

SEQ ID NO: 7248851 - DNA, 22 bp, Homo sapiens
cttggacttccaggaagtattt

SEQ ID NO: 7248852 - DNA, 22 bp, Homo sapiens
cttggactggacccgaggaatg

SEQ ID NO: 7248853 - DNA, 22 bp, Homo sapiens
cttcttctctacatcctttgat

SEQ ID NO: 7248854 - DNA, 22 bp, Homo sapiens
cttcttcttcccccttcagggg

SEQ ID NO: 7248855 - DNA, 22 bp, Homo sapiens
cttcttctggtttatgtggcaa

SEQ ID NO: 7248856 - DNA, 22 bp, Homo sapiens
cttggaggaaaggcagggagac

SEQ ID NO: 7248857 - DNA, 22 bp, Homo sapiens
cttggaggaaaggcagggagac

SEQ ID NO: 7248858 - DNA, 20 bp, Homo sapiens
ctttctctaatttataagta

SEQ ID NO: 7248859 - DNA, 22 bp, Homo sapiens
cttccctcctggattccagact

SEQ ID NO: 7248860 - DNA, 22 bp, Homo sapiens
cttccctcctggattccagact

SEQ ID NO: 7248861 - DNA, 22 bp, Homo sapiens
cttcccttcccctcacggagac

SEQ ID NO: 7248862 - DNA, 22 bp, Homo sapiens
cttcttcagcacaatattgatg

SEQ ID NO: 7248863 - DNA, 20 bp, Homo sapiens
cttcttcagcctatgcttca

SEQ ID NO: 7248864 - DNA, 22 bp, Homo sapiens
cttcttcatgtattgatagtct

SEQ ID NO: 7248865 - DNA, 22 bp, Homo sapiens
cttcttcagttgcatgtattgg

SEQ ID NO: 7248866 - DNA, 22 bp, Homo sapiens
ctgtcccaggagctgtaagaca

SEQ ID NO: 7248867 - DNA, 22 bp, Homo sapiens
ctgtccccgcgagtccagagct

SEQ ID NO: 7248868 - DNA, 21 bp, Homo sapiens
ctgtccccagtgagcaccccc

SEQ ID NO: 7248869 - DNA, 22 bp, Homo sapiens
ctggtttagtaggggactgaag

SEQ ID NO: 7248870 - DNA, 22 bp, Homo sapiens
ctgtgacctccaggaaggggtg

SEQ ID NO: 7248871 - DNA, 22 bp, Homo sapiens
ctgtgacagtttctcagacttt

SEQ ID NO: 7248872 - DNA, 21 bp, Homo sapiens
ctgtccctctttgcttccctc

SEQ ID NO: 7248873 - DNA, 22 bp, Homo sapiens
ctgtgagctgggtggccaggac

SEQ ID NO: 7248874 - DNA, 22 bp, Homo sapiens
ctgtgaggcctttggccagata

SEQ ID NO: 7248875 - DNA, 22 bp, Homo sapiens
ctgtgttcagtgctactgagtt

SEQ ID NO: 7248876 - DNA, 22 bp, Homo sapiens
ctgtgggctgaaagtgctcccg

SEQ ID NO: 7248877 - DNA, 22 bp, Homo sapiens
ctgtggggccaaattctcctct

SEQ ID NO: 7248878 - DNA, 22 bp, Homo sapiens
ctgtggtcaggggttagacagg

SEQ ID NO: 7248879 - DNA, 22 bp, Homo sapiens
ctgtggtcaggggttagacagg

SEQ ID NO: 7248880 - DNA, 20 bp, Homo sapiens
ctgtggtgagcaggagagta

SEQ ID NO: 7248881 - DNA, 22 bp, Homo sapiens
ctgtggtggcacagcgggctgg

SEQ ID NO: 7248882 - DNA, 22 bp, Homo sapiens
ctgtgtcttctgttttgaagtt

SEQ ID NO: 7248883 - DNA, 22 bp, Homo sapiens
ctgtggatcagtttggaaactt

SEQ ID NO: 7248884 - DNA, 22 bp, Homo sapiens
ctgtggcattgccgaggctggc

SEQ ID NO: 7248885 - DNA, 22 bp, Homo sapiens
ctgtgggcgcctgtcagcctca

SEQ ID NO: 7248886 - DNA, 22 bp, Homo sapiens
ctgtgggcatttgagtgtgggt

SEQ ID NO: 7248887 - DNA, 22 bp, Homo sapiens
ctgtgggcctagtctggcctag

SEQ ID NO: 7248888 - DNA, 22 bp, Homo sapiens
ctgtgggattcatgacattaat

SEQ ID NO: 7248889 - DNA, 22 bp, Homo sapiens
ctgtgggatgggacctcagctg

SEQ ID NO: 7248890 - DNA, 23 bp, Homo sapiens
ctgtggccacccctagctggagg

SEQ ID NO: 7248891 - DNA, 22 bp, Homo sapiens
ctgtggctttctctgcctcctt

SEQ ID NO: 7248892 - DNA, 22 bp, Homo sapiens
ctgtgggatcccatgactttcc

SEQ ID NO: 7248893 - DNA, 22 bp, Homo sapiens
ctgggagtgtccctctggtaat

SEQ ID NO: 7248894 - DNA, 22 bp, Homo sapiens
ctgggcccacgagggctctggg

SEQ ID NO: 7248895 - DNA, 22 bp, Homo sapiens
ctgggcccaggcggctctcgga

SEQ ID NO: 7248896 - DNA, 22 bp, Homo sapiens
ctgggcccacgagggctctggg

SEQ ID NO: 7248897 - DNA, 22 bp, Homo sapiens
ctgggatggctccgctgctgct

SEQ ID NO: 7248898 - DNA, 22 bp, Homo sapiens
ctgggccagatccagcctcaca

SEQ ID NO: 7248899 - DNA, 22 bp, Homo sapiens
ctggagccttcaccaggggaaa

SEQ ID NO: 7248900 - DNA, 22 bp, Homo sapiens
ctgggaggcggaggttgcagtg

SEQ ID NO: 7248901 - DNA, 22 bp, Homo sapiens
ctgggccctgaagacagtcagg

SEQ ID NO: 7248902 - DNA, 22 bp, Homo sapiens
ctgggccctatggaagaaaggg

SEQ ID NO: 7248903 - DNA, 22 bp, Homo sapiens
ctgggcccaggcggctctcgga

SEQ ID NO: 7248904 - DNA, 22 bp, Homo sapiens
ctgggcctaacccacagcgttt

SEQ ID NO: 7248905 - DNA, 22 bp, Homo sapiens
ctgggctcaaatcctggccctg

SEQ ID NO: 7248906 - DNA, 22 bp, Homo sapiens
ctgggtggctgtccagccagcc

SEQ ID NO: 7248907 - DNA, 22 bp, Homo sapiens
ctgggtgttcacccgaggcgct

SEQ ID NO: 7248908 - DNA, 22 bp, Homo sapiens
ctgggttgatctcagccctaag

SEQ ID NO: 7248909 - DNA, 22 bp, Homo sapiens
ctggtgggtagagggcatcagg

SEQ ID NO: 7248910 - DNA, 22 bp, Homo sapiens
ctggtgcctcctccctgtgctt

SEQ ID NO: 7248911 - DNA, 22 bp, Homo sapiens
ctggtgtggactccgcgcggag

SEQ ID NO: 7248912 - DNA, 22 bp, Homo sapiens
ctggttattttgtttggcagag

SEQ ID NO: 7248913 - DNA, 22 bp, Homo sapiens
ctggtgtttattacaggtgctc

SEQ ID NO: 7248914 - DNA, 22 bp, Homo sapiens
ctggtgttgtccgggtgagagt

SEQ ID NO: 7248915 - DNA, 22 bp, Homo sapiens
ctggggctggtgaggcaggctc

SEQ ID NO: 7248916 - DNA, 22 bp, Homo sapiens
ctggggctggtgaggcaggctc

SEQ ID NO: 7248917 - DNA, 22 bp, Homo sapiens
ctggggggagctgcgtccagca

SEQ ID NO: 7248918 - DNA, 22 bp, Homo sapiens
ctgggggccttacggaactcca

SEQ ID NO: 7248919 - DNA, 20 bp, Homo sapiens
ctgggctcggtggccctggc

SEQ ID NO: 7248920 - DNA, 22 bp, Homo sapiens
ctggggtggagattggcaatct

SEQ ID NO: 7248921 - DNA, 22 bp, Homo sapiens
ctggggtggaggagctcccctg

SEQ ID NO: 7248922 - DNA, 22 bp, Homo sapiens
ctggggtggatgggtccaagtt

SEQ ID NO: 7248923 - DNA, 22 bp, Homo sapiens
ctggggtggaggagctcccctg

SEQ ID NO: 7248924 - DNA, 22 bp, Homo sapiens
ctggggtggtgcaggcctcatg

SEQ ID NO: 7248925 - DNA, 22 bp, Homo sapiens
ctggggtgtctcgtctgccatt

SEQ ID NO: 7248926 - DNA, 22 bp, Homo sapiens
ctggggtggtgcaggcctcatg

SEQ ID NO: 7248927 - DNA, 22 bp, Homo sapiens
ctggggggctactgacagagga

SEQ ID NO: 7248928 - DNA, 22 bp, Homo sapiens
ctgggggtcgcgcctctgggca

SEQ ID NO: 7248929 - DNA, 22 bp, Homo sapiens
ctggggtgagcagaaacagggg

SEQ ID NO: 7248930 - DNA, 22 bp, Homo sapiens
ctggggtgaaggattacctgag

SEQ ID NO: 7248931 - DNA, 22 bp, Homo sapiens
ctgggggtgagcagcagcgacg

SEQ ID NO: 7248932 - DNA, 22 bp, Homo sapiens
tttccaaggatgtgtctctcta

SEQ ID NO: 7248933 - DNA, 22 bp, Homo sapiens
tttccacatcaccatgaggtga

SEQ ID NO: 7248934 - DNA, 22 bp, Homo sapiens
tttctacagaagatacactgct

SEQ ID NO: 7248935 - DNA, 22 bp, Homo sapiens
tttctcaaggtgtcatgtattt

SEQ ID NO: 7248936 - DNA, 22 bp, Homo sapiens
tttctacatgtcagtaactgat

SEQ ID NO: 7248937 - DNA, 18 bp, Homo sapiens
ctctctttccactctttg

SEQ ID NO: 7248938 - DNA, 18 bp, Homo sapiens
ctctctggtctggatccc

SEQ ID NO: 7248939 - DNA, 22 bp, Homo sapiens
tttatgattattttaaagcagc

SEQ ID NO: 7248940 - DNA, 22 bp, Homo sapiens
ctccaggcccacggccgcggcc

SEQ ID NO: 7248941 - DNA, 22 bp, Homo sapiens
ctccaggatacctgttcctata

SEQ ID NO: 7248942 - DNA, 22 bp, Homo sapiens
ctccaggatgttagacgtccag

SEQ ID NO: 7248943 - DNA, 22 bp, Homo sapiens
ctccaggaggttgctgcttcct

SEQ ID NO: 7248944 - DNA, 22 bp, Homo sapiens
ctccaggagggcttcctgtgat

SEQ ID NO: 7248945 - DNA, 22 bp, Homo sapiens
tttatgattattttaaagcagc

SEQ ID NO: 7248946 - DNA, 22 bp, Homo sapiens
tttatgcacacttagacatggc

SEQ ID NO: 7248947 - DNA, 22 bp, Homo sapiens
tttatgcagcgtttcaccaccc

SEQ ID NO: 7248948 - DNA, 22 bp, Homo sapiens
tttattcactcattcagccagt

SEQ ID NO: 7248949 - DNA, 22 bp, Homo sapiens
tttattcactggggtctgcccg

SEQ ID NO: 7248950 - DNA, 22 bp, Homo sapiens
tttattcacttcagtgccaaag

SEQ ID NO: 7248951 - DNA, 22 bp, Homo sapiens
tttattcacttcagtgccaaag

SEQ ID NO: 7248952 - DNA, 19 bp, Homo sapiens
tttattcacctttaccttg

SEQ ID NO: 7248953 - DNA, 22 bp, Homo sapiens
tttcagaaattgttattattct

SEQ ID NO: 7248954 - DNA, 22 bp, Homo sapiens
tttcagaaattatattagatgc

SEQ ID NO: 7248955 - DNA, 22 bp, Homo sapiens
tttcagaagtcaactaggtaaa

SEQ ID NO: 7248956 - DNA, 22 bp, Homo sapiens
tttattcagcagcagcagtggt

SEQ ID NO: 7248957 - DNA, 20 bp, Homo sapiens
tttattcagcctaccctctt

SEQ ID NO: 7248958 - DNA, 22 bp, Homo sapiens
tttattcatcatctgttcatat

SEQ ID NO: 7248959 - DNA, 22 bp, Homo sapiens
tttattcattgtttcgtcgcag

SEQ ID NO: 7248960 - DNA, 22 bp, Homo sapiens
ctctgcaacttctagcagtgtc

SEQ ID NO: 7248961 - DNA, 22 bp, Homo sapiens
tttcttgtaagatgtttattaa

SEQ ID NO: 7248962 - DNA, 22 bp, Homo sapiens
tttgagaaaaccagaaagatct

SEQ ID NO: 7248963 - DNA, 22 bp, Homo sapiens
ctctggcctggggcctgctccc

SEQ ID NO: 7248964 - DNA, 22 bp, Homo sapiens
ctctggcctgcttcctcaggta

SEQ ID NO: 7248965 - DNA, 22 bp, Homo sapiens
ctctggcctgcagatccatgct

SEQ ID NO: 7248966 - DNA, 19 bp, Homo sapiens
ctctggcctctggatgctg

SEQ ID NO: 7248967 - DNA, 22 bp, Homo sapiens
ctctggccccagtggccccttg

SEQ ID NO: 7248968 - DNA, 22 bp, Homo sapiens
ctctggccagagcctgcgggaa

SEQ ID NO: 7248969 - DNA, 22 bp, Homo sapiens
ctctggagtgcagcctggtggc

SEQ ID NO: 7248970 - DNA, 22 bp, Homo sapiens
ctctgtgggaggaggagtaggc

SEQ ID NO: 7248971 - DNA, 22 bp, Homo sapiens
ctctgggtgtgacagcacctgg

SEQ ID NO: 7248972 - DNA, 22 bp, Homo sapiens
ctctgggtgttaatgtcagtgt

SEQ ID NO: 7248973 - DNA, 22 bp, Homo sapiens
ctctgggtgagacagacctggt

SEQ ID NO: 7248974 - DNA, 17 bp, Homo sapiens
ctctgggtctcctgctt

SEQ ID NO: 7248975 - DNA, 22 bp, Homo sapiens
ctctgggtctataatgcagctg

SEQ ID NO: 7248976 - DNA, 22 bp, Homo sapiens
ctctgggtctccctgaggctaa

SEQ ID NO: 7248977 - DNA, 20 bp, Homo sapiens
ctctgggtcgagacagactt

SEQ ID NO: 7248978 - DNA, 22 bp, Homo sapiens
ctctgggtctacctgtggccag

SEQ ID NO: 7248979 - DNA, 22 bp, Homo sapiens
ctctgggtcctggggctacaag

SEQ ID NO: 7248980 - DNA, 22 bp, Homo sapiens
ctctgggtggtctcactgagtg

SEQ ID NO: 7248981 - DNA, 22 bp, Homo sapiens
ctctgggtgggcagcagatgga

SEQ ID NO: 7248982 - DNA, 17 bp, Homo sapiens
ctctgggtgcctgtgtg

SEQ ID NO: 7248983 - DNA, 22 bp, Homo sapiens
ctctgggtgcagcgctgaccgg

SEQ ID NO: 7248984 - DNA, 22 bp, Homo sapiens
ctctgggtgtcatggcctcagc

SEQ ID NO: 7248985 - DNA, 22 bp, Homo sapiens
ctctgggtgtcttaggagctca

SEQ ID NO: 7248986 - DNA, 22 bp, Homo sapiens
tttggaataatcagatcctagt

SEQ ID NO: 7248987 - DNA, 22 bp, Homo sapiens
tttggaatggaatagagattgc

SEQ ID NO: 7248988 - DNA, 22 bp, Homo sapiens
tttggaatgcccatggactggt

SEQ ID NO: 7248989 - DNA, 22 bp, Homo sapiens
tttggaatgcccatggactggt

SEQ ID NO: 7248990 - DNA, 22 bp, Homo sapiens
tttggaatgacagatatcaata

SEQ ID NO: 7248991 - DNA, 22 bp, Homo sapiens
tttggaatgaaacagcagagcc

SEQ ID NO: 7248992 - DNA, 22 bp, Homo sapiens
tttggaatctgagggcttagtt

SEQ ID NO: 7248993 - DNA, 22 bp, Homo sapiens
tttggaatattaaaatgtctca

SEQ ID NO: 7248994 - DNA, 22 bp, Homo sapiens
tttggaatattaaaatgtctca

SEQ ID NO: 7248995 - DNA, 22 bp, Homo sapiens
tttggaatagcatagaagctca

SEQ ID NO: 7248996 - DNA, 22 bp, Homo sapiens
tttggaatcctcagtatgatca

SEQ ID NO: 7248997 - DNA, 22 bp, Homo sapiens
tttggaatcatagatatattca

SEQ ID NO: 7248998 - DNA, 22 bp, Homo sapiens
tttggaatattgagaaagtgaa

SEQ ID NO: 7248999 - DNA, 22 bp, Homo sapiens
tttggaatgtagtttaatcatc

SEQ ID NO: 7249000 - DNA, 22 bp, Homo sapiens
tttggaatggtgctgtacagat

SEQ ID NO: 7249001 - DNA, 22 bp, Homo sapiens
tttggaatggtaccttcagttg

SEQ ID NO: 7249002 - DNA, 22 bp, Homo sapiens
tttggaattcagatggcttagg

SEQ ID NO: 7249003 - DNA, 22 bp, Homo sapiens
tttggaattatgcttaaagttt

SEQ ID NO: 7249004 - DNA, 22 bp, Homo sapiens
tttggaattacttactcaagcc

SEQ ID NO: 7249005 - DNA, 22 bp, Homo sapiens
tttggaatgttaggtgtctcat

SEQ ID NO: 7249006 - DNA, 22 bp, Homo sapiens
tttggaatgtatttgaccaaag

SEQ ID NO: 7249007 - DNA, 22 bp, Homo sapiens
tttggaattctgcagctcatgt

SEQ ID NO: 7249008 - DNA, 22 bp, Homo sapiens
tttggaattccatttctgcatt

SEQ ID NO: 7249009 - DNA, 22 bp, Homo sapiens
tttggaattcagatggcttagg

SEQ ID NO: 7249010 - DNA, 22 bp, Homo sapiens
tttggaattggaaagtgctgtg

SEQ ID NO: 7249011 - DNA, 23 bp, Homo sapiens
ctctgggtccgatgtcctgacag

SEQ ID NO: 7249012 - DNA, 22 bp, Homo sapiens
ctggagcagcaggtggccaggg

SEQ ID NO: 7249013 - DNA, 22 bp, Homo sapiens
ctggagccctgaatgggcagga

SEQ ID NO: 7249014 - DNA, 22 bp, Homo sapiens
ctggagccccaggctgtgcaga

SEQ ID NO: 7249015 - DNA, 22 bp, Homo sapiens
ctggagccggcgagccccagcc

SEQ ID NO: 7249016 - DNA, 22 bp, Homo sapiens
ctggagcctaggttgacctggg

SEQ ID NO: 7249017 - DNA, 22 bp, Homo sapiens
ctggagaggctgggaacaggtt

SEQ ID NO: 7249018 - DNA, 22 bp, Homo sapiens
ctggagagggagccctggcagt

SEQ ID NO: 7249019 - DNA, 22 bp, Homo sapiens
ctggaagagtaatataaattag

SEQ ID NO: 7249020 - DNA, 22 bp, Homo sapiens
ctggaaggagaaggaggctgtg

SEQ ID NO: 7249021 - DNA, 22 bp, Homo sapiens
ctggaaggtggatggcgaggcc

SEQ ID NO: 7249022 - DNA, 21 bp, Homo sapiens
ctgctctgacagtgaggccag

SEQ ID NO: 7249023 - DNA, 19 bp, Homo sapiens
ctgctgggtgctgagggag

SEQ ID NO: 7249024 - DNA, 22 bp, Homo sapiens
ctgctgggtctatgcaagtgga

SEQ ID NO: 7249025 - DNA, 17 bp, Homo sapiens
ctgaggggagtgctgtg

SEQ ID NO: 7249026 - DNA, 22 bp, Homo sapiens
ctgaggctggagtgcagtggtg

SEQ ID NO: 7249027 - DNA, 23 bp, Homo sapiens
ctgaggggaaaagggcttcaggc

SEQ ID NO: 7249028 - DNA, 23 bp, Homo sapiens
ctgaggggaaaagggcttcaggc

SEQ ID NO: 7249029 - DNA, 22 bp, Homo sapiens
ctgaggggaaaagtcaggatga

SEQ ID NO: 7249030 - DNA, 22 bp, Homo sapiens
ctgaggcctggccccaccacag

SEQ ID NO: 7249031 - DNA, 22 bp, Homo sapiens
ctgaggctagtataaagagcat

SEQ ID NO: 7249032 - DNA, 22 bp, Homo sapiens
ctgaggctcaagggcaggtggg

SEQ ID NO: 7249033 - DNA, 22 bp, Homo sapiens
ctgaggccgtctgggtctgcag

SEQ ID NO: 7249034 - DNA, 22 bp, Homo sapiens
ctcttcttatggccgtggctga

SEQ ID NO: 7249035 - DNA, 22 bp, Homo sapiens
ctcttctgtacctcggcctcca

SEQ ID NO: 7249036 - DNA, 19 bp, Homo sapiens
ctgagcagcggcagcactt

SEQ ID NO: 7249037 - DNA, 22 bp, Homo sapiens
ctgagcagcgtggggagctggc

SEQ ID NO: 7249038 - DNA, 22 bp, Homo sapiens
ctgagcagcgtggggagctggc

SEQ ID NO: 7249039 - DNA, 22 bp, Homo sapiens
ctgagcagctccctgagtggtc

SEQ ID NO: 7249040 - DNA, 22 bp, Homo sapiens
ctgagcaggacagtgggagacc

SEQ ID NO: 7249041 - DNA, 22 bp, Homo sapiens
ctgagcaggatattcacagcag

SEQ ID NO: 7249042 - DNA, 22 bp, Homo sapiens
ctgagcagaagggtgcacgtgc

SEQ ID NO: 7249043 - DNA, 22 bp, Homo sapiens
ctgagcagaccatggcagaggt

SEQ ID NO: 7249044 - DNA, 19 bp, Homo sapiens
ctgagcagcggcagcactt

SEQ ID NO: 7249045 - DNA, 22 bp, Homo sapiens
ctgagcaggcggtggagcggct

SEQ ID NO: 7249046 - DNA, 22 bp, Homo sapiens
ctgagcaggcggtggagcggct

SEQ ID NO: 7249047 - DNA, 19 bp, Homo sapiens
ctgagcaggcaggtaggat

SEQ ID NO: 7249048 - DNA, 22 bp, Homo sapiens
ctgagcagtgctttgcagtggg

SEQ ID NO: 7249049 - DNA, 22 bp, Homo sapiens
ctgagcagtctagccaggtgtt

SEQ ID NO: 7249050 - DNA, 22 bp, Homo sapiens
ctgaggtgtttagtaggggcgg

SEQ ID NO: 7249051 - DNA, 22 bp, Homo sapiens
ctgaggtggcctctgccgggga

SEQ ID NO: 7249052 - DNA, 22 bp, Homo sapiens
ctgaggtggggcctgggcatca

SEQ ID NO: 7249053 - DNA, 19 bp, Homo sapiens
ctgaggtgaggggcatcat

SEQ ID NO: 7249054 - DNA, 22 bp, Homo sapiens
ctgaggtgatgtcaaatgggtt

SEQ ID NO: 7249055 - DNA, 19 bp, Homo sapiens
ctgaggtgcagtaagaggc

SEQ ID NO: 7249056 - DNA, 22 bp, Homo sapiens
ctgaggtgctatggaggatacg

SEQ ID NO: 7249057 - DNA, 22 bp, Homo sapiens
ctgaggtggaacagaggtgaag

SEQ ID NO: 7249058 - DNA, 22 bp, Homo sapiens
ctgcaggaatctgtgctaggtg

SEQ ID NO: 7249059 - DNA, 22 bp, Homo sapiens
ctgcaggacagggccggaggcc

SEQ ID NO: 7249060 - DNA, 22 bp, Homo sapiens
ctgcaggacagggaggagcaag

SEQ ID NO: 7249061 - DNA, 22 bp, Homo sapiens
ctgcaggagtgaaagcaggcct

SEQ ID NO: 7249062 - DNA, 21 bp, Homo sapiens
ctgcaggatgctgaagccagg

SEQ ID NO: 7249063 - DNA, 22 bp, Homo sapiens
ctgcaggaggatcctgagagtg

SEQ ID NO: 7249064 - DNA, 22 bp, Homo sapiens
ctgcccagattttaccacctgc

SEQ ID NO: 7249065 - DNA, 20 bp, Homo sapiens
ctgcccagccactgagggat

SEQ ID NO: 7249066 - DNA, 20 bp, Homo sapiens
ctgcccagccactgagggat

SEQ ID NO: 7249067 - DNA, 20 bp, Homo sapiens
ctgcccagccactgagggat

SEQ ID NO: 7249068 - DNA, 22 bp, Homo sapiens
ctgcccacacctgagctgggcc

SEQ ID NO: 7249069 - DNA, 22 bp, Homo sapiens
ctgcccaggctgaaggaacatc

SEQ ID NO: 7249070 - DNA, 22 bp, Homo sapiens
ctgccccacaggcttggtaggg

SEQ ID NO: 7249071 - DNA, 22 bp, Homo sapiens
ctgcccagtttgggagcctttc

SEQ ID NO: 7249072 - DNA, 22 bp, Homo sapiens
cgtgtctgggatagcagaagta

SEQ ID NO: 7249073 - DNA, 22 bp, Homo sapiens
cgttaataggtgcaaggtaagg

SEQ ID NO: 7249074 - DNA, 22 bp, Homo sapiens
cgttcttttcatatttacatgg

SEQ ID NO: 7249075 - DNA, 22 bp, Homo sapiens
cgttttcttcactttgcaagtt

SEQ ID NO: 7249076 - DNA, 22 bp, Homo sapiens
ctagagcagattgcagagtagg

SEQ ID NO: 7249077 - DNA, 17 bp, Homo sapiens
ctagagagaaagagcta

SEQ ID NO: 7249078 - DNA, 22 bp, Homo sapiens
ctagagtgaagggtcttgaggc

SEQ ID NO: 7249079 - DNA, 22 bp, Homo sapiens
ctagagtgcaggtgtatggtta

SEQ ID NO: 7249080 - DNA, 22 bp, Homo sapiens
ctagagggatgttaggatagca

SEQ ID NO: 7249081 - DNA, 22 bp, Homo sapiens
ctagatccattttctgtctctg

SEQ ID NO: 7249082 - DNA, 22 bp, Homo sapiens
ttctatgcctgagaagaagccg

SEQ ID NO: 7249083 - DNA, 22 bp, Homo sapiens
ttctatgctagtggaaagcttc

SEQ ID NO: 7249084 - DNA, 22 bp, Homo sapiens
ctagaaatattttacagtcaag

SEQ ID NO: 7249085 - DNA, 22 bp, Homo sapiens
ttctggaaggatgtttctatct

SEQ ID NO: 7249086 - DNA, 22 bp, Homo sapiens
ttctggaagcttttggagagaa

SEQ ID NO: 7249087 - DNA, 22 bp, Homo sapiens
ttctggaagctgggcagcaccc

SEQ ID NO: 7249088 - DNA, 22 bp, Homo sapiens
ttctggaagctggaaaaggcaa

SEQ ID NO: 7249089 - DNA, 22 bp, Homo sapiens
ttctggaaggcagggagaaccc

SEQ ID NO: 7249090 - DNA, 22 bp, Homo sapiens
ttctggaagccccagagtcaga

SEQ ID NO: 7249091 - DNA, 22 bp, Homo sapiens
ttctggaagccctaagggagaa

SEQ ID NO: 7249092 - DNA, 22 bp, Homo sapiens
ttctggaagctgcaggtggccg

SEQ ID NO: 7249093 - DNA, 23 bp, Homo sapiens
ttctggaagatttacttgagaca

SEQ ID NO: 7249094 - DNA, 22 bp, Homo sapiens
ttctggaagcagtggggagtga

SEQ ID NO: 7249095 - DNA, 22 bp, Homo sapiens
ttctggaagccatgggaacagg

SEQ ID NO: 7249096 - DNA, 22 bp, Homo sapiens
ttctggaagaggtgtaagtata

SEQ ID NO: 7249097 - DNA, 22 bp, Homo sapiens
ttctggaagaataatgggcaaa

SEQ ID NO: 7249098 - DNA, 22 bp, Homo sapiens
ttctggaactatactgttggtg

SEQ ID NO: 7249099 - DNA, 22 bp, Homo sapiens
ttctggaagatacctctcctaa

SEQ ID NO: 7249100 - DNA, 22 bp, Homo sapiens
ttctggaagagtaaaataagcc

SEQ ID NO: 7249101 - DNA, 22 bp, Homo sapiens
ttctggaacatagcaagaagtt

SEQ ID NO: 7249102 - DNA, 22 bp, Homo sapiens
ttctggaaccagcctgcctggg

SEQ ID NO: 7249103 - DNA, 22 bp, Homo sapiens
ttctggaaccaacatgccagtt

SEQ ID NO: 7249104 - DNA, 22 bp, Homo sapiens
ttctatgctcaatggagccttt

SEQ ID NO: 7249105 - DNA, 22 bp, Homo sapiens
ctcagagaacctaagcggagga

SEQ ID NO: 7249106 - DNA, 22 bp, Homo sapiens
ctcagagaagatggatgaggta

SEQ ID NO: 7249107 - DNA, 22 bp, Homo sapiens
ctcagagccagttagcaggtgc

SEQ ID NO: 7249108 - DNA, 22 bp, Homo sapiens
ctcagaggcaagcaaggagctg

SEQ ID NO: 7249109 - DNA, 22 bp, Homo sapiens
ctcagaggaggcagggtgtgcc

SEQ ID NO: 7249110 - DNA, 22 bp, Homo sapiens
ctcagagccccaggagggtgtg

SEQ ID NO: 7249111 - DNA, 22 bp, Homo sapiens
ctcagagagggcaccagggcca

SEQ ID NO: 7249112 - DNA, 19 bp, Homo sapiens
ctcagagaggggcagtgcc

SEQ ID NO: 7249113 - DNA, 22 bp, Homo sapiens
ctcagagatatagtccctgctt

SEQ ID NO: 7249114 - DNA, 22 bp, Homo sapiens
ttctggccaaggctgccagatt

SEQ ID NO: 7249115 - DNA, 22 bp, Homo sapiens
ctatagaaaattgtatcacacg

SEQ ID NO: 7249116 - DNA, 22 bp, Homo sapiens
ctatagaaaattgtatcacacg

SEQ ID NO: 7249117 - DNA, 22 bp, Homo sapiens
ctatacagtaaccacagtgatt

SEQ ID NO: 7249118 - DNA, 22 bp, Homo sapiens
ctatacagcagcttactagtta

SEQ ID NO: 7249119 - DNA, 22 bp, Homo sapiens
ctatagaaacaacctctctttc

SEQ ID NO: 7249120 - DNA, 22 bp, Homo sapiens
ctcacaggttctgcagctcaca

SEQ ID NO: 7249121 - DNA, 22 bp, Homo sapiens
ctcacccctgtaattccagcac

SEQ ID NO: 7249122 - DNA, 22 bp, Homo sapiens
ctcacccatatctccatgactc

SEQ ID NO: 7249123 - DNA, 22 bp, Homo sapiens
ttgcagaacttaaagacagagt

SEQ ID NO: 7249124 - DNA, 22 bp, Homo sapiens
ttgcagaaaacagttttcttgt

SEQ ID NO: 7249125 - DNA, 23 bp, Homo sapiens
ctcagaggcctgtccagggtggt

SEQ ID NO: 7249126 - DNA, 22 bp, Homo sapiens
ctcaggacttggttagtgtttt

SEQ ID NO: 7249127 - DNA, 22 bp, Homo sapiens
ctcaggagatgacagaaggtat

SEQ ID NO: 7249128 - DNA, 22 bp, Homo sapiens
ctcagggctggaaagccaggaa

SEQ ID NO: 7249129 - DNA, 22 bp, Homo sapiens
ctcagggcagtatggctgagag

SEQ ID NO: 7249130 - DNA, 23 bp, Homo sapiens
ctcagggatagaaaggaagacag

SEQ ID NO: 7249131 - DNA, 22 bp, Homo sapiens
ttgcatcaggtagacaactata

SEQ ID NO: 7249132 - DNA, 22 bp, Homo sapiens
ttgcatcagaattacttggagg

SEQ ID NO: 7249133 - DNA, 22 bp, Homo sapiens
ttgccctgaagaacgtcccaga

SEQ ID NO: 7249134 - DNA, 16 bp, Homo sapiens
ttgccctgaggggagg

SEQ ID NO: 7249135 - DNA, 17 bp, Homo sapiens
ttgccctgatttttaac

SEQ ID NO: 7249136 - DNA, 22 bp, Homo sapiens
ttgccctgcagcggtgagtggt

SEQ ID NO: 7249137 - DNA, 22 bp, Homo sapiens
ttgccctgcctccctgaggtga

SEQ ID NO: 7249138 - DNA, 22 bp, Homo sapiens
ttgccctgtggggcctccagcc

SEQ ID NO: 7249139 - DNA, 22 bp, Homo sapiens
ttgccctgtctcactatgttaa

SEQ ID NO: 7249140 - DNA, 22 bp, Homo sapiens
ttgccctgtcttaagctggcaa

SEQ ID NO: 7249141 - DNA, 22 bp, Homo sapiens
ttgccctgtcagtagaagtgca

SEQ ID NO: 7249142 - DNA, 22 bp, Homo sapiens
ttgccctggggctggcctggca

SEQ ID NO: 7249143 - DNA, 22 bp, Homo sapiens
ttgccctgcgggtcctgcgcaa

SEQ ID NO: 7249144 - DNA, 22 bp, Homo sapiens
ttgccctgcgttaccatctctt

SEQ ID NO: 7249145 - DNA, 22 bp, Homo sapiens
ctccagagggtcagactctgag

SEQ ID NO: 7249146 - DNA, 22 bp, Homo sapiens
ctccagagggtcagactctgag

SEQ ID NO: 7249147 - DNA, 22 bp, Homo sapiens
ctccagagtcacactgcctggg

SEQ ID NO: 7249148 - DNA, 20 bp, Homo sapiens
ttggctctgatcagtggagc

SEQ ID NO: 7249149 - DNA, 22 bp, Homo sapiens
ctccaggaccagggctcctgga

SEQ ID NO: 7249150 - DNA, 22 bp, Homo sapiens
ctccaggacatgactttcttgc

SEQ ID NO: 7249151 - DNA, 22 bp, Homo sapiens
ctccagcctcatctcctggctg

SEQ ID NO: 7249152 - DNA, 22 bp, Homo sapiens
ctccactcaacaagcccagtgt

SEQ ID NO: 7249153 - DNA, 22 bp, Homo sapiens
ttggagggacagatggctaggc

SEQ ID NO: 7249154 - DNA, 22 bp, Homo sapiens
ttggagggactgagcttcagtc

SEQ ID NO: 7249155 - DNA, 22 bp, Homo sapiens
ttggaggggccactgcagagct

SEQ ID NO: 7249156 - DNA, 22 bp, Homo sapiens
ttggagggtcttccacagccat

SEQ ID NO: 7249157 - DNA, 20 bp, Homo sapiens
ttatttcagttgctagattg

SEQ ID NO: 7249158 - DNA, 23 bp, Homo sapiens
ttattgcatccaaatgcattcct

SEQ ID NO: 7249159 - DNA, 17 bp, Homo sapiens
ttattgcagtgctgaag

SEQ ID NO: 7249160 - DNA, 17 bp, Homo sapiens
ttattgcagtgctgaag

SEQ ID NO: 7249161 - DNA, 22 bp, Homo sapiens
ttattgcagatggtgtgagaga

SEQ ID NO: 7249162 - DNA, 22 bp, Homo sapiens
ttattgcagatggtgtgagaga

SEQ ID NO: 7249163 - DNA, 22 bp, Homo sapiens
ttattgcaccttcctcactaac

SEQ ID NO: 7249164 - DNA, 22 bp, Homo sapiens
ttattgcaccatgcctcagttt

SEQ ID NO: 7249165 - DNA, 22 bp, Homo sapiens
ttattgcaactttagggataga

SEQ ID NO: 7249166 - DNA, 23 bp, Homo sapiens
ttattgcaaggtaaaattgctga

SEQ ID NO: 7249167 - DNA, 22 bp, Homo sapiens
cgctgataaacgtcacgttccc

SEQ ID NO: 7249168 - DNA, 20 bp, Homo sapiens
cgctcctgttcccggtccca

SEQ ID NO: 7249169 - DNA, 22 bp, Homo sapiens
ttatttcatgtaaaatttatgt

SEQ ID NO: 7249170 - DNA, 22 bp, Homo sapiens
ttatttcatgtaaaatttatgt

SEQ ID NO: 7249171 - DNA, 22 bp, Homo sapiens
cgctgggcaggtccacttgtta

SEQ ID NO: 7249172 - DNA, 22 bp, Homo sapiens
ttattgcaaaggaagagcttga

SEQ ID NO: 7249173 - DNA, 22 bp, Homo sapiens
ttattgcaaccttttctggtgt

SEQ ID NO: 7249174 - DNA, 22 bp, Homo sapiens
cgagagttagctaggagtcaca

SEQ ID NO: 7249175 - DNA, 22 bp, Homo sapiens
cgagagatgggttggcaggggc

SEQ ID NO: 7249176 - DNA, 22 bp, Homo sapiens
cgagaaatgagaaacccatttt

SEQ ID NO: 7249177 - DNA, 22 bp, Homo sapiens
ccttttctacaagcaaatgtgc

SEQ ID NO: 7249178 - DNA, 22 bp, Homo sapiens
ccttttctaatcttaagaatgt

SEQ ID NO: 7249179 - DNA, 22 bp, Homo sapiens
ccttttctgaaccacttaaata

SEQ ID NO: 7249180 - DNA, 22 bp, Homo sapiens
ccttttctggccaccaagcgct

SEQ ID NO: 7249181 - DNA, 22 bp, Homo sapiens
cgggaggaaaggcgaggctctg

SEQ ID NO: 7249182 - DNA, 22 bp, Homo sapiens
cggggaggcttcggattaaagc

SEQ ID NO: 7249183 - DNA, 22 bp, Homo sapiens
cggggaggcttcggattaaagc

SEQ ID NO: 7249184 - DNA, 22 bp, Homo sapiens
cggggaagcggttctggcggta

SEQ ID NO: 7249185 - DNA, 22 bp, Homo sapiens
cggggcaggagtccctgtagag

SEQ ID NO: 7249186 - DNA, 23 bp, Homo sapiens
cggggccagggtcaggaccggtc

SEQ ID NO: 7249187 - DNA, 22 bp, Homo sapiens
cggggcagaaagttgtcttttg

SEQ ID NO: 7249188 - DNA, 22 bp, Homo sapiens
cggggcagagggtcttctccag

SEQ ID NO: 7249189 - DNA, 22 bp, Homo sapiens
cggggcaggagtccctgtagag

SEQ ID NO: 7249190 - DNA, 22 bp, Homo sapiens
cggggcagagggtcttctccag

SEQ ID NO: 7249191 - DNA, 22 bp, Homo sapiens
cggggagggcagaggctccctc

SEQ ID NO: 7249192 - DNA, 22 bp, Homo sapiens
cggggagggcagaggctccctc

SEQ ID NO: 7249193 - DNA, 22 bp, Homo sapiens
cggggcagaaagttgtcttttg

SEQ ID NO: 7249194 - DNA, 22 bp, Homo sapiens
cggggagggcagaggctccctc

SEQ ID NO: 7249195 - DNA, 22 bp, Homo sapiens
cgtgggtcgggactccgcctcg

SEQ ID NO: 7249196 - DNA, 22 bp, Homo sapiens
cgtggggacccacgtgcagcac

SEQ ID NO: 7249197 - DNA, 22 bp, Homo sapiens
cgtgggaggaaaaatgggcttc

SEQ ID NO: 7249198 - DNA, 22 bp, Homo sapiens
cgtgggagtggtgggtgctcag

SEQ ID NO: 7249199 - DNA, 22 bp, Homo sapiens
cgtgggagtggtgggtgctcag

SEQ ID NO: 7249200 - DNA, 22 bp, Homo sapiens
cggggctgctcgtcctcctgtg

SEQ ID NO: 7249201 - DNA, 22 bp, Homo sapiens
cggggctggcacaggtgaccac

SEQ ID NO: 7249202 - DNA, 22 bp, Homo sapiens
cggggctgacagcaggtgtgct

SEQ ID NO: 7249203 - DNA, 22 bp, Homo sapiens
cggggctgaggcaacgcggaga

SEQ ID NO: 7249204 - DNA, 22 bp, Homo sapiens
cggggcgagcagacggcggcaa

SEQ ID NO: 7249205 - DNA, 22 bp, Homo sapiens
cggggcctaccgctgcgtggcc

SEQ ID NO: 7249206 - DNA, 22 bp, Homo sapiens
cggggccctggggctgaaggtc

SEQ ID NO: 7249207 - DNA, 22 bp, Homo sapiens
ttcaaatcactttggagcttaa

SEQ ID NO: 7249208 - DNA, 22 bp, Homo sapiens
cggcagagcttcctgctcagcg

SEQ ID NO: 7249209 - DNA, 22 bp, Homo sapiens
cggcagagtgtgtgcgtgcatg

SEQ ID NO: 7249210 - DNA, 22 bp, Homo sapiens
cggcagagccctgagtcagcct

SEQ ID NO: 7249211 - DNA, 22 bp, Homo sapiens
ttagacatagaatattgtctag

SEQ ID NO: 7249212 - DNA, 22 bp, Homo sapiens
ttagcaaatatcttgaaacagg

SEQ ID NO: 7249213 - DNA, 21 bp, Homo sapiens
ttagcaaagcaaacacatgct

SEQ ID NO: 7249214 - DNA, 22 bp, Homo sapiens
ttacatagttaaatagtacagc

SEQ ID NO: 7249215 - DNA, 22 bp, Homo sapiens
ttacataaaagttcacgtaggc

SEQ ID NO: 7249216 - DNA, 20 bp, Homo sapiens
ccttcagaacttacatagta

SEQ ID NO: 7249217 - DNA, 22 bp, Homo sapiens
ccttcagacctagacaggaatc

SEQ ID NO: 7249218 - DNA, 23 bp, Homo sapiens
ccttcagaagaagtaacaggggc

SEQ ID NO: 7249219 - DNA, 22 bp, Homo sapiens
ccttcagaggtgtagattgcgt

SEQ ID NO: 7249220 - DNA, 22 bp, Homo sapiens
ttatcatagtgcagttttctga

SEQ ID NO: 7249221 - DNA, 22 bp, Homo sapiens
ccttaaattctccatttgaaag

SEQ ID NO: 7249222 - DNA, 23 bp, Homo sapiens
ccttaaatatctaccctgtggca

SEQ ID NO: 7249223 - DNA, 22 bp, Homo sapiens
ttacagttgcccccagcctcgc

SEQ ID NO: 7249224 - DNA, 21 bp, Homo sapiens
ttacagaatccatgggaagtc

SEQ ID NO: 7249225 - DNA, 22 bp, Homo sapiens
ttacagttgttctatcagcatg

SEQ ID NO: 7249226 - DNA, 22 bp, Homo sapiens
ttaagattttcttcagtattat

SEQ ID NO: 7249227 - DNA, 22 bp, Homo sapiens
ttaagatgttcagataatttgg

SEQ ID NO: 7249228 - DNA, 21 bp, Homo sapiens
tgtcagcaacaatactttctc

SEQ ID NO: 7249229 - DNA, 22 bp, Homo sapiens
tgtcagcagctggtttgctgtt

SEQ ID NO: 7249230 - DNA, 22 bp, Homo sapiens
ttaaatagtaggtctattttgg

SEQ ID NO: 7249231 - DNA, 22 bp, Homo sapiens
cattatattttactgcatggga

SEQ ID NO: 7249232 - DNA, 22 bp, Homo sapiens
catgtttaattgcgatgtttga

SEQ ID NO: 7249233 - DNA, 22 bp, Homo sapiens
catgttgtatcattctgttcct

SEQ ID NO: 7249234 - DNA, 22 bp, Homo sapiens
cattcataggaggagatgatta

SEQ ID NO: 7249235 - DNA, 22 bp, Homo sapiens
cattcacattcttcttactgtt

SEQ ID NO: 7249236 - DNA, 22 bp, Homo sapiens
cattcacagcaggtcagctgaa

SEQ ID NO: 7249237 - DNA, 22 bp, Homo sapiens
tcccagcccaggtatgatgata

SEQ ID NO: 7249238 - DNA, 22 bp, Homo sapiens
tcccagcccagatttgtgtgac

SEQ ID NO: 7249239 - DNA, 22 bp, Homo sapiens
tcccagcccagacttctccagt

SEQ ID NO: 7249240 - DNA, 22 bp, Homo sapiens
tcccagccattcctttaggtgt

SEQ ID NO: 7249241 - DNA, 22 bp, Homo sapiens
tcccagccaggctctaccactt

SEQ ID NO: 7249242 - DNA, 22 bp, Homo sapiens
tcccagccaggctctaccactt

SEQ ID NO: 7249243 - DNA, 22 bp, Homo sapiens
tcccagccacagtttccacctg

SEQ ID NO: 7249244 - DNA, 22 bp, Homo sapiens
tcccagccacagtttccacctg

SEQ ID NO: 7249245 - DNA, 22 bp, Homo sapiens
tcccagagctctgacaccagct

SEQ ID NO: 7249246 - DNA, 22 bp, Homo sapiens
tcccagagctctggaggttgga

SEQ ID NO: 7249247 - DNA, 22 bp, Homo sapiens
cattcatttactttcaacagct

SEQ ID NO: 7249248 - DNA, 22 bp, Homo sapiens
tcccagagcccaagttggagag

SEQ ID NO: 7249249 - DNA, 22 bp, Homo sapiens
cattcatttatgaaatatctat

SEQ ID NO: 7249250 - DNA, 22 bp, Homo sapiens
tcccactgagcatatgcagatg

SEQ ID NO: 7249251 - DNA, 21 bp, Homo sapiens
tcccactctaaatggactgaa

SEQ ID NO: 7249252 - DNA, 22 bp, Homo sapiens
catttggccattccagtcacat

SEQ ID NO: 7249253 - DNA, 22 bp, Homo sapiens
catttgtactgttcaatgtcat

SEQ ID NO: 7249254 - DNA, 22 bp, Homo sapiens
catttgtagttaaaaatgtctc

SEQ ID NO: 7249255 - DNA, 22 bp, Homo sapiens
tcctctccaggtgagccgaaat

SEQ ID NO: 7249256 - DNA, 22 bp, Homo sapiens
tcctctccatattttctgattt

SEQ ID NO: 7249257 - DNA, 22 bp, Homo sapiens
tcctcaggctgcctggaagact

SEQ ID NO: 7249258 - DNA, 22 bp, Homo sapiens
tcctcaggatgtggggtagaat

SEQ ID NO: 7249259 - DNA, 22 bp, Homo sapiens
tcctcaggatgtggagtagaat

SEQ ID NO: 7249260 - DNA, 22 bp, Homo sapiens
cattgaataatgtccttgcaaa

SEQ ID NO: 7249261 - DNA, 22 bp, Homo sapiens
cattgaaacctaacataggctg

SEQ ID NO: 7249262 - DNA, 22 bp, Homo sapiens
cattgaaaaacgttgactgagt

SEQ ID NO: 7249263 - DNA, 22 bp, Homo sapiens
cattgcaacttcaaactcctgg

SEQ ID NO: 7249264 - DNA, 22 bp, Homo sapiens
tccccactcaccactggccaaa

SEQ ID NO: 7249265 - DNA, 22 bp, Homo sapiens
tccccactcctgggcagatgcg

SEQ ID NO: 7249266 - DNA, 22 bp, Homo sapiens
tccccagcttgctacttctgct

SEQ ID NO: 7249267 - DNA, 22 bp, Homo sapiens
tccccagctctgtgcttccact

SEQ ID NO: 7249268 - DNA, 22 bp, Homo sapiens
tccccagccgtgaaggagagga

SEQ ID NO: 7249269 - DNA, 22 bp, Homo sapiens
tccccagcattgagggtctctc

SEQ ID NO: 7249270 - DNA, 22 bp, Homo sapiens
tccccactgggcctcctctttc

SEQ ID NO: 7249271 - DNA, 22 bp, Homo sapiens
tccccactctgggccaccacaa

SEQ ID NO: 7249272 - DNA, 22 bp, Homo sapiens
tccccactctgggccaccacaa

SEQ ID NO: 7249273 - DNA, 22 bp, Homo sapiens
tccccactctctcctggagctt

SEQ ID NO: 7249274 - DNA, 22 bp, Homo sapiens
tccccactctctcctggagctt

SEQ ID NO: 7249275 - DNA, 22 bp, Homo sapiens
tccccactcctgggcagatgcg

SEQ ID NO: 7249276 - DNA, 22 bp, Homo sapiens
tccccactgggcctcctctttc

SEQ ID NO: 7249277 - DNA, 19 bp, Homo sapiens
tccccagcacctctgagtc

SEQ ID NO: 7249278 - DNA, 19 bp, Homo sapiens
tccccagcacctctgagtc

SEQ ID NO: 7249279 - DNA, 22 bp, Homo sapiens
catgtgtggttacctacttgac

SEQ ID NO: 7249280 - DNA, 18 bp, Homo sapiens
catgtgttctacatcagt

SEQ ID NO: 7249281 - DNA, 20 bp, Homo sapiens
tccaggctcctccacttagt

SEQ ID NO: 7249282 - DNA, 22 bp, Homo sapiens
tccaggctcccctgcgtgctcc

SEQ ID NO: 7249283 - DNA, 22 bp, Homo sapiens
tccaggccccagcaccttggga

SEQ ID NO: 7249284 - DNA, 22 bp, Homo sapiens
tccaggcccgagatgggctgga

SEQ ID NO: 7249285 - DNA, 22 bp, Homo sapiens
tccaggcccctgcctgggcctg

SEQ ID NO: 7249286 - DNA, 22 bp, Homo sapiens
tccaggcccatggagcagagct

SEQ ID NO: 7249287 - DNA, 23 bp, Homo sapiens
tccagcctcttgctctcacatgc

SEQ ID NO: 7249288 - DNA, 17 bp, Homo sapiens
tccagcctcctctgctg

SEQ ID NO: 7249289 - DNA, 22 bp, Homo sapiens
tccagcctcctatttaccctaa

SEQ ID NO: 7249290 - DNA, 22 bp, Homo sapiens
tccagcctcatttctcctgctt

SEQ ID NO: 7249291 - DNA, 22 bp, Homo sapiens
tccagcctaggggaacagctgc

SEQ ID NO: 7249292 - DNA, 22 bp, Homo sapiens
tccagagagaaaaacaagcttt

SEQ ID NO: 7249293 - DNA, 22 bp, Homo sapiens
tccagcctaatgttcttcccac

SEQ ID NO: 7249294 - DNA, 22 bp, Homo sapiens
tccagccgtcacagccacattc

SEQ ID NO: 7249295 - DNA, 22 bp, Homo sapiens
tccagccgccggccctgcaggt

SEQ ID NO: 7249296 - DNA, 18 bp, Homo sapiens
tcattcattaaacttggc

SEQ ID NO: 7249297 - DNA, 22 bp, Homo sapiens
catcttttggtaggagccgggc

SEQ ID NO: 7249298 - DNA, 22 bp, Homo sapiens
catcttttggcctattctgagg

SEQ ID NO: 7249299 - DNA, 22 bp, Homo sapiens
catctttgggctgcatggaagg

SEQ ID NO: 7249300 - DNA, 22 bp, Homo sapiens
catctttggttttctatatgcc

SEQ ID NO: 7249301 - DNA, 22 bp, Homo sapiens
catctttgttttggatataatc

SEQ ID NO: 7249302 - DNA, 22 bp, Homo sapiens
catcttttcagaagccattctg

SEQ ID NO: 7249303 - DNA, 21 bp, Homo sapiens
tccaagccttcaacacattca

SEQ ID NO: 7249304 - DNA, 20 bp, Homo sapiens
tccaagccctccttccattc

SEQ ID NO: 7249305 - DNA, 17 bp, Homo sapiens
tccaagccagcttgcct

SEQ ID NO: 7249306 - DNA, 22 bp, Homo sapiens
tcatttatttgactttggagtg

SEQ ID NO: 7249307 - DNA, 22 bp, Homo sapiens
tccagacattttatagcagtct

SEQ ID NO: 7249308 - DNA, 19 bp, Homo sapiens
tcattgaacataattactt

SEQ ID NO: 7249309 - DNA, 22 bp, Homo sapiens
tcattgaaagtgcctcctcgga

SEQ ID NO: 7249310 - DNA, 22 bp, Homo sapiens
tcattgaaaactcagcatctac

SEQ ID NO: 7249311 - DNA, 22 bp, Homo sapiens
tcattcttgatcactagttagt

SEQ ID NO: 7249312 - DNA, 22 bp, Homo sapiens
tcattctggatgactttctaga

SEQ ID NO: 7249313 - DNA, 22 bp, Homo sapiens
tcattctgcatcactcttgctc

SEQ ID NO: 7249314 - DNA, 19 bp, Homo sapiens
tcattgaacataattactt

SEQ ID NO: 7249315 - DNA, 22 bp, Homo sapiens
tctcaaatttgttagataaaat

SEQ ID NO: 7249316 - DNA, 18 bp, Homo sapiens
tctatatggacatagaga

SEQ ID NO: 7249317 - DNA, 22 bp, Homo sapiens
tctatattccagatacagatta

SEQ ID NO: 7249318 - DNA, 22 bp, Homo sapiens
ccacctcctaggcctggagaag

SEQ ID NO: 7249319 - DNA, 22 bp, Homo sapiens
ccacttttgggaacagtgagta

SEQ ID NO: 7249320 - DNA, 22 bp, Homo sapiens
tctccacagtcccacctcgctt

SEQ ID NO: 7249321 - DNA, 22 bp, Homo sapiens
tctccacagaaggttccaggcc

SEQ ID NO: 7249322 - DNA, 19 bp, Homo sapiens
ccagagagctaggtacaga

SEQ ID NO: 7249323 - DNA, 22 bp, Homo sapiens
ccagagagctacaaggcataaa

SEQ ID NO: 7249324 - DNA, 22 bp, Homo sapiens
ccagagagagtactgggctctg

SEQ ID NO: 7249325 - DNA, 22 bp, Homo sapiens
ccagagagattgcttctaaaga

SEQ ID NO: 7249326 - DNA, 21 bp, Homo sapiens
ccagagagagggaagtgggtt

SEQ ID NO: 7249327 - DNA, 18 bp, Homo sapiens
tctccacttctgtgagaa

SEQ ID NO: 7249328 - DNA, 22 bp, Homo sapiens
tctccactctgagtgcctttca

SEQ ID NO: 7249329 - DNA, 22 bp, Homo sapiens
tctccactattttctagctctt

SEQ ID NO: 7249330 - DNA, 22 bp, Homo sapiens
ccagagagagaggtcaatggca

SEQ ID NO: 7249331 - DNA, 22 bp, Homo sapiens
tctccgggtggcggcgaaggga

SEQ ID NO: 7249332 - DNA, 22 bp, Homo sapiens
tctccgggtgcatgtgtgtgcc

SEQ ID NO: 7249333 - DNA, 22 bp, Homo sapiens
tctccctctcagatttattcac

SEQ ID NO: 7249334 - DNA, 22 bp, Homo sapiens
ccagagaggccaaggtcgtggt

SEQ ID NO: 7249335 - DNA, 22 bp, Homo sapiens
ccagagaggcaaaactccttcc

SEQ ID NO: 7249336 - DNA, 22 bp, Homo sapiens
ccacccttccattcttcctctt

SEQ ID NO: 7249337 - DNA, 22 bp, Homo sapiens
ccaccctgtgcaggcgtgggta

SEQ ID NO: 7249338 - DNA, 23 bp, Homo sapiens
tcggtgggcgtggaggccgaggc

SEQ ID NO: 7249339 - DNA, 22 bp, Homo sapiens
tcgggctcctgcacttggagac

SEQ ID NO: 7249340 - DNA, 22 bp, Homo sapiens
tcgggctcgctctcctagcgga

SEQ ID NO: 7249341 - DNA, 22 bp, Homo sapiens
tcgggccataggctaggtccct

SEQ ID NO: 7249342 - DNA, 22 bp, Homo sapiens
tcgcggggaagtggtgggctaa

SEQ ID NO: 7249343 - DNA, 22 bp, Homo sapiens
ccaccaggacagccctgagggg

SEQ ID NO: 7249344 - DNA, 22 bp, Homo sapiens
ccaccagaagctgggagaagct

SEQ ID NO: 7249345 - DNA, 22 bp, Homo sapiens
ccaccagagcttcgtggcttaa

SEQ ID NO: 7249346 - DNA, 22 bp, Homo sapiens
ccaccagaccaccaagagcaac

SEQ ID NO: 7249347 - DNA, 22 bp, Homo sapiens
tcctctgaattcgctctgtgat

SEQ ID NO: 7249348 - DNA, 18 bp, Homo sapiens
tcctctctttccccaggg

SEQ ID NO: 7249349 - DNA, 21 bp, Homo sapiens
tcctctccatgatctgtttgt

SEQ ID NO: 7249350 - DNA, 22 bp, Homo sapiens
tcctctccatgtctcacgccac

SEQ ID NO: 7249351 - DNA, 22 bp, Homo sapiens
ccacatttactgatgtatgtat

SEQ ID NO: 7249352 - DNA, 22 bp, Homo sapiens
ccacattgactgtctgtagatt

SEQ ID NO: 7249353 - DNA, 22 bp, Homo sapiens
ccacatggagcaggaggtgggg

SEQ ID NO: 7249354 - DNA, 22 bp, Homo sapiens
ccacatggatagatagggacat

SEQ ID NO: 7249355 - DNA, 23 bp, Homo sapiens
ccacatggcaagatgatgcattc

SEQ ID NO: 7249356 - DNA, 19 bp, Homo sapiens
ccacatggctggatgacag

SEQ ID NO: 7249357 - DNA, 22 bp, Homo sapiens
ccacatctgcagtcccttctgt

SEQ ID NO: 7249358 - DNA, 22 bp, Homo sapiens
ccacatctcggtcccctctttg

SEQ ID NO: 7249359 - DNA, 22 bp, Homo sapiens
ccacagtgatccctgcctgcga

SEQ ID NO: 7249360 - DNA, 22 bp, Homo sapiens
tctcctggctcaccaggctgga

SEQ ID NO: 7249361 - DNA, 22 bp, Homo sapiens
tctcctggcctttaggttaagg

SEQ ID NO: 7249362 - DNA, 22 bp, Homo sapiens
tctcctggccgggctgtcccct

SEQ ID NO: 7249363 - DNA, 23 bp, Homo sapiens
tctcctggctgcactgtggccac

SEQ ID NO: 7249364 - DNA, 22 bp, Homo sapiens
tctcctggctctaaaaggctgt

SEQ ID NO: 7249365 - DNA, 17 bp, Homo sapiens
tctcctggctctatcag

SEQ ID NO: 7249366 - DNA, 22 bp, Homo sapiens
tctctgatgacctatgatgttg

SEQ ID NO: 7249367 - DNA, 23 bp, Homo sapiens
tctctgagttgtactttcccttg

SEQ ID NO: 7249368 - DNA, 21 bp, Homo sapiens
tctctgggaggacttgtgaga

SEQ ID NO: 7249369 - DNA, 22 bp, Homo sapiens
tctctgggacactgggtcagtt

SEQ ID NO: 7249370 - DNA, 22 bp, Homo sapiens
tctctgggaatgggcctgggta

SEQ ID NO: 7249371 - DNA, 22 bp, Homo sapiens
tctctgcccaagtttctcaagt

SEQ ID NO: 7249372 - DNA, 22 bp, Homo sapiens
ccagcagcgatagggtgagtgc

SEQ ID NO: 7249373 - DNA, 22 bp, Homo sapiens
ccagcagccctcttccaagact

SEQ ID NO: 7249374 - DNA, 22 bp, Homo sapiens
ccagcagcccacaggcgtccct

SEQ ID NO: 7249375 - DNA, 22 bp, Homo sapiens
ccagcagcaggccaggccctcc

SEQ ID NO: 7249376 - DNA, 22 bp, Homo sapiens
ccagcagctgctatgtggtttt

SEQ ID NO: 7249377 - DNA, 22 bp, Homo sapiens
ccagcagctgcaaagcctgggt

SEQ ID NO: 7249378 - DNA, 22 bp, Homo sapiens
ccagcagctccctcagggtccg

SEQ ID NO: 7249379 - DNA, 22 bp, Homo sapiens
ccagcagctcagctactggtca

SEQ ID NO: 7249380 - DNA, 22 bp, Homo sapiens
ccagcagctttattggctctcc

SEQ ID NO: 7249381 - DNA, 22 bp, Homo sapiens
ccagcagggcagtgccctggac

SEQ ID NO: 7249382 - DNA, 22 bp, Homo sapiens
ccagcagggaaaaacccaccaa

SEQ ID NO: 7249383 - DNA, 22 bp, Homo sapiens
tctgagagctctggggcccctt

SEQ ID NO: 7249384 - DNA, 22 bp, Homo sapiens
ccagcccttagataaacctggc

SEQ ID NO: 7249385 - DNA, 22 bp, Homo sapiens
ccagccctgtttatgtgtcact

SEQ ID NO: 7249386 - DNA, 19 bp, Homo sapiens
ccagccctgtcacttcttg

SEQ ID NO: 7249387 - DNA, 22 bp, Homo sapiens
ccagccctgtaaggatgaggca

SEQ ID NO: 7249388 - DNA, 22 bp, Homo sapiens
tctctgttcatggcactatgtc

SEQ ID NO: 7249389 - DNA, 19 bp, Homo sapiens
ccagcaggttcatttcagg

SEQ ID NO: 7249390 - DNA, 22 bp, Homo sapiens
ccagcaggtgtagggctcatgg

SEQ ID NO: 7249391 - DNA, 19 bp, Homo sapiens
tctgaagtccagggcatac

SEQ ID NO: 7249392 - DNA, 20 bp, Homo sapiens
cagtttacaacataaattgt

SEQ ID NO: 7249393 - DNA, 22 bp, Homo sapiens
cagtttaagtagaactgagaat

SEQ ID NO: 7249394 - DNA, 19 bp, Homo sapiens
cataaatgtacaagataca

SEQ ID NO: 7249395 - DNA, 22 bp, Homo sapiens
cataaagttaagctgtaagtat

SEQ ID NO: 7249396 - DNA, 22 bp, Homo sapiens
cataaagtgtataagtgaagaa

SEQ ID NO: 7249397 - DNA, 22 bp, Homo sapiens
cataaagttttataggctcaaa

SEQ ID NO: 7249398 - DNA, 22 bp, Homo sapiens
cataaagtaaagatgtcttcca

SEQ ID NO: 7249399 - DNA, 22 bp, Homo sapiens
cataaagtaaagatgtcttcca

SEQ ID NO: 7249400 - DNA, 22 bp, Homo sapiens
cataaagtagcagagcatgact

SEQ ID NO: 7249401 - DNA, 22 bp, Homo sapiens
cataaagtaacatggaccttaa

SEQ ID NO: 7249402 - DNA, 22 bp, Homo sapiens
cataaagtgctgggtttaggaa

SEQ ID NO: 7249403 - DNA, 22 bp, Homo sapiens
cataaagtctcataattcactt

SEQ ID NO: 7249404 - DNA, 22 bp, Homo sapiens
cataaagtcatgatctgagtat

SEQ ID NO: 7249405 - DNA, 22 bp, Homo sapiens
cataaagtatagatctgtgggt

SEQ ID NO: 7249406 - DNA, 22 bp, Homo sapiens
cataaagtaggcaagcattcca

SEQ ID NO: 7249407 - DNA, 22 bp, Homo sapiens
cataaactctctgtaccaatat

SEQ ID NO: 7249408 - DNA, 22 bp, Homo sapiens
cagttaaattctccagttacca

SEQ ID NO: 7249409 - DNA, 19 bp, Homo sapiens
cagtttaactaattttatc

SEQ ID NO: 7249410 - DNA, 22 bp, Homo sapiens
tcagcagcagctcagcatgttt

SEQ ID NO: 7249411 - DNA, 19 bp, Homo sapiens
tcagcagcactgtgatttc

SEQ ID NO: 7249412 - DNA, 22 bp, Homo sapiens
cagtgccaggagacaagatcag

SEQ ID NO: 7249413 - DNA, 22 bp, Homo sapiens
cagtgcccaagatgtgccatgc

SEQ ID NO: 7249414 - DNA, 21 bp, Homo sapiens
cagtgggctgctgcgctccag

SEQ ID NO: 7249415 - DNA, 23 bp, Homo sapiens
cagtgggcttctaactgctcctg

SEQ ID NO: 7249416 - DNA, 22 bp, Homo sapiens
cagtgggggggccatgctgcag

SEQ ID NO: 7249417 - DNA, 22 bp, Homo sapiens
cagttaaaaggtatgctaccaa

SEQ ID NO: 7249418 - DNA, 22 bp, Homo sapiens
cagtgtttctgtgcccagtggg

SEQ ID NO: 7249419 - DNA, 22 bp, Homo sapiens
cagtgtctgggacagaaagtca

SEQ ID NO: 7249420 - DNA, 22 bp, Homo sapiens
cagtgtctttcagactcagaaa

SEQ ID NO: 7249421 - DNA, 23 bp, Homo sapiens
cagtgtgacgaggtgaggcaggc

SEQ ID NO: 7249422 - DNA, 22 bp, Homo sapiens
tcagagaaataattgctgagtt

SEQ ID NO: 7249423 - DNA, 22 bp, Homo sapiens
tcagactgaccgaagcatctgg

SEQ ID NO: 7249424 - DNA, 22 bp, Homo sapiens
tcagactgtttgcaccataggc

SEQ ID NO: 7249425 - DNA, 22 bp, Homo sapiens
tcagactgtgtcataagtaggt

SEQ ID NO: 7249426 - DNA, 22 bp, Homo sapiens
tcaatgatagacaagatctaag

SEQ ID NO: 7249427 - DNA, 22 bp, Homo sapiens
tcacaacgcctctgcaaatcct

SEQ ID NO: 7249428 - DNA, 22 bp, Homo sapiens
cagtgagaattcagtaggtact

SEQ ID NO: 7249429 - DNA, 22 bp, Homo sapiens
cagtgagagtatttgtgctaag

SEQ ID NO: 7249430 - DNA, 22 bp, Homo sapiens
cagtgagaccttctaaggtggt

SEQ ID NO: 7249431 - DNA, 22 bp, Homo sapiens
cagtgaagtttaaagtgtagat

SEQ ID NO: 7249432 - DNA, 22 bp, Homo sapiens
cagtgaggaagctgtctggacc

SEQ ID NO: 7249433 - DNA, 22 bp, Homo sapiens
cagtgagataccacagagcaaa

SEQ ID NO: 7249434 - DNA, 22 bp, Homo sapiens
tcacagactcaagggcatagga

SEQ ID NO: 7249435 - DNA, 22 bp, Homo sapiens
tcacagacgcctcccctcgcct

SEQ ID NO: 7249436 - DNA, 22 bp, Homo sapiens
tcacagacgcatcctcaggtag

SEQ ID NO: 7249437 - DNA, 22 bp, Homo sapiens
tcacagacctggtgggaggtgg

SEQ ID NO: 7249438 - DNA, 22 bp, Homo sapiens
cagtgccaagccacagatcact

SEQ ID NO: 7249439 - DNA, 22 bp, Homo sapiens
tcacaggaccctgagggtggcg

SEQ ID NO: 7249440 - DNA, 21 bp, Homo sapiens
tcacagactggtcagtgaggc

SEQ ID NO: 7249441 - DNA, 22 bp, Homo sapiens
tcacagactggtcagtcaactt

SEQ ID NO: 7249442 - DNA, 22 bp, Homo sapiens
tcacagactcttgattgtctaa

SEQ ID NO: 7249443 - DNA, 22 bp, Homo sapiens
tcacagactgtgttgctactca

SEQ ID NO: 7249444 - DNA, 22 bp, Homo sapiens
tcacagacttgtctccagggat

SEQ ID NO: 7249445 - DNA, 18 bp, Homo sapiens
tcacagacttactgggcc

SEQ ID NO: 7249446 - DNA, 22 bp, Homo sapiens
cagtaggaaggatgcagaaaaa

SEQ ID NO: 7249447 - DNA, 22 bp, Homo sapiens
tatttctttcaggtatgtgttg

SEQ ID NO: 7249448 - DNA, 20 bp, Homo sapiens
cagtccactggagttcctac

SEQ ID NO: 7249449 - DNA, 22 bp, Homo sapiens
cagggtggggaaatagcgccct

SEQ ID NO: 7249450 - DNA, 22 bp, Homo sapiens
cagggtggccctgtggtctcat

SEQ ID NO: 7249451 - DNA, 22 bp, Homo sapiens
cagggtggccctgtggtctcat

SEQ ID NO: 7249452 - DNA, 22 bp, Homo sapiens
cagggtgggcacccagcctcca

SEQ ID NO: 7249453 - DNA, 22 bp, Homo sapiens
tatttataacagtgagaacggg

SEQ ID NO: 7249454 - DNA, 22 bp, Homo sapiens
tatttcagtcacttcttctctg

SEQ ID NO: 7249455 - DNA, 22 bp, Homo sapiens
caggttctgggtcctgggtcct

SEQ ID NO: 7249456 - DNA, 22 bp, Homo sapiens
caggttgggctgcgaggaggag

SEQ ID NO: 7249457 - DNA, 22 bp, Homo sapiens
caggggacattaaagctccata

SEQ ID NO: 7249458 - DNA, 22 bp, Homo sapiens
caggggacattaaagctccata

SEQ ID NO: 7249459 - DNA, 22 bp, Homo sapiens
caggggaaggagccttgaaact

SEQ ID NO: 7249460 - DNA, 22 bp, Homo sapiens
caggggaagatgccaagggaga

SEQ ID NO: 7249461 - DNA, 18 bp, Homo sapiens
cagggctgtggggtcact

SEQ ID NO: 7249462 - DNA, 22 bp, Homo sapiens
cagggctgtggctttgtgctgt

SEQ ID NO: 7249463 - DNA, 22 bp, Homo sapiens
tagggtggagactggaagcagg

SEQ ID NO: 7249464 - DNA, 22 bp, Homo sapiens
tagggtggagactggaagcagg

SEQ ID NO: 7249465 - DNA, 22 bp, Homo sapiens
tagggtggttagaaggagtatg

SEQ ID NO: 7249466 - DNA, 22 bp, Homo sapiens
tagggcaggtgaagaaaagcta

SEQ ID NO: 7249467 - DNA, 21 bp, Homo sapiens
tagggcaggcattggaagaga

SEQ ID NO: 7249468 - DNA, 22 bp, Homo sapiens
tagggcagttataacattagtg

SEQ ID NO: 7249469 - DNA, 22 bp, Homo sapiens
tagggctccactcccagagatt

SEQ ID NO: 7249470 - DNA, 23 bp, Homo sapiens
tatcagtgtgatgaggctgctgc

SEQ ID NO: 7249471 - DNA, 22 bp, Homo sapiens
tatcagtggtcacaagatacat

SEQ ID NO: 7249472 - DNA, 22 bp, Homo sapiens
tatcagtgtggtttctggactg

SEQ ID NO: 7249473 - DNA, 22 bp, Homo sapiens
tatcataagttaattaaacagt

SEQ ID NO: 7249474 - DNA, 22 bp, Homo sapiens
cagggtggccaggtagataata

SEQ ID NO: 7249475 - DNA, 22 bp, Homo sapiens
cagggtggcaggcaccatggcc

SEQ ID NO: 7249476 - DNA, 22 bp, Homo sapiens
cagggtggcactcagcgcatct

SEQ ID NO: 7249477 - DNA, 22 bp, Homo sapiens
tatcaggagttgacagttgcta

SEQ ID NO: 7249478 - DNA, 22 bp, Homo sapiens
caggggagttttatgcaacaga

SEQ ID NO: 7249479 - DNA, 22 bp, Homo sapiens
tagctcaaaggttaagtgtgga

SEQ ID NO: 7249480 - DNA, 22 bp, Homo sapiens
cagggctcaggctctgggattc

SEQ ID NO: 7249481 - DNA, 22 bp, Homo sapiens
cagggctcagaagacagacctc

SEQ ID NO: 7249482 - DNA, 22 bp, Homo sapiens
cagggctcactcggctggcgtc

SEQ ID NO: 7249483 - DNA, 22 bp, Homo sapiens
cagggctcactcggctggcgtc

SEQ ID NO: 7249484 - DNA, 22 bp, Homo sapiens
cagggcggggtctgccggccct

SEQ ID NO: 7249485 - DNA, 20 bp, Homo sapiens
taggagcaatgagagtagaa

SEQ ID NO: 7249486 - DNA, 22 bp, Homo sapiens
cagggcctcattgtcagtcctg

SEQ ID NO: 7249487 - DNA, 22 bp, Homo sapiens
cagggcctggagctgggcctgc

SEQ ID NO: 7249488 - DNA, 20 bp, Homo sapiens
cagccctgtgacctggccct

SEQ ID NO: 7249489 - DNA, 22 bp, Homo sapiens
gtgaggggagtaaagccatgtt

SEQ ID NO: 7249490 - DNA, 22 bp, Homo sapiens
gtgaggggagtaaagccatgtt

SEQ ID NO: 7249491 - DNA, 22 bp, Homo sapiens
gtgaggggtctggacgcacagt

SEQ ID NO: 7249492 - DNA, 22 bp, Homo sapiens
gtgaggggtctggacgcacagt

SEQ ID NO: 7249493 - DNA, 22 bp, Homo sapiens
gtgaggggccaagagtagggca

SEQ ID NO: 7249494 - DNA, 22 bp, Homo sapiens
gtgaggggccaagagtagggca

SEQ ID NO: 7249495 - DNA, 22 bp, Homo sapiens
gtgaggggtggctgagcagttt

SEQ ID NO: 7249496 - DNA, 22 bp, Homo sapiens
gtgaggtaaactgtagttcaga

SEQ ID NO: 7249497 - DNA, 22 bp, Homo sapiens
gtgaggggtggctgagcagttt

SEQ ID NO: 7249498 - DNA, 21 bp, Homo sapiens
tactgtagccttgcactgtag

SEQ ID NO: 7249499 - DNA, 21 bp, Homo sapiens
tactgtagccttgcactgtag

SEQ ID NO: 7249500 - DNA, 18 bp, Homo sapiens
tagaatataggtcattct

SEQ ID NO: 7249501 - DNA, 22 bp, Homo sapiens
tagaatatgattaattttctta

SEQ ID NO: 7249502 - DNA, 18 bp, Homo sapiens
tagaatataggtcattct

SEQ ID NO: 7249503 - DNA, 22 bp, Homo sapiens
tagaatatacactacagcttaa

SEQ ID NO: 7249504 - DNA, 22 bp, Homo sapiens
tagaatatacactacagcttaa

SEQ ID NO: 7249505 - DNA, 22 bp, Homo sapiens
tagaataatctgaggaaatgct

SEQ ID NO: 7249506 - DNA, 22 bp, Homo sapiens
caggctggagtgcagtggggcg

SEQ ID NO: 7249507 - DNA, 22 bp, Homo sapiens
caggctggagtgcagtggcgcc

SEQ ID NO: 7249508 - DNA, 22 bp, Homo sapiens
caggctggagtgcagtggcgct

SEQ ID NO: 7249509 - DNA, 22 bp, Homo sapiens
tactgtgcaaaaatgaatattg

SEQ ID NO: 7249510 - DNA, 22 bp, Homo sapiens
caggctggagtgcaatgacgcc

SEQ ID NO: 7249511 - DNA, 22 bp, Homo sapiens
caggctggagtgcaatggcaca

SEQ ID NO: 7249512 - DNA, 22 bp, Homo sapiens
caggctggagtgcaatggtgct

SEQ ID NO: 7249513 - DNA, 22 bp, Homo sapiens
tagaatatgtggtaggatctgg

SEQ ID NO: 7249514 - DNA, 22 bp, Homo sapiens
caggctgggcagcctccccggc

SEQ ID NO: 7249515 - DNA, 22 bp, Homo sapiens
caggctgggctccggagataaa

SEQ ID NO: 7249516 - DNA, 22 bp, Homo sapiens
tagaggagaacacaaattatag

SEQ ID NO: 7249517 - DNA, 19 bp, Homo sapiens
tagaggagaagggaagtgg

SEQ ID NO: 7249518 - DNA, 19 bp, Homo sapiens
tagaggagaagggaagtgg

SEQ ID NO: 7249519 - DNA, 22 bp, Homo sapiens
tagataaaagggcaaagggcat

SEQ ID NO: 7249520 - DNA, 22 bp, Homo sapiens
tagataaattagaaagtttact

SEQ ID NO: 7249521 - DNA, 22 bp, Homo sapiens
tagataaattagaaagtttact

SEQ ID NO: 7249522 - DNA, 22 bp, Homo sapiens
tagataaaagggcaaagggcat

SEQ ID NO: 7249523 - DNA, 22 bp, Homo sapiens
cagggcaagtttgagattattt

SEQ ID NO: 7249524 - DNA, 22 bp, Homo sapiens
tagataaattagaaagtttact

SEQ ID NO: 7249525 - DNA, 22 bp, Homo sapiens
tagataatttggcatcatattg

SEQ ID NO: 7249526 - DNA, 22 bp, Homo sapiens
tagataatttggcatcatattg

SEQ ID NO: 7249527 - DNA, 22 bp, Homo sapiens
tagatacacacacagtcatgtg

SEQ ID NO: 7249528 - DNA, 22 bp, Homo sapiens
tgggagcggcccgggccacacg

SEQ ID NO: 7249529 - DNA, 22 bp, Homo sapiens
tgggagcagttgtgaagctcag

SEQ ID NO: 7249530 - DNA, 21 bp, Homo sapiens
tgggagagcgttgctgtcctc

SEQ ID NO: 7249531 - DNA, 21 bp, Homo sapiens
tggctctgaaagagtgctgca

SEQ ID NO: 7249532 - DNA, 22 bp, Homo sapiens
tgggccacgtgacccttaccct

SEQ ID NO: 7249533 - DNA, 22 bp, Homo sapiens
tgggccagaggcatggagctat

SEQ ID NO: 7249534 - DNA, 22 bp, Homo sapiens
tgggccagaagtatgcatgttt

SEQ ID NO: 7249535 - DNA, 22 bp, Homo sapiens
tgggccacttgaaagtggatgt

SEQ ID NO: 7249536 - DNA, 22 bp, Homo sapiens
tgggccagaggcatggagctat

SEQ ID NO: 7249537 - DNA, 22 bp, Homo sapiens
cctcttctgagtgagactccct

SEQ ID NO: 7249538 - DNA, 22 bp, Homo sapiens
cctgcaccacaaggcttcagag

SEQ ID NO: 7249539 - DNA, 22 bp, Homo sapiens
cctgcacctaacacaacgctct

SEQ ID NO: 7249540 - DNA, 22 bp, Homo sapiens
cctgcaccaggcccagcatggt

SEQ ID NO: 7249541 - DNA, 22 bp, Homo sapiens
cctgccaggagctggtgctgca

SEQ ID NO: 7249542 - DNA, 22 bp, Homo sapiens
tgggggtgtcctggtgcacaca

SEQ ID NO: 7249543 - DNA, 22 bp, Homo sapiens
tgggggtggttcttgcctccag

SEQ ID NO: 7249544 - DNA, 22 bp, Homo sapiens
tgggggagagaggcattctttc

SEQ ID NO: 7249545 - DNA, 21 bp, Homo sapiens
tgggggagaattggttgcttt

SEQ ID NO: 7249546 - DNA, 22 bp, Homo sapiens
tgggggtgtcctggtgcacaca

SEQ ID NO: 7249547 - DNA, 22 bp, Homo sapiens
tggggtaggagtcagcgagaga

SEQ ID NO: 7249548 - DNA, 22 bp, Homo sapiens
tgggggtgtgccagggacctcc

SEQ ID NO: 7249549 - DNA, 22 bp, Homo sapiens
cctgagaaatagcatcattttt

SEQ ID NO: 7249550 - DNA, 22 bp, Homo sapiens
cctgagaataacaaattgctgc

SEQ ID NO: 7249551 - DNA, 22 bp, Homo sapiens
cctgaccctccttagagtccag

SEQ ID NO: 7249552 - DNA, 22 bp, Homo sapiens
cctgaggctggcccttccatcc

SEQ ID NO: 7249553 - DNA, 22 bp, Homo sapiens
cctgaggctccacctccagaga

SEQ ID NO: 7249554 - DNA, 22 bp, Homo sapiens
cctgaggctcgcgcgcccctgg

SEQ ID NO: 7249555 - DNA, 22 bp, Homo sapiens
cctgaggcttgggagttccgcc

SEQ ID NO: 7249556 - DNA, 22 bp, Homo sapiens
cctgaggcttaatctgtcccaa

SEQ ID NO: 7249557 - DNA, 22 bp, Homo sapiens
cctgaggcttaatctgtcccaa

SEQ ID NO: 7249558 - DNA, 22 bp, Homo sapiens
cctgaggggctgcaggccagct

SEQ ID NO: 7249559 - DNA, 18 bp, Homo sapiens
cctggaggtcttcggggt

SEQ ID NO: 7249560 - DNA, 18 bp, Homo sapiens
cctggaggtcttcggggt

SEQ ID NO: 7249561 - DNA, 16 bp, Homo sapiens
cctggaggtcacttca

SEQ ID NO: 7249562 - DNA, 22 bp, Homo sapiens
cctggaggggaccaggaccagg

SEQ ID NO: 7249563 - DNA, 22 bp, Homo sapiens
cctggagggcgccgcacagtcc

SEQ ID NO: 7249564 - DNA, 22 bp, Homo sapiens
cctggagggcgccgcacagtcc

SEQ ID NO: 7249565 - DNA, 22 bp, Homo sapiens
cctggagggcgccgcacagtcc

SEQ ID NO: 7249566 - DNA, 22 bp, Homo sapiens
cctggaggagcgctgaccagct

SEQ ID NO: 7249567 - DNA, 22 bp, Homo sapiens
cctggaggagcgctgaccagct

SEQ ID NO: 7249568 - DNA, 22 bp, Homo sapiens
cctggagcttttccatcctgga

SEQ ID NO: 7249569 - DNA, 18 bp, Homo sapiens
cctggagctccacagcaa

SEQ ID NO: 7249570 - DNA, 22 bp, Homo sapiens
cctggagcttggtcacgctgcg

SEQ ID NO: 7249571 - DNA, 22 bp, Homo sapiens
cctggagcttggtcacgctgcg

SEQ ID NO: 7249572 - DNA, 22 bp, Homo sapiens
cctggagggcagcccattctgg

SEQ ID NO: 7249573 - DNA, 22 bp, Homo sapiens
cctggagggaccctggccctgt

SEQ ID NO: 7249574 - DNA, 22 bp, Homo sapiens
cctggaggctctgggagggcag

SEQ ID NO: 7249575 - DNA, 22 bp, Homo sapiens
cctggaggctctgggagggcag

SEQ ID NO: 7249576 - DNA, 22 bp, Homo sapiens
cctggaggcagaaataggactt

SEQ ID NO: 7249577 - DNA, 22 bp, Homo sapiens
cctggaggagcgctgaccagct

SEQ ID NO: 7249578 - DNA, 22 bp, Homo sapiens
cctggaggcggaggttgcagtg

SEQ ID NO: 7249579 - DNA, 22 bp, Homo sapiens
cctggaggcggaggttgcagtg

SEQ ID NO: 7249580 - DNA, 22 bp, Homo sapiens
cctggaggctctgggagggcag

SEQ ID NO: 7249581 - DNA, 21 bp, Homo sapiens
tgtaagtttcatctgaattgg

SEQ ID NO: 7249582 - DNA, 22 bp, Homo sapiens
tgtacatacatagatatacaca

SEQ ID NO: 7249583 - DNA, 22 bp, Homo sapiens
tgtacattttctcagagtttat

SEQ ID NO: 7249584 - DNA, 22 bp, Homo sapiens
cctggagctcactgggagccgg

SEQ ID NO: 7249585 - DNA, 22 bp, Homo sapiens
tgtacatagaaaggatacagct

SEQ ID NO: 7249586 - DNA, 22 bp, Homo sapiens
tggtctggaactcctggcttca

SEQ ID NO: 7249587 - DNA, 22 bp, Homo sapiens
cctgctggacgtggaggagggg

SEQ ID NO: 7249588 - DNA, 22 bp, Homo sapiens
cctgctggccagtggagggctg

SEQ ID NO: 7249589 - DNA, 22 bp, Homo sapiens
cctgctggtgtccaggctttgg

SEQ ID NO: 7249590 - DNA, 22 bp, Homo sapiens
tgggtaggtgctggggattcag

SEQ ID NO: 7249591 - DNA, 22 bp, Homo sapiens
tgggtcagagcagacctctgga

SEQ ID NO: 7249592 - DNA, 22 bp, Homo sapiens
tgggtcagacagccagtgggcc

SEQ ID NO: 7249593 - DNA, 22 bp, Homo sapiens
tgggtcagaggacctcgtggcc

SEQ ID NO: 7249594 - DNA, 22 bp, Homo sapiens
cctgcctgtctttatcccctgt

SEQ ID NO: 7249595 - DNA, 22 bp, Homo sapiens
tgcctgcctctggcagccctgc

SEQ ID NO: 7249596 - DNA, 22 bp, Homo sapiens
tgcctgcctctggagcccatcc

SEQ ID NO: 7249597 - DNA, 22 bp, Homo sapiens
tgcctgcctgcatagtcccacg

SEQ ID NO: 7249598 - DNA, 22 bp, Homo sapiens
tgcctgccctttccacacagcc

SEQ ID NO: 7249599 - DNA, 22 bp, Homo sapiens
tgcctcagtttcatctgcagaa

SEQ ID NO: 7249600 - DNA, 22 bp, Homo sapiens
tggaagaatttggggataaatt

SEQ ID NO: 7249601 - DNA, 22 bp, Homo sapiens
tggaagggaaagtttggggtcc

SEQ ID NO: 7249602 - DNA, 22 bp, Homo sapiens
tggaagggaaagtttggggtcc

SEQ ID NO: 7249603 - DNA, 22 bp, Homo sapiens
tggaagggaacaggtgggtgtt

SEQ ID NO: 7249604 - DNA, 20 bp, Homo sapiens
ccctaggaacgcagcaggag

SEQ ID NO: 7249605 - DNA, 22 bp, Homo sapiens
tggaagaaggcagagaggcatt

SEQ ID NO: 7249606 - DNA, 22 bp, Homo sapiens
tggaagaaggcagagaggcatt

SEQ ID NO: 7249607 - DNA, 22 bp, Homo sapiens
tggaagaataggatagaagaac

SEQ ID NO: 7249608 - DNA, 22 bp, Homo sapiens
tggaagaataggatagaagaac

SEQ ID NO: 7249609 - DNA, 22 bp, Homo sapiens
cccgggaggtggaggttgcagt

SEQ ID NO: 7249610 - DNA, 22 bp, Homo sapiens
cccgggaggcggaggttgcagt

SEQ ID NO: 7249611 - DNA, 22 bp, Homo sapiens
cccgggaggcagaggttgcagt

SEQ ID NO: 7249612 - DNA, 22 bp, Homo sapiens
tggacaggtttgggtgcctgtt

SEQ ID NO: 7249613 - DNA, 22 bp, Homo sapiens
tggacaggtttgggtgcctgtt

SEQ ID NO: 7249614 - DNA, 22 bp, Homo sapiens
ccctgcctctgaagctgctcag

SEQ ID NO: 7249615 - DNA, 22 bp, Homo sapiens
ccctgcctgtgggcatcaacat

SEQ ID NO: 7249616 - DNA, 22 bp, Homo sapiens
tggacaggtgcacacagcagcc

SEQ ID NO: 7249617 - DNA, 21 bp, Homo sapiens
tggaagggaagtcttggttgt

SEQ ID NO: 7249618 - DNA, 22 bp, Homo sapiens
tggaagggaacaggtgggtgtt

SEQ ID NO: 7249619 - DNA, 22 bp, Homo sapiens
ccctgccttggggtccacaccg

SEQ ID NO: 7249620 - DNA, 22 bp, Homo sapiens
tggaggccagaggtactgggac

SEQ ID NO: 7249621 - DNA, 22 bp, Homo sapiens
tggaggccagaggtactgggac

SEQ ID NO: 7249622 - DNA, 22 bp, Homo sapiens
ccctgctcttctgactcaagct

SEQ ID NO: 7249623 - DNA, 22 bp, Homo sapiens
tggaggtgagtgtggtacagca

SEQ ID NO: 7249624 - DNA, 23 bp, Homo sapiens
ccctggagctagtctgagcagag

SEQ ID NO: 7249625 - DNA, 23 bp, Homo sapiens
ccctggagctagtctgagcagag

SEQ ID NO: 7249626 - DNA, 22 bp, Homo sapiens
ccctggagctagtctgagcaga

SEQ ID NO: 7249627 - DNA, 22 bp, Homo sapiens
ccctggagctagtctgagcaga

SEQ ID NO: 7249628 - DNA, 22 bp, Homo sapiens
tggaggtacataatgagagggt

SEQ ID NO: 7249629 - DNA, 19 bp, Homo sapiens
tggaggggtttgaatgtgg

SEQ ID NO: 7249630 - DNA, 19 bp, Homo sapiens
tggaggggtttgaatgtgg

SEQ ID NO: 7249631 - DNA, 22 bp, Homo sapiens
tggaggggcaatggagcgcgga

SEQ ID NO: 7249632 - DNA, 22 bp, Homo sapiens
tggaggggcaatggagcgcgga

SEQ ID NO: 7249633 - DNA, 22 bp, Homo sapiens
tggaggtactcaggcacagagt

SEQ ID NO: 7249634 - DNA, 22 bp, Homo sapiens
tggcctggggacctgtgagacc

SEQ ID NO: 7249635 - DNA, 22 bp, Homo sapiens
cctcagccttggccccaggcag

SEQ ID NO: 7249636 - DNA, 23 bp, Homo sapiens
cctcagcatggcaggagcccagc

SEQ ID NO: 7249637 - DNA, 22 bp, Homo sapiens
cctcagcatcctggtgaagtag

SEQ ID NO: 7249638 - DNA, 22 bp, Homo sapiens
cctcagcccctgaatggagaga

SEQ ID NO: 7249639 - DNA, 22 bp, Homo sapiens
tggccctgcttatgtctctctt

SEQ ID NO: 7249640 - DNA, 22 bp, Homo sapiens
tggctcagccagccctaggaac

SEQ ID NO: 7249641 - DNA, 22 bp, Homo sapiens
tggctcagccattcgtgttgcc

SEQ ID NO: 7249642 - DNA, 22 bp, Homo sapiens
tggctcagcctggccctttcat

SEQ ID NO: 7249643 - DNA, 22 bp, Homo sapiens
tggctcagcggtggcagcagac

SEQ ID NO: 7249644 - DNA, 22 bp, Homo sapiens
tggctcagcgcggcctggtctt

SEQ ID NO: 7249645 - DNA, 22 bp, Homo sapiens
cctccccatgacccggtgctgg

SEQ ID NO: 7249646 - DNA, 22 bp, Homo sapiens
ccggagaaactggcaaacccta

SEQ ID NO: 7249647 - DNA, 22 bp, Homo sapiens
ccgcggggtcatggctgggccg

SEQ ID NO: 7249648 - DNA, 22 bp, Homo sapiens
ccctttcattggcagagctctc

SEQ ID NO: 7249649 - DNA, 22 bp, Homo sapiens
ccgccgtgtcgacaggccctgg

SEQ ID NO: 7249650 - DNA, 22 bp, Homo sapiens
ccctgtggatttcagtttgtgt

SEQ ID NO: 7249651 - DNA, 22 bp, Homo sapiens
ccctgtggaggcagcatcctgc

SEQ ID NO: 7249652 - DNA, 22 bp, Homo sapiens
ccctggtggtacggcactggca

SEQ ID NO: 7249653 - DNA, 22 bp, Homo sapiens
ccctgtacagtctctgtggcac

SEQ ID NO: 7249654 - DNA, 22 bp, Homo sapiens
ccctgtcctgctaggccctggt

SEQ ID NO: 7249655 - DNA, 22 bp, Homo sapiens
ccctggtcagggaaggcgcctg

SEQ ID NO: 7249656 - DNA, 22 bp, Homo sapiens
ccctggaggaagaaacaatggc

SEQ ID NO: 7249657 - DNA, 22 bp, Homo sapiens
cctcacccagtcacctaggtgg

SEQ ID NO: 7249658 - DNA, 22 bp, Homo sapiens
cctcacccactacactcaaggg

SEQ ID NO: 7249659 - DNA, 22 bp, Homo sapiens
cctcacagggccaggcccctca

SEQ ID NO: 7249660 - DNA, 20 bp, Homo sapiens
cctcacagggcagagagggg

SEQ ID NO: 7249661 - DNA, 17 bp, Homo sapiens
cctcacagggaccagac

SEQ ID NO: 7249662 - DNA, 22 bp, Homo sapiens
cctcacagcttgggcaaacggc

SEQ ID NO: 7249663 - DNA, 22 bp, Homo sapiens
cctcacagcctcatgcccagcc

SEQ ID NO: 7249664 - DNA, 22 bp, Homo sapiens
cctcacagcccttggcccagga

SEQ ID NO: 7249665 - DNA, 22 bp, Homo sapiens
cctcacagaggggcagccatct

SEQ ID NO: 7249666 - DNA, 21 bp, Homo sapiens
cctcaaagatgatggggtttc

SEQ ID NO: 7249667 - DNA, 22 bp, Homo sapiens
cctcacagagcccagatgtcta

SEQ ID NO: 7249668 - DNA, 22 bp, Homo sapiens
cctatgtttaactttttgagga

SEQ ID NO: 7249669 - DNA, 22 bp, Homo sapiens
cctattcagtccttcaaggagg

SEQ ID NO: 7249670 - DNA, 22 bp, Homo sapiens
cctatgttcttggcaagcagca

SEQ ID NO: 7249671 - DNA, 22 bp, Homo sapiens
ccgggcgggggctctcgtcacc

SEQ ID NO: 7249672 - DNA, 22 bp, Homo sapiens
ccgggccgccccgcgtttctta

SEQ ID NO: 7249673 - DNA, 22 bp, Homo sapiens
ccgggccccacggtgacctcag

SEQ ID NO: 7249674 - DNA, 22 bp, Homo sapiens
ccgggtggggactccaggtttc

SEQ ID NO: 7249675 - DNA, 22 bp, Homo sapiens
ccggggacttaaagtgaaggaa

SEQ ID NO: 7249676 - DNA, 18 bp, Homo sapiens
ccgggctttggtgacaca

SEQ ID NO: 7249677 - DNA, 22 bp, Homo sapiens
ccgtctgcagcctccaggagtt

SEQ ID NO: 7249678 - DNA, 22 bp, Homo sapiens
ccgtcccctctgaccttgctga

SEQ ID NO: 7249679 - DNA, 22 bp, Homo sapiens
ccgtccccagccacctgctgat

SEQ ID NO: 7249680 - DNA, 22 bp, Homo sapiens
ccgtggagttgtgctgagtatg

SEQ ID NO: 7249681 - DNA, 22 bp, Homo sapiens
ccgtggagttgtgctgagtatg

SEQ ID NO: 7249682 - DNA, 22 bp, Homo sapiens
tgcagtggaagaggtggagatc

SEQ ID NO: 7249683 - DNA, 22 bp, Homo sapiens
cccagctcatcaggagccgccc

SEQ ID NO: 7249684 - DNA, 22 bp, Homo sapiens
tgcagtggaatctggagagcag

SEQ ID NO: 7249685 - DNA, 22 bp, Homo sapiens
tgcagtggaatctggagagcag

SEQ ID NO: 7249686 - DNA, 22 bp, Homo sapiens
tgcagtggaggccgtgagacag

SEQ ID NO: 7249687 - DNA, 22 bp, Homo sapiens
cccagcccacggtcctgggtgg

SEQ ID NO: 7249688 - DNA, 18 bp, Homo sapiens
cccagcccaccatttctc

SEQ ID NO: 7249689 - DNA, 22 bp, Homo sapiens
cccagcccagcgttcgaggggt

SEQ ID NO: 7249690 - DNA, 22 bp, Homo sapiens
cccagcccccgagtgtctggaa

SEQ ID NO: 7249691 - DNA, 22 bp, Homo sapiens
cccagcccccgagtgtctggaa

SEQ ID NO: 7249692 - DNA, 22 bp, Homo sapiens
cccagccaaggtgctggtgttg

SEQ ID NO: 7249693 - DNA, 21 bp, Homo sapiens
cccaggaggagctccggctcc

SEQ ID NO: 7249694 - DNA, 22 bp, Homo sapiens
cccaggaggcagaagttgcagt

SEQ ID NO: 7249695 - DNA, 22 bp, Homo sapiens
tgcatatctggggatagggatg

SEQ ID NO: 7249696 - DNA, 22 bp, Homo sapiens
tgcatatccacaccttatctct

SEQ ID NO: 7249697 - DNA, 22 bp, Homo sapiens
tgcatatcagaattcaagagtg

SEQ ID NO: 7249698 - DNA, 23 bp, Homo sapiens
tgcatatcagaaatttcatatgg

SEQ ID NO: 7249699 - DNA, 22 bp, Homo sapiens
tgcatatcactttgaatgggga

SEQ ID NO: 7249700 - DNA, 22 bp, Homo sapiens
tgcatatcttcaatgctgttgc

SEQ ID NO: 7249701 - DNA, 22 bp, Homo sapiens
tgccctgtcgctcactcccacc

SEQ ID NO: 7249702 - DNA, 23 bp, Homo sapiens
tgcctcagtggaatgtgagggtg

SEQ ID NO: 7249703 - DNA, 20 bp, Homo sapiens
cccaggagtgagcagcttta

SEQ ID NO: 7249704 - DNA, 22 bp, Homo sapiens
cccaggaggttggggctacagt

SEQ ID NO: 7249705 - DNA, 21 bp, Homo sapiens
cccaggaggctgagaagagca

SEQ ID NO: 7249706 - DNA, 22 bp, Homo sapiens
tgccctctgcaggccgccatgg

SEQ ID NO: 7249707 - DNA, 22 bp, Homo sapiens
tgcagaggtgaaagactagcaa

SEQ ID NO: 7249708 - DNA, 22 bp, Homo sapiens
tgcagaggtgaaagactagcaa

SEQ ID NO: 7249709 - DNA, 22 bp, Homo sapiens
tgcagaggtgttgctgagataa

SEQ ID NO: 7249710 - DNA, 22 bp, Homo sapiens
tgcagaggtttccaggcaagtt

SEQ ID NO: 7249711 - DNA, 22 bp, Homo sapiens
cccaccacgtgctttgctggag

SEQ ID NO: 7249712 - DNA, 23 bp, Homo sapiens
cccacatgtctgagtcagtgcca

SEQ ID NO: 7249713 - DNA, 22 bp, Homo sapiens
cccacccagctgagccgctcac

SEQ ID NO: 7249714 - DNA, 22 bp, Homo sapiens
cccacccagcctggctgagggg

SEQ ID NO: 7249715 - DNA, 22 bp, Homo sapiens
cccacccctggacaggtgagtg

SEQ ID NO: 7249716 - DNA, 22 bp, Homo sapiens
tgcagagatagaactactttct

SEQ ID NO: 7249717 - DNA, 22 bp, Homo sapiens
cccaagggtgcccagcagagga

SEQ ID NO: 7249718 - DNA, 22 bp, Homo sapiens
cccacaggcaggtgcatgggct

SEQ ID NO: 7249719 - DNA, 22 bp, Homo sapiens
cccacaggccctgctgccttga

SEQ ID NO: 7249720 - DNA, 22 bp, Homo sapiens
cccacaggctaggggtagggca

SEQ ID NO: 7249721 - DNA, 22 bp, Homo sapiens
cccacagggctgctgatggcag

SEQ ID NO: 7249722 - DNA, 18 bp, Homo sapiens
cccagcactttgggagcc

SEQ ID NO: 7249723 - DNA, 22 bp, Homo sapiens
cccagcactttgaatatgtcac

SEQ ID NO: 7249724 - DNA, 22 bp, Homo sapiens
cccagcactttgaatatgtcac

SEQ ID NO: 7249725 - DNA, 22 bp, Homo sapiens
tgcagaggtttttaatacattt

SEQ ID NO: 7249726 - DNA, 22 bp, Homo sapiens
tgcagaggtttgtggtgttgct

SEQ ID NO: 7249727 - DNA, 22 bp, Homo sapiens
tgcagaggtttccaggcaagtt

SEQ ID NO: 7249728 - DNA, 22 bp, Homo sapiens
cccagagaaccttctgtgccac

SEQ ID NO: 7249729 - DNA, 22 bp, Homo sapiens
cccagagaagtgaagtgacttg

SEQ ID NO: 7249730 - DNA, 22 bp, Homo sapiens
ccagtgtgtttaatgcattcca

SEQ ID NO: 7249731 - DNA, 22 bp, Homo sapiens
ccagtgtgtttttctctgactc

SEQ ID NO: 7249732 - DNA, 22 bp, Homo sapiens
ccagtgtgggcccggcctcctc

SEQ ID NO: 7249733 - DNA, 23 bp, Homo sapiens
ccagtgtggctctgtccgctctc

SEQ ID NO: 7249734 - DNA, 22 bp, Homo sapiens
ccatggagcgggtgagtgagtg

SEQ ID NO: 7249735 - DNA, 20 bp, Homo sapiens
ccatggccacatctgtgctg

SEQ ID NO: 7249736 - DNA, 22 bp, Homo sapiens
tgattacattggtaatgtttat

SEQ ID NO: 7249737 - DNA, 22 bp, Homo sapiens
tgattacagtctgacagatgtt

SEQ ID NO: 7249738 - DNA, 22 bp, Homo sapiens
tgattacagtatttgagatcca

SEQ ID NO: 7249739 - DNA, 21 bp, Homo sapiens
cccaacccatttccagttcat

SEQ ID NO: 7249740 - DNA, 22 bp, Homo sapiens
cccaaccccaacttcctatgtt

SEQ ID NO: 7249741 - DNA, 22 bp, Homo sapiens
cccaagagcttctaggacgctg

SEQ ID NO: 7249742 - DNA, 22 bp, Homo sapiens
tcttgttttgaactcatcagga

SEQ ID NO: 7249743 - DNA, 22 bp, Homo sapiens
ccagccggactccacttcccgt

SEQ ID NO: 7249744 - DNA, 22 bp, Homo sapiens
ccagcccttgagatggaaggga

SEQ ID NO: 7249745 - DNA, 22 bp, Homo sapiens
ccagcccttgagatggaaggga

SEQ ID NO: 7249746 - DNA, 22 bp, Homo sapiens
tctgcagacaggaagctgaggc

SEQ ID NO: 7249747 - DNA, 22 bp, Homo sapiens
tgaaagcagtgccatgattatg

SEQ ID NO: 7249748 - DNA, 22 bp, Homo sapiens
tgaaagcagtgatttctccttc

SEQ ID NO: 7249749 - DNA, 22 bp, Homo sapiens
tgaaagcattagtctaaggtag

SEQ ID NO: 7249750 - DNA, 22 bp, Homo sapiens
tgaaaggaaagtacagtgatgc

SEQ ID NO: 7249751 - DNA, 22 bp, Homo sapiens
tgaaaggaaagtacagtgatgc

SEQ ID NO: 7249752 - DNA, 22 bp, Homo sapiens
tgaaaggaagagggctactcct

SEQ ID NO: 7249753 - DNA, 22 bp, Homo sapiens
tgaacactgtccagagccatta

SEQ ID NO: 7249754 - DNA, 20 bp, Homo sapiens
tgaacactggggtgtttcag

SEQ ID NO: 7249755 - DNA, 22 bp, Homo sapiens
tgaacagctatcttgtcagtgt

SEQ ID NO: 7249756 - DNA, 22 bp, Homo sapiens
tgaagagatagaagtacatgct

SEQ ID NO: 7249757 - DNA, 22 bp, Homo sapiens
tgaagagtgtgactgcacctag

SEQ ID NO: 7249758 - DNA, 22 bp, Homo sapiens
tgaagagtgcttgagattttaa

SEQ ID NO: 7249759 - DNA, 20 bp, Homo sapiens
tgaagagtgcgcacattgcc

SEQ ID NO: 7249760 - DNA, 22 bp, Homo sapiens
tgaagagtgattcatgcagtca

SEQ ID NO: 7249761 - DNA, 22 bp, Homo sapiens
tgaagagtcatttcattcccag

SEQ ID NO: 7249762 - DNA, 22 bp, Homo sapiens
tgaagagtattaggttatttga

SEQ ID NO: 7249763 - DNA, 22 bp, Homo sapiens
tgaagagtttccagcctgcttg

SEQ ID NO: 7249764 - DNA, 22 bp, Homo sapiens
tgaagagttaattatgaggtgc

SEQ ID NO: 7249765 - DNA, 17 bp, Homo sapiens
tgaagatgcatggcagc

SEQ ID NO: 7249766 - DNA, 22 bp, Homo sapiens
tgaaggaagaataggcagtgtt

SEQ ID NO: 7249767 - DNA, 22 bp, Homo sapiens
tgaaggagaaatggaaagtggg

SEQ ID NO: 7249768 - DNA, 22 bp, Homo sapiens
ccaggctttcccagcctctcca

SEQ ID NO: 7249769 - DNA, 22 bp, Homo sapiens
tgacagagcatgtagtgacagc

SEQ ID NO: 7249770 - DNA, 22 bp, Homo sapiens
tgacagagcatgtagtgacagc

SEQ ID NO: 7249771 - DNA, 19 bp, Homo sapiens
tgacagagagcagggtggt

SEQ ID NO: 7249772 - DNA, 23 bp, Homo sapiens
tgacagagcacagtgggggagat

SEQ ID NO: 7249773 - DNA, 22 bp, Homo sapiens
tgactttagacttagtcaagtt

SEQ ID NO: 7249774 - DNA, 22 bp, Homo sapiens
tgagaaaacagtttgtaataat

SEQ ID NO: 7249775 - DNA, 18 bp, Homo sapiens
tgactttctttttcaacc

SEQ ID NO: 7249776 - DNA, 22 bp, Homo sapiens
tgagataactctgatttatgtt

SEQ ID NO: 7249777 - DNA, 22 bp, Homo sapiens
tgagagtgaaatgtcacatgtc

SEQ ID NO: 7249778 - DNA, 22 bp, Homo sapiens
ccagggtgtgagaaggaagtag

SEQ ID NO: 7249779 - DNA, 22 bp, Homo sapiens
ccagggtgggaggctgaaggcg

SEQ ID NO: 7249780 - DNA, 22 bp, Homo sapiens
ccagggtggggcaggcccactg

SEQ ID NO: 7249781 - DNA, 22 bp, Homo sapiens
ccagggttgcagggagccagca

SEQ ID NO: 7249782 - DNA, 22 bp, Homo sapiens
tgaggacattggtcaggacatg

SEQ ID NO: 7249783 - DNA, 22 bp, Homo sapiens
ccagtgtggccaggtcttctgg

SEQ ID NO: 7249784 - DNA, 22 bp, Homo sapiens
tgaggacattaggaagtgaagg

SEQ ID NO: 7249785 - DNA, 22 bp, Homo sapiens
tgaggacattgagactggagac

SEQ ID NO: 7249786 - DNA, 22 bp, Homo sapiens
tgaggaatttctttatgaatga

SEQ ID NO: 7249787 - DNA, 22 bp, Homo sapiens
tttgatgacttcagatctttgt

SEQ ID NO: 7249788 - DNA, 22 bp, Homo sapiens
tttgatgacctgtatctttttc

SEQ ID NO: 7249789 - DNA, 22 bp, Homo sapiens
tttgatgaacctatataatttg

SEQ ID NO: 7249790 - DNA, 21 bp, Homo sapiens
tttgatgattgattctctggc

SEQ ID NO: 7249791 - DNA, 22 bp, Homo sapiens
tttgatgatgggggtgcaggac

SEQ ID NO: 7249792 - DNA, 22 bp, Homo sapiens
tttgatgatgatgataaagttt

SEQ ID NO: 7249793 - DNA, 22 bp, Homo sapiens
tttgatgagtttaataacagcc

SEQ ID NO: 7249794 - DNA, 22 bp, Homo sapiens
tttgatttactataagcagcac

SEQ ID NO: 7249795 - DNA, 22 bp, Homo sapiens
tttgatgaaagctactatttac

SEQ ID NO: 7249796 - DNA, 22 bp, Homo sapiens
tttggttgtatcattctatgaa

SEQ ID NO: 7249797 - DNA, 22 bp, Homo sapiens
tttgtaaaagcccaagctgtag

SEQ ID NO: 7249798 - DNA, 22 bp, Homo sapiens
tttggaaaaagacagcttatga

SEQ ID NO: 7249799 - DNA, 22 bp, Homo sapiens
tttggaaactgatggtacattc

SEQ ID NO: 7249800 - DNA, 22 bp, Homo sapiens
tttggaaaggtttggccattat

SEQ ID NO: 7249801 - DNA, 23 bp, Homo sapiens
tttgaatgggtctatttttctta

SEQ ID NO: 7249802 - DNA, 22 bp, Homo sapiens
tttgaatgagggaaccacagtt

SEQ ID NO: 7249803 - DNA, 22 bp, Homo sapiens
tttgaatgtaaatgctgcagct

SEQ ID NO: 7249804 - DNA, 20 bp, Homo sapiens
tttgaatgtaaagcatgtca

SEQ ID NO: 7249805 - DNA, 20 bp, Homo sapiens
tttgaatgtaaagcatgtca

SEQ ID NO: 7249806 - DNA, 22 bp, Homo sapiens
tttgaatgttttaggtacttaa

SEQ ID NO: 7249807 - DNA, 22 bp, Homo sapiens
tttcttttgctgagaggggcac

SEQ ID NO: 7249808 - DNA, 22 bp, Homo sapiens
tttgaaaggaattaggatgaca

SEQ ID NO: 7249809 - DNA, 22 bp, Homo sapiens
tttgaatatacttcaaacaaag

SEQ ID NO: 7249810 - DNA, 22 bp, Homo sapiens
tttgaatgagaattattgtcat

SEQ ID NO: 7249811 - DNA, 22 bp, Homo sapiens
tttcttttgaatagtgtgtggt

SEQ ID NO: 7249812 - DNA, 22 bp, Homo sapiens
tttcttttccaatatccctact

SEQ ID NO: 7249813 - DNA, 19 bp, Homo sapiens
tttcttttcccctcagcac

SEQ ID NO: 7249814 - DNA, 22 bp, Homo sapiens
tttcttttccaatatccctact

SEQ ID NO: 7249815 - DNA, 22 bp, Homo sapiens
tttcttttgccctgtgggttag

SEQ ID NO: 7249816 - DNA, 22 bp, Homo sapiens
tttcttttgccctgtgggttag

SEQ ID NO: 7249817 - DNA, 22 bp, Homo sapiens
tttcttttacagtgtggctatt

SEQ ID NO: 7249818 - DNA, 22 bp, Homo sapiens
tttcttttacagtgtggctatt

SEQ ID NO: 7249819 - DNA, 21 bp, Homo sapiens
tttctttctggctctcacagt

SEQ ID NO: 7249820 - DNA, 17 bp, Homo sapiens
tttccctccttccactc

SEQ ID NO: 7249821 - DNA, 22 bp, Homo sapiens
tttcccttgttccttcctctga

SEQ ID NO: 7249822 - DNA, 22 bp, Homo sapiens
ttttattgcaataaagtgtgta

SEQ ID NO: 7249823 - DNA, 21 bp, Homo sapiens
ttttattgatgaatggccact

SEQ ID NO: 7249824 - DNA, 22 bp, Homo sapiens
ttttattggagtgataccaagc

SEQ ID NO: 7249825 - DNA, 22 bp, Homo sapiens
ttttattgcaataaagtgtgta

SEQ ID NO: 7249826 - DNA, 22 bp, Homo sapiens
ttttattggagtgataccaagc

SEQ ID NO: 7249827 - DNA, 22 bp, Homo sapiens
ttttccaaattagaagtagaga

SEQ ID NO: 7249828 - DNA, 22 bp, Homo sapiens
ttttcatttttgtagatgcaag

SEQ ID NO: 7249829 - DNA, 18 bp, Homo sapiens
ttttaatttcaggggtgg

SEQ ID NO: 7249830 - DNA, 22 bp, Homo sapiens
ttttatgattgagctggctaca

SEQ ID NO: 7249831 - DNA, 22 bp, Homo sapiens
ttttatgagtgtccctctgtgg

SEQ ID NO: 7249832 - DNA, 22 bp, Homo sapiens
ttttatgattgagctggctaca

SEQ ID NO: 7249833 - DNA, 22 bp, Homo sapiens
ttttaatgtgctctgcaatgat

SEQ ID NO: 7249834 - DNA, 22 bp, Homo sapiens
ttttaatgggcgactattatgg

SEQ ID NO: 7249835 - DNA, 22 bp, Homo sapiens
ttttaaagagatgctgtgcata

SEQ ID NO: 7249836 - DNA, 22 bp, Homo sapiens
tttgttcaaattttcctatctg

SEQ ID NO: 7249837 - DNA, 22 bp, Homo sapiens
tttgtgtgtgctcacatagatg

SEQ ID NO: 7249838 - DNA, 21 bp, Homo sapiens
tttgtgtgtcacgtgcacagg

SEQ ID NO: 7249839 - DNA, 22 bp, Homo sapiens
tttttcacacatgtggcttgat

SEQ ID NO: 7249840 - DNA, 22 bp, Homo sapiens
tttttagaattggctgagaatt

SEQ ID NO: 7249841 - DNA, 22 bp, Homo sapiens
tttaccaactgtagatctgcta

SEQ ID NO: 7249842 - DNA, 22 bp, Homo sapiens
tttaccaaggcatagtaatctc

SEQ ID NO: 7249843 - DNA, 17 bp, Homo sapiens
tttagaatacaatgttt

SEQ ID NO: 7249844 - DNA, 20 bp, Homo sapiens
tttacattttgaaacagtga

SEQ ID NO: 7249845 - DNA, 22 bp, Homo sapiens
tttacagtctgtctagcaatgt

SEQ ID NO: 7249846 - DNA, 20 bp, Homo sapiens
tttagcaaaagggactgctc

SEQ ID NO: 7249847 - DNA, 22 bp, Homo sapiens
tttagagagtgtaaaaatatat

SEQ ID NO: 7249848 - DNA, 22 bp, Homo sapiens
tttagagaggctctgtaaaatg

SEQ ID NO: 7249849 - DNA, 22 bp, Homo sapiens
tttagagaattagaacagtact

SEQ ID NO: 7249850 - DNA, 22 bp, Homo sapiens
tttagcaggcagggatgggtgt

SEQ ID NO: 7249851 - DNA, 22 bp, Homo sapiens
tttattcaagatgaggttcatg

SEQ ID NO: 7249852 - DNA, 22 bp, Homo sapiens
tttaagatggtattttataaag

SEQ ID NO: 7249853 - DNA, 19 bp, Homo sapiens
tttaaagtgactggtattt

SEQ ID NO: 7249854 - DNA, 22 bp, Homo sapiens
tttaaagtgctgctcctatcct

SEQ ID NO: 7249855 - DNA, 22 bp, Homo sapiens
tttaaataggactcctgggggt

SEQ ID NO: 7249856 - DNA, 22 bp, Homo sapiens
tttaaagtttttgcacattctg

SEQ ID NO: 7249857 - DNA, 22 bp, Homo sapiens
tttaaagtggtccatttcagaa

SEQ ID NO: 7249858 - DNA, 22 bp, Homo sapiens
ttgtgtgtactggttatgggca

SEQ ID NO: 7249859 - DNA, 22 bp, Homo sapiens
tttaaagagaatgtgaaggagt

SEQ ID NO: 7249860 - DNA, 22 bp, Homo sapiens
tttacagtctctatagtcaaaa

SEQ ID NO: 7249861 - DNA, 22 bp, Homo sapiens
tttaatggcaagaaggctgcag

SEQ ID NO: 7249862 - DNA, 22 bp, Homo sapiens
tttaagcacagggataaagtta

SEQ ID NO: 7249863 - DNA, 22 bp, Homo sapiens
tttaagattcagtaaggcaaac

SEQ ID NO: 7249864 - DNA, 22 bp, Homo sapiens
tttattcaagatgaggttcatg

SEQ ID NO: 7249865 - DNA, 20 bp, Homo sapiens
tttattcacagagaagagtt

SEQ ID NO: 7249866 - DNA, 22 bp, Homo sapiens
tttattctagctcagaatagtt

SEQ ID NO: 7249867 - DNA, 22 bp, Homo sapiens
tttattgaacacttgcactggc

SEQ ID NO: 7249868 - DNA, 22 bp, Homo sapiens
tttattcttgagagtgagaaga

SEQ ID NO: 7249869 - DNA, 22 bp, Homo sapiens
tttattctgtgctacatgaaga

SEQ ID NO: 7249870 - DNA, 22 bp, Homo sapiens
tttattctctagttggtcagat

SEQ ID NO: 7249871 - DNA, 22 bp, Homo sapiens
tttcaacaggatgataataggc

SEQ ID NO: 7249872 - DNA, 22 bp, Homo sapiens
tttcacagaaagaagctagttt

SEQ ID NO: 7249873 - DNA, 22 bp, Homo sapiens
tttcacagagaaatataacagg

SEQ ID NO: 7249874 - DNA, 22 bp, Homo sapiens
tttcacagaggaggaagctgag

SEQ ID NO: 7249875 - DNA, 22 bp, Homo sapiens
tttcacactagtcagaatacca

SEQ ID NO: 7249876 - DNA, 22 bp, Homo sapiens
tttcacagctgggtggcagagt

SEQ ID NO: 7249877 - DNA, 22 bp, Homo sapiens
tttcccatccatagccctgcaa

SEQ ID NO: 7249878 - DNA, 22 bp, Homo sapiens
tttcccatcttagcagattaaa

SEQ ID NO: 7249879 - DNA, 22 bp, Homo sapiens
tttcagagctcagcagctagag

SEQ ID NO: 7249880 - DNA, 22 bp, Homo sapiens
ttgtgtccatttgagtcatgtg

SEQ ID NO: 7249881 - DNA, 22 bp, Homo sapiens
ttgtgtccccctttgagagcca

SEQ ID NO: 7249882 - DNA, 22 bp, Homo sapiens
ttgtgtcctatatgcatgttct

SEQ ID NO: 7249883 - DNA, 22 bp, Homo sapiens
ttgtgtctgggggagtgacatc

SEQ ID NO: 7249884 - DNA, 22 bp, Homo sapiens
ttgggccctgctctgagttgct

SEQ ID NO: 7249885 - DNA, 22 bp, Homo sapiens
ttgggacagaaaaggagaagat

SEQ ID NO: 7249886 - DNA, 22 bp, Homo sapiens
ttgggacagctgtggtagtgag

SEQ ID NO: 7249887 - DNA, 22 bp, Homo sapiens
ttgggcccatggggctaagcta

SEQ ID NO: 7249888 - DNA, 22 bp, Homo sapiens
ttgggcagtgattagttcatga

SEQ ID NO: 7249889 - DNA, 22 bp, Homo sapiens
ttgggcagtagcctcttggtgt

SEQ ID NO: 7249890 - DNA, 22 bp, Homo sapiens
ttgggcagtctggctgcagagt

SEQ ID NO: 7249891 - DNA, 22 bp, Homo sapiens
ttgggcagggaaaggacaggca

SEQ ID NO: 7249892 - DNA, 22 bp, Homo sapiens
ttgggcaggtgtggctctcctt

SEQ ID NO: 7249893 - DNA, 22 bp, Homo sapiens
ttgggcaggtgaagagagggct

SEQ ID NO: 7249894 - DNA, 22 bp, Homo sapiens
ttggagatatcacaccttcaca

SEQ ID NO: 7249895 - DNA, 22 bp, Homo sapiens
ttggagatgtaaaattcagaga

SEQ ID NO: 7249896 - DNA, 22 bp, Homo sapiens
ttggagatatgtgaaaaaaaca

SEQ ID NO: 7249897 - DNA, 22 bp, Homo sapiens
ttggactctgggattctggatt

SEQ ID NO: 7249898 - DNA, 22 bp, Homo sapiens
ttggactcctctttcctcttgg

SEQ ID NO: 7249899 - DNA, 22 bp, Homo sapiens
ttggactcatgatcacttcggg

SEQ ID NO: 7249900 - DNA, 22 bp, Homo sapiens
ttggactcaaaaggagatttac

SEQ ID NO: 7249901 - DNA, 22 bp, Homo sapiens
ttggaggaggcattggaggatt

SEQ ID NO: 7249902 - DNA, 22 bp, Homo sapiens
ttggagctaccaggaagggctg

SEQ ID NO: 7249903 - DNA, 22 bp, Homo sapiens
ttggaggaagctcatgggggat

SEQ ID NO: 7249904 - DNA, 22 bp, Homo sapiens
ttggaggactagttaagagacc

SEQ ID NO: 7249905 - DNA, 22 bp, Homo sapiens
ttggaaagattattattatgaa

SEQ ID NO: 7249906 - DNA, 22 bp, Homo sapiens
ttggacactgagactagcaagc

SEQ ID NO: 7249907 - DNA, 21 bp, Homo sapiens
ttggaacaagcagcagtttgc

SEQ ID NO: 7249908 - DNA, 22 bp, Homo sapiens
ttggaaatggctgtagttatga

SEQ ID NO: 7249909 - DNA, 22 bp, Homo sapiens
ttggaaatgtagaaaagcagat

SEQ ID NO: 7249910 - DNA, 23 bp, Homo sapiens
ttggaaatggggagaacagattc

SEQ ID NO: 7249911 - DNA, 22 bp, Homo sapiens
ttggaaatgcaaatatattgaa

SEQ ID NO: 7249912 - DNA, 22 bp, Homo sapiens
ttggaaatgatttctattatta

SEQ ID NO: 7249913 - DNA, 22 bp, Homo sapiens
ttggaaatacagcagttacttt

SEQ ID NO: 7249914 - DNA, 22 bp, Homo sapiens
ttggaaatacgagtagtatcat

SEQ ID NO: 7249915 - DNA, 22 bp, Homo sapiens
ttgcatttaagtagatgttaca

SEQ ID NO: 7249916 - DNA, 22 bp, Homo sapiens
ttgcatttcactttcagtaggc

SEQ ID NO: 7249917 - DNA, 22 bp, Homo sapiens
ttgcatttcaattgctcaggaa

SEQ ID NO: 7249918 - DNA, 22 bp, Homo sapiens
ttgcatttatagactgccattt

SEQ ID NO: 7249919 - DNA, 22 bp, Homo sapiens
ttgcatttactgcaccgtgagt

SEQ ID NO: 7249920 - DNA, 22 bp, Homo sapiens
ttgctctgtcagggcctcagtc

SEQ ID NO: 7249921 - DNA, 22 bp, Homo sapiens
ttgctgaaaggtagctgtgtgg

SEQ ID NO: 7249922 - DNA, 22 bp, Homo sapiens
ttgctgaaaagctggcctttgt

SEQ ID NO: 7249923 - DNA, 22 bp, Homo sapiens
ttgctgaaaacagtgggtattg

SEQ ID NO: 7249924 - DNA, 22 bp, Homo sapiens
ttgctgaaaacaggtcatcagg

SEQ ID NO: 7249925 - DNA, 22 bp, Homo sapiens
ttgctgaaagtggcaagaagta

SEQ ID NO: 7249926 - DNA, 22 bp, Homo sapiens
ttgctgaaaggtagctgtgtgg

SEQ ID NO: 7249927 - DNA, 22 bp, Homo sapiens
ttgctgaagaaaaaatatgtta

SEQ ID NO: 7249928 - DNA, 22 bp, Homo sapiens
ttgctgaaccctgccctctaat

SEQ ID NO: 7249929 - DNA, 22 bp, Homo sapiens
ttgctgaaatctatgacatcct

SEQ ID NO: 7249930 - DNA, 22 bp, Homo sapiens
ttgctgaagtattgtgaatcct

SEQ ID NO: 7249931 - DNA, 22 bp, Homo sapiens
ttgctgaagtatgaaaaagaca

SEQ ID NO: 7249932 - DNA, 22 bp, Homo sapiens
ttgctgaaggcctcttggggtt

SEQ ID NO: 7249933 - DNA, 19 bp, Homo sapiens
ttgctgaaggaagcctctg

SEQ ID NO: 7249934 - DNA, 22 bp, Homo sapiens
ttgctgaagctgccaaaccagt

SEQ ID NO: 7249935 - DNA, 22 bp, Homo sapiens
ttgctgaatgcaagttggatag

SEQ ID NO: 7249936 - DNA, 22 bp, Homo sapiens
ttgctgaagttgctcagctcca

SEQ ID NO: 7249937 - DNA, 22 bp, Homo sapiens
ttgctgaagttaatgcttgcaa

SEQ ID NO: 7249938 - DNA, 22 bp, Homo sapiens
ttgctgaagtgaaggtatgttt

SEQ ID NO: 7249939 - DNA, 22 bp, Homo sapiens
ttgctgaattgaatcctttggt

SEQ ID NO: 7249940 - DNA, 22 bp, Homo sapiens
ttgcagcatgcatagacactgc

SEQ ID NO: 7249941 - DNA, 22 bp, Homo sapiens
ttgcagcatattgatctcctgt

SEQ ID NO: 7249942 - DNA, 22 bp, Homo sapiens
ttgacaaagtttagtaataatc

SEQ ID NO: 7249943 - DNA, 22 bp, Homo sapiens
ttgacaaaggctgagaggaaaa

SEQ ID NO: 7249944 - DNA, 22 bp, Homo sapiens
ttgacaaaggaccttgctattt

SEQ ID NO: 7249945 - DNA, 22 bp, Homo sapiens
ttgacaaaggaattgaatctct

SEQ ID NO: 7249946 - DNA, 22 bp, Homo sapiens
ttgacaaagatatattcatgct

SEQ ID NO: 7249947 - DNA, 22 bp, Homo sapiens
ttgacaaaacaacacagatttc

SEQ ID NO: 7249948 - DNA, 22 bp, Homo sapiens
ttgacaaaaataacacagcata

SEQ ID NO: 7249949 - DNA, 22 bp, Homo sapiens
ttgacaaaaacctcatttcacc

SEQ ID NO: 7249950 - DNA, 22 bp, Homo sapiens
ttgacaaatacccattagacca

SEQ ID NO: 7249951 - DNA, 22 bp, Homo sapiens
ttgacagaaatgtatttgcatg

SEQ ID NO: 7249952 - DNA, 22 bp, Homo sapiens
ttgcagaatacttattctgtat

SEQ ID NO: 7249953 - DNA, 22 bp, Homo sapiens
ttgcagaagggcacagtgatca

SEQ ID NO: 7249954 - DNA, 22 bp, Homo sapiens
ttgcagaagggcacagtgatca

SEQ ID NO: 7249955 - DNA, 23 bp, Homo sapiens
ttgcagaagcagacgaccataat

SEQ ID NO: 7249956 - DNA, 22 bp, Homo sapiens
ttgcagaattaagcagagagcc

SEQ ID NO: 7249957 - DNA, 22 bp, Homo sapiens
ttattggagctggaggctgttt

SEQ ID NO: 7249958 - DNA, 22 bp, Homo sapiens
ttattgtagcactttggcagtg

SEQ ID NO: 7249959 - DNA, 22 bp, Homo sapiens
ttattgtaggcctattgtagaa

SEQ ID NO: 7249960 - DNA, 22 bp, Homo sapiens
ttattgactgaaatgagagtga

SEQ ID NO: 7249961 - DNA, 22 bp, Homo sapiens
ttattgaaggaactgaaataaa

SEQ ID NO: 7249962 - DNA, 22 bp, Homo sapiens
ttcaaacattcaaataaaccgg

SEQ ID NO: 7249963 - DNA, 22 bp, Homo sapiens
ttattatagattatgcaagatt

SEQ ID NO: 7249964 - DNA, 22 bp, Homo sapiens
ttattctttaaacatatatgtt

SEQ ID NO: 7249965 - DNA, 19 bp, Homo sapiens
ttatatacttggtttctct

SEQ ID NO: 7249966 - DNA, 22 bp, Homo sapiens
ttaggaaagaagcagctaggag

SEQ ID NO: 7249967 - DNA, 22 bp, Homo sapiens
ttatagaacagcctcctctaga

SEQ ID NO: 7249968 - DNA, 22 bp, Homo sapiens
ttatagaaggagcattcactta

SEQ ID NO: 7249969 - DNA, 22 bp, Homo sapiens
ttatagaacggttctgtgcaaa

SEQ ID NO: 7249970 - DNA, 22 bp, Homo sapiens
ttatagaatggtggattttctg

SEQ ID NO: 7249971 - DNA, 22 bp, Homo sapiens
ttatagttatgaaagactgagg

SEQ ID NO: 7249972 - DNA, 22 bp, Homo sapiens
ttatataactcaggtgggctca

SEQ ID NO: 7249973 - DNA, 22 bp, Homo sapiens
ttatataactcaggtgggctca

SEQ ID NO: 7249974 - DNA, 22 bp, Homo sapiens
ttatatactgtggtagtactgt

SEQ ID NO: 7249975 - DNA, 22 bp, Homo sapiens
ttcagtgtgtgatacctgctgt

SEQ ID NO: 7249976 - DNA, 22 bp, Homo sapiens
ttcatttaatttgtgtattaac

SEQ ID NO: 7249977 - DNA, 22 bp, Homo sapiens
ttcattggtcctgctcctggac

SEQ ID NO: 7249978 - DNA, 22 bp, Homo sapiens
ttccagtgaccatagagtatgg

SEQ ID NO: 7249979 - DNA, 20 bp, Homo sapiens
ttcatttgggaaaatctgcg

SEQ ID NO: 7249980 - DNA, 22 bp, Homo sapiens
ttcatttgtctgctatagatcc

SEQ ID NO: 7249981 - DNA, 22 bp, Homo sapiens
ttcatttgtggttatttacaat

SEQ ID NO: 7249982 - DNA, 22 bp, Homo sapiens
ttcagactgctggtgcttccct

SEQ ID NO: 7249983 - DNA, 22 bp, Homo sapiens
ttcagagaagcaaaggcagatt

SEQ ID NO: 7249984 - DNA, 22 bp, Homo sapiens
ttcagagatggaaggcagaatg

SEQ ID NO: 7249985 - DNA, 22 bp, Homo sapiens
ttcacagcttaataaggctcag

SEQ ID NO: 7249986 - DNA, 19 bp, Homo sapiens
ttcacagctctgtgtcagt

SEQ ID NO: 7249987 - DNA, 22 bp, Homo sapiens
ttcacagctccttttactcaac

SEQ ID NO: 7249988 - DNA, 22 bp, Homo sapiens
ttcacagctcatactgttctca

SEQ ID NO: 7249989 - DNA, 22 bp, Homo sapiens
ttcacagctaagagctaagtaa

SEQ ID NO: 7249990 - DNA, 22 bp, Homo sapiens
ttcacagcctctgccccaggca

SEQ ID NO: 7249991 - DNA, 22 bp, Homo sapiens
ttctggttttactgaggaaatc

SEQ ID NO: 7249992 - DNA, 22 bp, Homo sapiens
ttctggagctctcgaccccact

SEQ ID NO: 7249993 - DNA, 22 bp, Homo sapiens
ttctggagctaaagtccactct

SEQ ID NO: 7249994 - DNA, 22 bp, Homo sapiens
ttctggagctaaagtccactct

SEQ ID NO: 7249995 - DNA, 22 bp, Homo sapiens
ttctggagccgggcctgggcag

SEQ ID NO: 7249996 - DNA, 22 bp, Homo sapiens
ttctggagccccaagatctgta

SEQ ID NO: 7249997 - DNA, 22 bp, Homo sapiens
ttctggagattgagaaggcatt

SEQ ID NO: 7249998 - DNA, 22 bp, Homo sapiens
ttctggagattgagaaggcatt

SEQ ID NO: 7249999 - DNA, 22 bp, Homo sapiens
ttctggagatgacttttagaaa

SEQ ID NO: 7250000 - DNA, 22 bp, Homo sapiens
ttctggagatctgcctatggga

SEQ ID NO: 7250001 - DNA, 22 bp, Homo sapiens
ttctggagatagtcaggcatta

SEQ ID NO: 7250002 - DNA, 22 bp, Homo sapiens
ttctggagaggaacagaaaggt

SEQ ID NO: 7250003 - DNA, 22 bp, Homo sapiens
ttctggaattcttgcagccact

SEQ ID NO: 7250004 - DNA, 22 bp, Homo sapiens
ttctggaatcctcaaaacatga

SEQ ID NO: 7250005 - DNA, 22 bp, Homo sapiens
ttctggaatatttgacacaatt

SEQ ID NO: 7250006 - DNA, 22 bp, Homo sapiens
ttctggaatgcctgttctaatt

SEQ ID NO: 7250007 - DNA, 22 bp, Homo sapiens
ttctggaattctggctatggta

SEQ ID NO: 7250008 - DNA, 22 bp, Homo sapiens
ttctggagagaagaccagtgtg

SEQ ID NO: 7250009 - DNA, 22 bp, Homo sapiens
ttctggagagaaaccttacaaa

SEQ ID NO: 7250010 - DNA, 22 bp, Homo sapiens
ttctggagacccagcaacaggg

SEQ ID NO: 7250011 - DNA, 23 bp, Homo sapiens
ttctggagaaaggaccatagctt

SEQ ID NO: 7250012 - DNA, 22 bp, Homo sapiens
ttctggagaaaattctgtcatt

SEQ ID NO: 7250013 - DNA, 23 bp, Homo sapiens
ttctggagaaaggaccatagctt

SEQ ID NO: 7250014 - DNA, 22 bp, Homo sapiens
ttctggagaatcaccaccaggc

SEQ ID NO: 7250015 - DNA, 22 bp, Homo sapiens
ttctggagaataatcagcattg

SEQ ID NO: 7250016 - DNA, 22 bp, Homo sapiens
ttctggaagtgttagaatctgg

SEQ ID NO: 7250017 - DNA, 22 bp, Homo sapiens
ttctggaagggtggagtagctt

SEQ ID NO: 7250018 - DNA, 22 bp, Homo sapiens
ttctggaagtggaatttttgta

SEQ ID NO: 7250019 - DNA, 22 bp, Homo sapiens
ttctggaagttggaaatagcag

SEQ ID NO: 7250020 - DNA, 22 bp, Homo sapiens
ttctggaagttttctcctgtgg

SEQ ID NO: 7250021 - DNA, 22 bp, Homo sapiens
ttctggaatactaagttccttt

SEQ ID NO: 7250022 - DNA, 22 bp, Homo sapiens
ttctggaaatgcacaactaatt

SEQ ID NO: 7250023 - DNA, 22 bp, Homo sapiens
ttctggaaatgaatgctaggaa

SEQ ID NO: 7250024 - DNA, 22 bp, Homo sapiens
ttctggaaatcagcagagggtg

SEQ ID NO: 7250025 - DNA, 22 bp, Homo sapiens
ttctggaaatgggtatagagca

SEQ ID NO: 7250026 - DNA, 22 bp, Homo sapiens
ttctggaaatgttgctgaggcc

SEQ ID NO: 7250027 - DNA, 22 bp, Homo sapiens
ttctctggggactgtctctatt

SEQ ID NO: 7250028 - DNA, 22 bp, Homo sapiens
ttctgtgtgtctcagcaagctg

SEQ ID NO: 7250029 - DNA, 22 bp, Homo sapiens
ttctgtgttgtgacattctaga

SEQ ID NO: 7250030 - DNA, 22 bp, Homo sapiens
ttctgtgttctgtgcaatgagc

SEQ ID NO: 7250031 - DNA, 22 bp, Homo sapiens
ttctgtctgtaaacttctcaat

SEQ ID NO: 7250032 - DNA, 22 bp, Homo sapiens
ttctgtggtctcccatgtctgt

SEQ ID NO: 7250033 - DNA, 22 bp, Homo sapiens
ttgaactagaagctttggaact

SEQ ID NO: 7250034 - DNA, 22 bp, Homo sapiens
ttgaactaataggtatcttgta

SEQ ID NO: 7250035 - DNA, 22 bp, Homo sapiens
ttgaacattttctatgttatag

SEQ ID NO: 7250036 - DNA, 22 bp, Homo sapiens
ttgaacattagaataagtaatt

SEQ ID NO: 7250037 - DNA, 22 bp, Homo sapiens
ttgaaattgggtgtggctgtca

SEQ ID NO: 7250038 - DNA, 19 bp, Homo sapiens
ttgaaattgtttgatatgg

SEQ ID NO: 7250039 - DNA, 22 bp, Homo sapiens
ttgaaattgggtgtggctgtca

SEQ ID NO: 7250040 - DNA, 20 bp, Homo sapiens
ttgaaattggatggtagcta

SEQ ID NO: 7250041 - DNA, 22 bp, Homo sapiens
ttgaaattttaggccttgcaat

SEQ ID NO: 7250042 - DNA, 22 bp, Homo sapiens
ttcttttctttaggcattgtgt

SEQ ID NO: 7250043 - DNA, 22 bp, Homo sapiens
ttcttttaatagagatcctgtg

SEQ ID NO: 7250044 - DNA, 22 bp, Homo sapiens
ttcttttaaaagagagcagaaa

SEQ ID NO: 7250045 - DNA, 22 bp, Homo sapiens
ttcttttaatgtctggctttca

SEQ ID NO: 7250046 - DNA, 17 bp, Homo sapiens
ttcttttctgagccttg

SEQ ID NO: 7250047 - DNA, 22 bp, Homo sapiens
ttcttttaatgttctgaagttt

SEQ ID NO: 7250048 - DNA, 22 bp, Homo sapiens
ttcttttctgcagctggtattt

SEQ ID NO: 7250049 - DNA, 22 bp, Homo sapiens
ttcttttcttggcaggagtaga

SEQ ID NO: 7250050 - DNA, 22 bp, Homo sapiens
ttcttttcttggcaggagtaga

SEQ ID NO: 7250051 - DNA, 22 bp, Homo sapiens
ttcttcaaaatccagcatgatt

SEQ ID NO: 7250052 - DNA, 22 bp, Homo sapiens
ttcttcaagggtaaaggcaacg

SEQ ID NO: 7250053 - DNA, 22 bp, Homo sapiens
ttcctggtgacctcactggtag

SEQ ID NO: 7250054 - DNA, 20 bp, Homo sapiens
ttccttggattgtgtcttga

SEQ ID NO: 7250055 - DNA, 22 bp, Homo sapiens
ttcctgaggctcatcggagtcg

SEQ ID NO: 7250056 - DNA, 22 bp, Homo sapiens
ttccttggtagagagaatattt

SEQ ID NO: 7250057 - DNA, 22 bp, Homo sapiens
ttctcagatgattcagataaac

SEQ ID NO: 7250058 - DNA, 22 bp, Homo sapiens
ttctcctctgttggccttccct

SEQ ID NO: 7250059 - DNA, 22 bp, Homo sapiens
ttctctcttccagttcccactt

SEQ ID NO: 7250060 - DNA, 22 bp, Homo sapiens
cagaggaaggctctgggaatgt

SEQ ID NO: 7250061 - DNA, 22 bp, Homo sapiens
cagaggaagggtgctgcgaaag

SEQ ID NO: 7250062 - DNA, 22 bp, Homo sapiens
cagaggaagcagacacatcttg

SEQ ID NO: 7250063 - DNA, 22 bp, Homo sapiens
cagaggaagctgggtgtggagt

SEQ ID NO: 7250064 - DNA, 22 bp, Homo sapiens
ggggcgctcggagggatcccct

SEQ ID NO: 7250065 - DNA, 22 bp, Homo sapiens
cagaggaccagaaaggggccca

SEQ ID NO: 7250066 - DNA, 22 bp, Homo sapiens
gggggaggtgaatgcaataagg

SEQ ID NO: 7250067 - DNA, 22 bp, Homo sapiens
cagaggcagaccctccagggcg

SEQ ID NO: 7250068 - DNA, 22 bp, Homo sapiens
gggggcaggtctggaactttga

SEQ ID NO: 7250069 - DNA, 22 bp, Homo sapiens
gggggcagtaacctcaaagtgt

SEQ ID NO: 7250070 - DNA, 22 bp, Homo sapiens
gggggcagaatgtactcttgtc

SEQ ID NO: 7250071 - DNA, 22 bp, Homo sapiens
gggggatgctcaggaggctgct

SEQ ID NO: 7250072 - DNA, 22 bp, Homo sapiens
gggggaggtgaatgcaataagg

SEQ ID NO: 7250073 - DNA, 22 bp, Homo sapiens
gggggaggtgaatgcaataagg

SEQ ID NO: 7250074 - DNA, 22 bp, Homo sapiens
gggctctgcctggctgggagta

SEQ ID NO: 7250075 - DNA, 22 bp, Homo sapiens
cagagcttgaatccaacaaaga

SEQ ID NO: 7250076 - DNA, 22 bp, Homo sapiens
gggctctgcagtgacttgaggg

SEQ ID NO: 7250077 - DNA, 21 bp, Homo sapiens
gggctctgccctcctggagct

SEQ ID NO: 7250078 - DNA, 22 bp, Homo sapiens
gggctctgcctggctgggagta

SEQ ID NO: 7250079 - DNA, 22 bp, Homo sapiens
gggctctgcacgttctggcgtc

SEQ ID NO: 7250080 - DNA, 22 bp, Homo sapiens
gggctcagtcctggttctaccc

SEQ ID NO: 7250081 - DNA, 22 bp, Homo sapiens
gggctcagtcggcaagcccctt

SEQ ID NO: 7250082 - DNA, 22 bp, Homo sapiens
gggctcagtcggcaagcccctt

SEQ ID NO: 7250083 - DNA, 22 bp, Homo sapiens
gggctcagtctggcgtggaatg

SEQ ID NO: 7250084 - DNA, 22 bp, Homo sapiens
gggctcagtctgcggcgcgcgg

SEQ ID NO: 7250085 - DNA, 22 bp, Homo sapiens
gggctcaggagtttgaggctgc

SEQ ID NO: 7250086 - DNA, 22 bp, Homo sapiens
gggctcaggcctggcctctcac

SEQ ID NO: 7250087 - DNA, 22 bp, Homo sapiens
gggctcaggcctggcctctcac

SEQ ID NO: 7250088 - DNA, 22 bp, Homo sapiens
gggctcagggacacatgtgtgt

SEQ ID NO: 7250089 - DNA, 22 bp, Homo sapiens
gggctcaggtcagggcatcagc

SEQ ID NO: 7250090 - DNA, 22 bp, Homo sapiens
gggccaggagtggagatatggg

SEQ ID NO: 7250091 - DNA, 16 bp, Homo sapiens
cagagaggacagaggc

SEQ ID NO: 7250092 - DNA, 22 bp, Homo sapiens
gggccctgcgtccggaagtctg

SEQ ID NO: 7250093 - DNA, 22 bp, Homo sapiens
gggccctggccgaatccctctg

SEQ ID NO: 7250094 - DNA, 22 bp, Homo sapiens
gggccctggatttaagcatgga

SEQ ID NO: 7250095 - DNA, 22 bp, Homo sapiens
gggccctggacgtggcggcaga

SEQ ID NO: 7250096 - DNA, 22 bp, Homo sapiens
gggccctggacgtggcggcaga

SEQ ID NO: 7250097 - DNA, 22 bp, Homo sapiens
cagagagagtctgtccctgaag

SEQ ID NO: 7250098 - DNA, 22 bp, Homo sapiens
cagagagagtggggtgtggatt

SEQ ID NO: 7250099 - DNA, 20 bp, Homo sapiens
gggccctgggattcagagca

SEQ ID NO: 7250100 - DNA, 22 bp, Homo sapiens
gggccctggctttcctgttctt

SEQ ID NO: 7250101 - DNA, 18 bp, Homo sapiens
gggccctggcgtccgccc

SEQ ID NO: 7250102 - DNA, 18 bp, Homo sapiens
gggccctggcgtccgccc

SEQ ID NO: 7250103 - DNA, 18 bp, Homo sapiens
cagagcagaggtggagcg

SEQ ID NO: 7250104 - DNA, 22 bp, Homo sapiens
cagagcagcctccagggggagc

SEQ ID NO: 7250105 - DNA, 17 bp, Homo sapiens
gggcgcgggtagagccc

SEQ ID NO: 7250106 - DNA, 22 bp, Homo sapiens
cagagagagcaggaaacctccg

SEQ ID NO: 7250107 - DNA, 22 bp, Homo sapiens
cagagagaatcttggcagctga

SEQ ID NO: 7250108 - DNA, 19 bp, Homo sapiens
cagagagaccaaggcgcca

SEQ ID NO: 7250109 - DNA, 22 bp, Homo sapiens
cagagagaggggctgcctggcc

SEQ ID NO: 7250110 - DNA, 22 bp, Homo sapiens
cagagagaggccactgctatta

SEQ ID NO: 7250111 - DNA, 22 bp, Homo sapiens
cagagagagtcaaatctttgct

SEQ ID NO: 7250112 - DNA, 22 bp, Homo sapiens
cagagagaggtgccgataatgg

SEQ ID NO: 7250113 - DNA, 22 bp, Homo sapiens
cagagagaatcttggcagctga

SEQ ID NO: 7250114 - DNA, 22 bp, Homo sapiens
cagagagaatatgtagtatgga

SEQ ID NO: 7250115 - DNA, 22 bp, Homo sapiens
cagagacagtttcacagggtct

SEQ ID NO: 7250116 - DNA, 23 bp, Homo sapiens
cagaagcacctgttgactgctgc

SEQ ID NO: 7250117 - DNA, 22 bp, Homo sapiens
cagaagcaaatgccttgctgag

SEQ ID NO: 7250118 - DNA, 22 bp, Homo sapiens
ggtgtctgattccaaggccaca

SEQ ID NO: 7250119 - DNA, 22 bp, Homo sapiens
ggtgtctcagctgctggcaggg

SEQ ID NO: 7250120 - DNA, 22 bp, Homo sapiens
ggtgtctgttgcctcctggtta

SEQ ID NO: 7250121 - DNA, 19 bp, Homo sapiens
ggtgtgaagtgaggagtta

SEQ ID NO: 7250122 - DNA, 22 bp, Homo sapiens
cagcagactggagtaggcagtg

SEQ ID NO: 7250123 - DNA, 22 bp, Homo sapiens
cagcagacttactagaatgtaa

SEQ ID NO: 7250124 - DNA, 22 bp, Homo sapiens
gtaagcagaggttaatgttaac

SEQ ID NO: 7250125 - DNA, 18 bp, Homo sapiens
ggtgggaagccagggcct

SEQ ID NO: 7250126 - DNA, 18 bp, Homo sapiens
ggtggctggggacggaca

SEQ ID NO: 7250127 - DNA, 22 bp, Homo sapiens
ggtggctgcttcctcaagagga

SEQ ID NO: 7250128 - DNA, 22 bp, Homo sapiens
ggtggcagtgcttgcgggtcta

SEQ ID NO: 7250129 - DNA, 22 bp, Homo sapiens
ggtggcagtgcttgcgggtcta

SEQ ID NO: 7250130 - DNA, 22 bp, Homo sapiens
cagcactgctgctgtacacaca

SEQ ID NO: 7250131 - DNA, 22 bp, Homo sapiens
ggtgggaaggggccagtgtgcg

SEQ ID NO: 7250132 - DNA, 22 bp, Homo sapiens
ggtggcagtagcactgggcctg

SEQ ID NO: 7250133 - DNA, 22 bp, Homo sapiens
ggtggcagggagtgtccctggg

SEQ ID NO: 7250134 - DNA, 22 bp, Homo sapiens
cagatggaacacagaaaggaga

SEQ ID NO: 7250135 - DNA, 22 bp, Homo sapiens
cagatggaaggcatagaggttt

SEQ ID NO: 7250136 - DNA, 22 bp, Homo sapiens
cagatggaacacagaaaggaga

SEQ ID NO: 7250137 - DNA, 22 bp, Homo sapiens
cagatggaggataaaacatgca

SEQ ID NO: 7250138 - DNA, 22 bp, Homo sapiens
cagatggagtcccgtggagttc

SEQ ID NO: 7250139 - DNA, 22 bp, Homo sapiens
cagatggattttgtaggctgat

SEQ ID NO: 7250140 - DNA, 22 bp, Homo sapiens
ggtggcaggctggcattggcaa

SEQ ID NO: 7250141 - DNA, 22 bp, Homo sapiens
cagatacattaaaatgatgatt

SEQ ID NO: 7250142 - DNA, 22 bp, Homo sapiens
cagatataaatggatgtggtag

SEQ ID NO: 7250143 - DNA, 22 bp, Homo sapiens
cagatataagaaagctattgtc

SEQ ID NO: 7250144 - DNA, 22 bp, Homo sapiens
cagatatatattcatcaggctg

SEQ ID NO: 7250145 - DNA, 22 bp, Homo sapiens
cagatacaggtttttgttagat

SEQ ID NO: 7250146 - DNA, 22 bp, Homo sapiens
cagataaatagatagataaact

SEQ ID NO: 7250147 - DNA, 20 bp, Homo sapiens
cagataaacgggaaagaagc

SEQ ID NO: 7250148 - DNA, 22 bp, Homo sapiens
cagataaaggcttactagtagt

SEQ ID NO: 7250149 - DNA, 22 bp, Homo sapiens
ggtgcagcctccccagtgacag

SEQ ID NO: 7250150 - DNA, 22 bp, Homo sapiens
ggtgcagaggagccagctgggg

SEQ ID NO: 7250151 - DNA, 22 bp, Homo sapiens
ggtgcagaggagccagctgggg

SEQ ID NO: 7250152 - DNA, 22 bp, Homo sapiens
ggtgcagctggacagagaagcc

SEQ ID NO: 7250153 - DNA, 22 bp, Homo sapiens
ggtgcagagcagtgtcagagca

SEQ ID NO: 7250154 - DNA, 22 bp, Homo sapiens
ggtgcagaggagccagctgggg

SEQ ID NO: 7250155 - DNA, 22 bp, Homo sapiens
ggtgcagaaggaagggagctgg

SEQ ID NO: 7250156 - DNA, 22 bp, Homo sapiens
ggtgcagaagaaagcagtcatt

SEQ ID NO: 7250157 - DNA, 22 bp, Homo sapiens
ggtgcagaaggaagggagctgg

SEQ ID NO: 7250158 - DNA, 22 bp, Homo sapiens
cagagtttaaacaaatgaaata

SEQ ID NO: 7250159 - DNA, 22 bp, Homo sapiens
cagagttttgtgaacaacttgg

SEQ ID NO: 7250160 - DNA, 22 bp, Homo sapiens
cagagtgggctgtcagccacca

SEQ ID NO: 7250161 - DNA, 22 bp, Homo sapiens
ggggtctgctgcggagcagaga

SEQ ID NO: 7250162 - DNA, 22 bp, Homo sapiens
ggggtcggggcatagccactta

SEQ ID NO: 7250163 - DNA, 22 bp, Homo sapiens
ggggtcctggaggccagctgga

SEQ ID NO: 7250164 - DNA, 22 bp, Homo sapiens
ggggtcctcggagcctgggtct

SEQ ID NO: 7250165 - DNA, 22 bp, Homo sapiens
ggggtctgggcttagctggaat

SEQ ID NO: 7250166 - DNA, 22 bp, Homo sapiens
ggggtctgggttgctcggcctt

SEQ ID NO: 7250167 - DNA, 22 bp, Homo sapiens
ggggtctgggcttagctggaat

SEQ ID NO: 7250168 - DNA, 22 bp, Homo sapiens
cagagtgaaaactgagctcaaa

SEQ ID NO: 7250169 - DNA, 22 bp, Homo sapiens
ggggtgagatcaaggaagccct

SEQ ID NO: 7250170 - DNA, 22 bp, Homo sapiens
cagaggctgatgtgggatgggc

SEQ ID NO: 7250171 - DNA, 22 bp, Homo sapiens
cagaggctgctctgggtggcat

SEQ ID NO: 7250172 - DNA, 22 bp, Homo sapiens
ggggtaggtcatagcccctcta

SEQ ID NO: 7250173 - DNA, 22 bp, Homo sapiens
cagcagtggctgcaggcagctg

SEQ ID NO: 7250174 - DNA, 22 bp, Homo sapiens
cagcagagacggtaagcagaac

SEQ ID NO: 7250175 - DNA, 22 bp, Homo sapiens
cagcagagcatttggtaggagg

SEQ ID NO: 7250176 - DNA, 20 bp, Homo sapiens
gtcctaggtttgaaggtaaa

SEQ ID NO: 7250177 - DNA, 22 bp, Homo sapiens
gtctcaggtattgaatgggaac

SEQ ID NO: 7250178 - DNA, 22 bp, Homo sapiens
gtctcagggctgagggcagtgg

SEQ ID NO: 7250179 - DNA, 22 bp, Homo sapiens
gtctcagggcagctggaggagg

SEQ ID NO: 7250180 - DNA, 22 bp, Homo sapiens
gtgaagtaagtactattaagat

SEQ ID NO: 7250181 - DNA, 22 bp, Homo sapiens
gtgaatggggcaggaaggatgg

SEQ ID NO: 7250182 - DNA, 22 bp, Homo sapiens
cagctcctctggccagccctgc

SEQ ID NO: 7250183 - DNA, 22 bp, Homo sapiens
cagctctgagactgaggctatg

SEQ ID NO: 7250184 - DNA, 22 bp, Homo sapiens
gtgcctgtaagggcaggtttct

SEQ ID NO: 7250185 - DNA, 22 bp, Homo sapiens
gtgctgagctgcagatgcgctc

SEQ ID NO: 7250186 - DNA, 22 bp, Homo sapiens
cagccgtcagatgtgccgcagc

SEQ ID NO: 7250187 - DNA, 22 bp, Homo sapiens
gtgccctgaaagagttaattca

SEQ ID NO: 7250188 - DNA, 22 bp, Homo sapiens
gtgccctgacacacctggtgtg

SEQ ID NO: 7250189 - DNA, 22 bp, Homo sapiens
gtgcatgtggtaaagaggagag

SEQ ID NO: 7250190 - DNA, 22 bp, Homo sapiens
gtgcaggaggtaacatagcaaa

SEQ ID NO: 7250191 - DNA, 22 bp, Homo sapiens
gtgcatgaagactcagaaagtc

SEQ ID NO: 7250192 - DNA, 22 bp, Homo sapiens
ggatattctttatagatacagt

SEQ ID NO: 7250193 - DNA, 22 bp, Homo sapiens
ggatcaggcgccatgggaagtg

SEQ ID NO: 7250194 - DNA, 22 bp, Homo sapiens
ggcagctgcaaatctgctctgt

SEQ ID NO: 7250195 - DNA, 22 bp, Homo sapiens
ggagtctgttttacatgcagga

SEQ ID NO: 7250196 - DNA, 21 bp, Homo sapiens
ggagtctgtggatgctgtttc

SEQ ID NO: 7250197 - DNA, 22 bp, Homo sapiens
ggagtctgtgtcttgaagcagt

SEQ ID NO: 7250198 - DNA, 22 bp, Homo sapiens
ggagtctgtcacctgtttctct

SEQ ID NO: 7250199 - DNA, 22 bp, Homo sapiens
ggagtctgggaattggagagaa

SEQ ID NO: 7250200 - DNA, 22 bp, Homo sapiens
ggagtgaaaggtaagttgagct

SEQ ID NO: 7250201 - DNA, 22 bp, Homo sapiens
ggagtgaagtggcgcgatctcg

SEQ ID NO: 7250202 - DNA, 22 bp, Homo sapiens
ggagtgactcacagctgggaca

SEQ ID NO: 7250203 - DNA, 22 bp, Homo sapiens
ggagtgagcaaatagagatttg

SEQ ID NO: 7250204 - DNA, 22 bp, Homo sapiens
ggagtttcttgagcccttaagg

SEQ ID NO: 7250205 - DNA, 19 bp, Homo sapiens
ggcaggtgtgcttatgctt

SEQ ID NO: 7250206 - DNA, 22 bp, Homo sapiens
ggcaggtgtgagatcgaggcca

SEQ ID NO: 7250207 - DNA, 22 bp, Homo sapiens
ggcaggtgtggtgaccagagat

SEQ ID NO: 7250208 - DNA, 22 bp, Homo sapiens
ggcaggtgtggtgaccagagat

SEQ ID NO: 7250209 - DNA, 22 bp, Homo sapiens
ggcaggactctcaggaccaagc

SEQ ID NO: 7250210 - DNA, 22 bp, Homo sapiens
ggcaggactcttctgtgggccg

SEQ ID NO: 7250211 - DNA, 22 bp, Homo sapiens
ggcaggactgatcagtgggatg

SEQ ID NO: 7250212 - DNA, 22 bp, Homo sapiens
cacatgcataaggataattact

SEQ ID NO: 7250213 - DNA, 22 bp, Homo sapiens
ggccagctcagactccacttgc

SEQ ID NO: 7250214 - DNA, 22 bp, Homo sapiens
ggccagctacccatctgcgtca

SEQ ID NO: 7250215 - DNA, 22 bp, Homo sapiens
ggccagctcagtctccatcagg

SEQ ID NO: 7250216 - DNA, 18 bp, Homo sapiens
ggccagctcctgaggcag

SEQ ID NO: 7250217 - DNA, 21 bp, Homo sapiens
ggccagctcggaaggtcccat

SEQ ID NO: 7250218 - DNA, 22 bp, Homo sapiens
ggccagctccttggcagtgcct

SEQ ID NO: 7250219 - DNA, 22 bp, Homo sapiens
caccacagcatccactagaagg

SEQ ID NO: 7250220 - DNA, 22 bp, Homo sapiens
ggccagcccagtggtcctctct

SEQ ID NO: 7250221 - DNA, 22 bp, Homo sapiens
ggccagcccagtggtcctctct

SEQ ID NO: 7250222 - DNA, 18 bp, Homo sapiens
ggccagccccaggccagc

SEQ ID NO: 7250223 - DNA, 22 bp, Homo sapiens
ggccagccctcctccctgggtt

SEQ ID NO: 7250224 - DNA, 22 bp, Homo sapiens
ggccagcctggggctcccagac

SEQ ID NO: 7250225 - DNA, 22 bp, Homo sapiens
ggccagcctggggctcccagac

SEQ ID NO: 7250226 - DNA, 22 bp, Homo sapiens
ggccagcggcacagcctggccc

SEQ ID NO: 7250227 - DNA, 22 bp, Homo sapiens
ggccagcggcacagcctggccc

SEQ ID NO: 7250228 - DNA, 22 bp, Homo sapiens
ggccagcggcacagcctggccc

SEQ ID NO: 7250229 - DNA, 22 bp, Homo sapiens
ggccccagggattaggccaacc

SEQ ID NO: 7250230 - DNA, 22 bp, Homo sapiens
ggccccagggaagaaggtggtc

SEQ ID NO: 7250231 - DNA, 22 bp, Homo sapiens
ggccccaggcctttggtctggc

SEQ ID NO: 7250232 - DNA, 22 bp, Homo sapiens
ggccccaggacctccacggtcc

SEQ ID NO: 7250233 - DNA, 22 bp, Homo sapiens
ggccccagcttcaaccccgtgg

SEQ ID NO: 7250234 - DNA, 22 bp, Homo sapiens
ggccccagctgtggtgaataga

SEQ ID NO: 7250235 - DNA, 22 bp, Homo sapiens
ggcgcaggccttggatcctggt

SEQ ID NO: 7250236 - DNA, 22 bp, Homo sapiens
ggcgccctggtgccgcaccgcg

SEQ ID NO: 7250237 - DNA, 22 bp, Homo sapiens
ggcgccagcccaggccgtcgtg

SEQ ID NO: 7250238 - DNA, 22 bp, Homo sapiens
ggcgaggccgggacaggctgga

SEQ ID NO: 7250239 - DNA, 22 bp, Homo sapiens
ggcgagggagcagtgcggtggg

SEQ ID NO: 7250240 - DNA, 22 bp, Homo sapiens
ggcgcacgccattggccgtgcg

SEQ ID NO: 7250241 - DNA, 22 bp, Homo sapiens
ggccccagcctcagtcccctga

SEQ ID NO: 7250242 - DNA, 21 bp, Homo sapiens
ggccccagcccatgggttctc

SEQ ID NO: 7250243 - DNA, 19 bp, Homo sapiens
ggccccagccagggtatca

SEQ ID NO: 7250244 - DNA, 22 bp, Homo sapiens
ggccccagcagtgcttgtttat

SEQ ID NO: 7250245 - DNA, 22 bp, Homo sapiens
ggcccagcccgagtcagccttc

SEQ ID NO: 7250246 - DNA, 22 bp, Homo sapiens
ggcccagcatcttgtgaagttt

SEQ ID NO: 7250247 - DNA, 22 bp, Homo sapiens
ggcccagcatcttgtgaagttt

SEQ ID NO: 7250248 - DNA, 22 bp, Homo sapiens
ggcccagcacagtgcttggggg

SEQ ID NO: 7250249 - DNA, 22 bp, Homo sapiens
ggcccagcacagtgcttggggg

SEQ ID NO: 7250250 - DNA, 22 bp, Homo sapiens
cagaagaggactgggtagctca

SEQ ID NO: 7250251 - DNA, 22 bp, Homo sapiens
cagaagagtagctgaacaagtt

SEQ ID NO: 7250252 - DNA, 19 bp, Homo sapiens
cagaacaggaccaggggcc

SEQ ID NO: 7250253 - DNA, 19 bp, Homo sapiens
cagaacagctgggaagaga

SEQ ID NO: 7250254 - DNA, 22 bp, Homo sapiens
ggctgggagctggacaggccgg

SEQ ID NO: 7250255 - DNA, 22 bp, Homo sapiens
ggctggctttctctccgcacct

SEQ ID NO: 7250256 - DNA, 23 bp, Homo sapiens
ggctgggagctccgggtgcacgt

SEQ ID NO: 7250257 - DNA, 22 bp, Homo sapiens
cagaaatgtttgttaatattgt

SEQ ID NO: 7250258 - DNA, 22 bp, Homo sapiens
ggctgctgggtcatgatgcaga

SEQ ID NO: 7250259 - DNA, 22 bp, Homo sapiens
ggctgctgtactgatgtcagtt

SEQ ID NO: 7250260 - DNA, 21 bp, Homo sapiens
ggctgctgtcaccgctgtcac

SEQ ID NO: 7250261 - DNA, 19 bp, Homo sapiens
cagaaatagcgaagtgtaa

SEQ ID NO: 7250262 - DNA, 19 bp, Homo sapiens
cagaaatagcgaagtgtaa

SEQ ID NO: 7250263 - DNA, 22 bp, Homo sapiens
ggctcctgtggcaagacagctt

SEQ ID NO: 7250264 - DNA, 22 bp, Homo sapiens
ggctcctgtcctcctggagctc

SEQ ID NO: 7250265 - DNA, 22 bp, Homo sapiens
ggctcctgtcccctcagctgct

SEQ ID NO: 7250266 - DNA, 22 bp, Homo sapiens
cactgcccagcgtcttaggcac

SEQ ID NO: 7250267 - DNA, 22 bp, Homo sapiens
cactgcccaggacctgccaccc

SEQ ID NO: 7250268 - DNA, 20 bp, Homo sapiens
cactgccctccagcctgagc

SEQ ID NO: 7250269 - DNA, 22 bp, Homo sapiens
cactgaggtttgttaactgagt

SEQ ID NO: 7250270 - DNA, 22 bp, Homo sapiens
cactgagttagtacgcaaacat

SEQ ID NO: 7250271 - DNA, 19 bp, Homo sapiens
ggctcctggggctcagccc

SEQ ID NO: 7250272 - DNA, 19 bp, Homo sapiens
ggctcctggggctcagccc

SEQ ID NO: 7250273 - DNA, 22 bp, Homo sapiens
cactgagggcggagcccaggga

SEQ ID NO: 7250274 - DNA, 22 bp, Homo sapiens
cactgaggtatctgtctctcct

SEQ ID NO: 7250275 - DNA, 22 bp, Homo sapiens
ggcgccgcactcggtgcagccg

SEQ ID NO: 7250276 - DNA, 20 bp, Homo sapiens
ggcgcctggcctcatggctg

SEQ ID NO: 7250277 - DNA, 18 bp, Homo sapiens
ggctgctcgctctccccg

SEQ ID NO: 7250278 - DNA, 22 bp, Homo sapiens
ggctgctcctttaccctggcag

SEQ ID NO: 7250279 - DNA, 18 bp, Homo sapiens
ggctgctcctctccctac

SEQ ID NO: 7250280 - DNA, 22 bp, Homo sapiens
ggctgctcacgcagccctccct

SEQ ID NO: 7250281 - DNA, 22 bp, Homo sapiens
ggctgctcacgcagccctccct

SEQ ID NO: 7250282 - DNA, 19 bp, Homo sapiens
ggctgcctttccttaccag

SEQ ID NO: 7250283 - DNA, 22 bp, Homo sapiens
ggctgcggatctaaggctggga

SEQ ID NO: 7250284 - DNA, 22 bp, Homo sapiens
cactgtctgtgtgtccttgggg

SEQ ID NO: 7250285 - DNA, 22 bp, Homo sapiens
cactgtctgtgtgtccttgggg

SEQ ID NO: 7250286 - DNA, 22 bp, Homo sapiens
ggctgcctcaaagctcaagctc

SEQ ID NO: 7250287 - DNA, 22 bp, Homo sapiens
ggctgcagatagccagccacca

SEQ ID NO: 7250288 - DNA, 22 bp, Homo sapiens
ggctgcagccctcgcctagcca

SEQ ID NO: 7250289 - DNA, 22 bp, Homo sapiens
ggctgcagattgtagtctgtta

SEQ ID NO: 7250290 - DNA, 22 bp, Homo sapiens
ggacagcgtggctggtggaggg

SEQ ID NO: 7250291 - DNA, 17 bp, Homo sapiens
ggagagtgggaatggcc

SEQ ID NO: 7250292 - DNA, 22 bp, Homo sapiens
cacagagaatgatgagtcactg

SEQ ID NO: 7250293 - DNA, 22 bp, Homo sapiens
cacagagaattcccatatgtga

SEQ ID NO: 7250294 - DNA, 22 bp, Homo sapiens
cacagagacagaagcacttatg

SEQ ID NO: 7250295 - DNA, 22 bp, Homo sapiens
cacagcaggcactatacagggc

SEQ ID NO: 7250296 - DNA, 22 bp, Homo sapiens
cacagagacagatctattttgc

SEQ ID NO: 7250297 - DNA, 22 bp, Homo sapiens
cacagagacatgatgtcattgc

SEQ ID NO: 7250298 - DNA, 22 bp, Homo sapiens
cacagagaatactgctcttgct

SEQ ID NO: 7250299 - DNA, 22 bp, Homo sapiens
cacagagaactgtgggagtgtg

SEQ ID NO: 7250300 - DNA, 22 bp, Homo sapiens
ggagatagtccaggtgaaggga

SEQ ID NO: 7250301 - DNA, 22 bp, Homo sapiens
ggacagagggttgacagagtat

SEQ ID NO: 7250302 - DNA, 22 bp, Homo sapiens
ggacagagggttgacagagtat

SEQ ID NO: 7250303 - DNA, 22 bp, Homo sapiens
ggacacacaagttatctaatga

SEQ ID NO: 7250304 - DNA, 22 bp, Homo sapiens
ggacaaaggtagacagtctctg

SEQ ID NO: 7250305 - DNA, 22 bp, Homo sapiens
ggacaaagggtggagcctctga

SEQ ID NO: 7250306 - DNA, 22 bp, Homo sapiens
ggacaaaggggtacgatctagc

SEQ ID NO: 7250307 - DNA, 22 bp, Homo sapiens
ggacaaaggggagcctgccccg

SEQ ID NO: 7250308 - DNA, 22 bp, Homo sapiens
ggacaaagggctagccacaact

SEQ ID NO: 7250309 - DNA, 22 bp, Homo sapiens
ggacaaagctctgctgcctccc

SEQ ID NO: 7250310 - DNA, 22 bp, Homo sapiens
ggaaggggccttgagcaaactg

SEQ ID NO: 7250311 - DNA, 22 bp, Homo sapiens
ggacaaaggtctggggaacctg

SEQ ID NO: 7250312 - DNA, 22 bp, Homo sapiens
ggaacaggaaaggagggatgct

SEQ ID NO: 7250313 - DNA, 22 bp, Homo sapiens
ggaagagagggctgggcctcaa

SEQ ID NO: 7250314 - DNA, 22 bp, Homo sapiens
cacaggagagctgggaggtgcc

SEQ ID NO: 7250315 - DNA, 18 bp, Homo sapiens
cacaggagatgacctgac

SEQ ID NO: 7250316 - DNA, 22 bp, Homo sapiens
cacaggagaaaggggaagctcg

SEQ ID NO: 7250317 - DNA, 22 bp, Homo sapiens
cacaggagaaaggggaagctcg

SEQ ID NO: 7250318 - DNA, 22 bp, Homo sapiens
ggaggggccggctgcctgccac

SEQ ID NO: 7250319 - DNA, 22 bp, Homo sapiens
ggaggggccggctgcctgccac

SEQ ID NO: 7250320 - DNA, 22 bp, Homo sapiens
ggaggggccggctgcctgccac

SEQ ID NO: 7250321 - DNA, 22 bp, Homo sapiens
ggaggggcatagttcaccatca

SEQ ID NO: 7250322 - DNA, 22 bp, Homo sapiens
ggaggggcatagttcaccatca

SEQ ID NO: 7250323 - DNA, 22 bp, Homo sapiens
ggaggggcatagttcaccatca

SEQ ID NO: 7250324 - DNA, 22 bp, Homo sapiens
ggaggggcagccatggaactcc

SEQ ID NO: 7250325 - DNA, 22 bp, Homo sapiens
ggaggggcagccatggaactcc

SEQ ID NO: 7250326 - DNA, 22 bp, Homo sapiens
ggaggggcaggtcccaagttgt

SEQ ID NO: 7250327 - DNA, 22 bp, Homo sapiens
ggaggggcaggtcccaagttgt

SEQ ID NO: 7250328 - DNA, 22 bp, Homo sapiens
ggaggggagtctcccaaagccg

SEQ ID NO: 7250329 - DNA, 19 bp, Homo sapiens
cacagctctgctcagggaa

SEQ ID NO: 7250330 - DNA, 22 bp, Homo sapiens
cacagctaggaggaaagcagag

SEQ ID NO: 7250331 - DNA, 22 bp, Homo sapiens
ggagggagtttcattcctgccc

SEQ ID NO: 7250332 - DNA, 22 bp, Homo sapiens
cacagcagtctttcactaaata

SEQ ID NO: 7250333 - DNA, 22 bp, Homo sapiens
cacagcaggtgcttaatgatta

SEQ ID NO: 7250334 - DNA, 21 bp, Homo sapiens
cacagcagggttcctgggctc

SEQ ID NO: 7250335 - DNA, 22 bp, Homo sapiens
cacagcagggcatggctgttgt

SEQ ID NO: 7250336 - DNA, 22 bp, Homo sapiens
cacagcagggatgaatggagtg

SEQ ID NO: 7250337 - DNA, 22 bp, Homo sapiens
cacagcaggcagaacgtgggca

SEQ ID NO: 7250338 - DNA, 22 bp, Homo sapiens
cacagcccccttgacactctgg

SEQ ID NO: 7250339 - DNA, 22 bp, Homo sapiens
ggagcagccacgtctcagggca

SEQ ID NO: 7250340 - DNA, 22 bp, Homo sapiens
ggagcagccacgtctcagggca

SEQ ID NO: 7250341 - DNA, 22 bp, Homo sapiens
ggagcagcctgtgtagacgggg

SEQ ID NO: 7250342 - DNA, 22 bp, Homo sapiens
ggagcagccgcgtctcagggca

SEQ ID NO: 7250343 - DNA, 22 bp, Homo sapiens
ggagcagccgcgtctcagggca

SEQ ID NO: 7250344 - DNA, 22 bp, Homo sapiens
ggaggagacggagtgattagtg

SEQ ID NO: 7250345 - DNA, 22 bp, Homo sapiens
ggaggagaccctgtgtcagttt

SEQ ID NO: 7250346 - DNA, 22 bp, Homo sapiens
ggaggagattcccctctcactt

SEQ ID NO: 7250347 - DNA, 22 bp, Homo sapiens
ggaggagagaggttgcaaacac

SEQ ID NO: 7250348 - DNA, 22 bp, Homo sapiens
ggaggagcacttctgagctcag

SEQ ID NO: 7250349 - DNA, 22 bp, Homo sapiens
ggaggagcatgagagggtagtg

SEQ ID NO: 7250350 - DNA, 22 bp, Homo sapiens
ggaggagcacttgacggggtct

SEQ ID NO: 7250351 - DNA, 22 bp, Homo sapiens
ggagcagcttgcatgctcaggg

SEQ ID NO: 7250352 - DNA, 22 bp, Homo sapiens
ggaggagacagtaaaaagcacg

SEQ ID NO: 7250353 - DNA, 22 bp, Homo sapiens
ggaggagacagtaaaaagcacg

SEQ ID NO: 7250354 - DNA, 22 bp, Homo sapiens
ggagctggccctctgagtttgt

SEQ ID NO: 7250355 - DNA, 22 bp, Homo sapiens
ggagctggccgcctatgtgcag

SEQ ID NO: 7250356 - DNA, 22 bp, Homo sapiens
caatgtatcaaccagaaagttc

SEQ ID NO: 7250357 - DNA, 22 bp, Homo sapiens
ggaaattgatctgagctcacct

SEQ ID NO: 7250358 - DNA, 22 bp, Homo sapiens
gctggtggcagagctccgcggc

SEQ ID NO: 7250359 - DNA, 22 bp, Homo sapiens
gctggtgctctgggccctgagg

SEQ ID NO: 7250360 - DNA, 22 bp, Homo sapiens
gctggtgcattagctgcagttc

SEQ ID NO: 7250361 - DNA, 22 bp, Homo sapiens
caatgcatgatggaattgcctt

SEQ ID NO: 7250362 - DNA, 22 bp, Homo sapiens
caatgcacgctcagatttgacc

SEQ ID NO: 7250363 - DNA, 22 bp, Homo sapiens
caatcccatcaccatctgctct

SEQ ID NO: 7250364 - DNA, 20 bp, Homo sapiens
gctgggctaccactggccct

SEQ ID NO: 7250365 - DNA, 22 bp, Homo sapiens
gctggcagccaagtgaagaggg

SEQ ID NO: 7250366 - DNA, 22 bp, Homo sapiens
gctggccagtgtggtgaccacc

SEQ ID NO: 7250367 - DNA, 19 bp, Homo sapiens
gctggcagatgtggccgtg

SEQ ID NO: 7250368 - DNA, 22 bp, Homo sapiens
gctggcagcattagaccctggg

SEQ ID NO: 7250369 - DNA, 20 bp, Homo sapiens
gctggcagatgtcttgagat

SEQ ID NO: 7250370 - DNA, 22 bp, Homo sapiens
gctggcagagctctgggctggg

SEQ ID NO: 7250371 - DNA, 22 bp, Homo sapiens
gctggcagagagctggtgagga

SEQ ID NO: 7250372 - DNA, 16 bp, Homo sapiens
gctggagggaggggtt

SEQ ID NO: 7250373 - DNA, 22 bp, Homo sapiens
gctggaggctggagtgcagtgg

SEQ ID NO: 7250374 - DNA, 22 bp, Homo sapiens
gctgggagccctggtctgctcc

SEQ ID NO: 7250375 - DNA, 22 bp, Homo sapiens
gctgggcccagatcccaggatc

SEQ ID NO: 7250376 - DNA, 22 bp, Homo sapiens
gctgggccagccagacatgtga

SEQ ID NO: 7250377 - DNA, 22 bp, Homo sapiens
gctgggccagccagacatgtga

SEQ ID NO: 7250378 - DNA, 22 bp, Homo sapiens
gctgggccccatccctcgagca

SEQ ID NO: 7250379 - DNA, 22 bp, Homo sapiens
gctgggccccttgaaaggcgtc

SEQ ID NO: 7250380 - DNA, 22 bp, Homo sapiens
gctgggccctgggtgccctagc

SEQ ID NO: 7250381 - DNA, 22 bp, Homo sapiens
gctgggccgacctgggctgcag

SEQ ID NO: 7250382 - DNA, 22 bp, Homo sapiens
gctgggccttccgattctcaag

SEQ ID NO: 7250383 - DNA, 22 bp, Homo sapiens
gctgggccgacctgggctgcag

SEQ ID NO: 7250384 - DNA, 21 bp, Homo sapiens
gctgggcctgtacttgccctg

SEQ ID NO: 7250385 - DNA, 22 bp, Homo sapiens
gctggcccagcgcccagggcag

SEQ ID NO: 7250386 - DNA, 22 bp, Homo sapiens
gctggccatggggagtgaggag

SEQ ID NO: 7250387 - DNA, 22 bp, Homo sapiens
gctggccatagaagccaaagag

SEQ ID NO: 7250388 - DNA, 22 bp, Homo sapiens
gctggccatggcctgcgccatc

SEQ ID NO: 7250389 - DNA, 22 bp, Homo sapiens
gctgggagcaaagccatgcata

SEQ ID NO: 7250390 - DNA, 19 bp, Homo sapiens
gctgggagcagaccctccc

SEQ ID NO: 7250391 - DNA, 22 bp, Homo sapiens
gcagaggcctgaaggtggcggg

SEQ ID NO: 7250392 - DNA, 22 bp, Homo sapiens
gcagaggcctgaaggtggcggg

SEQ ID NO: 7250393 - DNA, 22 bp, Homo sapiens
gcagaggctgtagggaaggttg

SEQ ID NO: 7250394 - DNA, 22 bp, Homo sapiens
gcagaggggaagctgaggaatt

SEQ ID NO: 7250395 - DNA, 22 bp, Homo sapiens
gcagagggcaggggtgtttgtt

SEQ ID NO: 7250396 - DNA, 22 bp, Homo sapiens
gcagaatattatggaaaaagta

SEQ ID NO: 7250397 - DNA, 22 bp, Homo sapiens
gcagaatagggcataactttgc

SEQ ID NO: 7250398 - DNA, 22 bp, Homo sapiens
gcagaggcctaggtggaaggcc

SEQ ID NO: 7250399 - DNA, 16 bp, Homo sapiens
gcagaggaaaggggag

SEQ ID NO: 7250400 - DNA, 16 bp, Homo sapiens
gcagaggaaaggggag

SEQ ID NO: 7250401 - DNA, 22 bp, Homo sapiens
gcagaaggtcaaagcaagatgt

SEQ ID NO: 7250402 - DNA, 22 bp, Homo sapiens
gcagaagggaataaggagcttt

SEQ ID NO: 7250403 - DNA, 22 bp, Homo sapiens
gcagcctgttgtaccagcctgt

SEQ ID NO: 7250404 - DNA, 22 bp, Homo sapiens
gcagcctgggcaacagagtgag

SEQ ID NO: 7250405 - DNA, 22 bp, Homo sapiens
gcagcctgatgatctgggttgt

SEQ ID NO: 7250406 - DNA, 22 bp, Homo sapiens
gcagcctgaggccctttctggc

SEQ ID NO: 7250407 - DNA, 22 bp, Homo sapiens
gcagccaggtttgaggaccact

SEQ ID NO: 7250408 - DNA, 22 bp, Homo sapiens
gcagccagggagagaaccaggg

SEQ ID NO: 7250409 - DNA, 22 bp, Homo sapiens
gatttctgtggcttgtacatat

SEQ ID NO: 7250410 - DNA, 22 bp, Homo sapiens
gcacacagggatttttgaatgg

SEQ ID NO: 7250411 - DNA, 22 bp, Homo sapiens
gcacagggaggctggcctggcc

SEQ ID NO: 7250412 - DNA, 22 bp, Homo sapiens
gcacagggagcaggtctctggt

SEQ ID NO: 7250413 - DNA, 22 bp, Homo sapiens
gcacagggcaacaggtctgtta

SEQ ID NO: 7250414 - DNA, 23 bp, Homo sapiens
gcactgggctctcagcaaggtgt

SEQ ID NO: 7250415 - DNA, 22 bp, Homo sapiens
gcacagggagacagccgtggcc

SEQ ID NO: 7250416 - DNA, 20 bp, Homo sapiens
gcacagagatgagcaaagta

SEQ ID NO: 7250417 - DNA, 22 bp, Homo sapiens
gcaggtggatcaccacgtcagg

SEQ ID NO: 7250418 - DNA, 22 bp, Homo sapiens
gcaggtggatcacctgaggtca

SEQ ID NO: 7250419 - DNA, 22 bp, Homo sapiens
gcagggtgaaggtcacatagaa

SEQ ID NO: 7250420 - DNA, 22 bp, Homo sapiens
gcagggtcttgagaggcagcca

SEQ ID NO: 7250421 - DNA, 22 bp, Homo sapiens
gcagggtcgctctaggagatca

SEQ ID NO: 7250422 - DNA, 22 bp, Homo sapiens
gcagggtccatggaggcagccc

SEQ ID NO: 7250423 - DNA, 22 bp, Homo sapiens
gcaggggttttctgacttgagt

SEQ ID NO: 7250424 - DNA, 16 bp, Homo sapiens
gcaggggtgggtggag

SEQ ID NO: 7250425 - DNA, 22 bp, Homo sapiens
gcaggcggaggttgcagtgagc

SEQ ID NO: 7250426 - DNA, 22 bp, Homo sapiens
gcaggagcaaactgcagtgtgg

SEQ ID NO: 7250427 - DNA, 22 bp, Homo sapiens
gcaggagcaaactgcagtgtgg

SEQ ID NO: 7250428 - DNA, 18 bp, Homo sapiens
gcaggagatgggtggggt

SEQ ID NO: 7250429 - DNA, 22 bp, Homo sapiens
gcaggctggtctgaccatccct

SEQ ID NO: 7250430 - DNA, 22 bp, Homo sapiens
gcaggctgtctaaagttagagt

SEQ ID NO: 7250431 - DNA, 22 bp, Homo sapiens
gcaggctgtggtatgttgggca

SEQ ID NO: 7250432 - DNA, 22 bp, Homo sapiens
gcagggacgccagggacagcaa

SEQ ID NO: 7250433 - DNA, 22 bp, Homo sapiens
gcagggactttggcaacaggtg

SEQ ID NO: 7250434 - DNA, 22 bp, Homo sapiens
attgtacaatgcctggaacatt

SEQ ID NO: 7250435 - DNA, 22 bp, Homo sapiens
attgttagttagtgtggggaga

SEQ ID NO: 7250436 - DNA, 22 bp, Homo sapiens
attgttcactgtgaatcttgat

SEQ ID NO: 7250437 - DNA, 22 bp, Homo sapiens
attgttcaatgtaataattttg

SEQ ID NO: 7250438 - DNA, 22 bp, Homo sapiens
attgttgaggcagttcatcttg

SEQ ID NO: 7250439 - DNA, 22 bp, Homo sapiens
attgttgaggagactcttcaat

SEQ ID NO: 7250440 - DNA, 22 bp, Homo sapiens
atttaaagtggtagattggcag

SEQ ID NO: 7250441 - DNA, 22 bp, Homo sapiens
gccactcatgggaggtgtgcaa

SEQ ID NO: 7250442 - DNA, 21 bp, Homo sapiens
gccactgcactccagcctggg

SEQ ID NO: 7250443 - DNA, 22 bp, Homo sapiens
gccactgcactccagcccaggc

SEQ ID NO: 7250444 - DNA, 22 bp, Homo sapiens
gctcagggtcccttggtgctgg

SEQ ID NO: 7250445 - DNA, 22 bp, Homo sapiens
gctcagggtcccttggtgctgg

SEQ ID NO: 7250446 - DNA, 22 bp, Homo sapiens
gctcagggctaaggctgagggg

SEQ ID NO: 7250447 - DNA, 22 bp, Homo sapiens
gctcaggggaatgggctgccgt

SEQ ID NO: 7250448 - DNA, 22 bp, Homo sapiens
gctccaggcgagctggaccaga

SEQ ID NO: 7250449 - DNA, 22 bp, Homo sapiens
gctccaggcgagctggaccaga

SEQ ID NO: 7250450 - DNA, 22 bp, Homo sapiens
gctccaggccccagcgttccgc

SEQ ID NO: 7250451 - DNA, 22 bp, Homo sapiens
gctccaggccacggcttcttgg

SEQ ID NO: 7250452 - DNA, 17 bp, Homo sapiens
gctccaggcgtgagtga

SEQ ID NO: 7250453 - DNA, 22 bp, Homo sapiens
gctccaggctgctctgtcccat

SEQ ID NO: 7250454 - DNA, 22 bp, Homo sapiens
gctcggagaactgggggctccg

SEQ ID NO: 7250455 - DNA, 22 bp, Homo sapiens
gctcgcgccgcaccggtccacc

SEQ ID NO: 7250456 - DNA, 22 bp, Homo sapiens
gctctagcccatttcctgcttg

SEQ ID NO: 7250457 - DNA, 22 bp, Homo sapiens
gctctaaagggttggacaggtg

SEQ ID NO: 7250458 - DNA, 22 bp, Homo sapiens
gctatgttcccttttgctataa

SEQ ID NO: 7250459 - DNA, 22 bp, Homo sapiens
gctatgttagacattctcattt

SEQ ID NO: 7250460 - DNA, 22 bp, Homo sapiens
gctacacaaaaggagagtgagt

SEQ ID NO: 7250461 - DNA, 22 bp, Homo sapiens
gctatttttgagccatttataa

SEQ ID NO: 7250462 - DNA, 22 bp, Homo sapiens
gctcaaagaccagacagaggag

SEQ ID NO: 7250463 - DNA, 22 bp, Homo sapiens
gctcagggctaaggctgagggg

SEQ ID NO: 7250464 - DNA, 22 bp, Homo sapiens
gctcaaaggccaggtagcagca

SEQ ID NO: 7250465 - DNA, 22 bp, Homo sapiens
gctcaaagcataagacatctaa

SEQ ID NO: 7250466 - DNA, 22 bp, Homo sapiens
gcgtggggtaggtagacatgga

SEQ ID NO: 7250467 - DNA, 20 bp, Homo sapiens
caaatccctgctctgtgctg

SEQ ID NO: 7250468 - DNA, 22 bp, Homo sapiens
caaatctaggatgcatgtagtg

SEQ ID NO: 7250469 - DNA, 22 bp, Homo sapiens
gctctgggtgaacttggagcaa

SEQ ID NO: 7250470 - DNA, 22 bp, Homo sapiens
gctctgggtgaagggtaccatt

SEQ ID NO: 7250471 - DNA, 22 bp, Homo sapiens
gctctgggtgaatggcagattg

SEQ ID NO: 7250472 - DNA, 22 bp, Homo sapiens
gctctgagaggatgctgagcag

SEQ ID NO: 7250473 - DNA, 22 bp, Homo sapiens
gctgaggaagtcaggtggccca

SEQ ID NO: 7250474 - DNA, 22 bp, Homo sapiens
gctgaggagcgagaactctgct

SEQ ID NO: 7250475 - DNA, 22 bp, Homo sapiens
atttactaatgtcatatcgcgt

SEQ ID NO: 7250476 - DNA, 22 bp, Homo sapiens
atttacagtttagcatttcaag

SEQ ID NO: 7250477 - DNA, 22 bp, Homo sapiens
atttacagacgtggattagtgc

SEQ ID NO: 7250478 - DNA, 22 bp, Homo sapiens
gcccagcccctgggtggacgtg

SEQ ID NO: 7250479 - DNA, 22 bp, Homo sapiens
gcccagcccagaaaggttcgga

SEQ ID NO: 7250480 - DNA, 22 bp, Homo sapiens
gcccagccagagctgtgtgatg

SEQ ID NO: 7250481 - DNA, 22 bp, Homo sapiens
gcccagccacagtcactttcat

SEQ ID NO: 7250482 - DNA, 22 bp, Homo sapiens
gcccagcaggggatggcagctc

SEQ ID NO: 7250483 - DNA, 22 bp, Homo sapiens
gcccagcaggacagagtggttt

SEQ ID NO: 7250484 - DNA, 22 bp, Homo sapiens
gcccactccagcttctcccaca

SEQ ID NO: 7250485 - DNA, 22 bp, Homo sapiens
gccagaggggctcgaaggcgcg

SEQ ID NO: 7250486 - DNA, 22 bp, Homo sapiens
gccagaggggctcgaaggcgcg

SEQ ID NO: 7250487 - DNA, 22 bp, Homo sapiens
gccctgccctctcggcactcgc

SEQ ID NO: 7250488 - DNA, 22 bp, Homo sapiens
gccctgccctgttgaaactaga

SEQ ID NO: 7250489 - DNA, 22 bp, Homo sapiens
gccctgccctgagccgtagacc

SEQ ID NO: 7250490 - DNA, 22 bp, Homo sapiens
gccctgccgggtattttgtgct

SEQ ID NO: 7250491 - DNA, 23 bp, Homo sapiens
gccctgcccttagcacactcaca

SEQ ID NO: 7250492 - DNA, 22 bp, Homo sapiens
gccctcccctctgggtggtgag

SEQ ID NO: 7250493 - DNA, 19 bp, Homo sapiens
gccctcctcactgagctct

SEQ ID NO: 7250494 - DNA, 22 bp, Homo sapiens
gcccaggaggtggaggtgcagt

SEQ ID NO: 7250495 - DNA, 22 bp, Homo sapiens
gcccaggagttcaaggctgcag

SEQ ID NO: 7250496 - DNA, 22 bp, Homo sapiens
gcccaggagttgaagggctgac

SEQ ID NO: 7250497 - DNA, 22 bp, Homo sapiens
gcccccttgacctaatcacctt

SEQ ID NO: 7250498 - DNA, 22 bp, Homo sapiens
gccccgtcgtggggccagggat

SEQ ID NO: 7250499 - DNA, 22 bp, Homo sapiens
gccccgcagtgcgtgctggtct

SEQ ID NO: 7250500 - DNA, 22 bp, Homo sapiens
atttgtctttggacctgtgaga

SEQ ID NO: 7250501 - DNA, 18 bp, Homo sapiens
atttgcaggcatgcaggc

SEQ ID NO: 7250502 - DNA, 18 bp, Homo sapiens
gcctgccatccccacagc

SEQ ID NO: 7250503 - DNA, 22 bp, Homo sapiens
gcctgcccacggggctggcata

SEQ ID NO: 7250504 - DNA, 22 bp, Homo sapiens
gcctgccccttcctgggcaggg

SEQ ID NO: 7250505 - DNA, 22 bp, Homo sapiens
attttgaaaagcatttgagtaa

SEQ ID NO: 7250506 - DNA, 22 bp, Homo sapiens
attttgaaaccaagttatttcc

SEQ ID NO: 7250507 - DNA, 22 bp, Homo sapiens
attttgaaatacttgaaggaaa

SEQ ID NO: 7250508 - DNA, 22 bp, Homo sapiens
attttgaaatacttgaaggaaa

SEQ ID NO: 7250509 - DNA, 18 bp, Homo sapiens
attttgaacaatgctgta

SEQ ID NO: 7250510 - DNA, 22 bp, Homo sapiens
attttgaagggaattgaagttc

SEQ ID NO: 7250511 - DNA, 18 bp, Homo sapiens
attttgaactgggaatat

SEQ ID NO: 7250512 - DNA, 23 bp, Homo sapiens
gagtgcagaatagacatgcagtg

SEQ ID NO: 7250513 - DNA, 22 bp, Homo sapiens
gagtgcaggcctgagcaccatc

SEQ ID NO: 7250514 - DNA, 21 bp, Homo sapiens
gagtgcagcaaggtagagtct

SEQ ID NO: 7250515 - DNA, 23 bp, Homo sapiens
gagtgcagaatagacatgcagtg

SEQ ID NO: 7250516 - DNA, 22 bp, Homo sapiens
atgtttattgttttaagctgct

SEQ ID NO: 7250517 - DNA, 22 bp, Homo sapiens
atgtttaattatctgggttttg

SEQ ID NO: 7250518 - DNA, 22 bp, Homo sapiens
atgtttctaaaacttgcatggc

SEQ ID NO: 7250519 - DNA, 22 bp, Homo sapiens
gatctggaagaaagggagggca

SEQ ID NO: 7250520 - DNA, 22 bp, Homo sapiens
gatctctgaatctgaagccttc

SEQ ID NO: 7250521 - DNA, 21 bp, Homo sapiens
gatctctggaatgactctggc

SEQ ID NO: 7250522 - DNA, 18 bp, Homo sapiens
gatctctgcagtgcctac

SEQ ID NO: 7250523 - DNA, 22 bp, Homo sapiens
gatctctgtggactcttagcac

SEQ ID NO: 7250524 - DNA, 22 bp, Homo sapiens
gagttattgagtatagaatgta

SEQ ID NO: 7250525 - DNA, 22 bp, Homo sapiens
gagggcaccagaagagccagat

SEQ ID NO: 7250526 - DNA, 22 bp, Homo sapiens
gaggggagcccccatcctccag

SEQ ID NO: 7250527 - DNA, 22 bp, Homo sapiens
gagggggcgaacagaagcaagg

SEQ ID NO: 7250528 - DNA, 22 bp, Homo sapiens
gagggggcgtgcaaggctccgc

SEQ ID NO: 7250529 - DNA, 22 bp, Homo sapiens
gagggggctccctgaagccagt

SEQ ID NO: 7250530 - DNA, 22 bp, Homo sapiens
gagggggctagcgcagtgccca

SEQ ID NO: 7250531 - DNA, 22 bp, Homo sapiens
gagggggctagcgcagtgccca

SEQ ID NO: 7250532 - DNA, 22 bp, Homo sapiens
gagggggctagcgcagtgccca

SEQ ID NO: 7250533 - DNA, 22 bp, Homo sapiens
gaggggggcgccctgcagtgca

SEQ ID NO: 7250534 - DNA, 22 bp, Homo sapiens
gaggtacatgaggatacacagg

SEQ ID NO: 7250535 - DNA, 22 bp, Homo sapiens
gaggtacagagtgttccaatgt

SEQ ID NO: 7250536 - DNA, 22 bp, Homo sapiens
gagggggtctatgaggtagagc

SEQ ID NO: 7250537 - DNA, 22 bp, Homo sapiens
gaggggtcacatgggctggctt

SEQ ID NO: 7250538 - DNA, 22 bp, Homo sapiens
gaggggtcacatgggctggctt

SEQ ID NO: 7250539 - DNA, 22 bp, Homo sapiens
gaggccacagctatcagggaca

SEQ ID NO: 7250540 - DNA, 23 bp, Homo sapiens
gaggccacattcccctgcttgag

SEQ ID NO: 7250541 - DNA, 22 bp, Homo sapiens
gaggccacagtgtctgggggcc

SEQ ID NO: 7250542 - DNA, 22 bp, Homo sapiens
gaggctgtgtcttggggtggaa

SEQ ID NO: 7250543 - DNA, 22 bp, Homo sapiens
gaggctgtgtttcagtgaggcc

SEQ ID NO: 7250544 - DNA, 22 bp, Homo sapiens
gaggcttctggaaagcctggca

SEQ ID NO: 7250545 - DNA, 22 bp, Homo sapiens
gaggcttctgttcactcacgct

SEQ ID NO: 7250546 - DNA, 22 bp, Homo sapiens
gaggctgttagggcctgaggta

SEQ ID NO: 7250547 - DNA, 22 bp, Homo sapiens
gaggctgtttgtggcagtgatg

SEQ ID NO: 7250548 - DNA, 22 bp, Homo sapiens
gagggatggtgtgagaggctca

SEQ ID NO: 7250549 - DNA, 22 bp, Homo sapiens
gagggatggtgtgagaggctca

SEQ ID NO: 7250550 - DNA, 22 bp, Homo sapiens
gagggatggtgtgagaggctca

SEQ ID NO: 7250551 - DNA, 22 bp, Homo sapiens
gagggatgtcaggggaccttgg

SEQ ID NO: 7250552 - DNA, 22 bp, Homo sapiens
gagggatgtgcctgaaggcagg

SEQ ID NO: 7250553 - DNA, 22 bp, Homo sapiens
gagcagtgactggagcatgaga

SEQ ID NO: 7250554 - DNA, 19 bp, Homo sapiens
gagcagctgcacccattga

SEQ ID NO: 7250555 - DNA, 22 bp, Homo sapiens
gagcagctctgggtgacccagt

SEQ ID NO: 7250556 - DNA, 22 bp, Homo sapiens
gagcctggcctcctgcctcagc

SEQ ID NO: 7250557 - DNA, 22 bp, Homo sapiens
gagcctgggactgggggtcatg

SEQ ID NO: 7250558 - DNA, 20 bp, Homo sapiens
gagcctgggaagtctaaggt

SEQ ID NO: 7250559 - DNA, 22 bp, Homo sapiens
gagcctggggaccctcctgagt

SEQ ID NO: 7250560 - DNA, 22 bp, Homo sapiens
gagcctgggtccttccctggga

SEQ ID NO: 7250561 - DNA, 23 bp, Homo sapiens
gagctctgcactaggccctggga

SEQ ID NO: 7250562 - DNA, 22 bp, Homo sapiens
gagaggtggaggttgcagtgag

SEQ ID NO: 7250563 - DNA, 22 bp, Homo sapiens
gagaggtggtgaggacttgtct

SEQ ID NO: 7250564 - DNA, 22 bp, Homo sapiens
gagaggtgtgtttcagataaga

SEQ ID NO: 7250565 - DNA, 22 bp, Homo sapiens
gagaggtgaaggctgccctggg

SEQ ID NO: 7250566 - DNA, 22 bp, Homo sapiens
gagaggtgaatgtggatgccac

SEQ ID NO: 7250567 - DNA, 22 bp, Homo sapiens
gagcacagtaaagcagtgtcac

SEQ ID NO: 7250568 - DNA, 22 bp, Homo sapiens
gagcagctccagccgcatgact

SEQ ID NO: 7250569 - DNA, 22 bp, Homo sapiens
gagcagctcgagaaggaagcag

SEQ ID NO: 7250570 - DNA, 22 bp, Homo sapiens
gagaggctgcatatgcacactg

SEQ ID NO: 7250571 - DNA, 22 bp, Homo sapiens
gagaggctggcagtgccaggtt

SEQ ID NO: 7250572 - DNA, 22 bp, Homo sapiens
gagaggctgatcctgcagagaa

SEQ ID NO: 7250573 - DNA, 22 bp, Homo sapiens
gagaggctgaaatcacaggagc

SEQ ID NO: 7250574 - DNA, 22 bp, Homo sapiens
gagaggctgactggctgtcctg

SEQ ID NO: 7250575 - DNA, 22 bp, Homo sapiens
gagaggaatgaggttaaggact

SEQ ID NO: 7250576 - DNA, 22 bp, Homo sapiens
gagaggctccatgaccccggca

SEQ ID NO: 7250577 - DNA, 22 bp, Homo sapiens
gagaggctccgccactgctcag

SEQ ID NO: 7250578 - DNA, 22 bp, Homo sapiens
gagaggctctgaggactggggt

SEQ ID NO: 7250579 - DNA, 22 bp, Homo sapiens
atgctttttaaacttaattgga

SEQ ID NO: 7250580 - DNA, 17 bp, Homo sapiens
atgtaagaagaaagcag

SEQ ID NO: 7250581 - DNA, 22 bp, Homo sapiens
gagctctggcagggcaggtctg

SEQ ID NO: 7250582 - DNA, 22 bp, Homo sapiens
gagctctgggaaacaaagtgta

SEQ ID NO: 7250583 - DNA, 22 bp, Homo sapiens
gagctctgctactcaaagtatg

SEQ ID NO: 7250584 - DNA, 22 bp, Homo sapiens
gagctggggcggatactcagct

SEQ ID NO: 7250585 - DNA, 22 bp, Homo sapiens
gagctggggcggatactcagct

SEQ ID NO: 7250586 - DNA, 22 bp, Homo sapiens
gagctttctgtgttccagttgc

SEQ ID NO: 7250587 - DNA, 22 bp, Homo sapiens
gagctttcacagggtctcattg

SEQ ID NO: 7250588 - DNA, 22 bp, Homo sapiens
gaggaagctgcgtggcatttca

SEQ ID NO: 7250589 - DNA, 19 bp, Homo sapiens
gaatgtttctgtctcttct

SEQ ID NO: 7250590 - DNA, 22 bp, Homo sapiens
gaatgtttcatgtgtatgttag

SEQ ID NO: 7250591 - DNA, 20 bp, Homo sapiens
gaatgtttcacttgctccat

SEQ ID NO: 7250592 - DNA, 22 bp, Homo sapiens
gaatgtttaaggaaggcgtggc

SEQ ID NO: 7250593 - DNA, 22 bp, Homo sapiens
gaatgtttaaaaggtgcagttt

SEQ ID NO: 7250594 - DNA, 22 bp, Homo sapiens
atgcatataaggcacatgtatt

SEQ ID NO: 7250595 - DNA, 22 bp, Homo sapiens
atgcatataatggccagaacaa

SEQ ID NO: 7250596 - DNA, 22 bp, Homo sapiens
atgcatatagaacatttgacat

SEQ ID NO: 7250597 - DNA, 22 bp, Homo sapiens
gaatgtgggctgtgaagaggag

SEQ ID NO: 7250598 - DNA, 22 bp, Homo sapiens
atgcacaagcaagagataatgg

SEQ ID NO: 7250599 - DNA, 22 bp, Homo sapiens
atgcacaagaggctagaaaaga

SEQ ID NO: 7250600 - DNA, 22 bp, Homo sapiens
gaagcactgtgctgctaagttg

SEQ ID NO: 7250601 - DNA, 22 bp, Homo sapiens
atgccctgtggttcatgtgaga

SEQ ID NO: 7250602 - DNA, 18 bp, Homo sapiens
atgccctgttgacttcag

SEQ ID NO: 7250603 - DNA, 22 bp, Homo sapiens
atgccctggggctacctctgag

SEQ ID NO: 7250604 - DNA, 22 bp, Homo sapiens
atgccctggacttctagtattc

SEQ ID NO: 7250605 - DNA, 22 bp, Homo sapiens
atgccctgggagtgctgtacca

SEQ ID NO: 7250606 - DNA, 22 bp, Homo sapiens
atgccctgtgactctcctggac

SEQ ID NO: 7250607 - DNA, 23 bp, Homo sapiens
atgccctgtagaggctgctgacc

SEQ ID NO: 7250608 - DNA, 20 bp, Homo sapiens
atgccctgtcctcttctgtt

SEQ ID NO: 7250609 - DNA, 22 bp, Homo sapiens
atgccctgtggcagtacatatt

SEQ ID NO: 7250610 - DNA, 23 bp, Homo sapiens
atgccctgtgcagaaatgtggaa

SEQ ID NO: 7250611 - DNA, 22 bp, Homo sapiens
atgccctgagcaggccttcaag

SEQ ID NO: 7250612 - DNA, 22 bp, Homo sapiens
atgccctgaaagattcaaaggc

SEQ ID NO: 7250613 - DNA, 22 bp, Homo sapiens
atgccctgaggaatgtcacgct

SEQ ID NO: 7250614 - DNA, 22 bp, Homo sapiens
atgccctgcatcaagtgacact

SEQ ID NO: 7250615 - DNA, 22 bp, Homo sapiens
atgccctgccaagcaggctaaa

SEQ ID NO: 7250616 - DNA, 22 bp, Homo sapiens
atgccctgctctcgggaaggga

SEQ ID NO: 7250617 - DNA, 22 bp, Homo sapiens
atgccctgctgccatctggccg

SEQ ID NO: 7250618 - DNA, 22 bp, Homo sapiens
atgccctgctgctggggcagtg

SEQ ID NO: 7250619 - DNA, 22 bp, Homo sapiens
atgccctggactagctatactt

SEQ ID NO: 7250620 - DNA, 20 bp, Homo sapiens
atgcatatatgtggtgtctg

SEQ ID NO: 7250621 - DNA, 22 bp, Homo sapiens
atgcatatatacatacacagtc

SEQ ID NO: 7250622 - DNA, 22 bp, Homo sapiens
atgcatatcacagtctccatgt

SEQ ID NO: 7250623 - DNA, 22 bp, Homo sapiens
atgcatatcagtgattgtttgc

SEQ ID NO: 7250624 - DNA, 22 bp, Homo sapiens
atgcatatctcctatctcctca

SEQ ID NO: 7250625 - DNA, 22 bp, Homo sapiens
atgcatatcagtgattgtttgc

SEQ ID NO: 7250626 - DNA, 22 bp, Homo sapiens
atgcatatgcaatgcacaattt

SEQ ID NO: 7250627 - DNA, 22 bp, Homo sapiens
atgcatatgcatctgtgtacat

SEQ ID NO: 7250628 - DNA, 22 bp, Homo sapiens
atgcccaccctcagcccaggct

SEQ ID NO: 7250629 - DNA, 22 bp, Homo sapiens
atgcccacaacactgcactttt

SEQ ID NO: 7250630 - DNA, 22 bp, Homo sapiens
gacagtggttccaaggcagctt

SEQ ID NO: 7250631 - DNA, 22 bp, Homo sapiens
gacagggcatggtgcagagttc

SEQ ID NO: 7250632 - DNA, 22 bp, Homo sapiens
gacagggccgcagatggagact

SEQ ID NO: 7250633 - DNA, 22 bp, Homo sapiens
gacagggccgcagatggagact

SEQ ID NO: 7250634 - DNA, 22 bp, Homo sapiens
gaccccagaggaaggggcgccg

SEQ ID NO: 7250635 - DNA, 22 bp, Homo sapiens
gaccccaggcagatcagggggt

SEQ ID NO: 7250636 - DNA, 18 bp, Homo sapiens
gaccccgggatctgtcga

SEQ ID NO: 7250637 - DNA, 22 bp, Homo sapiens
atgctttgatagtttattacat

SEQ ID NO: 7250638 - DNA, 22 bp, Homo sapiens
atgcttttccaggagaaatata

SEQ ID NO: 7250639 - DNA, 21 bp, Homo sapiens
cttgagaattaactgttcatt

SEQ ID NO: 7250640 - DNA, 22 bp, Homo sapiens
cttgagaaaggaacaggaagct

SEQ ID NO: 7250641 - DNA, 22 bp, Homo sapiens
cttgagatgtcatctgctttgg

SEQ ID NO: 7250642 - DNA, 22 bp, Homo sapiens
cttgagggcaggattctgtttt

SEQ ID NO: 7250643 - DNA, 22 bp, Homo sapiens
gaaaagaactgcatgggattaa

SEQ ID NO: 7250644 - DNA, 22 bp, Homo sapiens
gaaaatgagcctcagctacatt

SEQ ID NO: 7250645 - DNA, 22 bp, Homo sapiens
gaagaaagattggcatgcttca

SEQ ID NO: 7250646 - DNA, 22 bp, Homo sapiens
atgcaatatgtgtttctgttta

SEQ ID NO: 7250647 - DNA, 22 bp, Homo sapiens
atgcacaacagacgaatggaag

SEQ ID NO: 7250648 - DNA, 19 bp, Homo sapiens
gaacaatttgttagctctc

SEQ ID NO: 7250649 - DNA, 22 bp, Homo sapiens
gaacataattaaatgtcctggg

SEQ ID NO: 7250650 - DNA, 22 bp, Homo sapiens
atgaggcatctgcagtcactag

SEQ ID NO: 7250651 - DNA, 22 bp, Homo sapiens
cttatgaagaccctacctccag

SEQ ID NO: 7250652 - DNA, 22 bp, Homo sapiens
cttattcataagtcagacacac

SEQ ID NO: 7250653 - DNA, 22 bp, Homo sapiens
cttattcatatattctcggtag

SEQ ID NO: 7250654 - DNA, 21 bp, Homo sapiens
cttattcactgttatttatca

SEQ ID NO: 7250655 - DNA, 22 bp, Homo sapiens
cttattcaatgctggaaatgtt

SEQ ID NO: 7250656 - DNA, 22 bp, Homo sapiens
cttattcagaaggagaaatgga

SEQ ID NO: 7250657 - DNA, 22 bp, Homo sapiens
cttattatggcatgtaagtggg

SEQ ID NO: 7250658 - DNA, 22 bp, Homo sapiens
cttattcagaccttggattctt

SEQ ID NO: 7250659 - DNA, 22 bp, Homo sapiens
cttattcagatacagactcttg

SEQ ID NO: 7250660 - DNA, 22 bp, Homo sapiens
cttattcagcaagtttgggtac

SEQ ID NO: 7250661 - DNA, 22 bp, Homo sapiens
cttattcagcacttgctctgta

SEQ ID NO: 7250662 - DNA, 22 bp, Homo sapiens
atccatttgacataatttcagc

SEQ ID NO: 7250663 - DNA, 22 bp, Homo sapiens
atccatttctatcttgctgagg

SEQ ID NO: 7250664 - DNA, 22 bp, Homo sapiens
atccatgaaggtacttctcagg

SEQ ID NO: 7250665 - DNA, 22 bp, Homo sapiens
atcatagaggaaaatccacgtt

SEQ ID NO: 7250666 - DNA, 21 bp, Homo sapiens
cttaacattttaaatgaaagg

SEQ ID NO: 7250667 - DNA, 22 bp, Homo sapiens
atctgtaaatgcaaatgtagct

SEQ ID NO: 7250668 - DNA, 22 bp, Homo sapiens
atctgtaattttgaatgcaaat

SEQ ID NO: 7250669 - DNA, 22 bp, Homo sapiens
cttcttaaattggattgctatt

SEQ ID NO: 7250670 - DNA, 22 bp, Homo sapiens
atctgggtttcaaagaagcctt

SEQ ID NO: 7250671 - DNA, 23 bp, Homo sapiens
atctcctgagaacccacagtggt

SEQ ID NO: 7250672 - DNA, 20 bp, Homo sapiens
atctcctgctaccacccatt

SEQ ID NO: 7250673 - DNA, 22 bp, Homo sapiens
cttccttgctgtctgctccagg

SEQ ID NO: 7250674 - DNA, 22 bp, Homo sapiens
cttccttgtggtccttctcatt

SEQ ID NO: 7250675 - DNA, 22 bp, Homo sapiens
atctctatctttattgaaatct

SEQ ID NO: 7250676 - DNA, 22 bp, Homo sapiens
cttctgagcagacctcctgggg

SEQ ID NO: 7250677 - DNA, 22 bp, Homo sapiens
ctgtctcaagactgcaggcact

SEQ ID NO: 7250678 - DNA, 22 bp, Homo sapiens
ctgtctccagggcaggtgcagg

SEQ ID NO: 7250679 - DNA, 22 bp, Homo sapiens
atcagctgctacattggcctct

SEQ ID NO: 7250680 - DNA, 20 bp, Homo sapiens
atcagctggagaacattatg

SEQ ID NO: 7250681 - DNA, 22 bp, Homo sapiens
atcagctggaacaagtgtctga

SEQ ID NO: 7250682 - DNA, 22 bp, Homo sapiens
ctgtctcctccactgcatggga

SEQ ID NO: 7250683 - DNA, 22 bp, Homo sapiens
ctgtctccgccctcttggtagg

SEQ ID NO: 7250684 - DNA, 22 bp, Homo sapiens
ctgtctcctcctttgttcttaa

SEQ ID NO: 7250685 - DNA, 23 bp, Homo sapiens
ctgtctcctgggctaggtggaat

SEQ ID NO: 7250686 - DNA, 22 bp, Homo sapiens
atcataaaccactttgtaatct

SEQ ID NO: 7250687 - DNA, 21 bp, Homo sapiens
ctgtaagaaatcagttttatc

SEQ ID NO: 7250688 - DNA, 22 bp, Homo sapiens
ctgtaagatgggataagacttt

SEQ ID NO: 7250689 - DNA, 22 bp, Homo sapiens
atcagcattcccaaatgatgtg

SEQ ID NO: 7250690 - DNA, 22 bp, Homo sapiens
atcagctgatgaatggatgaat

SEQ ID NO: 7250691 - DNA, 22 bp, Homo sapiens
atcagctgaaaaacaggcagca

SEQ ID NO: 7250692 - DNA, 22 bp, Homo sapiens
atcacagctagtaagtggagga

SEQ ID NO: 7250693 - DNA, 22 bp, Homo sapiens
atcacaatccctctctctgata

SEQ ID NO: 7250694 - DNA, 22 bp, Homo sapiens
ctgggaggcggaggttgcagtg

SEQ ID NO: 7250695 - DNA, 22 bp, Homo sapiens
ctgggaggacaacttggagctc

SEQ ID NO: 7250696 - DNA, 22 bp, Homo sapiens
ctgggaggtggaggttgcattg

SEQ ID NO: 7250697 - DNA, 22 bp, Homo sapiens
ctgggaggcggaggttgtagtg

SEQ ID NO: 7250698 - DNA, 22 bp, Homo sapiens
ctggggcttcaatgcttcggtg

SEQ ID NO: 7250699 - DNA, 22 bp, Homo sapiens
ctggggctgtgggagacaaggc

SEQ ID NO: 7250700 - DNA, 22 bp, Homo sapiens
ctggggctgtaggaggacttat

SEQ ID NO: 7250701 - DNA, 19 bp, Homo sapiens
ctgggaggtgttcagagaa

SEQ ID NO: 7250702 - DNA, 23 bp, Homo sapiens
ctggggctttcaaatctgggcag

SEQ ID NO: 7250703 - DNA, 22 bp, Homo sapiens
ctgggtggctgtccagccagcc

SEQ ID NO: 7250704 - DNA, 22 bp, Homo sapiens
ctgggtggcagagcctgcagtg

SEQ ID NO: 7250705 - DNA, 22 bp, Homo sapiens
ctggtccctgcagtgtgctggg

SEQ ID NO: 7250706 - DNA, 22 bp, Homo sapiens
ctgggtggagcctggtcatctg

SEQ ID NO: 7250707 - DNA, 22 bp, Homo sapiens
ctgggtggagcctggtcatctg

SEQ ID NO: 7250708 - DNA, 22 bp, Homo sapiens
ctgggtggcagagcctgcagtg

SEQ ID NO: 7250709 - DNA, 20 bp, Homo sapiens
ctgggtggcaagcaaggggg

SEQ ID NO: 7250710 - DNA, 18 bp, Homo sapiens
atattcaagaagacagag

SEQ ID NO: 7250711 - DNA, 22 bp, Homo sapiens
atagtttgtgaaacacagcagt

SEQ ID NO: 7250712 - DNA, 23 bp, Homo sapiens
atataaacaccagatagattgta

SEQ ID NO: 7250713 - DNA, 22 bp, Homo sapiens
atataaagagcttagtatagtg

SEQ ID NO: 7250714 - DNA, 22 bp, Homo sapiens
atagtttgggcaaagaggacct

SEQ ID NO: 7250715 - DNA, 22 bp, Homo sapiens
atagtttgaaggctgttctact

SEQ ID NO: 7250716 - DNA, 22 bp, Homo sapiens
atagtgcattttattatcagca

SEQ ID NO: 7250717 - DNA, 22 bp, Homo sapiens
atagtgcagccccttttctatt

SEQ ID NO: 7250718 - DNA, 22 bp, Homo sapiens
ctgggagctgtcaggagcgtgt

SEQ ID NO: 7250719 - DNA, 22 bp, Homo sapiens
ctgggagctggatgccctgccc

SEQ ID NO: 7250720 - DNA, 22 bp, Homo sapiens
ctgggagctggaatgggagaag

SEQ ID NO: 7250721 - DNA, 22 bp, Homo sapiens
ctgggagctggaatgggagaag

SEQ ID NO: 7250722 - DNA, 22 bp, Homo sapiens
atatactgtgttccatggacca

SEQ ID NO: 7250723 - DNA, 22 bp, Homo sapiens
atatactgtagtggtttagagc

SEQ ID NO: 7250724 - DNA, 22 bp, Homo sapiens
atatactgtaggccactataag

SEQ ID NO: 7250725 - DNA, 22 bp, Homo sapiens
atatactgatagctgcacttct

SEQ ID NO: 7250726 - DNA, 22 bp, Homo sapiens
atatactgaggagactttatat

SEQ ID NO: 7250727 - DNA, 19 bp, Homo sapiens
atatacatactgtgtgcat

SEQ ID NO: 7250728 - DNA, 22 bp, Homo sapiens
atatacatgggaatatgtggag

SEQ ID NO: 7250729 - DNA, 22 bp, Homo sapiens
atatacaggtggtatgtgtaaa

SEQ ID NO: 7250730 - DNA, 22 bp, Homo sapiens
atatacaggtggtatgtgtaaa

SEQ ID NO: 7250731 - DNA, 22 bp, Homo sapiens
atataatacaacctgctaagtg

SEQ ID NO: 7250732 - DNA, 22 bp, Homo sapiens
atacacatgttattgtggaagc

SEQ ID NO: 7250733 - DNA, 22 bp, Homo sapiens
ctggcaggtttggtgtctggtg

SEQ ID NO: 7250734 - DNA, 22 bp, Homo sapiens
ctggccactgcgggcctctgcc

SEQ ID NO: 7250735 - DNA, 22 bp, Homo sapiens
ctggcaggtctcgctgacgtgt

SEQ ID NO: 7250736 - DNA, 22 bp, Homo sapiens
ctggcaggtggaggttgcagtg

SEQ ID NO: 7250737 - DNA, 22 bp, Homo sapiens
ctggcaggttatagagctgccc

SEQ ID NO: 7250738 - DNA, 22 bp, Homo sapiens
ctggcaggtggatggggactcc

SEQ ID NO: 7250739 - DNA, 22 bp, Homo sapiens
ctggccagactacacatgtgtg

SEQ ID NO: 7250740 - DNA, 20 bp, Homo sapiens
ctggccagaacgcctacaca

SEQ ID NO: 7250741 - DNA, 20 bp, Homo sapiens
ctggccagaacgcctacaca

SEQ ID NO: 7250742 - DNA, 22 bp, Homo sapiens
agttcttattgaatagaaatca

SEQ ID NO: 7250743 - DNA, 22 bp, Homo sapiens
agttctataattaaaatgaagg

SEQ ID NO: 7250744 - DNA, 22 bp, Homo sapiens
agttctctcccctgctgttcag

SEQ ID NO: 7250745 - DNA, 22 bp, Homo sapiens
agttctgagcatctaggcagct

SEQ ID NO: 7250746 - DNA, 22 bp, Homo sapiens
agttctgactctgaatctggga

SEQ ID NO: 7250747 - DNA, 22 bp, Homo sapiens
agttctgaatgaggaatctggg

SEQ ID NO: 7250748 - DNA, 22 bp, Homo sapiens
agttctgtgacaatatcattac

SEQ ID NO: 7250749 - DNA, 22 bp, Homo sapiens
agttctgtctgattctaatgca

SEQ ID NO: 7250750 - DNA, 22 bp, Homo sapiens
ataaagctatttttaattctgt

SEQ ID NO: 7250751 - DNA, 22 bp, Homo sapiens
ataaagctattcctctcttttt

SEQ ID NO: 7250752 - DNA, 22 bp, Homo sapiens
ataaagctaagacttacatgaa

SEQ ID NO: 7250753 - DNA, 22 bp, Homo sapiens
ctgcagggaactgaggcccaga

SEQ ID NO: 7250754 - DNA, 22 bp, Homo sapiens
ctgcagggaactgaggcccaga

SEQ ID NO: 7250755 - DNA, 22 bp, Homo sapiens
ctgcagggaccacaagcaggtt

SEQ ID NO: 7250756 - DNA, 22 bp, Homo sapiens
ataaacatctgtttctcttctg

SEQ ID NO: 7250757 - DNA, 22 bp, Homo sapiens
ctgcctggaaggagcaagggga

SEQ ID NO: 7250758 - DNA, 22 bp, Homo sapiens
ataaagctttgaaatggagata

SEQ ID NO: 7250759 - DNA, 22 bp, Homo sapiens
ataaagctcttagtagcagcct

SEQ ID NO: 7250760 - DNA, 22 bp, Homo sapiens
ataaagcttctgagtctagatc

SEQ ID NO: 7250761 - DNA, 22 bp, Homo sapiens
ctgcctgtaactttctgaagca

SEQ ID NO: 7250762 - DNA, 22 bp, Homo sapiens
ctgctcaagtgcgcacccaggg

SEQ ID NO: 7250763 - DNA, 22 bp, Homo sapiens
ctgctcacgccaccgttcatca

SEQ ID NO: 7250764 - DNA, 20 bp, Homo sapiens
ctgctcagaccaactcttct

SEQ ID NO: 7250765 - DNA, 19 bp, Homo sapiens
ctgctcagagcagctccag

SEQ ID NO: 7250766 - DNA, 22 bp, Homo sapiens
ctgctgcccagtgtgcattggg

SEQ ID NO: 7250767 - DNA, 22 bp, Homo sapiens
ctgctgggcagaggctgcatga

SEQ ID NO: 7250768 - DNA, 22 bp, Homo sapiens
ctgctgtggtgtcaagcatctc

SEQ ID NO: 7250769 - DNA, 22 bp, Homo sapiens
ctgctggggtcagagcactggg

SEQ ID NO: 7250770 - DNA, 22 bp, Homo sapiens
ctgctgggggacacaggtccgg

SEQ ID NO: 7250771 - DNA, 22 bp, Homo sapiens
agtgcattatatgtttcaatgg

SEQ ID NO: 7250772 - DNA, 22 bp, Homo sapiens
agtgcagggcctgcccagcagg

SEQ ID NO: 7250773 - DNA, 22 bp, Homo sapiens
agtgccctcgtgcccagggcct

SEQ ID NO: 7250774 - DNA, 22 bp, Homo sapiens
agtgccccatgggtgcctgggg

SEQ ID NO: 7250775 - DNA, 22 bp, Homo sapiens
agtgccttctctgggctaggtc

SEQ ID NO: 7250776 - DNA, 22 bp, Homo sapiens
agtgccttaaacagcatcggag

SEQ ID NO: 7250777 - DNA, 22 bp, Homo sapiens
agtgccttgtgtgtgggcagcc

SEQ ID NO: 7250778 - DNA, 22 bp, Homo sapiens
agtgctgggtactgttcccatt

SEQ ID NO: 7250779 - DNA, 22 bp, Homo sapiens
agtggaaagaaccctggactca

SEQ ID NO: 7250780 - DNA, 21 bp, Homo sapiens
agtggaacccttagggtcagg

SEQ ID NO: 7250781 - DNA, 22 bp, Homo sapiens
agtgctgtcagttttatagata

SEQ ID NO: 7250782 - DNA, 22 bp, Homo sapiens
agtggacccggaacagaggccc

SEQ ID NO: 7250783 - DNA, 22 bp, Homo sapiens
agtggactaaagccaggcagca

SEQ ID NO: 7250784 - DNA, 22 bp, Homo sapiens
agtggagaagaggatggtctcc

SEQ ID NO: 7250785 - DNA, 22 bp, Homo sapiens
agtggagaagaggatggtctcc

SEQ ID NO: 7250786 - DNA, 22 bp, Homo sapiens
agtggagaatatgcagaaagcc

SEQ ID NO: 7250787 - DNA, 22 bp, Homo sapiens
agtggagacaggacagtcgata

SEQ ID NO: 7250788 - DNA, 22 bp, Homo sapiens
agtggagacaggacagtcgata

SEQ ID NO: 7250789 - DNA, 22 bp, Homo sapiens
agtggagcaggcggcgctcact

SEQ ID NO: 7250790 - DNA, 20 bp, Homo sapiens
agtggagcagcccaagcagc

SEQ ID NO: 7250791 - DNA, 22 bp, Homo sapiens
agtggagcttttcctatcagag

SEQ ID NO: 7250792 - DNA, 22 bp, Homo sapiens
agtggaggcactaattggattt

SEQ ID NO: 7250793 - DNA, 22 bp, Homo sapiens
agtggaggttattgagttaagg

SEQ ID NO: 7250794 - DNA, 22 bp, Homo sapiens
agtggcagaagccaagtctgca

SEQ ID NO: 7250795 - DNA, 22 bp, Homo sapiens
agtggcagggctggctgctgca

SEQ ID NO: 7250796 - DNA, 22 bp, Homo sapiens
agtggcagtggggcagggccct

SEQ ID NO: 7250797 - DNA, 22 bp, Homo sapiens
agtgaggggcagctgagtgggc

SEQ ID NO: 7250798 - DNA, 22 bp, Homo sapiens
agtgaggggattcaggcaaggt

SEQ ID NO: 7250799 - DNA, 22 bp, Homo sapiens
agtgagggactagtgctgggga

SEQ ID NO: 7250800 - DNA, 22 bp, Homo sapiens
agtgaaatgactgaatcagata

SEQ ID NO: 7250801 - DNA, 19 bp, Homo sapiens
agtgagaacatgtgcacac

SEQ ID NO: 7250802 - DNA, 22 bp, Homo sapiens
agtctagatgtgtactaggtta

SEQ ID NO: 7250803 - DNA, 22 bp, Homo sapiens
agtctagatgatcctaggaata

SEQ ID NO: 7250804 - DNA, 22 bp, Homo sapiens
agtctcacttcttgagctatgc

SEQ ID NO: 7250805 - DNA, 22 bp, Homo sapiens
ctcacagttggctcattaatga

SEQ ID NO: 7250806 - DNA, 22 bp, Homo sapiens
ctcacagtgtaatattgaaccc

SEQ ID NO: 7250807 - DNA, 22 bp, Homo sapiens
ctcacatgagatctgtacatcc

SEQ ID NO: 7250808 - DNA, 20 bp, Homo sapiens
agtggggagtcaggagtgcc

SEQ ID NO: 7250809 - DNA, 22 bp, Homo sapiens
agtgggtgagcttggtctagat

SEQ ID NO: 7250810 - DNA, 22 bp, Homo sapiens
agtggcctggagccccgcctgg

SEQ ID NO: 7250811 - DNA, 22 bp, Homo sapiens
ctctggagtgtctggccagggt

SEQ ID NO: 7250812 - DNA, 22 bp, Homo sapiens
ctctggagttcccttgatctga

SEQ ID NO: 7250813 - DNA, 22 bp, Homo sapiens
ctctggagttagtgatctgggc

SEQ ID NO: 7250814 - DNA, 22 bp, Homo sapiens
ctctggagtgggtggccgggag

SEQ ID NO: 7250815 - DNA, 20 bp, Homo sapiens
ctctggagttggggaacatt

SEQ ID NO: 7250816 - DNA, 22 bp, Homo sapiens
ctctggagttcttcaagctact

SEQ ID NO: 7250817 - DNA, 22 bp, Homo sapiens
ctctggagttctcatgaggaac

SEQ ID NO: 7250818 - DNA, 22 bp, Homo sapiens
ctctggagttctcatgaggaac

SEQ ID NO: 7250819 - DNA, 22 bp, Homo sapiens
agtgggtgggtgtctgacagtt

SEQ ID NO: 7250820 - DNA, 20 bp, Homo sapiens
agtgggtgatgaaggaatag

SEQ ID NO: 7250821 - DNA, 22 bp, Homo sapiens
agtgggtgcaaccatggctagg

SEQ ID NO: 7250822 - DNA, 19 bp, Homo sapiens
agtggtagatgagcaggag

SEQ ID NO: 7250823 - DNA, 22 bp, Homo sapiens
agtgtcctagcaagccggtcct

SEQ ID NO: 7250824 - DNA, 22 bp, Homo sapiens
agtgtgagtaattcagggaggg

SEQ ID NO: 7250825 - DNA, 22 bp, Homo sapiens
agtgtgagcctacaggccaaag

SEQ ID NO: 7250826 - DNA, 21 bp, Homo sapiens
ctctggagtttgaaggctggg

SEQ ID NO: 7250827 - DNA, 22 bp, Homo sapiens
agtgtggagccactgagtggct

SEQ ID NO: 7250828 - DNA, 17 bp, Homo sapiens
agtgtttccttatcatt

SEQ ID NO: 7250829 - DNA, 22 bp, Homo sapiens
ctgagccagcgggctcactttt

SEQ ID NO: 7250830 - DNA, 22 bp, Homo sapiens
agttcccaaattacaggccaca

SEQ ID NO: 7250831 - DNA, 19 bp, Homo sapiens
agttatttctaaatttacc

SEQ ID NO: 7250832 - DNA, 22 bp, Homo sapiens
agtaggaggcgggagcatgaag

SEQ ID NO: 7250833 - DNA, 22 bp, Homo sapiens
agtagaataattggattacagt

SEQ ID NO: 7250834 - DNA, 22 bp, Homo sapiens
agtagatttttgaatgtaagtt

SEQ ID NO: 7250835 - DNA, 19 bp, Homo sapiens
agtagcagaaagtgcagtg

SEQ ID NO: 7250836 - DNA, 22 bp, Homo sapiens
agtagaaatgtaagaaggatta

SEQ ID NO: 7250837 - DNA, 22 bp, Homo sapiens
agtagaaatgtagtgtagagaa

SEQ ID NO: 7250838 - DNA, 22 bp, Homo sapiens
ccttccaggtgcaggcaagcct

SEQ ID NO: 7250839 - DNA, 22 bp, Homo sapiens
ccttccagggctctccagaacc

SEQ ID NO: 7250840 - DNA, 21 bp, Homo sapiens
ccttctccattacagtaagct

SEQ ID NO: 7250841 - DNA, 22 bp, Homo sapiens
agtaaaaattgaggtgcaaaat

SEQ ID NO: 7250842 - DNA, 22 bp, Homo sapiens
agtcctgggtccagcaggtcct

SEQ ID NO: 7250843 - DNA, 22 bp, Homo sapiens
ctatgacacaggccattatata

SEQ ID NO: 7250844 - DNA, 22 bp, Homo sapiens
ctatgaaatgtcagattctgca

SEQ ID NO: 7250845 - DNA, 22 bp, Homo sapiens
ctatgaaaggatttggagttgt

SEQ ID NO: 7250846 - DNA, 22 bp, Homo sapiens
ctatcttggtccagtctacacc

SEQ ID NO: 7250847 - DNA, 22 bp, Homo sapiens
ctatcttttgttcattttgagt

SEQ ID NO: 7250848 - DNA, 22 bp, Homo sapiens
ctagtctgcagcggggaggggt

SEQ ID NO: 7250849 - DNA, 22 bp, Homo sapiens
ctatatcatcattacctgcacc

SEQ ID NO: 7250850 - DNA, 22 bp, Homo sapiens
agtcagcagcctggccaggaga

SEQ ID NO: 7250851 - DNA, 22 bp, Homo sapiens
agtcagcagtgaaagcacagcc

SEQ ID NO: 7250852 - DNA, 22 bp, Homo sapiens
agtcaggagctgctgcattgta

SEQ ID NO: 7250853 - DNA, 22 bp, Homo sapiens
agtcaggatatgccttgtgggc

SEQ ID NO: 7250854 - DNA, 22 bp, Homo sapiens
agtcacatagtgttttggaatc

SEQ ID NO: 7250855 - DNA, 22 bp, Homo sapiens
agtcacatcgattataaaattt

SEQ ID NO: 7250856 - DNA, 22 bp, Homo sapiens
ctagctttttatgacaatcttg

SEQ ID NO: 7250857 - DNA, 22 bp, Homo sapiens
ctaggaatcaccaagattctag

SEQ ID NO: 7250858 - DNA, 22 bp, Homo sapiens
ctaggaatccttttagagttgg

SEQ ID NO: 7250859 - DNA, 22 bp, Homo sapiens
ctaggaggcgggggctgcagta

SEQ ID NO: 7250860 - DNA, 21 bp, Homo sapiens
ctaggaggcccagaagacctc

SEQ ID NO: 7250861 - DNA, 22 bp, Homo sapiens
aggtcagctgctgataggcagc

SEQ ID NO: 7250862 - DNA, 22 bp, Homo sapiens
cctgggaggctgaggctgcagt

SEQ ID NO: 7250863 - DNA, 22 bp, Homo sapiens
cctgggagaactgctgggttgg

SEQ ID NO: 7250864 - DNA, 22 bp, Homo sapiens
cctgggaggtggaggttgcagc

SEQ ID NO: 7250865 - DNA, 22 bp, Homo sapiens
cctgggagggcaagtgctgatg

SEQ ID NO: 7250866 - DNA, 22 bp, Homo sapiens
cctgggaggctgtgggtctgct

SEQ ID NO: 7250867 - DNA, 22 bp, Homo sapiens
agggttgcttgagcccaggagt

SEQ ID NO: 7250868 - DNA, 22 bp, Homo sapiens
agggttgcttgagcccaggagt

SEQ ID NO: 7250869 - DNA, 21 bp, Homo sapiens
agggttttatagatctcttcc

SEQ ID NO: 7250870 - DNA, 22 bp, Homo sapiens
agggttttcatttctgagcatt

SEQ ID NO: 7250871 - DNA, 22 bp, Homo sapiens
agggttttggctgaagttcagc

SEQ ID NO: 7250872 - DNA, 22 bp, Homo sapiens
agggttttgtgaggctcaaact

SEQ ID NO: 7250873 - DNA, 22 bp, Homo sapiens
agggttttgtttcttgaagcac

SEQ ID NO: 7250874 - DNA, 22 bp, Homo sapiens
agggttgcagcagaggcccagt

SEQ ID NO: 7250875 - DNA, 22 bp, Homo sapiens
agggttgcaccatgttggtcag

SEQ ID NO: 7250876 - DNA, 22 bp, Homo sapiens
agggttgcagcagaggcccagt

SEQ ID NO: 7250877 - DNA, 22 bp, Homo sapiens
agggttgcaggggccatgccca

SEQ ID NO: 7250878 - DNA, 22 bp, Homo sapiens
agggttgcaggggccatgccca

SEQ ID NO: 7250879 - DNA, 22 bp, Homo sapiens
agggttgcatttttagaggctc

SEQ ID NO: 7250880 - DNA, 22 bp, Homo sapiens
agggttgcctctgagtgctccg

SEQ ID NO: 7250881 - DNA, 22 bp, Homo sapiens
agggtgggctagactcttcccc

SEQ ID NO: 7250882 - DNA, 22 bp, Homo sapiens
aggtaacatgtggtgctataag

SEQ ID NO: 7250883 - DNA, 22 bp, Homo sapiens
aggtaagggctgcgactataag

SEQ ID NO: 7250884 - DNA, 22 bp, Homo sapiens
aggtaaggctgtaagctaagcc

SEQ ID NO: 7250885 - DNA, 22 bp, Homo sapiens
aggtacaaaagagtatatgaga

SEQ ID NO: 7250886 - DNA, 22 bp, Homo sapiens
aggtaatagggttcagaattat

SEQ ID NO: 7250887 - DNA, 22 bp, Homo sapiens
cctggggctccagagcagcgga

SEQ ID NO: 7250888 - DNA, 22 bp, Homo sapiens
cctgggctttgagggcaggatg

SEQ ID NO: 7250889 - DNA, 22 bp, Homo sapiens
cctgggggccaggaaggtgtga

SEQ ID NO: 7250890 - DNA, 22 bp, Homo sapiens
cctggggctctgcacagagcag

SEQ ID NO: 7250891 - DNA, 22 bp, Homo sapiens
cctggggctttctttgtatcat

SEQ ID NO: 7250892 - DNA, 17 bp, Homo sapiens
aggtgcagaggcagagc

SEQ ID NO: 7250893 - DNA, 17 bp, Homo sapiens
aggtgcagaggcagagc

SEQ ID NO: 7250894 - DNA, 17 bp, Homo sapiens
aggtgcagaggcagagc

SEQ ID NO: 7250895 - DNA, 22 bp, Homo sapiens
aggtgcagctggtggagtctgg

SEQ ID NO: 7250896 - DNA, 22 bp, Homo sapiens
aggtgcaggagctgtgcaggga

SEQ ID NO: 7250897 - DNA, 22 bp, Homo sapiens
aggtgcagctggtggagtctgg

SEQ ID NO: 7250898 - DNA, 22 bp, Homo sapiens
aggtgcagctgacaccatgtgg

SEQ ID NO: 7250899 - DNA, 22 bp, Homo sapiens
aggtgcagcatgagtccaacgg

SEQ ID NO: 7250900 - DNA, 22 bp, Homo sapiens
cctgtgggccctggacagagac

SEQ ID NO: 7250901 - DNA, 22 bp, Homo sapiens
cctgtgggccaaggacctgcca

SEQ ID NO: 7250902 - DNA, 22 bp, Homo sapiens
cctgtgggctgagaacaagggc

SEQ ID NO: 7250903 - DNA, 22 bp, Homo sapiens
cctgtgggcctgcacgtgggga

SEQ ID NO: 7250904 - DNA, 22 bp, Homo sapiens
cctgtgggcgcagctggagtca

SEQ ID NO: 7250905 - DNA, 22 bp, Homo sapiens
cctgtgggcctgcacgtgggga

SEQ ID NO: 7250906 - DNA, 22 bp, Homo sapiens
cctgtgggagggagcggctgga

SEQ ID NO: 7250907 - DNA, 22 bp, Homo sapiens
cctgtgggagcccaggcagata

SEQ ID NO: 7250908 - DNA, 22 bp, Homo sapiens
cctgtgggaggggcctggcgcg

SEQ ID NO: 7250909 - DNA, 23 bp, Homo sapiens
cctgtgggatggcttaatatttt

SEQ ID NO: 7250910 - DNA, 22 bp, Homo sapiens
cctgtgggaggttctgtgagtc

SEQ ID NO: 7250911 - DNA, 22 bp, Homo sapiens
cctgtggggccatctcagtcac

SEQ ID NO: 7250912 - DNA, 22 bp, Homo sapiens
cctgtggggagagatctcttag

SEQ ID NO: 7250913 - DNA, 22 bp, Homo sapiens
cctgtgggcttgagtgtagggt

SEQ ID NO: 7250914 - DNA, 22 bp, Homo sapiens
cctgtgggtacaacagggtcac

SEQ ID NO: 7250915 - DNA, 22 bp, Homo sapiens
cctgtggggctgaaagaggctt

SEQ ID NO: 7250916 - DNA, 19 bp, Homo sapiens
ccttccagaactaaattaa

SEQ ID NO: 7250917 - DNA, 22 bp, Homo sapiens
aggtggcagcagaatcagggag

SEQ ID NO: 7250918 - DNA, 21 bp, Homo sapiens
aggcaggattcaaacacagag

SEQ ID NO: 7250919 - DNA, 22 bp, Homo sapiens
ccaaaattaagcctcttatgtt

SEQ ID NO: 7250920 - DNA, 22 bp, Homo sapiens
ccaaaattattacatttgtagg

SEQ ID NO: 7250921 - DNA, 22 bp, Homo sapiens
aggcaggctcaggcccatgctt

SEQ ID NO: 7250922 - DNA, 22 bp, Homo sapiens
aggcaggctcaatgcccagtct

SEQ ID NO: 7250923 - DNA, 22 bp, Homo sapiens
aggcaggctagtcgcttgagcc

SEQ ID NO: 7250924 - DNA, 22 bp, Homo sapiens
aggcaggccctctggaaaggta

SEQ ID NO: 7250925 - DNA, 22 bp, Homo sapiens
aggcagagctgggttttgaaat

SEQ ID NO: 7250926 - DNA, 22 bp, Homo sapiens
aggcagaggaagggtggatttg

SEQ ID NO: 7250927 - DNA, 22 bp, Homo sapiens
aggcagaggagaatgatcttcc

SEQ ID NO: 7250928 - DNA, 19 bp, Homo sapiens
aggcagaggcttggctagc

SEQ ID NO: 7250929 - DNA, 22 bp, Homo sapiens
aggcagagctgatgttctgtga

SEQ ID NO: 7250930 - DNA, 22 bp, Homo sapiens
aggcagagctaggaagaattgt

SEQ ID NO: 7250931 - DNA, 20 bp, Homo sapiens
aggcagagcgcacttttaga

SEQ ID NO: 7250932 - DNA, 22 bp, Homo sapiens
aggcacaggtggacttcacagt

SEQ ID NO: 7250933 - DNA, 22 bp, Homo sapiens
aggcagagagcagtggccgtct

SEQ ID NO: 7250934 - DNA, 23 bp, Homo sapiens
aggcagagccaaggtcaaaaccc

SEQ ID NO: 7250935 - DNA, 16 bp, Homo sapiens
aggcagagatttaccc

SEQ ID NO: 7250936 - DNA, 22 bp, Homo sapiens
aggcagagagcagtggccgtct

SEQ ID NO: 7250937 - DNA, 22 bp, Homo sapiens
aggatgaataactgaaatggtg

SEQ ID NO: 7250938 - DNA, 22 bp, Homo sapiens
aggatgaataactgaaatggtg

SEQ ID NO: 7250939 - DNA, 22 bp, Homo sapiens
aggatgaatatttagtgggata

SEQ ID NO: 7250940 - DNA, 22 bp, Homo sapiens
aggatgaatatttagtgggata

SEQ ID NO: 7250941 - DNA, 22 bp, Homo sapiens
aggatcagtgaatactcagggt

SEQ ID NO: 7250942 - DNA, 22 bp, Homo sapiens
aggagtgttcagcgtggggatg

SEQ ID NO: 7250943 - DNA, 23 bp, Homo sapiens
aggagttgagggttgggttggca

SEQ ID NO: 7250944 - DNA, 22 bp, Homo sapiens
aggataaaggtcattattccca

SEQ ID NO: 7250945 - DNA, 23 bp, Homo sapiens
aggataaactaaactcattttgg

SEQ ID NO: 7250946 - DNA, 17 bp, Homo sapiens
aggagctgggggtggtg

SEQ ID NO: 7250947 - DNA, 22 bp, Homo sapiens
cagtggaagctggctgtgaaga

SEQ ID NO: 7250948 - DNA, 22 bp, Homo sapiens
cagtggaatatataggggattt

SEQ ID NO: 7250949 - DNA, 23 bp, Homo sapiens
cagtggagactcatgcttcctta

SEQ ID NO: 7250950 - DNA, 22 bp, Homo sapiens
cagtggagagacttttactctt

SEQ ID NO: 7250951 - DNA, 22 bp, Homo sapiens
aggagccaaggaaaacagtatt

SEQ ID NO: 7250952 - DNA, 22 bp, Homo sapiens
cagtggaaactatgctgctgga

SEQ ID NO: 7250953 - DNA, 22 bp, Homo sapiens
cagtggaaatcagagtgagagt

SEQ ID NO: 7250954 - DNA, 22 bp, Homo sapiens
aggagcagcccactcctgtcct

SEQ ID NO: 7250955 - DNA, 22 bp, Homo sapiens
aggagcagcccactcctgtcct

SEQ ID NO: 7250956 - DNA, 22 bp, Homo sapiens
cagtgcaggctgggggccctgc

SEQ ID NO: 7250957 - DNA, 23 bp, Homo sapiens
cagtgcagggcaactcagactcc

SEQ ID NO: 7250958 - DNA, 22 bp, Homo sapiens
cagtgagggcattcagtgctgg

SEQ ID NO: 7250959 - DNA, 22 bp, Homo sapiens
cagtgcagccaaggacaggcac

SEQ ID NO: 7250960 - DNA, 22 bp, Homo sapiens
cagtgaggctctgctgagcggt

SEQ ID NO: 7250961 - DNA, 22 bp, Homo sapiens
cagtctcttttcagctccatcc

SEQ ID NO: 7250962 - DNA, 22 bp, Homo sapiens
catcagaatgttagagaaggga

SEQ ID NO: 7250963 - DNA, 22 bp, Homo sapiens
aggaggctgcaaccctgaggcc

SEQ ID NO: 7250964 - DNA, 22 bp, Homo sapiens
aggaggctgggcacagtggcct

SEQ ID NO: 7250965 - DNA, 22 bp, Homo sapiens
aggaggctgggcacagtggcct

SEQ ID NO: 7250966 - DNA, 23 bp, Homo sapiens
catcagaggttgccactccctgg

SEQ ID NO: 7250967 - DNA, 22 bp, Homo sapiens
aggaggctgcaaccctgaggcc

SEQ ID NO: 7250968 - DNA, 22 bp, Homo sapiens
cagttccttgagaatggttgct

SEQ ID NO: 7250969 - DNA, 22 bp, Homo sapiens
cagttataggagccattgtata

SEQ ID NO: 7250970 - DNA, 20 bp, Homo sapiens
catcattttaaaatctctcc

SEQ ID NO: 7250971 - DNA, 22 bp, Homo sapiens
aggagtgggggcgagaagttaa

SEQ ID NO: 7250972 - DNA, 22 bp, Homo sapiens
aggagtggtgcaggacctgcca

SEQ ID NO: 7250973 - DNA, 22 bp, Homo sapiens
aggagtgttcagcgtggggatg

SEQ ID NO: 7250974 - DNA, 22 bp, Homo sapiens
aggaggtgttgatagaaggttt

SEQ ID NO: 7250975 - DNA, 22 bp, Homo sapiens
aggagtggaattactgggttct

SEQ ID NO: 7250976 - DNA, 22 bp, Homo sapiens
aggagtgggggcgagaagttaa

SEQ ID NO: 7250977 - DNA, 22 bp, Homo sapiens
aggaggctggttcaggccatat

SEQ ID NO: 7250978 - DNA, 22 bp, Homo sapiens
aggaggctggttcaggccatat

SEQ ID NO: 7250979 - DNA, 22 bp, Homo sapiens
aggaggctggttcaggccatat

SEQ ID NO: 7250980 - DNA, 22 bp, Homo sapiens
aggaggggcaatgatagtctgg

SEQ ID NO: 7250981 - DNA, 22 bp, Homo sapiens
aggaggggcaatgatagtctgg

SEQ ID NO: 7250982 - DNA, 22 bp, Homo sapiens
aggaggggcatagaaatgtaat

SEQ ID NO: 7250983 - DNA, 22 bp, Homo sapiens
aggagggtggcctcatgtgagt

SEQ ID NO: 7250984 - DNA, 22 bp, Homo sapiens
aggagggtgggaagcagtttta

SEQ ID NO: 7250985 - DNA, 22 bp, Homo sapiens
aggagggtggggtctgcctgtc

SEQ ID NO: 7250986 - DNA, 22 bp, Homo sapiens
aggagggttctctggacagagg

SEQ ID NO: 7250987 - DNA, 22 bp, Homo sapiens
aggagggttgaggaggatactt

SEQ ID NO: 7250988 - DNA, 20 bp, Homo sapiens
aggagggtttctctgacaca

SEQ ID NO: 7250989 - DNA, 22 bp, Homo sapiens
aggaggtgagcggtcatgtggt

SEQ ID NO: 7250990 - DNA, 22 bp, Homo sapiens
caggtcctcgggggaggccggc

SEQ ID NO: 7250991 - DNA, 22 bp, Homo sapiens
aggaaggtgcagtagggtgtgc

SEQ ID NO: 7250992 - DNA, 22 bp, Homo sapiens
aggaaggtaatgaactgaggag

SEQ ID NO: 7250993 - DNA, 22 bp, Homo sapiens
aggaagggttctttgtgaaaga

SEQ ID NO: 7250994 - DNA, 22 bp, Homo sapiens
aggaagggctgtttctccaaga

SEQ ID NO: 7250995 - DNA, 20 bp, Homo sapiens
aggaaggagaatctgagcaa

SEQ ID NO: 7250996 - DNA, 22 bp, Homo sapiens
aggaaggggagaagttaaagct

SEQ ID NO: 7250997 - DNA, 22 bp, Homo sapiens
aggaagggttctttctgtttat

SEQ ID NO: 7250998 - DNA, 22 bp, Homo sapiens
aggaagggttctttgtgaaaga

SEQ ID NO: 7250999 - DNA, 22 bp, Homo sapiens
aggaagggtgtcatgagccctt

SEQ ID NO: 7251000 - DNA, 22 bp, Homo sapiens
aggaagggtggatagtaacgtg

SEQ ID NO: 7251001 - DNA, 22 bp, Homo sapiens
cagggtttcaccatgttagcag

SEQ ID NO: 7251002 - DNA, 22 bp, Homo sapiens
cagggtgtgaacagtgtaaaac

SEQ ID NO: 7251003 - DNA, 22 bp, Homo sapiens
cagggtgtatagtgtagaagtt

SEQ ID NO: 7251004 - DNA, 22 bp, Homo sapiens
cagggtggtgaatagctatagt

SEQ ID NO: 7251005 - DNA, 22 bp, Homo sapiens
cagggtggtaccagcatctagt

SEQ ID NO: 7251006 - DNA, 22 bp, Homo sapiens
cagggtgctgcaccatccctca

SEQ ID NO: 7251007 - DNA, 22 bp, Homo sapiens
cagggtgcttagaaatggacct

SEQ ID NO: 7251008 - DNA, 22 bp, Homo sapiens
cagggtggggctggctatcaaa

SEQ ID NO: 7251009 - DNA, 22 bp, Homo sapiens
cagggtggggctggctatcaaa

SEQ ID NO: 7251010 - DNA, 22 bp, Homo sapiens
aggaaaatgaaacagcaactgt

SEQ ID NO: 7251011 - DNA, 22 bp, Homo sapiens
aggaaaatcgagtctggaggca

SEQ ID NO: 7251012 - DNA, 20 bp, Homo sapiens
aggaaaagggtggtggtaga

SEQ ID NO: 7251013 - DNA, 22 bp, Homo sapiens
cagggacattggtggccaggtt

SEQ ID NO: 7251014 - DNA, 22 bp, Homo sapiens
cagggacatttccaagagaatt

SEQ ID NO: 7251015 - DNA, 22 bp, Homo sapiens
cagggacagcgggactctgaca

SEQ ID NO: 7251016 - DNA, 22 bp, Homo sapiens
cagggacaggggagaaaagatg

SEQ ID NO: 7251017 - DNA, 19 bp, Homo sapiens
agctggggcggtgtgtgtt

SEQ ID NO: 7251018 - DNA, 22 bp, Homo sapiens
agctggagatcatgctgatact

SEQ ID NO: 7251019 - DNA, 22 bp, Homo sapiens
agctggagcttcaagcaggtaa

SEQ ID NO: 7251020 - DNA, 22 bp, Homo sapiens
agctggagccagtgtgaggctt

SEQ ID NO: 7251021 - DNA, 22 bp, Homo sapiens
agctgggctggagctccaagcg

SEQ ID NO: 7251022 - DNA, 22 bp, Homo sapiens
agctgggctgatgactcatgtt

SEQ ID NO: 7251023 - DNA, 22 bp, Homo sapiens
agctgggctccaagagggatct

SEQ ID NO: 7251024 - DNA, 22 bp, Homo sapiens
agctgggcgcagtggctggtga

SEQ ID NO: 7251025 - DNA, 22 bp, Homo sapiens
agctgggcctgagctggaagct

SEQ ID NO: 7251026 - DNA, 22 bp, Homo sapiens
agctgggcctgatttgcagggg

SEQ ID NO: 7251027 - DNA, 22 bp, Homo sapiens
agctggaggataactcacttct

SEQ ID NO: 7251028 - DNA, 22 bp, Homo sapiens
agctgggcaccccgctgcgtct

SEQ ID NO: 7251029 - DNA, 22 bp, Homo sapiens
agctgggactcaactgtctggg

SEQ ID NO: 7251030 - DNA, 23 bp, Homo sapiens
agctgggccaggtggtcagacct

SEQ ID NO: 7251031 - DNA, 21 bp, Homo sapiens
agctgggcctcagcctgcagt

SEQ ID NO: 7251032 - DNA, 22 bp, Homo sapiens
agctgggcagtgcttggattca

SEQ ID NO: 7251033 - DNA, 22 bp, Homo sapiens
agctgggcagactgcagtggtt

SEQ ID NO: 7251034 - DNA, 22 bp, Homo sapiens
agctgggcagactgcagtggtt

SEQ ID NO: 7251035 - DNA, 22 bp, Homo sapiens
agctcttttgtgagcatttggc

SEQ ID NO: 7251036 - DNA, 22 bp, Homo sapiens
agctcttttgctctccaagttt

SEQ ID NO: 7251037 - DNA, 22 bp, Homo sapiens
agctcttttatcatgaggagag

SEQ ID NO: 7251038 - DNA, 22 bp, Homo sapiens
agctcttttgattctccctgtc

SEQ ID NO: 7251039 - DNA, 20 bp, Homo sapiens
agctctttttagctaaggta

SEQ ID NO: 7251040 - DNA, 22 bp, Homo sapiens
agctgaagaaatgggaagcatt

SEQ ID NO: 7251041 - DNA, 22 bp, Homo sapiens
caggaacccccactctcagctc

SEQ ID NO: 7251042 - DNA, 22 bp, Homo sapiens
caggaaccagaaccttcccccg

SEQ ID NO: 7251043 - DNA, 22 bp, Homo sapiens
agctgcccccagggctgtgctt

SEQ ID NO: 7251044 - DNA, 22 bp, Homo sapiens
agctgccctcgctggggccaga

SEQ ID NO: 7251045 - DNA, 20 bp, Homo sapiens
agctgcccctgggcactgcc

SEQ ID NO: 7251046 - DNA, 22 bp, Homo sapiens
agctgccctggcggagctgctc

SEQ ID NO: 7251047 - DNA, 22 bp, Homo sapiens
agctgcccttaataggcattca

SEQ ID NO: 7251048 - DNA, 22 bp, Homo sapiens
agctgcccttctcttgcccttg

SEQ ID NO: 7251049 - DNA, 22 bp, Homo sapiens
aggcggtgtgctttgcagagca

SEQ ID NO: 7251050 - DNA, 22 bp, Homo sapiens
aggcgtgggaggatctgaggcc

SEQ ID NO: 7251051 - DNA, 22 bp, Homo sapiens
aggcggctggtgtcctgcaggt

SEQ ID NO: 7251052 - DNA, 19 bp, Homo sapiens
aggcggctcgcgcgcctcc

SEQ ID NO: 7251053 - DNA, 22 bp, Homo sapiens
aggcgctgtgcttggggctgga

SEQ ID NO: 7251054 - DNA, 22 bp, Homo sapiens
ccaggaaggtgtttaactagag

SEQ ID NO: 7251055 - DNA, 17 bp, Homo sapiens
aggcctctgccggtgcc

SEQ ID NO: 7251056 - DNA, 22 bp, Homo sapiens
aggcctctgctggaaagagttg

SEQ ID NO: 7251057 - DNA, 22 bp, Homo sapiens
aggcctctggaggtggcagtgt

SEQ ID NO: 7251058 - DNA, 22 bp, Homo sapiens
aggcctctgggtctcctctgac

SEQ ID NO: 7251059 - DNA, 22 bp, Homo sapiens
ccagcaggagatgcctgtgtct

SEQ ID NO: 7251060 - DNA, 23 bp, Homo sapiens
ccagctccgtgagcctcgggctc

SEQ ID NO: 7251061 - DNA, 22 bp, Homo sapiens
ccagcaggagactagcaacata

SEQ ID NO: 7251062 - DNA, 22 bp, Homo sapiens
ccagaccctttcttggcatgtg

SEQ ID NO: 7251063 - DNA, 22 bp, Homo sapiens
ccagaccctgctctggggctct

SEQ ID NO: 7251064 - DNA, 22 bp, Homo sapiens
aggccacaagaaaatgcttcat

SEQ ID NO: 7251065 - DNA, 22 bp, Homo sapiens
aggccacagtcagtgggtgctg

SEQ ID NO: 7251066 - DNA, 22 bp, Homo sapiens
aggccacagtactttgcagacc

SEQ ID NO: 7251067 - DNA, 22 bp, Homo sapiens
aggccacagtactttgcagacc

SEQ ID NO: 7251068 - DNA, 21 bp, Homo sapiens
ccagagcctgctgagccccct

SEQ ID NO: 7251069 - DNA, 22 bp, Homo sapiens
ccagagcctggcatctgcataa

SEQ ID NO: 7251070 - DNA, 22 bp, Homo sapiens
aggccacagttgaggccagcaa

SEQ ID NO: 7251071 - DNA, 22 bp, Homo sapiens
ccagagcctggcatctgcataa

SEQ ID NO: 7251072 - DNA, 22 bp, Homo sapiens
aggcccagactcagcggggcgg

SEQ ID NO: 7251073 - DNA, 22 bp, Homo sapiens
aggccaggcaacattctgaagt

SEQ ID NO: 7251074 - DNA, 22 bp, Homo sapiens
aggccaggttcctcaatcttga

SEQ ID NO: 7251075 - DNA, 22 bp, Homo sapiens
ccaggctgctgttggtgtccgc

SEQ ID NO: 7251076 - DNA, 22 bp, Homo sapiens
aggcgtgggaggatctgaggcc

SEQ ID NO: 7251077 - DNA, 22 bp, Homo sapiens
aggcggtgtgctttgcagagca

SEQ ID NO: 7251078 - DNA, 22 bp, Homo sapiens
aggcgtggttgaggcgagcata

SEQ ID NO: 7251079 - DNA, 22 bp, Homo sapiens
ccagggctcaggctcccagtgg

SEQ ID NO: 7251080 - DNA, 22 bp, Homo sapiens
ccagggctccattgctcatcct

SEQ ID NO: 7251081 - DNA, 19 bp, Homo sapiens
ccagggctccaagctgagt

SEQ ID NO: 7251082 - DNA, 22 bp, Homo sapiens
aggctgaggatcgtactttcca

SEQ ID NO: 7251083 - DNA, 22 bp, Homo sapiens
ccagggctggtggctgcagagg

SEQ ID NO: 7251084 - DNA, 22 bp, Homo sapiens
ccagggctggtggctgcagagg

SEQ ID NO: 7251085 - DNA, 20 bp, Homo sapiens
ccagggctggctcctgggat

SEQ ID NO: 7251086 - DNA, 22 bp, Homo sapiens
aggctgaggcaagaggatcact

SEQ ID NO: 7251087 - DNA, 22 bp, Homo sapiens
aggctgaggcaggtggatcacc

SEQ ID NO: 7251088 - DNA, 20 bp, Homo sapiens
aggctggggtgttttgccca

SEQ ID NO: 7251089 - DNA, 22 bp, Homo sapiens
aggctgggtacctgtcatatgc

SEQ ID NO: 7251090 - DNA, 22 bp, Homo sapiens
aggctgggcaccgttttgatcc

SEQ ID NO: 7251091 - DNA, 22 bp, Homo sapiens
aggctgggctccgcccaactcc

SEQ ID NO: 7251092 - DNA, 22 bp, Homo sapiens
aggctggggaattgaatttgct

SEQ ID NO: 7251093 - DNA, 22 bp, Homo sapiens
aggctgggctccgcccaactcc

SEQ ID NO: 7251094 - DNA, 22 bp, Homo sapiens
aggctgggaaggtaaagttgta

SEQ ID NO: 7251095 - DNA, 22 bp, Homo sapiens
aggctggccctactggctgcct

SEQ ID NO: 7251096 - DNA, 22 bp, Homo sapiens
aggctggagtgctggagtgctg

SEQ ID NO: 7251097 - DNA, 22 bp, Homo sapiens
aggctggagtgtagcagtgcag

SEQ ID NO: 7251098 - DNA, 22 bp, Homo sapiens
aggctggaggtttgttgcggct

SEQ ID NO: 7251099 - DNA, 22 bp, Homo sapiens
aggctggaaagggaccagagtg

SEQ ID NO: 7251100 - DNA, 22 bp, Homo sapiens
aggctgctttattcacaatagc

SEQ ID NO: 7251101 - DNA, 22 bp, Homo sapiens
ccctagggtttggccagagccc

SEQ ID NO: 7251102 - DNA, 22 bp, Homo sapiens
ccctaggggcaatgatggtgct

SEQ ID NO: 7251103 - DNA, 22 bp, Homo sapiens
ccctagggctaagcaggactgc

SEQ ID NO: 7251104 - DNA, 22 bp, Homo sapiens
ccccagcactctgactcttacc

SEQ ID NO: 7251105 - DNA, 22 bp, Homo sapiens
ccccagcactaccagaagccag

SEQ ID NO: 7251106 - DNA, 22 bp, Homo sapiens
ccccagcacaggctcctcagat

SEQ ID NO: 7251107 - DNA, 21 bp, Homo sapiens
ccccagcaccttgccagcctg

SEQ ID NO: 7251108 - DNA, 22 bp, Homo sapiens
ccccagcacttggagtggggag

SEQ ID NO: 7251109 - DNA, 22 bp, Homo sapiens
ccccttccacagtgcttcctaa

SEQ ID NO: 7251110 - DNA, 22 bp, Homo sapiens
ccccagagaaagtcagcagcat

SEQ ID NO: 7251111 - DNA, 22 bp, Homo sapiens
ccccagaagtttgcacaagaga

SEQ ID NO: 7251112 - DNA, 22 bp, Homo sapiens
cccatgtgtgacagtccatttg

SEQ ID NO: 7251113 - DNA, 22 bp, Homo sapiens
cccatggggacaccatgaagga

SEQ ID NO: 7251114 - DNA, 23 bp, Homo sapiens
ccctgcccattgagcaggacgtc

SEQ ID NO: 7251115 - DNA, 22 bp, Homo sapiens
ccctgcccatcggggcggcctg

SEQ ID NO: 7251116 - DNA, 22 bp, Homo sapiens
ccctgcccaccacatgctggga

SEQ ID NO: 7251117 - DNA, 18 bp, Homo sapiens
ccctgccagctcccagca

SEQ ID NO: 7251118 - DNA, 22 bp, Homo sapiens
ccctgccagggtcctgacagac

SEQ ID NO: 7251119 - DNA, 22 bp, Homo sapiens
cccatcaggaacccaggagccc

SEQ ID NO: 7251120 - DNA, 22 bp, Homo sapiens
aggctgggtacctgtcatatgc

SEQ ID NO: 7251121 - DNA, 22 bp, Homo sapiens
aggctgtcatctttgcaggcag

SEQ ID NO: 7251122 - DNA, 20 bp, Homo sapiens
aggctgtcatttctggcagg

SEQ ID NO: 7251123 - DNA, 22 bp, Homo sapiens
aggctgtcctctcttgctcagt

SEQ ID NO: 7251124 - DNA, 22 bp, Homo sapiens
aggctgtccaaggtggcgaagt

SEQ ID NO: 7251125 - DNA, 21 bp, Homo sapiens
aggctgtcctttgccagccct

SEQ ID NO: 7251126 - DNA, 22 bp, Homo sapiens
aggctgtctgaccccagagccc

SEQ ID NO: 7251127 - DNA, 22 bp, Homo sapiens
aggctgtctcacctcaggaggg

SEQ ID NO: 7251128 - DNA, 22 bp, Homo sapiens
aggctgtctcagcctgcttgca

SEQ ID NO: 7251129 - DNA, 22 bp, Homo sapiens
cccaggagatgcactccattgg

SEQ ID NO: 7251130 - DNA, 22 bp, Homo sapiens
aggggaggagcttttcttgcct

SEQ ID NO: 7251131 - DNA, 22 bp, Homo sapiens
aggggaggagcttttcttgcct

SEQ ID NO: 7251132 - DNA, 22 bp, Homo sapiens
aggggaggcagcgataaacctg

SEQ ID NO: 7251133 - DNA, 22 bp, Homo sapiens
aggggaggcagcgataaacctg

SEQ ID NO: 7251134 - DNA, 22 bp, Homo sapiens
aggggatgcctagtggagtctc

SEQ ID NO: 7251135 - DNA, 22 bp, Homo sapiens
aggggaggtgtccccaaatctc

SEQ ID NO: 7251136 - DNA, 22 bp, Homo sapiens
aggggaggtgtccccaaatctc

SEQ ID NO: 7251137 - DNA, 23 bp, Homo sapiens
aggggcagcaagttttggtgtta

SEQ ID NO: 7251138 - DNA, 22 bp, Homo sapiens
cctcttccactgggccccatcc

SEQ ID NO: 7251139 - DNA, 22 bp, Homo sapiens
aggggcagcctcacaatcctct

SEQ ID NO: 7251140 - DNA, 22 bp, Homo sapiens
aggggatggagctggaaggcag

SEQ ID NO: 7251141 - DNA, 20 bp, Homo sapiens
aggggcacctgcgacggggc

SEQ ID NO: 7251142 - DNA, 22 bp, Homo sapiens
aggggatgcctgaggatctgta

SEQ ID NO: 7251143 - DNA, 22 bp, Homo sapiens
aggggtgaaggcccgataggag

SEQ ID NO: 7251144 - DNA, 22 bp, Homo sapiens
agggtagggcccggagacagac

SEQ ID NO: 7251145 - DNA, 22 bp, Homo sapiens
agggtagggcccggagacagac

SEQ ID NO: 7251146 - DNA, 22 bp, Homo sapiens
agggtatgttttaggctgagtt

SEQ ID NO: 7251147 - DNA, 22 bp, Homo sapiens
agggtagggccgtagggccatg

SEQ ID NO: 7251148 - DNA, 22 bp, Homo sapiens
agggtagggccgtagggccatg

SEQ ID NO: 7251149 - DNA, 19 bp, Homo sapiens
cctcagagctagtgaacat

SEQ ID NO: 7251150 - DNA, 22 bp, Homo sapiens
agggcctggcgcgtggccgccg

SEQ ID NO: 7251151 - DNA, 18 bp, Homo sapiens
agggcctccatcccctcc

SEQ ID NO: 7251152 - DNA, 22 bp, Homo sapiens
agggcctgagctctcctccagt

SEQ ID NO: 7251153 - DNA, 23 bp, Homo sapiens
agggcctgatggctcccgctggc

SEQ ID NO: 7251154 - DNA, 22 bp, Homo sapiens
cctcaggcaggaaactgtcccg

SEQ ID NO: 7251155 - DNA, 20 bp, Homo sapiens
cctcaggatgagggtgagca

SEQ ID NO: 7251156 - DNA, 22 bp, Homo sapiens
cctcaggatccgcaggtgcagt

SEQ ID NO: 7251157 - DNA, 22 bp, Homo sapiens
cctcaggcaggaaactgtcccg

SEQ ID NO: 7251158 - DNA, 22 bp, Homo sapiens
cctcaggccctgtccctgcgcc

SEQ ID NO: 7251159 - DNA, 22 bp, Homo sapiens
agggcgggctcatcacatgctc

SEQ ID NO: 7251160 - DNA, 22 bp, Homo sapiens
agggcgctgtctggccagcggt

SEQ ID NO: 7251161 - DNA, 22 bp, Homo sapiens
agggcgctgaaatactaacatg

SEQ ID NO: 7251162 - DNA, 22 bp, Homo sapiens
agggcgtggtggtgctggagca

SEQ ID NO: 7251163 - DNA, 19 bp, Homo sapiens
agggcggggcccaggcaca

SEQ ID NO: 7251164 - DNA, 22 bp, Homo sapiens
agggcgacaatggagagcgttt

SEQ ID NO: 7251165 - DNA, 22 bp, Homo sapiens
agggcgcctgctgtggccaccg

SEQ ID NO: 7251166 - DNA, 22 bp, Homo sapiens
agggctgctgctccgggcccag

SEQ ID NO: 7251167 - DNA, 22 bp, Homo sapiens
agggctgctgaggaagccttgc

SEQ ID NO: 7251168 - DNA, 22 bp, Homo sapiens
agggctgcatctgcctggtgaa

SEQ ID NO: 7251169 - DNA, 22 bp, Homo sapiens
agggctgcatctgcctggtgaa

SEQ ID NO: 7251170 - DNA, 22 bp, Homo sapiens
agggctgcagtcctaaggtgct

SEQ ID NO: 7251171 - DNA, 22 bp, Homo sapiens
agggctgctttgctaaatatgg

SEQ ID NO: 7251172 - DNA, 22 bp, Homo sapiens
agggctgcttacctggaatggc

SEQ ID NO: 7251173 - DNA, 22 bp, Homo sapiens
agggctgctttgctaaatatgg

SEQ ID NO: 7251174 - DNA, 22 bp, Homo sapiens
agggctgcttacctggaatggc

SEQ ID NO: 7251175 - DNA, 22 bp, Homo sapiens
agggctggcaagggattgaaat

SEQ ID NO: 7251176 - DNA, 22 bp, Homo sapiens
agggctggagccacagctggga

SEQ ID NO: 7251177 - DNA, 22 bp, Homo sapiens
agggctggagccacagctggga

SEQ ID NO: 7251178 - DNA, 22 bp, Homo sapiens
caaaggctggtagaatgagcca

SEQ ID NO: 7251179 - DNA, 22 bp, Homo sapiens
caaagggaaacgcagtgtcaag

SEQ ID NO: 7251180 - DNA, 20 bp, Homo sapiens
agcaccagtgggggcagccc

SEQ ID NO: 7251181 - DNA, 22 bp, Homo sapiens
caaagggcggctgtcggagggt

SEQ ID NO: 7251182 - DNA, 22 bp, Homo sapiens
agcactggaaagttaagagttt

SEQ ID NO: 7251183 - DNA, 20 bp, Homo sapiens
agcagagtgcccatcccgga

SEQ ID NO: 7251184 - DNA, 22 bp, Homo sapiens
agcagaggtttgttggaaacct

SEQ ID NO: 7251185 - DNA, 16 bp, Homo sapiens
agcagaggtgagtgaa

SEQ ID NO: 7251186 - DNA, 22 bp, Homo sapiens
caataatatcctgtgctgtttg

SEQ ID NO: 7251187 - DNA, 22 bp, Homo sapiens
agcagagacctggttttgttga

SEQ ID NO: 7251188 - DNA, 21 bp, Homo sapiens
agcagaggcagaatgtatgca

SEQ ID NO: 7251189 - DNA, 21 bp, Homo sapiens
agcagaggctgcctggtgact

SEQ ID NO: 7251190 - DNA, 22 bp, Homo sapiens
agcagaggacagttcttaggaa

SEQ ID NO: 7251191 - DNA, 22 bp, Homo sapiens
agcagcccagttgtactgagtg

SEQ ID NO: 7251192 - DNA, 22 bp, Homo sapiens
agcagccctagggattgctgtt

SEQ ID NO: 7251193 - DNA, 19 bp, Homo sapiens
agcagcagaagtgtgcctt

SEQ ID NO: 7251194 - DNA, 16 bp, Homo sapiens
caatacatggcatttc

SEQ ID NO: 7251195 - DNA, 22 bp, Homo sapiens
caatacaattaccagttaatca

SEQ ID NO: 7251196 - DNA, 22 bp, Homo sapiens
caatacatcaggtcaaaatgtg

SEQ ID NO: 7251197 - DNA, 22 bp, Homo sapiens
caatacagcacacctgtatcag

SEQ ID NO: 7251198 - DNA, 22 bp, Homo sapiens
caatacagcacacctgtatcag

SEQ ID NO: 7251199 - DNA, 21 bp, Homo sapiens
agcagcagatctggtgagggc

SEQ ID NO: 7251200 - DNA, 22 bp, Homo sapiens
agcagcagagctctggtctgca

SEQ ID NO: 7251201 - DNA, 22 bp, Homo sapiens
agcagctcatggagtaggcact

SEQ ID NO: 7251202 - DNA, 22 bp, Homo sapiens
agcagctcagaggcaccagggc

SEQ ID NO: 7251203 - DNA, 19 bp, Homo sapiens
agcagctcagggaggcacc

SEQ ID NO: 7251204 - DNA, 22 bp, Homo sapiens
agcagctcaagacttaaatttg

SEQ ID NO: 7251205 - DNA, 22 bp, Homo sapiens
agcagctcacaggattcctgaa

SEQ ID NO: 7251206 - DNA, 22 bp, Homo sapiens
agcagctcaacagtgtctctat

SEQ ID NO: 7251207 - DNA, 22 bp, Homo sapiens
agcagctcaaagcctgcaagga

SEQ ID NO: 7251208 - DNA, 22 bp, Homo sapiens
cacagagaggcttgtctccaag

SEQ ID NO: 7251209 - DNA, 22 bp, Homo sapiens
cacagagagctacgtgcagcgt

SEQ ID NO: 7251210 - DNA, 22 bp, Homo sapiens
agcagctcccctcatgctccac

SEQ ID NO: 7251211 - DNA, 21 bp, Homo sapiens
cacagagatattggtgagcct

SEQ ID NO: 7251212 - DNA, 22 bp, Homo sapiens
cacagagatcggaacagaagta

SEQ ID NO: 7251213 - DNA, 21 bp, Homo sapiens
agcagctgggcaacatggagg

SEQ ID NO: 7251214 - DNA, 22 bp, Homo sapiens
cacagagatggccagggcacat

SEQ ID NO: 7251215 - DNA, 22 bp, Homo sapiens
cacagagatggtctggcaggtg

SEQ ID NO: 7251216 - DNA, 22 bp, Homo sapiens
cacagagattagaattagacta

SEQ ID NO: 7251217 - DNA, 22 bp, Homo sapiens
agcagggctggggcacgagcca

SEQ ID NO: 7251218 - DNA, 22 bp, Homo sapiens
agcagtgagtgggaggaccatg

SEQ ID NO: 7251219 - DNA, 22 bp, Homo sapiens
agcatgaaaggcgtgccaactt

SEQ ID NO: 7251220 - DNA, 22 bp, Homo sapiens
agcatgaagacttcagagctag

SEQ ID NO: 7251221 - DNA, 22 bp, Homo sapiens
agcatgaaagcataggacagtc

SEQ ID NO: 7251222 - DNA, 22 bp, Homo sapiens
cactgtgggtcccagactggag

SEQ ID NO: 7251223 - DNA, 22 bp, Homo sapiens
agcattaataagaaatggctcc

SEQ ID NO: 7251224 - DNA, 22 bp, Homo sapiens
agcagggcaggtaaggatcaga

SEQ ID NO: 7251225 - DNA, 22 bp, Homo sapiens
agcagggcaggtaaggatcaga

SEQ ID NO: 7251226 - DNA, 22 bp, Homo sapiens
caccacttcataggctttaagg

SEQ ID NO: 7251227 - DNA, 19 bp, Homo sapiens
caccacttctttttgcatc

SEQ ID NO: 7251228 - DNA, 22 bp, Homo sapiens
agcagggctctgtggagggtgg

SEQ ID NO: 7251229 - DNA, 22 bp, Homo sapiens
caccagctaattaaaacagcag

SEQ ID NO: 7251230 - DNA, 22 bp, Homo sapiens
caccagagttgtccaaatgatt

SEQ ID NO: 7251231 - DNA, 22 bp, Homo sapiens
agcaggaactcagggagttctc

SEQ ID NO: 7251232 - DNA, 22 bp, Homo sapiens
agcaggaactcagggagttctc

SEQ ID NO: 7251233 - DNA, 22 bp, Homo sapiens
agcaggaaggctttgggggttc

SEQ ID NO: 7251234 - DNA, 22 bp, Homo sapiens
agcaggaaggtctgtgtgagtc

SEQ ID NO: 7251235 - DNA, 22 bp, Homo sapiens
agcaggaaggtctgtgtgagtc

SEQ ID NO: 7251236 - DNA, 22 bp, Homo sapiens
cacagcagaaagtgtaggagga

SEQ ID NO: 7251237 - DNA, 22 bp, Homo sapiens
cacagcagaaatatgaaggcag

SEQ ID NO: 7251238 - DNA, 22 bp, Homo sapiens
cacagcagaacttaatttcaaa

SEQ ID NO: 7251239 - DNA, 22 bp, Homo sapiens
cacagcagagggagccattgaa

SEQ ID NO: 7251240 - DNA, 22 bp, Homo sapiens
cacagcagacagggaggcggct

SEQ ID NO: 7251241 - DNA, 22 bp, Homo sapiens
cacagcagcatcatttatctgg

SEQ ID NO: 7251242 - DNA, 22 bp, Homo sapiens
cacagcagatccaggggttgtg

SEQ ID NO: 7251243 - DNA, 22 bp, Homo sapiens
agctcttccacctcatgatggg

SEQ ID NO: 7251244 - DNA, 22 bp, Homo sapiens
agctctttagagtctcccttct

SEQ ID NO: 7251245 - DNA, 22 bp, Homo sapiens
agctctttacacagagtccctc

SEQ ID NO: 7251246 - DNA, 22 bp, Homo sapiens
agctctttaatcttagccccag

SEQ ID NO: 7251247 - DNA, 22 bp, Homo sapiens
agctctttatgggtaaatgcca

SEQ ID NO: 7251248 - DNA, 22 bp, Homo sapiens
agctctttatgtggaagaggca

SEQ ID NO: 7251249 - DNA, 15 bp, Homo sapiens
agctctttcagctac

SEQ ID NO: 7251250 - DNA, 22 bp, Homo sapiens
agctctttcccctccctatggc

SEQ ID NO: 7251251 - DNA, 22 bp, Homo sapiens
agctctttctacaagcaggcag

SEQ ID NO: 7251252 - DNA, 22 bp, Homo sapiens
agctctttgactaatcttgctt

SEQ ID NO: 7251253 - DNA, 22 bp, Homo sapiens
agctctttgagaaggcagtgtg

SEQ ID NO: 7251254 - DNA, 22 bp, Homo sapiens
agctctttgagcaaggcagctc

SEQ ID NO: 7251255 - DNA, 19 bp, Homo sapiens
agctctttgctgcattcca

SEQ ID NO: 7251256 - DNA, 22 bp, Homo sapiens
agctctttgctggcagtaggct

SEQ ID NO: 7251257 - DNA, 22 bp, Homo sapiens
agctctttggaaggtgtgcact

SEQ ID NO: 7251258 - DNA, 22 bp, Homo sapiens
agctctttggcactgagcagca

SEQ ID NO: 7251259 - DNA, 22 bp, Homo sapiens
agctcctggtgcctcagccgaa

SEQ ID NO: 7251260 - DNA, 19 bp, Homo sapiens
agctcaggcccatcgtccc

SEQ ID NO: 7251261 - DNA, 22 bp, Homo sapiens
agctcaggcaactctgggcccc

SEQ ID NO: 7251262 - DNA, 22 bp, Homo sapiens
agctccagcccatctgctcgtg

SEQ ID NO: 7251263 - DNA, 22 bp, Homo sapiens
cagatgtaatctgacagctgga

SEQ ID NO: 7251264 - DNA, 22 bp, Homo sapiens
cagatgtatatgcataaaaagt

SEQ ID NO: 7251265 - DNA, 22 bp, Homo sapiens
agcctggcttagctctctcact

SEQ ID NO: 7251266 - DNA, 22 bp, Homo sapiens
agctacctgatccttcttctga

SEQ ID NO: 7251267 - DNA, 22 bp, Homo sapiens
agctagaagtcctagataaagg

SEQ ID NO: 7251268 - DNA, 22 bp, Homo sapiens
agctagaatgttccttttcatt

SEQ ID NO: 7251269 - DNA, 22 bp, Homo sapiens
agctagaatattgatctgaaat

SEQ ID NO: 7251270 - DNA, 22 bp, Homo sapiens
agcctgggcctggcttcccgcc

SEQ ID NO: 7251271 - DNA, 22 bp, Homo sapiens
agcctgggtgggggttcggaga

SEQ ID NO: 7251272 - DNA, 22 bp, Homo sapiens
agcctgggtttttattaaggag

SEQ ID NO: 7251273 - DNA, 22 bp, Homo sapiens
agccctgggcgttactgggatg

SEQ ID NO: 7251274 - DNA, 22 bp, Homo sapiens
agccctgggcacctgtgagggg

SEQ ID NO: 7251275 - DNA, 22 bp, Homo sapiens
agccctgcttcaccatttactt

SEQ ID NO: 7251276 - DNA, 22 bp, Homo sapiens
agccctgctgcttcttgtattt

SEQ ID NO: 7251277 - DNA, 22 bp, Homo sapiens
agccctgctgcctgaattagct

SEQ ID NO: 7251278 - DNA, 22 bp, Homo sapiens
agccctggattctgaggtccaa

SEQ ID NO: 7251279 - DNA, 22 bp, Homo sapiens
agccctggattctgaggtccaa

SEQ ID NO: 7251280 - DNA, 22 bp, Homo sapiens
agccctggagcaaaggtgtctt

SEQ ID NO: 7251281 - DNA, 22 bp, Homo sapiens
agccccagttccctggaagtct

SEQ ID NO: 7251282 - DNA, 22 bp, Homo sapiens
agccctgcgtgccaggggactg

SEQ ID NO: 7251283 - DNA, 23 bp, Homo sapiens
agccctgctgagacccagctccc

SEQ ID NO: 7251284 - DNA, 22 bp, Homo sapiens
agccctgctcatctggatcccg

SEQ ID NO: 7251285 - DNA, 22 bp, Homo sapiens
agccagtgggattagagcctct

SEQ ID NO: 7251286 - DNA, 22 bp, Homo sapiens
agccagtgttaagtgactggtt

SEQ ID NO: 7251287 - DNA, 19 bp, Homo sapiens
agccagttggtaagaggct

SEQ ID NO: 7251288 - DNA, 22 bp, Homo sapiens
agccccagcccctctctcacaa

SEQ ID NO: 7251289 - DNA, 22 bp, Homo sapiens
agccccacgttgtctagcacct

SEQ ID NO: 7251290 - DNA, 22 bp, Homo sapiens
agccccaggatgggccgcagga

SEQ ID NO: 7251291 - DNA, 22 bp, Homo sapiens
agccccagtccgctgcgggcgg

SEQ ID NO: 7251292 - DNA, 22 bp, Homo sapiens
agccccagtaagggagggcctg

SEQ ID NO: 7251293 - DNA, 22 bp, Homo sapiens
agccccaggcccggacgcctct

SEQ ID NO: 7251294 - DNA, 22 bp, Homo sapiens
agccagctaccggggctcctgg

SEQ ID NO: 7251295 - DNA, 22 bp, Homo sapiens
agccagcatgaagacagaggcc

SEQ ID NO: 7251296 - DNA, 22 bp, Homo sapiens
agccagcaggtgagtgcagcct

SEQ ID NO: 7251297 - DNA, 22 bp, Homo sapiens
agccagcaggtgagtgcagcct

SEQ ID NO: 7251298 - DNA, 22 bp, Homo sapiens
agccagcaggaacgtctaggtt

SEQ ID NO: 7251299 - DNA, 22 bp, Homo sapiens
cactttctgtgtatcttccatt

SEQ ID NO: 7251300 - DNA, 22 bp, Homo sapiens
agccagagttgaatgtgagtct

SEQ ID NO: 7251301 - DNA, 22 bp, Homo sapiens
agccaggccagctgtcttgagt

SEQ ID NO: 7251302 - DNA, 20 bp, Homo sapiens
agccaggcctcaagttaagt

SEQ ID NO: 7251303 - DNA, 22 bp, Homo sapiens
agccaggccttagggagaggca

SEQ ID NO: 7251304 - DNA, 22 bp, Homo sapiens
agccaggccttagggagaggca

SEQ ID NO: 7251305 - DNA, 22 bp, Homo sapiens
agccaggccttttctcaaggtt

SEQ ID NO: 7251306 - DNA, 22 bp, Homo sapiens
cagagcccagggcctacgtccc

SEQ ID NO: 7251307 - DNA, 22 bp, Homo sapiens
cagagacccttctcagtggcca

SEQ ID NO: 7251308 - DNA, 17 bp, Homo sapiens
agccaggcatatgaagt

SEQ ID NO: 7251309 - DNA, 22 bp, Homo sapiens
agccaggccagactcacaccct

SEQ ID NO: 7251310 - DNA, 20 bp, Homo sapiens
cagagaccaggccaggtgtc

SEQ ID NO: 7251311 - DNA, 22 bp, Homo sapiens
cagagaccccgctgcccttctg

SEQ ID NO: 7251312 - DNA, 22 bp, Homo sapiens
agaatattgaaagttcttgaca

SEQ ID NO: 7251313 - DNA, 22 bp, Homo sapiens
agaatattcatctgtattctta

SEQ ID NO: 7251314 - DNA, 22 bp, Homo sapiens
agaatatgatcggaatacagat

SEQ ID NO: 7251315 - DNA, 22 bp, Homo sapiens
agacaacaccaaatgctagtgt

SEQ ID NO: 7251316 - DNA, 22 bp, Homo sapiens
agacaacatgatcagcagtcct

SEQ ID NO: 7251317 - DNA, 22 bp, Homo sapiens
agacaacatgatcagcagtcct

SEQ ID NO: 7251318 - DNA, 22 bp, Homo sapiens
agacaactgcagagcaaagaat

SEQ ID NO: 7251319 - DNA, 22 bp, Homo sapiens
atgagggaggcaaggagatgct

SEQ ID NO: 7251320 - DNA, 22 bp, Homo sapiens
atgaggcccaaacattacaaat

SEQ ID NO: 7251321 - DNA, 22 bp, Homo sapiens
atgaggcccaggaatctgtatt

SEQ ID NO: 7251322 - DNA, 22 bp, Homo sapiens
atgaggccatggctgtcactaa

SEQ ID NO: 7251323 - DNA, 22 bp, Homo sapiens
atgaggcctatcttggcagagg

SEQ ID NO: 7251324 - DNA, 20 bp, Homo sapiens
atgaggccagcagggctcag

SEQ ID NO: 7251325 - DNA, 22 bp, Homo sapiens
atgaggccagaccactctgcat

SEQ ID NO: 7251326 - DNA, 22 bp, Homo sapiens
atgaggccagggtgccatgaaa

SEQ ID NO: 7251327 - DNA, 22 bp, Homo sapiens
atgcctgtaatcccagcacttt

SEQ ID NO: 7251328 - DNA, 22 bp, Homo sapiens
atgcctgtaaaacagcacccag

SEQ ID NO: 7251329 - DNA, 22 bp, Homo sapiens
atgcctgtggagatatttaagg

SEQ ID NO: 7251330 - DNA, 22 bp, Homo sapiens
atgcctgtgctatattctcaca

SEQ ID NO: 7251331 - DNA, 22 bp, Homo sapiens
atgcctgtctcagggtctgttt

SEQ ID NO: 7251332 - DNA, 22 bp, Homo sapiens
atgcctgtaattccagcatttt

SEQ ID NO: 7251333 - DNA, 22 bp, Homo sapiens
atgcctgtaatcccagtgcttt

SEQ ID NO: 7251334 - DNA, 22 bp, Homo sapiens
atgcctgtttgaaattggacct

SEQ ID NO: 7251335 - DNA, 19 bp, Homo sapiens
atgcctgttgattagttac

SEQ ID NO: 7251336 - DNA, 22 bp, Homo sapiens
atgcctgtgggaaaaacttgtt

SEQ ID NO: 7251337 - DNA, 22 bp, Homo sapiens
atgcctttttatcatggatgat

SEQ ID NO: 7251338 - DNA, 22 bp, Homo sapiens
atgcctttctctgtagaaagaa

SEQ ID NO: 7251339 - DNA, 22 bp, Homo sapiens
agacccaggattggggctgccg

SEQ ID NO: 7251340 - DNA, 22 bp, Homo sapiens
agacagaatttgtcagataaat

SEQ ID NO: 7251341 - DNA, 20 bp, Homo sapiens
agacagaatcagagataaag

SEQ ID NO: 7251342 - DNA, 22 bp, Homo sapiens
atgatagctaccgtttatgctg

SEQ ID NO: 7251343 - DNA, 22 bp, Homo sapiens
atgcatatggcttgagggaata

SEQ ID NO: 7251344 - DNA, 22 bp, Homo sapiens
atgcatttttgagtatgaatga

SEQ ID NO: 7251345 - DNA, 22 bp, Homo sapiens
atgcatttgtaaaatataatcg

SEQ ID NO: 7251346 - DNA, 22 bp, Homo sapiens
atgcatattttctactatatcg

SEQ ID NO: 7251347 - DNA, 22 bp, Homo sapiens
atgcatattttctgttggtgac

SEQ ID NO: 7251348 - DNA, 22 bp, Homo sapiens
atgcatatgtacccatgttctg

SEQ ID NO: 7251349 - DNA, 22 bp, Homo sapiens
atgcatatgtacttgcatatgt

SEQ ID NO: 7251350 - DNA, 22 bp, Homo sapiens
atgcatatgtgtgcacacgtgt

SEQ ID NO: 7251351 - DNA, 22 bp, Homo sapiens
atgcatattgattatagattca

SEQ ID NO: 7251352 - DNA, 22 bp, Homo sapiens
atgcatattgattatagattca

SEQ ID NO: 7251353 - DNA, 22 bp, Homo sapiens
atgcatattcttagcccctcct

SEQ ID NO: 7251354 - DNA, 22 bp, Homo sapiens
atgcatattggattagcagcca

SEQ ID NO: 7251355 - DNA, 22 bp, Homo sapiens
atgcatattgtcatttagtcct

SEQ ID NO: 7251356 - DNA, 22 bp, Homo sapiens
atgcatatttcatgaatctttg

SEQ ID NO: 7251357 - DNA, 22 bp, Homo sapiens
atgcatatttcatgaatctttg

SEQ ID NO: 7251358 - DNA, 22 bp, Homo sapiens
atgcatatttcttgggcttacc

SEQ ID NO: 7251359 - DNA, 22 bp, Homo sapiens
atgcatatttcttggagcacct

SEQ ID NO: 7251360 - DNA, 18 bp, Homo sapiens
atgcatattttaagttgt

SEQ ID NO: 7251361 - DNA, 21 bp, Homo sapiens
atgcatattttaagttgtgtc

SEQ ID NO: 7251362 - DNA, 18 bp, Homo sapiens
atgcatattttaagttgt

SEQ ID NO: 7251363 - DNA, 22 bp, Homo sapiens
agagcacaggctctggagtcta

SEQ ID NO: 7251364 - DNA, 22 bp, Homo sapiens
agagcacagggttttgtgccgg

SEQ ID NO: 7251365 - DNA, 22 bp, Homo sapiens
agagcagaggcatggccgtggg

SEQ ID NO: 7251366 - DNA, 22 bp, Homo sapiens
agagcacatggttcctgtgtcc

SEQ ID NO: 7251367 - DNA, 20 bp, Homo sapiens
agagcagcagttggtgaggt

SEQ ID NO: 7251368 - DNA, 22 bp, Homo sapiens
agagccctctgcaatgcctcag

SEQ ID NO: 7251369 - DNA, 22 bp, Homo sapiens
agagccctcttcactgcccctt

SEQ ID NO: 7251370 - DNA, 22 bp, Homo sapiens
agagcctctgtcatggagagaa

SEQ ID NO: 7251371 - DNA, 22 bp, Homo sapiens
agagcctgagcctgatcttgaa

SEQ ID NO: 7251372 - DNA, 17 bp, Homo sapiens
agagctcttcactgtga

SEQ ID NO: 7251373 - DNA, 22 bp, Homo sapiens
agagaggctgggcgtagggctt

SEQ ID NO: 7251374 - DNA, 22 bp, Homo sapiens
agagagggaatatttggggtat

SEQ ID NO: 7251375 - DNA, 22 bp, Homo sapiens
agagagggaatatttggggtat

SEQ ID NO: 7251376 - DNA, 21 bp, Homo sapiens
agagagggagatgaaacatcc

SEQ ID NO: 7251377 - DNA, 22 bp, Homo sapiens
agagagggaatatttggggtat

SEQ ID NO: 7251378 - DNA, 21 bp, Homo sapiens
agagagggagatgaaacatcc

SEQ ID NO: 7251379 - DNA, 22 bp, Homo sapiens
agagagggcatagaaaaaggga

SEQ ID NO: 7251380 - DNA, 22 bp, Homo sapiens
agagagggcatagaaaaaggga

SEQ ID NO: 7251381 - DNA, 22 bp, Homo sapiens
agagagctgactttggagtcag

SEQ ID NO: 7251382 - DNA, 22 bp, Homo sapiens
agagacaatgccaatgcacacg

SEQ ID NO: 7251383 - DNA, 22 bp, Homo sapiens
agagacagacacatcgggctgc

SEQ ID NO: 7251384 - DNA, 22 bp, Homo sapiens
agagagcatggcacagaggggt

SEQ ID NO: 7251385 - DNA, 22 bp, Homo sapiens
agagagaagcaatcagtggcca

SEQ ID NO: 7251386 - DNA, 22 bp, Homo sapiens
agagaaggggtaaagagtcctg

SEQ ID NO: 7251387 - DNA, 22 bp, Homo sapiens
agagaaggggtaaagagtcctg

SEQ ID NO: 7251388 - DNA, 22 bp, Homo sapiens
agagaaggaaagctgacatggg

SEQ ID NO: 7251389 - DNA, 19 bp, Homo sapiens
agagaaggatcctatggtt

SEQ ID NO: 7251390 - DNA, 22 bp, Homo sapiens
agagaatacaaagaagatatgt

SEQ ID NO: 7251391 - DNA, 22 bp, Homo sapiens
agagaatccccagacagagtta

SEQ ID NO: 7251392 - DNA, 22 bp, Homo sapiens
agagaaggtcactaaggaccca

SEQ ID NO: 7251393 - DNA, 22 bp, Homo sapiens
agacttgatgttaaaagaaact

SEQ ID NO: 7251394 - DNA, 22 bp, Homo sapiens
agacttgggacctaggaatgga

SEQ ID NO: 7251395 - DNA, 22 bp, Homo sapiens
caaagcaagggctgaagactcc

SEQ ID NO: 7251396 - DNA, 22 bp, Homo sapiens
caaaccatgacatgaagcgtga

SEQ ID NO: 7251397 - DNA, 17 bp, Homo sapiens
caaaccagtaagactgc

SEQ ID NO: 7251398 - DNA, 20 bp, Homo sapiens
agcaagagtaaggacagcga

SEQ ID NO: 7251399 - DNA, 22 bp, Homo sapiens
agcaagaagctttgctgtgata

SEQ ID NO: 7251400 - DNA, 22 bp, Homo sapiens
agcaagaagctttgctgtgata

SEQ ID NO: 7251401 - DNA, 22 bp, Homo sapiens
agcaagaaatcttcagtgttct

SEQ ID NO: 7251402 - DNA, 22 bp, Homo sapiens
agatgtttaaaaagatgactct

SEQ ID NO: 7251403 - DNA, 22 bp, Homo sapiens
attttcagcccccactcgtggc

SEQ ID NO: 7251404 - DNA, 22 bp, Homo sapiens
attggcatatccacgacaatgc

SEQ ID NO: 7251405 - DNA, 22 bp, Homo sapiens
attggcatagtaggacagatca

SEQ ID NO: 7251406 - DNA, 22 bp, Homo sapiens
attggcataggttaaacagcgg

SEQ ID NO: 7251407 - DNA, 22 bp, Homo sapiens
agagtggagagaaacaactctg

SEQ ID NO: 7251408 - DNA, 21 bp, Homo sapiens
attggcctgtttacagagtga

SEQ ID NO: 7251409 - DNA, 22 bp, Homo sapiens
attggcatttctcacagtcccc

SEQ ID NO: 7251410 - DNA, 22 bp, Homo sapiens
agatataataatttacaagtgt

SEQ ID NO: 7251411 - DNA, 21 bp, Homo sapiens
agatagttgggcatgcagctg

SEQ ID NO: 7251412 - DNA, 22 bp, Homo sapiens
attggggagagctaatatttta

SEQ ID NO: 7251413 - DNA, 22 bp, Homo sapiens
agatcaaaaacttaatggcttt

SEQ ID NO: 7251414 - DNA, 23 bp, Homo sapiens
agatcacatagttatcagatgac

SEQ ID NO: 7251415 - DNA, 22 bp, Homo sapiens
agatatttaaatcagacaaaga

SEQ ID NO: 7251416 - DNA, 22 bp, Homo sapiens
agatggaaaatatagacagaga

SEQ ID NO: 7251417 - DNA, 22 bp, Homo sapiens
agatgctgggaggctgagtgca

SEQ ID NO: 7251418 - DNA, 17 bp, Homo sapiens
agatgctggccacatgt

SEQ ID NO: 7251419 - DNA, 22 bp, Homo sapiens
agagtccatatgtgggaggagt

SEQ ID NO: 7251420 - DNA, 22 bp, Homo sapiens
agagtgcagataagagaatgtt

SEQ ID NO: 7251421 - DNA, 22 bp, Homo sapiens
agagtgcagaggtcaaagaaca

SEQ ID NO: 7251422 - DNA, 20 bp, Homo sapiens
agagtgagactccatctcag

SEQ ID NO: 7251423 - DNA, 22 bp, Homo sapiens
agagtgcaaccgaaacaagcag

SEQ ID NO: 7251424 - DNA, 18 bp, Homo sapiens
agagtatacagacaacaa

SEQ ID NO: 7251425 - DNA, 23 bp, Homo sapiens
agaggggagcatctgctggctga

SEQ ID NO: 7251426 - DNA, 22 bp, Homo sapiens
agaggggaggcgaaccagagtc

SEQ ID NO: 7251427 - DNA, 22 bp, Homo sapiens
agaggggacagccacctgcccg

SEQ ID NO: 7251428 - DNA, 22 bp, Homo sapiens
agaggggacagccacctgcccg

SEQ ID NO: 7251429 - DNA, 18 bp, Homo sapiens
agaggggaggtaagtctg

SEQ ID NO: 7251430 - DNA, 18 bp, Homo sapiens
agaggggaggtaagtctg

SEQ ID NO: 7251431 - DNA, 22 bp, Homo sapiens
agaggggcaagtaaagagtctt

SEQ ID NO: 7251432 - DNA, 22 bp, Homo sapiens
agaggggcagggtctccggatt

SEQ ID NO: 7251433 - DNA, 22 bp, Homo sapiens
agaggggcaagtaaagagtctt

SEQ ID NO: 7251434 - DNA, 22 bp, Homo sapiens
agaggggagtcctaatctgatt

SEQ ID NO: 7251435 - DNA, 22 bp, Homo sapiens
agaggggcgggaactcaacctc

SEQ ID NO: 7251436 - DNA, 22 bp, Homo sapiens
agaggggcgggaactcaacctc

SEQ ID NO: 7251437 - DNA, 22 bp, Homo sapiens
agaggggcccggttctccgtct

SEQ ID NO: 7251438 - DNA, 22 bp, Homo sapiens
agaggggcccggttctccgtct

SEQ ID NO: 7251439 - DNA, 22 bp, Homo sapiens
agaggggcagggtctccggatt

SEQ ID NO: 7251440 - DNA, 22 bp, Homo sapiens
agaggggcagggtctccggatt

SEQ ID NO: 7251441 - DNA, 22 bp, Homo sapiens
agaggctgggtacgggccacct

SEQ ID NO: 7251442 - DNA, 22 bp, Homo sapiens
agaggctgggaagggtccccgg

SEQ ID NO: 7251443 - DNA, 22 bp, Homo sapiens
agaggctgggcaggacccacag

SEQ ID NO: 7251444 - DNA, 22 bp, Homo sapiens
agaggctgggtacgggccacct

SEQ ID NO: 7251445 - DNA, 16 bp, Homo sapiens
agaggctgtaatggaa

SEQ ID NO: 7251446 - DNA, 19 bp, Homo sapiens
agaggctgtcacctgtagc

SEQ ID NO: 7251447 - DNA, 22 bp, Homo sapiens
agaggctgtcccttgctattcc

SEQ ID NO: 7251448 - DNA, 22 bp, Homo sapiens
agagggcttccctaggagtgag

SEQ ID NO: 7251449 - DNA, 22 bp, Homo sapiens
agagggcttccctaggagtgag

SEQ ID NO: 7251450 - DNA, 22 bp, Homo sapiens
agaggggaaggatgtgatgtga

SEQ ID NO: 7251451 - DNA, 22 bp, Homo sapiens
agagggctgggatgtgctgtgt

SEQ ID NO: 7251452 - DNA, 22 bp, Homo sapiens
agagggctggacgcaggttgga

SEQ ID NO: 7251453 - DNA, 22 bp, Homo sapiens
agagggcagtctcagattggga

SEQ ID NO: 7251454 - DNA, 22 bp, Homo sapiens
agaggccagcccaggccaccga

SEQ ID NO: 7251455 - DNA, 22 bp, Homo sapiens
agaggccagcagtgcctatctg

SEQ ID NO: 7251456 - DNA, 22 bp, Homo sapiens
agaggccacaccagcctcccgt

SEQ ID NO: 7251457 - DNA, 23 bp, Homo sapiens
agaggcaggagtggcttgcccgg

SEQ ID NO: 7251458 - DNA, 22 bp, Homo sapiens
agaggctgcacttgctcatgat

SEQ ID NO: 7251459 - DNA, 23 bp, Homo sapiens
agaggccagcctttggagacacc

SEQ ID NO: 7251460 - DNA, 22 bp, Homo sapiens
agaggctgcacttgctcatgat

SEQ ID NO: 7251461 - DNA, 22 bp, Homo sapiens
agaggctgcaggctggaaatca

SEQ ID NO: 7251462 - DNA, 18 bp, Homo sapiens
agaggctggacaggggat

SEQ ID NO: 7251463 - DNA, 18 bp, Homo sapiens
agaggctggacaggggat

SEQ ID NO: 7251464 - DNA, 23 bp, Homo sapiens
agaggctgcagggtattgagaat

SEQ ID NO: 7251465 - DNA, 22 bp, Homo sapiens
agaggctggattgagcatagac

SEQ ID NO: 7251466 - DNA, 22 bp, Homo sapiens
agaggctggattgagcatagac

SEQ ID NO: 7251467 - DNA, 22 bp, Homo sapiens
attacagatagactttgaagct

SEQ ID NO: 7251468 - DNA, 22 bp, Homo sapiens
attacagaaagcaatattgagt

SEQ ID NO: 7251469 - DNA, 22 bp, Homo sapiens
attacagaagatatgctcaaca

SEQ ID NO: 7251470 - DNA, 22 bp, Homo sapiens
agaggaggctgggtccagataa

SEQ ID NO: 7251471 - DNA, 22 bp, Homo sapiens
agaaagcatctccattgtaggt

SEQ ID NO: 7251472 - DNA, 22 bp, Homo sapiens
agaaagcagcatttatgatctc

SEQ ID NO: 7251473 - DNA, 22 bp, Homo sapiens
atcaaaacttctttagagttta

SEQ ID NO: 7251474 - DNA, 22 bp, Homo sapiens
agaaagcacgggccccaggctc

SEQ ID NO: 7251475 - DNA, 22 bp, Homo sapiens
atcagtgccccatggctaatgc

SEQ ID NO: 7251476 - DNA, 19 bp, Homo sapiens
atcagtgcatgagtgctgt

SEQ ID NO: 7251477 - DNA, 22 bp, Homo sapiens
atcagtgtttcaaatgtaatct

SEQ ID NO: 7251478 - DNA, 22 bp, Homo sapiens
agaaatcatgtcttatttctat

SEQ ID NO: 7251479 - DNA, 22 bp, Homo sapiens
agaaaaactaagagtgggtggt

SEQ ID NO: 7251480 - DNA, 22 bp, Homo sapiens
atattttggtagctctcaatga

SEQ ID NO: 7251481 - DNA, 22 bp, Homo sapiens
atcccaggcggcacaggttgca

SEQ ID NO: 7251482 - DNA, 22 bp, Homo sapiens
atccatttttgcaaagttgttc

SEQ ID NO: 7251483 - DNA, 22 bp, Homo sapiens
atccattttttcagaatgctct

SEQ ID NO: 7251484 - DNA, 22 bp, Homo sapiens
atccccagaaaataggtgccta

SEQ ID NO: 7251485 - DNA, 22 bp, Homo sapiens
atctctgctagccttcttcagg

SEQ ID NO: 7251486 - DNA, 22 bp, Homo sapiens
atctctgtaattacatgatatt

SEQ ID NO: 7251487 - DNA, 20 bp, Homo sapiens
agaagccaagtgacatgttt

SEQ ID NO: 7251488 - DNA, 22 bp, Homo sapiens
agaagccaatcagctctctgct

SEQ ID NO: 7251489 - DNA, 22 bp, Homo sapiens
agaagccaatcagctctctgct

SEQ ID NO: 7251490 - DNA, 22 bp, Homo sapiens
agaagccacaggcctcgtctgg

SEQ ID NO: 7251491 - DNA, 22 bp, Homo sapiens
agaagccaatccttgtctctct

SEQ ID NO: 7251492 - DNA, 22 bp, Homo sapiens
agaagccaatccttgtctctct

SEQ ID NO: 7251493 - DNA, 22 bp, Homo sapiens
agaagccaattctgtgtgagtc

SEQ ID NO: 7251494 - DNA, 22 bp, Homo sapiens
agaaggcactcacactggcacg

SEQ ID NO: 7251495 - DNA, 22 bp, Homo sapiens
agaaggcagatgggacggagca

SEQ ID NO: 7251496 - DNA, 22 bp, Homo sapiens
agaaggagtgtacaggtcatgc

SEQ ID NO: 7251497 - DNA, 22 bp, Homo sapiens
agaagccacaggcctcgtctgg

SEQ ID NO: 7251498 - DNA, 23 bp, Homo sapiens
acttttcaattagctatgcttaa

SEQ ID NO: 7251499 - DNA, 22 bp, Homo sapiens
actttggattgggtccctccca

SEQ ID NO: 7251500 - DNA, 22 bp, Homo sapiens
atagataatgtgtagcagtgat

SEQ ID NO: 7251501 - DNA, 22 bp, Homo sapiens
atagagttttattttccaataa

SEQ ID NO: 7251502 - DNA, 22 bp, Homo sapiens
actttgcaatacttaatacaaa

SEQ ID NO: 7251503 - DNA, 22 bp, Homo sapiens
acttggttggtctcaccctgtt

SEQ ID NO: 7251504 - DNA, 22 bp, Homo sapiens
acttctctgctacctgcaaaga

SEQ ID NO: 7251505 - DNA, 22 bp, Homo sapiens
acttctctccacccaagtccct

SEQ ID NO: 7251506 - DNA, 22 bp, Homo sapiens
actgttttctgtaaagggccag

SEQ ID NO: 7251507 - DNA, 22 bp, Homo sapiens
actgtttatagttttgagctga

SEQ ID NO: 7251508 - DNA, 22 bp, Homo sapiens
actgttttctgtaaagggccag

SEQ ID NO: 7251509 - DNA, 22 bp, Homo sapiens
ataaagtctgggccaggcatgg

SEQ ID NO: 7251510 - DNA, 22 bp, Homo sapiens
ataaagtctcatgggtaaatgt

SEQ ID NO: 7251511 - DNA, 22 bp, Homo sapiens
ataaagtctaccgtattaaaga

SEQ ID NO: 7251512 - DNA, 22 bp, Homo sapiens
ataaagtcatttcaaaagttga

SEQ ID NO: 7251513 - DNA, 22 bp, Homo sapiens
ataaagtcattatgaagatcta

SEQ ID NO: 7251514 - DNA, 22 bp, Homo sapiens
ataaagtcatggcagctagaat

SEQ ID NO: 7251515 - DNA, 22 bp, Homo sapiens
ataaagtcaaggcattttatga

SEQ ID NO: 7251516 - DNA, 19 bp, Homo sapiens
ataaataaaaagtgggaga

SEQ ID NO: 7251517 - DNA, 22 bp, Homo sapiens
agtttttgctgatagcatgctt

SEQ ID NO: 7251518 - DNA, 22 bp, Homo sapiens
actgttatttgtaatccattat

SEQ ID NO: 7251519 - DNA, 22 bp, Homo sapiens
actgttattgtgaacgggcaat

SEQ ID NO: 7251520 - DNA, 22 bp, Homo sapiens
actgttatttcaccactactga

SEQ ID NO: 7251521 - DNA, 22 bp, Homo sapiens
ataaaaactgacccatcctttg

SEQ ID NO: 7251522 - DNA, 21 bp, Homo sapiens
actgttattcccattttcacc

SEQ ID NO: 7251523 - DNA, 22 bp, Homo sapiens
agttttatgtagacaattcatt

SEQ ID NO: 7251524 - DNA, 22 bp, Homo sapiens
agttttatgcagtgttctgata

SEQ ID NO: 7251525 - DNA, 22 bp, Homo sapiens
agttttatctgtaagctgttca

SEQ ID NO: 7251526 - DNA, 22 bp, Homo sapiens
agttttatatcttccattggtt

SEQ ID NO: 7251527 - DNA, 22 bp, Homo sapiens
agttttagagtaagaattactg

SEQ ID NO: 7251528 - DNA, 21 bp, Homo sapiens
actgggctagcctgacttctg

SEQ ID NO: 7251529 - DNA, 22 bp, Homo sapiens
actgggctcaagtgattgtcct

SEQ ID NO: 7251530 - DNA, 22 bp, Homo sapiens
actgggccttgtgtgtctcatc

SEQ ID NO: 7251531 - DNA, 22 bp, Homo sapiens
actgggctccagatgtgatacg

SEQ ID NO: 7251532 - DNA, 22 bp, Homo sapiens
agtgaatatgcagcaagaagtt

SEQ ID NO: 7251533 - DNA, 20 bp, Homo sapiens
agtgaatagagacattgccc

SEQ ID NO: 7251534 - DNA, 22 bp, Homo sapiens
agtgctccacattgcactattc

SEQ ID NO: 7251535 - DNA, 22 bp, Homo sapiens
agtgctccaaaggttggtcatt

SEQ ID NO: 7251536 - DNA, 22 bp, Homo sapiens
agtgctcctgccagctttctgg

SEQ ID NO: 7251537 - DNA, 22 bp, Homo sapiens
agtgctcctgaagcttgaggca

SEQ ID NO: 7251538 - DNA, 22 bp, Homo sapiens
agtgctcctcagaagagttgga

SEQ ID NO: 7251539 - DNA, 22 bp, Homo sapiens
agtgctcctttcattgctgccc

SEQ ID NO: 7251540 - DNA, 22 bp, Homo sapiens
actctgagccaccagatcccca

SEQ ID NO: 7251541 - DNA, 22 bp, Homo sapiens
actgagcagggttccgcatgga

SEQ ID NO: 7251542 - DNA, 22 bp, Homo sapiens
actgagcatggctcacagagag

SEQ ID NO: 7251543 - DNA, 22 bp, Homo sapiens
actgagcataaatatgtgtcca

SEQ ID NO: 7251544 - DNA, 22 bp, Homo sapiens
agtgaaatttgtttagataggt

SEQ ID NO: 7251545 - DNA, 19 bp, Homo sapiens
agtgaacacaaagagaagg

SEQ ID NO: 7251546 - DNA, 22 bp, Homo sapiens
agtgaacaagttaagaacacta

SEQ ID NO: 7251547 - DNA, 21 bp, Homo sapiens
actggctggtggctaagaatc

SEQ ID NO: 7251548 - DNA, 20 bp, Homo sapiens
actgggcctaggggaggcat

SEQ ID NO: 7251549 - DNA, 22 bp, Homo sapiens
actgggcctacccagattggca

SEQ ID NO: 7251550 - DNA, 22 bp, Homo sapiens
actgggccggtgcagagtagtt

SEQ ID NO: 7251551 - DNA, 22 bp, Homo sapiens
actgggccgcgctgcagagggc

SEQ ID NO: 7251552 - DNA, 22 bp, Homo sapiens
actgggccgaaatggacagaat

SEQ ID NO: 7251553 - DNA, 22 bp, Homo sapiens
actgggcccatatactcagtct

SEQ ID NO: 7251554 - DNA, 22 bp, Homo sapiens
actgggcctggattggcgtgtc

SEQ ID NO: 7251555 - DNA, 22 bp, Homo sapiens
actgggcctgattgggtcggag

SEQ ID NO: 7251556 - DNA, 22 bp, Homo sapiens
actgggccttgccatggcagcc

SEQ ID NO: 7251557 - DNA, 22 bp, Homo sapiens
actgggcctgtacagagaaaac

SEQ ID NO: 7251558 - DNA, 22 bp, Homo sapiens
actgggcccagtggtgtggctg

SEQ ID NO: 7251559 - DNA, 22 bp, Homo sapiens
actgggccaggtgtgggtgagt

SEQ ID NO: 7251560 - DNA, 22 bp, Homo sapiens
actgggccaggggctttggagc

SEQ ID NO: 7251561 - DNA, 23 bp, Homo sapiens
actgggccagctacttagcactg

SEQ ID NO: 7251562 - DNA, 18 bp, Homo sapiens
actgggccagcaggcagg

SEQ ID NO: 7251563 - DNA, 22 bp, Homo sapiens
actgggccagatcagagcaact

SEQ ID NO: 7251564 - DNA, 22 bp, Homo sapiens
actgggccacatagacctgctg

SEQ ID NO: 7251565 - DNA, 22 bp, Homo sapiens
actgggccaactatttgttcta

SEQ ID NO: 7251566 - DNA, 22 bp, Homo sapiens
actgggccagacactgattccc

SEQ ID NO: 7251567 - DNA, 22 bp, Homo sapiens
actgccctccagcctgggtgac

SEQ ID NO: 7251568 - DNA, 22 bp, Homo sapiens
actgccctcccatctattgcaa

SEQ ID NO: 7251569 - DNA, 22 bp, Homo sapiens
actgccctggagacagcagagt

SEQ ID NO: 7251570 - DNA, 22 bp, Homo sapiens
actgccctgtaactgccaggta

SEQ ID NO: 7251571 - DNA, 22 bp, Homo sapiens
actgccctgtaactgccaggta

SEQ ID NO: 7251572 - DNA, 22 bp, Homo sapiens
actgccctggcaccacacatgc

SEQ ID NO: 7251573 - DNA, 22 bp, Homo sapiens
actgcccttgtcctggcacacc

SEQ ID NO: 7251574 - DNA, 22 bp, Homo sapiens
actggctgcctccaaagtgtgc

SEQ ID NO: 7251575 - DNA, 21 bp, Homo sapiens
actggccaccactggcagggg

SEQ ID NO: 7251576 - DNA, 22 bp, Homo sapiens
aggtgggcttggtgccaacatg

SEQ ID NO: 7251577 - DNA, 22 bp, Homo sapiens
aggtgggcggattcatgaggtc

SEQ ID NO: 7251578 - DNA, 22 bp, Homo sapiens
aggtgggcatagctagaatatt

SEQ ID NO: 7251579 - DNA, 21 bp, Homo sapiens
aggtgggcaggtggagtggcc

SEQ ID NO: 7251580 - DNA, 22 bp, Homo sapiens
aggtgggcgctgctcccgctgg

SEQ ID NO: 7251581 - DNA, 22 bp, Homo sapiens
aggtgggcccagtgggctccag

SEQ ID NO: 7251582 - DNA, 22 bp, Homo sapiens
aggtgggcggatcacaaggtca

SEQ ID NO: 7251583 - DNA, 22 bp, Homo sapiens
agtaataatagctgtaaagtgc

SEQ ID NO: 7251584 - DNA, 22 bp, Homo sapiens
agtaataatagtagccggcatt

SEQ ID NO: 7251585 - DNA, 22 bp, Homo sapiens
agtagtttttaagaggtataaa

SEQ ID NO: 7251586 - DNA, 22 bp, Homo sapiens
agtataaagtggttttcagcac

SEQ ID NO: 7251587 - DNA, 22 bp, Homo sapiens
actccctccaaatctgcacagt

SEQ ID NO: 7251588 - DNA, 22 bp, Homo sapiens
actccctccaaatctgcacagt

SEQ ID NO: 7251589 - DNA, 22 bp, Homo sapiens
actcctgcttcttccctgagga

SEQ ID NO: 7251590 - DNA, 22 bp, Homo sapiens
actcctgctgtcactgcagttc

SEQ ID NO: 7251591 - DNA, 22 bp, Homo sapiens
actccgggagccaggagaggct

SEQ ID NO: 7251592 - DNA, 22 bp, Homo sapiens
actcctcagccagcatcaggga

SEQ ID NO: 7251593 - DNA, 22 bp, Homo sapiens
actcctggggctgccatcacag

SEQ ID NO: 7251594 - DNA, 22 bp, Homo sapiens
actcctgggtgctgaccagcgt

SEQ ID NO: 7251595 - DNA, 22 bp, Homo sapiens
agtcaccatctgtggcagcctg

SEQ ID NO: 7251596 - DNA, 22 bp, Homo sapiens
actagaaagcactaagctaggc

SEQ ID NO: 7251597 - DNA, 22 bp, Homo sapiens
actagaaagcaaaagccatttc

SEQ ID NO: 7251598 - DNA, 22 bp, Homo sapiens
actagaaagaagttttttgaga

SEQ ID NO: 7251599 - DNA, 22 bp, Homo sapiens
actagaaagaagttttttgaga

SEQ ID NO: 7251600 - DNA, 22 bp, Homo sapiens
aggtgggcaccaggcttgtggt

SEQ ID NO: 7251601 - DNA, 22 bp, Homo sapiens
aggtgggcactccgctcgaggt

SEQ ID NO: 7251602 - DNA, 22 bp, Homo sapiens
actagaaattactcagaataaa

SEQ ID NO: 7251603 - DNA, 22 bp, Homo sapiens
aggtgggcacagatggagaagt

SEQ ID NO: 7251604 - DNA, 22 bp, Homo sapiens
actactgatgtaaaggagcaat

SEQ ID NO: 7251605 - DNA, 22 bp, Homo sapiens
actacttgagctgaggctagca

SEQ ID NO: 7251606 - DNA, 22 bp, Homo sapiens
actacttgtgagagattatctc

SEQ ID NO: 7251607 - DNA, 22 bp, Homo sapiens
actacagtactatatctatagg

SEQ ID NO: 7251608 - DNA, 20 bp, Homo sapiens
aggtcttccaatcagctcct

SEQ ID NO: 7251609 - DNA, 22 bp, Homo sapiens
aggtgactgagtttcagtgtga

SEQ ID NO: 7251610 - DNA, 22 bp, Homo sapiens
acgaggagcctgtggcctggta

SEQ ID NO: 7251611 - DNA, 22 bp, Homo sapiens
aggtctgtttaacaaagtcagg

SEQ ID NO: 7251612 - DNA, 22 bp, Homo sapiens
accttcgtttcccactttgtaa

SEQ ID NO: 7251613 - DNA, 22 bp, Homo sapiens
aggtccagctgttgcagcctcc

SEQ ID NO: 7251614 - DNA, 23 bp, Homo sapiens
aggtcaaccacaagctgacaaac

SEQ ID NO: 7251615 - DNA, 20 bp, Homo sapiens
aggtcaacacctagtaagtg

SEQ ID NO: 7251616 - DNA, 21 bp, Homo sapiens
aggtcaaaggcatccatgagg

SEQ ID NO: 7251617 - DNA, 22 bp, Homo sapiens
aggagctgctttggtgcggttt

SEQ ID NO: 7251618 - DNA, 22 bp, Homo sapiens
aggagctgcaaaaccggccgct

SEQ ID NO: 7251619 - DNA, 22 bp, Homo sapiens
aggagcctgaatcagagggtga

SEQ ID NO: 7251620 - DNA, 22 bp, Homo sapiens
acagggggtcccatggcctgga

SEQ ID NO: 7251621 - DNA, 22 bp, Homo sapiens
acagggtgactttgtgacagat

SEQ ID NO: 7251622 - DNA, 22 bp, Homo sapiens
acagggtggggatggtgagctt

SEQ ID NO: 7251623 - DNA, 22 bp, Homo sapiens
acagggtgaatgtgacattatc

SEQ ID NO: 7251624 - DNA, 22 bp, Homo sapiens
acagggtgactttgtgacagat

SEQ ID NO: 7251625 - DNA, 22 bp, Homo sapiens
aggagccatggaggtgaggcgg

SEQ ID NO: 7251626 - DNA, 22 bp, Homo sapiens
aggaagctaaccagggagtgag

SEQ ID NO: 7251627 - DNA, 22 bp, Homo sapiens
aggaagcctggcattaaaaagc

SEQ ID NO: 7251628 - DNA, 22 bp, Homo sapiens
aggaagcccaagtctcatcttc

SEQ ID NO: 7251629 - DNA, 22 bp, Homo sapiens
aggaagggagcagtttgttgtt

SEQ ID NO: 7251630 - DNA, 22 bp, Homo sapiens
aggaaggctgatcactgcttgt

SEQ ID NO: 7251631 - DNA, 22 bp, Homo sapiens
aggagacagccaggggcctgag

SEQ ID NO: 7251632 - DNA, 23 bp, Homo sapiens
aggagacagggaagtgcctggct

SEQ ID NO: 7251633 - DNA, 22 bp, Homo sapiens
aggaagggatacataggatagt

SEQ ID NO: 7251634 - DNA, 17 bp, Homo sapiens
aggaagggcaagtttct

SEQ ID NO: 7251635 - DNA, 17 bp, Homo sapiens
aggaagggcaagtttct

SEQ ID NO: 7251636 - DNA, 22 bp, Homo sapiens
acatacagacctgcagggcagc

SEQ ID NO: 7251637 - DNA, 22 bp, Homo sapiens
aggcacagagaatgccctccat

SEQ ID NO: 7251638 - DNA, 21 bp, Homo sapiens
aggaggggtctttcccactga

SEQ ID NO: 7251639 - DNA, 21 bp, Homo sapiens
aggaggggtctttcccactga

SEQ ID NO: 7251640 - DNA, 22 bp, Homo sapiens
aggaggggttctcgggtgctga

SEQ ID NO: 7251641 - DNA, 22 bp, Homo sapiens
aggaggggttctcgggtgctga

SEQ ID NO: 7251642 - DNA, 22 bp, Homo sapiens
aggaggggttctcgggtgctga

SEQ ID NO: 7251643 - DNA, 22 bp, Homo sapiens
aggaggcttttgcaggtgccac

SEQ ID NO: 7251644 - DNA, 22 bp, Homo sapiens
aggaggctgtggagcactccat

SEQ ID NO: 7251645 - DNA, 22 bp, Homo sapiens
aggagggaataagaaagagtca

SEQ ID NO: 7251646 - DNA, 17 bp, Homo sapiens
aggagggaaatagcttg

SEQ ID NO: 7251647 - DNA, 22 bp, Homo sapiens
aggagggagatgcccatcctgg

SEQ ID NO: 7251648 - DNA, 22 bp, Homo sapiens
aggagggagatgcccatcctgg

SEQ ID NO: 7251649 - DNA, 22 bp, Homo sapiens
aggaggggcatagaaatgtaat

SEQ ID NO: 7251650 - DNA, 22 bp, Homo sapiens
aggaggggcatagaaatgtaat

SEQ ID NO: 7251651 - DNA, 22 bp, Homo sapiens
aggagggacctaggaatattgc

SEQ ID NO: 7251652 - DNA, 22 bp, Homo sapiens
aggagggacaccaatatatgtt

SEQ ID NO: 7251653 - DNA, 20 bp, Homo sapiens
aggagggacctggattggcg

SEQ ID NO: 7251654 - DNA, 22 bp, Homo sapiens
agctcccagaagccagagtcgg

SEQ ID NO: 7251655 - DNA, 23 bp, Homo sapiens
acagccagttcacctctccttgg

SEQ ID NO: 7251656 - DNA, 22 bp, Homo sapiens
agctgctgtggccacatctggc

SEQ ID NO: 7251657 - DNA, 22 bp, Homo sapiens
agctgcttagagtcctcaggat

SEQ ID NO: 7251658 - DNA, 22 bp, Homo sapiens
acagcctgcagccccaggtcgc

SEQ ID NO: 7251659 - DNA, 22 bp, Homo sapiens
acagcctgatttatggagcagt

SEQ ID NO: 7251660 - DNA, 22 bp, Homo sapiens
acagcctgagagtggagctggc

SEQ ID NO: 7251661 - DNA, 22 bp, Homo sapiens
acagcctgacttttgttgtcac

SEQ ID NO: 7251662 - DNA, 22 bp, Homo sapiens
agctggcaggggttcacactgc

SEQ ID NO: 7251663 - DNA, 22 bp, Homo sapiens
agcttatattctagtgatgcca

SEQ ID NO: 7251664 - DNA, 22 bp, Homo sapiens
agcttatagatctctctgatat

SEQ ID NO: 7251665 - DNA, 22 bp, Homo sapiens
agcttataatgtaactaaggac

SEQ ID NO: 7251666 - DNA, 22 bp, Homo sapiens
agcttagcacacacaggcaggt

SEQ ID NO: 7251667 - DNA, 22 bp, Homo sapiens
agctgggcaaaatgtgaggttg

SEQ ID NO: 7251668 - DNA, 22 bp, Homo sapiens
agctgggcaaaatgtgaggttg

SEQ ID NO: 7251669 - DNA, 23 bp, Homo sapiens
agctgggcaaggatccgggctcc

SEQ ID NO: 7251670 - DNA, 22 bp, Homo sapiens
agcttttagtacgttaaaattg

SEQ ID NO: 7251671 - DNA, 19 bp, Homo sapiens
agcttttactaacagcaga

SEQ ID NO: 7251672 - DNA, 22 bp, Homo sapiens
aggaagccactgaatgaaagtt

SEQ ID NO: 7251673 - DNA, 22 bp, Homo sapiens
aggcatggggctgcagtcaggt

SEQ ID NO: 7251674 - DNA, 22 bp, Homo sapiens
acatacatggattcatggattc

SEQ ID NO: 7251675 - DNA, 21 bp, Homo sapiens
acatacattatctttttaaaa

SEQ ID NO: 7251676 - DNA, 22 bp, Homo sapiens
aggccacacaactcttagagat

SEQ ID NO: 7251677 - DNA, 22 bp, Homo sapiens
aggccacaatttgatttggttt

SEQ ID NO: 7251678 - DNA, 22 bp, Homo sapiens
aggccacagcctgggaggtgac

SEQ ID NO: 7251679 - DNA, 22 bp, Homo sapiens
aggccacaggagtactgtcggt

SEQ ID NO: 7251680 - DNA, 22 bp, Homo sapiens
aggccacaggattgcacagcat

SEQ ID NO: 7251681 - DNA, 22 bp, Homo sapiens
aggccacaggcaccctgtgttc

SEQ ID NO: 7251682 - DNA, 23 bp, Homo sapiens
aggcccaggtatgtttgttttgg

SEQ ID NO: 7251683 - DNA, 22 bp, Homo sapiens
aggcccagtagtcgacggcgct

SEQ ID NO: 7251684 - DNA, 22 bp, Homo sapiens
aggccctgagaaaatccctgca

SEQ ID NO: 7251685 - DNA, 22 bp, Homo sapiens
aggccctgagcatccgagggca

SEQ ID NO: 7251686 - DNA, 22 bp, Homo sapiens
aggcccagggctgctctctgaa

SEQ ID NO: 7251687 - DNA, 21 bp, Homo sapiens
aggcccaggaatatgcatttt

SEQ ID NO: 7251688 - DNA, 22 bp, Homo sapiens
aggcccagggctgctctctgaa

SEQ ID NO: 7251689 - DNA, 21 bp, Homo sapiens
aggcccagctttcctcttgct

SEQ ID NO: 7251690 - DNA, 22 bp, Homo sapiens
aggcccagcttgaagtgggaag

SEQ ID NO: 7251691 - DNA, 22 bp, Homo sapiens
aggccaggtggtcatgcttgct

SEQ ID NO: 7251692 - DNA, 22 bp, Homo sapiens
aggccagccctgggctgagaga

SEQ ID NO: 7251693 - DNA, 22 bp, Homo sapiens
acatgaaaaatgtttgcagttt

SEQ ID NO: 7251694 - DNA, 22 bp, Homo sapiens
aggccagcattctctctccagg

SEQ ID NO: 7251695 - DNA, 22 bp, Homo sapiens
aggccagcagacgtgggactga

SEQ ID NO: 7251696 - DNA, 22 bp, Homo sapiens
aggccagcagacgtgggactga

SEQ ID NO: 7251697 - DNA, 22 bp, Homo sapiens
aggccagcagcatgacggcatc

SEQ ID NO: 7251698 - DNA, 22 bp, Homo sapiens
acattcatgtcccacttctagc

SEQ ID NO: 7251699 - DNA, 22 bp, Homo sapiens
acattcaggccacagtggagtc

SEQ ID NO: 7251700 - DNA, 22 bp, Homo sapiens
acattcaaggccttctgacaca

SEQ ID NO: 7251701 - DNA, 22 bp, Homo sapiens
acattcaaggccttctgacaca

SEQ ID NO: 7251702 - DNA, 22 bp, Homo sapiens
acattcaagtttctgctcatgg

SEQ ID NO: 7251703 - DNA, 22 bp, Homo sapiens
aggccctgcaggagtggggaca

SEQ ID NO: 7251704 - DNA, 22 bp, Homo sapiens
aggccctgatccgaatccagat

SEQ ID NO: 7251705 - DNA, 22 bp, Homo sapiens
aggccctgcaggaagcaggatg

SEQ ID NO: 7251706 - DNA, 22 bp, Homo sapiens
aggccctgcattgtactgaggg

SEQ ID NO: 7251707 - DNA, 22 bp, Homo sapiens
acattgaaagcatattatctcc

SEQ ID NO: 7251708 - DNA, 22 bp, Homo sapiens
acattccaaaaactagcagata

SEQ ID NO: 7251709 - DNA, 22 bp, Homo sapiens
aggctgtgcaattagggtaaga

SEQ ID NO: 7251710 - DNA, 22 bp, Homo sapiens
aggcttccgagtagctgggact

SEQ ID NO: 7251711 - DNA, 22 bp, Homo sapiens
acattgaatttcacttttgtac

SEQ ID NO: 7251712 - DNA, 22 bp, Homo sapiens
acattgaatttcacttttgtac

SEQ ID NO: 7251713 - DNA, 22 bp, Homo sapiens
acattgaattcaaaattactga

SEQ ID NO: 7251714 - DNA, 22 bp, Homo sapiens
acattgaattcaaaattactga

SEQ ID NO: 7251715 - DNA, 22 bp, Homo sapiens
acattgaatgtatgtgatgaaa

SEQ ID NO: 7251716 - DNA, 22 bp, Homo sapiens
acattgaagtgtctggcctcct

SEQ ID NO: 7251717 - DNA, 22 bp, Homo sapiens
acattgaagggctatccaatag

SEQ ID NO: 7251718 - DNA, 22 bp, Homo sapiens
acattgaagggctatccaatag

SEQ ID NO: 7251719 - DNA, 22 bp, Homo sapiens
acattgaagggctatccaatag

SEQ ID NO: 7251720 - DNA, 22 bp, Homo sapiens
acattgaagggaatgcaaagat

SEQ ID NO: 7251721 - DNA, 22 bp, Homo sapiens
acattgaagctgtgaaatcaaa

SEQ ID NO: 7251722 - DNA, 22 bp, Homo sapiens
acattgaactacttgtaatgag

SEQ ID NO: 7251723 - DNA, 22 bp, Homo sapiens
acattgaagctgtgaaatcaaa

SEQ ID NO: 7251724 - DNA, 22 bp, Homo sapiens
acattgaaccagtagacacaaa

SEQ ID NO: 7251725 - DNA, 22 bp, Homo sapiens
acattgaactacttgtaatgag

SEQ ID NO: 7251726 - DNA, 22 bp, Homo sapiens
acattgaaccagtagacacaaa

SEQ ID NO: 7251727 - DNA, 22 bp, Homo sapiens
acattgaacatggcaggacatt

SEQ ID NO: 7251728 - DNA, 22 bp, Homo sapiens
acattgaacagtacaaatgatc

SEQ ID NO: 7251729 - DNA, 22 bp, Homo sapiens
acattgaacagtacaaatgatc

SEQ ID NO: 7251730 - DNA, 22 bp, Homo sapiens
acattgaaagcatattatctcc

SEQ ID NO: 7251731 - DNA, 22 bp, Homo sapiens
acattgacaaagattgagctgt

SEQ ID NO: 7251732 - DNA, 19 bp, Homo sapiens
acattgaattttcttcttt

SEQ ID NO: 7251733 - DNA, 19 bp, Homo sapiens
acattgaattttcttcttt

SEQ ID NO: 7251734 - DNA, 22 bp, Homo sapiens
accaggggtgtcaacagcattt

SEQ ID NO: 7251735 - DNA, 22 bp, Homo sapiens
accagggcccgggagagctctc

SEQ ID NO: 7251736 - DNA, 22 bp, Homo sapiens
agggcctcgggctcagtgggtc

SEQ ID NO: 7251737 - DNA, 22 bp, Homo sapiens
agggcctctaccatccaaggtt

SEQ ID NO: 7251738 - DNA, 23 bp, Homo sapiens
agggcccaagcctggacagcagg

SEQ ID NO: 7251739 - DNA, 22 bp, Homo sapiens
agggccagttctacctctgaat

SEQ ID NO: 7251740 - DNA, 22 bp, Homo sapiens
accatataacaagtttaggaga

SEQ ID NO: 7251741 - DNA, 22 bp, Homo sapiens
accagtgcttcctgctggagct

SEQ ID NO: 7251742 - DNA, 20 bp, Homo sapiens
accaggtggctgatgacacc

SEQ ID NO: 7251743 - DNA, 22 bp, Homo sapiens
accaggagccatagagtcaggc

SEQ ID NO: 7251744 - DNA, 22 bp, Homo sapiens
accaggaggcctggagcacaaa

SEQ ID NO: 7251745 - DNA, 22 bp, Homo sapiens
accaggagccacaggaggagcc

SEQ ID NO: 7251746 - DNA, 20 bp, Homo sapiens
accaggagatggaggcaggg

SEQ ID NO: 7251747 - DNA, 22 bp, Homo sapiens
accacactggctagtgaagaag

SEQ ID NO: 7251748 - DNA, 22 bp, Homo sapiens
accaatttttcctgaagggcat

SEQ ID NO: 7251749 - DNA, 22 bp, Homo sapiens
accaatttttacagctgtggtt

SEQ ID NO: 7251750 - DNA, 22 bp, Homo sapiens
accaattttagagcaccaagaa

SEQ ID NO: 7251751 - DNA, 22 bp, Homo sapiens
accaatttcttggcttccaaat

SEQ ID NO: 7251752 - DNA, 20 bp, Homo sapiens
accaatttcagaggtgcaga

SEQ ID NO: 7251753 - DNA, 22 bp, Homo sapiens
accaaaggtgatcaggatcacc

SEQ ID NO: 7251754 - DNA, 22 bp, Homo sapiens
accaaaggctcctgaagaactg

SEQ ID NO: 7251755 - DNA, 22 bp, Homo sapiens
accaaaggctatgggacctgcc

SEQ ID NO: 7251756 - DNA, 22 bp, Homo sapiens
accaagatttaacatgcctttt

SEQ ID NO: 7251757 - DNA, 22 bp, Homo sapiens
acccagggtttgagctctgcag

SEQ ID NO: 7251758 - DNA, 22 bp, Homo sapiens
acccagggtttgagctctgcag

SEQ ID NO: 7251759 - DNA, 22 bp, Homo sapiens
acccagggtagagtgcagtggc

SEQ ID NO: 7251760 - DNA, 22 bp, Homo sapiens
acccagggttcctgggtcccag

SEQ ID NO: 7251761 - DNA, 22 bp, Homo sapiens
acccagagatgtcaatggcttt

SEQ ID NO: 7251762 - DNA, 17 bp, Homo sapiens
acccagagaaggaggtc

SEQ ID NO: 7251763 - DNA, 22 bp, Homo sapiens
acccagagcactgggtgtgggc

SEQ ID NO: 7251764 - DNA, 22 bp, Homo sapiens
acccagagcacagatgcaacgt

SEQ ID NO: 7251765 - DNA, 22 bp, Homo sapiens
acccagagcagagcttggcttc

SEQ ID NO: 7251766 - DNA, 22 bp, Homo sapiens
acccagggaccccgctgacgcc

SEQ ID NO: 7251767 - DNA, 22 bp, Homo sapiens
acccagggtagaacctcagagc

SEQ ID NO: 7251768 - DNA, 22 bp, Homo sapiens
acccagggtagagtgcagtggc

SEQ ID NO: 7251769 - DNA, 22 bp, Homo sapiens
agggcctctggaacactgaggg

SEQ ID NO: 7251770 - DNA, 22 bp, Homo sapiens
agggcctgacacccttgccagc

SEQ ID NO: 7251771 - DNA, 22 bp, Homo sapiens
acccaccctactagcagtgtcc

SEQ ID NO: 7251772 - DNA, 22 bp, Homo sapiens
acccacagccgctgtgcgtccc

SEQ ID NO: 7251773 - DNA, 22 bp, Homo sapiens
acccagagaactgaggcatgaa

SEQ ID NO: 7251774 - DNA, 22 bp, Homo sapiens
acccactgtcatctctgaccac

SEQ ID NO: 7251775 - DNA, 22 bp, Homo sapiens
acccagagaactgaggcatgaa

SEQ ID NO: 7251776 - DNA, 22 bp, Homo sapiens
acccagagaactgtgccttgag

SEQ ID NO: 7251777 - DNA, 22 bp, Homo sapiens
acccagagaactgtgccttgag

SEQ ID NO: 7251778 - DNA, 22 bp, Homo sapiens
acccactgtagccactctgggt

SEQ ID NO: 7251779 - DNA, 22 bp, Homo sapiens
accctgggacttccgagttgag

SEQ ID NO: 7251780 - DNA, 22 bp, Homo sapiens
accctgggacctggaggtggat

SEQ ID NO: 7251781 - DNA, 22 bp, Homo sapiens
accctgggaactggaaactgga

SEQ ID NO: 7251782 - DNA, 18 bp, Homo sapiens
accctgggcaattcactc

SEQ ID NO: 7251783 - DNA, 23 bp, Homo sapiens
accctgggcaagtcacctaacct

SEQ ID NO: 7251784 - DNA, 22 bp, Homo sapiens
accctgggagggagaaatcaga

SEQ ID NO: 7251785 - DNA, 22 bp, Homo sapiens
accctgggcacaccatttcccc

SEQ ID NO: 7251786 - DNA, 22 bp, Homo sapiens
accctgggtcatatacagtgtg

SEQ ID NO: 7251787 - DNA, 22 bp, Homo sapiens
accctgggtatttcccaaactt

SEQ ID NO: 7251788 - DNA, 16 bp, Homo sapiens
accctgggtagtcctg

SEQ ID NO: 7251789 - DNA, 22 bp, Homo sapiens
accctggggtcacccttctctg

SEQ ID NO: 7251790 - DNA, 22 bp, Homo sapiens
accctgggcttggcctgctcag

SEQ ID NO: 7251791 - DNA, 22 bp, Homo sapiens
accctgggggtggccagtgcca

SEQ ID NO: 7251792 - DNA, 22 bp, Homo sapiens
accctgggtgagaggcaaacag

SEQ ID NO: 7251793 - DNA, 22 bp, Homo sapiens
accctgggtctcaatcatccta

SEQ ID NO: 7251794 - DNA, 21 bp, Homo sapiens
accctgggttctccataccct

SEQ ID NO: 7251795 - DNA, 22 bp, Homo sapiens
accctgtatacgctacattttt

SEQ ID NO: 7251796 - DNA, 22 bp, Homo sapiens
accctgtatgctatatccctaa

SEQ ID NO: 7251797 - DNA, 22 bp, Homo sapiens
accctgggttcccgcagcacca

SEQ ID NO: 7251798 - DNA, 17 bp, Homo sapiens
acccatccccagggcag

SEQ ID NO: 7251799 - DNA, 22 bp, Homo sapiens
acccatgagctgcttgggatgc

SEQ ID NO: 7251800 - DNA, 22 bp, Homo sapiens
acccattcctttacttcatctg

SEQ ID NO: 7251801 - DNA, 22 bp, Homo sapiens
acccattcctctcctgagggat

SEQ ID NO: 7251802 - DNA, 22 bp, Homo sapiens
accccactcctctgttttaact

SEQ ID NO: 7251803 - DNA, 22 bp, Homo sapiens
accccactcctctgttttaact

SEQ ID NO: 7251804 - DNA, 22 bp, Homo sapiens
accccactaccccggcagatgg

SEQ ID NO: 7251805 - DNA, 22 bp, Homo sapiens
accccactcacacatggacctg

SEQ ID NO: 7251806 - DNA, 22 bp, Homo sapiens
accccactcacacatggacctg

SEQ ID NO: 7251807 - DNA, 22 bp, Homo sapiens
accccactaccccggcagatgg

SEQ ID NO: 7251808 - DNA, 22 bp, Homo sapiens
accccagccctgcttctgggag

SEQ ID NO: 7251809 - DNA, 20 bp, Homo sapiens
accccagcccctctatctga

SEQ ID NO: 7251810 - DNA, 22 bp, Homo sapiens
accccagctctgagccacacca

SEQ ID NO: 7251811 - DNA, 22 bp, Homo sapiens
accccagcgcatatggtctgcg

SEQ ID NO: 7251812 - DNA, 18 bp, Homo sapiens
accctctggcttctgagc

SEQ ID NO: 7251813 - DNA, 22 bp, Homo sapiens
accctctggctcatttcctagt

SEQ ID NO: 7251814 - DNA, 22 bp, Homo sapiens
accctgcctctgcttcctgtag

SEQ ID NO: 7251815 - DNA, 22 bp, Homo sapiens
accctgcctgacaacagaggat

SEQ ID NO: 7251816 - DNA, 22 bp, Homo sapiens
aaacacagggatatatattcca

SEQ ID NO: 7251817 - DNA, 22 bp, Homo sapiens
aaacacagggatatatattcca

SEQ ID NO: 7251818 - DNA, 22 bp, Homo sapiens
aaaccacctccccagctgctgt

SEQ ID NO: 7251819 - DNA, 22 bp, Homo sapiens
aaaccacagttcagtgcttttg

SEQ ID NO: 7251820 - DNA, 22 bp, Homo sapiens
aaacatttttcttcatcatcct

SEQ ID NO: 7251821 - DNA, 22 bp, Homo sapiens
aaacatttttctaggtcttggt

SEQ ID NO: 7251822 - DNA, 23 bp, Homo sapiens
aaacatttctcttttcctgcctc

SEQ ID NO: 7251823 - DNA, 22 bp, Homo sapiens
aaacatttgcaactcggtttgg

SEQ ID NO: 7251824 - DNA, 18 bp, Homo sapiens
aaagaaggattggagagc

SEQ ID NO: 7251825 - DNA, 22 bp, Homo sapiens
aaagaagatggagacctgacta

SEQ ID NO: 7251826 - DNA, 21 bp, Homo sapiens
aaagatgagaactggatggct

SEQ ID NO: 7251827 - DNA, 22 bp, Homo sapiens
aaacttgtgtatgtatatgcaa

SEQ ID NO: 7251828 - DNA, 22 bp, Homo sapiens
aaaaatgtcattatggaactga

SEQ ID NO: 7251829 - DNA, 19 bp, Homo sapiens
aaacacagatttcttacca

SEQ ID NO: 7251830 - DNA, 22 bp, Homo sapiens
aaacaaagcatcttgctatgca

SEQ ID NO: 7251831 - DNA, 22 bp, Homo sapiens
aaaatagattctaggatgtctt

SEQ ID NO: 7251832 - DNA, 22 bp, Homo sapiens
aaaataggtacggattagaatg

SEQ ID NO: 7251833 - DNA, 22 bp, Homo sapiens
aaaattcattcctcagactgcc

SEQ ID NO: 7251834 - DNA, 22 bp, Homo sapiens
aaaattcattcctcagactgcc

SEQ ID NO: 7251835 - DNA, 22 bp, Homo sapiens
aaagtccaattttgttcaggct

SEQ ID NO: 7251836 - DNA, 22 bp, Homo sapiens
aaacactgtctctggtattgaa

SEQ ID NO: 7251837 - DNA, 22 bp, Homo sapiens
aaacactgtacaatctgcaggg

SEQ ID NO: 7251838 - DNA, 22 bp, Homo sapiens
aaacactggtatgatgtatagt

SEQ ID NO: 7251839 - DNA, 22 bp, Homo sapiens
aaacactggcaatttcatgcac

SEQ ID NO: 7251840 - DNA, 22 bp, Homo sapiens
aaacactggcaatttcatgcac

SEQ ID NO: 7251841 - DNA, 22 bp, Homo sapiens
aaacactgcgtggtggcaactc

SEQ ID NO: 7251842 - DNA, 22 bp, Homo sapiens
aaacactgcagggtttacttga

SEQ ID NO: 7251843 - DNA, 22 bp, Homo sapiens
aaacatagataatagatagatg

SEQ ID NO: 7251844 - DNA, 22 bp, Homo sapiens
aaagtgctgggattacaagcgt

SEQ ID NO: 7251845 - DNA, 22 bp, Homo sapiens
aaagtgctgagattacaagcgt

SEQ ID NO: 7251846 - DNA, 22 bp, Homo sapiens
aaagtgctaggattacaagcgt

SEQ ID NO: 7251847 - DNA, 22 bp, Homo sapiens
aaaggcatgtgcaactacaaat

SEQ ID NO: 7251848 - DNA, 22 bp, Homo sapiens
aaaggccactgcaagggaaggt

SEQ ID NO: 7251849 - DNA, 22 bp, Homo sapiens
aaagcaatcagattcagatgtc

SEQ ID NO: 7251850 - DNA, 22 bp, Homo sapiens
aaagcaatcagattcagatgtc

SEQ ID NO: 7251851 - DNA, 22 bp, Homo sapiens
aaagcaatgcccgttcattatc

SEQ ID NO: 7251852 - DNA, 22 bp, Homo sapiens
aaagatgtcagtttgaaataac

SEQ ID NO: 7251853 - DNA, 19 bp, Homo sapiens
aaagatgtccttttgggct

SEQ ID NO: 7251854 - DNA, 22 bp, Homo sapiens
aaatagaaaccaacaaggtcag

SEQ ID NO: 7251855 - DNA, 22 bp, Homo sapiens
aaatacagattctgactcagag

SEQ ID NO: 7251856 - DNA, 22 bp, Homo sapiens
aaatagaattggaagcagagtt

SEQ ID NO: 7251857 - DNA, 22 bp, Homo sapiens
aaatagaattggaagcagagtt

SEQ ID NO: 7251858 - DNA, 22 bp, Homo sapiens
aaatagaattaactagctactg

SEQ ID NO: 7251859 - DNA, 22 bp, Homo sapiens
aaatagaaaccaacaaggtcag

SEQ ID NO: 7251860 - DNA, 22 bp, Homo sapiens
aaatagaattaactagctactg

SEQ ID NO: 7251861 - DNA, 23 bp, Homo sapiens
aaatatgtctgagggcaaagaat

SEQ ID NO: 7251862 - DNA, 22 bp, Homo sapiens
aaactagaaatcagcaagatag

SEQ ID NO: 7251863 - DNA, 22 bp, Homo sapiens
aaatgcagctgggcatgagagg

SEQ ID NO: 7251864 - DNA, 18 bp, Homo sapiens
aaatgctaggctacatga

SEQ ID NO: 7251865 - DNA, 22 bp, Homo sapiens
aaatgctctggggataagactg

SEQ ID NO: 7251866 - DNA, 22 bp, Homo sapiens
aaatgctctccaaaatgaaagt

SEQ ID NO: 7251867 - DNA, 22 bp, Homo sapiens
aagaaaggatatatgggaggta

SEQ ID NO: 7251868 - DNA, 22 bp, Homo sapiens
aagaaagctgaatattctgtgt

SEQ ID NO: 7251869 - DNA, 22 bp, Homo sapiens
aagaaagccaaagttcatacct

SEQ ID NO: 7251870 - DNA, 23 bp, Homo sapiens
aacttttagagtttaacagtgtt

SEQ ID NO: 7251871 - DNA, 22 bp, Homo sapiens
aactttctttgcatctaagttt

SEQ ID NO: 7251872 - DNA, 22 bp, Homo sapiens
aagacagaagtgatttgatgtg

SEQ ID NO: 7251873 - DNA, 22 bp, Homo sapiens
aagagagagttcctaggcaaaa

SEQ ID NO: 7251874 - DNA, 22 bp, Homo sapiens
aagagcatatatgtatgtttgt

SEQ ID NO: 7251875 - DNA, 20 bp, Homo sapiens
aagagcatagtacaggaaga

SEQ ID NO: 7251876 - DNA, 22 bp, Homo sapiens
aagaggagaaaggctggctttg

SEQ ID NO: 7251877 - DNA, 22 bp, Homo sapiens
aagagcatcggtggagccccca

SEQ ID NO: 7251878 - DNA, 22 bp, Homo sapiens
aagagcatctatttcacagtgg

SEQ ID NO: 7251879 - DNA, 22 bp, Homo sapiens
aagagcatcaatgactcgcagt

SEQ ID NO: 7251880 - DNA, 22 bp, Homo sapiens
aagagcatattaatagtggaga

SEQ ID NO: 7251881 - DNA, 22 bp, Homo sapiens
aagagcatatggttctcaaagc

SEQ ID NO: 7251882 - DNA, 22 bp, Homo sapiens
aagagcattccgttctgattct

SEQ ID NO: 7251883 - DNA, 22 bp, Homo sapiens
aagagcatgttaattctaggac

SEQ ID NO: 7251884 - DNA, 22 bp, Homo sapiens
aagagcatgtaattggatttct

SEQ ID NO: 7251885 - DNA, 22 bp, Homo sapiens
aagagcatggcaagaaaagggt

SEQ ID NO: 7251886 - DNA, 22 bp, Homo sapiens
aagagcatggagttcccctaaa

SEQ ID NO: 7251887 - DNA, 22 bp, Homo sapiens
aagagcatggaatggagatcca

SEQ ID NO: 7251888 - DNA, 22 bp, Homo sapiens
aagagcatctatttcacagtgg

SEQ ID NO: 7251889 - DNA, 22 bp, Homo sapiens
aagagcatttaattaggagagt

SEQ ID NO: 7251890 - DNA, 22 bp, Homo sapiens
aagagcattcctaaaggaccat

SEQ ID NO: 7251891 - DNA, 22 bp, Homo sapiens
aagagcatttccactggcactg

SEQ ID NO: 7251892 - DNA, 22 bp, Homo sapiens
aagagcattttgtaaaatcctt

SEQ ID NO: 7251893 - DNA, 22 bp, Homo sapiens
aagagcattttagtctcccttt

SEQ ID NO: 7251894 - DNA, 22 bp, Homo sapiens
aagagcatttggtgagatttga

SEQ ID NO: 7251895 - DNA, 22 bp, Homo sapiens
aagagccagctagtgaagaggc

SEQ ID NO: 7251896 - DNA, 22 bp, Homo sapiens
aagagccagtgggaaagtcttg

SEQ ID NO: 7251897 - DNA, 22 bp, Homo sapiens
aagccactgagatttcactgca

SEQ ID NO: 7251898 - DNA, 22 bp, Homo sapiens
aagccactatggtgattctcaa

SEQ ID NO: 7251899 - DNA, 22 bp, Homo sapiens
aagccagatagaagaactcatt

SEQ ID NO: 7251900 - DNA, 22 bp, Homo sapiens
aagccagatagaagaactcatt

SEQ ID NO: 7251901 - DNA, 22 bp, Homo sapiens
aagcactgggtatagcaatgat

SEQ ID NO: 7251902 - DNA, 22 bp, Homo sapiens
aagcactgtacaaatgtcactt

SEQ ID NO: 7251903 - DNA, 22 bp, Homo sapiens
aagcacttgcttagatgtggtt

SEQ ID NO: 7251904 - DNA, 20 bp, Homo sapiens
aagcactgtggtggcatgga

SEQ ID NO: 7251905 - DNA, 22 bp, Homo sapiens
aagcactgggaggaggctgaga

SEQ ID NO: 7251906 - DNA, 22 bp, Homo sapiens
aagcactgaggaaaaatttgat

SEQ ID NO: 7251907 - DNA, 22 bp, Homo sapiens
aaatatcttaggagtatatgag

SEQ ID NO: 7251908 - DNA, 22 bp, Homo sapiens
aaatatcattctggtgcacaga

SEQ ID NO: 7251909 - DNA, 22 bp, Homo sapiens
aagaggaggacggttcccagaa

SEQ ID NO: 7251910 - DNA, 22 bp, Homo sapiens
aagaggaggacggttcccagaa

SEQ ID NO: 7251911 - DNA, 18 bp, Homo sapiens
aagaggaggaaacccagg

SEQ ID NO: 7251912 - DNA, 22 bp, Homo sapiens
aagaggagacttcagcaacttg

SEQ ID NO: 7251913 - DNA, 22 bp, Homo sapiens
aagaggagacttcagcaacttg

SEQ ID NO: 7251914 - DNA, 22 bp, Homo sapiens
aagcaacagaaacattctaata

SEQ ID NO: 7251915 - DNA, 22 bp, Homo sapiens
aaagcaatggcacatgatggta

SEQ ID NO: 7251916 - DNA, 22 bp, Homo sapiens
aaagcaatgggtctaaggtaaa

SEQ ID NO: 7251917 - DNA, 22 bp, Homo sapiens
aaagcaattgtggtttttgtca

SEQ ID NO: 7251918 - DNA, 22 bp, Homo sapiens
aaagcaattgtggtttttgtca

SEQ ID NO: 7251919 - DNA, 22 bp, Homo sapiens
aaagcacagggtgctagagagt

SEQ ID NO: 7251920 - DNA, 22 bp, Homo sapiens
aaagcacaggagagttcagtaa

SEQ ID NO: 7251921 - DNA, 22 bp, Homo sapiens
aaagcacattacaagctcagtc

SEQ ID NO: 7251922 - DNA, 22 bp, Homo sapiens
aaagcacatgagtagtgtagta

SEQ ID NO: 7251923 - DNA, 22 bp, Homo sapiens
aaagcacatagtagaaggattt

SEQ ID NO: 7251924 - DNA, 22 bp, Homo sapiens
aacacatgggtgtttattgtac

SEQ ID NO: 7251925 - DNA, 22 bp, Homo sapiens
aacacatgccttaagaataagt

SEQ ID NO: 7251926 - DNA, 22 bp, Homo sapiens
aacagctttgcttctggagaca

SEQ ID NO: 7251927 - DNA, 22 bp, Homo sapiens
aacagctttgtatacagtaact

SEQ ID NO: 7251928 - DNA, 22 bp, Homo sapiens
aacagcttttttggtcagcatt

SEQ ID NO: 7251929 - DNA, 22 bp, Homo sapiens
aacagcttttttggtcagcatt

SEQ ID NO: 7251930 - DNA, 22 bp, Homo sapiens
aacagtaggcatcacataatga

SEQ ID NO: 7251931 - DNA, 22 bp, Homo sapiens
aacagtagtatttaaactgaac

SEQ ID NO: 7251932 - DNA, 22 bp, Homo sapiens
aacagtaatggcattgccatga

SEQ ID NO: 7251933 - DNA, 22 bp, Homo sapiens
aacagtatcttttatcagaaat

SEQ ID NO: 7251934 - DNA, 22 bp, Homo sapiens
aacagtattggttgaactcaag

SEQ ID NO: 7251935 - DNA, 22 bp, Homo sapiens
aacagtatgtgagatttacaca

SEQ ID NO: 7251936 - DNA, 22 bp, Homo sapiens
aacatgcaatgtctgaaaatcc

SEQ ID NO: 7251937 - DNA, 20 bp, Homo sapiens
aactatgaatagaagagatt

SEQ ID NO: 7251938 - DNA, 22 bp, Homo sapiens
aactatgttaataagtttcatt

SEQ ID NO: 7251939 - DNA, 22 bp, Homo sapiens
aacatttgaaaatcaagaatct

SEQ ID NO: 7251940 - DNA, 22 bp, Homo sapiens
aactaatacattaatacatgtg

SEQ ID NO: 7251941 - DNA, 20 bp, Homo sapiens
aactgagagttcaggaggag

SEQ ID NO: 7251942 - DNA, 22 bp, Homo sapiens
aactgagattacaagagacatt

SEQ ID NO: 7251943 - DNA, 22 bp, Homo sapiens
aactgaaatcaatcagtgattc

SEQ ID NO: 7251944 - DNA, 22 bp, Homo sapiens
aactcactttgtggcttctgaa

SEQ ID NO: 7251945 - DNA, 22 bp, Homo sapiens
aagtcaagtgttattattgtag

SEQ ID NO: 7251946 - DNA, 22 bp, Homo sapiens
aagtcaaagctttcagaggaaa

SEQ ID NO: 7251947 - DNA, 22 bp, Homo sapiens
aacactggtttggcattagatg

SEQ ID NO: 7251948 - DNA, 22 bp, Homo sapiens
aagttgagagaaagcccgtgtt

SEQ ID NO: 7251949 - DNA, 22 bp, Homo sapiens
aagtttctgccatactgtggtg

SEQ ID NO: 7251950 - DNA, 22 bp, Homo sapiens
aagtttctggaccttacctgct

SEQ ID NO: 7251951 - DNA, 22 bp, Homo sapiens
aagtttctgggcaagacaaggc

SEQ ID NO: 7251952 - DNA, 20 bp, Homo sapiens
aagtttctggtttatatctt

SEQ ID NO: 7251953 - DNA, 22 bp, Homo sapiens
aagtttctgatattgttaaagc

SEQ ID NO: 7251954 - DNA, 20 bp, Homo sapiens
aagtttctggtttatatctt

SEQ ID NO: 7251955 - DNA, 22 bp, Homo sapiens
aagtttctgtatgctcttctgt

SEQ ID NO: 7251956 - DNA, 22 bp, Homo sapiens
aagtttctgttcatatctctga

SEQ ID NO: 7251957 - DNA, 22 bp, Homo sapiens
aagtttctgttcatatctctga

SEQ ID NO: 7251958 - DNA, 22 bp, Homo sapiens
aagtttctttattagcttgtcc

SEQ ID NO: 7251959 - DNA, 22 bp, Homo sapiens
aagtttctgttcgctttaataa

SEQ ID NO: 7251960 - DNA, 22 bp, Homo sapiens
aagtttctgttcgctttaataa

SEQ ID NO: 7251961 - DNA, 20 bp, Homo sapiens
aactcctagcctcaagtgat

SEQ ID NO: 7251962 - DNA, 22 bp, Homo sapiens
aatcacattagtgaaacactga

SEQ ID NO: 7251963 - DNA, 22 bp, Homo sapiens
aaccaggacaatttgaatagaa

SEQ ID NO: 7251964 - DNA, 22 bp, Homo sapiens
aacattgattgcatctgttcac

SEQ ID NO: 7251965 - DNA, 22 bp, Homo sapiens
aacattgagttagggagcgtat

SEQ ID NO: 7251966 - DNA, 22 bp, Homo sapiens
aacattgagttctacttccatt

SEQ ID NO: 7251967 - DNA, 21 bp, Homo sapiens
aacattgattcatttggctat

SEQ ID NO: 7251968 - DNA, 22 bp, Homo sapiens
aacattgaacttggcacaccca

SEQ ID NO: 7251969 - DNA, 22 bp, Homo sapiens
aacatttaggaaggacctcctc

SEQ ID NO: 7251970 - DNA, 22 bp, Homo sapiens
aacatttacaaatccttctgca

SEQ ID NO: 7251971 - DNA, 22 bp, Homo sapiens
aacatttatatgggttcatgaa

SEQ ID NO: 7251972 - DNA, 22 bp, Homo sapiens
aacatttatgattgaggtaaat

SEQ ID NO: 7251973 - DNA, 22 bp, Homo sapiens
aacatttatggtagtcattgca

SEQ ID NO: 7251974 - DNA, 22 bp, Homo sapiens
aacatttattctaattctggga

SEQ ID NO: 7251975 - DNA, 22 bp, Homo sapiens
aacatttattgagcacctactg

SEQ ID NO: 7251976 - DNA, 22 bp, Homo sapiens
aatcacatgtgctcaattttaa

SEQ ID NO: 7251977 - DNA, 22 bp, Homo sapiens
aagctgattctaaaatttatta

SEQ ID NO: 7251978 - DNA, 22 bp, Homo sapiens
aagccagtgtttttgagagttg

SEQ ID NO: 7251979 - DNA, 22 bp, Homo sapiens
aagccagtcctctactgggcac

SEQ ID NO: 7251980 - DNA, 22 bp, Homo sapiens
aagccagtgtccagaatgggca

SEQ ID NO: 7251981 - DNA, 21 bp, Homo sapiens
aagccagcccacagtggtttg

SEQ ID NO: 7251982 - DNA, 22 bp, Homo sapiens
aaattgcattttaaaggtagat

SEQ ID NO: 7251983 - DNA, 22 bp, Homo sapiens
aaattgttgatctacagtaagg

SEQ ID NO: 7251984 - DNA, 22 bp, Homo sapiens
aaatttaaaaagcagcattgca

SEQ ID NO: 7251985 - DNA, 22 bp, Homo sapiens
aaggaccagttttgcagaattg

SEQ ID NO: 7251986 - DNA, 22 bp, Homo sapiens
aaggaccagttgagtgatctta

SEQ ID NO: 7251987 - DNA, 22 bp, Homo sapiens
aaggaccagattatccttaata

SEQ ID NO: 7251988 - DNA, 22 bp, Homo sapiens
aaggagaaatggtagatgtgca

SEQ ID NO: 7251989 - DNA, 22 bp, Homo sapiens
aaggaccacctagggtgggggt

SEQ ID NO: 7251990 - DNA, 17 bp, Homo sapiens
aaggaccaacaggaaat

SEQ ID NO: 7251991 - DNA, 22 bp, Homo sapiens
aaggacaggttggggcttcagg

SEQ ID NO: 7251992 - DNA, 22 bp, Homo sapiens
aagggagacagttgtgtgagga

SEQ ID NO: 7251993 - DNA, 22 bp, Homo sapiens
aaggccaccaccagcgaggggg

SEQ ID NO: 7251994 - DNA, 23 bp, Homo sapiens
aaggcattggcttctctcatttc

SEQ ID NO: 7251995 - DNA, 23 bp, Homo sapiens
aaggcattggcttctctcatttc

SEQ ID NO: 7251996 - DNA, 22 bp, Homo sapiens
aagtatgtcaatcatacttcaa

SEQ ID NO: 7251997 - DNA, 22 bp, Homo sapiens
aagggaggaggatttattgtac

SEQ ID NO: 7251998 - DNA, 22 bp, Homo sapiens
aagggctggagactgggtcttc

SEQ ID NO: 7251999 - DNA, 22 bp, Homo sapiens
aaggggaagtagcaccagaggt

SEQ ID NO: 7252000 - DNA, 22 bp, Homo sapiens
aagggagaggagggtcttgttg

SEQ ID NO: 7252001 - DNA, 21 bp, Homo sapiens
aagggagataggaatcaggcc

SEQ ID NO: 7252002 - DNA, 22 bp, Homo sapiens
aaggggaatagagtgggttgtg

SEQ ID NO: 7252003 - DNA, 22 bp, Homo sapiens
aaggggcatgcttttgccagga

SEQ ID NO: 7252004 - DNA, 22 bp, Homo sapiens
aagaggttgtctgtgatgagtt

SEQ ID NO: 7252005 - DNA, 22 bp, Homo sapiens
aagagtatgcatgcatgtttgt

SEQ ID NO: 7252006 - DNA, 22 bp, Homo sapiens
aagagtttaattttgtctagac

SEQ ID NO: 7252007 - DNA, 23 bp, Homo sapiens
aagagtttagagtcttgcagagt

SEQ ID NO: 7252008 - DNA, 22 bp, Homo sapiens
aagagtttaccagtgctgcttc

SEQ ID NO: 7252009 - DNA, 22 bp, Homo sapiens
aagagtggagctggaaagtggg

SEQ ID NO: 7252010 - DNA, 22 bp, Homo sapiens
acactacagggagaagactcac

SEQ ID NO: 7252011 - DNA, 22 bp, Homo sapiens
aagagtttatgatataacatgt

SEQ ID NO: 7252012 - DNA, 22 bp, Homo sapiens
acacacagagtttatacaggca

SEQ ID NO: 7252013 - DNA, 22 bp, Homo sapiens
acacacagagtttatacaggca

SEQ ID NO: 7252014 - DNA, 22 bp, Homo sapiens
aagaggaggattgatgtgggag

SEQ ID NO: 7252015 - DNA, 23 bp, Homo sapiens
aagaggaggccctgctcccgtcc

SEQ ID NO: 7252016 - DNA, 22 bp, Homo sapiens
aagacatttatttgaatcaatt

SEQ ID NO: 7252017 - DNA, 22 bp, Homo sapiens
aagaggagtagatgtggttggt

SEQ ID NO: 7252018 - DNA, 22 bp, Homo sapiens
aagaggagtagatgtggttggt

SEQ ID NO: 7252019 - DNA, 22 bp, Homo sapiens
aagaggagggcagattcaaggc

SEQ ID NO: 7252020 - DNA, 23 bp, Homo sapiens
aagaggaggccctgctcccgtcc

SEQ ID NO: 7252021 - DNA, 23 bp, Homo sapiens
acagatgaaagtgtggctcagag

SEQ ID NO: 7252022 - DNA, 22 bp, Homo sapiens
acagatgagactccaggacctt

SEQ ID NO: 7252023 - DNA, 22 bp, Homo sapiens
acagatgaaaaagcttgtggat

SEQ ID NO: 7252024 - DNA, 23 bp, Homo sapiens
acagatcatctcgaaacaactat

SEQ ID NO: 7252025 - DNA, 22 bp, Homo sapiens
aagcacagttcttagagttaca

SEQ ID NO: 7252026 - DNA, 22 bp, Homo sapiens
acagaggacaactaggcgctca

SEQ ID NO: 7252027 - DNA, 22 bp, Homo sapiens
acagaggaaggctgagctgccc

SEQ ID NO: 7252028 - DNA, 22 bp, Homo sapiens
acagaggaaggctgagctgccc

SEQ ID NO: 7252029 - DNA, 22 bp, Homo sapiens
acagaggacaactaggcgctca

SEQ ID NO: 7252030 - DNA, 22 bp, Homo sapiens
acagaagcagcgcggctcttct

SEQ ID NO: 7252031 - DNA, 22 bp, Homo sapiens
acagaagaccagagagctaact

SEQ ID NO: 7252032 - DNA, 20 bp, Homo sapiens
aagatactccagaaattaaa

SEQ ID NO: 7252033 - DNA, 22 bp, Homo sapiens
aagatagatgtcatcagcatat

SEQ ID NO: 7252034 - DNA, 22 bp, Homo sapiens
aagaatgaaggatttagctgtt

SEQ ID NO: 7252035 - DNA, 22 bp, Homo sapiens
aagaatttaaactaaccatatg

SEQ ID NO: 7252036 - DNA, 22 bp, Homo sapiens
aattcacaaaagttagatccat

SEQ ID NO: 7252037 - DNA, 22 bp, Homo sapiens
aattcacaaaaccagattgctt

SEQ ID NO: 7252038 - DNA, 20 bp, Homo sapiens
aattagatgtttaatcaata

SEQ ID NO: 7252039 - DNA, 22 bp, Homo sapiens
aattcaatctaagaaatgatca

SEQ ID NO: 7252040 - DNA, 22 bp, Homo sapiens
aagacaatgtttctgatagata

SEQ ID NO: 7252041 - DNA, 22 bp, Homo sapiens
aagacaatgcattactaagaag

SEQ ID NO: 7252042 - DNA, 22 bp, Homo sapiens
aagacaattttgagtatgcaca

SEQ ID NO: 7252043 - DNA, 22 bp, Homo sapiens
aagacaattttgagtatgcaca

SEQ ID NO: 7252044 - DNA, 22 bp, Homo sapiens
aagacacacacatatgctgagt

SEQ ID NO: 7252045 - DNA, 22 bp, Homo sapiens
acaagaaccaaagaaggatatt

SEQ ID NO: 7252046 - DNA, 23 bp, Homo sapiens
acaactttacagatacattttgt

SEQ ID NO: 7252047 - DNA, 22 bp, Homo sapiens
acaactttctgggttatctgat

SEQ ID NO: 7252048 - DNA, 22 bp, Homo sapiens
aatgtatttgatgtattagcct

SEQ ID NO: 7252049 - DNA, 22 bp, Homo sapiens
aatgtattttgggagtttcttt

SEQ ID NO: 7252050 - DNA, 22 bp, Homo sapiens
aactcttaattttcatgaaatg

SEQ ID NO: 7252051 - DNA, 22 bp, Homo sapiens
aactgaaacggtgatcttttaa

SEQ ID NO: 7252052 - DNA, 22 bp, Homo sapiens
aactcctatgacccactgaact

SEQ ID NO: 7252053 - DNA, 23 bp, Homo sapiens
aactctggctagcatagaataga

SEQ ID NO: 7252054 - DNA, 22 bp, Homo sapiens
aataacagaaacttgagcatca

SEQ ID NO: 7252055 - DNA, 22 bp, Homo sapiens
aataacagaaacttgagcatca

SEQ ID NO: 7252056 - DNA, 22 bp, Homo sapiens
aataaagacaaacaggggagcc

SEQ ID NO: 7252057 - DNA, 22 bp, Homo sapiens
aataaagcctgtctctttagag

SEQ ID NO: 7252058 - DNA, 22 bp, Homo sapiens
aataaagtgtattctttgtcat

SEQ ID NO: 7252059 - DNA, 22 bp, Homo sapiens
aataaagccttattgattttac

SEQ ID NO: 7252060 - DNA, 22 bp, Homo sapiens
aataaagtagcgtttaaggtgc

SEQ ID NO: 7252061 - DNA, 22 bp, Homo sapiens
aataaaggcaccataaggcaaa

SEQ ID NO: 7252062 - DNA, 22 bp, Homo sapiens
actgacatttttccctaagcat

SEQ ID NO: 7252063 - DNA, 19 bp, Homo sapiens
actcatctgccacctctgt

SEQ ID NO: 7252064 - DNA, 22 bp, Homo sapiens
actcatatactgttgtttttaa

SEQ ID NO: 7252065 - DNA, 22 bp, Homo sapiens
actcatgtaagcggaatgtagt

SEQ ID NO: 7252066 - DNA, 22 bp, Homo sapiens
actcatctgccattcctgtacc

SEQ ID NO: 7252067 - DNA, 22 bp, Homo sapiens
aagtggagctataggctcagat

SEQ ID NO: 7252068 - DNA, 22 bp, Homo sapiens
aagtggaggccgagttcacgca

SEQ ID NO: 7252069 - DNA, 22 bp, Homo sapiens
aagtggagtccctacaaccagc

SEQ ID NO: 7252070 - DNA, 22 bp, Homo sapiens
aagtggggcctggtggtacagt

SEQ ID NO: 7252071 - DNA, 22 bp, Homo sapiens
aagtttctgaatttgaaaggat

SEQ ID NO: 7252072 - DNA, 22 bp, Homo sapiens
aagtttctcagggttgattggg

SEQ ID NO: 7252073 - DNA, 21 bp, Homo sapiens
aagtttctccctaattgttgc

SEQ ID NO: 7252074 - DNA, 22 bp, Homo sapiens
aagtgaataaaattgtgttctt

SEQ ID NO: 7252075 - DNA, 22 bp, Homo sapiens
aagtgaagaaatacatgagaat

SEQ ID NO: 7252076 - DNA, 21 bp, Homo sapiens
acctttaattcaagcatcagg

SEQ ID NO: 7252077 - DNA, 22 bp, Homo sapiens
acctttatatgaaagatgacat

SEQ ID NO: 7252078 - DNA, 22 bp, Homo sapiens
aagtgaatctcctttctttatt

SEQ ID NO: 7252079 - DNA, 22 bp, Homo sapiens
aagtgaatagcctatttactag

SEQ ID NO: 7252080 - DNA, 22 bp, Homo sapiens
aagtgaattcattgtgttatat

SEQ ID NO: 7252081 - DNA, 22 bp, Homo sapiens
aagtgaatttcattccaattct

SEQ ID NO: 7252082 - DNA, 18 bp, Homo sapiens
aagtgaattgtccttttc

SEQ ID NO: 7252083 - DNA, 22 bp, Homo sapiens
aagtgacataccttacatatgt

SEQ ID NO: 7252084 - DNA, 22 bp, Homo sapiens
aagtgcaggtctcagctactct

SEQ ID NO: 7252085 - DNA, 22 bp, Homo sapiens
aagtgatacctaggaaatcaag

SEQ ID NO: 7252086 - DNA, 22 bp, Homo sapiens
aagtaaatatctgtttatagca

SEQ ID NO: 7252087 - DNA, 20 bp, Homo sapiens
acctggggttgcctgtgctc

SEQ ID NO: 7252088 - DNA, 22 bp, Homo sapiens
acctgggaggcggaggttgcag

SEQ ID NO: 7252089 - DNA, 22 bp, Homo sapiens
acctgggaggcagaggttgcag

SEQ ID NO: 7252090 - DNA, 22 bp, Homo sapiens
acttatgaggagaaaatatata

SEQ ID NO: 7252091 - DNA, 22 bp, Homo sapiens
acttatgaatgtcattataatg

SEQ ID NO: 7252092 - DNA, 18 bp, Homo sapiens
acttaggaggtacctcaa

SEQ ID NO: 7252093 - DNA, 22 bp, Homo sapiens
acttataagagtgctatgggga

SEQ ID NO: 7252094 - DNA, 21 bp, Homo sapiens
acttcccaggacctactcaga

SEQ ID NO: 7252095 - DNA, 22 bp, Homo sapiens
aatactgtgatatcgagcgatt

SEQ ID NO: 7252096 - DNA, 22 bp, Homo sapiens
aatactgtaaatggagcagcca

SEQ ID NO: 7252097 - DNA, 21 bp, Homo sapiens
actgtggggttcaactggcag

SEQ ID NO: 7252098 - DNA, 22 bp, Homo sapiens
actgtgggccattgggttctgt

SEQ ID NO: 7252099 - DNA, 22 bp, Homo sapiens
actgtgggcagcttctgggaac

SEQ ID NO: 7252100 - DNA, 23 bp, Homo sapiens
actgtgggcaccacagagagtgt

SEQ ID NO: 7252101 - DNA, 22 bp, Homo sapiens
actgtgggagcttatcatttca

SEQ ID NO: 7252102 - DNA, 22 bp, Homo sapiens
actgtggggtgcgaggcagtga

SEQ ID NO: 7252103 - DNA, 22 bp, Homo sapiens
actgtggggtgaggcccaagaa

SEQ ID NO: 7252104 - DNA, 22 bp, Homo sapiens
actgtggggggctttgctcagt

SEQ ID NO: 7252105 - DNA, 22 bp, Homo sapiens
actgtgggcctttcctttgacc

SEQ ID NO: 7252106 - DNA, 22 bp, Homo sapiens
actgtgggggagccagtcccat

SEQ ID NO: 7252107 - DNA, 22 bp, Homo sapiens
aatagaaaggaggggctcttgt

SEQ ID NO: 7252108 - DNA, 22 bp, Homo sapiens
aatagaaaggaggggctcttgt

SEQ ID NO: 7252109 - DNA, 22 bp, Homo sapiens
aatacttgtcagatgaataaga

SEQ ID NO: 7252110 - DNA, 22 bp, Homo sapiens
aatactgtgggatgcagtagga

SEQ ID NO: 7252111 - DNA, 22 bp, Homo sapiens
aataacagattttcaagctgtg

SEQ ID NO: 7252112 - DNA, 22 bp, Homo sapiens
actgtgggagcgcagtggcagc

SEQ ID NO: 7252113 - DNA, 22 bp, Homo sapiens
actgtgggaaccactgaatcag

SEQ ID NO: 7252114 - DNA, 22 bp, Homo sapiens
actgtgggacatccctccctat

SEQ ID NO: 7252115 - DNA, 22 bp, Homo sapiens
actgtggctcatcaggctggtg

SEQ ID NO: 7252116 - DNA, 22 bp, Homo sapiens
aatcttttgattctagggctgt

SEQ ID NO: 7252117 - DNA, 22 bp, Homo sapiens
aatcttttaggggatcctgagg

SEQ ID NO: 7252118 - DNA, 22 bp, Homo sapiens
aatctttttcacaagaaagcac

SEQ ID NO: 7252119 - DNA, 22 bp, Homo sapiens
aatcttacaccgaatttaaact

SEQ ID NO: 7252120 - DNA, 22 bp, Homo sapiens
aatctgtattgttaacaagtaa

SEQ ID NO: 7252121 - DNA, 22 bp, Homo sapiens
aatctgtttaacagatttctgt

SEQ ID NO: 7252122 - DNA, 22 bp, Homo sapiens
aatctgtttttgaaactttgta

SEQ ID NO: 7252123 - DNA, 22 bp, Homo sapiens
aatatgcagcatgatgaagtaa

SEQ ID NO: 7252124 - DNA, 22 bp, Homo sapiens
aatatgcagcatgatgaagtaa

SEQ ID NO: 7252125 - DNA, 22 bp, Homo sapiens
aatatgcaaataggtgtaatga

SEQ ID NO: 7252126 - DNA, 22 bp, Homo sapiens
aatatgcaaataggtgtaatga

SEQ ID NO: 7252127 - DNA, 22 bp, Homo sapiens
agaaaataatttcttggctggt

SEQ ID NO: 7252128 - DNA, 21 bp, Homo sapiens
agaaaatggcgttttagattt

SEQ ID NO: 7252129 - DNA, 22 bp, Homo sapiens
agaaaatattcattgagaggct

SEQ ID NO: 7252130 - DNA, 22 bp, Homo sapiens
agaaaatattcattgagaggct

SEQ ID NO: 7252131 - DNA, 22 bp, Homo sapiens
agaaaatgtgaacttgtgaatt

SEQ ID NO: 7252132 - DNA, 21 bp, Homo sapiens
agaaaatggcgttttagattt

SEQ ID NO: 7252133 - DNA, 22 bp, Homo sapiens
agaaaattactccagagacaag

SEQ ID NO: 7252134 - DNA, 22 bp, Homo sapiens
agaaacctcacagcaattctga

SEQ ID NO: 7252135 - DNA, 22 bp, Homo sapiens
acagtgcaggtctcaacaatta

SEQ ID NO: 7252136 - DNA, 22 bp, Homo sapiens
acagtgcataaaaacaactttt

SEQ ID NO: 7252137 - DNA, 22 bp, Homo sapiens
acagtgtagcatggtagcaatg

SEQ ID NO: 7252138 - DNA, 22 bp, Homo sapiens
acagtgtatattgtttatctgg

SEQ ID NO: 7252139 - DNA, 22 bp, Homo sapiens
acagtgtactaaatagtaagag

SEQ ID NO: 7252140 - DNA, 22 bp, Homo sapiens
acagatgaggaagagtcagcca

SEQ ID NO: 7252141 - DNA, 21 bp, Homo sapiens
acaggagaccgcctggcagtc

SEQ ID NO: 7252142 - DNA, 22 bp, Homo sapiens
acaggagcccaggatgggcgga

SEQ ID NO: 7252143 - DNA, 20 bp, Homo sapiens
acaggagatctgaggaaagg

SEQ ID NO: 7252144 - DNA, 22 bp, Homo sapiens
acaggcactttgacatgccatc

SEQ ID NO: 7252145 - DNA, 22 bp, Homo sapiens
aagtaaaatgtttcctttatta

SEQ ID NO: 7252146 - DNA, 22 bp, Homo sapiens
accagcacttccagaggtcagg

SEQ ID NO: 7252147 - DNA, 22 bp, Homo sapiens
accagcacggattagaatgctt

SEQ ID NO: 7252148 - DNA, 22 bp, Homo sapiens
aagggcaggaaaagatggatgt

SEQ ID NO: 7252149 - DNA, 22 bp, Homo sapiens
aagggcagctgacagatgctta

SEQ ID NO: 7252150 - DNA, 22 bp, Homo sapiens
aagggcagcctgactcacggtc

SEQ ID NO: 7252151 - DNA, 22 bp, Homo sapiens
aaggccagctggagggatgagg

SEQ ID NO: 7252152 - DNA, 22 bp, Homo sapiens
acattctgaaatccatgtgggt

SEQ ID NO: 7252153 - DNA, 22 bp, Homo sapiens
acattcaaccaatgtttgctat

SEQ ID NO: 7252154 - DNA, 22 bp, Homo sapiens
acattcaagatgcattcactta

SEQ ID NO: 7252155 - DNA, 22 bp, Homo sapiens
acattacctggcatttgatctt

SEQ ID NO: 7252156 - DNA, 22 bp, Homo sapiens
acattatagttgctacagagta

SEQ ID NO: 7252157 - DNA, 22 bp, Homo sapiens
acataagtgcacaataaatatt

SEQ ID NO: 7252158 - DNA, 22 bp, Homo sapiens
acataatgaaatgcagaaatca

SEQ ID NO: 7252159 - DNA, 22 bp, Homo sapiens
acatacattgcctcattggtaa

SEQ ID NO: 7252160 - DNA, 22 bp, Homo sapiens
acatgcattctctaaaagcaaa

SEQ ID NO: 7252161 - DNA, 22 bp, Homo sapiens
acatgcattctctaaaagcaaa

SEQ ID NO: 7252162 - DNA, 22 bp, Homo sapiens
acatgcattaaaaatacttgtg

SEQ ID NO: 7252163 - DNA, 22 bp, Homo sapiens
acatgcattaaaaatacttgtg

SEQ ID NO: 7252164 - DNA, 23 bp, Homo sapiens
acatagaacagaatatatttgtg

SEQ ID NO: 7252165 - DNA, 22 bp, Homo sapiens
acatagaaatttatttcttaca

SEQ ID NO: 7252166 - DNA, 22 bp, Homo sapiens
agaggtggccatgggcgctgga

SEQ ID NO: 7252167 - DNA, 22 bp, Homo sapiens
acaaaaaccgtggattcagcat

SEQ ID NO: 7252168 - DNA, 22 bp, Homo sapiens
agaggtggccatgggcgctgga

SEQ ID NO: 7252169 - DNA, 22 bp, Homo sapiens
agagtacactgtacacacaatt

SEQ ID NO: 7252170 - DNA, 22 bp, Homo sapiens
agagtgaaaagctagagcagta

SEQ ID NO: 7252171 - DNA, 22 bp, Homo sapiens
agagtgaaaagctagagcagta

SEQ ID NO: 7252172 - DNA, 22 bp, Homo sapiens
agatatgagaatatagaggccc

SEQ ID NO: 7252173 - DNA, 22 bp, Homo sapiens
agatatgactagaagctcattt

SEQ ID NO: 7252174 - DNA, 22 bp, Homo sapiens
agatatagttgttgagaagaac

SEQ ID NO: 7252175 - DNA, 22 bp, Homo sapiens
agatcccaggatactggcctat

SEQ ID NO: 7252176 - DNA, 21 bp, Homo sapiens
agattacaggtgtgatccacc

SEQ ID NO: 7252177 - DNA, 22 bp, Homo sapiens
agattacagaagaataagtaga

SEQ ID NO: 7252178 - DNA, 22 bp, Homo sapiens
agattacagcatgggaatggga

SEQ ID NO: 7252179 - DNA, 22 bp, Homo sapiens
agattacaaatcctctgtgttt

SEQ ID NO: 7252180 - DNA, 22 bp, Homo sapiens
agatgttttggagacactaacc

SEQ ID NO: 7252181 - DNA, 22 bp, Homo sapiens
aattcagttatatgtccacttc

SEQ ID NO: 7252182 - DNA, 22 bp, Homo sapiens
aattcagtgtctggcactgctg

SEQ ID NO: 7252183 - DNA, 22 bp, Homo sapiens
aattcacatgttgaagtcctaa

SEQ ID NO: 7252184 - DNA, 22 bp, Homo sapiens
aattcacatgcatgtctgtgca

SEQ ID NO: 7252185 - DNA, 22 bp, Homo sapiens
aattcacatccgaccaggtcaa

SEQ ID NO: 7252186 - DNA, 22 bp, Homo sapiens
aattcacatatacattattcct

SEQ ID NO: 7252187 - DNA, 22 bp, Homo sapiens
aattcacagttctgcaccttac

SEQ ID NO: 7252188 - DNA, 22 bp, Homo sapiens
aattcacaggatcacaggagag

SEQ ID NO: 7252189 - DNA, 22 bp, Homo sapiens
aattcacagcatttgcccatct

SEQ ID NO: 7252190 - DNA, 22 bp, Homo sapiens
aattcacaggaggtatttgtcc

SEQ ID NO: 7252191 - DNA, 22 bp, Homo sapiens
agagcagctggggcagagacca

SEQ ID NO: 7252192 - DNA, 22 bp, Homo sapiens
agagcagctgtgacatggacag

SEQ ID NO: 7252193 - DNA, 23 bp, Homo sapiens
agaggcaggagtggcttgcccgg

SEQ ID NO: 7252194 - DNA, 22 bp, Homo sapiens
agaggccaagccagactgtgca

SEQ ID NO: 7252195 - DNA, 22 bp, Homo sapiens
aatttatggtggggtaagggga

SEQ ID NO: 7252196 - DNA, 22 bp, Homo sapiens
aatttatgacaaacaggtaggt

SEQ ID NO: 7252197 - DNA, 22 bp, Homo sapiens
agaggccaatagtaggtggcat

SEQ ID NO: 7252198 - DNA, 22 bp, Homo sapiens
aatttatggccttcgtcttgat

SEQ ID NO: 7252199 - DNA, 17 bp, Homo sapiens
agagggctcaaggcatc

SEQ ID NO: 7252200 - DNA, 22 bp, Homo sapiens
agagggctggacgcaggttgga

SEQ ID NO: 7252201 - DNA, 22 bp, Homo sapiens
agagggctgcctcagtcagcta

SEQ ID NO: 7252202 - DNA, 22 bp, Homo sapiens
agagggctgctgcacagtgctc

SEQ ID NO: 7252203 - DNA, 21 bp, Homo sapiens
aattttgaaggaagattaagg

SEQ ID NO: 7252204 - DNA, 21 bp, Homo sapiens
aattttgaaggaagattaagg

SEQ ID NO: 7252205 - DNA, 22 bp, Homo sapiens
agagggcccatgttgggctgct

SEQ ID NO: 7252206 - DNA, 21 bp, Homo sapiens
agagggcgaaggcggggtccg

SEQ ID NO: 7252207 - DNA, 22 bp, Homo sapiens
agagggctaactgggaagcagg

SEQ ID NO: 7252208 - DNA, 22 bp, Homo sapiens
agagggcatgcttggtggcctg

SEQ ID NO: 7252209 - DNA, 22 bp, Homo sapiens
agactgggccatttccccagct

SEQ ID NO: 7252210 - DNA, 22 bp, Homo sapiens
agagaaacccttcagtgttttg

SEQ ID NO: 7252211 - DNA, 19 bp, Homo sapiens
agagaaagaattgagtcta

SEQ ID NO: 7252212 - DNA, 18 bp, Homo sapiens
agagaaagaccaaagcat

SEQ ID NO: 7252213 - DNA, 19 bp, Homo sapiens
agagaaagaattgagtcta

SEQ ID NO: 7252214 - DNA, 22 bp, Homo sapiens
agagaaagtaaagattctacct

SEQ ID NO: 7252215 - DNA, 18 bp, Homo sapiens
agagaaagaccaaagcat

SEQ ID NO: 7252216 - DNA, 22 bp, Homo sapiens
agacctctggatagatgtgagg

SEQ ID NO: 7252217 - DNA, 23 bp, Homo sapiens
agagagagtttgtgtcaggtacc

SEQ ID NO: 7252218 - DNA, 22 bp, Homo sapiens
agagatataagtataaataggg

SEQ ID NO: 7252219 - DNA, 22 bp, Homo sapiens
agagatagtgtattagttgggc

SEQ ID NO: 7252220 - DNA, 22 bp, Homo sapiens
aattcacagaaccatggtgctc

SEQ ID NO: 7252221 - DNA, 22 bp, Homo sapiens
aattcacacctccggtttttct

SEQ ID NO: 7252222 - DNA, 20 bp, Homo sapiens
agagagaggtaaattgagca

SEQ ID NO: 7252223 - DNA, 22 bp, Homo sapiens
agagagaggggcgagcaaacac

SEQ ID NO: 7252224 - DNA, 22 bp, Homo sapiens
agagagaggcagcagtgctcac

SEQ ID NO: 7252225 - DNA, 22 bp, Homo sapiens
agagagaggcagcagtgctcac

SEQ ID NO: 7252226 - DNA, 17 bp, Homo sapiens
agagagagcatgccacc

SEQ ID NO: 7252227 - DNA, 17 bp, Homo sapiens
agagagagcatgccacc

SEQ ID NO: 7252228 - DNA, 22 bp, Homo sapiens
agagagagaaatgaaatgtgct

SEQ ID NO: 7252229 - DNA, 20 bp, Homo sapiens
agagagacctaggcctagtc

SEQ ID NO: 7252230 - DNA, 22 bp, Homo sapiens
agagaaagtcctgatctctcta

SEQ ID NO: 7252231 - DNA, 21 bp, Homo sapiens
agaatccaagatgccattggc

SEQ ID NO: 7252232 - DNA, 22 bp, Homo sapiens
agaatcagtgctggctattagc

SEQ ID NO: 7252233 - DNA, 21 bp, Homo sapiens
agaataatggtatcatttgct

SEQ ID NO: 7252234 - DNA, 22 bp, Homo sapiens
agaataatcactgaagttcaaa

SEQ ID NO: 7252235 - DNA, 22 bp, Homo sapiens
agaataatcactgaagttcaaa

SEQ ID NO: 7252236 - DNA, 22 bp, Homo sapiens
agaataaatgctacctatcaca

SEQ ID NO: 7252237 - DNA, 22 bp, Homo sapiens
aatgtacagctgctgctgaagg

SEQ ID NO: 7252238 - DNA, 22 bp, Homo sapiens
agaatttctggaagattgcaag

SEQ ID NO: 7252239 - DNA, 22 bp, Homo sapiens
aatgtacactgaaagcctatca

SEQ ID NO: 7252240 - DNA, 22 bp, Homo sapiens
agaatttaggatgcatgtgaat

SEQ ID NO: 7252241 - DNA, 22 bp, Homo sapiens
agaattgttctgtagcttggct

SEQ ID NO: 7252242 - DNA, 22 bp, Homo sapiens
agcaggagggttttgtagagtc

SEQ ID NO: 7252243 - DNA, 22 bp, Homo sapiens
agcaggaggagagcctggcggt

SEQ ID NO: 7252244 - DNA, 22 bp, Homo sapiens
agcaggaacgagttcatgggga

SEQ ID NO: 7252245 - DNA, 22 bp, Homo sapiens
agcagctctgtttacctggagg

SEQ ID NO: 7252246 - DNA, 22 bp, Homo sapiens
agcagctcttaacaaagcatgg

SEQ ID NO: 7252247 - DNA, 22 bp, Homo sapiens
agcagctctggcactgtagcat

SEQ ID NO: 7252248 - DNA, 22 bp, Homo sapiens
agcagctcgggctacagagggg

SEQ ID NO: 7252249 - DNA, 22 bp, Homo sapiens
agcagctctgagaggccagcac

SEQ ID NO: 7252250 - DNA, 22 bp, Homo sapiens
agcagctcctgtttttgggata

SEQ ID NO: 7252251 - DNA, 22 bp, Homo sapiens
agcagctcggccagtcaccagg

SEQ ID NO: 7252252 - DNA, 22 bp, Homo sapiens
agcagctcctgccatgagtgct

SEQ ID NO: 7252253 - DNA, 22 bp, Homo sapiens
agcagccatagatagcatgcaa

SEQ ID NO: 7252254 - DNA, 22 bp, Homo sapiens
agcaggtgagcacagccaggct

SEQ ID NO: 7252255 - DNA, 22 bp, Homo sapiens
agcatccagatgcctgatgtca

SEQ ID NO: 7252256 - DNA, 22 bp, Homo sapiens
agcagggcccactaggggagat

SEQ ID NO: 7252257 - DNA, 22 bp, Homo sapiens
acacactgctcatgaggagcat

SEQ ID NO: 7252258 - DNA, 22 bp, Homo sapiens
acacactgagtgccataggacc

SEQ ID NO: 7252259 - DNA, 22 bp, Homo sapiens
agcagaaaattggaaatgacaa

SEQ ID NO: 7252260 - DNA, 22 bp, Homo sapiens
agatttggtgtctggttgatat

SEQ ID NO: 7252261 - DNA, 22 bp, Homo sapiens
agatttctgtcaccttctatgc

SEQ ID NO: 7252262 - DNA, 22 bp, Homo sapiens
agatttctgtggtcatgtaatg

SEQ ID NO: 7252263 - DNA, 22 bp, Homo sapiens
agcagcatacacatcatgttga

SEQ ID NO: 7252264 - DNA, 22 bp, Homo sapiens
agcagccagagtctgaacatta

SEQ ID NO: 7252265 - DNA, 22 bp, Homo sapiens
agcagccaggaatctgcagagc

SEQ ID NO: 7252266 - DNA, 19 bp, Homo sapiens
agcagcaactgttgattca

SEQ ID NO: 7252267 - DNA, 22 bp, Homo sapiens
agcatctggtgagggcctagtt

SEQ ID NO: 7252268 - DNA, 22 bp, Homo sapiens
agccaggctcaaggcctgctcc

SEQ ID NO: 7252269 - DNA, 20 bp, Homo sapiens
agccaggctcaagctccccc

SEQ ID NO: 7252270 - DNA, 22 bp, Homo sapiens
agccaggcgggtctttgctcct

SEQ ID NO: 7252271 - DNA, 22 bp, Homo sapiens
agccaggctaaatgagccatga

SEQ ID NO: 7252272 - DNA, 22 bp, Homo sapiens
agccaggctaaatgagccatga

SEQ ID NO: 7252273 - DNA, 22 bp, Homo sapiens
agccaggctactccttgctgac

SEQ ID NO: 7252274 - DNA, 23 bp, Homo sapiens
agcattgatgcaaggtgcccctg

SEQ ID NO: 7252275 - DNA, 22 bp, Homo sapiens
agcattgatttgtgaccaacaa

SEQ ID NO: 7252276 - DNA, 22 bp, Homo sapiens
agccaggcggggcaggtttcct

SEQ ID NO: 7252277 - DNA, 22 bp, Homo sapiens
acagacagtatggtggggctga

SEQ ID NO: 7252278 - DNA, 21 bp, Homo sapiens
acagacagggccagtgtcccc

SEQ ID NO: 7252279 - DNA, 22 bp, Homo sapiens
acagacagggcacctgcctcct

SEQ ID NO: 7252280 - DNA, 22 bp, Homo sapiens
acagacagtaaatagtgtggct

SEQ ID NO: 7252281 - DNA, 22 bp, Homo sapiens
acagacagtaaatagtgtggct

SEQ ID NO: 7252282 - DNA, 22 bp, Homo sapiens
agcccaggtctggcccagcctg

SEQ ID NO: 7252283 - DNA, 22 bp, Homo sapiens
agcccaggtctcaaagtacagg

SEQ ID NO: 7252284 - DNA, 22 bp, Homo sapiens
agcccagctttgaaccatatca

SEQ ID NO: 7252285 - DNA, 22 bp, Homo sapiens
acagaactgtgatctcataaat

SEQ ID NO: 7252286 - DNA, 22 bp, Homo sapiens
agcccagggagttgattagcat

SEQ ID NO: 7252287 - DNA, 22 bp, Homo sapiens
acagaacaggctgagaaaaaca

SEQ ID NO: 7252288 - DNA, 22 bp, Homo sapiens
acagaactgagaattctctatc

SEQ ID NO: 7252289 - DNA, 22 bp, Homo sapiens
agctcagggccatcggcccttt

SEQ ID NO: 7252290 - DNA, 23 bp, Homo sapiens
agctccaggtgattgtaatgtgt

SEQ ID NO: 7252291 - DNA, 22 bp, Homo sapiens
agcctggctaaattctcccatg

SEQ ID NO: 7252292 - DNA, 22 bp, Homo sapiens
agccttacataaacagccttat

SEQ ID NO: 7252293 - DNA, 22 bp, Homo sapiens
agccctgtagatttaggagagt

SEQ ID NO: 7252294 - DNA, 22 bp, Homo sapiens
agccctgtctctcactccaggt

SEQ ID NO: 7252295 - DNA, 17 bp, Homo sapiens
agccctgtgctcttttt

SEQ ID NO: 7252296 - DNA, 22 bp, Homo sapiens
agccctgtgtgcttgtgttcct

SEQ ID NO: 7252297 - DNA, 20 bp, Homo sapiens
agccctgtaaatcccctgga

SEQ ID NO: 7252298 - DNA, 22 bp, Homo sapiens
agccctgggttagggtgggagc

SEQ ID NO: 7252299 - DNA, 22 bp, Homo sapiens
agccctgtgggccttgtggcac

SEQ ID NO: 7252300 - DNA, 22 bp, Homo sapiens
agccctgttaactgttttgaag

SEQ ID NO: 7252301 - DNA, 22 bp, Homo sapiens
agcctggccaggcctgcccagg

SEQ ID NO: 7252302 - DNA, 22 bp, Homo sapiens
acagacatggaccaagcactgt

SEQ ID NO: 7252303 - DNA, 22 bp, Homo sapiens
agccctgcacagttcgggagga

SEQ ID NO: 7252304 - DNA, 22 bp, Homo sapiens
agccctgcacaggtctgtggct

SEQ ID NO: 7252305 - DNA, 22 bp, Homo sapiens
agccctgcataaatcagttggt

SEQ ID NO: 7252306 - DNA, 22 bp, Homo sapiens
agccctgcaggatgagggaggt

SEQ ID NO: 7252307 - DNA, 22 bp, Homo sapiens
agccctgcaggaggtgggagag

SEQ ID NO: 7252308 - DNA, 22 bp, Homo sapiens
agccctgcctctccaatgccca

SEQ ID NO: 7252309 - DNA, 16 bp, Homo sapiens
agccctgccgtgtact

SEQ ID NO: 7252310 - DNA, 22 bp, Homo sapiens
agccctgccctgccatgtggca

SEQ ID NO: 7252311 - DNA, 22 bp, Homo sapiens
agccctgccattctctggagct

SEQ ID NO: 7252312 - DNA, 22 bp, Homo sapiens
agccctgcatagaagggaacac

SEQ ID NO: 7252313 - DNA, 22 bp, Homo sapiens
agccctgcgctcacgttctgca

SEQ ID NO: 7252314 - DNA, 22 bp, Homo sapiens
agccctgcgatcgtgatttctt

SEQ ID NO: 7252315 - DNA, 22 bp, Homo sapiens
agccctggggctggtcttggaa

SEQ ID NO: 7252316 - DNA, 22 bp, Homo sapiens
tcaaaagtctgcattcttcaca

SEQ ID NO: 7252317 - DNA, 22 bp, Homo sapiens
tcaaaaatggtctttgagctgc

SEQ ID NO: 7252318 - DNA, 19 bp, Homo sapiens
tcaatgcatgaaatcagcc

SEQ ID NO: 7252319 - DNA, 22 bp, Homo sapiens
tcaatagaaatgcagagtctca

SEQ ID NO: 7252320 - DNA, 22 bp, Homo sapiens
tcacacagcttggagttatggt

SEQ ID NO: 7252321 - DNA, 22 bp, Homo sapiens
tcacacagggtcggaaagagtg

SEQ ID NO: 7252322 - DNA, 22 bp, Homo sapiens
tcaatttaaggtactactttgg

SEQ ID NO: 7252323 - DNA, 23 bp, Homo sapiens
tcaattatcaatggaaagaagtt

SEQ ID NO: 7252324 - DNA, 22 bp, Homo sapiens
tcaattacagcacagtactcca

SEQ ID NO: 7252325 - DNA, 22 bp, Homo sapiens
tcaattcatagagttgacacag

SEQ ID NO: 7252326 - DNA, 22 bp, Homo sapiens
tcaattcaattgcatttctgtg

SEQ ID NO: 7252327 - DNA, 22 bp, Homo sapiens
tcaattcagtccaacagtaatt

SEQ ID NO: 7252328 - DNA, 22 bp, Homo sapiens
tcaattcaacacatgcacattg

SEQ ID NO: 7252329 - DNA, 22 bp, Homo sapiens
tcacatctgattagtgactgat

SEQ ID NO: 7252330 - DNA, 22 bp, Homo sapiens
tcacatctgaaaaaatattgag

SEQ ID NO: 7252331 - DNA, 22 bp, Homo sapiens
tcacagcaccaggatctctcca

SEQ ID NO: 7252332 - DNA, 22 bp, Homo sapiens
tcacagcacatggaccgagtcc

SEQ ID NO: 7252333 - DNA, 22 bp, Homo sapiens
tcacagcaacactggggcagac

SEQ ID NO: 7252334 - DNA, 22 bp, Homo sapiens
tcacagcaaccctgaggcgagt

SEQ ID NO: 7252335 - DNA, 22 bp, Homo sapiens
tcacagcagggtaacaggaaga

SEQ ID NO: 7252336 - DNA, 22 bp, Homo sapiens
tcacagcaggcagatattgttg

SEQ ID NO: 7252337 - DNA, 22 bp, Homo sapiens
tcacagcaccctgaggtgctgg

SEQ ID NO: 7252338 - DNA, 22 bp, Homo sapiens
tcacagcagaatttaggaggca

SEQ ID NO: 7252339 - DNA, 22 bp, Homo sapiens
tcacagcattcgcaatggacag

SEQ ID NO: 7252340 - DNA, 19 bp, Homo sapiens
tcacagcatctgtctgaac

SEQ ID NO: 7252341 - DNA, 22 bp, Homo sapiens
tcacagcagtaaagaaaacact

SEQ ID NO: 7252342 - DNA, 22 bp, Homo sapiens
tcacagcattgagtgtactaga

SEQ ID NO: 7252343 - DNA, 22 bp, Homo sapiens
tcacagcatttttagaaagatt

SEQ ID NO: 7252344 - DNA, 22 bp, Homo sapiens
tcacagcattgtcacaaggctg

SEQ ID NO: 7252345 - DNA, 22 bp, Homo sapiens
tcacagacaattgttttggtgt

SEQ ID NO: 7252346 - DNA, 22 bp, Homo sapiens
tcacacatactcatgtgtgagt

SEQ ID NO: 7252347 - DNA, 22 bp, Homo sapiens
tcacagcaaatgctgcttctca

SEQ ID NO: 7252348 - DNA, 22 bp, Homo sapiens
tcacagcaaaagtgtgcagagc

SEQ ID NO: 7252349 - DNA, 22 bp, Homo sapiens
tcacagacaccttggccacagt

SEQ ID NO: 7252350 - DNA, 22 bp, Homo sapiens
tcacagacacattaaacatgtg

SEQ ID NO: 7252351 - DNA, 22 bp, Homo sapiens
tcacagacacagggagaagcat

SEQ ID NO: 7252352 - DNA, 18 bp, Homo sapiens
tcacagacagctgtcttt

SEQ ID NO: 7252353 - DNA, 19 bp, Homo sapiens
tcacagacagagcaatcac

SEQ ID NO: 7252354 - DNA, 22 bp, Homo sapiens
tcacagacactgggttattgca

SEQ ID NO: 7252355 - DNA, 22 bp, Homo sapiens
tcacagacagaagggatgggat

SEQ ID NO: 7252356 - DNA, 22 bp, Homo sapiens
tcacagacccttgctgagctct

SEQ ID NO: 7252357 - DNA, 22 bp, Homo sapiens
tcacagacatggtgaggtaaca

SEQ ID NO: 7252358 - DNA, 20 bp, Homo sapiens
tcagagaagggactgagatt

SEQ ID NO: 7252359 - DNA, 22 bp, Homo sapiens
tcagaagaaggtatatttatac

SEQ ID NO: 7252360 - DNA, 22 bp, Homo sapiens
tcagaggcctgaaagaatttgg

SEQ ID NO: 7252361 - DNA, 20 bp, Homo sapiens
tcagaggctgccagctgggg

SEQ ID NO: 7252362 - DNA, 22 bp, Homo sapiens
tcagaggacgcactagggttgt

SEQ ID NO: 7252363 - DNA, 22 bp, Homo sapiens
tcagaggagaagttgggaaaat

SEQ ID NO: 7252364 - DNA, 22 bp, Homo sapiens
tcagaggagaccaaggggaata

SEQ ID NO: 7252365 - DNA, 19 bp, Homo sapiens
tcagaggatttggctatga

SEQ ID NO: 7252366 - DNA, 22 bp, Homo sapiens
tcagagagctggtgggcagagg

SEQ ID NO: 7252367 - DNA, 22 bp, Homo sapiens
tcagagagcctcaggcactgcc

SEQ ID NO: 7252368 - DNA, 18 bp, Homo sapiens
tcagagagcagctttatt

SEQ ID NO: 7252369 - DNA, 22 bp, Homo sapiens
tcagagagcagaacttttttac

SEQ ID NO: 7252370 - DNA, 20 bp, Homo sapiens
tcagagagagggtgccactt

SEQ ID NO: 7252371 - DNA, 22 bp, Homo sapiens
tcagagacagttctggggcagg

SEQ ID NO: 7252372 - DNA, 22 bp, Homo sapiens
tcagagagaaatagtttttgac

SEQ ID NO: 7252373 - DNA, 18 bp, Homo sapiens
tcagagagaatagtaatt

SEQ ID NO: 7252374 - DNA, 23 bp, Homo sapiens
tcagagagctgttgagagctgcc

SEQ ID NO: 7252375 - DNA, 23 bp, Homo sapiens
tcagagagctgttgagagctgcc

SEQ ID NO: 7252376 - DNA, 22 bp, Homo sapiens
tcagagaggattttaataagtg

SEQ ID NO: 7252377 - DNA, 22 bp, Homo sapiens
tcagaggaagccttggtgggag

SEQ ID NO: 7252378 - DNA, 22 bp, Homo sapiens
tcagaggaataatgctgcattt

SEQ ID NO: 7252379 - DNA, 22 bp, Homo sapiens
tcagaggaatttgcttttcatg

SEQ ID NO: 7252380 - DNA, 22 bp, Homo sapiens
tcagaggacaagctccctggtg

SEQ ID NO: 7252381 - DNA, 22 bp, Homo sapiens
tcagaggaccttactgagaacc

SEQ ID NO: 7252382 - DNA, 17 bp, Homo sapiens
tcactgggcctgctccc

SEQ ID NO: 7252383 - DNA, 22 bp, Homo sapiens
tcactggggccatgtgagggac

SEQ ID NO: 7252384 - DNA, 22 bp, Homo sapiens
tcactgggccctgaggtgggac

SEQ ID NO: 7252385 - DNA, 22 bp, Homo sapiens
tcactggggcctttggtcagga

SEQ ID NO: 7252386 - DNA, 22 bp, Homo sapiens
tcactgggtaggacatgctgat

SEQ ID NO: 7252387 - DNA, 22 bp, Homo sapiens
tcacatgagtattattttccaa

SEQ ID NO: 7252388 - DNA, 22 bp, Homo sapiens
tcacatcttggattacaatttt

SEQ ID NO: 7252389 - DNA, 20 bp, Homo sapiens
tcacatctggcagctgatga

SEQ ID NO: 7252390 - DNA, 22 bp, Homo sapiens
tcaggggctgtgcatttcccag

SEQ ID NO: 7252391 - DNA, 22 bp, Homo sapiens
tcaggggcttgaggtgcatgtc

SEQ ID NO: 7252392 - DNA, 22 bp, Homo sapiens
tcaggggacttaggagagaagt

SEQ ID NO: 7252393 - DNA, 22 bp, Homo sapiens
tcaggggacagccagctggagg

SEQ ID NO: 7252394 - DNA, 22 bp, Homo sapiens
tcaggtcctctgggtcccagcc

SEQ ID NO: 7252395 - DNA, 22 bp, Homo sapiens
tcagggtgaaccaggcaggaat

SEQ ID NO: 7252396 - DNA, 22 bp, Homo sapiens
tcagggtgaaattgggtcctgg

SEQ ID NO: 7252397 - DNA, 22 bp, Homo sapiens
tcagggtgaaccaggcaggaat

SEQ ID NO: 7252398 - DNA, 22 bp, Homo sapiens
tcagggggaggagactgccagt

SEQ ID NO: 7252399 - DNA, 22 bp, Homo sapiens
tcaggcctttgaacttggagtg

SEQ ID NO: 7252400 - DNA, 22 bp, Homo sapiens
tcatcatctgcaagctcatgtc

SEQ ID NO: 7252401 - DNA, 20 bp, Homo sapiens
tcatatttttgccctgggcc

SEQ ID NO: 7252402 - DNA, 22 bp, Homo sapiens
tcatccagtatgactggtgtct

SEQ ID NO: 7252403 - DNA, 22 bp, Homo sapiens
tcataaaaatagactctaaagt

SEQ ID NO: 7252404 - DNA, 22 bp, Homo sapiens
tcagtttcctggttttgacatt

SEQ ID NO: 7252405 - DNA, 22 bp, Homo sapiens
tcagtgcttgacagctctggga

SEQ ID NO: 7252406 - DNA, 22 bp, Homo sapiens
tcagtgcttgcctctggaggag

SEQ ID NO: 7252407 - DNA, 23 bp, Homo sapiens
tcagtgcttgggggtgacgcgcc

SEQ ID NO: 7252408 - DNA, 22 bp, Homo sapiens
tcagtggaactgtctgggtgag

SEQ ID NO: 7252409 - DNA, 19 bp, Homo sapiens
tcagtggagaaaggggaag

SEQ ID NO: 7252410 - DNA, 22 bp, Homo sapiens
tcagtggagagcttccaggatt

SEQ ID NO: 7252411 - DNA, 22 bp, Homo sapiens
tcagtggattggatgagatctg

SEQ ID NO: 7252412 - DNA, 22 bp, Homo sapiens
tcagtggattgtagaaggctta

SEQ ID NO: 7252413 - DNA, 22 bp, Homo sapiens
tcagtggagctaagcatgagat

SEQ ID NO: 7252414 - DNA, 22 bp, Homo sapiens
tcagtggagctaagcatgagat

SEQ ID NO: 7252415 - DNA, 22 bp, Homo sapiens
tcagtggagtatggatgaagtc

SEQ ID NO: 7252416 - DNA, 22 bp, Homo sapiens
tcagtggatatttctgtggctg

SEQ ID NO: 7252417 - DNA, 22 bp, Homo sapiens
tcagtggatatttctgtggctg

SEQ ID NO: 7252418 - DNA, 19 bp, Homo sapiens
tcagtggatgaacatgttt

SEQ ID NO: 7252419 - DNA, 22 bp, Homo sapiens
tcagtggattgacatgaaaaag

SEQ ID NO: 7252420 - DNA, 22 bp, Homo sapiens
tcaggaggtccgcccgggaggg

SEQ ID NO: 7252421 - DNA, 22 bp, Homo sapiens
tcagagtgaccttacatggtct

SEQ ID NO: 7252422 - DNA, 23 bp, Homo sapiens
tcagagtagcaatttttctctcc

SEQ ID NO: 7252423 - DNA, 22 bp, Homo sapiens
tcagagtgaggcgtcaacatga

SEQ ID NO: 7252424 - DNA, 22 bp, Homo sapiens
tcagagtgcagcgggaggctgg

SEQ ID NO: 7252425 - DNA, 22 bp, Homo sapiens
tcagaggctggaagagcctcct

SEQ ID NO: 7252426 - DNA, 22 bp, Homo sapiens
tcagaggcttctggccagtctg

SEQ ID NO: 7252427 - DNA, 22 bp, Homo sapiens
tcagaggcttccttcctcggag

SEQ ID NO: 7252428 - DNA, 21 bp, Homo sapiens
tcagagggccctggaggctca

SEQ ID NO: 7252429 - DNA, 21 bp, Homo sapiens
tcagagggccctggaggctca

SEQ ID NO: 7252430 - DNA, 22 bp, Homo sapiens
tcagaggtggcaggggtgtcca

SEQ ID NO: 7252431 - DNA, 22 bp, Homo sapiens
tcagcctgcgtcatggtgacac

SEQ ID NO: 7252432 - DNA, 22 bp, Homo sapiens
tccacaggaaagcacctcccat

SEQ ID NO: 7252433 - DNA, 22 bp, Homo sapiens
tccacagattaaaaacatactt

SEQ ID NO: 7252434 - DNA, 22 bp, Homo sapiens
tccacagataaaaacagaggtt

SEQ ID NO: 7252435 - DNA, 22 bp, Homo sapiens
tccacacacatttctatgtgca

SEQ ID NO: 7252436 - DNA, 22 bp, Homo sapiens
tccacagaccagtatctgcagc

SEQ ID NO: 7252437 - DNA, 23 bp, Homo sapiens
tccaccccagctgaggcttagcc

SEQ ID NO: 7252438 - DNA, 19 bp, Homo sapiens
tccaccccagccagctctg

SEQ ID NO: 7252439 - DNA, 22 bp, Homo sapiens
tccaccatgtaacaagctctgt

SEQ ID NO: 7252440 - DNA, 22 bp, Homo sapiens
tccaccatgtaacaagctctgt

SEQ ID NO: 7252441 - DNA, 22 bp, Homo sapiens
tccaccatgatttagcactggc

SEQ ID NO: 7252442 - DNA, 22 bp, Homo sapiens
tccactgctcattccacaggca

SEQ ID NO: 7252443 - DNA, 22 bp, Homo sapiens
tccacttctattgggtcttggt

SEQ ID NO: 7252444 - DNA, 22 bp, Homo sapiens
tccacttccacgtgtgcagaat

SEQ ID NO: 7252445 - DNA, 22 bp, Homo sapiens
tccacttcatccagggtcacca

SEQ ID NO: 7252446 - DNA, 22 bp, Homo sapiens
tccacgctgtgtgaccttgggc

SEQ ID NO: 7252447 - DNA, 22 bp, Homo sapiens
tccactctaattactaccttct

SEQ ID NO: 7252448 - DNA, 22 bp, Homo sapiens
tccactccttatgccagacggt

SEQ ID NO: 7252449 - DNA, 22 bp, Homo sapiens
tccactcaaggccattgcacat

SEQ ID NO: 7252450 - DNA, 22 bp, Homo sapiens
tccaggacagcggcaggcagat

SEQ ID NO: 7252451 - DNA, 22 bp, Homo sapiens
tccaggacctgactgggcctgc

SEQ ID NO: 7252452 - DNA, 22 bp, Homo sapiens
tccaggagaaggccatccagcg

SEQ ID NO: 7252453 - DNA, 21 bp, Homo sapiens
tccagcctttccctcacttcc

SEQ ID NO: 7252454 - DNA, 22 bp, Homo sapiens
tccagccttgccacttttctgt

SEQ ID NO: 7252455 - DNA, 22 bp, Homo sapiens
tccagccttctcaaggctggct

SEQ ID NO: 7252456 - DNA, 22 bp, Homo sapiens
tccagccttccttttcactctc

SEQ ID NO: 7252457 - DNA, 22 bp, Homo sapiens
tccagcctggttgcgggcatcc

SEQ ID NO: 7252458 - DNA, 19 bp, Homo sapiens
tccagcctgctgtttctct

SEQ ID NO: 7252459 - DNA, 22 bp, Homo sapiens
tccagcctgaactttgtccaga

SEQ ID NO: 7252460 - DNA, 22 bp, Homo sapiens
tcccagcttagatttgctcatt

SEQ ID NO: 7252461 - DNA, 22 bp, Homo sapiens
tcccagcagagccagcaagccg

SEQ ID NO: 7252462 - DNA, 22 bp, Homo sapiens
tcccagcactgtaattctttgg

SEQ ID NO: 7252463 - DNA, 22 bp, Homo sapiens
tcccagcacgtctgctgtttct

SEQ ID NO: 7252464 - DNA, 22 bp, Homo sapiens
tcccagcacagggcagatgtga

SEQ ID NO: 7252465 - DNA, 22 bp, Homo sapiens
tcccagcaagaaagggggtggc

SEQ ID NO: 7252466 - DNA, 22 bp, Homo sapiens
tcccagattcctgctcttatat

SEQ ID NO: 7252467 - DNA, 22 bp, Homo sapiens
tcccagcagcatagctcagaat

SEQ ID NO: 7252468 - DNA, 22 bp, Homo sapiens
tcccagcagatgagctgaccta

SEQ ID NO: 7252469 - DNA, 22 bp, Homo sapiens
tcccagcaggagtccagttccc

SEQ ID NO: 7252470 - DNA, 22 bp, Homo sapiens
tcccagcagggccgaccagcct

SEQ ID NO: 7252471 - DNA, 22 bp, Homo sapiens
tcccagcctttcttttctgctg

SEQ ID NO: 7252472 - DNA, 22 bp, Homo sapiens
tcccagcataacaaactgcccg

SEQ ID NO: 7252473 - DNA, 22 bp, Homo sapiens
tcccagcagtcagagctatgtg

SEQ ID NO: 7252474 - DNA, 22 bp, Homo sapiens
tcccactgagcccctgctggtg

SEQ ID NO: 7252475 - DNA, 22 bp, Homo sapiens
tcccactgtgcctgttgtaatc

SEQ ID NO: 7252476 - DNA, 22 bp, Homo sapiens
tcccactgtgaatccaaggcct

SEQ ID NO: 7252477 - DNA, 22 bp, Homo sapiens
tcccactgtcttctcgtgctcg

SEQ ID NO: 7252478 - DNA, 22 bp, Homo sapiens
tcccactgtctgtcttgctgca

SEQ ID NO: 7252479 - DNA, 22 bp, Homo sapiens
tcccactgtgcctgttgtaatc

SEQ ID NO: 7252480 - DNA, 22 bp, Homo sapiens
tcccactgctttgctctgctca

SEQ ID NO: 7252481 - DNA, 22 bp, Homo sapiens
tcccactggacgtctgtgctgg

SEQ ID NO: 7252482 - DNA, 21 bp, Homo sapiens
tcccactgccacagcttcagg

SEQ ID NO: 7252483 - DNA, 22 bp, Homo sapiens
tcccactggacgtctgtgctgg

SEQ ID NO: 7252484 - DNA, 20 bp, Homo sapiens
tcccactgggcctcagtttc

SEQ ID NO: 7252485 - DNA, 21 bp, Homo sapiens
tcccactggcccagggctcca

SEQ ID NO: 7252486 - DNA, 22 bp, Homo sapiens
tcccagagtgagccaggggcag

SEQ ID NO: 7252487 - DNA, 22 bp, Homo sapiens
tccagtcctgggagcctttctg

SEQ ID NO: 7252488 - DNA, 20 bp, Homo sapiens
tccagtggcctgaatctgga

SEQ ID NO: 7252489 - DNA, 20 bp, Homo sapiens
tccagggcaaactcatcacc

SEQ ID NO: 7252490 - DNA, 22 bp, Homo sapiens
tccaggccgcaggggcagcccc

SEQ ID NO: 7252491 - DNA, 22 bp, Homo sapiens
tccgcgtgggaggggccggtgt

SEQ ID NO: 7252492 - DNA, 22 bp, Homo sapiens
tccggcggccggcctgagcccg

SEQ ID NO: 7252493 - DNA, 22 bp, Homo sapiens
tccgagggctggacgcaggggc

SEQ ID NO: 7252494 - DNA, 22 bp, Homo sapiens
tcctcatctcggaacctgccac

SEQ ID NO: 7252495 - DNA, 22 bp, Homo sapiens
tcctccactttgtctagcaaca

SEQ ID NO: 7252496 - DNA, 22 bp, Homo sapiens
tcctccagcaggactgaggccc

SEQ ID NO: 7252497 - DNA, 22 bp, Homo sapiens
tcctccagggggatcttcagcc

SEQ ID NO: 7252498 - DNA, 22 bp, Homo sapiens
tcctcctgctgttagtcttgaa

SEQ ID NO: 7252499 - DNA, 22 bp, Homo sapiens
tcctcctgcctttgcttcttgt

SEQ ID NO: 7252500 - DNA, 23 bp, Homo sapiens
tcctcctgacacagcctgagtga

SEQ ID NO: 7252501 - DNA, 22 bp, Homo sapiens
tcctcctcctcacagtcacctg

SEQ ID NO: 7252502 - DNA, 22 bp, Homo sapiens
tcctccagtggcccagtccttc

SEQ ID NO: 7252503 - DNA, 22 bp, Homo sapiens
tcctccagtggcccagtccttc

SEQ ID NO: 7252504 - DNA, 22 bp, Homo sapiens
tcctccctgggagcttctgagt

SEQ ID NO: 7252505 - DNA, 23 bp, Homo sapiens
tccctgggcccgtgccagcggtg

SEQ ID NO: 7252506 - DNA, 22 bp, Homo sapiens
tccctgggccacagctgtgagc

SEQ ID NO: 7252507 - DNA, 22 bp, Homo sapiens
tccctgggcatcacgttgcttc

SEQ ID NO: 7252508 - DNA, 22 bp, Homo sapiens
tccctgggcacaatctgctggc

SEQ ID NO: 7252509 - DNA, 22 bp, Homo sapiens
tccctgggcaagtttactcttc

SEQ ID NO: 7252510 - DNA, 22 bp, Homo sapiens
tccctgccaatgattggagcaa

SEQ ID NO: 7252511 - DNA, 22 bp, Homo sapiens
tccctgccagtcctggtctgaa

SEQ ID NO: 7252512 - DNA, 22 bp, Homo sapiens
tccctggggatgttggcctgcc

SEQ ID NO: 7252513 - DNA, 22 bp, Homo sapiens
tccctggggaagggcaagcaag

SEQ ID NO: 7252514 - DNA, 22 bp, Homo sapiens
tccctgggcttctccagacttg

SEQ ID NO: 7252515 - DNA, 22 bp, Homo sapiens
tccctgggcggacattctccca

SEQ ID NO: 7252516 - DNA, 22 bp, Homo sapiens
tccctgggcctcctgctatgca

SEQ ID NO: 7252517 - DNA, 22 bp, Homo sapiens
tccctgggcctatcttagctcc

SEQ ID NO: 7252518 - DNA, 22 bp, Homo sapiens
tccctgtaaggttctgagattt

SEQ ID NO: 7252519 - DNA, 22 bp, Homo sapiens
tccctgtaaacctcaagttgat

SEQ ID NO: 7252520 - DNA, 22 bp, Homo sapiens
tccctgtacactaacttgagac

SEQ ID NO: 7252521 - DNA, 22 bp, Homo sapiens
tccctgtacttacacagcgtcc

SEQ ID NO: 7252522 - DNA, 22 bp, Homo sapiens
tccctgtagttcgtggtctttg

SEQ ID NO: 7252523 - DNA, 22 bp, Homo sapiens
tccctggggcagtggctcggag

SEQ ID NO: 7252524 - DNA, 22 bp, Homo sapiens
tccctgtatatcacaagggcta

SEQ ID NO: 7252525 - DNA, 22 bp, Homo sapiens
tccctgtatagagaatcccttt

SEQ ID NO: 7252526 - DNA, 22 bp, Homo sapiens
tccctgtattcgaaagtgatcg

SEQ ID NO: 7252527 - DNA, 23 bp, Homo sapiens
tccctgtgtacagcctgcatgag

SEQ ID NO: 7252528 - DNA, 21 bp, Homo sapiens
tcccttgggaaactttcttga

SEQ ID NO: 7252529 - DNA, 23 bp, Homo sapiens
tactggaaatttgacagatttga

SEQ ID NO: 7252530 - DNA, 22 bp, Homo sapiens
tactggaagttagagatctttt

SEQ ID NO: 7252531 - DNA, 22 bp, Homo sapiens
tactgagtaccaagcattgtgt

SEQ ID NO: 7252532 - DNA, 22 bp, Homo sapiens
tacgacacatctgatctcaaaa

SEQ ID NO: 7252533 - DNA, 22 bp, Homo sapiens
taccttgggttgagttcattct

SEQ ID NO: 7252534 - DNA, 22 bp, Homo sapiens
tacgaacagggccatagaaact

SEQ ID NO: 7252535 - DNA, 22 bp, Homo sapiens
tactgaaatactaagaagttaa

SEQ ID NO: 7252536 - DNA, 22 bp, Homo sapiens
tactgaaatggcagatatataa

SEQ ID NO: 7252537 - DNA, 22 bp, Homo sapiens
tactgaaagactgaatatttag

SEQ ID NO: 7252538 - DNA, 22 bp, Homo sapiens
tactaacaatgagaacaagcca

SEQ ID NO: 7252539 - DNA, 22 bp, Homo sapiens
tacattcaacatgtcactatgt

SEQ ID NO: 7252540 - DNA, 22 bp, Homo sapiens
tacattcaaacgatttattgat

SEQ ID NO: 7252541 - DNA, 22 bp, Homo sapiens
tacattcagaagaatggacacg

SEQ ID NO: 7252542 - DNA, 22 bp, Homo sapiens
tacattcagaagaatggacacg

SEQ ID NO: 7252543 - DNA, 22 bp, Homo sapiens
tacattcagcaaaagaatggtt

SEQ ID NO: 7252544 - DNA, 22 bp, Homo sapiens
tacattcatggtgacttgtatg

SEQ ID NO: 7252545 - DNA, 22 bp, Homo sapiens
tacattcatatgtgtgcataca

SEQ ID NO: 7252546 - DNA, 22 bp, Homo sapiens
tacagtttttattcatgacaag

SEQ ID NO: 7252547 - DNA, 22 bp, Homo sapiens
tacagttactgttatatgtgct

SEQ ID NO: 7252548 - DNA, 22 bp, Homo sapiens
tacagttacgctgagaaacgaa

SEQ ID NO: 7252549 - DNA, 22 bp, Homo sapiens
tacagttactttgaaaattgat

SEQ ID NO: 7252550 - DNA, 22 bp, Homo sapiens
tacagttaccctggaaagaaat

SEQ ID NO: 7252551 - DNA, 22 bp, Homo sapiens
tacagcttgatgtttgtgtgtt

SEQ ID NO: 7252552 - DNA, 22 bp, Homo sapiens
tacagcttttcatatttgtgtt

SEQ ID NO: 7252553 - DNA, 22 bp, Homo sapiens
taagcatacattctctcctttc

SEQ ID NO: 7252554 - DNA, 22 bp, Homo sapiens
taagcaatgagataatcatggg

SEQ ID NO: 7252555 - DNA, 18 bp, Homo sapiens
taagcaatgacattgcaa

SEQ ID NO: 7252556 - DNA, 22 bp, Homo sapiens
taataaagatgtgggctttgaa

SEQ ID NO: 7252557 - DNA, 22 bp, Homo sapiens
taataaatgaaagtgctggcat

SEQ ID NO: 7252558 - DNA, 22 bp, Homo sapiens
taataaatgaaagtgctggcat

SEQ ID NO: 7252559 - DNA, 22 bp, Homo sapiens
taataaatgaaagtgctggcat

SEQ ID NO: 7252560 - DNA, 22 bp, Homo sapiens
taataacaattgtaggacatga

SEQ ID NO: 7252561 - DNA, 22 bp, Homo sapiens
taagtttaagtcatgtttgatg

SEQ ID NO: 7252562 - DNA, 22 bp, Homo sapiens
taagtttagagagaatggggac

SEQ ID NO: 7252563 - DNA, 22 bp, Homo sapiens
taagtttaaatgtacatgaagc

SEQ ID NO: 7252564 - DNA, 22 bp, Homo sapiens
taatgcctttctgtactatatg

SEQ ID NO: 7252565 - DNA, 20 bp, Homo sapiens
taatgcctcatgatactaga

SEQ ID NO: 7252566 - DNA, 19 bp, Homo sapiens
taatgcacttaacacatgg

SEQ ID NO: 7252567 - DNA, 22 bp, Homo sapiens
tacaatcacccaaagagccaga

SEQ ID NO: 7252568 - DNA, 22 bp, Homo sapiens
taatttcttcatctctgcagct

SEQ ID NO: 7252569 - DNA, 20 bp, Homo sapiens
tacactaagtatgaagtgct

SEQ ID NO: 7252570 - DNA, 22 bp, Homo sapiens
tacacattagtcaagagtttga

SEQ ID NO: 7252571 - DNA, 22 bp, Homo sapiens
tacacatctctgtcagtagtga

SEQ ID NO: 7252572 - DNA, 22 bp, Homo sapiens
taagaaactaatgcaataagag

SEQ ID NO: 7252573 - DNA, 22 bp, Homo sapiens
taagaaacccaggaatttctta

SEQ ID NO: 7252574 - DNA, 22 bp, Homo sapiens
taagaaatttagttatagaatg

SEQ ID NO: 7252575 - DNA, 22 bp, Homo sapiens
taagaaacttaactgggaacta

SEQ ID NO: 7252576 - DNA, 22 bp, Homo sapiens
taactgtatagcttggactaaa

SEQ ID NO: 7252577 - DNA, 22 bp, Homo sapiens
taacacattttcctcatacgga

SEQ ID NO: 7252578 - DNA, 21 bp, Homo sapiens
taaataataagttgctgagat

SEQ ID NO: 7252579 - DNA, 22 bp, Homo sapiens
taaagaataatacccatggagc

SEQ ID NO: 7252580 - DNA, 16 bp, Homo sapiens
taaacagcagacagtt

SEQ ID NO: 7252581 - DNA, 22 bp, Homo sapiens
gttttattggaacacagccatg

SEQ ID NO: 7252582 - DNA, 22 bp, Homo sapiens
gttttatttccatgagagaccg

SEQ ID NO: 7252583 - DNA, 22 bp, Homo sapiens
gttttattggaacacagccatg

SEQ ID NO: 7252584 - DNA, 22 bp, Homo sapiens
gttttatttccatgagagaccg

SEQ ID NO: 7252585 - DNA, 22 bp, Homo sapiens
gtttctacatgcctctttcacc

SEQ ID NO: 7252586 - DNA, 22 bp, Homo sapiens
gtttctcagcatgtcagtacaa

SEQ ID NO: 7252587 - DNA, 22 bp, Homo sapiens
gtttctcaagcttgaatgcaca

SEQ ID NO: 7252588 - DNA, 22 bp, Homo sapiens
gtttctatggtttatattactg

SEQ ID NO: 7252589 - DNA, 22 bp, Homo sapiens
gtttcccatatctagggagagg

SEQ ID NO: 7252590 - DNA, 22 bp, Homo sapiens
gtttatatgtgtgccactctta

SEQ ID NO: 7252591 - DNA, 22 bp, Homo sapiens
gtttcccagtctgcagagttct

SEQ ID NO: 7252592 - DNA, 22 bp, Homo sapiens
gtttatatgaacttcataccca

SEQ ID NO: 7252593 - DNA, 22 bp, Homo sapiens
gttttagataaagctgtccttg

SEQ ID NO: 7252594 - DNA, 22 bp, Homo sapiens
gtttctcatcagtttctgatat

SEQ ID NO: 7252595 - DNA, 22 bp, Homo sapiens
gtttctcagtttggtctgcaga

SEQ ID NO: 7252596 - DNA, 22 bp, Homo sapiens
gtttagaatggcaaaattaagt

SEQ ID NO: 7252597 - DNA, 22 bp, Homo sapiens
gtttacttctgcttaggcctct

SEQ ID NO: 7252598 - DNA, 22 bp, Homo sapiens
gtttacttgtgccttggcttaa

SEQ ID NO: 7252599 - DNA, 22 bp, Homo sapiens
gtttagaaaatagtgaagcaag

SEQ ID NO: 7252600 - DNA, 22 bp, Homo sapiens
gtttagaagccaagatttgggt

SEQ ID NO: 7252601 - DNA, 21 bp, Homo sapiens
gtttagaagtagtctggctca

SEQ ID NO: 7252602 - DNA, 22 bp, Homo sapiens
gtgtgtgtgcctgcacacacac

SEQ ID NO: 7252603 - DNA, 22 bp, Homo sapiens
gttccaaagtctctgagctgag

SEQ ID NO: 7252604 - DNA, 22 bp, Homo sapiens
gttataaaatgcacagttgttt

SEQ ID NO: 7252605 - DNA, 22 bp, Homo sapiens
gttcattttactgtaaatagca

SEQ ID NO: 7252606 - DNA, 22 bp, Homo sapiens
tattcagagtgtagcaaataga

SEQ ID NO: 7252607 - DNA, 22 bp, Homo sapiens
tattcagaaaactgagcgatga

SEQ ID NO: 7252608 - DNA, 22 bp, Homo sapiens
tattcagaataaagactacatt

SEQ ID NO: 7252609 - DNA, 22 bp, Homo sapiens
tatgtttatactttgatgtact

SEQ ID NO: 7252610 - DNA, 19 bp, Homo sapiens
tatgttatgttgtttactc

SEQ ID NO: 7252611 - DNA, 22 bp, Homo sapiens
tatgtttaaatgtatgtgtatg

SEQ ID NO: 7252612 - DNA, 22 bp, Homo sapiens
tatgtttacgctggtagaatta

SEQ ID NO: 7252613 - DNA, 22 bp, Homo sapiens
tatgctagatggaaaaatattg

SEQ ID NO: 7252614 - DNA, 22 bp, Homo sapiens
tatgctactagaaataaaatgg

SEQ ID NO: 7252615 - DNA, 22 bp, Homo sapiens
tatgctgaatttggtttgctat

SEQ ID NO: 7252616 - DNA, 22 bp, Homo sapiens
tatgctacatcctgggggatgt

SEQ ID NO: 7252617 - DNA, 22 bp, Homo sapiens
tatgcctgtctcaccattgtat

SEQ ID NO: 7252618 - DNA, 22 bp, Homo sapiens
tatgcctggggtgctcaggcca

SEQ ID NO: 7252619 - DNA, 22 bp, Homo sapiens
tatgcctggaacctttctcttt

SEQ ID NO: 7252620 - DNA, 21 bp, Homo sapiens
tatgcctgatttctaatgatg

SEQ ID NO: 7252621 - DNA, 22 bp, Homo sapiens
tatgcctggaacctttctcttt

SEQ ID NO: 7252622 - DNA, 22 bp, Homo sapiens
tatgcctgataactgtgtctct

SEQ ID NO: 7252623 - DNA, 22 bp, Homo sapiens
tatgcctgataactgtgtctct

SEQ ID NO: 7252624 - DNA, 23 bp, Homo sapiens
tattgcacacatagaaacataga

SEQ ID NO: 7252625 - DNA, 22 bp, Homo sapiens
tattgcatattgtacttgaatg

SEQ ID NO: 7252626 - DNA, 22 bp, Homo sapiens
tattggtttattgtgtatgaga

SEQ ID NO: 7252627 - DNA, 22 bp, Homo sapiens
tatttggatagacagggagatg

SEQ ID NO: 7252628 - DNA, 22 bp, Homo sapiens
tatttggatacaatcatttgct

SEQ ID NO: 7252629 - DNA, 22 bp, Homo sapiens
tatttggcaaagaattttctgg

SEQ ID NO: 7252630 - DNA, 22 bp, Homo sapiens
tatttggagtgatggaaatgtt

SEQ ID NO: 7252631 - DNA, 22 bp, Homo sapiens
tatttggaggccactgttgagt

SEQ ID NO: 7252632 - DNA, 22 bp, Homo sapiens
tatttggagctgtgtgagctca

SEQ ID NO: 7252633 - DNA, 22 bp, Homo sapiens
tatttgttccagagataaaaat

SEQ ID NO: 7252634 - DNA, 22 bp, Homo sapiens
tatttgttgagttgttatgtct

SEQ ID NO: 7252635 - DNA, 22 bp, Homo sapiens
tatttgttgcgggaattgctat

SEQ ID NO: 7252636 - DNA, 22 bp, Homo sapiens
tattttcaccttctctggatat

SEQ ID NO: 7252637 - DNA, 22 bp, Homo sapiens
tattttcaccttctctggatat

SEQ ID NO: 7252638 - DNA, 22 bp, Homo sapiens
tattttcattctgtgtgactgt

SEQ ID NO: 7252639 - DNA, 22 bp, Homo sapiens
tattttcattctgtgtgactgt

SEQ ID NO: 7252640 - DNA, 22 bp, Homo sapiens
tatactattattgtcagtttat

SEQ ID NO: 7252641 - DNA, 22 bp, Homo sapiens
tatacctttaccttgaccaaat

SEQ ID NO: 7252642 - DNA, 22 bp, Homo sapiens
tatagacaagcgtaacaagaag

SEQ ID NO: 7252643 - DNA, 22 bp, Homo sapiens
tatactgtgttttcaccactgt

SEQ ID NO: 7252644 - DNA, 22 bp, Homo sapiens
tatactgtcgcattacactcac

SEQ ID NO: 7252645 - DNA, 22 bp, Homo sapiens
tatactgtccctctgcactcca

SEQ ID NO: 7252646 - DNA, 22 bp, Homo sapiens
tatactgtaggtgcagaaagaa

SEQ ID NO: 7252647 - DNA, 22 bp, Homo sapiens
tagttaaagccctaaattgata

SEQ ID NO: 7252648 - DNA, 22 bp, Homo sapiens
tatatgctctgggatcctgaaa

SEQ ID NO: 7252649 - DNA, 22 bp, Homo sapiens
tatatgctaatggtgccattcc

SEQ ID NO: 7252650 - DNA, 22 bp, Homo sapiens
tatatgcatgcccatgtataca

SEQ ID NO: 7252651 - DNA, 22 bp, Homo sapiens
tatatgcttgtgcatgtctttg

SEQ ID NO: 7252652 - DNA, 22 bp, Homo sapiens
tatatgcttgggaaatggtaga

SEQ ID NO: 7252653 - DNA, 22 bp, Homo sapiens
tatatgtagtcagtcagagtaa

SEQ ID NO: 7252654 - DNA, 22 bp, Homo sapiens
tatagactgtgaaatttaggca

SEQ ID NO: 7252655 - DNA, 22 bp, Homo sapiens
tatatgcagtgtgtcattcaag

SEQ ID NO: 7252656 - DNA, 22 bp, Homo sapiens
tatcaacaatagccagtgttta

SEQ ID NO: 7252657 - DNA, 22 bp, Homo sapiens
tatcaacaaaggccttgtgttt

SEQ ID NO: 7252658 - DNA, 22 bp, Homo sapiens
tatattcaacaggctaatgtca

SEQ ID NO: 7252659 - DNA, 22 bp, Homo sapiens
tatatttaatcctagagccatt

SEQ ID NO: 7252660 - DNA, 22 bp, Homo sapiens
tatatttgtgtgtgatttatga

SEQ ID NO: 7252661 - DNA, 22 bp, Homo sapiens
tatctttgatgccagatgttac

SEQ ID NO: 7252662 - DNA, 22 bp, Homo sapiens
tatcttcttgccaggctggtgt

SEQ ID NO: 7252663 - DNA, 22 bp, Homo sapiens
tatcttctcagtatatgggatg

SEQ ID NO: 7252664 - DNA, 22 bp, Homo sapiens
tatgcagtgtatgcactgagat

SEQ ID NO: 7252665 - DNA, 22 bp, Homo sapiens
tatgcattttatagtgcaaagc

SEQ ID NO: 7252666 - DNA, 22 bp, Homo sapiens
tatgcattgtgagactgtggga

SEQ ID NO: 7252667 - DNA, 22 bp, Homo sapiens
tatgcattcagaggttgggtgt

SEQ ID NO: 7252668 - DNA, 22 bp, Homo sapiens
tatgcattatacattaatttct

SEQ ID NO: 7252669 - DNA, 22 bp, Homo sapiens
tatgcattatacattaatttct

SEQ ID NO: 7252670 - DNA, 22 bp, Homo sapiens
tatgagtttaaggctaaaatag

SEQ ID NO: 7252671 - DNA, 22 bp, Homo sapiens
tatctttgtatcaatctccatt

SEQ ID NO: 7252672 - DNA, 22 bp, Homo sapiens
tatctttgcaaatatctctaag

SEQ ID NO: 7252673 - DNA, 22 bp, Homo sapiens
tatctttgcaaatatctctaag

SEQ ID NO: 7252674 - DNA, 22 bp, Homo sapiens
tatgataacctgttgtagtttg

SEQ ID NO: 7252675 - DNA, 22 bp, Homo sapiens
taggtgtgggctcaggaatgtg

SEQ ID NO: 7252676 - DNA, 22 bp, Homo sapiens
taggctggaggaagcagtgcct

SEQ ID NO: 7252677 - DNA, 22 bp, Homo sapiens
tagtagaaaaatgttaatccct

SEQ ID NO: 7252678 - DNA, 22 bp, Homo sapiens
tagtaaaagtttagttgaaagt

SEQ ID NO: 7252679 - DNA, 22 bp, Homo sapiens
tagtaaaaagcaatggtgagta

SEQ ID NO: 7252680 - DNA, 22 bp, Homo sapiens
tagtaaaaagcaatggtgagta

SEQ ID NO: 7252681 - DNA, 22 bp, Homo sapiens
tagtgggtgatttgatgaggaa

SEQ ID NO: 7252682 - DNA, 22 bp, Homo sapiens
tagtggggcctgggagggttcc

SEQ ID NO: 7252683 - DNA, 22 bp, Homo sapiens
tagtggggaaggaggacaagaa

SEQ ID NO: 7252684 - DNA, 22 bp, Homo sapiens
tagtatttcctgtaagctatag

SEQ ID NO: 7252685 - DNA, 22 bp, Homo sapiens
tagtatttataatcatgcttaa

SEQ ID NO: 7252686 - DNA, 22 bp, Homo sapiens
tagtattttagaaaaccatgaa

SEQ ID NO: 7252687 - DNA, 22 bp, Homo sapiens
taggctcattaagtccccaggg

SEQ ID NO: 7252688 - DNA, 22 bp, Homo sapiens
taggcccctagtgccacgtggc

SEQ ID NO: 7252689 - DNA, 22 bp, Homo sapiens
taggacaggtgaggggctgtgg

SEQ ID NO: 7252690 - DNA, 20 bp, Homo sapiens
taggacagggcctggcttct

SEQ ID NO: 7252691 - DNA, 22 bp, Homo sapiens
taggacagggacatctttttga

SEQ ID NO: 7252692 - DNA, 21 bp, Homo sapiens
taggacagcccccctgccctc

SEQ ID NO: 7252693 - DNA, 22 bp, Homo sapiens
taggacagagttccctgatggc

SEQ ID NO: 7252694 - DNA, 22 bp, Homo sapiens
taggacagagctggttacaatg

SEQ ID NO: 7252695 - DNA, 22 bp, Homo sapiens
taggaaatgctccattgcataa

SEQ ID NO: 7252696 - DNA, 22 bp, Homo sapiens
taggaaatatttgaacatagga

SEQ ID NO: 7252697 - DNA, 22 bp, Homo sapiens
taggaaagcagtagagccagga

SEQ ID NO: 7252698 - DNA, 22 bp, Homo sapiens
tactttcttgttcctttcataa

SEQ ID NO: 7252699 - DNA, 22 bp, Homo sapiens
tactttctgtccttctgttaaa

SEQ ID NO: 7252700 - DNA, 22 bp, Homo sapiens
tagaatccagattctatgctaa

SEQ ID NO: 7252701 - DNA, 22 bp, Homo sapiens
tagaatccacctacacaagaga

SEQ ID NO: 7252702 - DNA, 22 bp, Homo sapiens
tagaatcattgagaataacagg

SEQ ID NO: 7252703 - DNA, 22 bp, Homo sapiens
tagaatcatacctctaggaaca

SEQ ID NO: 7252704 - DNA, 22 bp, Homo sapiens
tagaataagttgatgatatatg

SEQ ID NO: 7252705 - DNA, 22 bp, Homo sapiens
tagaatcagaagatttgactgt

SEQ ID NO: 7252706 - DNA, 20 bp, Homo sapiens
tagaatctggtgatgtatcg

SEQ ID NO: 7252707 - DNA, 22 bp, Homo sapiens
tagaatctgcctgcagcaaaga

SEQ ID NO: 7252708 - DNA, 22 bp, Homo sapiens
tagagatagcagtattgattcg

SEQ ID NO: 7252709 - DNA, 22 bp, Homo sapiens
tagagctcattttaagcagaca

SEQ ID NO: 7252710 - DNA, 22 bp, Homo sapiens
tagagcatttagaggggcagga

SEQ ID NO: 7252711 - DNA, 23 bp, Homo sapiens
tagagcattgctgaggcctccct

SEQ ID NO: 7252712 - DNA, 22 bp, Homo sapiens
tagagcattctatctccaacag

SEQ ID NO: 7252713 - DNA, 22 bp, Homo sapiens
tagagcattatgacaaccccat

SEQ ID NO: 7252714 - DNA, 22 bp, Homo sapiens
tagagcattagaaattagtgta

SEQ ID NO: 7252715 - DNA, 22 bp, Homo sapiens
tagagcattaagtattgttgtt

SEQ ID NO: 7252716 - DNA, 20 bp, Homo sapiens
tagagcatgaagtcctatcc

SEQ ID NO: 7252717 - DNA, 22 bp, Homo sapiens
tagatgcatagagcacagcaca

SEQ ID NO: 7252718 - DNA, 22 bp, Homo sapiens
tagaggagcggcgagctgagct

SEQ ID NO: 7252719 - DNA, 22 bp, Homo sapiens
tagaggagcggcgagctgagct

SEQ ID NO: 7252720 - DNA, 22 bp, Homo sapiens
tagaggagagttgctggatgga

SEQ ID NO: 7252721 - DNA, 22 bp, Homo sapiens
tagaggagagttgctggatgga

SEQ ID NO: 7252722 - DNA, 22 bp, Homo sapiens
tagaggaggtgattcttgagct

SEQ ID NO: 7252723 - DNA, 22 bp, Homo sapiens
tagaggagggctgttcttcagt

SEQ ID NO: 7252724 - DNA, 22 bp, Homo sapiens
tagaggaggtgattcttgagct

SEQ ID NO: 7252725 - DNA, 22 bp, Homo sapiens
tagaggaggcaaggccctccct

SEQ ID NO: 7252726 - DNA, 23 bp, Homo sapiens
tagaggaggatgtgatgcatatt

SEQ ID NO: 7252727 - DNA, 22 bp, Homo sapiens
tagatgttaagcttctagaagg

SEQ ID NO: 7252728 - DNA, 22 bp, Homo sapiens
tagatgtatcttctcttatcgt

SEQ ID NO: 7252729 - DNA, 20 bp, Homo sapiens
tagatgtttcctgtcataaa

SEQ ID NO: 7252730 - DNA, 22 bp, Homo sapiens
tagatgttggtgagtgctgagg

SEQ ID NO: 7252731 - DNA, 22 bp, Homo sapiens
tagatgttccacatatatatgt

SEQ ID NO: 7252732 - DNA, 22 bp, Homo sapiens
tagatgttccacatatatatgt

SEQ ID NO: 7252733 - DNA, 22 bp, Homo sapiens
tagatgttgaagtcatatttgg

SEQ ID NO: 7252734 - DNA, 18 bp, Homo sapiens
tagattaaaattgaattc

SEQ ID NO: 7252735 - DNA, 22 bp, Homo sapiens
tagcacaagaagtacacataga

SEQ ID NO: 7252736 - DNA, 22 bp, Homo sapiens
tagcacagcttcttgatgtcac

SEQ ID NO: 7252737 - DNA, 21 bp, Homo sapiens
tagcacagctgtagacagttt

SEQ ID NO: 7252738 - DNA, 22 bp, Homo sapiens
tagcacagagcttttaaacttc

SEQ ID NO: 7252739 - DNA, 22 bp, Homo sapiens
tagcacagacagaatggtcata

SEQ ID NO: 7252740 - DNA, 18 bp, Homo sapiens
tagcacagagcaggatgt

SEQ ID NO: 7252741 - DNA, 22 bp, Homo sapiens
tagcacagttcactatgataca

SEQ ID NO: 7252742 - DNA, 22 bp, Homo sapiens
tagcacagtgttcacaacagtg

SEQ ID NO: 7252743 - DNA, 17 bp, Homo sapiens
tagcacagtgcctggta

SEQ ID NO: 7252744 - DNA, 22 bp, Homo sapiens
tagcacagtatttctcaactgg

SEQ ID NO: 7252745 - DNA, 22 bp, Homo sapiens
tagcacagggctcctcaaccca

SEQ ID NO: 7252746 - DNA, 22 bp, Homo sapiens
tagcacagggcatatgcggtgg

SEQ ID NO: 7252747 - DNA, 22 bp, Homo sapiens
tagcacaggtcttgttgccatt

SEQ ID NO: 7252748 - DNA, 22 bp, Homo sapiens
tagcacagttcctgactctttg

SEQ ID NO: 7252749 - DNA, 17 bp, Homo sapiens
tagcatttatcttcctt

SEQ ID NO: 7252750 - DNA, 22 bp, Homo sapiens
tagcatttattccagatttgga

SEQ ID NO: 7252751 - DNA, 22 bp, Homo sapiens
gtgaggtgactagcaggtgggg

SEQ ID NO: 7252752 - DNA, 22 bp, Homo sapiens
gtgaggccgcacgccccggagt

SEQ ID NO: 7252753 - DNA, 22 bp, Homo sapiens
gtgaggtcctaatagacatcga

SEQ ID NO: 7252754 - DNA, 22 bp, Homo sapiens
gtcttcttgtgttgcctgtctt

SEQ ID NO: 7252755 - DNA, 22 bp, Homo sapiens
gtcttcttttcagtctgcttgt

SEQ ID NO: 7252756 - DNA, 22 bp, Homo sapiens
gtgaggtggtacaatattaact

SEQ ID NO: 7252757 - DNA, 22 bp, Homo sapiens
gtctcctggaaatatgcccata

SEQ ID NO: 7252758 - DNA, 22 bp, Homo sapiens
gtctcctgctagcaagcaccac

SEQ ID NO: 7252759 - DNA, 22 bp, Homo sapiens
gtctcctgcccccggtgcttgg

SEQ ID NO: 7252760 - DNA, 22 bp, Homo sapiens
gtctcctgccacactcagtccc

SEQ ID NO: 7252761 - DNA, 22 bp, Homo sapiens
gtctcctggctgcagctaagac

SEQ ID NO: 7252762 - DNA, 22 bp, Homo sapiens
gtctcctggcctccagtttctc

SEQ ID NO: 7252763 - DNA, 22 bp, Homo sapiens
gtctcctggctgcagctaagac

SEQ ID NO: 7252764 - DNA, 22 bp, Homo sapiens
gtctcctgccacactcagtccc

SEQ ID NO: 7252765 - DNA, 22 bp, Homo sapiens
gtctcctgaggcatccattgaa

SEQ ID NO: 7252766 - DNA, 22 bp, Homo sapiens
gtctcctgagccttgactgcaa

SEQ ID NO: 7252767 - DNA, 22 bp, Homo sapiens
gtctcctgagccttgactgcaa

SEQ ID NO: 7252768 - DNA, 22 bp, Homo sapiens
gtctcctgagactgcagtcacc

SEQ ID NO: 7252769 - DNA, 22 bp, Homo sapiens
gtctcctgtcctgcaggatgga

SEQ ID NO: 7252770 - DNA, 22 bp, Homo sapiens
gtctcctggcttttgtcccagt

SEQ ID NO: 7252771 - DNA, 22 bp, Homo sapiens
gtcttcctaatttgctattagg

SEQ ID NO: 7252772 - DNA, 22 bp, Homo sapiens
gtctgggtttcatgggcactgg

SEQ ID NO: 7252773 - DNA, 22 bp, Homo sapiens
gtctggggtgaggcccgggatt

SEQ ID NO: 7252774 - DNA, 22 bp, Homo sapiens
gtctgggtctccacagtcagca

SEQ ID NO: 7252775 - DNA, 22 bp, Homo sapiens
gtctgggtggctgctttcagct

SEQ ID NO: 7252776 - DNA, 22 bp, Homo sapiens
gtctgggttaagtcctgataat

SEQ ID NO: 7252777 - DNA, 22 bp, Homo sapiens
gtgctgggccctgagaccaggg

SEQ ID NO: 7252778 - DNA, 22 bp, Homo sapiens
gtgctgggccctgagaccaggg

SEQ ID NO: 7252779 - DNA, 22 bp, Homo sapiens
gtgctgggtgctgcagacaggt

SEQ ID NO: 7252780 - DNA, 22 bp, Homo sapiens
gtgctgggtgctgcagacaggt

SEQ ID NO: 7252781 - DNA, 22 bp, Homo sapiens
gtgccctggtccccagcatata

SEQ ID NO: 7252782 - DNA, 22 bp, Homo sapiens
gtgccctggggtgaacccctgg

SEQ ID NO: 7252783 - DNA, 22 bp, Homo sapiens
gtgccctgggccttcagggcca

SEQ ID NO: 7252784 - DNA, 22 bp, Homo sapiens
gtgccctggctcacagtgtctc

SEQ ID NO: 7252785 - DNA, 22 bp, Homo sapiens
gtgccctgttgcacacttgagg

SEQ ID NO: 7252786 - DNA, 21 bp, Homo sapiens
gtgccctgttcccacatgccc

SEQ ID NO: 7252787 - DNA, 21 bp, Homo sapiens
gtgccctgttcccacatgccc

SEQ ID NO: 7252788 - DNA, 22 bp, Homo sapiens
gtgccctgtgaactgtaaggaa

SEQ ID NO: 7252789 - DNA, 22 bp, Homo sapiens
gtgccctgtctcttgtctccag

SEQ ID NO: 7252790 - DNA, 20 bp, Homo sapiens
gtgccctgtgggctattttc

SEQ ID NO: 7252791 - DNA, 22 bp, Homo sapiens
gtgccctgttcatttctctccc

SEQ ID NO: 7252792 - DNA, 22 bp, Homo sapiens
gtgatttcaggtttttcatact

SEQ ID NO: 7252793 - DNA, 22 bp, Homo sapiens
gtgccctgatgcaattgtctca

SEQ ID NO: 7252794 - DNA, 22 bp, Homo sapiens
gtgccctgcatgccccgggtat

SEQ ID NO: 7252795 - DNA, 22 bp, Homo sapiens
gtgccctggatgactttggtct

SEQ ID NO: 7252796 - DNA, 22 bp, Homo sapiens
gtgccctggaggggttgaaggg

SEQ ID NO: 7252797 - DNA, 22 bp, Homo sapiens
gtgccctgatcgctaggctccc

SEQ ID NO: 7252798 - DNA, 22 bp, Homo sapiens
gtgccctgagcttatgcattct

SEQ ID NO: 7252799 - DNA, 22 bp, Homo sapiens
gtgccctgaggtcttcactttg

SEQ ID NO: 7252800 - DNA, 22 bp, Homo sapiens
gtgccctgagtgggtaggagag

SEQ ID NO: 7252801 - DNA, 22 bp, Homo sapiens
ggtgggcagctcttggcaggca

SEQ ID NO: 7252802 - DNA, 22 bp, Homo sapiens
ggtgggcacccgagactggatc

SEQ ID NO: 7252803 - DNA, 22 bp, Homo sapiens
ggtgggcacccgagactggatc

SEQ ID NO: 7252804 - DNA, 22 bp, Homo sapiens
ggtgggcacattcagtctctgt

SEQ ID NO: 7252805 - DNA, 22 bp, Homo sapiens
ggtgggcacattcagtctctgt

SEQ ID NO: 7252806 - DNA, 21 bp, Homo sapiens
ggtgggcacaggagagcagag

SEQ ID NO: 7252807 - DNA, 22 bp, Homo sapiens
ggtgggcagctcttggcaggca

SEQ ID NO: 7252808 - DNA, 22 bp, Homo sapiens
gtaacaaaggataacttggttt

SEQ ID NO: 7252809 - DNA, 22 bp, Homo sapiens
gtaaattatttcaagatcatct

SEQ ID NO: 7252810 - DNA, 22 bp, Homo sapiens
gtaataatttgctacctggtgg

SEQ ID NO: 7252811 - DNA, 22 bp, Homo sapiens
gtaataatggtccccaaacact

SEQ ID NO: 7252812 - DNA, 22 bp, Homo sapiens
gtaataatactagtcagccttg

SEQ ID NO: 7252813 - DNA, 22 bp, Homo sapiens
gtaacaaagtttctaggtgctg

SEQ ID NO: 7252814 - DNA, 22 bp, Homo sapiens
gtcaacttgcaagatgctgggc

SEQ ID NO: 7252815 - DNA, 22 bp, Homo sapiens
gtcaacttgacaggcagagtgg

SEQ ID NO: 7252816 - DNA, 22 bp, Homo sapiens
gtcaacttatctctttatctgt

SEQ ID NO: 7252817 - DNA, 22 bp, Homo sapiens
gtcaactttttcatagctctgc

SEQ ID NO: 7252818 - DNA, 22 bp, Homo sapiens
gtcaactttaagatgatctttt

SEQ ID NO: 7252819 - DNA, 22 bp, Homo sapiens
gtcaacataggcctcagtgagg

SEQ ID NO: 7252820 - DNA, 22 bp, Homo sapiens
gtagctttatagtgaataaacc

SEQ ID NO: 7252821 - DNA, 22 bp, Homo sapiens
gtaggaaagggagtgaagggaa

SEQ ID NO: 7252822 - DNA, 22 bp, Homo sapiens
gtagaccatttatctggggagt

SEQ ID NO: 7252823 - DNA, 22 bp, Homo sapiens
gtcaggggatgtgctggtggcc

SEQ ID NO: 7252824 - DNA, 20 bp, Homo sapiens
gtcagtgtcttcagtagtga

SEQ ID NO: 7252825 - DNA, 22 bp, Homo sapiens
gtcacattcatgcagaatcaaa

SEQ ID NO: 7252826 - DNA, 22 bp, Homo sapiens
gtcaccagcaccaatgccacat

SEQ ID NO: 7252827 - DNA, 22 bp, Homo sapiens
gtctccggccgccctggtgctg

SEQ ID NO: 7252828 - DNA, 22 bp, Homo sapiens
gtcctctgagggggctgcacgc

SEQ ID NO: 7252829 - DNA, 22 bp, Homo sapiens
gtcctctgatttctaggtatat

SEQ ID NO: 7252830 - DNA, 22 bp, Homo sapiens
gtcctctgcccaggtcaaggtt

SEQ ID NO: 7252831 - DNA, 22 bp, Homo sapiens
gtcctctgcccaggtcaaggtt

SEQ ID NO: 7252832 - DNA, 22 bp, Homo sapiens
gtcctctgactcagccttggga

SEQ ID NO: 7252833 - DNA, 22 bp, Homo sapiens
gtcctctgagggggctgcacgc

SEQ ID NO: 7252834 - DNA, 19 bp, Homo sapiens
gtcctctcaacaacccggg

SEQ ID NO: 7252835 - DNA, 22 bp, Homo sapiens
gtcctcagtcagtttggtgggg

SEQ ID NO: 7252836 - DNA, 22 bp, Homo sapiens
gtcctcagtaagagggcctctg

SEQ ID NO: 7252837 - DNA, 21 bp, Homo sapiens
gtcctcagctgatgggagctg

SEQ ID NO: 7252838 - DNA, 22 bp, Homo sapiens
gtcctcagcaccagaactaggg

SEQ ID NO: 7252839 - DNA, 22 bp, Homo sapiens
gtcctcagatgctgctgaaatg

SEQ ID NO: 7252840 - DNA, 22 bp, Homo sapiens
gtcattttatgggaacagattt

SEQ ID NO: 7252841 - DNA, 22 bp, Homo sapiens
ggggctgtttttggaatggctg

SEQ ID NO: 7252842 - DNA, 22 bp, Homo sapiens
ggggctggtggtggtttctcca

SEQ ID NO: 7252843 - DNA, 22 bp, Homo sapiens
ggggcttccagcgcccgccggt

SEQ ID NO: 7252844 - DNA, 22 bp, Homo sapiens
ggggcttctttctgccaccgac

SEQ ID NO: 7252845 - DNA, 22 bp, Homo sapiens
ggggcttccagcgcccgccggt

SEQ ID NO: 7252846 - DNA, 22 bp, Homo sapiens
gggggaaagctcaggagcctgt

SEQ ID NO: 7252847 - DNA, 22 bp, Homo sapiens
ggggcttctttctgccaccgac

SEQ ID NO: 7252848 - DNA, 22 bp, Homo sapiens
ggggcagctcccgagggcagga

SEQ ID NO: 7252849 - DNA, 22 bp, Homo sapiens
ggggcaggagcccttcttcagc

SEQ ID NO: 7252850 - DNA, 22 bp, Homo sapiens
ggggcaggagcccttcttcagc

SEQ ID NO: 7252851 - DNA, 22 bp, Homo sapiens
gggggaagaggcatgaagtcct

SEQ ID NO: 7252852 - DNA, 22 bp, Homo sapiens
gggggaagactgggctagtgat

SEQ ID NO: 7252853 - DNA, 22 bp, Homo sapiens
gggggaagactgggctagtgat

SEQ ID NO: 7252854 - DNA, 22 bp, Homo sapiens
gggggaagactgggctagtgat

SEQ ID NO: 7252855 - DNA, 22 bp, Homo sapiens
gggggaagaaagaacatggcat

SEQ ID NO: 7252856 - DNA, 23 bp, Homo sapiens
gggggcgtgtcatggagggccac

SEQ ID NO: 7252857 - DNA, 22 bp, Homo sapiens
gggggcgggagacagcagtgac

SEQ ID NO: 7252858 - DNA, 22 bp, Homo sapiens
gggggcggagcacgtgaccacg

SEQ ID NO: 7252859 - DNA, 22 bp, Homo sapiens
gggggccttgttagtggatgga

SEQ ID NO: 7252860 - DNA, 22 bp, Homo sapiens
gggggcgccccatggaggtgag

SEQ ID NO: 7252861 - DNA, 22 bp, Homo sapiens
gggggccagtgtctcttccttg

SEQ ID NO: 7252862 - DNA, 22 bp, Homo sapiens
gggggccatcttcaaggatgtg

SEQ ID NO: 7252863 - DNA, 22 bp, Homo sapiens
gggggccagtcatctcccaaga

SEQ ID NO: 7252864 - DNA, 20 bp, Homo sapiens
gggggccagcagcagacgcc

SEQ ID NO: 7252865 - DNA, 22 bp, Homo sapiens
gggggcagtaaggatatggaaa

SEQ ID NO: 7252866 - DNA, 22 bp, Homo sapiens
gggggagagacgagcggctctg

SEQ ID NO: 7252867 - DNA, 22 bp, Homo sapiens
gggctggggctcaataatttgt

SEQ ID NO: 7252868 - DNA, 22 bp, Homo sapiens
gggctgggcatggtgttccctc

SEQ ID NO: 7252869 - DNA, 22 bp, Homo sapiens
gggctgggcatggtgttccctc

SEQ ID NO: 7252870 - DNA, 22 bp, Homo sapiens
gggctgggattgcttgctgtga

SEQ ID NO: 7252871 - DNA, 22 bp, Homo sapiens
gggctgggattgcttgctgtga

SEQ ID NO: 7252872 - DNA, 22 bp, Homo sapiens
gggctgggatggcttgaagatt

SEQ ID NO: 7252873 - DNA, 22 bp, Homo sapiens
gggctgggatggcttgaagatt

SEQ ID NO: 7252874 - DNA, 22 bp, Homo sapiens
gggctgggaatggctaagtatg

SEQ ID NO: 7252875 - DNA, 22 bp, Homo sapiens
gggctggctcccaggtgttgaa

SEQ ID NO: 7252876 - DNA, 22 bp, Homo sapiens
ggggatggattccgggtccctg

SEQ ID NO: 7252877 - DNA, 22 bp, Homo sapiens
ggggatggtagaccggtgacgt

SEQ ID NO: 7252878 - DNA, 22 bp, Homo sapiens
ggggatggaggcgtgtggtcct

SEQ ID NO: 7252879 - DNA, 22 bp, Homo sapiens
ggggatggattccgggtccctg

SEQ ID NO: 7252880 - DNA, 22 bp, Homo sapiens
ggggatggtagaccggtgacgt

SEQ ID NO: 7252881 - DNA, 22 bp, Homo sapiens
ggggatggaatgtagtagtgat

SEQ ID NO: 7252882 - DNA, 22 bp, Homo sapiens
ggggcagaaagcccacagagtg

SEQ ID NO: 7252883 - DNA, 22 bp, Homo sapiens
ggggcagaaagcccacagagtg

SEQ ID NO: 7252884 - DNA, 22 bp, Homo sapiens
ggggcagctcccgagggcagga

SEQ ID NO: 7252885 - DNA, 22 bp, Homo sapiens
ggggcacttccaggctgaggct

SEQ ID NO: 7252886 - DNA, 22 bp, Homo sapiens
ggggcacacttttggtagatat

SEQ ID NO: 7252887 - DNA, 22 bp, Homo sapiens
gggctccagcccgggaccaggt

SEQ ID NO: 7252888 - DNA, 22 bp, Homo sapiens
gggctccagcagaggcagccgg

SEQ ID NO: 7252889 - DNA, 22 bp, Homo sapiens
gggctccagtttggccaggaag

SEQ ID NO: 7252890 - DNA, 22 bp, Homo sapiens
gggctccatcacaggctccatc

SEQ ID NO: 7252891 - DNA, 22 bp, Homo sapiens
gggctccatcacaggctccatc

SEQ ID NO: 7252892 - DNA, 22 bp, Homo sapiens
gggctccgcccttggctgagct

SEQ ID NO: 7252893 - DNA, 22 bp, Homo sapiens
gggctccagttgtccccaggat

SEQ ID NO: 7252894 - DNA, 22 bp, Homo sapiens
gggctctcaaggcagggcccca

SEQ ID NO: 7252895 - DNA, 21 bp, Homo sapiens
gggctctcctgaggccatgaa

SEQ ID NO: 7252896 - DNA, 22 bp, Homo sapiens
gggctctcccacaacgtgccag

SEQ ID NO: 7252897 - DNA, 22 bp, Homo sapiens
gggctcggcatctgtggactct

SEQ ID NO: 7252898 - DNA, 19 bp, Homo sapiens
gggctccttgggcctctct

SEQ ID NO: 7252899 - DNA, 22 bp, Homo sapiens
gggctcctcctctgactgtggc

SEQ ID NO: 7252900 - DNA, 22 bp, Homo sapiens
gggctcctgcctcctggcacct

SEQ ID NO: 7252901 - DNA, 22 bp, Homo sapiens
gggctggcgggaaaggcaattc

SEQ ID NO: 7252902 - DNA, 22 bp, Homo sapiens
gggctctctttttggcctgccc

SEQ ID NO: 7252903 - DNA, 22 bp, Homo sapiens
gggcctccggggtgagctgtgg

SEQ ID NO: 7252904 - DNA, 22 bp, Homo sapiens
gggcctctgtgcagaggggcct

SEQ ID NO: 7252905 - DNA, 22 bp, Homo sapiens
gggcatgcctgcgcagtgcatg

SEQ ID NO: 7252906 - DNA, 19 bp, Homo sapiens
gggcatcaaagtgctggtg

SEQ ID NO: 7252907 - DNA, 23 bp, Homo sapiens
gggcagttatgttgtccttggct

SEQ ID NO: 7252908 - DNA, 22 bp, Homo sapiens
gggcatgacttttggagtggga

SEQ ID NO: 7252909 - DNA, 22 bp, Homo sapiens
gggcatgcctgagcctgccact

SEQ ID NO: 7252910 - DNA, 22 bp, Homo sapiens
gggcatgagagggcagctggca

SEQ ID NO: 7252911 - DNA, 22 bp, Homo sapiens
gggctccaaggaggccagcctg

SEQ ID NO: 7252912 - DNA, 22 bp, Homo sapiens
gggcctgccattgctgccccag

SEQ ID NO: 7252913 - DNA, 22 bp, Homo sapiens
gggcctgccattgctgccccag

SEQ ID NO: 7252914 - DNA, 22 bp, Homo sapiens
gggcctggcatgcagccccgtt

SEQ ID NO: 7252915 - DNA, 21 bp, Homo sapiens
ggtcagggggtgcctccaggt

SEQ ID NO: 7252916 - DNA, 22 bp, Homo sapiens
ggtcaggggctgctctacagag

SEQ ID NO: 7252917 - DNA, 18 bp, Homo sapiens
ggtcaggggcggagagaa

SEQ ID NO: 7252918 - DNA, 19 bp, Homo sapiens
ggtagaagggaagtgtttt

SEQ ID NO: 7252919 - DNA, 22 bp, Homo sapiens
ggtactttatacatgcatctgc

SEQ ID NO: 7252920 - DNA, 20 bp, Homo sapiens
ggtacaacttgaatgataac

SEQ ID NO: 7252921 - DNA, 22 bp, Homo sapiens
ggtacacattgtgactgtatta

SEQ ID NO: 7252922 - DNA, 22 bp, Homo sapiens
ggtaaggagagagaaattatgc

SEQ ID NO: 7252923 - DNA, 22 bp, Homo sapiens
gggtccagagttttcccgccct

SEQ ID NO: 7252924 - DNA, 22 bp, Homo sapiens
gggtcaggctagcccagacttc

SEQ ID NO: 7252925 - DNA, 22 bp, Homo sapiens
gggtcagggaggccccaccatg

SEQ ID NO: 7252926 - DNA, 22 bp, Homo sapiens
gggtcaggctcagcagggcagc

SEQ ID NO: 7252927 - DNA, 22 bp, Homo sapiens
gggtcaggcctcaaggtgggct

SEQ ID NO: 7252928 - DNA, 22 bp, Homo sapiens
gggtcaggctagcccagacttc

SEQ ID NO: 7252929 - DNA, 22 bp, Homo sapiens
ggtctgggtttccccaccacac

SEQ ID NO: 7252930 - DNA, 22 bp, Homo sapiens
ggtctgggcttgagtccttttg

SEQ ID NO: 7252931 - DNA, 22 bp, Homo sapiens
ggtctggcctcgggcaccccca

SEQ ID NO: 7252932 - DNA, 22 bp, Homo sapiens
ggtcttctctatgagctggtct

SEQ ID NO: 7252933 - DNA, 22 bp, Homo sapiens
ggtctttctttgatagtggaga

SEQ ID NO: 7252934 - DNA, 22 bp, Homo sapiens
ggtgcagggagaggcaggcccc

SEQ ID NO: 7252935 - DNA, 22 bp, Homo sapiens
ggtgcagggagaggcaggcccc

SEQ ID NO: 7252936 - DNA, 22 bp, Homo sapiens
ggtgaaggtggaacgcagagca

SEQ ID NO: 7252937 - DNA, 22 bp, Homo sapiens
ggtgaaggtcagagcaggaaaa

SEQ ID NO: 7252938 - DNA, 22 bp, Homo sapiens
ggtgaaggtcagagcaggaaaa

SEQ ID NO: 7252939 - DNA, 22 bp, Homo sapiens
ggtgaaggcacaagagggcaag

SEQ ID NO: 7252940 - DNA, 22 bp, Homo sapiens
ggtgaaggcacaagagggcaag

SEQ ID NO: 7252941 - DNA, 22 bp, Homo sapiens
ggtgaagggccttaggagacag

SEQ ID NO: 7252942 - DNA, 22 bp, Homo sapiens
ggtgggaggactgtttgaggca

SEQ ID NO: 7252943 - DNA, 22 bp, Homo sapiens
ggtgggaggcaggctgctccca

SEQ ID NO: 7252944 - DNA, 22 bp, Homo sapiens
ggtgggcaacatttggcctgag

SEQ ID NO: 7252945 - DNA, 22 bp, Homo sapiens
ggtgcgggccgcctgcccttgg

SEQ ID NO: 7252946 - DNA, 22 bp, Homo sapiens
ggtgccagagtggcccaggggc

SEQ ID NO: 7252947 - DNA, 22 bp, Homo sapiens
ggtgccagagtggcccaggggc

SEQ ID NO: 7252948 - DNA, 22 bp, Homo sapiens
ggtgccagatgaggcccgcgat

SEQ ID NO: 7252949 - DNA, 22 bp, Homo sapiens
ggtgccagatgaggcccgcgat

SEQ ID NO: 7252950 - DNA, 22 bp, Homo sapiens
ggtgccagagtggcccaggggc

SEQ ID NO: 7252951 - DNA, 22 bp, Homo sapiens
ggtgccagcctagtgcagtggt

SEQ ID NO: 7252952 - DNA, 22 bp, Homo sapiens
ggtgccaggctcccagctcagg

SEQ ID NO: 7252953 - DNA, 22 bp, Homo sapiens
ggtgccaggctgtagtcagggt

SEQ ID NO: 7252954 - DNA, 22 bp, Homo sapiens
ggtgccagtgggtctcaggata

SEQ ID NO: 7252955 - DNA, 22 bp, Homo sapiens
gggaggtgttctgccaacgcgg

SEQ ID NO: 7252956 - DNA, 21 bp, Homo sapiens
gggagggatggaaatgatgtt

SEQ ID NO: 7252957 - DNA, 22 bp, Homo sapiens
gggagggattagttctgcctgg

SEQ ID NO: 7252958 - DNA, 22 bp, Homo sapiens
gggagggattagttctgcctgg

SEQ ID NO: 7252959 - DNA, 22 bp, Homo sapiens
gggagggatctgctaggcaatg

SEQ ID NO: 7252960 - DNA, 22 bp, Homo sapiens
gggaggtgaaaggttgctgcag

SEQ ID NO: 7252961 - DNA, 22 bp, Homo sapiens
gggaggtgatggcaagcagcgg

SEQ ID NO: 7252962 - DNA, 22 bp, Homo sapiens
gggagctggagttgtgttgcct

SEQ ID NO: 7252963 - DNA, 22 bp, Homo sapiens
gggagctggatcgcgcgcccgg

SEQ ID NO: 7252964 - DNA, 22 bp, Homo sapiens
gggagctggagttgtgttgcct

SEQ ID NO: 7252965 - DNA, 22 bp, Homo sapiens
gggagctggatgattgaggcaa

SEQ ID NO: 7252966 - DNA, 22 bp, Homo sapiens
gggagctggcctactattagat

SEQ ID NO: 7252967 - DNA, 22 bp, Homo sapiens
gggagctggcggattccccagg

SEQ ID NO: 7252968 - DNA, 22 bp, Homo sapiens
gggagggacacaaagagttccc

SEQ ID NO: 7252969 - DNA, 22 bp, Homo sapiens
gggagggagaggacagttctat

SEQ ID NO: 7252970 - DNA, 22 bp, Homo sapiens
gggagggaggtgatgcttggct

SEQ ID NO: 7252971 - DNA, 22 bp, Homo sapiens
gggagggaggtgctggttcacg

SEQ ID NO: 7252972 - DNA, 16 bp, Homo sapiens
gggagggagttggtgg

SEQ ID NO: 7252973 - DNA, 22 bp, Homo sapiens
gggcaggttggcatcccgggca

SEQ ID NO: 7252974 - DNA, 18 bp, Homo sapiens
gggcagtaagtgtggggt

SEQ ID NO: 7252975 - DNA, 18 bp, Homo sapiens
gggcagtaagtgtggggt

SEQ ID NO: 7252976 - DNA, 23 bp, Homo sapiens
gggcaggtttttataggcttcag

SEQ ID NO: 7252977 - DNA, 22 bp, Homo sapiens
gggcaggttattggagtaggga

SEQ ID NO: 7252978 - DNA, 18 bp, Homo sapiens
gggcactggggactggag

SEQ ID NO: 7252979 - DNA, 22 bp, Homo sapiens
gggcactggcagtcggggacgc

SEQ ID NO: 7252980 - DNA, 18 bp, Homo sapiens
gggcactggggactggag

SEQ ID NO: 7252981 - DNA, 22 bp, Homo sapiens
gggcagtcacagtgctggagca

SEQ ID NO: 7252982 - DNA, 21 bp, Homo sapiens
gggcagtctggtggctatggc

SEQ ID NO: 7252983 - DNA, 21 bp, Homo sapiens
gggcagtctggtggctatggc

SEQ ID NO: 7252984 - DNA, 22 bp, Homo sapiens
gggcagtcacagtgctggagca

SEQ ID NO: 7252985 - DNA, 22 bp, Homo sapiens
gggcagtgaatattggtgggaa

SEQ ID NO: 7252986 - DNA, 22 bp, Homo sapiens
gggcagtgacaaaggggatgaa

SEQ ID NO: 7252987 - DNA, 22 bp, Homo sapiens
gggcagtgacaaaggggatgaa

SEQ ID NO: 7252988 - DNA, 22 bp, Homo sapiens
gggcactggaggccaaggagct

SEQ ID NO: 7252989 - DNA, 22 bp, Homo sapiens
gggcactggaggccaaggagct

SEQ ID NO: 7252990 - DNA, 22 bp, Homo sapiens
gggcactgagtggatgatgcag

SEQ ID NO: 7252991 - DNA, 22 bp, Homo sapiens
gggcacaggagaaggatctggc

SEQ ID NO: 7252992 - DNA, 22 bp, Homo sapiens
gggcactcagctgtagagcagg

SEQ ID NO: 7252993 - DNA, 22 bp, Homo sapiens
gggcactctgctcccagtgttt

SEQ ID NO: 7252994 - DNA, 22 bp, Homo sapiens
gggcactcctgatcgggacttg

SEQ ID NO: 7252995 - DNA, 22 bp, Homo sapiens
gggcactcctgatcgggacttg

SEQ ID NO: 7252996 - DNA, 22 bp, Homo sapiens
gggcactcctctggtccagccc

SEQ ID NO: 7252997 - DNA, 22 bp, Homo sapiens
ggctgtgcctctggcagcacat

SEQ ID NO: 7252998 - DNA, 22 bp, Homo sapiens
gggaaggccttgtcagcggatt

SEQ ID NO: 7252999 - DNA, 22 bp, Homo sapiens
gggaaggctgcctgagggatgg

SEQ ID NO: 7253000 - DNA, 22 bp, Homo sapiens
gggaagggacttgtttaaggtc

SEQ ID NO: 7253001 - DNA, 22 bp, Homo sapiens
gggaaggctgcctgagggatgg

SEQ ID NO: 7253002 - DNA, 22 bp, Homo sapiens
gggaagggagctgggtatttag

SEQ ID NO: 7253003 - DNA, 22 bp, Homo sapiens
gggaagggagggcctccagtca

SEQ ID NO: 7253004 - DNA, 22 bp, Homo sapiens
gggaagggagggacctcagtct

SEQ ID NO: 7253005 - DNA, 22 bp, Homo sapiens
gggaagggagggacctcagtct

SEQ ID NO: 7253006 - DNA, 22 bp, Homo sapiens
gggagctgagctggaagagaat

SEQ ID NO: 7253007 - DNA, 22 bp, Homo sapiens
gggagctgacctgcaggttccc

SEQ ID NO: 7253008 - DNA, 22 bp, Homo sapiens
gggagctgacctgcaggttccc

SEQ ID NO: 7253009 - DNA, 22 bp, Homo sapiens
gggagctgagaaacaacattct

SEQ ID NO: 7253010 - DNA, 22 bp, Homo sapiens
gggagctgagctctgagccacg

SEQ ID NO: 7253011 - DNA, 19 bp, Homo sapiens
gggagctgaggtctttggt

SEQ ID NO: 7253012 - DNA, 22 bp, Homo sapiens
gggagctggagctggaagactc

SEQ ID NO: 7253013 - DNA, 22 bp, Homo sapiens
gggagctgaggagccccgtcgg

SEQ ID NO: 7253014 - DNA, 22 bp, Homo sapiens
gggagctgaggagccccgtcgg

SEQ ID NO: 7253015 - DNA, 22 bp, Homo sapiens
gggagctgagggacctctgtgg

SEQ ID NO: 7253016 - DNA, 22 bp, Homo sapiens
gggaagggctccttttattgca

SEQ ID NO: 7253017 - DNA, 22 bp, Homo sapiens
gggaagggagggcctccagtca

SEQ ID NO: 7253018 - DNA, 22 bp, Homo sapiens
gggaagggagggcctccagtca

SEQ ID NO: 7253019 - DNA, 22 bp, Homo sapiens
gggaagggctccttttattgca

SEQ ID NO: 7253020 - DNA, 22 bp, Homo sapiens
gggaagggtgttgtcttatctt

SEQ ID NO: 7253021 - DNA, 22 bp, Homo sapiens
gggaaggtatttagctgctgaa

SEQ ID NO: 7253022 - DNA, 21 bp, Homo sapiens
gggagctgacagcagcacggc

SEQ ID NO: 7253023 - DNA, 22 bp, Homo sapiens
ggctctgggccagagttggctt

SEQ ID NO: 7253024 - DNA, 22 bp, Homo sapiens
ggctcctgaggaccaggcacag

SEQ ID NO: 7253025 - DNA, 22 bp, Homo sapiens
ggctcctgagaatgggccatca

SEQ ID NO: 7253026 - DNA, 22 bp, Homo sapiens
ggctcttcacacagtgatgtca

SEQ ID NO: 7253027 - DNA, 22 bp, Homo sapiens
ggctgagccatgggcactgcag

SEQ ID NO: 7253028 - DNA, 22 bp, Homo sapiens
ggctgagccatgggcactgcag

SEQ ID NO: 7253029 - DNA, 17 bp, Homo sapiens
ggctctgggtgtcacat

SEQ ID NO: 7253030 - DNA, 22 bp, Homo sapiens
ggctacagactgcataagggca

SEQ ID NO: 7253031 - DNA, 22 bp, Homo sapiens
ggcgtggggccttctgcccgct

SEQ ID NO: 7253032 - DNA, 22 bp, Homo sapiens
ggcggtggcgtgaaggtggctg

SEQ ID NO: 7253033 - DNA, 22 bp, Homo sapiens
ggcgtgggcgaggtgctctatc

SEQ ID NO: 7253034 - DNA, 22 bp, Homo sapiens
ggcgtgggaagtggggcttctg

SEQ ID NO: 7253035 - DNA, 22 bp, Homo sapiens
ggcgtctgtttgaaggcaacgt

SEQ ID NO: 7253036 - DNA, 22 bp, Homo sapiens
ggctagagtggaactggagcgg

SEQ ID NO: 7253037 - DNA, 22 bp, Homo sapiens
ggctaggcctcaggcctgcctg

SEQ ID NO: 7253038 - DNA, 22 bp, Homo sapiens
ggctcccaggagggcctggagg

SEQ ID NO: 7253039 - DNA, 22 bp, Homo sapiens
ggctccagtttgtgccttcagc

SEQ ID NO: 7253040 - DNA, 23 bp, Homo sapiens
ggctccaggcctgacgggcgcgg

SEQ ID NO: 7253041 - DNA, 22 bp, Homo sapiens
ggctccccaggtccaggagctg

SEQ ID NO: 7253042 - DNA, 22 bp, Homo sapiens
ggctccctggaaatcccgaggc

SEQ ID NO: 7253043 - DNA, 22 bp, Homo sapiens
ggctgtgagcaggcagaatgct

SEQ ID NO: 7253044 - DNA, 22 bp, Homo sapiens
ggctgggtttgactcctggctt

SEQ ID NO: 7253045 - DNA, 22 bp, Homo sapiens
ggctggtggggaaagaggacca

SEQ ID NO: 7253046 - DNA, 23 bp, Homo sapiens
ggctggtgcccttggccagtcgg

SEQ ID NO: 7253047 - DNA, 22 bp, Homo sapiens
ggctggactgcctcccagagtc

SEQ ID NO: 7253048 - DNA, 19 bp, Homo sapiens
ggctggagaaaggaatcag

SEQ ID NO: 7253049 - DNA, 19 bp, Homo sapiens
ggctggagaaaggaatcag

SEQ ID NO: 7253050 - DNA, 21 bp, Homo sapiens
ggctgggtcatgcagctggcc

SEQ ID NO: 7253051 - DNA, 22 bp, Homo sapiens
ggctgctggggacgtgggagag

SEQ ID NO: 7253052 - DNA, 20 bp, Homo sapiens
ggctgctgtgggcagagagg

SEQ ID NO: 7253053 - DNA, 22 bp, Homo sapiens
ggctgctgtttcagagactgtt

SEQ ID NO: 7253054 - DNA, 22 bp, Homo sapiens
ggatttcttccttcctcagaag

SEQ ID NO: 7253055 - DNA, 21 bp, Homo sapiens
ggcactgctgggccatctgct

SEQ ID NO: 7253056 - DNA, 22 bp, Homo sapiens
ggcactgccccctgcccaggac

SEQ ID NO: 7253057 - DNA, 22 bp, Homo sapiens
ggcagcagcaaggttggagctg

SEQ ID NO: 7253058 - DNA, 22 bp, Homo sapiens
ggcagcagcaaggttggagctg

SEQ ID NO: 7253059 - DNA, 22 bp, Homo sapiens
ggcagaaggcaattagagactg

SEQ ID NO: 7253060 - DNA, 22 bp, Homo sapiens
ggcagctgtttgtcctcctgtt

SEQ ID NO: 7253061 - DNA, 22 bp, Homo sapiens
ggcaggagaatggcgtgaactc

SEQ ID NO: 7253062 - DNA, 22 bp, Homo sapiens
ggcagccagcaatgagaagttt

SEQ ID NO: 7253063 - DNA, 22 bp, Homo sapiens
ggcagccatactcagacctggg

SEQ ID NO: 7253064 - DNA, 22 bp, Homo sapiens
ggcagccatgcacgctgcctgg

SEQ ID NO: 7253065 - DNA, 22 bp, Homo sapiens
ggcagccatggacactggctag

SEQ ID NO: 7253066 - DNA, 22 bp, Homo sapiens
ggagaggcttggcccagcctgg

SEQ ID NO: 7253067 - DNA, 22 bp, Homo sapiens
ggagcaccctgctcagccaagc

SEQ ID NO: 7253068 - DNA, 22 bp, Homo sapiens
ggagcagagctcttcatctgca

SEQ ID NO: 7253069 - DNA, 22 bp, Homo sapiens
ggagcagagcatttcacagcct

SEQ ID NO: 7253070 - DNA, 22 bp, Homo sapiens
ggagcagagctgggcttggctg

SEQ ID NO: 7253071 - DNA, 22 bp, Homo sapiens
ggagcagatgtcttcatggcct

SEQ ID NO: 7253072 - DNA, 22 bp, Homo sapiens
ggagttggaggctccagggaac

SEQ ID NO: 7253073 - DNA, 22 bp, Homo sapiens
ggatgctgggagacagcaggca

SEQ ID NO: 7253074 - DNA, 22 bp, Homo sapiens
ggatgctgactttggagcatgg

SEQ ID NO: 7253075 - DNA, 22 bp, Homo sapiens
ggatgctgtctaagctgaggac

SEQ ID NO: 7253076 - DNA, 18 bp, Homo sapiens
ggatgctgtgtgctcctt

SEQ ID NO: 7253077 - DNA, 22 bp, Homo sapiens
ggatgaggtagatgaacaaggg

SEQ ID NO: 7253078 - DNA, 17 bp, Homo sapiens
ggcaggtgacagacacc

SEQ ID NO: 7253079 - DNA, 22 bp, Homo sapiens
ggcaggtgacctggcctcccag

SEQ ID NO: 7253080 - DNA, 22 bp, Homo sapiens
ggcagggtggcagaggctcaga

SEQ ID NO: 7253081 - DNA, 22 bp, Homo sapiens
ggcagggtggccctccagtgag

SEQ ID NO: 7253082 - DNA, 22 bp, Homo sapiens
ggcaggagctctccagtttgcc

SEQ ID NO: 7253083 - DNA, 22 bp, Homo sapiens
ggcagtggtgggaggctcgctc

SEQ ID NO: 7253084 - DNA, 22 bp, Homo sapiens
ggcatccgcctggagggtgcta

SEQ ID NO: 7253085 - DNA, 21 bp, Homo sapiens
ggcatgagggcagtgagcaga

SEQ ID NO: 7253086 - DNA, 22 bp, Homo sapiens
ggccagctgtggggccgagcct

SEQ ID NO: 7253087 - DNA, 19 bp, Homo sapiens
ggccagctgtctcctgcta

SEQ ID NO: 7253088 - DNA, 22 bp, Homo sapiens
ggccagcttctctgctgcctgt

SEQ ID NO: 7253089 - DNA, 22 bp, Homo sapiens
ggcatgagtaacgtgagtgagg

SEQ ID NO: 7253090 - DNA, 22 bp, Homo sapiens
ggccctggcagccacgaaagcc

SEQ ID NO: 7253091 - DNA, 22 bp, Homo sapiens
ggccctgctgagtggagtggag

SEQ ID NO: 7253092 - DNA, 22 bp, Homo sapiens
ggccctgctgaagccgggtcta

SEQ ID NO: 7253093 - DNA, 22 bp, Homo sapiens
ggccctgctcaggctgcgatga

SEQ ID NO: 7253094 - DNA, 19 bp, Homo sapiens
ggccaggctgactgtggtc

SEQ ID NO: 7253095 - DNA, 22 bp, Homo sapiens
ggccaggcactgtgtgagatat

SEQ ID NO: 7253096 - DNA, 22 bp, Homo sapiens
ggccaggccaagagggttggaa

SEQ ID NO: 7253097 - DNA, 22 bp, Homo sapiens
ggccaggccaagagggttggaa

SEQ ID NO: 7253098 - DNA, 22 bp, Homo sapiens
ggccaggcgatgacccctccac

SEQ ID NO: 7253099 - DNA, 22 bp, Homo sapiens
ggccaggcgatgacccctccac

SEQ ID NO: 7253100 - DNA, 22 bp, Homo sapiens
ggccaggagcaagccaggctct

SEQ ID NO: 7253101 - DNA, 22 bp, Homo sapiens
ggccaggaagggaagatcagca

SEQ ID NO: 7253102 - DNA, 22 bp, Homo sapiens
ggccaggagcaagccaggctct

SEQ ID NO: 7253103 - DNA, 22 bp, Homo sapiens
ggcctcacccatcggtgccttt

SEQ ID NO: 7253104 - DNA, 22 bp, Homo sapiens
ggcctagggagtggccatgcct

SEQ ID NO: 7253105 - DNA, 23 bp, Homo sapiens
ggcctaacagaggcagggctgag

SEQ ID NO: 7253106 - DNA, 21 bp, Homo sapiens
ggccctggttacgcctcctct

SEQ ID NO: 7253107 - DNA, 22 bp, Homo sapiens
ggccctgggatgctcagcagtg

SEQ ID NO: 7253108 - DNA, 22 bp, Homo sapiens
ggccctgggatgctcagcagtg

SEQ ID NO: 7253109 - DNA, 22 bp, Homo sapiens
ggccctgggcagaggagtgggc

SEQ ID NO: 7253110 - DNA, 22 bp, Homo sapiens
ggcctgcctcacagtcagcacc

SEQ ID NO: 7253111 - DNA, 22 bp, Homo sapiens
ggcctggaagaggacagagaaa

SEQ ID NO: 7253112 - DNA, 22 bp, Homo sapiens
ggcctggacacctgaggtctta

SEQ ID NO: 7253113 - DNA, 22 bp, Homo sapiens
ggcctggagaaggcccagggag

SEQ ID NO: 7253114 - DNA, 22 bp, Homo sapiens
ggcctggagcagagactaggga

SEQ ID NO: 7253115 - DNA, 18 bp, Homo sapiens
ggcgggtgttttattcac

SEQ ID NO: 7253116 - DNA, 22 bp, Homo sapiens
ggcgggtgtaagtaggacagcg

SEQ ID NO: 7253117 - DNA, 22 bp, Homo sapiens
ggcgggtggcgaggcttctcgg

SEQ ID NO: 7253118 - DNA, 19 bp, Homo sapiens
ggcgggtggactggagccc

SEQ ID NO: 7253119 - DNA, 22 bp, Homo sapiens
ggcgggtgataggatgagcagg

SEQ ID NO: 7253120 - DNA, 22 bp, Homo sapiens
ggcgggggtccaggagcctgca

SEQ ID NO: 7253121 - DNA, 22 bp, Homo sapiens
ggcctggctcttgcccagcctg

SEQ ID NO: 7253122 - DNA, 22 bp, Homo sapiens
ggaagctgttgtgagtgcagca

SEQ ID NO: 7253123 - DNA, 22 bp, Homo sapiens
ggaagccagttgcttggtgtgg

SEQ ID NO: 7253124 - DNA, 22 bp, Homo sapiens
ggaagccatgagggacagttct

SEQ ID NO: 7253125 - DNA, 21 bp, Homo sapiens
ggacaccagtcacactggatt

SEQ ID NO: 7253126 - DNA, 22 bp, Homo sapiens
ggaacagtagacgatctccttt

SEQ ID NO: 7253127 - DNA, 22 bp, Homo sapiens
ggaagccacccagctttgatag

SEQ ID NO: 7253128 - DNA, 22 bp, Homo sapiens
ggaagccagaaagtgagaatat

SEQ ID NO: 7253129 - DNA, 22 bp, Homo sapiens
ggaagccagaaagtgagaatat

SEQ ID NO: 7253130 - DNA, 22 bp, Homo sapiens
ggaagccagagtgctgggcagg

SEQ ID NO: 7253131 - DNA, 22 bp, Homo sapiens
ggaagccaggccaatgagaaca

SEQ ID NO: 7253132 - DNA, 20 bp, Homo sapiens
ggaagccagcatccttgagg

SEQ ID NO: 7253133 - DNA, 22 bp, Homo sapiens
ggaagccaggccaatgagaaca

SEQ ID NO: 7253134 - DNA, 22 bp, Homo sapiens
ggaagccaggctgggggatctg

SEQ ID NO: 7253135 - DNA, 20 bp, Homo sapiens
ggaagccagggtgcagggga

SEQ ID NO: 7253136 - DNA, 22 bp, Homo sapiens
gcttcccaggcgcctgaccttt

SEQ ID NO: 7253137 - DNA, 20 bp, Homo sapiens
gcttcccaattcttgatctg

SEQ ID NO: 7253138 - DNA, 22 bp, Homo sapiens
ggaaaggagatattggagagtg

SEQ ID NO: 7253139 - DNA, 22 bp, Homo sapiens
ggaaaggagatgaataggatta

SEQ ID NO: 7253140 - DNA, 22 bp, Homo sapiens
ggaaagggcatggccttttcac

SEQ ID NO: 7253141 - DNA, 22 bp, Homo sapiens
ggaaaggggcctggatcttttg

SEQ ID NO: 7253142 - DNA, 22 bp, Homo sapiens
ggacagacagtgtgagtgaggc

SEQ ID NO: 7253143 - DNA, 22 bp, Homo sapiens
ggacagagcagacgagcagcgg

SEQ ID NO: 7253144 - DNA, 22 bp, Homo sapiens
ggacagagcagacgagcagcgg

SEQ ID NO: 7253145 - DNA, 22 bp, Homo sapiens
ggacagagcagacgagcagcgg

SEQ ID NO: 7253146 - DNA, 22 bp, Homo sapiens
ggacagagccctggtggcctaa

SEQ ID NO: 7253147 - DNA, 22 bp, Homo sapiens
ggacagaaattcttgttggaca

SEQ ID NO: 7253148 - DNA, 22 bp, Homo sapiens
ggacagagggcaggagcccaga

SEQ ID NO: 7253149 - DNA, 22 bp, Homo sapiens
ggacccagaggggagtctggca

SEQ ID NO: 7253150 - DNA, 22 bp, Homo sapiens
ggacctgccagaactcaggcta

SEQ ID NO: 7253151 - DNA, 22 bp, Homo sapiens
ggacggggagctggaaagggga

SEQ ID NO: 7253152 - DNA, 22 bp, Homo sapiens
ggacggggagctggaaagggga

SEQ ID NO: 7253153 - DNA, 22 bp, Homo sapiens
ggagaggaaatgccagcacttc

SEQ ID NO: 7253154 - DNA, 22 bp, Homo sapiens
ggagaggaaatgccagcacttc

SEQ ID NO: 7253155 - DNA, 22 bp, Homo sapiens
ggagaggaaatgccagcacttc

SEQ ID NO: 7253156 - DNA, 22 bp, Homo sapiens
ggagaggaaatgccagcacttc

SEQ ID NO: 7253157 - DNA, 22 bp, Homo sapiens
ggagaggacatggctcccacag

SEQ ID NO: 7253158 - DNA, 22 bp, Homo sapiens
ggagaggcttccagagtcgtgc

SEQ ID NO: 7253159 - DNA, 19 bp, Homo sapiens
ggagaggctggagggatgc

SEQ ID NO: 7253160 - DNA, 19 bp, Homo sapiens
ggagaggctggagggatgc

SEQ ID NO: 7253161 - DNA, 19 bp, Homo sapiens
ggagaggctggagggatgc

SEQ ID NO: 7253162 - DNA, 19 bp, Homo sapiens
ggagaggctggagggatgc

SEQ ID NO: 7253163 - DNA, 22 bp, Homo sapiens
ggagaggagctattgggggctc

SEQ ID NO: 7253164 - DNA, 22 bp, Homo sapiens
ggagaggagctattgggggctc

SEQ ID NO: 7253165 - DNA, 22 bp, Homo sapiens
ggagaggagctattgggggctc

SEQ ID NO: 7253166 - DNA, 22 bp, Homo sapiens
ggagaggagctattgggggctc

SEQ ID NO: 7253167 - DNA, 22 bp, Homo sapiens
ggagaggcgatgagtcacagcc

SEQ ID NO: 7253168 - DNA, 22 bp, Homo sapiens
gctgggtcctatgctggtagag

SEQ ID NO: 7253169 - DNA, 20 bp, Homo sapiens
gctgggggtgtgctgagtga

SEQ ID NO: 7253170 - DNA, 22 bp, Homo sapiens
gctgggaggatctctccctgtc

SEQ ID NO: 7253171 - DNA, 22 bp, Homo sapiens
gctgggagtcgcgtctgtggcc

SEQ ID NO: 7253172 - DNA, 22 bp, Homo sapiens
gctggggctgggctgaggaaga

SEQ ID NO: 7253173 - DNA, 21 bp, Homo sapiens
gctgtgcagaggatggagtgg

SEQ ID NO: 7253174 - DNA, 22 bp, Homo sapiens
gctgtgcagagcacagggtccc

SEQ ID NO: 7253175 - DNA, 22 bp, Homo sapiens
gctgtgcactacctatacatcc

SEQ ID NO: 7253176 - DNA, 22 bp, Homo sapiens
gctgtgcattgagcctgagagt

SEQ ID NO: 7253177 - DNA, 21 bp, Homo sapiens
gctgtgcaggtgcccctgctc

SEQ ID NO: 7253178 - DNA, 22 bp, Homo sapiens
gctgtgcaggtccccactgcct

SEQ ID NO: 7253179 - DNA, 22 bp, Homo sapiens
gctgtgcagccaagtgcctctg

SEQ ID NO: 7253180 - DNA, 22 bp, Homo sapiens
gcttccacctactaaatgccac

SEQ ID NO: 7253181 - DNA, 22 bp, Homo sapiens
gcttccaagtcaatcaatgctg

SEQ ID NO: 7253182 - DNA, 22 bp, Homo sapiens
gcttccaagcggtagatagcat

SEQ ID NO: 7253183 - DNA, 22 bp, Homo sapiens
gcttccaaacaaaattttgatg

SEQ ID NO: 7253184 - DNA, 22 bp, Homo sapiens
gctggcagctggaagttgggct

SEQ ID NO: 7253185 - DNA, 22 bp, Homo sapiens
gctggcagagacaagaagacta

SEQ ID NO: 7253186 - DNA, 22 bp, Homo sapiens
gctggcaggagcctttcccttt

SEQ ID NO: 7253187 - DNA, 22 bp, Homo sapiens
gctggcaggagaccatacccta

SEQ ID NO: 7253188 - DNA, 22 bp, Homo sapiens
gctggcaggagaaacggggtgc

SEQ ID NO: 7253189 - DNA, 22 bp, Homo sapiens
gctggcaggatagaagtctaat

SEQ ID NO: 7253190 - DNA, 22 bp, Homo sapiens
gctggcaggataacttctaagc

SEQ ID NO: 7253191 - DNA, 22 bp, Homo sapiens
gctggcagggacagctgcgtgt

SEQ ID NO: 7253192 - DNA, 22 bp, Homo sapiens
gctggcagaatttcttcttgct

SEQ ID NO: 7253193 - DNA, 22 bp, Homo sapiens
gctggcagaagagctggttcaa

SEQ ID NO: 7253194 - DNA, 22 bp, Homo sapiens
gctggcagactgggggcagaac

SEQ ID NO: 7253195 - DNA, 19 bp, Homo sapiens
gctggcagaattttgaacc

SEQ ID NO: 7253196 - DNA, 22 bp, Homo sapiens
gctggcagacttcctctggaac

SEQ ID NO: 7253197 - DNA, 22 bp, Homo sapiens
gctgggactgagacagtgacct

SEQ ID NO: 7253198 - DNA, 22 bp, Homo sapiens
gctgggagaggccctgaagtga

SEQ ID NO: 7253199 - DNA, 22 bp, Homo sapiens
gctgggacaggcttggccctgt

SEQ ID NO: 7253200 - DNA, 22 bp, Homo sapiens
gctgggaagaacaggagagaat

SEQ ID NO: 7253201 - DNA, 22 bp, Homo sapiens
gctggctgagttctgtcgtctg

SEQ ID NO: 7253202 - DNA, 22 bp, Homo sapiens
gctcagggaaagagctcctgtc

SEQ ID NO: 7253203 - DNA, 19 bp, Homo sapiens
gctcaggctgtgtgtgggg

SEQ ID NO: 7253204 - DNA, 22 bp, Homo sapiens
gctcaggctggattgcagtggc

SEQ ID NO: 7253205 - DNA, 22 bp, Homo sapiens
gctcaggctggattgcagtggc

SEQ ID NO: 7253206 - DNA, 21 bp, Homo sapiens
gctcaggctcttgacagagca

SEQ ID NO: 7253207 - DNA, 22 bp, Homo sapiens
gctcagggaaagagctcctgtc

SEQ ID NO: 7253208 - DNA, 21 bp, Homo sapiens
gctcaggctcttgacagagca

SEQ ID NO: 7253209 - DNA, 22 bp, Homo sapiens
gctcaggctctcccaggggaat

SEQ ID NO: 7253210 - DNA, 21 bp, Homo sapiens
gctcaggctcaggttcaggtt

SEQ ID NO: 7253211 - DNA, 22 bp, Homo sapiens
gctcaggcctggcccatgggac

SEQ ID NO: 7253212 - DNA, 22 bp, Homo sapiens
gctcaggcctggcccatgggac

SEQ ID NO: 7253213 - DNA, 22 bp, Homo sapiens
gctcaggcctccagaggggcaa

SEQ ID NO: 7253214 - DNA, 18 bp, Homo sapiens
gctcaggccctagtcagt

SEQ ID NO: 7253215 - DNA, 22 bp, Homo sapiens
gctctggctactccaccctgtt

SEQ ID NO: 7253216 - DNA, 22 bp, Homo sapiens
gctctgcgattattgggccttt

SEQ ID NO: 7253217 - DNA, 22 bp, Homo sapiens
gctctgcctggtcgcgtgctgg

SEQ ID NO: 7253218 - DNA, 22 bp, Homo sapiens
gctctgcctctttgctgcgtca

SEQ ID NO: 7253219 - DNA, 17 bp, Homo sapiens
gctctgcctctcccacc

SEQ ID NO: 7253220 - DNA, 22 bp, Homo sapiens
gctctgccccaggaactcagcc

SEQ ID NO: 7253221 - DNA, 17 bp, Homo sapiens
gctctgccccagcctct

SEQ ID NO: 7253222 - DNA, 22 bp, Homo sapiens
gctctgccctgggccgttgtaa

SEQ ID NO: 7253223 - DNA, 22 bp, Homo sapiens
gctctgcccagtgccctgagac

SEQ ID NO: 7253224 - DNA, 18 bp, Homo sapiens
gctctgcccaggctgccc

SEQ ID NO: 7253225 - DNA, 22 bp, Homo sapiens
gctctgcccaggaccgtccttg

SEQ ID NO: 7253226 - DNA, 20 bp, Homo sapiens
gctgccagggcggagacatc

SEQ ID NO: 7253227 - DNA, 22 bp, Homo sapiens
gctgccagggaggtggtggagg

SEQ ID NO: 7253228 - DNA, 21 bp, Homo sapiens
gctgccaggattttgcaggaa

SEQ ID NO: 7253229 - DNA, 22 bp, Homo sapiens
gctgccaggacggagaggagcg

SEQ ID NO: 7253230 - DNA, 22 bp, Homo sapiens
gctgcaggagctggagctgtgg

SEQ ID NO: 7253231 - DNA, 22 bp, Homo sapiens
gctgcagggggtgggcgtctcc

SEQ ID NO: 7253232 - DNA, 22 bp, Homo sapiens
gctgcaggttgggcaacagagt

SEQ ID NO: 7253233 - DNA, 22 bp, Homo sapiens
gctgcagactgggaggcaggtg

SEQ ID NO: 7253234 - DNA, 22 bp, Homo sapiens
gctgcaggagattttgagagtc

SEQ ID NO: 7253235 - DNA, 20 bp, Homo sapiens
gctgaagattcccatgcaag

SEQ ID NO: 7253236 - DNA, 22 bp, Homo sapiens
gctgaaggagcctggggtggga

SEQ ID NO: 7253237 - DNA, 22 bp, Homo sapiens
gctgaaggcccggaggacaggg

SEQ ID NO: 7253238 - DNA, 22 bp, Homo sapiens
gctgaagtaactcacatcgtta

SEQ ID NO: 7253239 - DNA, 22 bp, Homo sapiens
gctgaaggtctctggagaggtc

SEQ ID NO: 7253240 - DNA, 22 bp, Homo sapiens
gctgaaggtctctggagaggtc

SEQ ID NO: 7253241 - DNA, 22 bp, Homo sapiens
gctgaagttttgcagagagtaa

SEQ ID NO: 7253242 - DNA, 22 bp, Homo sapiens
gctgaagtttatgtcttctttt

SEQ ID NO: 7253243 - DNA, 22 bp, Homo sapiens
gctgaagttgcctattttaata

SEQ ID NO: 7253244 - DNA, 22 bp, Homo sapiens
gctgaagttgaatattctggga

SEQ ID NO: 7253245 - DNA, 16 bp, Homo sapiens
gctgaagtgagtatag

SEQ ID NO: 7253246 - DNA, 22 bp, Homo sapiens
gctgaagtctgagaatttgcaa

SEQ ID NO: 7253247 - DNA, 22 bp, Homo sapiens
gctgaagtcctaatcccaagta

SEQ ID NO: 7253248 - DNA, 22 bp, Homo sapiens
gctgaagtgtggagtgacagtt

SEQ ID NO: 7253249 - DNA, 22 bp, Homo sapiens
gctgaagtgcttttgaatttgg

SEQ ID NO: 7253250 - DNA, 22 bp, Homo sapiens
gctgaagtggcgtgatcagaat

SEQ ID NO: 7253251 - DNA, 22 bp, Homo sapiens
gctgatctcccttttctcacag

SEQ ID NO: 7253252 - DNA, 22 bp, Homo sapiens
gccttttgatctataactgtgt

SEQ ID NO: 7253253 - DNA, 22 bp, Homo sapiens
gcgacctcctgcctgagagtct

SEQ ID NO: 7253254 - DNA, 22 bp, Homo sapiens
gccttttgatctataactgtgt

SEQ ID NO: 7253255 - DNA, 22 bp, Homo sapiens
gccttttgaaatagaaatctga

SEQ ID NO: 7253256 - DNA, 22 bp, Homo sapiens
gccttgccaaggggcagcagag

SEQ ID NO: 7253257 - DNA, 22 bp, Homo sapiens
gcgcctgccaccatgccaggct

SEQ ID NO: 7253258 - DNA, 22 bp, Homo sapiens
gcgcctggcacacagcaagggc

SEQ ID NO: 7253259 - DNA, 22 bp, Homo sapiens
gcgcgctgagtgtccgttgggg

SEQ ID NO: 7253260 - DNA, 22 bp, Homo sapiens
gcgcctggcacacagcaagggc

SEQ ID NO: 7253261 - DNA, 17 bp, Homo sapiens
gccttctctgccctcac

SEQ ID NO: 7253262 - DNA, 22 bp, Homo sapiens
gccttctctgtgagctcctagg

SEQ ID NO: 7253263 - DNA, 15 bp, Homo sapiens
gccttgaatgtgaat

SEQ ID NO: 7253264 - DNA, 19 bp, Homo sapiens
gccttgaagcaactcttgt

SEQ ID NO: 7253265 - DNA, 22 bp, Homo sapiens
gccttgaactcatgtatattga

SEQ ID NO: 7253266 - DNA, 22 bp, Homo sapiens
gcggcccgggtccccagcagca

SEQ ID NO: 7253267 - DNA, 22 bp, Homo sapiens
gcggcccgagcaggacgggtgg

SEQ ID NO: 7253268 - DNA, 22 bp, Homo sapiens
gcggcaggagtaaaggaggaag

SEQ ID NO: 7253269 - DNA, 22 bp, Homo sapiens
gcgggccggttcgatccgtatg

SEQ ID NO: 7253270 - DNA, 22 bp, Homo sapiens
gcgggcgggggttcccaggtct

SEQ ID NO: 7253271 - DNA, 18 bp, Homo sapiens
gcgggcggtgcagtgggc

SEQ ID NO: 7253272 - DNA, 22 bp, Homo sapiens
gcggagggagataggccttgct

SEQ ID NO: 7253273 - DNA, 22 bp, Homo sapiens
gcggaggaaactgaggcaagag

SEQ ID NO: 7253274 - DNA, 22 bp, Homo sapiens
gcggaggaaactgaggcaagag

SEQ ID NO: 7253275 - DNA, 22 bp, Homo sapiens
gcggaggaaactgaggcaagag

SEQ ID NO: 7253276 - DNA, 22 bp, Homo sapiens
gcggcagaggtgttgcgagcga

SEQ ID NO: 7253277 - DNA, 22 bp, Homo sapiens
gcggaggtgaggaagtggggca

SEQ ID NO: 7253278 - DNA, 22 bp, Homo sapiens
gcggagggcgagcccgcggagc

SEQ ID NO: 7253279 - DNA, 22 bp, Homo sapiens
gcgcggggtacacgcggtggcc

SEQ ID NO: 7253280 - DNA, 22 bp, Homo sapiens
gcgctgcctctgctctccccac

SEQ ID NO: 7253281 - DNA, 22 bp, Homo sapiens
gcgctcctcccggccctggtgg

SEQ ID NO: 7253282 - DNA, 22 bp, Homo sapiens
gcgctctgtctcaggggtccag

SEQ ID NO: 7253283 - DNA, 22 bp, Homo sapiens
gctcaggcccagcggctggtgt

SEQ ID NO: 7253284 - DNA, 22 bp, Homo sapiens
gctcaggcccagcggctggtgt

SEQ ID NO: 7253285 - DNA, 23 bp, Homo sapiens
gctcaggcatcattcttcctggc

SEQ ID NO: 7253286 - DNA, 22 bp, Homo sapiens
gctcacaggtctgtggctattg

SEQ ID NO: 7253287 - DNA, 23 bp, Homo sapiens
gctcacagggtgtaactcctagt

SEQ ID NO: 7253288 - DNA, 22 bp, Homo sapiens
gctcaagatgtggcctctgaag

SEQ ID NO: 7253289 - DNA, 20 bp, Homo sapiens
gctcaagagcccattctgaa

SEQ ID NO: 7253290 - DNA, 22 bp, Homo sapiens
gctcaagactgttagcctggca

SEQ ID NO: 7253291 - DNA, 22 bp, Homo sapiens
gctcaagagccagcgtctcctg

SEQ ID NO: 7253292 - DNA, 22 bp, Homo sapiens
gctcaagccttctgcccacctc

SEQ ID NO: 7253293 - DNA, 22 bp, Homo sapiens
gctatcttcatggaaatacagg

SEQ ID NO: 7253294 - DNA, 22 bp, Homo sapiens
gctatcttcctcaatgtcagct

SEQ ID NO: 7253295 - DNA, 22 bp, Homo sapiens
gctatctttctgcaccataatt

SEQ ID NO: 7253296 - DNA, 22 bp, Homo sapiens
gcgggggcggcgcagacctcag

SEQ ID NO: 7253297 - DNA, 22 bp, Homo sapiens
gcgggggcagactgggcagttc

SEQ ID NO: 7253298 - DNA, 22 bp, Homo sapiens
gcggggcctgactctgacccgc

SEQ ID NO: 7253299 - DNA, 22 bp, Homo sapiens
gcggggcccggacccagcctct

SEQ ID NO: 7253300 - DNA, 22 bp, Homo sapiens
gcggggccatgtccaacggcct

SEQ ID NO: 7253301 - DNA, 22 bp, Homo sapiens
gcggggcccccggccgagctct

SEQ ID NO: 7253302 - DNA, 22 bp, Homo sapiens
gcctcaggcctatagctgctgt

SEQ ID NO: 7253303 - DNA, 22 bp, Homo sapiens
gcctcaggccgccctgctgctc

SEQ ID NO: 7253304 - DNA, 22 bp, Homo sapiens
gcctcagggggagaggccagct

SEQ ID NO: 7253305 - DNA, 22 bp, Homo sapiens
gcctcagggataggatgagcat

SEQ ID NO: 7253306 - DNA, 22 bp, Homo sapiens
gcctggctgccggccttggcaa

SEQ ID NO: 7253307 - DNA, 22 bp, Homo sapiens
gcctggctgctggttctgagga

SEQ ID NO: 7253308 - DNA, 22 bp, Homo sapiens
gcctggctgggctgaatgctta

SEQ ID NO: 7253309 - DNA, 22 bp, Homo sapiens
gcctggctgtctggcaaggttc

SEQ ID NO: 7253310 - DNA, 22 bp, Homo sapiens
gcctggcttcccttggagcatt

SEQ ID NO: 7253311 - DNA, 22 bp, Homo sapiens
gcctggggggcatgtcataata

SEQ ID NO: 7253312 - DNA, 22 bp, Homo sapiens
gcctggggtctctgactcacag

SEQ ID NO: 7253313 - DNA, 22 bp, Homo sapiens
gcctggggtcccttgttggcac

SEQ ID NO: 7253314 - DNA, 22 bp, Homo sapiens
gcctggggaacttgatcctgtc

SEQ ID NO: 7253315 - DNA, 22 bp, Homo sapiens
gcctggggccagcttgggctga

SEQ ID NO: 7253316 - DNA, 22 bp, Homo sapiens
gcctggggcatgcagctgatac

SEQ ID NO: 7253317 - DNA, 23 bp, Homo sapiens
gccagagctgcctgcccttgctg

SEQ ID NO: 7253318 - DNA, 22 bp, Homo sapiens
gccagaggaacgctgcgcgccc

SEQ ID NO: 7253319 - DNA, 22 bp, Homo sapiens
gccagaggaacgctgcgcgccc

SEQ ID NO: 7253320 - DNA, 22 bp, Homo sapiens
gccagcagtcctgctgtgtgcc

SEQ ID NO: 7253321 - DNA, 22 bp, Homo sapiens
gcattttaatgaggtttatgag

SEQ ID NO: 7253322 - DNA, 22 bp, Homo sapiens
gccagagcatgcactgcctgca

SEQ ID NO: 7253323 - DNA, 22 bp, Homo sapiens
gccagagcacaggctggtagta

SEQ ID NO: 7253324 - DNA, 22 bp, Homo sapiens
gccaagggtagtggaggcccct

SEQ ID NO: 7253325 - DNA, 22 bp, Homo sapiens
gcagtatatggattttaaacat

SEQ ID NO: 7253326 - DNA, 22 bp, Homo sapiens
gcagtcagtaaggcagccagaa

SEQ ID NO: 7253327 - DNA, 22 bp, Homo sapiens
gcagggctcattgccaggcatt

SEQ ID NO: 7253328 - DNA, 22 bp, Homo sapiens
gcagggctcattgccaggcatt

SEQ ID NO: 7253329 - DNA, 22 bp, Homo sapiens
gcagggctcagccgctcccacc

SEQ ID NO: 7253330 - DNA, 22 bp, Homo sapiens
gcagtcctgggattctgtcctt

SEQ ID NO: 7253331 - DNA, 19 bp, Homo sapiens
gcagtctgttgaagggcag

SEQ ID NO: 7253332 - DNA, 22 bp, Homo sapiens
gcagtgaaaaagtgcaccctgt

SEQ ID NO: 7253333 - DNA, 22 bp, Homo sapiens
gcagtgaaaaagtgcaccctgt

SEQ ID NO: 7253334 - DNA, 22 bp, Homo sapiens
gcagtgaaacaataggatcaaa

SEQ ID NO: 7253335 - DNA, 22 bp, Homo sapiens
gcagtgaacataacacagaagg

SEQ ID NO: 7253336 - DNA, 22 bp, Homo sapiens
gcagtgaacataacacagaagg

SEQ ID NO: 7253337 - DNA, 18 bp, Homo sapiens
gcagtgaagaaagagctt

SEQ ID NO: 7253338 - DNA, 18 bp, Homo sapiens
gcagtgaagaaagagctt

SEQ ID NO: 7253339 - DNA, 22 bp, Homo sapiens
gcagtgaagccagatctgaaat

SEQ ID NO: 7253340 - DNA, 22 bp, Homo sapiens
gcatccagtcttggctcctgga

SEQ ID NO: 7253341 - DNA, 17 bp, Homo sapiens
gcatccagtaacatgcc

SEQ ID NO: 7253342 - DNA, 22 bp, Homo sapiens
gcatccaggctgcccctctgcg

SEQ ID NO: 7253343 - DNA, 22 bp, Homo sapiens
gcatccaggactatatgatgat

SEQ ID NO: 7253344 - DNA, 22 bp, Homo sapiens
gcatccagaggtagccactgtg

SEQ ID NO: 7253345 - DNA, 20 bp, Homo sapiens
gcatccagacacccagctgc

SEQ ID NO: 7253346 - DNA, 23 bp, Homo sapiens
gcatccagagctcagtccccttt

SEQ ID NO: 7253347 - DNA, 22 bp, Homo sapiens
gcatccagaggtagccactgtg

SEQ ID NO: 7253348 - DNA, 22 bp, Homo sapiens
gcatttgaaatcctctgtgacg

SEQ ID NO: 7253349 - DNA, 22 bp, Homo sapiens
gcatgaggggggttaggaagtt

SEQ ID NO: 7253350 - DNA, 22 bp, Homo sapiens
gccagtggcatgcggcagggac

SEQ ID NO: 7253351 - DNA, 22 bp, Homo sapiens
gccagtggccctctggagaagg

SEQ ID NO: 7253352 - DNA, 22 bp, Homo sapiens
gccagtggcttgccaggcagga

SEQ ID NO: 7253353 - DNA, 22 bp, Homo sapiens
gcccacagtacgaggctcaggc

SEQ ID NO: 7253354 - DNA, 22 bp, Homo sapiens
gcccacagtacgaggctcaggc

SEQ ID NO: 7253355 - DNA, 22 bp, Homo sapiens
gccagtctgctcccacaagttc

SEQ ID NO: 7253356 - DNA, 22 bp, Homo sapiens
gcccactgagtgactccctcag

SEQ ID NO: 7253357 - DNA, 22 bp, Homo sapiens
gcccactctggagcctgttccc

SEQ ID NO: 7253358 - DNA, 22 bp, Homo sapiens
gcccactctggagcctgttccc

SEQ ID NO: 7253359 - DNA, 19 bp, Homo sapiens
gcccactgtctttgccaac

SEQ ID NO: 7253360 - DNA, 22 bp, Homo sapiens
gcccactggctggagtgctggt

SEQ ID NO: 7253361 - DNA, 18 bp, Homo sapiens
gcccagaggtctgggccc

SEQ ID NO: 7253362 - DNA, 22 bp, Homo sapiens
gccaggtgggagacagacagca

SEQ ID NO: 7253363 - DNA, 22 bp, Homo sapiens
gccaggtgtagtggccacacct

SEQ ID NO: 7253364 - DNA, 22 bp, Homo sapiens
gccaggtgtcctcacagtgagg

SEQ ID NO: 7253365 - DNA, 22 bp, Homo sapiens
gccaggacctcagatgcagggc

SEQ ID NO: 7253366 - DNA, 22 bp, Homo sapiens
gccaggagagctccttcaggtt

SEQ ID NO: 7253367 - DNA, 22 bp, Homo sapiens
gccaggagagctccttcaggtt

SEQ ID NO: 7253368 - DNA, 22 bp, Homo sapiens
gccaggagtgtgtggctatgtt

SEQ ID NO: 7253369 - DNA, 22 bp, Homo sapiens
gccaggagccctgggcaagttc

SEQ ID NO: 7253370 - DNA, 22 bp, Homo sapiens
gccctctggggcacacagagga

SEQ ID NO: 7253371 - DNA, 18 bp, Homo sapiens
gccctctggctgctgatg

SEQ ID NO: 7253372 - DNA, 22 bp, Homo sapiens
gccctctggcagccttggctgg

SEQ ID NO: 7253373 - DNA, 22 bp, Homo sapiens
gccctctggtgggtgagccccg

SEQ ID NO: 7253374 - DNA, 22 bp, Homo sapiens
gccctctggtggccgcctcggc

SEQ ID NO: 7253375 - DNA, 22 bp, Homo sapiens
gccctctgttattgcatcctta

SEQ ID NO: 7253376 - DNA, 22 bp, Homo sapiens
gccctctgtgtaacaatccaga

SEQ ID NO: 7253377 - DNA, 22 bp, Homo sapiens
gcccatgcccctccttctggca

SEQ ID NO: 7253378 - DNA, 22 bp, Homo sapiens
gcccatgcccctccttctggca

SEQ ID NO: 7253379 - DNA, 23 bp, Homo sapiens
gcccatgctgttgggcccgagca

SEQ ID NO: 7253380 - DNA, 22 bp, Homo sapiens
gcccagggcttcaaagagagaa

SEQ ID NO: 7253381 - DNA, 22 bp, Homo sapiens
gcccaggggagtagtcaattta

SEQ ID NO: 7253382 - DNA, 22 bp, Homo sapiens
gcccaggggcagcgcatagtgg

SEQ ID NO: 7253383 - DNA, 22 bp, Homo sapiens
gcccaggctggagtgcagtggt

SEQ ID NO: 7253384 - DNA, 22 bp, Homo sapiens
gcccagcaaggaccaagggccg

SEQ ID NO: 7253385 - DNA, 22 bp, Homo sapiens
gcccagcaactgcacccttctt

SEQ ID NO: 7253386 - DNA, 23 bp, Homo sapiens
gcccagggactgggaatcagtgg

SEQ ID NO: 7253387 - DNA, 22 bp, Homo sapiens
gcccagggcgatggtcggggcc

SEQ ID NO: 7253388 - DNA, 22 bp, Homo sapiens
gcccagggctgcaagtggacgc

SEQ ID NO: 7253389 - DNA, 22 bp, Homo sapiens
gcccagggctgcaagtggacgc

SEQ ID NO: 7253390 - DNA, 22 bp, Homo sapiens
gcccagggcgatggtcggggcc

SEQ ID NO: 7253391 - DNA, 22 bp, Homo sapiens
gccctgaccttcactgactctc

SEQ ID NO: 7253392 - DNA, 22 bp, Homo sapiens
gccctgacactttgcagctgag

SEQ ID NO: 7253393 - DNA, 22 bp, Homo sapiens
gccctctgttttgtaagcaacg

SEQ ID NO: 7253394 - DNA, 22 bp, Homo sapiens
gcctcagctcccagcccaggct

SEQ ID NO: 7253395 - DNA, 22 bp, Homo sapiens
gcctcagccggcggacgccagg

SEQ ID NO: 7253396 - DNA, 22 bp, Homo sapiens
gcctcagccggcggacgccagg

SEQ ID NO: 7253397 - DNA, 20 bp, Homo sapiens
gcctcagccaacccatgggg

SEQ ID NO: 7253398 - DNA, 22 bp, Homo sapiens
gcctcagagggccctagggaca

SEQ ID NO: 7253399 - DNA, 22 bp, Homo sapiens
gcctcagagggccctagggaca

SEQ ID NO: 7253400 - DNA, 22 bp, Homo sapiens
gcctcagctgttgcaggggccc

SEQ ID NO: 7253401 - DNA, 22 bp, Homo sapiens
gcctcagctcccagcccaggct

SEQ ID NO: 7253402 - DNA, 22 bp, Homo sapiens
gcctcaggactggcatactcat

SEQ ID NO: 7253403 - DNA, 22 bp, Homo sapiens
gcctcagctgttgcaggggccc

SEQ ID NO: 7253404 - DNA, 22 bp, Homo sapiens
gcctcagacactgcctgggtgt

SEQ ID NO: 7253405 - DNA, 23 bp, Homo sapiens
gcctcagagaaacagctgcacac

SEQ ID NO: 7253406 - DNA, 22 bp, Homo sapiens
gcctcagagctacacacacgca

SEQ ID NO: 7253407 - DNA, 22 bp, Homo sapiens
gcctcagagggcagggtggtga

SEQ ID NO: 7253408 - DNA, 22 bp, Homo sapiens
gcctaggagacaagcgtgaaag

SEQ ID NO: 7253409 - DNA, 20 bp, Homo sapiens
gcctagagatggaaggcgca

SEQ ID NO: 7253410 - DNA, 22 bp, Homo sapiens
gcaggagctttgcttactgctg

SEQ ID NO: 7253411 - DNA, 22 bp, Homo sapiens
gcaggagctggaaagtgatgtt

SEQ ID NO: 7253412 - DNA, 22 bp, Homo sapiens
gcaggagctggaaagtgatgtt

SEQ ID NO: 7253413 - DNA, 22 bp, Homo sapiens
gcaggaggttgagccaggactg

SEQ ID NO: 7253414 - DNA, 22 bp, Homo sapiens
gcaggaggttgagccaggactg

SEQ ID NO: 7253415 - DNA, 22 bp, Homo sapiens
gcagggcgcgtttgagcgggct

SEQ ID NO: 7253416 - DNA, 22 bp, Homo sapiens
gcagggcggcccagagcaggcc

SEQ ID NO: 7253417 - DNA, 22 bp, Homo sapiens
gcagggctaatggggcaagtag

SEQ ID NO: 7253418 - DNA, 22 bp, Homo sapiens
gcagggccttagcagcggctgc

SEQ ID NO: 7253419 - DNA, 20 bp, Homo sapiens
gcagggcgacacgggggagg

SEQ ID NO: 7253420 - DNA, 22 bp, Homo sapiens
gcaggctgatgactggagttgg

SEQ ID NO: 7253421 - DNA, 22 bp, Homo sapiens
gcaggctgaaactcggggtcta

SEQ ID NO: 7253422 - DNA, 22 bp, Homo sapiens
gcagcatccccaggcagcaggg

SEQ ID NO: 7253423 - DNA, 22 bp, Homo sapiens
gcagcagtggcagttaatattt

SEQ ID NO: 7253424 - DNA, 22 bp, Homo sapiens
gcagcagtaggaaataacacag

SEQ ID NO: 7253425 - DNA, 22 bp, Homo sapiens
gcagcagtggtctgtagaagga

SEQ ID NO: 7253426 - DNA, 21 bp, Homo sapiens
gcagcagtgttctagaatact

SEQ ID NO: 7253427 - DNA, 22 bp, Homo sapiens
gcagccacagaggagggatgca

SEQ ID NO: 7253428 - DNA, 23 bp, Homo sapiens
gcagaggagcaagctggacacca

SEQ ID NO: 7253429 - DNA, 22 bp, Homo sapiens
gcagaggaggacccaggaatta

SEQ ID NO: 7253430 - DNA, 22 bp, Homo sapiens
gcagaggagcaagttgctacag

SEQ ID NO: 7253431 - DNA, 22 bp, Homo sapiens
gcagcagccgacatggattgca

SEQ ID NO: 7253432 - DNA, 22 bp, Homo sapiens
gcagcagctgacagtgggtgcc

SEQ ID NO: 7253433 - DNA, 22 bp, Homo sapiens
gcagcagctcagttctgggagg

SEQ ID NO: 7253434 - DNA, 22 bp, Homo sapiens
gcagcaggagagtttgtcctgc

SEQ ID NO: 7253435 - DNA, 22 bp, Homo sapiens
gcagcaggtctgtcaatgtcat

SEQ ID NO: 7253436 - DNA, 22 bp, Homo sapiens
gcagaggagcaagctggacacc

SEQ ID NO: 7253437 - DNA, 22 bp, Homo sapiens
gcagaggagatgaagatacttt

SEQ ID NO: 7253438 - DNA, 22 bp, Homo sapiens
gcagaggagatgaagatacttt

SEQ ID NO: 7253439 - DNA, 22 bp, Homo sapiens
gcagaggacacaggagggcaag

SEQ ID NO: 7253440 - DNA, 22 bp, Homo sapiens
gcagaggacacaggagggcaag

SEQ ID NO: 7253441 - DNA, 22 bp, Homo sapiens
gcagaggacagggatttagatt

SEQ ID NO: 7253442 - DNA, 22 bp, Homo sapiens
gcagaggactcaatcaaggtat

SEQ ID NO: 7253443 - DNA, 21 bp, Homo sapiens
gcagaggaatggtatacataa

SEQ ID NO: 7253444 - DNA, 22 bp, Homo sapiens
gcagaggacacaggagggcaag

SEQ ID NO: 7253445 - DNA, 22 bp, Homo sapiens
gcagagctgcagcgaggcctgg

SEQ ID NO: 7253446 - DNA, 21 bp, Homo sapiens
gcacttggaaacttcaactag

SEQ ID NO: 7253447 - DNA, 17 bp, Homo sapiens
gcactcccccacctcct

SEQ ID NO: 7253448 - DNA, 22 bp, Homo sapiens
gcacctgggacccagaggcacc

SEQ ID NO: 7253449 - DNA, 22 bp, Homo sapiens
gcacctgggcaaggattcagag

SEQ ID NO: 7253450 - DNA, 22 bp, Homo sapiens
gcacctggggtacacagctaca

SEQ ID NO: 7253451 - DNA, 18 bp, Homo sapiens
gcactgaggaaaacctct

SEQ ID NO: 7253452 - DNA, 22 bp, Homo sapiens
gcactgagatacatttctaagg

SEQ ID NO: 7253453 - DNA, 22 bp, Homo sapiens
gcactgagaactgttttctaga

SEQ ID NO: 7253454 - DNA, 22 bp, Homo sapiens
gcactgagagctttattctaga

SEQ ID NO: 7253455 - DNA, 23 bp, Homo sapiens
gcactgccatgtgctctgcaggc

SEQ ID NO: 7253456 - DNA, 22 bp, Homo sapiens
gcacagccttgccctgtgccct

SEQ ID NO: 7253457 - DNA, 22 bp, Homo sapiens
gcacagcctgtccctgtcctgg

SEQ ID NO: 7253458 - DNA, 22 bp, Homo sapiens
gcacagccctgagcgcatgtct

SEQ ID NO: 7253459 - DNA, 22 bp, Homo sapiens
gcacagccagcatctgagggat

SEQ ID NO: 7253460 - DNA, 22 bp, Homo sapiens
gcacaggcacagagggccactg

SEQ ID NO: 7253461 - DNA, 19 bp, Homo sapiens
gcaaatctgaccaaatagt

SEQ ID NO: 7253462 - DNA, 22 bp, Homo sapiens
gagggtcccgagccctgtcaga

SEQ ID NO: 7253463 - DNA, 22 bp, Homo sapiens
gcaagacctatctagttgctgt

SEQ ID NO: 7253464 - DNA, 22 bp, Homo sapiens
gaggggtcacatgggctggctt

SEQ ID NO: 7253465 - DNA, 22 bp, Homo sapiens
gaggggtcctgccttggctgga

SEQ ID NO: 7253466 - DNA, 22 bp, Homo sapiens
gagggggagatgtgcacacact

SEQ ID NO: 7253467 - DNA, 22 bp, Homo sapiens
gaggggtgtggagccatcagtt

SEQ ID NO: 7253468 - DNA, 22 bp, Homo sapiens
gaggggtgtggagccatcagtt

SEQ ID NO: 7253469 - DNA, 22 bp, Homo sapiens
gaggggtgtggagccatcagtt

SEQ ID NO: 7253470 - DNA, 22 bp, Homo sapiens
gaggggtgggctggaagttata

SEQ ID NO: 7253471 - DNA, 22 bp, Homo sapiens
gaggggctgggtagggcaaccc

SEQ ID NO: 7253472 - DNA, 22 bp, Homo sapiens
gaggggctggggttgactccaa

SEQ ID NO: 7253473 - DNA, 22 bp, Homo sapiens
gaggggctggggttgactccaa

SEQ ID NO: 7253474 - DNA, 22 bp, Homo sapiens
gaggggctgggtagggcaaccc

SEQ ID NO: 7253475 - DNA, 22 bp, Homo sapiens
gagggggaaagtccctggagtc

SEQ ID NO: 7253476 - DNA, 22 bp, Homo sapiens
gagggggagatgtgcacacact

SEQ ID NO: 7253477 - DNA, 22 bp, Homo sapiens
gacagacaggagctcacaggca

SEQ ID NO: 7253478 - DNA, 22 bp, Homo sapiens
gacagaattttccatcatgtgg

SEQ ID NO: 7253479 - DNA, 22 bp, Homo sapiens
gacagaattttccatcatgtgg

SEQ ID NO: 7253480 - DNA, 22 bp, Homo sapiens
gaatcatttcttctgaaaggta

SEQ ID NO: 7253481 - DNA, 22 bp, Homo sapiens
gaatcatttatttttgacagca

SEQ ID NO: 7253482 - DNA, 22 bp, Homo sapiens
gaatcatttagctctgcatgga

SEQ ID NO: 7253483 - DNA, 22 bp, Homo sapiens
gaatcattggaaccacatccaa

SEQ ID NO: 7253484 - DNA, 22 bp, Homo sapiens
gaatcattcattgctcaattaa

SEQ ID NO: 7253485 - DNA, 22 bp, Homo sapiens
gaaggttatgggggttggatta

SEQ ID NO: 7253486 - DNA, 22 bp, Homo sapiens
gaaggtgtctggcccagagtct

SEQ ID NO: 7253487 - DNA, 22 bp, Homo sapiens
gaagggggttgcagtctagggt

SEQ ID NO: 7253488 - DNA, 22 bp, Homo sapiens
gaagggggagctcttcctaatt

SEQ ID NO: 7253489 - DNA, 22 bp, Homo sapiens
gaagggggaaaatgacaacaga

SEQ ID NO: 7253490 - DNA, 22 bp, Homo sapiens
gaagggtgcatggagggaagtc

SEQ ID NO: 7253491 - DNA, 22 bp, Homo sapiens
gaagggtgtgtgtgagggacac

SEQ ID NO: 7253492 - DNA, 22 bp, Homo sapiens
gaagggtgtgtgtgagggacac

SEQ ID NO: 7253493 - DNA, 22 bp, Homo sapiens
gaagggtgtgatttgcctgaga

SEQ ID NO: 7253494 - DNA, 22 bp, Homo sapiens
gaagggtgtgtgtgagggacac

SEQ ID NO: 7253495 - DNA, 22 bp, Homo sapiens
gaaggggactggcagctgcaga

SEQ ID NO: 7253496 - DNA, 18 bp, Homo sapiens
gaagggagctggaatgca

SEQ ID NO: 7253497 - DNA, 22 bp, Homo sapiens
gaagggcttggctgggaggcca

SEQ ID NO: 7253498 - DNA, 22 bp, Homo sapiens
gaagggctttctgggagaagag

SEQ ID NO: 7253499 - DNA, 22 bp, Homo sapiens
gaaggagctaaagggagccctg

SEQ ID NO: 7253500 - DNA, 20 bp, Homo sapiens
gaagccagaggggaaaggag

SEQ ID NO: 7253501 - DNA, 20 bp, Homo sapiens
gaagccagaggggaaaggag

SEQ ID NO: 7253502 - DNA, 22 bp, Homo sapiens
gaagccacaactttttcttagc

SEQ ID NO: 7253503 - DNA, 23 bp, Homo sapiens
gaagccacacaaaggtcgccaag

SEQ ID NO: 7253504 - DNA, 23 bp, Homo sapiens
gaagccacacaaaggtcgccaag

SEQ ID NO: 7253505 - DNA, 22 bp, Homo sapiens
gaagccacagagattgtggggg

SEQ ID NO: 7253506 - DNA, 22 bp, Homo sapiens
gaagccaccctccttccagccc

SEQ ID NO: 7253507 - DNA, 22 bp, Homo sapiens
gaagccactatagatattctaa

SEQ ID NO: 7253508 - DNA, 22 bp, Homo sapiens
gaaggcactgaactccttctgg

SEQ ID NO: 7253509 - DNA, 22 bp, Homo sapiens
gaaggcagggaatgtggtgcta

SEQ ID NO: 7253510 - DNA, 18 bp, Homo sapiens
gaagggagctggaatgca

SEQ ID NO: 7253511 - DNA, 18 bp, Homo sapiens
gaagggagctggaatgca

SEQ ID NO: 7253512 - DNA, 22 bp, Homo sapiens
gaagggagaaggttgggtgacg

SEQ ID NO: 7253513 - DNA, 22 bp, Homo sapiens
gaagggagaaggttgggtgacg

SEQ ID NO: 7253514 - DNA, 22 bp, Homo sapiens
gaaggccatttttaggtagaat

SEQ ID NO: 7253515 - DNA, 22 bp, Homo sapiens
gaaaggagtgctttccaggtct

SEQ ID NO: 7253516 - DNA, 22 bp, Homo sapiens
gaaaggagtgaatatttgtgac

SEQ ID NO: 7253517 - DNA, 22 bp, Homo sapiens
gaaaggagtcagtcttactgaa

SEQ ID NO: 7253518 - DNA, 22 bp, Homo sapiens
gaaaggagagggttaaggagct

SEQ ID NO: 7253519 - DNA, 22 bp, Homo sapiens
gaaaggaacttgtgagtgggag

SEQ ID NO: 7253520 - DNA, 22 bp, Homo sapiens
gaaaggaacttgtgagtgggag

SEQ ID NO: 7253521 - DNA, 22 bp, Homo sapiens
gaaaggaaattgagggacgcat

SEQ ID NO: 7253522 - DNA, 22 bp, Homo sapiens
gaaagctctgcttcagcctgca

SEQ ID NO: 7253523 - DNA, 22 bp, Homo sapiens
gacagagaggctgagcagtaca

SEQ ID NO: 7253524 - DNA, 22 bp, Homo sapiens
gacagagattgaatcaggaaat

SEQ ID NO: 7253525 - DNA, 22 bp, Homo sapiens
gacagaggcaagaccagaagcc

SEQ ID NO: 7253526 - DNA, 22 bp, Homo sapiens
gacattgagtatttcttttctc

SEQ ID NO: 7253527 - DNA, 22 bp, Homo sapiens
gacattgacagtcctccttata

SEQ ID NO: 7253528 - DNA, 22 bp, Homo sapiens
gactgaggtattaagatggctt

SEQ ID NO: 7253529 - DNA, 22 bp, Homo sapiens
gactgaggtattaagatggctt

SEQ ID NO: 7253530 - DNA, 17 bp, Homo sapiens
gactgaggtaaggtgag

SEQ ID NO: 7253531 - DNA, 22 bp, Homo sapiens
gactgaggctcccctaggctca

SEQ ID NO: 7253532 - DNA, 22 bp, Homo sapiens
gactgagggacagggcagtgga

SEQ ID NO: 7253533 - DNA, 22 bp, Homo sapiens
gactcctctctaacccactgga

SEQ ID NO: 7253534 - DNA, 22 bp, Homo sapiens
gactcctcccgctcccatgccg

SEQ ID NO: 7253535 - DNA, 22 bp, Homo sapiens
gactcccaagcttggaggaagg

SEQ ID NO: 7253536 - DNA, 22 bp, Homo sapiens
gagaaagcttcagaaatggcct

SEQ ID NO: 7253537 - DNA, 22 bp, Homo sapiens
gagaaagctaataggaatccta

SEQ ID NO: 7253538 - DNA, 22 bp, Homo sapiens
gagaaagctaaataagttgatt

SEQ ID NO: 7253539 - DNA, 23 bp, Homo sapiens
gagaaagccggctatgatcctgg

SEQ ID NO: 7253540 - DNA, 18 bp, Homo sapiens
gagaaagcagggaatgtt

SEQ ID NO: 7253541 - DNA, 19 bp, Homo sapiens
gagaaagcaggcacagcac

SEQ ID NO: 7253542 - DNA, 22 bp, Homo sapiens
gagaaagatgtaggctgggagg

SEQ ID NO: 7253543 - DNA, 22 bp, Homo sapiens
gagaaaggcattcctatgcaaa

SEQ ID NO: 7253544 - DNA, 22 bp, Homo sapiens
gagaaagcttctttcccacagg

SEQ ID NO: 7253545 - DNA, 22 bp, Homo sapiens
gagaaacaacacttgatgcctt

SEQ ID NO: 7253546 - DNA, 22 bp, Homo sapiens
gagaaagacgtaggctgggagg

SEQ ID NO: 7253547 - DNA, 21 bp, Homo sapiens
gagagggcattataggaagtg

SEQ ID NO: 7253548 - DNA, 22 bp, Homo sapiens
gagagggccagggtgagaacta

SEQ ID NO: 7253549 - DNA, 22 bp, Homo sapiens
gagagggctctgtgtgggtact

SEQ ID NO: 7253550 - DNA, 22 bp, Homo sapiens
gagagggccgggggccagctcc

SEQ ID NO: 7253551 - DNA, 22 bp, Homo sapiens
gagagggctgcctggtgtgagg

SEQ ID NO: 7253552 - DNA, 22 bp, Homo sapiens
gagagaaatgtgcagtttgggc

SEQ ID NO: 7253553 - DNA, 18 bp, Homo sapiens
gagagggatccctcagga

SEQ ID NO: 7253554 - DNA, 22 bp, Homo sapiens
gagagaaagcccctgcatccct

SEQ ID NO: 7253555 - DNA, 22 bp, Homo sapiens
gagagaaaacaagttctccatt

SEQ ID NO: 7253556 - DNA, 22 bp, Homo sapiens
gagagaaaaatgagcttcattg

SEQ ID NO: 7253557 - DNA, 22 bp, Homo sapiens
gagacctcttggtatcgctagg

SEQ ID NO: 7253558 - DNA, 22 bp, Homo sapiens
gagacccaggggtctgctgccc

SEQ ID NO: 7253559 - DNA, 22 bp, Homo sapiens
gaggctgaggttgcagtgagcc

SEQ ID NO: 7253560 - DNA, 22 bp, Homo sapiens
gaggctgaggttgcagtgagct

SEQ ID NO: 7253561 - DNA, 22 bp, Homo sapiens
gaggctgcccaactggagtgga

SEQ ID NO: 7253562 - DNA, 22 bp, Homo sapiens
gaggctgccaatgtgtgcatgt

SEQ ID NO: 7253563 - DNA, 22 bp, Homo sapiens
gaggctgcattcttcccactgc

SEQ ID NO: 7253564 - DNA, 22 bp, Homo sapiens
gaggctgcattcttcccactgc

SEQ ID NO: 7253565 - DNA, 22 bp, Homo sapiens
gaggctgcagctatcagacatt

SEQ ID NO: 7253566 - DNA, 22 bp, Homo sapiens
gaggctgcaggcaatgctgccc

SEQ ID NO: 7253567 - DNA, 22 bp, Homo sapiens
gaggctgcaggcaatgctgccc

SEQ ID NO: 7253568 - DNA, 22 bp, Homo sapiens
gagggaggcatcatgaatccag

SEQ ID NO: 7253569 - DNA, 22 bp, Homo sapiens
gagggagctggagcagacgccg

SEQ ID NO: 7253570 - DNA, 22 bp, Homo sapiens
gagggagagtgatggaccattg

SEQ ID NO: 7253571 - DNA, 22 bp, Homo sapiens
gagggagggccaggtcccaacc

SEQ ID NO: 7253572 - DNA, 22 bp, Homo sapiens
gagggagggccaggtcccaacc

SEQ ID NO: 7253573 - DNA, 22 bp, Homo sapiens
gagggagggactagcattctct

SEQ ID NO: 7253574 - DNA, 22 bp, Homo sapiens
gagggagggactagcattctct

SEQ ID NO: 7253575 - DNA, 22 bp, Homo sapiens
gagggagggaaagtttaacact

SEQ ID NO: 7253576 - DNA, 22 bp, Homo sapiens
gagggctgctggaaaaatgcag

SEQ ID NO: 7253577 - DNA, 22 bp, Homo sapiens
gagggctgctgccagatatgcc

SEQ ID NO: 7253578 - DNA, 22 bp, Homo sapiens
gagggctgccacgttgggcgag

SEQ ID NO: 7253579 - DNA, 22 bp, Homo sapiens
gagggctgcaatgagacagaga

SEQ ID NO: 7253580 - DNA, 22 bp, Homo sapiens
gagggctgcaatgagacagaga

SEQ ID NO: 7253581 - DNA, 22 bp, Homo sapiens
gagggctgatgttgccacctca

SEQ ID NO: 7253582 - DNA, 22 bp, Homo sapiens
gagggctgcaatgagacagaga

SEQ ID NO: 7253583 - DNA, 22 bp, Homo sapiens
gagggctgatgttgccacctca

SEQ ID NO: 7253584 - DNA, 18 bp, Homo sapiens
gagggagtagctgaggtt

SEQ ID NO: 7253585 - DNA, 22 bp, Homo sapiens
gagggagtgccagagggccagc

SEQ ID NO: 7253586 - DNA, 22 bp, Homo sapiens
gagggagtgctttctgatagtt

SEQ ID NO: 7253587 - DNA, 22 bp, Homo sapiens
gagggagtgccagagggccagc

SEQ ID NO: 7253588 - DNA, 22 bp, Homo sapiens
gagggaggggagctccaccctc

SEQ ID NO: 7253589 - DNA, 22 bp, Homo sapiens
gagggaggtgatactgaacgta

SEQ ID NO: 7253590 - DNA, 18 bp, Homo sapiens
gagggagtagctgaggtt

SEQ ID NO: 7253591 - DNA, 22 bp, Homo sapiens
gagggctgtgaaggagcgggtt

SEQ ID NO: 7253592 - DNA, 22 bp, Homo sapiens
gagggctgtggggcatgaccag

SEQ ID NO: 7253593 - DNA, 22 bp, Homo sapiens
gagggctgtggggcatgaccag

SEQ ID NO: 7253594 - DNA, 22 bp, Homo sapiens
gagggctgtgaaggagcgggtt

SEQ ID NO: 7253595 - DNA, 22 bp, Homo sapiens
gaggggctggcacgatggctgc

SEQ ID NO: 7253596 - DNA, 22 bp, Homo sapiens
gaggggctgccctggtgtcagg

SEQ ID NO: 7253597 - DNA, 22 bp, Homo sapiens
gaggggaaagtgtgaggctgcg

SEQ ID NO: 7253598 - DNA, 22 bp, Homo sapiens
gaggggctctttaatagtaaca

SEQ ID NO: 7253599 - DNA, 22 bp, Homo sapiens
gaggggctggctgtggtcccat

SEQ ID NO: 7253600 - DNA, 22 bp, Homo sapiens
gaggggctggcacgatggctgc

SEQ ID NO: 7253601 - DNA, 22 bp, Homo sapiens
gaggggctggcacgatggctgc

SEQ ID NO: 7253602 - DNA, 22 bp, Homo sapiens
gaggcagcttggggctgtgggt

SEQ ID NO: 7253603 - DNA, 22 bp, Homo sapiens
gaggagagatggtagattgggt

SEQ ID NO: 7253604 - DNA, 22 bp, Homo sapiens
gaggagagggctgcgggcccac

SEQ ID NO: 7253605 - DNA, 22 bp, Homo sapiens
gaggagaggggctcccaagagc

SEQ ID NO: 7253606 - DNA, 22 bp, Homo sapiens
gaggagcacatgaggctgaggg

SEQ ID NO: 7253607 - DNA, 22 bp, Homo sapiens
gaggagcacatgaggctgaggg

SEQ ID NO: 7253608 - DNA, 22 bp, Homo sapiens
gaggagcacatgaggctgaggg

SEQ ID NO: 7253609 - DNA, 22 bp, Homo sapiens
gaggagcatgggaaggctctgg

SEQ ID NO: 7253610 - DNA, 22 bp, Homo sapiens
gaggctgaatggccagaagcca

SEQ ID NO: 7253611 - DNA, 22 bp, Homo sapiens
gaggcataagtagaagagattg

SEQ ID NO: 7253612 - DNA, 22 bp, Homo sapiens
gaggcagtgtcggtggcaggat

SEQ ID NO: 7253613 - DNA, 22 bp, Homo sapiens
gagctgcctgtgtgccatgatg

SEQ ID NO: 7253614 - DNA, 22 bp, Homo sapiens
gaggaaagctggtttaaagtat

SEQ ID NO: 7253615 - DNA, 22 bp, Homo sapiens
gaggaagaaagcataggtgggg

SEQ ID NO: 7253616 - DNA, 18 bp, Homo sapiens
gagccctgagtctgcaca

SEQ ID NO: 7253617 - DNA, 22 bp, Homo sapiens
gagccctgcggagccccgaggc

SEQ ID NO: 7253618 - DNA, 22 bp, Homo sapiens
gagccctgctgggccttgtctc

SEQ ID NO: 7253619 - DNA, 22 bp, Homo sapiens
gagctgaggctgaggcctcact

SEQ ID NO: 7253620 - DNA, 22 bp, Homo sapiens
gagctgcctacattgccaagag

SEQ ID NO: 7253621 - DNA, 22 bp, Homo sapiens
gagctgagggtctaggagggtt

SEQ ID NO: 7253622 - DNA, 22 bp, Homo sapiens
gagccctgaacaacagcaggaa

SEQ ID NO: 7253623 - DNA, 22 bp, Homo sapiens
gagcccaggaagtggaggctga

SEQ ID NO: 7253624 - DNA, 22 bp, Homo sapiens
gagcaggcttgcagagaagggg

SEQ ID NO: 7253625 - DNA, 22 bp, Homo sapiens
gagcagggagacaactctggtg

SEQ ID NO: 7253626 - DNA, 22 bp, Homo sapiens
gagagggtgcctggaagccagg

SEQ ID NO: 7253627 - DNA, 22 bp, Homo sapiens
gagcaggctctgcctgtgtgtc

SEQ ID NO: 7253628 - DNA, 22 bp, Homo sapiens
gagaggggcgcgcagctcgcga

SEQ ID NO: 7253629 - DNA, 22 bp, Homo sapiens
gagaggggcccaagccacatag

SEQ ID NO: 7253630 - DNA, 22 bp, Homo sapiens
gagaggggacctgtgtgtctag

SEQ ID NO: 7253631 - DNA, 22 bp, Homo sapiens
gagagggctgcctggtgtgagg

SEQ ID NO: 7253632 - DNA, 22 bp, Homo sapiens
gagagggctggaaacttcctgg

SEQ ID NO: 7253633 - DNA, 22 bp, Homo sapiens
gagcatccagaggtgttttctc

SEQ ID NO: 7253634 - DNA, 22 bp, Homo sapiens
ctggtgcacattcgctctcata

SEQ ID NO: 7253635 - DNA, 22 bp, Homo sapiens
ctggtgcacgtggctgcagtcg

SEQ ID NO: 7253636 - DNA, 22 bp, Homo sapiens
ctggtgcacattcgctctcata

SEQ ID NO: 7253637 - DNA, 22 bp, Homo sapiens
ctggtgcactacagcctggaac

SEQ ID NO: 7253638 - DNA, 22 bp, Homo sapiens
ctggtgcaggaaggagctggca

SEQ ID NO: 7253639 - DNA, 22 bp, Homo sapiens
ctggtgcaggaaggagctggca

SEQ ID NO: 7253640 - DNA, 22 bp, Homo sapiens
ctggtgcatgtggccttgctct

SEQ ID NO: 7253641 - DNA, 22 bp, Homo sapiens
ctggtgcaaaagtaattgtggt

SEQ ID NO: 7253642 - DNA, 22 bp, Homo sapiens
ctggtgcaagattccctgcttc

SEQ ID NO: 7253643 - DNA, 22 bp, Homo sapiens
ctggtgcaaggctttggaatcc

SEQ ID NO: 7253644 - DNA, 22 bp, Homo sapiens
ctggtgcacatgaaagagaagg

SEQ ID NO: 7253645 - DNA, 22 bp, Homo sapiens
ctggtgcaaggctttggaatcc

SEQ ID NO: 7253646 - DNA, 22 bp, Homo sapiens
ctggtgccattctgtggcctag

SEQ ID NO: 7253647 - DNA, 22 bp, Homo sapiens
ctggtgccctgtgtggcaggag

SEQ ID NO: 7253648 - DNA, 22 bp, Homo sapiens
ctgtacagaagctagagcaaat

SEQ ID NO: 7253649 - DNA, 22 bp, Homo sapiens
ctggtctgggatgagggatgta

SEQ ID NO: 7253650 - DNA, 22 bp, Homo sapiens
ctggtgaagcccctcatgctgg

SEQ ID NO: 7253651 - DNA, 22 bp, Homo sapiens
ctggtctgcgggaaggcgtggg

SEQ ID NO: 7253652 - DNA, 22 bp, Homo sapiens
ctggtctgaaaaggaggcatgc

SEQ ID NO: 7253653 - DNA, 22 bp, Homo sapiens
ctggggagaagcgactcggctg

SEQ ID NO: 7253654 - DNA, 22 bp, Homo sapiens
ctggggaaggcggtgactgcgc

SEQ ID NO: 7253655 - DNA, 19 bp, Homo sapiens
ctgggcttgatgttgagtt

SEQ ID NO: 7253656 - DNA, 22 bp, Homo sapiens
ctgtctgccaataatctatggc

SEQ ID NO: 7253657 - DNA, 22 bp, Homo sapiens
ctgtcacctgttcactgcagca

SEQ ID NO: 7253658 - DNA, 22 bp, Homo sapiens
ctgtcaccatttgagccctgga

SEQ ID NO: 7253659 - DNA, 22 bp, Homo sapiens
ctgtcacccacccagcctgtca

SEQ ID NO: 7253660 - DNA, 22 bp, Homo sapiens
ctgtaggagtgggaatttattg

SEQ ID NO: 7253661 - DNA, 22 bp, Homo sapiens
ctgtctgctagaacatctatac

SEQ ID NO: 7253662 - DNA, 22 bp, Homo sapiens
ctgtctggagttatgtaaatag

SEQ ID NO: 7253663 - DNA, 22 bp, Homo sapiens
ctgtctggaatttaagataaag

SEQ ID NO: 7253664 - DNA, 22 bp, Homo sapiens
ctgtctggaatgcagtacatag

SEQ ID NO: 7253665 - DNA, 21 bp, Homo sapiens
ctgtctggccgcgggctccgc

SEQ ID NO: 7253666 - DNA, 22 bp, Homo sapiens
ctgtctggatgtgagtcaccta

SEQ ID NO: 7253667 - DNA, 22 bp, Homo sapiens
ctgtctggatataccttggcca

SEQ ID NO: 7253668 - DNA, 22 bp, Homo sapiens
ctgtctggccggcccagcttcc

SEQ ID NO: 7253669 - DNA, 22 bp, Homo sapiens
ctgtctgggtctacatcctctg

SEQ ID NO: 7253670 - DNA, 22 bp, Homo sapiens
ctgtctggtcaacaactgagtg

SEQ ID NO: 7253671 - DNA, 22 bp, Homo sapiens
ctgtctggtgtccctgtctaca

SEQ ID NO: 7253672 - DNA, 22 bp, Homo sapiens
ctgtctgtacaaatgtggggcc

SEQ ID NO: 7253673 - DNA, 19 bp, Homo sapiens
ctgtctggttcatgtgttc

SEQ ID NO: 7253674 - DNA, 22 bp, Homo sapiens
ctgtgctctggcatcgctgcaa

SEQ ID NO: 7253675 - DNA, 22 bp, Homo sapiens
ctgtgctggtccagggagctgg

SEQ ID NO: 7253676 - DNA, 22 bp, Homo sapiens
ctgtgctggagatgggccagag

SEQ ID NO: 7253677 - DNA, 22 bp, Homo sapiens
ctgcttatggagatgagtaaga

SEQ ID NO: 7253678 - DNA, 22 bp, Homo sapiens
ctgcttatggaattgtatactg

SEQ ID NO: 7253679 - DNA, 22 bp, Homo sapiens
ctgggaagaagtgggctacatt

SEQ ID NO: 7253680 - DNA, 22 bp, Homo sapiens
ctgggaagaaattgtgggaggc

SEQ ID NO: 7253681 - DNA, 23 bp, Homo sapiens
ctgggacatggtaggggcacaac

SEQ ID NO: 7253682 - DNA, 22 bp, Homo sapiens
ctgggagatatgaggatctgga

SEQ ID NO: 7253683 - DNA, 22 bp, Homo sapiens
ctgggagaggtggtgggaagta

SEQ ID NO: 7253684 - DNA, 22 bp, Homo sapiens
ctgggagattgaggccatggtg

SEQ ID NO: 7253685 - DNA, 22 bp, Homo sapiens
ctgggagatgactcagagcagg

SEQ ID NO: 7253686 - DNA, 22 bp, Homo sapiens
ctgggagatctgttgggactgg

SEQ ID NO: 7253687 - DNA, 22 bp, Homo sapiens
ctgggagatctcctgagggcag

SEQ ID NO: 7253688 - DNA, 22 bp, Homo sapiens
ctgggcagctgtatcagggagt

SEQ ID NO: 7253689 - DNA, 22 bp, Homo sapiens
ctgggcagctgtgcaaacaata

SEQ ID NO: 7253690 - DNA, 22 bp, Homo sapiens
ctgggcagctgtatcagggagt

SEQ ID NO: 7253691 - DNA, 22 bp, Homo sapiens
ctgggcagctccataccaccca

SEQ ID NO: 7253692 - DNA, 22 bp, Homo sapiens
ctgggcagctaccaccactgct

SEQ ID NO: 7253693 - DNA, 22 bp, Homo sapiens
ctgggcagcctcacacaatgtt

SEQ ID NO: 7253694 - DNA, 22 bp, Homo sapiens
ctgggcagagtccggaagatgg

SEQ ID NO: 7253695 - DNA, 22 bp, Homo sapiens
ctgggcagcacatcatcgtatc

SEQ ID NO: 7253696 - DNA, 22 bp, Homo sapiens
ctgggcagagctaacacctgag

SEQ ID NO: 7253697 - DNA, 22 bp, Homo sapiens
ctgggcagaattttaggatggc

SEQ ID NO: 7253698 - DNA, 22 bp, Homo sapiens
ctgggcacttgctcacagctct

SEQ ID NO: 7253699 - DNA, 22 bp, Homo sapiens
ctgggcgcgtcccctgaggcgg

SEQ ID NO: 7253700 - DNA, 22 bp, Homo sapiens
cttccaaaatttatatgttgaa

SEQ ID NO: 7253701 - DNA, 22 bp, Homo sapiens
cttccaaaatttatatgttgaa

SEQ ID NO: 7253702 - DNA, 22 bp, Homo sapiens
cttccaaagcactttatggacc

SEQ ID NO: 7253703 - DNA, 22 bp, Homo sapiens
cttccaaagcactttatggacc

SEQ ID NO: 7253704 - DNA, 18 bp, Homo sapiens
cttcatttgtagagttcc

SEQ ID NO: 7253705 - DNA, 22 bp, Homo sapiens
cttagccctgagagttctgagc

SEQ ID NO: 7253706 - DNA, 22 bp, Homo sapiens
cttagccctgagagttctgagc

SEQ ID NO: 7253707 - DNA, 22 bp, Homo sapiens
cttccaagtggggcacgtgcca

SEQ ID NO: 7253708 - DNA, 22 bp, Homo sapiens
cttcctttccccaatcatatcg

SEQ ID NO: 7253709 - DNA, 22 bp, Homo sapiens
cttctagaaccctctattcttt

SEQ ID NO: 7253710 - DNA, 23 bp, Homo sapiens
cttctagagtcagctccaagttt

SEQ ID NO: 7253711 - DNA, 19 bp, Homo sapiens
cttctagaccttataccac

SEQ ID NO: 7253712 - DNA, 22 bp, Homo sapiens
cttctagagtttctgatgcaac

SEQ ID NO: 7253713 - DNA, 22 bp, Homo sapiens
cttctcagatctcagctttgag

SEQ ID NO: 7253714 - DNA, 22 bp, Homo sapiens
cttctcagtcacctgtgagtct

SEQ ID NO: 7253715 - DNA, 22 bp, Homo sapiens
cttctcagaggccagaagctat

SEQ ID NO: 7253716 - DNA, 21 bp, Homo sapiens
ctgtttcttgtgaagtgacac

SEQ ID NO: 7253717 - DNA, 22 bp, Homo sapiens
ctgtttatccctttggtcagca

SEQ ID NO: 7253718 - DNA, 22 bp, Homo sapiens
cttaaacaggaaagagccaggt

SEQ ID NO: 7253719 - DNA, 18 bp, Homo sapiens
cttaaactgtccccagta

SEQ ID NO: 7253720 - DNA, 22 bp, Homo sapiens
cttaccatgtgagaaacaaaca

SEQ ID NO: 7253721 - DNA, 22 bp, Homo sapiens
cttagaaatgcagattctcagg

SEQ ID NO: 7253722 - DNA, 22 bp, Homo sapiens
cttaaagttgacacagtccctg

SEQ ID NO: 7253723 - DNA, 22 bp, Homo sapiens
ctttgaattccagtacaataac

SEQ ID NO: 7253724 - DNA, 23 bp, Homo sapiens
ctttaatgaaattctctgtgaag

SEQ ID NO: 7253725 - DNA, 22 bp, Homo sapiens
ctttaatgagtctttctgctgt

SEQ ID NO: 7253726 - DNA, 22 bp, Homo sapiens
cttctggaggacactggcccca

SEQ ID NO: 7253727 - DNA, 22 bp, Homo sapiens
cttctggagctcaccaacttcc

SEQ ID NO: 7253728 - DNA, 22 bp, Homo sapiens
cttctcttggtagttcttgttg

SEQ ID NO: 7253729 - DNA, 22 bp, Homo sapiens
cttgtgaaatgccagataatct

SEQ ID NO: 7253730 - DNA, 22 bp, Homo sapiens
cttctgggtgcctgtgagtgtt

SEQ ID NO: 7253731 - DNA, 22 bp, Homo sapiens
cttctgggttgcaggtcttggc

SEQ ID NO: 7253732 - DNA, 22 bp, Homo sapiens
cttctgggtgtggagtgaggac

SEQ ID NO: 7253733 - DNA, 22 bp, Homo sapiens
gaaacagattaacagcatattt

SEQ ID NO: 7253734 - DNA, 22 bp, Homo sapiens
gaaagagaggggctgagatgca

SEQ ID NO: 7253735 - DNA, 23 bp, Homo sapiens
gaaagctctctcctcaggacctt

SEQ ID NO: 7253736 - DNA, 22 bp, Homo sapiens
gaaagccatagcccagctttac

SEQ ID NO: 7253737 - DNA, 22 bp, Homo sapiens
gaaagccatctggctgctggga

SEQ ID NO: 7253738 - DNA, 22 bp, Homo sapiens
cttttcttactcccgcaaggca

SEQ ID NO: 7253739 - DNA, 22 bp, Homo sapiens
cttttcttctcacggctgtcag

SEQ ID NO: 7253740 - DNA, 22 bp, Homo sapiens
cttttcttatgtggacgtacct

SEQ ID NO: 7253741 - DNA, 22 bp, Homo sapiens
cttttcttctcacggctgtcag

SEQ ID NO: 7253742 - DNA, 21 bp, Homo sapiens
ctttgcaagatgtctatgaaa

SEQ ID NO: 7253743 - DNA, 22 bp, Homo sapiens
ctttgattcagagagaattagc

SEQ ID NO: 7253744 - DNA, 21 bp, Homo sapiens
ctttgcaagatgtctatgaaa

SEQ ID NO: 7253745 - DNA, 22 bp, Homo sapiens
cttttcattgtttgtacatgca

SEQ ID NO: 7253746 - DNA, 22 bp, Homo sapiens
ctcggtggacatttcagaggtg

SEQ ID NO: 7253747 - DNA, 22 bp, Homo sapiens
ctcgggttgtaagtatctatta

SEQ ID NO: 7253748 - DNA, 22 bp, Homo sapiens
ctcctgggctgtcggcgctctg

SEQ ID NO: 7253749 - DNA, 22 bp, Homo sapiens
tttatattacctggaatagctt

SEQ ID NO: 7253750 - DNA, 22 bp, Homo sapiens
ctcctgtcagaagcatcctgag

SEQ ID NO: 7253751 - DNA, 22 bp, Homo sapiens
ctcctgtcagaagcatcctgag

SEQ ID NO: 7253752 - DNA, 22 bp, Homo sapiens
ctcctgtgattcatttaacata

SEQ ID NO: 7253753 - DNA, 22 bp, Homo sapiens
tttacaattctctaccagtgtt

SEQ ID NO: 7253754 - DNA, 20 bp, Homo sapiens
ctcctcagttccatgggagg

SEQ ID NO: 7253755 - DNA, 22 bp, Homo sapiens
ctcctgcctgtgggactgagga

SEQ ID NO: 7253756 - DNA, 22 bp, Homo sapiens
tttatatctggagttgctagga

SEQ ID NO: 7253757 - DNA, 22 bp, Homo sapiens
tttatatgaaagtgaccagtgg

SEQ ID NO: 7253758 - DNA, 18 bp, Homo sapiens
tttatatggatagagacc

SEQ ID NO: 7253759 - DNA, 22 bp, Homo sapiens
tttatatgtgaaggtttgcaga

SEQ ID NO: 7253760 - DNA, 22 bp, Homo sapiens
tttatatgtattgactttgatg

SEQ ID NO: 7253761 - DNA, 22 bp, Homo sapiens
tttatatggttgactatgagtt

SEQ ID NO: 7253762 - DNA, 22 bp, Homo sapiens
tttatatgtttgtacaattaag

SEQ ID NO: 7253763 - DNA, 22 bp, Homo sapiens
tttatatgtttgtacaattaag

SEQ ID NO: 7253764 - DNA, 22 bp, Homo sapiens
ttgtttacactgcagaattggg

SEQ ID NO: 7253765 - DNA, 22 bp, Homo sapiens
ttgtttaatgcctcatacatct

SEQ ID NO: 7253766 - DNA, 22 bp, Homo sapiens
ctccccagcattctgacttcct

SEQ ID NO: 7253767 - DNA, 22 bp, Homo sapiens
ctccgagactcgagtgtcctca

SEQ ID NO: 7253768 - DNA, 22 bp, Homo sapiens
ctcccttccaatgactatgctt

SEQ ID NO: 7253769 - DNA, 22 bp, Homo sapiens
ctccggagagcagacgagggca

SEQ ID NO: 7253770 - DNA, 22 bp, Homo sapiens
ctcctcagctgggaggagtccc

SEQ ID NO: 7253771 - DNA, 21 bp, Homo sapiens
ctcctcaggaccagccacagg

SEQ ID NO: 7253772 - DNA, 22 bp, Homo sapiens
ctcctcagtcaggtctagggtc

SEQ ID NO: 7253773 - DNA, 19 bp, Homo sapiens
ctcctcagtcccagaggtc

SEQ ID NO: 7253774 - DNA, 20 bp, Homo sapiens
ctcctcagttccatgggagg

SEQ ID NO: 7253775 - DNA, 19 bp, Homo sapiens
ctcctcagtcccagaggtc

SEQ ID NO: 7253776 - DNA, 23 bp, Homo sapiens
ctccctggagtttctggaagatg

SEQ ID NO: 7253777 - DNA, 22 bp, Homo sapiens
ctccctctgtcttgtccagaaa

SEQ ID NO: 7253778 - DNA, 22 bp, Homo sapiens
ctccctgacctggattccaggc

SEQ ID NO: 7253779 - DNA, 22 bp, Homo sapiens
tttcttgagtgatgcttagtgt

SEQ ID NO: 7253780 - DNA, 22 bp, Homo sapiens
ctctgctgcccaggcctgctag

SEQ ID NO: 7253781 - DNA, 20 bp, Homo sapiens
ctctgctgcgcatcccactt

SEQ ID NO: 7253782 - DNA, 20 bp, Homo sapiens
ctctgctgcccgccggctgc

SEQ ID NO: 7253783 - DNA, 22 bp, Homo sapiens
tttcttctgtttgtagttacac

SEQ ID NO: 7253784 - DNA, 22 bp, Homo sapiens
tttcttctgtttgtagttacac

SEQ ID NO: 7253785 - DNA, 22 bp, Homo sapiens
tttcttcttgagtaaccagatt

SEQ ID NO: 7253786 - DNA, 22 bp, Homo sapiens
tttcttcttaatactggctgct

SEQ ID NO: 7253787 - DNA, 22 bp, Homo sapiens
tttcttcttaatactggctgct

SEQ ID NO: 7253788 - DNA, 22 bp, Homo sapiens
tttcttctttcccagtgatggg

SEQ ID NO: 7253789 - DNA, 22 bp, Homo sapiens
tttcttctttcccagtgatggg

SEQ ID NO: 7253790 - DNA, 21 bp, Homo sapiens
ctctggaggcaagggagagtg

SEQ ID NO: 7253791 - DNA, 21 bp, Homo sapiens
ctctggaggcaagggagagtg

SEQ ID NO: 7253792 - DNA, 22 bp, Homo sapiens
ctctggagcgctgcttcccgcg

SEQ ID NO: 7253793 - DNA, 22 bp, Homo sapiens
ctctggaggcagcaccagccag

SEQ ID NO: 7253794 - DNA, 22 bp, Homo sapiens
ctctggaggccgttggccctta

SEQ ID NO: 7253795 - DNA, 22 bp, Homo sapiens
ctctggagggaggctgagctgg

SEQ ID NO: 7253796 - DNA, 19 bp, Homo sapiens
ctctggagggaccgccgtt

SEQ ID NO: 7253797 - DNA, 22 bp, Homo sapiens
ctctggaggcctaaggaagtgg

SEQ ID NO: 7253798 - DNA, 22 bp, Homo sapiens
ctctggaggtcaggtgtggtgg

SEQ ID NO: 7253799 - DNA, 22 bp, Homo sapiens
ctctggaggtggaggttgcagt

SEQ ID NO: 7253800 - DNA, 22 bp, Homo sapiens
ctctggaggttgagcccagcaa

SEQ ID NO: 7253801 - DNA, 19 bp, Homo sapiens
ctctggagtcattgctccc

SEQ ID NO: 7253802 - DNA, 22 bp, Homo sapiens
ctctggagtcaggcagccctgg

SEQ ID NO: 7253803 - DNA, 22 bp, Homo sapiens
ctctggagtaagagctatgaaa

SEQ ID NO: 7253804 - DNA, 21 bp, Homo sapiens
ctctggagtcaagagcttcca

SEQ ID NO: 7253805 - DNA, 22 bp, Homo sapiens
tttgaagtcagatggtctgagt

SEQ ID NO: 7253806 - DNA, 22 bp, Homo sapiens
ctctggaattaaggaagcctgt

SEQ ID NO: 7253807 - DNA, 22 bp, Homo sapiens
ctctggagcgctgcttcccgcg

SEQ ID NO: 7253808 - DNA, 22 bp, Homo sapiens
ctctggagcatttcacctacat

SEQ ID NO: 7253809 - DNA, 19 bp, Homo sapiens
ctctggagcagacactgga

SEQ ID NO: 7253810 - DNA, 22 bp, Homo sapiens
ctctggaattgacctgggaggg

SEQ ID NO: 7253811 - DNA, 22 bp, Homo sapiens
tttctgatatactgtagaatcc

SEQ ID NO: 7253812 - DNA, 22 bp, Homo sapiens
tttctgatattcatttagaaga

SEQ ID NO: 7253813 - DNA, 22 bp, Homo sapiens
tttctgattctcactttggcat

SEQ ID NO: 7253814 - DNA, 20 bp, Homo sapiens
tttctgcagatgtttacatg

SEQ ID NO: 7253815 - DNA, 19 bp, Homo sapiens
tttctgcagcccagcagca

SEQ ID NO: 7253816 - DNA, 22 bp, Homo sapiens
tttctgttgttggtgtctggct

SEQ ID NO: 7253817 - DNA, 22 bp, Homo sapiens
tttctgttgtatggcttctgca

SEQ ID NO: 7253818 - DNA, 19 bp, Homo sapiens
tttctgtttgcttctggtt

SEQ ID NO: 7253819 - DNA, 22 bp, Homo sapiens
ctctgagggtctaaggagtcac

SEQ ID NO: 7253820 - DNA, 22 bp, Homo sapiens
ctctgagggctcgagggacgcg

SEQ ID NO: 7253821 - DNA, 20 bp, Homo sapiens
ctctgaggctgagaagggag

SEQ ID NO: 7253822 - DNA, 22 bp, Homo sapiens
ctctgaggctccatgcaggctt

SEQ ID NO: 7253823 - DNA, 22 bp, Homo sapiens
ctctgaggagaaagagcttggt

SEQ ID NO: 7253824 - DNA, 20 bp, Homo sapiens
ctctctggaaggtgggagcc

SEQ ID NO: 7253825 - DNA, 22 bp, Homo sapiens
ctctctggaattaaagcccaat

SEQ ID NO: 7253826 - DNA, 22 bp, Homo sapiens
tttctctccccaagtggaattg

SEQ ID NO: 7253827 - DNA, 23 bp, Homo sapiens
tttctctgagaagcagttctcta

SEQ ID NO: 7253828 - DNA, 22 bp, Homo sapiens
ctctagggaagaatgagagccc

SEQ ID NO: 7253829 - DNA, 19 bp, Homo sapiens
ctctagggtctaagggcag

SEQ ID NO: 7253830 - DNA, 22 bp, Homo sapiens
ctctagggaagaatgagagccc

SEQ ID NO: 7253831 - DNA, 22 bp, Homo sapiens
ctctagggctctgtgaggttgg

SEQ ID NO: 7253832 - DNA, 22 bp, Homo sapiens
ctctaggggctggtcagcgtct

SEQ ID NO: 7253833 - DNA, 19 bp, Homo sapiens
ctctagggtctaagggcag

SEQ ID NO: 7253834 - DNA, 21 bp, Homo sapiens
tttctcaccatggtatggaaa

SEQ ID NO: 7253835 - DNA, 22 bp, Homo sapiens
ctgaaggatgtgtggtgggagt

SEQ ID NO: 7253836 - DNA, 18 bp, Homo sapiens
ctgaaggcaccagggcag

SEQ ID NO: 7253837 - DNA, 22 bp, Homo sapiens
ctgaagttattgtacaaatttg

SEQ ID NO: 7253838 - DNA, 22 bp, Homo sapiens
ctgaagttattcagtgggctga

SEQ ID NO: 7253839 - DNA, 22 bp, Homo sapiens
ctgaagttagttatgcctaaaa

SEQ ID NO: 7253840 - DNA, 22 bp, Homo sapiens
ctgaagttaatcagaggtacaa

SEQ ID NO: 7253841 - DNA, 22 bp, Homo sapiens
ctgaagttaacatcttgatgtc

SEQ ID NO: 7253842 - DNA, 22 bp, Homo sapiens
ctgaagttaaagtagtttttat

SEQ ID NO: 7253843 - DNA, 22 bp, Homo sapiens
ctctggagtcctgtatcactcc

SEQ ID NO: 7253844 - DNA, 22 bp, Homo sapiens
ctctggagtcctgtatcactcc

SEQ ID NO: 7253845 - DNA, 22 bp, Homo sapiens
ctgaagttttgacatctcattt

SEQ ID NO: 7253846 - DNA, 22 bp, Homo sapiens
ctgaagtttcgagatggatgtg

SEQ ID NO: 7253847 - DNA, 22 bp, Homo sapiens
ctgaagtttatgcttttcgggt

SEQ ID NO: 7253848 - DNA, 22 bp, Homo sapiens
ctgaagttctacaagcctcagg

SEQ ID NO: 7253849 - DNA, 22 bp, Homo sapiens
ctgaagttcgccagactcgggc

SEQ ID NO: 7253850 - DNA, 22 bp, Homo sapiens
ctgaagttcatacaatggccat

SEQ ID NO: 7253851 - DNA, 22 bp, Homo sapiens
ctgaagtttttcaatttatgtt

SEQ ID NO: 7253852 - DNA, 22 bp, Homo sapiens
ctgagaggggaccagggtgttt

SEQ ID NO: 7253853 - DNA, 22 bp, Homo sapiens
ctgagaggtaagcagcgcagtg

SEQ ID NO: 7253854 - DNA, 22 bp, Homo sapiens
ctgagaggtaagcagcgcagtg

SEQ ID NO: 7253855 - DNA, 22 bp, Homo sapiens
ctgagagtgtggcttccaggcc

SEQ ID NO: 7253856 - DNA, 22 bp, Homo sapiens
ctgagggcaccgacagagtgga

SEQ ID NO: 7253857 - DNA, 18 bp, Homo sapiens
ctgagggcagcccctggg

SEQ ID NO: 7253858 - DNA, 22 bp, Homo sapiens
ctgagggcagtgatgaaggtga

SEQ ID NO: 7253859 - DNA, 22 bp, Homo sapiens
ctgagggcagtgatgaaggtga

SEQ ID NO: 7253860 - DNA, 22 bp, Homo sapiens
ctgcctgcactgcctggctcca

SEQ ID NO: 7253861 - DNA, 22 bp, Homo sapiens
ctgcctgcctggagacagatgg

SEQ ID NO: 7253862 - DNA, 22 bp, Homo sapiens
ctgcggtgggctgggctgtccc

SEQ ID NO: 7253863 - DNA, 22 bp, Homo sapiens
ctgcgggctgtcaggcgtgcca

SEQ ID NO: 7253864 - DNA, 22 bp, Homo sapiens
ctgctccccagcctgcgccttt

SEQ ID NO: 7253865 - DNA, 22 bp, Homo sapiens
ctgctccaggatttcaggccag

SEQ ID NO: 7253866 - DNA, 20 bp, Homo sapiens
ctgctccacccggctctcag

SEQ ID NO: 7253867 - DNA, 19 bp, Homo sapiens
ctgctccaggagctgggga

SEQ ID NO: 7253868 - DNA, 23 bp, Homo sapiens
ctgctccaggacagcatggaggt

SEQ ID NO: 7253869 - DNA, 22 bp, Homo sapiens
ctgctccaggaacagagctgct

SEQ ID NO: 7253870 - DNA, 22 bp, Homo sapiens
ctgctccacctccgggtcaggc

SEQ ID NO: 7253871 - DNA, 22 bp, Homo sapiens
ctgctccagacacctgcagggg

SEQ ID NO: 7253872 - DNA, 22 bp, Homo sapiens
ctgctggaagtttgctgtggat

SEQ ID NO: 7253873 - DNA, 22 bp, Homo sapiens
ctgctggaaggtacacatcttg

SEQ ID NO: 7253874 - DNA, 22 bp, Homo sapiens
ctgctgcctgattgcagacctc

SEQ ID NO: 7253875 - DNA, 22 bp, Homo sapiens
ctgctgccggcgagcctccctt

SEQ ID NO: 7253876 - DNA, 22 bp, Homo sapiens
ctgctctaggggcagggccctt

SEQ ID NO: 7253877 - DNA, 22 bp, Homo sapiens
ctgccctggcagcctaccatgg

SEQ ID NO: 7253878 - DNA, 22 bp, Homo sapiens
ctgccctgcttgtttccagtgg

SEQ ID NO: 7253879 - DNA, 22 bp, Homo sapiens
ctgccctggaaaacgtatctta

SEQ ID NO: 7253880 - DNA, 22 bp, Homo sapiens
ctgccctgcttgatgacagcga

SEQ ID NO: 7253881 - DNA, 22 bp, Homo sapiens
ctgccctgggatggtctgtgcg

SEQ ID NO: 7253882 - DNA, 22 bp, Homo sapiens
ctgccctggccactgtgcccag

SEQ ID NO: 7253883 - DNA, 22 bp, Homo sapiens
ctgccctgggagtacctgtcct

SEQ ID NO: 7253884 - DNA, 22 bp, Homo sapiens
ctgccctgggccaggaagcggc

SEQ ID NO: 7253885 - DNA, 22 bp, Homo sapiens
ctgccctgggccaggaagcggc

SEQ ID NO: 7253886 - DNA, 22 bp, Homo sapiens
ctgcctctattcactgaggcag

SEQ ID NO: 7253887 - DNA, 22 bp, Homo sapiens
ctgccctgcctggccagtgtgg

SEQ ID NO: 7253888 - DNA, 20 bp, Homo sapiens
ctgccctgccctgggtcctg

SEQ ID NO: 7253889 - DNA, 22 bp, Homo sapiens
ctgccctgcccaggccttgggc

SEQ ID NO: 7253890 - DNA, 22 bp, Homo sapiens
ctgccctgctggagatcacagt

SEQ ID NO: 7253891 - DNA, 22 bp, Homo sapiens
ctgccctgctctccgggatctt

SEQ ID NO: 7253892 - DNA, 22 bp, Homo sapiens
ctgccctgctctccgggatctt

SEQ ID NO: 7253893 - DNA, 22 bp, Homo sapiens
ctgccctgctaatgagttccaa

SEQ ID NO: 7253894 - DNA, 22 bp, Homo sapiens
ctgccctgcttctgagggaagc

SEQ ID NO: 7253895 - DNA, 22 bp, Homo sapiens
ctgccctgcttgatgacagcga

SEQ ID NO: 7253896 - DNA, 22 bp, Homo sapiens
ctgccctgatatgatttagaac

SEQ ID NO: 7253897 - DNA, 22 bp, Homo sapiens
ctgccctgagtcatgccagatg

SEQ ID NO: 7253898 - DNA, 23 bp, Homo sapiens
ctgccctgatcttgatctattgt

SEQ ID NO: 7253899 - DNA, 22 bp, Homo sapiens
ctgccctgcagctccacggact

SEQ ID NO: 7253900 - DNA, 22 bp, Homo sapiens
ctgccctgcagctccacggact

SEQ ID NO: 7253901 - DNA, 22 bp, Homo sapiens
ctgccctgagggcctgtgtgtt

SEQ ID NO: 7253902 - DNA, 22 bp, Homo sapiens
ctgcagggtttttcaaggacaa

SEQ ID NO: 7253903 - DNA, 22 bp, Homo sapiens
ctgcaggggcctcgagcacagg

SEQ ID NO: 7253904 - DNA, 21 bp, Homo sapiens
ctgagggccgcagctgggctc

SEQ ID NO: 7253905 - DNA, 21 bp, Homo sapiens
ctgagggccgcagctgggctc

SEQ ID NO: 7253906 - DNA, 22 bp, Homo sapiens
ctgagggccttctatgctgagc

SEQ ID NO: 7253907 - DNA, 22 bp, Homo sapiens
ctgagggctggagctgaggcct

SEQ ID NO: 7253908 - DNA, 23 bp, Homo sapiens
ctgagggctggtctgaagtctgc

SEQ ID NO: 7253909 - DNA, 23 bp, Homo sapiens
ctgagggctggtctgaagtctgc

SEQ ID NO: 7253910 - DNA, 22 bp, Homo sapiens
ctgcagttggataaagatactt

SEQ ID NO: 7253911 - DNA, 22 bp, Homo sapiens
ctgcagtttcagcctttctggc

SEQ ID NO: 7253912 - DNA, 22 bp, Homo sapiens
ctgcagtctacctggattttta

SEQ ID NO: 7253913 - DNA, 22 bp, Homo sapiens
ctgcagtatcttaaaatttgta

SEQ ID NO: 7253914 - DNA, 22 bp, Homo sapiens
ctgcagtgcaagcccagatgga

SEQ ID NO: 7253915 - DNA, 22 bp, Homo sapiens
ctgcagtgttctggaatgcatt

SEQ ID NO: 7253916 - DNA, 22 bp, Homo sapiens
ttatttttaaaagttcacacag

SEQ ID NO: 7253917 - DNA, 22 bp, Homo sapiens
ttatttcattgatttctaagac

SEQ ID NO: 7253918 - DNA, 22 bp, Homo sapiens
ttattattgtggttgcattatc

SEQ ID NO: 7253919 - DNA, 21 bp, Homo sapiens
cgcagagcgaacttgcggcgc

SEQ ID NO: 7253920 - DNA, 21 bp, Homo sapiens
cgcagagcgaacttgcggcgc

SEQ ID NO: 7253921 - DNA, 22 bp, Homo sapiens
cgcagagggcaggcagtgctgg

SEQ ID NO: 7253922 - DNA, 22 bp, Homo sapiens
cgcagagggagccgcgggctgc

SEQ ID NO: 7253923 - DNA, 22 bp, Homo sapiens
cgcagcagccccgtggtaggtg

SEQ ID NO: 7253924 - DNA, 22 bp, Homo sapiens
ttcaaaacaatctgtttgcatt

SEQ ID NO: 7253925 - DNA, 22 bp, Homo sapiens
cgcacagctgcaaggagttgca

SEQ ID NO: 7253926 - DNA, 19 bp, Homo sapiens
cgcacagcctgccaggcgc

SEQ ID NO: 7253927 - DNA, 22 bp, Homo sapiens
cctttggctgcatagggaaggg

SEQ ID NO: 7253928 - DNA, 22 bp, Homo sapiens
cgagggtgtgctgacccagctc

SEQ ID NO: 7253929 - DNA, 17 bp, Homo sapiens
cgagggcttgctggctc

SEQ ID NO: 7253930 - DNA, 22 bp, Homo sapiens
cgagggctgtgttgctctcctt

SEQ ID NO: 7253931 - DNA, 22 bp, Homo sapiens
ttatggcttgtgcaggatctag

SEQ ID NO: 7253932 - DNA, 22 bp, Homo sapiens
ttatgggagcaattggggaggt

SEQ ID NO: 7253933 - DNA, 22 bp, Homo sapiens
ttatggctgaataaattatggt

SEQ ID NO: 7253934 - DNA, 20 bp, Homo sapiens
ttatggctcctaccttgtga

SEQ ID NO: 7253935 - DNA, 22 bp, Homo sapiens
ttatggctaggatatgtgtgta

SEQ ID NO: 7253936 - DNA, 22 bp, Homo sapiens
ttatggctagactagtttttga

SEQ ID NO: 7253937 - DNA, 22 bp, Homo sapiens
ttatggcattcattggggcttt

SEQ ID NO: 7253938 - DNA, 22 bp, Homo sapiens
ccttggggaatatccattcttc

SEQ ID NO: 7253939 - DNA, 23 bp, Homo sapiens
ccttgtctggctggctggacttt

SEQ ID NO: 7253940 - DNA, 22 bp, Homo sapiens
ccttgtgcaggttcatgatggg

SEQ ID NO: 7253941 - DNA, 22 bp, Homo sapiens
ccttggctgcttatatgtctgt

SEQ ID NO: 7253942 - DNA, 22 bp, Homo sapiens
ccttggctggaattactctggg

SEQ ID NO: 7253943 - DNA, 22 bp, Homo sapiens
ccttggggaactggacgtgctg

SEQ ID NO: 7253944 - DNA, 22 bp, Homo sapiens
ttacagaaaggaaggactgact

SEQ ID NO: 7253945 - DNA, 19 bp, Homo sapiens
ttacaatgacccaatctgg

SEQ ID NO: 7253946 - DNA, 20 bp, Homo sapiens
ttacagaaatgatgttattt

SEQ ID NO: 7253947 - DNA, 22 bp, Homo sapiens
ttacagaagagaaagaattcag

SEQ ID NO: 7253948 - DNA, 22 bp, Homo sapiens
ttacagaagtattgagagatcc

SEQ ID NO: 7253949 - DNA, 20 bp, Homo sapiens
ccttctctggaattgcctcc

SEQ ID NO: 7253950 - DNA, 22 bp, Homo sapiens
ttaccgagaacatgactggaat

SEQ ID NO: 7253951 - DNA, 22 bp, Homo sapiens
ttacctaaaatagctcaattta

SEQ ID NO: 7253952 - DNA, 22 bp, Homo sapiens
ccttctgagtgtggacccctgt

SEQ ID NO: 7253953 - DNA, 21 bp, Homo sapiens
ccttctcttgcttcagcttca

SEQ ID NO: 7253954 - DNA, 22 bp, Homo sapiens
ttaatatacaattttacgggct

SEQ ID NO: 7253955 - DNA, 22 bp, Homo sapiens
ttaagcgccttctctttgtctt

SEQ ID NO: 7253956 - DNA, 22 bp, Homo sapiens
cctgtacttgtattaaaggtcc

SEQ ID NO: 7253957 - DNA, 22 bp, Homo sapiens
cctgtactagggtctcattgcc

SEQ ID NO: 7253958 - DNA, 22 bp, Homo sapiens
tgttttctattacctgagattg

SEQ ID NO: 7253959 - DNA, 22 bp, Homo sapiens
tgttttctagaaacaatgccta

SEQ ID NO: 7253960 - DNA, 22 bp, Homo sapiens
ttaatcaagagtggggactgtg

SEQ ID NO: 7253961 - DNA, 22 bp, Homo sapiens
ttacaatagttccttcttttgt

SEQ ID NO: 7253962 - DNA, 18 bp, Homo sapiens
cctgtggctcagcccaca

SEQ ID NO: 7253963 - DNA, 17 bp, Homo sapiens
tgttttcattcattgct

SEQ ID NO: 7253964 - DNA, 21 bp, Homo sapiens
tgttttctaaagggcggatca

SEQ ID NO: 7253965 - DNA, 19 bp, Homo sapiens
tgtttcttcctccatctga

SEQ ID NO: 7253966 - DNA, 22 bp, Homo sapiens
tgtttcttctcacacaaactca

SEQ ID NO: 7253967 - DNA, 22 bp, Homo sapiens
tgtttcttgagagtattaccct

SEQ ID NO: 7253968 - DNA, 22 bp, Homo sapiens
tgtttcttacgtttttagaggc

SEQ ID NO: 7253969 - DNA, 22 bp, Homo sapiens
tgtttcttatccaagtggtctg

SEQ ID NO: 7253970 - DNA, 22 bp, Homo sapiens
cctggggccccgagccagaagc

SEQ ID NO: 7253971 - DNA, 23 bp, Homo sapiens
cctggggcacttgagtcctcatc

SEQ ID NO: 7253972 - DNA, 22 bp, Homo sapiens
cctgctccatgctcaccatcag

SEQ ID NO: 7253973 - DNA, 22 bp, Homo sapiens
cctgctcctatctgggctcatt

SEQ ID NO: 7253974 - DNA, 22 bp, Homo sapiens
tgttccatgtctttgtaggact

SEQ ID NO: 7253975 - DNA, 22 bp, Homo sapiens
tgttgcccaggttctctcctgc

SEQ ID NO: 7253976 - DNA, 22 bp, Homo sapiens
cctgctcagccccagctcaccc

SEQ ID NO: 7253977 - DNA, 22 bp, Homo sapiens
cctgctcagctgtcctcacgct

SEQ ID NO: 7253978 - DNA, 23 bp, Homo sapiens
cctgctcaggcgtgtgccctgct

SEQ ID NO: 7253979 - DNA, 22 bp, Homo sapiens
cctgcgggctgtgctgaagcct

SEQ ID NO: 7253980 - DNA, 22 bp, Homo sapiens
cctgcgggctggtaagaggctt

SEQ ID NO: 7253981 - DNA, 22 bp, Homo sapiens
cctgcgggctgtgctgaagcct

SEQ ID NO: 7253982 - DNA, 17 bp, Homo sapiens
tggttccaaccatacgc

SEQ ID NO: 7253983 - DNA, 22 bp, Homo sapiens
cgtcctgctcggcgcgcctcgg

SEQ ID NO: 7253984 - DNA, 22 bp, Homo sapiens
cgtcctctagagggaagcactt

SEQ ID NO: 7253985 - DNA, 22 bp, Homo sapiens
cgtctctggcccggcccctggg

SEQ ID NO: 7253986 - DNA, 22 bp, Homo sapiens
ttccactctatgatagaagggt

SEQ ID NO: 7253987 - DNA, 22 bp, Homo sapiens
ttccactctccagtcaatttca

SEQ ID NO: 7253988 - DNA, 22 bp, Homo sapiens
ttccactcttctctggacttat

SEQ ID NO: 7253989 - DNA, 22 bp, Homo sapiens
ttccactctgtcccctgtggga

SEQ ID NO: 7253990 - DNA, 22 bp, Homo sapiens
cgtctggacgggaaggagaagt

SEQ ID NO: 7253991 - DNA, 22 bp, Homo sapiens
ttcctaaaagctgagtagagaa

SEQ ID NO: 7253992 - DNA, 22 bp, Homo sapiens
ttcctctcaacatgcctgccgg

SEQ ID NO: 7253993 - DNA, 22 bp, Homo sapiens
ttcctctcctcccaccaggtga

SEQ ID NO: 7253994 - DNA, 22 bp, Homo sapiens
ttcctctcctcacatgagtcac

SEQ ID NO: 7253995 - DNA, 17 bp, Homo sapiens
ttcctctcacatttttt

SEQ ID NO: 7253996 - DNA, 22 bp, Homo sapiens
ttcctctcgctctccggggccc

SEQ ID NO: 7253997 - DNA, 22 bp, Homo sapiens
ttcctctctcttgccagaatgt

SEQ ID NO: 7253998 - DNA, 22 bp, Homo sapiens
ttcctctgaaatggcttggaaa

SEQ ID NO: 7253999 - DNA, 22 bp, Homo sapiens
cgcagctctggccgagggcggc

SEQ ID NO: 7254000 - DNA, 22 bp, Homo sapiens
cgcagctcttaccctcccctta

SEQ ID NO: 7254001 - DNA, 22 bp, Homo sapiens
cggcttaattctaactgtaagg

SEQ ID NO: 7254002 - DNA, 22 bp, Homo sapiens
cggctgggttcggctgcaggcc

SEQ ID NO: 7254003 - DNA, 22 bp, Homo sapiens
cggctgggtagaggtgccgggt

SEQ ID NO: 7254004 - DNA, 22 bp, Homo sapiens
cggctgggttcggctgcaggcc

SEQ ID NO: 7254005 - DNA, 22 bp, Homo sapiens
cggctggtgtcgggcacagcaa

SEQ ID NO: 7254006 - DNA, 22 bp, Homo sapiens
ttccactctactctggccagtc

SEQ ID NO: 7254007 - DNA, 22 bp, Homo sapiens
ttccactctacacactgctggc

SEQ ID NO: 7254008 - DNA, 22 bp, Homo sapiens
ttccactcctcctggtggggtg

SEQ ID NO: 7254009 - DNA, 22 bp, Homo sapiens
ttccactcatgcaaaggtccca

SEQ ID NO: 7254010 - DNA, 22 bp, Homo sapiens
cgggaaagttccacagatggat

SEQ ID NO: 7254011 - DNA, 15 bp, Homo sapiens
ctacatgctggagca

SEQ ID NO: 7254012 - DNA, 22 bp, Homo sapiens
ctacattaaattggcttactta

SEQ ID NO: 7254013 - DNA, 22 bp, Homo sapiens
ttctacatgtcaagtctccaag

SEQ ID NO: 7254014 - DNA, 22 bp, Homo sapiens
ttctacattgtgaagttcttta

SEQ ID NO: 7254015 - DNA, 22 bp, Homo sapiens
ttctacatttaaaaggaaaatc

SEQ ID NO: 7254016 - DNA, 22 bp, Homo sapiens
ctacagtgaagactagctatag

SEQ ID NO: 7254017 - DNA, 22 bp, Homo sapiens
ttcctttttacataatcacatt

SEQ ID NO: 7254018 - DNA, 21 bp, Homo sapiens
ttcctttttatggcttagtgg

SEQ ID NO: 7254019 - DNA, 22 bp, Homo sapiens
ttctacaggtactgaagtacat

SEQ ID NO: 7254020 - DNA, 21 bp, Homo sapiens
ttctacaggatgaatgaaaac

SEQ ID NO: 7254021 - DNA, 22 bp, Homo sapiens
ttctcctggagtgcttgttggg

SEQ ID NO: 7254022 - DNA, 22 bp, Homo sapiens
ttctcctgcgcaggcccaggga

SEQ ID NO: 7254023 - DNA, 22 bp, Homo sapiens
ttctcattctgactcagtgtag

SEQ ID NO: 7254024 - DNA, 22 bp, Homo sapiens
ctagttctagatccctgaggaa

SEQ ID NO: 7254025 - DNA, 22 bp, Homo sapiens
ctagtggaaactaactggaatt

SEQ ID NO: 7254026 - DNA, 22 bp, Homo sapiens
ttctccttgttcccttcaattg

SEQ ID NO: 7254027 - DNA, 22 bp, Homo sapiens
ttctcctgggaggggttgccca

SEQ ID NO: 7254028 - DNA, 21 bp, Homo sapiens
ttctcctgttttgcaccacag

SEQ ID NO: 7254029 - DNA, 23 bp, Homo sapiens
ttgcaaaatgcaattgagttaga

SEQ ID NO: 7254030 - DNA, 22 bp, Homo sapiens
ctcaggccattcttccagctgc

SEQ ID NO: 7254031 - DNA, 22 bp, Homo sapiens
ctcaggccattcctaccaaggg

SEQ ID NO: 7254032 - DNA, 22 bp, Homo sapiens
ctcaggccaggtttctcccaca

SEQ ID NO: 7254033 - DNA, 22 bp, Homo sapiens
ctcaggccaataagctccagcc

SEQ ID NO: 7254034 - DNA, 22 bp, Homo sapiens
ctcaggcccacagcagacccac

SEQ ID NO: 7254035 - DNA, 22 bp, Homo sapiens
ctcaggccattcttccagctgc

SEQ ID NO: 7254036 - DNA, 22 bp, Homo sapiens
ctcagcccagcccaggaccagg

SEQ ID NO: 7254037 - DNA, 22 bp, Homo sapiens
ctcagccccaattctccccatt

SEQ ID NO: 7254038 - DNA, 22 bp, Homo sapiens
ctcagcattcaatgtccagtcc

SEQ ID NO: 7254039 - DNA, 22 bp, Homo sapiens
ctcagcatggagggagaacaag

SEQ ID NO: 7254040 - DNA, 22 bp, Homo sapiens
ttgcactccagtctgggaacaa

SEQ ID NO: 7254041 - DNA, 22 bp, Homo sapiens
ttgcaccaaatgagttaaaatt

SEQ ID NO: 7254042 - DNA, 22 bp, Homo sapiens
ttgcacatttcctagaatttca

SEQ ID NO: 7254043 - DNA, 23 bp, Homo sapiens
ttgcacattggagctggtcttct

SEQ ID NO: 7254044 - DNA, 22 bp, Homo sapiens
ttgcacatgttggttcttgaaa

SEQ ID NO: 7254045 - DNA, 21 bp, Homo sapiens
ttgcaccatgataaattcaga

SEQ ID NO: 7254046 - DNA, 22 bp, Homo sapiens
ttgcacatgatagatgatttct

SEQ ID NO: 7254047 - DNA, 18 bp, Homo sapiens
ctcaggcctttccctgtg

SEQ ID NO: 7254048 - DNA, 22 bp, Homo sapiens
ctcaggcctgagtggcagtccc

SEQ ID NO: 7254049 - DNA, 22 bp, Homo sapiens
ttgctggcttgaagatagagga

SEQ ID NO: 7254050 - DNA, 19 bp, Homo sapiens
ttgctggcatttgatctct

SEQ ID NO: 7254051 - DNA, 22 bp, Homo sapiens
ttgctggcaatttagagatttc

SEQ ID NO: 7254052 - DNA, 22 bp, Homo sapiens
ttgctgggtcagaagccaggag

SEQ ID NO: 7254053 - DNA, 22 bp, Homo sapiens
ttgctgatggagggaatgctca

SEQ ID NO: 7254054 - DNA, 22 bp, Homo sapiens
ttgctgatctgaaacgttactg

SEQ ID NO: 7254055 - DNA, 22 bp, Homo sapiens
ttgctgataccatgaatgttaa

SEQ ID NO: 7254056 - DNA, 22 bp, Homo sapiens
ttgctgagtgaccaataaatat

SEQ ID NO: 7254057 - DNA, 22 bp, Homo sapiens
ttcttaaagaggcaaaacacag

SEQ ID NO: 7254058 - DNA, 22 bp, Homo sapiens
ttctgaaaccttcagtatgaag

SEQ ID NO: 7254059 - DNA, 22 bp, Homo sapiens
ctcactgcaagctccacctctt

SEQ ID NO: 7254060 - DNA, 22 bp, Homo sapiens
ttgaatctctctgagattcagt

SEQ ID NO: 7254061 - DNA, 22 bp, Homo sapiens
ttgaatcattacaatagataag

SEQ ID NO: 7254062 - DNA, 22 bp, Homo sapiens
ctcactgcaagttccacctacc

SEQ ID NO: 7254063 - DNA, 22 bp, Homo sapiens
ttcttcccttcattccaccacc

SEQ ID NO: 7254064 - DNA, 22 bp, Homo sapiens
ttcttcccagccagcacagccc

SEQ ID NO: 7254065 - DNA, 21 bp, Homo sapiens
tgcacagcaaaagttgagtaa

SEQ ID NO: 7254066 - DNA, 22 bp, Homo sapiens
cccaagggatgcttgagtagtt

SEQ ID NO: 7254067 - DNA, 22 bp, Homo sapiens
cccaaggggtgttgatggagga

SEQ ID NO: 7254068 - DNA, 22 bp, Homo sapiens
tgcacagatctggtggcaagga

SEQ ID NO: 7254069 - DNA, 22 bp, Homo sapiens
cccaagccagaccctgaccctg

SEQ ID NO: 7254070 - DNA, 19 bp, Homo sapiens
tgcaagtgtcttggacaag

SEQ ID NO: 7254071 - DNA, 22 bp, Homo sapiens
tgataatattttgaatcataag

SEQ ID NO: 7254072 - DNA, 22 bp, Homo sapiens
tgcagagacttgtgtgcatttg

SEQ ID NO: 7254073 - DNA, 22 bp, Homo sapiens
tgcagagacttgtgtgcatttg

SEQ ID NO: 7254074 - DNA, 17 bp, Homo sapiens
cccagagatgctgcctt

SEQ ID NO: 7254075 - DNA, 23 bp, Homo sapiens
cccagaggagcagggcgtgagat

SEQ ID NO: 7254076 - DNA, 22 bp, Homo sapiens
tgcagggccgctggaggtcatg

SEQ ID NO: 7254077 - DNA, 22 bp, Homo sapiens
cccagcagcttgcacagtgctg

SEQ ID NO: 7254078 - DNA, 22 bp, Homo sapiens
tgcaggcattggtgagagaagc

SEQ ID NO: 7254079 - DNA, 22 bp, Homo sapiens
tgcaggcataaccgatgttgat

SEQ ID NO: 7254080 - DNA, 22 bp, Homo sapiens
tgcaggcaggggatgagcagcc

SEQ ID NO: 7254081 - DNA, 21 bp, Homo sapiens
tgcaggcaggcagagatgctg

SEQ ID NO: 7254082 - DNA, 19 bp, Homo sapiens
tgcagccacgtgagagact

SEQ ID NO: 7254083 - DNA, 22 bp, Homo sapiens
tgcagctgcaagtccaggtcag

SEQ ID NO: 7254084 - DNA, 22 bp, Homo sapiens
cccagaggggtcgtctgagggg

SEQ ID NO: 7254085 - DNA, 22 bp, Homo sapiens
cccagagggaagggaatgaggt

SEQ ID NO: 7254086 - DNA, 22 bp, Homo sapiens
tgcaggacagtttggaagagag

SEQ ID NO: 7254087 - DNA, 23 bp, Homo sapiens
tgcaggactcaagaaagaaaggc

SEQ ID NO: 7254088 - DNA, 17 bp, Homo sapiens
ccaggtgggaggtgggg

SEQ ID NO: 7254089 - DNA, 22 bp, Homo sapiens
ccaggtgggaggaaagcagaga

SEQ ID NO: 7254090 - DNA, 22 bp, Homo sapiens
ccaggtggataaggtttctgga

SEQ ID NO: 7254091 - DNA, 22 bp, Homo sapiens
ccaggtggaggtgtgaggtcct

SEQ ID NO: 7254092 - DNA, 22 bp, Homo sapiens
ccagggctgcctggccgtgtgt

SEQ ID NO: 7254093 - DNA, 22 bp, Homo sapiens
ccagggctgctgggggagttga

SEQ ID NO: 7254094 - DNA, 22 bp, Homo sapiens
ccagggctgctgtgggactcca

SEQ ID NO: 7254095 - DNA, 18 bp, Homo sapiens
tgagcaggggctgacctt

SEQ ID NO: 7254096 - DNA, 22 bp, Homo sapiens
tgagcaggtcaagactccagct

SEQ ID NO: 7254097 - DNA, 22 bp, Homo sapiens
tgagcaggtcaagactccagct

SEQ ID NO: 7254098 - DNA, 18 bp, Homo sapiens
tgagcaggggctgacctt

SEQ ID NO: 7254099 - DNA, 22 bp, Homo sapiens
tgagcaggtgagtctagggcag

SEQ ID NO: 7254100 - DNA, 22 bp, Homo sapiens
tgagcagtaacagctcacaggg

SEQ ID NO: 7254101 - DNA, 22 bp, Homo sapiens
ccagtcccagctctgccatgct

SEQ ID NO: 7254102 - DNA, 22 bp, Homo sapiens
tgagcccagaagcccactcggc

SEQ ID NO: 7254103 - DNA, 22 bp, Homo sapiens
ccagtggagtttttatacccag

SEQ ID NO: 7254104 - DNA, 22 bp, Homo sapiens
ccagtggccatgcacgagcagc

SEQ ID NO: 7254105 - DNA, 22 bp, Homo sapiens
ccagtggaaatgtggtcaggat

SEQ ID NO: 7254106 - DNA, 22 bp, Homo sapiens
ccagtggaattaaaaataagtg

SEQ ID NO: 7254107 - DNA, 22 bp, Homo sapiens
ccagtggacaatttctgaggaa

SEQ ID NO: 7254108 - DNA, 22 bp, Homo sapiens
ccagtggacttctccctgtggt

SEQ ID NO: 7254109 - DNA, 22 bp, Homo sapiens
ccagtgcctgtgggcatggtgc

SEQ ID NO: 7254110 - DNA, 22 bp, Homo sapiens
ccagtgcccagctgcccaggca

SEQ ID NO: 7254111 - DNA, 22 bp, Homo sapiens
ccagtgcccagtctccctggtc

SEQ ID NO: 7254112 - DNA, 23 bp, Homo sapiens
ccatcaggcctccgtgtccagcc

SEQ ID NO: 7254113 - DNA, 18 bp, Homo sapiens
tgaggctgagggtagagg

SEQ ID NO: 7254114 - DNA, 22 bp, Homo sapiens
tgaggctgagatatcagggagg

SEQ ID NO: 7254115 - DNA, 22 bp, Homo sapiens
ccatagaactctgaggccagag

SEQ ID NO: 7254116 - DNA, 22 bp, Homo sapiens
ccatagaactctgaggccagag

SEQ ID NO: 7254117 - DNA, 22 bp, Homo sapiens
tgaggccatggtcttcccagtc

SEQ ID NO: 7254118 - DNA, 17 bp, Homo sapiens
tgaggccatggcaccat

SEQ ID NO: 7254119 - DNA, 17 bp, Homo sapiens
tgaggccatggcaccat

SEQ ID NO: 7254120 - DNA, 22 bp, Homo sapiens
tgaggcccagccgccctgagag

SEQ ID NO: 7254121 - DNA, 22 bp, Homo sapiens
tgaggctgacaaaagatgaggt

SEQ ID NO: 7254122 - DNA, 22 bp, Homo sapiens
ccatcctgaatggtctcagcca

SEQ ID NO: 7254123 - DNA, 22 bp, Homo sapiens
ccatccctcctactcacagtca

SEQ ID NO: 7254124 - DNA, 22 bp, Homo sapiens
ccatccctgagtcacaggaggg

SEQ ID NO: 7254125 - DNA, 21 bp, Homo sapiens
tgagtctctcagcttcaggta

SEQ ID NO: 7254126 - DNA, 22 bp, Homo sapiens
tgaaggtgtttatacctcagat

SEQ ID NO: 7254127 - DNA, 22 bp, Homo sapiens
tgaagtgattagaaccacttga

SEQ ID NO: 7254128 - DNA, 22 bp, Homo sapiens
tgaagtgagtagtgtctagggg

SEQ ID NO: 7254129 - DNA, 22 bp, Homo sapiens
tgaagtgacctggggcagtgta

SEQ ID NO: 7254130 - DNA, 22 bp, Homo sapiens
tgaagtgacctggggcagtgta

SEQ ID NO: 7254131 - DNA, 22 bp, Homo sapiens
tgaagtgaagaagcatgaatag

SEQ ID NO: 7254132 - DNA, 23 bp, Homo sapiens
tgaagtgaaatttcacaagggac

SEQ ID NO: 7254133 - DNA, 23 bp, Homo sapiens
tgaagtgaaatttcacaagggac

SEQ ID NO: 7254134 - DNA, 22 bp, Homo sapiens
ccagggctgagctgtgaccatg

SEQ ID NO: 7254135 - DNA, 22 bp, Homo sapiens
ccagggctccattgctcatcct

SEQ ID NO: 7254136 - DNA, 17 bp, Homo sapiens
tgaagttaggctgcaga

SEQ ID NO: 7254137 - DNA, 23 bp, Homo sapiens
ccagggcccctacaccactgtcc

SEQ ID NO: 7254138 - DNA, 22 bp, Homo sapiens
tgaaatgagatagataatcagg

SEQ ID NO: 7254139 - DNA, 22 bp, Homo sapiens
ccagggagggtcctgtggcttc

SEQ ID NO: 7254140 - DNA, 22 bp, Homo sapiens
tcttttgtgaggacaaggtacg

SEQ ID NO: 7254141 - DNA, 22 bp, Homo sapiens
tcttttcttcttaatggttaat

SEQ ID NO: 7254142 - DNA, 22 bp, Homo sapiens
tcttttgtgattctttagttac

SEQ ID NO: 7254143 - DNA, 22 bp, Homo sapiens
tgaaacaattagaatgtaatga

SEQ ID NO: 7254144 - DNA, 22 bp, Homo sapiens
tgaaacaattagaatgtaatga

SEQ ID NO: 7254145 - DNA, 22 bp, Homo sapiens
ccaggctgtaagagtgatgttg

SEQ ID NO: 7254146 - DNA, 20 bp, Homo sapiens
tctgttattgcatgtacata

SEQ ID NO: 7254147 - DNA, 22 bp, Homo sapiens
tctgggccggagccgacggcag

SEQ ID NO: 7254148 - DNA, 22 bp, Homo sapiens
tctgggccgctgcgttccatga

SEQ ID NO: 7254149 - DNA, 22 bp, Homo sapiens
tctgggccctgagatgttcttc

SEQ ID NO: 7254150 - DNA, 22 bp, Homo sapiens
tctgggcctatagaagtctacc

SEQ ID NO: 7254151 - DNA, 22 bp, Homo sapiens
tctgggccggagccgacggcag

SEQ ID NO: 7254152 - DNA, 22 bp, Homo sapiens
tctgggcctcacctgctgctca

SEQ ID NO: 7254153 - DNA, 22 bp, Homo sapiens
ccagcactctgtcccagcttcc

SEQ ID NO: 7254154 - DNA, 22 bp, Homo sapiens
tctgggaggctgggtcccgtcc

SEQ ID NO: 7254155 - DNA, 22 bp, Homo sapiens
tctgggagggagcctcagaatc

SEQ ID NO: 7254156 - DNA, 22 bp, Homo sapiens
tctgggcctgatggctaaagcc

SEQ ID NO: 7254157 - DNA, 22 bp, Homo sapiens
tctgggcctcagtttcttcatc

SEQ ID NO: 7254158 - DNA, 22 bp, Homo sapiens
tctgggcctgtctcagagctgg

SEQ ID NO: 7254159 - DNA, 22 bp, Homo sapiens
tctgggccttggagtggggaga

SEQ ID NO: 7254160 - DNA, 22 bp, Homo sapiens
ccaggcctcccttttccagcca

SEQ ID NO: 7254161 - DNA, 22 bp, Homo sapiens
ccaggcaggcgatggtgcagtg

SEQ ID NO: 7254162 - DNA, 22 bp, Homo sapiens
tcttctctcatgtaggagggaa

SEQ ID NO: 7254163 - DNA, 22 bp, Homo sapiens
tcttctctcctgcttggcagaa

SEQ ID NO: 7254164 - DNA, 22 bp, Homo sapiens
tcttagaagtttatggcacgga

SEQ ID NO: 7254165 - DNA, 22 bp, Homo sapiens
tcttctctgtggcctggtggtg

SEQ ID NO: 7254166 - DNA, 17 bp, Homo sapiens
tcttctcttccagtctt

SEQ ID NO: 7254167 - DNA, 19 bp, Homo sapiens
tcttctgacttgagaaaga

SEQ ID NO: 7254168 - DNA, 22 bp, Homo sapiens
tcttacagaaaatagataacat

SEQ ID NO: 7254169 - DNA, 22 bp, Homo sapiens
ccaggaggctctgactggaccc

SEQ ID NO: 7254170 - DNA, 22 bp, Homo sapiens
cctgcctgcaccttctctgggg

SEQ ID NO: 7254171 - DNA, 22 bp, Homo sapiens
tggtgggacatctgaggagagg

SEQ ID NO: 7254172 - DNA, 22 bp, Homo sapiens
cctgcctcaggactctgcatat

SEQ ID NO: 7254173 - DNA, 22 bp, Homo sapiens
cctgccctgtgtttggggacta

SEQ ID NO: 7254174 - DNA, 22 bp, Homo sapiens
cctgcccttctttccccagcat

SEQ ID NO: 7254175 - DNA, 22 bp, Homo sapiens
cctgcccttctttccccagcat

SEQ ID NO: 7254176 - DNA, 22 bp, Homo sapiens
cctgccctgtcactggctaggg

SEQ ID NO: 7254177 - DNA, 17 bp, Homo sapiens
tggtacaggctgaggga

SEQ ID NO: 7254178 - DNA, 22 bp, Homo sapiens
tgggtgggagcaccctgtctgg

SEQ ID NO: 7254179 - DNA, 22 bp, Homo sapiens
tgggtgggagcaccctgtctgg

SEQ ID NO: 7254180 - DNA, 22 bp, Homo sapiens
tgggtggcacttctggggtcca

SEQ ID NO: 7254181 - DNA, 22 bp, Homo sapiens
tgggtggattaggatagggtat

SEQ ID NO: 7254182 - DNA, 22 bp, Homo sapiens
tgggtggagaagtggacctgct

SEQ ID NO: 7254183 - DNA, 22 bp, Homo sapiens
tgggtggagctccacaacctgt

SEQ ID NO: 7254184 - DNA, 22 bp, Homo sapiens
tgggtggagaagtggacctgct

SEQ ID NO: 7254185 - DNA, 22 bp, Homo sapiens
tgggtggaataaatcagttctg

SEQ ID NO: 7254186 - DNA, 22 bp, Homo sapiens
cctgcagggtgctgccacagat

SEQ ID NO: 7254187 - DNA, 22 bp, Homo sapiens
cctgcagggtgctgccacagat

SEQ ID NO: 7254188 - DNA, 22 bp, Homo sapiens
cctgcagggaatcgaggcagaa

SEQ ID NO: 7254189 - DNA, 22 bp, Homo sapiens
tgggtcagtttgggggccagcc

SEQ ID NO: 7254190 - DNA, 22 bp, Homo sapiens
cctgcaggtttcccccggacgg

SEQ ID NO: 7254191 - DNA, 22 bp, Homo sapiens
tgggcaggagagaagctaaaga

SEQ ID NO: 7254192 - DNA, 22 bp, Homo sapiens
tgggcaggatgcgttgattctt

SEQ ID NO: 7254193 - DNA, 22 bp, Homo sapiens
tgggcaggataatatctcatgt

SEQ ID NO: 7254194 - DNA, 22 bp, Homo sapiens
tgggcctggagccctggagagt

SEQ ID NO: 7254195 - DNA, 22 bp, Homo sapiens
tgggccgggcactgtactgggc

SEQ ID NO: 7254196 - DNA, 22 bp, Homo sapiens
tgggcaggcaagtgaatacctt

SEQ ID NO: 7254197 - DNA, 23 bp, Homo sapiens
tgggcctggcctcccagtccagc

SEQ ID NO: 7254198 - DNA, 22 bp, Homo sapiens
tgggcctgggagggcagacgct

SEQ ID NO: 7254199 - DNA, 22 bp, Homo sapiens
tgggctcatgctggagatgaga

SEQ ID NO: 7254200 - DNA, 22 bp, Homo sapiens
tgggctcatggcccagcactgg

SEQ ID NO: 7254201 - DNA, 22 bp, Homo sapiens
tgggctcatggcccagcactgg

SEQ ID NO: 7254202 - DNA, 22 bp, Homo sapiens
tgggctcatgtttatacatatc

SEQ ID NO: 7254203 - DNA, 19 bp, Homo sapiens
tgggctcattcaggtggtt

SEQ ID NO: 7254204 - DNA, 22 bp, Homo sapiens
tgggctccgttgcctggggcag

SEQ ID NO: 7254205 - DNA, 22 bp, Homo sapiens
tgggctccggcggcctcaggct

SEQ ID NO: 7254206 - DNA, 22 bp, Homo sapiens
tgggctccagcacctgtgctct

SEQ ID NO: 7254207 - DNA, 22 bp, Homo sapiens
cctgataacacagatacaagat

SEQ ID NO: 7254208 - DNA, 22 bp, Homo sapiens
cctgataaaccctggaatttgt

SEQ ID NO: 7254209 - DNA, 22 bp, Homo sapiens
cctgataatattgacctacaga

SEQ ID NO: 7254210 - DNA, 22 bp, Homo sapiens
cctgataatgtaattgttaaat

SEQ ID NO: 7254211 - DNA, 22 bp, Homo sapiens
tggggagactggccgagatcct

SEQ ID NO: 7254212 - DNA, 23 bp, Homo sapiens
tggggagagttaccctggaagcg

SEQ ID NO: 7254213 - DNA, 22 bp, Homo sapiens
tggggagagttacaaggaatct

SEQ ID NO: 7254214 - DNA, 22 bp, Homo sapiens
tggggagcccactcacctcccc

SEQ ID NO: 7254215 - DNA, 22 bp, Homo sapiens
tggggagagattgaggagtttt

SEQ ID NO: 7254216 - DNA, 22 bp, Homo sapiens
tggggagaggtatcattgagat

SEQ ID NO: 7254217 - DNA, 22 bp, Homo sapiens
tggggagaggtatcattgagat

SEQ ID NO: 7254218 - DNA, 22 bp, Homo sapiens
tggggagagattgaggagtttt

SEQ ID NO: 7254219 - DNA, 22 bp, Homo sapiens
tggggagagaccggaatgtttc

SEQ ID NO: 7254220 - DNA, 23 bp, Homo sapiens
cctgcagctgctggggctccacc

SEQ ID NO: 7254221 - DNA, 22 bp, Homo sapiens
tggcagtggctttgctggtgga

SEQ ID NO: 7254222 - DNA, 22 bp, Homo sapiens
cctcctgggactcattagcacc

SEQ ID NO: 7254223 - DNA, 22 bp, Homo sapiens
cctcctctggtgctgccaaccc

SEQ ID NO: 7254224 - DNA, 22 bp, Homo sapiens
cctcccaccatttagagagagc

SEQ ID NO: 7254225 - DNA, 22 bp, Homo sapiens
cctccagtactccagtccagcg

SEQ ID NO: 7254226 - DNA, 22 bp, Homo sapiens
tgggaaggcgtggaagtagaag

SEQ ID NO: 7254227 - DNA, 22 bp, Homo sapiens
cctctcccagggagagcctgag

SEQ ID NO: 7254228 - DNA, 22 bp, Homo sapiens
cctctccagcggcctcagggcc

SEQ ID NO: 7254229 - DNA, 22 bp, Homo sapiens
cctcctggtaattagcgaaagg

SEQ ID NO: 7254230 - DNA, 22 bp, Homo sapiens
tgggagagcagagaaccctctt

SEQ ID NO: 7254231 - DNA, 22 bp, Homo sapiens
tgggagagcactgcagccccgg

SEQ ID NO: 7254232 - DNA, 22 bp, Homo sapiens
tgggagagcactgcagccccgg

SEQ ID NO: 7254233 - DNA, 22 bp, Homo sapiens
tgggcactgtagctggtgctgg

SEQ ID NO: 7254234 - DNA, 22 bp, Homo sapiens
tgggcagactaaggtcaaagct

SEQ ID NO: 7254235 - DNA, 22 bp, Homo sapiens
tgggcagacgggagcttgcctt

SEQ ID NO: 7254236 - DNA, 22 bp, Homo sapiens
tgggcagacgctgttggaaggc

SEQ ID NO: 7254237 - DNA, 22 bp, Homo sapiens
tgggcagacattgagtttgttc

SEQ ID NO: 7254238 - DNA, 22 bp, Homo sapiens
tgggcagaattgtggtagttaa

SEQ ID NO: 7254239 - DNA, 22 bp, Homo sapiens
tgggcagaaatcagtatcagat

SEQ ID NO: 7254240 - DNA, 22 bp, Homo sapiens
tgggcagaatgtgggatccaga

SEQ ID NO: 7254241 - DNA, 22 bp, Homo sapiens
tgggcagaaggaagagccacct

SEQ ID NO: 7254242 - DNA, 22 bp, Homo sapiens
tgggacaggatgaccagaaggt

SEQ ID NO: 7254243 - DNA, 22 bp, Homo sapiens
tgggacaggaggcctctggaga

SEQ ID NO: 7254244 - DNA, 22 bp, Homo sapiens
tgggacaggaggcctctggaga

SEQ ID NO: 7254245 - DNA, 22 bp, Homo sapiens
tgggagagaattctggtgactg

SEQ ID NO: 7254246 - DNA, 22 bp, Homo sapiens
tgggagagaataatcaataggt

SEQ ID NO: 7254247 - DNA, 22 bp, Homo sapiens
tgggagagaattctggtgactg

SEQ ID NO: 7254248 - DNA, 22 bp, Homo sapiens
tgggagagaattctggtgactg

SEQ ID NO: 7254249 - DNA, 22 bp, Homo sapiens
tgggagagataggcttctggac

SEQ ID NO: 7254250 - DNA, 22 bp, Homo sapiens
tgggagagagaattcccagtgg

SEQ ID NO: 7254251 - DNA, 22 bp, Homo sapiens
tgcagggctaagtcagagcctg

SEQ ID NO: 7254252 - DNA, 21 bp, Homo sapiens
tgctacattgctggttatgtt

SEQ ID NO: 7254253 - DNA, 22 bp, Homo sapiens
tgctacattatatggcaaagga

SEQ ID NO: 7254254 - DNA, 22 bp, Homo sapiens
tgctacatgcactgtgatctag

SEQ ID NO: 7254255 - DNA, 22 bp, Homo sapiens
tgctacataggatagctcaaat

SEQ ID NO: 7254256 - DNA, 22 bp, Homo sapiens
tgctacataccacgatgcagta

SEQ ID NO: 7254257 - DNA, 22 bp, Homo sapiens
tgctcaggaggaggctgtgagg

SEQ ID NO: 7254258 - DNA, 22 bp, Homo sapiens
tgctcaggccctgggccatcct

SEQ ID NO: 7254259 - DNA, 22 bp, Homo sapiens
tgctcagggacaatggagaggg

SEQ ID NO: 7254260 - DNA, 22 bp, Homo sapiens
tgctactcaattcacctgccac

SEQ ID NO: 7254261 - DNA, 22 bp, Homo sapiens
tgctagccaagcccatcccttt

SEQ ID NO: 7254262 - DNA, 22 bp, Homo sapiens
tgctctgcacatccctcacaaa

SEQ ID NO: 7254263 - DNA, 22 bp, Homo sapiens
cccagtccaaaagtaggttcta

SEQ ID NO: 7254264 - DNA, 22 bp, Homo sapiens
tgctcaggtgccttggctgctg

SEQ ID NO: 7254265 - DNA, 22 bp, Homo sapiens
tgctcagggagcttcctggtgg

SEQ ID NO: 7254266 - DNA, 22 bp, Homo sapiens
cccagtccagaccatgacctca

SEQ ID NO: 7254267 - DNA, 19 bp, Homo sapiens
cccagtccttgtcctgggc

SEQ ID NO: 7254268 - DNA, 22 bp, Homo sapiens
cccagtgccaggcacaggcagc

SEQ ID NO: 7254269 - DNA, 22 bp, Homo sapiens
tgctctgcaagcaggagcaaga

SEQ ID NO: 7254270 - DNA, 22 bp, Homo sapiens
cccagtggcaaagcagcttaga

SEQ ID NO: 7254271 - DNA, 22 bp, Homo sapiens
cccagtggaaggagtagaagac

SEQ ID NO: 7254272 - DNA, 22 bp, Homo sapiens
cccagtggagataggagtgtgg

SEQ ID NO: 7254273 - DNA, 18 bp, Homo sapiens
cccagtgctcactgcctc

SEQ ID NO: 7254274 - DNA, 22 bp, Homo sapiens
tgcttaaaaacagtatggtagt

SEQ ID NO: 7254275 - DNA, 22 bp, Homo sapiens
tgctgggcactgtctaggtact

SEQ ID NO: 7254276 - DNA, 22 bp, Homo sapiens
tgctgggcaccagtgcctgcag

SEQ ID NO: 7254277 - DNA, 22 bp, Homo sapiens
tgctgctcaatgagatgccatc

SEQ ID NO: 7254278 - DNA, 22 bp, Homo sapiens
cccagtggtttgcagaaccaag

SEQ ID NO: 7254279 - DNA, 22 bp, Homo sapiens
tgctgggggttcagatgagtaa

SEQ ID NO: 7254280 - DNA, 18 bp, Homo sapiens
tgctggggtagaatccac

SEQ ID NO: 7254281 - DNA, 22 bp, Homo sapiens
tgctgggggtagctctgcgtag

SEQ ID NO: 7254282 - DNA, 22 bp, Homo sapiens
tgctgggggtgtctcaccaggc

SEQ ID NO: 7254283 - DNA, 22 bp, Homo sapiens
tgctgggggctttctggatacc

SEQ ID NO: 7254284 - DNA, 22 bp, Homo sapiens
tgctggggctctgaccactcca

SEQ ID NO: 7254285 - DNA, 22 bp, Homo sapiens
tgctgggggctttctggatacc

SEQ ID NO: 7254286 - DNA, 22 bp, Homo sapiens
tggcaggtagtcagaggcgaca

SEQ ID NO: 7254287 - DNA, 22 bp, Homo sapiens
tggcagggagccaccggtcatg

SEQ ID NO: 7254288 - DNA, 22 bp, Homo sapiens
cccttgctgccacagctgccca

SEQ ID NO: 7254289 - DNA, 19 bp, Homo sapiens
tggcagggagagtttgaag

SEQ ID NO: 7254290 - DNA, 22 bp, Homo sapiens
tggcagggaatacagatgttta

SEQ ID NO: 7254291 - DNA, 22 bp, Homo sapiens
ccctgggacccgctgcagaggc

SEQ ID NO: 7254292 - DNA, 22 bp, Homo sapiens
ccctggagtgtgacgaggcatt

SEQ ID NO: 7254293 - DNA, 22 bp, Homo sapiens
ccctggagtgccggaatcaaga

SEQ ID NO: 7254294 - DNA, 22 bp, Homo sapiens
ccctggagtccggagctcacct

SEQ ID NO: 7254295 - DNA, 22 bp, Homo sapiens
ccctggagtagcactgggtcgc

SEQ ID NO: 7254296 - DNA, 22 bp, Homo sapiens
ccctggagggcagacagatgcc

SEQ ID NO: 7254297 - DNA, 22 bp, Homo sapiens
ccctggaggtggaggttgcagg

SEQ ID NO: 7254298 - DNA, 22 bp, Homo sapiens
ccctggaggttgaggctgcagt

SEQ ID NO: 7254299 - DNA, 22 bp, Homo sapiens
tggcacttggctgagaggttct

SEQ ID NO: 7254300 - DNA, 22 bp, Homo sapiens
tggcacttgatatttgatttgc

SEQ ID NO: 7254301 - DNA, 22 bp, Homo sapiens
tggagaattctatgttgagggg

SEQ ID NO: 7254302 - DNA, 22 bp, Homo sapiens
tggagacctctacccatctcct

SEQ ID NO: 7254303 - DNA, 22 bp, Homo sapiens
tggaggaaaattactggggtct

SEQ ID NO: 7254304 - DNA, 22 bp, Homo sapiens
tggagatgcacgagcaggtgga

SEQ ID NO: 7254305 - DNA, 22 bp, Homo sapiens
tggagatgggttaatggagaga

SEQ ID NO: 7254306 - DNA, 23 bp, Homo sapiens
tggaggaaacacatcagaagacc

SEQ ID NO: 7254307 - DNA, 22 bp, Homo sapiens
tggaggaagttgctggaagtca

SEQ ID NO: 7254308 - DNA, 22 bp, Homo sapiens
tggaggaagtggctggccagaa

SEQ ID NO: 7254309 - DNA, 21 bp, Homo sapiens
tggaggaataaagcacagaag

SEQ ID NO: 7254310 - DNA, 22 bp, Homo sapiens
tggaggacaggactggacagcc

SEQ ID NO: 7254311 - DNA, 22 bp, Homo sapiens
ccctggaggaccccaatgtggc

SEQ ID NO: 7254312 - DNA, 22 bp, Homo sapiens
tggaggacgtgtccaccatgaa

SEQ ID NO: 7254313 - DNA, 22 bp, Homo sapiens
tggaggcagtttaagtctgaga

SEQ ID NO: 7254314 - DNA, 22 bp, Homo sapiens
tatgaagaagacaaatgacact

SEQ ID NO: 7254315 - DNA, 19 bp, Homo sapiens
tatgaagaatgtggcaaag

SEQ ID NO: 7254316 - DNA, 22 bp, Homo sapiens
tatgatgggaggaatggaattt

SEQ ID NO: 7254317 - DNA, 22 bp, Homo sapiens
tatgatattctaaattgacacc

SEQ ID NO: 7254318 - DNA, 22 bp, Homo sapiens
tatgatatgcactttatcagaa

SEQ ID NO: 7254319 - DNA, 22 bp, Homo sapiens
tatgcaaagtcctaagaaagaa

SEQ ID NO: 7254320 - DNA, 21 bp, Homo sapiens
tatgaacatgaccaatagtcc

SEQ ID NO: 7254321 - DNA, 22 bp, Homo sapiens
caggtgggctgcctctccagct

SEQ ID NO: 7254322 - DNA, 22 bp, Homo sapiens
caggtggggcgccctcaggcag

SEQ ID NO: 7254323 - DNA, 22 bp, Homo sapiens
caggtggggagagtgtggagca

SEQ ID NO: 7254324 - DNA, 22 bp, Homo sapiens
caggtggggcagctgtgggagc

SEQ ID NO: 7254325 - DNA, 22 bp, Homo sapiens
tatatacttttgtaagttggct

SEQ ID NO: 7254326 - DNA, 22 bp, Homo sapiens
tatatactttcttcctgggtag

SEQ ID NO: 7254327 - DNA, 22 bp, Homo sapiens
tatatactatgcgattcctgcc

SEQ ID NO: 7254328 - DNA, 18 bp, Homo sapiens
tatatagagaaacccatt

SEQ ID NO: 7254329 - DNA, 22 bp, Homo sapiens
tatataattttctgccatatcc

SEQ ID NO: 7254330 - DNA, 22 bp, Homo sapiens
tatataatttgtaaaagcacct

SEQ ID NO: 7254331 - DNA, 22 bp, Homo sapiens
tatataatttgtaaaagcacct

SEQ ID NO: 7254332 - DNA, 22 bp, Homo sapiens
tatataactactattttgctca

SEQ ID NO: 7254333 - DNA, 22 bp, Homo sapiens
tagtttctagacagtaagaatt

SEQ ID NO: 7254334 - DNA, 22 bp, Homo sapiens
tagtttctagtcaatcttcttt

SEQ ID NO: 7254335 - DNA, 22 bp, Homo sapiens
tagtttctagtaacaaacccat

SEQ ID NO: 7254336 - DNA, 22 bp, Homo sapiens
tagtttcttcacctgtaaaatg

SEQ ID NO: 7254337 - DNA, 22 bp, Homo sapiens
tagtttctggttcttgctctgg

SEQ ID NO: 7254338 - DNA, 22 bp, Homo sapiens
tagtttcttgattagccacttt

SEQ ID NO: 7254339 - DNA, 22 bp, Homo sapiens
tagtttctttcacgtagtaata

SEQ ID NO: 7254340 - DNA, 22 bp, Homo sapiens
tagtttctcagggaggaaagaa

SEQ ID NO: 7254341 - DNA, 22 bp, Homo sapiens
tagtttctgaggattgaaagat

SEQ ID NO: 7254342 - DNA, 22 bp, Homo sapiens
tagtttctgcctcggaagctga

SEQ ID NO: 7254343 - DNA, 22 bp, Homo sapiens
tagtttctgggttggcttctac

SEQ ID NO: 7254344 - DNA, 22 bp, Homo sapiens
tagtaaattaaaatattgactt

SEQ ID NO: 7254345 - DNA, 22 bp, Homo sapiens
cagggccaagctgcagcatctg

SEQ ID NO: 7254346 - DNA, 22 bp, Homo sapiens
cagggctggatttcatttctag

SEQ ID NO: 7254347 - DNA, 22 bp, Homo sapiens
cagggctgagaatttagagaca

SEQ ID NO: 7254348 - DNA, 22 bp, Homo sapiens
cagggctgaggacacaagtaaa

SEQ ID NO: 7254349 - DNA, 22 bp, Homo sapiens
cagtggcagagaacagagacct

SEQ ID NO: 7254350 - DNA, 22 bp, Homo sapiens
cagtggcacccacgggctgggc

SEQ ID NO: 7254351 - DNA, 19 bp, Homo sapiens
tcactctccctgtctgtcc

SEQ ID NO: 7254352 - DNA, 22 bp, Homo sapiens
cagtggcaatgggacagagcac

SEQ ID NO: 7254353 - DNA, 22 bp, Homo sapiens
cagtggattagccagagctgga

SEQ ID NO: 7254354 - DNA, 22 bp, Homo sapiens
cagtggaggctcaagtgtgctt

SEQ ID NO: 7254355 - DNA, 22 bp, Homo sapiens
cagtggaggccttgggaccttt

SEQ ID NO: 7254356 - DNA, 22 bp, Homo sapiens
cagtggagtgggactggtctga

SEQ ID NO: 7254357 - DNA, 19 bp, Homo sapiens
cagtggagattggaggagg

SEQ ID NO: 7254358 - DNA, 19 bp, Homo sapiens
cagtggagattggaggagg

SEQ ID NO: 7254359 - DNA, 17 bp, Homo sapiens
cagtgcagataagtgag

SEQ ID NO: 7254360 - DNA, 22 bp, Homo sapiens
cagtgcaggtttagggctgggg

SEQ ID NO: 7254361 - DNA, 22 bp, Homo sapiens
cagtgcagtcaaggaagaacca

SEQ ID NO: 7254362 - DNA, 22 bp, Homo sapiens
cagtgcagttggtggcaggggt

SEQ ID NO: 7254363 - DNA, 22 bp, Homo sapiens
cagtgcagtttcccagatgctg

SEQ ID NO: 7254364 - DNA, 22 bp, Homo sapiens
tcaaattagtggaataataatg

SEQ ID NO: 7254365 - DNA, 22 bp, Homo sapiens
tattccaacttcactattgtct

SEQ ID NO: 7254366 - DNA, 23 bp, Homo sapiens
tcaaaggaggcatcgttctgcag

SEQ ID NO: 7254367 - DNA, 22 bp, Homo sapiens
tcaaaggagtttaagttactgg

SEQ ID NO: 7254368 - DNA, 22 bp, Homo sapiens
tcaaaggcggtccaggaataaa

SEQ ID NO: 7254369 - DNA, 22 bp, Homo sapiens
tcaaaggataactgagggcagt

SEQ ID NO: 7254370 - DNA, 22 bp, Homo sapiens
tcaaaggcattgccaataagta

SEQ ID NO: 7254371 - DNA, 22 bp, Homo sapiens
tcaaaggaaacgtggtcctggc

SEQ ID NO: 7254372 - DNA, 22 bp, Homo sapiens
tagcatagtttggaaatgcagg

SEQ ID NO: 7254373 - DNA, 22 bp, Homo sapiens
tagcataacaggtaagagtgag

SEQ ID NO: 7254374 - DNA, 22 bp, Homo sapiens
cagggcagtttgtgcctatgag

SEQ ID NO: 7254375 - DNA, 22 bp, Homo sapiens
cagggatggcctggcgggccac

SEQ ID NO: 7254376 - DNA, 22 bp, Homo sapiens
cagggatgagagatggcacaga

SEQ ID NO: 7254377 - DNA, 22 bp, Homo sapiens
cagggatgagcagatggagcaa

SEQ ID NO: 7254378 - DNA, 22 bp, Homo sapiens
cagggatgagcagatggagcaa

SEQ ID NO: 7254379 - DNA, 22 bp, Homo sapiens
cagggatgctgcttaggcagtt

SEQ ID NO: 7254380 - DNA, 22 bp, Homo sapiens
cagggatgaccagagggatgtg

SEQ ID NO: 7254381 - DNA, 22 bp, Homo sapiens
cagggaggctgtcttatgcctg

SEQ ID NO: 7254382 - DNA, 22 bp, Homo sapiens
cagggagggacaattgtcacct

SEQ ID NO: 7254383 - DNA, 22 bp, Homo sapiens
cagggagggaggaaaatttgct

SEQ ID NO: 7254384 - DNA, 22 bp, Homo sapiens
cagggaggatgggctgttttgc

SEQ ID NO: 7254385 - DNA, 23 bp, Homo sapiens
cagggaggagatactgtgtatct

SEQ ID NO: 7254386 - DNA, 22 bp, Homo sapiens
cagggagctttcccaggaccct

SEQ ID NO: 7254387 - DNA, 22 bp, Homo sapiens
tagaaagcaaaatcctaccaag

SEQ ID NO: 7254388 - DNA, 22 bp, Homo sapiens
tagaaagcagaaaccatcagag

SEQ ID NO: 7254389 - DNA, 22 bp, Homo sapiens
tagaaacaagggagaggattct

SEQ ID NO: 7254390 - DNA, 22 bp, Homo sapiens
tagaaagacaatgggaagtgct

SEQ ID NO: 7254391 - DNA, 22 bp, Homo sapiens
caggctgcagcagcagtggccc

SEQ ID NO: 7254392 - DNA, 22 bp, Homo sapiens
tagaacagcatttggctattaa

SEQ ID NO: 7254393 - DNA, 22 bp, Homo sapiens
cagggacagccttggggtggcg

SEQ ID NO: 7254394 - DNA, 22 bp, Homo sapiens
tagaacagtataggctaaacat

SEQ ID NO: 7254395 - DNA, 22 bp, Homo sapiens
cagggagaaatctccaggaggt

SEQ ID NO: 7254396 - DNA, 22 bp, Homo sapiens
tagaaagcagtatctccatttt

SEQ ID NO: 7254397 - DNA, 22 bp, Homo sapiens
tagaaagcagttgtgggggctc

SEQ ID NO: 7254398 - DNA, 22 bp, Homo sapiens
tagaaagcatgcaagtttgatg

SEQ ID NO: 7254399 - DNA, 22 bp, Homo sapiens
tagaacaatgaatttctggagg

SEQ ID NO: 7254400 - DNA, 22 bp, Homo sapiens
tagacatttctggttattgaca

SEQ ID NO: 7254401 - DNA, 22 bp, Homo sapiens
cagggagaggctggtggagtaa

SEQ ID NO: 7254402 - DNA, 22 bp, Homo sapiens
cagggagaggcatcatagggaa

SEQ ID NO: 7254403 - DNA, 22 bp, Homo sapiens
cagggagaggcatcatagggaa

SEQ ID NO: 7254404 - DNA, 22 bp, Homo sapiens
cagggagaggcatcatagggaa

SEQ ID NO: 7254405 - DNA, 22 bp, Homo sapiens
cagggagaagtctggtcagtcc

SEQ ID NO: 7254406 - DNA, 22 bp, Homo sapiens
tacagagaactcatagaaagaa

SEQ ID NO: 7254407 - DNA, 22 bp, Homo sapiens
tacagagaataataggacaggt

SEQ ID NO: 7254408 - DNA, 22 bp, Homo sapiens
tacagagaataataggacaggt

SEQ ID NO: 7254409 - DNA, 22 bp, Homo sapiens
tacagagaactcatagaaagaa

SEQ ID NO: 7254410 - DNA, 22 bp, Homo sapiens
tacagagaactcatagaaagaa

SEQ ID NO: 7254411 - DNA, 22 bp, Homo sapiens
tacactttgtgatgccgggagc

SEQ ID NO: 7254412 - DNA, 22 bp, Homo sapiens
tacactggccaaatgcctttgg

SEQ ID NO: 7254413 - DNA, 22 bp, Homo sapiens
caggccctcgcccgcagcgacc

SEQ ID NO: 7254414 - DNA, 22 bp, Homo sapiens
caggccctcctgtgatctgcct

SEQ ID NO: 7254415 - DNA, 22 bp, Homo sapiens
caggccctcgtggtgagctggg

SEQ ID NO: 7254416 - DNA, 22 bp, Homo sapiens
caggccccattcctcttgggac

SEQ ID NO: 7254417 - DNA, 22 bp, Homo sapiens
tacacagatatgtgatcaatca

SEQ ID NO: 7254418 - DNA, 22 bp, Homo sapiens
gtggagaggaacccagctctgt

SEQ ID NO: 7254419 - DNA, 22 bp, Homo sapiens
cagctctgcctctggggctgag

SEQ ID NO: 7254420 - DNA, 22 bp, Homo sapiens
cagctctgccacttcctagcta

SEQ ID NO: 7254421 - DNA, 22 bp, Homo sapiens
gtggagcaggactagctgagaa

SEQ ID NO: 7254422 - DNA, 22 bp, Homo sapiens
gtggagcaatcagagggtcagt

SEQ ID NO: 7254423 - DNA, 20 bp, Homo sapiens
gtggagaggctggcgggact

SEQ ID NO: 7254424 - DNA, 20 bp, Homo sapiens
gtggagaggctggcgggact

SEQ ID NO: 7254425 - DNA, 22 bp, Homo sapiens
gtggagcaatcagagggtcagt

SEQ ID NO: 7254426 - DNA, 22 bp, Homo sapiens
caggctcccgctccactgggca

SEQ ID NO: 7254427 - DNA, 22 bp, Homo sapiens
tacagtttgtatggtcaggaat

SEQ ID NO: 7254428 - DNA, 22 bp, Homo sapiens
tacagtttcccagcagatgcaa

SEQ ID NO: 7254429 - DNA, 22 bp, Homo sapiens
tacagtttacatgagaggaagc

SEQ ID NO: 7254430 - DNA, 22 bp, Homo sapiens
caggctcggaagtgctggcttt

SEQ ID NO: 7254431 - DNA, 17 bp, Homo sapiens
caggccttgagccttta

SEQ ID NO: 7254432 - DNA, 22 bp, Homo sapiens
caggcctgtgagttgaggcccc

SEQ ID NO: 7254433 - DNA, 22 bp, Homo sapiens
tacagagagataagtgtaaaag

SEQ ID NO: 7254434 - DNA, 22 bp, Homo sapiens
tacagagagaggggttaccagg

SEQ ID NO: 7254435 - DNA, 22 bp, Homo sapiens
tacagagactttatggcacaaa

SEQ ID NO: 7254436 - DNA, 22 bp, Homo sapiens
tacagagacccacaagagactg

SEQ ID NO: 7254437 - DNA, 22 bp, Homo sapiens
tacagagaggtgacccttgggc

SEQ ID NO: 7254438 - DNA, 22 bp, Homo sapiens
tacagagagctccggacattca

SEQ ID NO: 7254439 - DNA, 20 bp, Homo sapiens
tacagagagctagctctctg

SEQ ID NO: 7254440 - DNA, 22 bp, Homo sapiens
tacagcatgtccttagcaaggc

SEQ ID NO: 7254441 - DNA, 22 bp, Homo sapiens
tcctggcctgtctggagtagct

SEQ ID NO: 7254442 - DNA, 22 bp, Homo sapiens
tcctggccttagcgaggcggtc

SEQ ID NO: 7254443 - DNA, 22 bp, Homo sapiens
ccacaggggcccacgagccgct

SEQ ID NO: 7254444 - DNA, 22 bp, Homo sapiens
ccacagggcctttcctgctggc

SEQ ID NO: 7254445 - DNA, 22 bp, Homo sapiens
ccacagggctctaggcgcttcc

SEQ ID NO: 7254446 - DNA, 21 bp, Homo sapiens
ccacaggggctcccctgtcag

SEQ ID NO: 7254447 - DNA, 17 bp, Homo sapiens
tcctggcctggtgtgtg

SEQ ID NO: 7254448 - DNA, 22 bp, Homo sapiens
ccacagggactgttaaaaccct

SEQ ID NO: 7254449 - DNA, 22 bp, Homo sapiens
ccacagggaacatgacagcctt

SEQ ID NO: 7254450 - DNA, 20 bp, Homo sapiens
tcctggagctgcttgaattc

SEQ ID NO: 7254451 - DNA, 22 bp, Homo sapiens
tcctggagcctcattcaaacac

SEQ ID NO: 7254452 - DNA, 22 bp, Homo sapiens
ccaagaatgataggtgtgagca

SEQ ID NO: 7254453 - DNA, 22 bp, Homo sapiens
ccaacaggttgagagtctgaat

SEQ ID NO: 7254454 - DNA, 19 bp, Homo sapiens
tcctgcccaccagccaggg

SEQ ID NO: 7254455 - DNA, 22 bp, Homo sapiens
catttgtgtgggaacccatcag

SEQ ID NO: 7254456 - DNA, 22 bp, Homo sapiens
catttctagggatcataaagta

SEQ ID NO: 7254457 - DNA, 19 bp, Homo sapiens
cattttaagcatccccagt

SEQ ID NO: 7254458 - DNA, 22 bp, Homo sapiens
tcctgagggactggttcctcgc

SEQ ID NO: 7254459 - DNA, 20 bp, Homo sapiens
tccagttttggagacattct

SEQ ID NO: 7254460 - DNA, 22 bp, Homo sapiens
tccagtttggttctgttctcca

SEQ ID NO: 7254461 - DNA, 22 bp, Homo sapiens
tccagtttctctcaatcaatta

SEQ ID NO: 7254462 - DNA, 22 bp, Homo sapiens
tccatatacaacttaatcttta

SEQ ID NO: 7254463 - DNA, 22 bp, Homo sapiens
tccatattaactaaaactagaa

SEQ ID NO: 7254464 - DNA, 22 bp, Homo sapiens
ccagagcctcgcccggagcctc

SEQ ID NO: 7254465 - DNA, 22 bp, Homo sapiens
ccagagcctcgcccggagcctc

SEQ ID NO: 7254466 - DNA, 22 bp, Homo sapiens
ccagagcctaagatctgatcct

SEQ ID NO: 7254467 - DNA, 22 bp, Homo sapiens
ccagagcctcaacacaggtcct

SEQ ID NO: 7254468 - DNA, 22 bp, Homo sapiens
ccagagggaagaggaagcgctg

SEQ ID NO: 7254469 - DNA, 22 bp, Homo sapiens
ccagagggaactgggcctcatt

SEQ ID NO: 7254470 - DNA, 22 bp, Homo sapiens
ccagagggcaaaatgaagctta

SEQ ID NO: 7254471 - DNA, 22 bp, Homo sapiens
ccagagggagccaccagggtgt

SEQ ID NO: 7254472 - DNA, 22 bp, Homo sapiens
ccagagccggctccctcagctt

SEQ ID NO: 7254473 - DNA, 22 bp, Homo sapiens
ccagagccggctccctcagctt

SEQ ID NO: 7254474 - DNA, 22 bp, Homo sapiens
ccagagcccgggacctggactt

SEQ ID NO: 7254475 - DNA, 22 bp, Homo sapiens
ccagagcccgggacctggactt

SEQ ID NO: 7254476 - DNA, 19 bp, Homo sapiens
ccagagcccgccagatggg

SEQ ID NO: 7254477 - DNA, 22 bp, Homo sapiens
ccagagcccctgagcttccctg

SEQ ID NO: 7254478 - DNA, 22 bp, Homo sapiens
ccagagcccagggtcatgcagg

SEQ ID NO: 7254479 - DNA, 22 bp, Homo sapiens
ccagagcccagggtcatgcagg

SEQ ID NO: 7254480 - DNA, 22 bp, Homo sapiens
ccagagccagagaggtgcctgc

SEQ ID NO: 7254481 - DNA, 22 bp, Homo sapiens
ccagagcagggcagcagggctc

SEQ ID NO: 7254482 - DNA, 22 bp, Homo sapiens
ccagagcagggcagcagggctc

SEQ ID NO: 7254483 - DNA, 22 bp, Homo sapiens
ccagagcagggcagcagggctc

SEQ ID NO: 7254484 - DNA, 18 bp, Homo sapiens
ccagagggtgcgtcagct

SEQ ID NO: 7254485 - DNA, 18 bp, Homo sapiens
ccagagggtgcgtcagct

SEQ ID NO: 7254486 - DNA, 20 bp, Homo sapiens
ccagagggtagggccgcccc

SEQ ID NO: 7254487 - DNA, 20 bp, Homo sapiens
ccagagggtagggccgcccc

SEQ ID NO: 7254488 - DNA, 22 bp, Homo sapiens
ccagaggggctgagcaggtcac

SEQ ID NO: 7254489 - DNA, 22 bp, Homo sapiens
ccagaggggctgagcaggtcac

SEQ ID NO: 7254490 - DNA, 22 bp, Homo sapiens
ccagaggggcacaaaagtagaa

SEQ ID NO: 7254491 - DNA, 22 bp, Homo sapiens
ccagagggcctttggagttatc

SEQ ID NO: 7254492 - DNA, 22 bp, Homo sapiens
ccagagggccctggtctcagct

SEQ ID NO: 7254493 - DNA, 22 bp, Homo sapiens
ccagagggccctggtctcagct

SEQ ID NO: 7254494 - DNA, 22 bp, Homo sapiens
tcctgtgttcaagtcattcatt

SEQ ID NO: 7254495 - DNA, 22 bp, Homo sapiens
tcctgtgttacccttgcagtga

SEQ ID NO: 7254496 - DNA, 22 bp, Homo sapiens
tctagaatagattctgctgatc

SEQ ID NO: 7254497 - DNA, 22 bp, Homo sapiens
tctagaatactgtgacatgcca

SEQ ID NO: 7254498 - DNA, 22 bp, Homo sapiens
tctagaaagccaaattaggaat

SEQ ID NO: 7254499 - DNA, 19 bp, Homo sapiens
ccacccctttgctgggccc

SEQ ID NO: 7254500 - DNA, 22 bp, Homo sapiens
ccacccctgggtgcagggagcg

SEQ ID NO: 7254501 - DNA, 22 bp, Homo sapiens
ccacccctgggtgcagggagcg

SEQ ID NO: 7254502 - DNA, 22 bp, Homo sapiens
ccaccccaaatgaagacctctc

SEQ ID NO: 7254503 - DNA, 18 bp, Homo sapiens
ccacccatctctgccttt

SEQ ID NO: 7254504 - DNA, 22 bp, Homo sapiens
tcctgtggtctggaaggaatgg

SEQ ID NO: 7254505 - DNA, 22 bp, Homo sapiens
tctagaatggctgggcacagct

SEQ ID NO: 7254506 - DNA, 22 bp, Homo sapiens
tctataaatgcagatatgtgtg

SEQ ID NO: 7254507 - DNA, 22 bp, Homo sapiens
tctagaatttgcgtaggttaga

SEQ ID NO: 7254508 - DNA, 22 bp, Homo sapiens
tctagaattcccttttgacaat

SEQ ID NO: 7254509 - DNA, 22 bp, Homo sapiens
tctataaatgcagatatgtgtg

SEQ ID NO: 7254510 - DNA, 22 bp, Homo sapiens
tctatacaagtttcactttgac

SEQ ID NO: 7254511 - DNA, 17 bp, Homo sapiens
tctcaggcacgtgtggc

SEQ ID NO: 7254512 - DNA, 23 bp, Homo sapiens
tctcaggcaaaccaggacaagtt

SEQ ID NO: 7254513 - DNA, 22 bp, Homo sapiens
tctcaggatctaatacatggta

SEQ ID NO: 7254514 - DNA, 22 bp, Homo sapiens
ccagagaggccttggcaagaca

SEQ ID NO: 7254515 - DNA, 22 bp, Homo sapiens
tccaagatctacagcagtttag

SEQ ID NO: 7254516 - DNA, 22 bp, Homo sapiens
tccaagacaagcacattcctgc

SEQ ID NO: 7254517 - DNA, 22 bp, Homo sapiens
catgctggtcagccagtggatg

SEQ ID NO: 7254518 - DNA, 22 bp, Homo sapiens
catgctgtgtgttttagctcca

SEQ ID NO: 7254519 - DNA, 22 bp, Homo sapiens
catgctacttgctatgcaaaaa

SEQ ID NO: 7254520 - DNA, 22 bp, Homo sapiens
catggtgggtgtagtttccgcc

SEQ ID NO: 7254521 - DNA, 22 bp, Homo sapiens
catgctgtgttacttggcatct

SEQ ID NO: 7254522 - DNA, 22 bp, Homo sapiens
tccagcagaaaagaggtaggga

SEQ ID NO: 7254523 - DNA, 22 bp, Homo sapiens
tccagcactcgcccagggcttg

SEQ ID NO: 7254524 - DNA, 22 bp, Homo sapiens
tccagcacctggaggcgtcccc

SEQ ID NO: 7254525 - DNA, 20 bp, Homo sapiens
tccagcaccctcacagagaa

SEQ ID NO: 7254526 - DNA, 22 bp, Homo sapiens
tccagcacccaatgtggctaag

SEQ ID NO: 7254527 - DNA, 22 bp, Homo sapiens
tccagcaccaccacagggaaga

SEQ ID NO: 7254528 - DNA, 22 bp, Homo sapiens
tccagcacagaatttcctagct

SEQ ID NO: 7254529 - DNA, 21 bp, Homo sapiens
tccagcacagatgacctcccc

SEQ ID NO: 7254530 - DNA, 22 bp, Homo sapiens
catgtggttcaagtactccaca

SEQ ID NO: 7254531 - DNA, 22 bp, Homo sapiens
cattacaaccccaaattacaaa

SEQ ID NO: 7254532 - DNA, 22 bp, Homo sapiens
cattacaaagttataaacagtt

SEQ ID NO: 7254533 - DNA, 22 bp, Homo sapiens
tccagggcagggtgcgcatggg

SEQ ID NO: 7254534 - DNA, 22 bp, Homo sapiens
tccagggcagtgactacagcgg

SEQ ID NO: 7254535 - DNA, 23 bp, Homo sapiens
tccagggcagtggctgggtctgc

SEQ ID NO: 7254536 - DNA, 22 bp, Homo sapiens
tccagggcatgctcagactcag

SEQ ID NO: 7254537 - DNA, 22 bp, Homo sapiens
cagtgtctacagtggctggagg

SEQ ID NO: 7254538 - DNA, 22 bp, Homo sapiens
tcaggaggccaccaggacctgt

SEQ ID NO: 7254539 - DNA, 22 bp, Homo sapiens
tcaggaggcgtctcgctggggc

SEQ ID NO: 7254540 - DNA, 22 bp, Homo sapiens
tcaggagggagtgtggatagag

SEQ ID NO: 7254541 - DNA, 22 bp, Homo sapiens
catcaaaattagacattgttga

SEQ ID NO: 7254542 - DNA, 22 bp, Homo sapiens
catcaaagggcctgtggtgcag

SEQ ID NO: 7254543 - DNA, 22 bp, Homo sapiens
catcaagagtcttactatcagt

SEQ ID NO: 7254544 - DNA, 22 bp, Homo sapiens
tcataatgacaaacatactcag

SEQ ID NO: 7254545 - DNA, 21 bp, Homo sapiens
tcataagggtagggctctaat

SEQ ID NO: 7254546 - DNA, 22 bp, Homo sapiens
tcatcaaagtcaaagaatgact

SEQ ID NO: 7254547 - DNA, 22 bp, Homo sapiens
tcatacataaataagagtttag

SEQ ID NO: 7254548 - DNA, 22 bp, Homo sapiens
catcagtgttcactattccttc

SEQ ID NO: 7254549 - DNA, 22 bp, Homo sapiens
catcagtgtgttgccttgctca

SEQ ID NO: 7254550 - DNA, 22 bp, Homo sapiens
catcagtggtaactgaatggtt

SEQ ID NO: 7254551 - DNA, 22 bp, Homo sapiens
catcagtgtggcagttcactgt

SEQ ID NO: 7254552 - DNA, 22 bp, Homo sapiens
catcagtgtctctctggtactt

SEQ ID NO: 7254553 - DNA, 22 bp, Homo sapiens
catcagtgaaagtgaatgttct

SEQ ID NO: 7254554 - DNA, 22 bp, Homo sapiens
catcagtgagccccttgatgag

SEQ ID NO: 7254555 - DNA, 20 bp, Homo sapiens
catcagtgcctgacaggtcc

SEQ ID NO: 7254556 - DNA, 22 bp, Homo sapiens
catcagtgcccttggggatgcc

SEQ ID NO: 7254557 - DNA, 20 bp, Homo sapiens
catcagtgcctgacaggtcc

SEQ ID NO: 7254558 - DNA, 20 bp, Homo sapiens
tcagtgtggcggggacctca

SEQ ID NO: 7254559 - DNA, 22 bp, Homo sapiens
tcagtgtggcccagggaagcag

SEQ ID NO: 7254560 - DNA, 22 bp, Homo sapiens
tcagtgtgattaggctatctga

SEQ ID NO: 7254561 - DNA, 22 bp, Homo sapiens
catcatatggaatttaaagtca

SEQ ID NO: 7254562 - DNA, 22 bp, Homo sapiens
catcatatggaatttaaagtca

SEQ ID NO: 7254563 - DNA, 22 bp, Homo sapiens
catcatatatttctacaagtgc

SEQ ID NO: 7254564 - DNA, 19 bp, Homo sapiens
ttccaaaatcaggatttga

SEQ ID NO: 7254565 - DNA, 22 bp, Homo sapiens
ttccaaaacagtatggcatgtg

SEQ ID NO: 7254566 - DNA, 22 bp, Homo sapiens
ttccaaaacaatattctgtgaa

SEQ ID NO: 7254567 - DNA, 22 bp, Homo sapiens
ttccaaggcccagcagagagga

SEQ ID NO: 7254568 - DNA, 22 bp, Homo sapiens
ttccaagagctgctggggtaag

SEQ ID NO: 7254569 - DNA, 22 bp, Homo sapiens
ttccaagagcctttcttctaga

SEQ ID NO: 7254570 - DNA, 22 bp, Homo sapiens
ttccatatgaaaaagctgttgc

SEQ ID NO: 7254571 - DNA, 18 bp, Homo sapiens
ttccataatgtatgtaac

SEQ ID NO: 7254572 - DNA, 22 bp, Homo sapiens
ttccccttgcactatcaccctg

SEQ ID NO: 7254573 - DNA, 22 bp, Homo sapiens
ttcccatagtgaccgatgctga

SEQ ID NO: 7254574 - DNA, 22 bp, Homo sapiens
ttcaagtatgagaaaggggact

SEQ ID NO: 7254575 - DNA, 22 bp, Homo sapiens
ttcaatcattagaatctcaggc

SEQ ID NO: 7254576 - DNA, 22 bp, Homo sapiens
ttcactgtgaactcatattcag

SEQ ID NO: 7254577 - DNA, 22 bp, Homo sapiens
ttcatagtgacatgcattctgg

SEQ ID NO: 7254578 - DNA, 22 bp, Homo sapiens
ttcatatttctttaaggacttt

SEQ ID NO: 7254579 - DNA, 22 bp, Homo sapiens
ttcatattttctgcttgctcac

SEQ ID NO: 7254580 - DNA, 22 bp, Homo sapiens
ttcagacagttttcagattcat

SEQ ID NO: 7254581 - DNA, 22 bp, Homo sapiens
ttcagacatgcaggctgaggct

SEQ ID NO: 7254582 - DNA, 22 bp, Homo sapiens
ttatgcaacaggtgagcagaca

SEQ ID NO: 7254583 - DNA, 22 bp, Homo sapiens
ttatgcagagttgagaggaatg

SEQ ID NO: 7254584 - DNA, 22 bp, Homo sapiens
ttagttgctggcagaccctagg

SEQ ID NO: 7254585 - DNA, 22 bp, Homo sapiens
ttagttgctcactacaaggtta

SEQ ID NO: 7254586 - DNA, 22 bp, Homo sapiens
ttagttgcctcagtgggcactt

SEQ ID NO: 7254587 - DNA, 22 bp, Homo sapiens
ttagttgccagtgaggaggatt

SEQ ID NO: 7254588 - DNA, 22 bp, Homo sapiens
ttagttgcatgccagacttggc

SEQ ID NO: 7254589 - DNA, 22 bp, Homo sapiens
ttagttgcaatctattgacgtt

SEQ ID NO: 7254590 - DNA, 22 bp, Homo sapiens
ttatggaatggagaaagtctgc

SEQ ID NO: 7254591 - DNA, 22 bp, Homo sapiens
ttatggcatattcctcattgta

SEQ ID NO: 7254592 - DNA, 22 bp, Homo sapiens
ttatgctgttaggaaaatcaaa

SEQ ID NO: 7254593 - DNA, 22 bp, Homo sapiens
ttatgcagtcgacatctgatca

SEQ ID NO: 7254594 - DNA, 22 bp, Homo sapiens
ttatgcagcaaagtgcttgaaa

SEQ ID NO: 7254595 - DNA, 22 bp, Homo sapiens
ttatgcagcaaagtgcttgaaa

SEQ ID NO: 7254596 - DNA, 18 bp, Homo sapiens
ttatgcagatcagttcac

SEQ ID NO: 7254597 - DNA, 22 bp, Homo sapiens
ttatgcagatggcatgaggagg

SEQ ID NO: 7254598 - DNA, 22 bp, Homo sapiens
ttatgcagtcgacatctgatca

SEQ ID NO: 7254599 - DNA, 22 bp, Homo sapiens
tcctctggcccagctgcctctg

SEQ ID NO: 7254600 - DNA, 20 bp, Homo sapiens
tcctccttgcagagcccaga

SEQ ID NO: 7254601 - DNA, 22 bp, Homo sapiens
tcctcctttccccgctggagcc

SEQ ID NO: 7254602 - DNA, 21 bp, Homo sapiens
tcctctactgagccatgcaga

SEQ ID NO: 7254603 - DNA, 22 bp, Homo sapiens
tcctctccagcaaactggctat

SEQ ID NO: 7254604 - DNA, 22 bp, Homo sapiens
ttatgttttatggctatatcat

SEQ ID NO: 7254605 - DNA, 22 bp, Homo sapiens
ttattgtttgggtataatttga

SEQ ID NO: 7254606 - DNA, 22 bp, Homo sapiens
ttatttatatctctgcagttta

SEQ ID NO: 7254607 - DNA, 22 bp, Homo sapiens
ttatttactggatggccttggg

SEQ ID NO: 7254608 - DNA, 22 bp, Homo sapiens
ttatttacaactcttctcttcc

SEQ ID NO: 7254609 - DNA, 22 bp, Homo sapiens
ttattttcagctaggaaagcca

SEQ ID NO: 7254610 - DNA, 22 bp, Homo sapiens
ttattttgagagaatgtgtgct

SEQ ID NO: 7254611 - DNA, 22 bp, Homo sapiens
ttattttgtagctctgatcttt

SEQ ID NO: 7254612 - DNA, 22 bp, Homo sapiens
ttcaagcagagatatttcaaga

SEQ ID NO: 7254613 - DNA, 22 bp, Homo sapiens
ttctcttctgttcagtgcccaa

SEQ ID NO: 7254614 - DNA, 18 bp, Homo sapiens
ttctctggtggatgttat

SEQ ID NO: 7254615 - DNA, 22 bp, Homo sapiens
ttctggagcttggcttgtatgt

SEQ ID NO: 7254616 - DNA, 20 bp, Homo sapiens
ttctggaggctacaagtctg

SEQ ID NO: 7254617 - DNA, 22 bp, Homo sapiens
ttctggaggcgggcgacctcgc

SEQ ID NO: 7254618 - DNA, 22 bp, Homo sapiens
ttctggaggccccttccttctc

SEQ ID NO: 7254619 - DNA, 22 bp, Homo sapiens
ttctggaggccagctgccacct

SEQ ID NO: 7254620 - DNA, 22 bp, Homo sapiens
ttctggaggagaaagggtgggc

SEQ ID NO: 7254621 - DNA, 22 bp, Homo sapiens
ttctggaggacaactgttttca

SEQ ID NO: 7254622 - DNA, 20 bp, Homo sapiens
ttctctttgggtccagagaa

SEQ ID NO: 7254623 - DNA, 22 bp, Homo sapiens
ttctgataacaaacaccaattt

SEQ ID NO: 7254624 - DNA, 19 bp, Homo sapiens
ttctatgattaacatgaga

SEQ ID NO: 7254625 - DNA, 22 bp, Homo sapiens
ttctcacaggaagtaggacttt

SEQ ID NO: 7254626 - DNA, 22 bp, Homo sapiens
ttctcacaaatccatccaggag

SEQ ID NO: 7254627 - DNA, 22 bp, Homo sapiens
ttctcacagtacctaacatgta

SEQ ID NO: 7254628 - DNA, 22 bp, Homo sapiens
ttctaaactgaagtattttaaa

SEQ ID NO: 7254629 - DNA, 22 bp, Homo sapiens
ttctaaaataagtttatctggt

SEQ ID NO: 7254630 - DNA, 22 bp, Homo sapiens
ttccctctcacttaaagcttgg

SEQ ID NO: 7254631 - DNA, 22 bp, Homo sapiens
ttccctctccaggagccctgag

SEQ ID NO: 7254632 - DNA, 22 bp, Homo sapiens
ttccctctctagctttccccaa

SEQ ID NO: 7254633 - DNA, 22 bp, Homo sapiens
ttccctctcctactcaggaaag

SEQ ID NO: 7254634 - DNA, 22 bp, Homo sapiens
ttccctctgcgcattgaatttc

SEQ ID NO: 7254635 - DNA, 22 bp, Homo sapiens
ttccctctctccagggctgcct

SEQ ID NO: 7254636 - DNA, 22 bp, Homo sapiens
ttccctcttttccaacagttgt

SEQ ID NO: 7254637 - DNA, 22 bp, Homo sapiens
ttccctctttcactgtgatttt

SEQ ID NO: 7254638 - DNA, 20 bp, Homo sapiens
ttcttctctagttatcttca

SEQ ID NO: 7254639 - DNA, 22 bp, Homo sapiens
ttcttctgaaacagtgacagac

SEQ ID NO: 7254640 - DNA, 22 bp, Homo sapiens
ttcttcttcatttctgacgatg

SEQ ID NO: 7254641 - DNA, 22 bp, Homo sapiens
ttctttgggctcagagagggag

SEQ ID NO: 7254642 - DNA, 22 bp, Homo sapiens
ttctttgggctcagagagggag

SEQ ID NO: 7254643 - DNA, 22 bp, Homo sapiens
ttcttctcagggtcccacatgg

SEQ ID NO: 7254644 - DNA, 22 bp, Homo sapiens
ttctggaggttattaggagtct

SEQ ID NO: 7254645 - DNA, 19 bp, Homo sapiens
ttctggaggttaccctgag

SEQ ID NO: 7254646 - DNA, 22 bp, Homo sapiens
ttctggaggtgtgaccattagc

SEQ ID NO: 7254647 - DNA, 22 bp, Homo sapiens
ttctggagggcctgatcacaca

SEQ ID NO: 7254648 - DNA, 22 bp, Homo sapiens
ttctggagggcatgctgctgcc

SEQ ID NO: 7254649 - DNA, 22 bp, Homo sapiens
ttctggaggctctaagggacaa

SEQ ID NO: 7254650 - DNA, 22 bp, Homo sapiens
ttctggaggctccagggaagaa

SEQ ID NO: 7254651 - DNA, 22 bp, Homo sapiens
ttctggagtgtggaccgctgtt

SEQ ID NO: 7254652 - DNA, 22 bp, Homo sapiens
ttctggagtgtattgggtctgc

SEQ ID NO: 7254653 - DNA, 22 bp, Homo sapiens
ttctggagtgataaaacaccac

SEQ ID NO: 7254654 - DNA, 22 bp, Homo sapiens
ttctggagtcttcaattttaga

SEQ ID NO: 7254655 - DNA, 22 bp, Homo sapiens
ttctggagtcccacagccaggg

SEQ ID NO: 7254656 - DNA, 22 bp, Homo sapiens
ttctggagtattcctggcagcc

SEQ ID NO: 7254657 - DNA, 22 bp, Homo sapiens
ttctggagtattcctggcacct

SEQ ID NO: 7254658 - DNA, 22 bp, Homo sapiens
ttctggagtcattggggctgat

SEQ ID NO: 7254659 - DNA, 22 bp, Homo sapiens
ttctggagtttgaagatcaggt

SEQ ID NO: 7254660 - DNA, 22 bp, Homo sapiens
ttctggagttgtgacctcaggg

SEQ ID NO: 7254661 - DNA, 22 bp, Homo sapiens
ttctggagttcaggtccctaaa

SEQ ID NO: 7254662 - DNA, 22 bp, Homo sapiens
ttgagaaactctgggttagaat

SEQ ID NO: 7254663 - DNA, 18 bp, Homo sapiens
ttgagaaataagcactaa

SEQ ID NO: 7254664 - DNA, 22 bp, Homo sapiens
ttgagaaatacttttgtagcct

SEQ ID NO: 7254665 - DNA, 22 bp, Homo sapiens
ttgagatacattgggaaatgcc

SEQ ID NO: 7254666 - DNA, 22 bp, Homo sapiens
ttgaggcccggcaggccgagcg

SEQ ID NO: 7254667 - DNA, 18 bp, Homo sapiens
ttgagggaggggcagagt

SEQ ID NO: 7254668 - DNA, 22 bp, Homo sapiens
ttgagggagcctgggagccatg

SEQ ID NO: 7254669 - DNA, 22 bp, Homo sapiens
ttgagggatttacagaggtggg

SEQ ID NO: 7254670 - DNA, 19 bp, Homo sapiens
ttgaggggccaggggagat

SEQ ID NO: 7254671 - DNA, 22 bp, Homo sapiens
ttgaaactttagtaaactaagg

SEQ ID NO: 7254672 - DNA, 22 bp, Homo sapiens
ttgagaaactctgggttagaat

SEQ ID NO: 7254673 - DNA, 22 bp, Homo sapiens
ttgagaaactaacggcttgagc

SEQ ID NO: 7254674 - DNA, 22 bp, Homo sapiens
ttgaaaggaatacagaggccta

SEQ ID NO: 7254675 - DNA, 22 bp, Homo sapiens
ttgaaaatatcacaggagcagc

SEQ ID NO: 7254676 - DNA, 19 bp, Homo sapiens
ttgaaaatatggatctgag

SEQ ID NO: 7254677 - DNA, 20 bp, Homo sapiens
ttgaaaatgcattgtgcagt

SEQ ID NO: 7254678 - DNA, 22 bp, Homo sapiens
ttgaaaatggtaagcatgatat

SEQ ID NO: 7254679 - DNA, 22 bp, Homo sapiens
ttgaaaatggtaagcatgatat

SEQ ID NO: 7254680 - DNA, 22 bp, Homo sapiens
ttgtagaatcattatttctagt

SEQ ID NO: 7254681 - DNA, 22 bp, Homo sapiens
ttgtagatataaattttattgt

SEQ ID NO: 7254682 - DNA, 22 bp, Homo sapiens
ttgtagatggcttatttctgtg

SEQ ID NO: 7254683 - DNA, 22 bp, Homo sapiens
ttgtagatgtgtttttatctca

SEQ ID NO: 7254684 - DNA, 18 bp, Homo sapiens
ttggggtgaggccaggaa

SEQ ID NO: 7254685 - DNA, 19 bp, Homo sapiens
ttggggtgaatgccagaca

SEQ ID NO: 7254686 - DNA, 22 bp, Homo sapiens
ttgtgagtagtgccgcaataaa

SEQ ID NO: 7254687 - DNA, 22 bp, Homo sapiens
ttgttcttacttaagagtgaat

SEQ ID NO: 7254688 - DNA, 23 bp, Homo sapiens
ttgggaaatagttaagacatgag

SEQ ID NO: 7254689 - DNA, 22 bp, Homo sapiens
ttgggaaagggattatgagtag

SEQ ID NO: 7254690 - DNA, 22 bp, Homo sapiens
ttgggaaagccacaaattggag

SEQ ID NO: 7254691 - DNA, 22 bp, Homo sapiens
ttgggaaagaatgagaaggtga

SEQ ID NO: 7254692 - DNA, 22 bp, Homo sapiens
ttgggaaattactctgctagga

SEQ ID NO: 7254693 - DNA, 22 bp, Homo sapiens
ttgggaaatatggattgttatt

SEQ ID NO: 7254694 - DNA, 22 bp, Homo sapiens
ttgggaaacagtatagctaaca

SEQ ID NO: 7254695 - DNA, 22 bp, Homo sapiens
ttggggaggttgccacattcca

SEQ ID NO: 7254696 - DNA, 22 bp, Homo sapiens
ttgggctcaggagtttgagacc

SEQ ID NO: 7254697 - DNA, 22 bp, Homo sapiens
ttggctcagcatcttggtgcca

SEQ ID NO: 7254698 - DNA, 21 bp, Homo sapiens
ttggcctttgtctcagacact

SEQ ID NO: 7254699 - DNA, 22 bp, Homo sapiens
ttggcctttgtcatcaagatca

SEQ ID NO: 7254700 - DNA, 22 bp, Homo sapiens
ttggcctttggactctgggact

SEQ ID NO: 7254701 - DNA, 22 bp, Homo sapiens
ttggcctttgctgggctgttga

SEQ ID NO: 7254702 - DNA, 22 bp, Homo sapiens
ttggcctttattctgtacttct

SEQ ID NO: 7254703 - DNA, 22 bp, Homo sapiens
ttggcctttaaactggactttc

SEQ ID NO: 7254704 - DNA, 22 bp, Homo sapiens
ttggcagatgaacacaactgga

SEQ ID NO: 7254705 - DNA, 22 bp, Homo sapiens
ttggccgtttcactgggcagtt

SEQ ID NO: 7254706 - DNA, 19 bp, Homo sapiens
ttggccttgtttcatatct

SEQ ID NO: 7254707 - DNA, 22 bp, Homo sapiens
ttggccttgttaaggaggccct

SEQ ID NO: 7254708 - DNA, 22 bp, Homo sapiens
ttggccttgtctggtcttctcc

SEQ ID NO: 7254709 - DNA, 22 bp, Homo sapiens
ttggccttgtcacttcattact

SEQ ID NO: 7254710 - DNA, 22 bp, Homo sapiens
ttggccttgtacatcatattaa

SEQ ID NO: 7254711 - DNA, 22 bp, Homo sapiens
ttggccttgaacatggtttagg

SEQ ID NO: 7254712 - DNA, 22 bp, Homo sapiens
ttggccttcttccccctgcact

SEQ ID NO: 7254713 - DNA, 22 bp, Homo sapiens
ttggccttctggtgttcatttt

SEQ ID NO: 7254714 - DNA, 22 bp, Homo sapiens
ttggccttctcttcccggtcct

SEQ ID NO: 7254715 - DNA, 22 bp, Homo sapiens
ttggccttctctgacactgccc

SEQ ID NO: 7254716 - DNA, 22 bp, Homo sapiens
ttggccttctcatttgcttatt

SEQ ID NO: 7254717 - DNA, 17 bp, Homo sapiens
ttggccttctagcctct

SEQ ID NO: 7254718 - DNA, 22 bp, Homo sapiens
ttggccttccctacctgggcca

SEQ ID NO: 7254719 - DNA, 22 bp, Homo sapiens
ttggccttagcttcttcttaaa

SEQ ID NO: 7254720 - DNA, 22 bp, Homo sapiens
ttggccttactctcctacactg

SEQ ID NO: 7254721 - DNA, 22 bp, Homo sapiens
ttggccttacgcatggtcggca

SEQ ID NO: 7254722 - DNA, 22 bp, Homo sapiens
ttggccttaacctctctgtgcc

SEQ ID NO: 7254723 - DNA, 22 bp, Homo sapiens
ttgctcagctgtgagatatcca

SEQ ID NO: 7254724 - DNA, 22 bp, Homo sapiens
ttgctaccattgataccagcac

SEQ ID NO: 7254725 - DNA, 22 bp, Homo sapiens
ttgcatttgagaaagttctcct

SEQ ID NO: 7254726 - DNA, 22 bp, Homo sapiens
ttgcatttgatcttgggttctc

SEQ ID NO: 7254727 - DNA, 22 bp, Homo sapiens
ttgcatttgacaaattatttaa

SEQ ID NO: 7254728 - DNA, 22 bp, Homo sapiens
ttgcatttcctgtactgtttga

SEQ ID NO: 7254729 - DNA, 19 bp, Homo sapiens
ttgcatttcatgtttgatt

SEQ ID NO: 7254730 - DNA, 22 bp, Homo sapiens
ttgcatttcccattgagtaatg

SEQ ID NO: 7254731 - DNA, 22 bp, Homo sapiens
ttgcatttgtttgagtagaatg

SEQ ID NO: 7254732 - DNA, 22 bp, Homo sapiens
ttgcatttgtggcatgggtgtt

SEQ ID NO: 7254733 - DNA, 22 bp, Homo sapiens
ttgcatttggttctgcctggta

SEQ ID NO: 7254734 - DNA, 22 bp, Homo sapiens
ttgcatttgctcatttgatatg

SEQ ID NO: 7254735 - DNA, 22 bp, Homo sapiens
ttgcattttggttgtaaatatg

SEQ ID NO: 7254736 - DNA, 21 bp, Homo sapiens
ttgcattttaagtttactgct

SEQ ID NO: 7254737 - DNA, 22 bp, Homo sapiens
ttgcatttttagatgcttctgt

SEQ ID NO: 7254738 - DNA, 22 bp, Homo sapiens
ttgcatttttacaagtagccag

SEQ ID NO: 7254739 - DNA, 22 bp, Homo sapiens
ttgcatttttgagcacgaagtt

SEQ ID NO: 7254740 - DNA, 22 bp, Homo sapiens
ttgctttatgtgtatgacttga

SEQ ID NO: 7254741 - DNA, 22 bp, Homo sapiens
ttggaatcctgcctctgctact

SEQ ID NO: 7254742 - DNA, 22 bp, Homo sapiens
ttggaatcctgagatgagaatt

SEQ ID NO: 7254743 - DNA, 21 bp, Homo sapiens
ttggaatctcttcatctctgc

SEQ ID NO: 7254744 - DNA, 22 bp, Homo sapiens
ttggaatcctgagatgagaatt

SEQ ID NO: 7254745 - DNA, 22 bp, Homo sapiens
ttggaatcattcttaaaggtct

SEQ ID NO: 7254746 - DNA, 22 bp, Homo sapiens
ttggaatcactcacataagtct

SEQ ID NO: 7254747 - DNA, 20 bp, Homo sapiens
ttggaatcacctggagaggt

SEQ ID NO: 7254748 - DNA, 22 bp, Homo sapiens
ttggaatcaattcatgttgcaa

SEQ ID NO: 7254749 - DNA, 22 bp, Homo sapiens
ttggaggcaatgggaaggaggc

SEQ ID NO: 7254750 - DNA, 21 bp, Homo sapiens
ttggaatcttaggagtgtggg

SEQ ID NO: 7254751 - DNA, 22 bp, Homo sapiens
ttggaatctgcaatttaacaaa

SEQ ID NO: 7254752 - DNA, 22 bp, Homo sapiens
ttggaggatgcaatgagggagt

SEQ ID NO: 7254753 - DNA, 22 bp, Homo sapiens
ttggcacagtaatctctcttca

SEQ ID NO: 7254754 - DNA, 22 bp, Homo sapiens
ttggcacagctccatggctttg

SEQ ID NO: 7254755 - DNA, 22 bp, Homo sapiens
ttggcacagccacttctgctgc

SEQ ID NO: 7254756 - DNA, 22 bp, Homo sapiens
ttggcactgaccaaagaagtcc

SEQ ID NO: 7254757 - DNA, 22 bp, Homo sapiens
ttggcactcagcaagtgttaat

SEQ ID NO: 7254758 - DNA, 22 bp, Homo sapiens
ttggcagactgacaatctgttt

SEQ ID NO: 7254759 - DNA, 22 bp, Homo sapiens
tttattgctgagaaggattcca

SEQ ID NO: 7254760 - DNA, 22 bp, Homo sapiens
tttattgctagcccttggtcca

SEQ ID NO: 7254761 - DNA, 22 bp, Homo sapiens
tttattgtctatgaactgcttg

SEQ ID NO: 7254762 - DNA, 22 bp, Homo sapiens
tttatttataagccacttgctg

SEQ ID NO: 7254763 - DNA, 22 bp, Homo sapiens
tttattgtctatgaactgcttg

SEQ ID NO: 7254764 - DNA, 22 bp, Homo sapiens
tttatgaaccactctacacctt

SEQ ID NO: 7254765 - DNA, 22 bp, Homo sapiens
tttatgaactacagatataact

SEQ ID NO: 7254766 - DNA, 22 bp, Homo sapiens
tttatgaactacagatataact

SEQ ID NO: 7254767 - DNA, 21 bp, Homo sapiens
tttatgtacttcatagagtag

SEQ ID NO: 7254768 - DNA, 22 bp, Homo sapiens
tttatgtttgacaatgatctgg

SEQ ID NO: 7254769 - DNA, 22 bp, Homo sapiens
tttatctttaggactttgcaga

SEQ ID NO: 7254770 - DNA, 22 bp, Homo sapiens
ttgtttaaaagaaatcatagaa

SEQ ID NO: 7254771 - DNA, 22 bp, Homo sapiens
ttgttcttagtatgcattgttt

SEQ ID NO: 7254772 - DNA, 22 bp, Homo sapiens
ttgttcttctctagagaagtgg

SEQ ID NO: 7254773 - DNA, 22 bp, Homo sapiens
ttgttcttccatcatccctcag

SEQ ID NO: 7254774 - DNA, 21 bp, Homo sapiens
ttgttcttccagaagcaaagt

SEQ ID NO: 7254775 - DNA, 22 bp, Homo sapiens
ttgttcttggagcaggcagaga

SEQ ID NO: 7254776 - DNA, 23 bp, Homo sapiens
ttgttcttggatcttcctgaagc

SEQ ID NO: 7254777 - DNA, 22 bp, Homo sapiens
ttgttgaatggataaataaatt

SEQ ID NO: 7254778 - DNA, 22 bp, Homo sapiens
ttgttcttgtctttgccttcac

SEQ ID NO: 7254779 - DNA, 22 bp, Homo sapiens
ttgttctttatcctggaagcct

SEQ ID NO: 7254780 - DNA, 22 bp, Homo sapiens
ttgttcttttgcttagacagat

SEQ ID NO: 7254781 - DNA, 22 bp, Homo sapiens
ttgttctttttctccatgagat

SEQ ID NO: 7254782 - DNA, 22 bp, Homo sapiens
tttaacaggtaaagtaaatgtg

SEQ ID NO: 7254783 - DNA, 22 bp, Homo sapiens
ttgtttaaaatgtagcaagaaa

SEQ ID NO: 7254784 - DNA, 22 bp, Homo sapiens
tttacaagtttacagaatgatg

SEQ ID NO: 7254785 - DNA, 22 bp, Homo sapiens
tttaagatcatttgtattatcc

SEQ ID NO: 7254786 - DNA, 22 bp, Homo sapiens
tttacagaagagaaggatgctt

SEQ ID NO: 7254787 - DNA, 22 bp, Homo sapiens
tttccaaataaggtcacactca

SEQ ID NO: 7254788 - DNA, 22 bp, Homo sapiens
tttccaaataaggtcacattct

SEQ ID NO: 7254789 - DNA, 22 bp, Homo sapiens
tttccagtgattgctgctctca

SEQ ID NO: 7254790 - DNA, 22 bp, Homo sapiens
tttccagtcaccactagatcag

SEQ ID NO: 7254791 - DNA, 22 bp, Homo sapiens
tttcataatctgtcaagtgggg

SEQ ID NO: 7254792 - DNA, 22 bp, Homo sapiens
tttcatctctctaaaagacagt

SEQ ID NO: 7254793 - DNA, 22 bp, Homo sapiens
tttctaacagcaaatgtttatc

SEQ ID NO: 7254794 - DNA, 22 bp, Homo sapiens
tttctaacgtagacagggaggt

SEQ ID NO: 7254795 - DNA, 22 bp, Homo sapiens
tttcataaacagtagaagacta

SEQ ID NO: 7254796 - DNA, 22 bp, Homo sapiens
tttcacatcccgcgcgccctta

SEQ ID NO: 7254797 - DNA, 22 bp, Homo sapiens
tttcacatggtactgcctgttt

SEQ ID NO: 7254798 - DNA, 22 bp, Homo sapiens
tttcacatgtggaatgccaggt

SEQ ID NO: 7254799 - DNA, 20 bp, Homo sapiens
tttcaagtcagcaattctca

SEQ ID NO: 7254800 - DNA, 23 bp, Homo sapiens
tttatttatttaggctgagggat

SEQ ID NO: 7254801 - DNA, 22 bp, Homo sapiens
tttatttatccttctggattgc

SEQ ID NO: 7254802 - DNA, 21 bp, Homo sapiens
tttatttatataggacacatg

SEQ ID NO: 7254803 - DNA, 22 bp, Homo sapiens
tttgtcttaaatcttgttactg

SEQ ID NO: 7254804 - DNA, 22 bp, Homo sapiens
tttgtcttccccctttaatcag

SEQ ID NO: 7254805 - DNA, 22 bp, Homo sapiens
ttttacaggtcataggtatagt

SEQ ID NO: 7254806 - DNA, 22 bp, Homo sapiens
ttttattggtaatgataaaagt

SEQ ID NO: 7254807 - DNA, 22 bp, Homo sapiens
ttttattggtaatgataaaagt

SEQ ID NO: 7254808 - DNA, 22 bp, Homo sapiens
ttttattgggagtcctctactg

SEQ ID NO: 7254809 - DNA, 22 bp, Homo sapiens
ttttattgggagtcctctactg

SEQ ID NO: 7254810 - DNA, 22 bp, Homo sapiens
ttttagaagtgcctatcctatg

SEQ ID NO: 7254811 - DNA, 16 bp, Homo sapiens
ttttattgtgacagcc

SEQ ID NO: 7254812 - DNA, 22 bp, Homo sapiens
ttttattgtctgtattgcctat

SEQ ID NO: 7254813 - DNA, 16 bp, Homo sapiens
ttttattgtgacagcc

SEQ ID NO: 7254814 - DNA, 22 bp, Homo sapiens
ttttcacaagggtccaactagt

SEQ ID NO: 7254815 - DNA, 22 bp, Homo sapiens
ttttattgtctcccagttctgg

SEQ ID NO: 7254816 - DNA, 22 bp, Homo sapiens
ttttattgtctgtattgcctat

SEQ ID NO: 7254817 - DNA, 22 bp, Homo sapiens
ttttattgtcaatgaagacaga

SEQ ID NO: 7254818 - DNA, 22 bp, Homo sapiens
ttttattgtctcccagttctgg

SEQ ID NO: 7254819 - DNA, 22 bp, Homo sapiens
ttttattgtcaatgaagacaga

SEQ ID NO: 7254820 - DNA, 22 bp, Homo sapiens
ttttgttggcttaagaaataca

SEQ ID NO: 7254821 - DNA, 22 bp, Homo sapiens
ttttgttgacctctcccacctt

SEQ ID NO: 7254822 - DNA, 17 bp, Homo sapiens
ttttggtgagttgtttc

SEQ ID NO: 7254823 - DNA, 22 bp, Homo sapiens
ttttggtgcacctagctttttc

SEQ ID NO: 7254824 - DNA, 22 bp, Homo sapiens
tttgaagactactgggagtgaa

SEQ ID NO: 7254825 - DNA, 22 bp, Homo sapiens
tttgacatgtgcttataacttt

SEQ ID NO: 7254826 - DNA, 22 bp, Homo sapiens
tttgaaatatgtgatgagagag

SEQ ID NO: 7254827 - DNA, 22 bp, Homo sapiens
tttgaaatatgaggcattatga

SEQ ID NO: 7254828 - DNA, 22 bp, Homo sapiens
tttgaaattggctcattggttt

SEQ ID NO: 7254829 - DNA, 22 bp, Homo sapiens
tttgaaatctaatcaaggaaca

SEQ ID NO: 7254830 - DNA, 22 bp, Homo sapiens
tttgaaatgtatcagtataggt

SEQ ID NO: 7254831 - DNA, 22 bp, Homo sapiens
tttctagatattcgcagataga

SEQ ID NO: 7254832 - DNA, 22 bp, Homo sapiens
tttctagatattccttgaagtg

SEQ ID NO: 7254833 - DNA, 22 bp, Homo sapiens
tttctagagtgggcatgtctta

SEQ ID NO: 7254834 - DNA, 22 bp, Homo sapiens
tttctagagataactcaaccat

SEQ ID NO: 7254835 - DNA, 17 bp, Homo sapiens
tttctagattatcctct

SEQ ID NO: 7254836 - DNA, 17 bp, Homo sapiens
tttctagattatcctct

SEQ ID NO: 7254837 - DNA, 22 bp, Homo sapiens
tttgagcttgtagcattgctat

SEQ ID NO: 7254838 - DNA, 22 bp, Homo sapiens
tttgagctatgggcttggattt

SEQ ID NO: 7254839 - DNA, 22 bp, Homo sapiens
tttgagctatgggcttggattt

SEQ ID NO: 7254840 - DNA, 22 bp, Homo sapiens
tttgagcagcagatgcacttag

SEQ ID NO: 7254841 - DNA, 22 bp, Homo sapiens
tttgagcagaagggtgacatgc

SEQ ID NO: 7254842 - DNA, 22 bp, Homo sapiens
tttgagattccttagctcagag

SEQ ID NO: 7254843 - DNA, 22 bp, Homo sapiens
tttgagatagtctagagtaact

SEQ ID NO: 7254844 - DNA, 22 bp, Homo sapiens
tttgagatctcaatgaggacta

SEQ ID NO: 7254845 - DNA, 22 bp, Homo sapiens
tttgctgagttgaagtttgagg

SEQ ID NO: 7254846 - DNA, 22 bp, Homo sapiens
tttggctttagtgccttctgat

SEQ ID NO: 7254847 - DNA, 20 bp, Homo sapiens
tttggcttcaagtgcattgc

SEQ ID NO: 7254848 - DNA, 22 bp, Homo sapiens
tttggctcgatggactttgaat

SEQ ID NO: 7254849 - DNA, 22 bp, Homo sapiens
tttggctaggttaagactggga

SEQ ID NO: 7254850 - DNA, 22 bp, Homo sapiens
tttggctacttgatattctgaa

SEQ ID NO: 7254851 - DNA, 22 bp, Homo sapiens
ggtggggtcacgacagagggaa

SEQ ID NO: 7254852 - DNA, 21 bp, Homo sapiens
ggtggggtacctaaggtagct

SEQ ID NO: 7254853 - DNA, 22 bp, Homo sapiens
ggtgggtcttgtggggcagctt

SEQ ID NO: 7254854 - DNA, 22 bp, Homo sapiens
ggtgggtcttgcggggcagctt

SEQ ID NO: 7254855 - DNA, 20 bp, Homo sapiens
gggtgggagagtctgagggt

SEQ ID NO: 7254856 - DNA, 20 bp, Homo sapiens
gggtgggagagtctgagggt

SEQ ID NO: 7254857 - DNA, 22 bp, Homo sapiens
ggtggggctaggacctcaggat

SEQ ID NO: 7254858 - DNA, 22 bp, Homo sapiens
ggtgggacaggtaggagtggct

SEQ ID NO: 7254859 - DNA, 22 bp, Homo sapiens
gggtgggagaaatgagtatcta

SEQ ID NO: 7254860 - DNA, 22 bp, Homo sapiens
gggtgggactctttggcctgag

SEQ ID NO: 7254861 - DNA, 22 bp, Homo sapiens
ggtgtgccacttcactgagcag

SEQ ID NO: 7254862 - DNA, 22 bp, Homo sapiens
cagcacaattttcaggagtcca

SEQ ID NO: 7254863 - DNA, 23 bp, Homo sapiens
cagcaagtgaattccaagagaga

SEQ ID NO: 7254864 - DNA, 22 bp, Homo sapiens
cagcaagtcagtgagtagaaga

SEQ ID NO: 7254865 - DNA, 22 bp, Homo sapiens
gtaaacaacacaaatcatttga

SEQ ID NO: 7254866 - DNA, 22 bp, Homo sapiens
gtaaacaatagcattgcctgat

SEQ ID NO: 7254867 - DNA, 22 bp, Homo sapiens
ggttctttgtatatatcacttt

SEQ ID NO: 7254868 - DNA, 22 bp, Homo sapiens
ggttgctctttggaccctgctg

SEQ ID NO: 7254869 - DNA, 22 bp, Homo sapiens
ggttgctgggggtggcagagct

SEQ ID NO: 7254870 - DNA, 22 bp, Homo sapiens
ggttgctgggggtggcagagct

SEQ ID NO: 7254871 - DNA, 22 bp, Homo sapiens
cagcaggcaggtgggccaagtc

SEQ ID NO: 7254872 - DNA, 22 bp, Homo sapiens
gtatgaaagcatcattcctgct

SEQ ID NO: 7254873 - DNA, 22 bp, Homo sapiens
gtatgaaagcatcattcctgct

SEQ ID NO: 7254874 - DNA, 22 bp, Homo sapiens
gtatgaaaattgtaaagttctt

SEQ ID NO: 7254875 - DNA, 22 bp, Homo sapiens
gtatctttgtcttcatgttgga

SEQ ID NO: 7254876 - DNA, 22 bp, Homo sapiens
cagcagctacttggagcagcag

SEQ ID NO: 7254877 - DNA, 22 bp, Homo sapiens
cagcagctacctgctcttgtgg

SEQ ID NO: 7254878 - DNA, 22 bp, Homo sapiens
cagcagcagattcagcgtctgg

SEQ ID NO: 7254879 - DNA, 22 bp, Homo sapiens
cagcagcagagatactggtttc

SEQ ID NO: 7254880 - DNA, 22 bp, Homo sapiens
cagcagcagacatttgatcttc

SEQ ID NO: 7254881 - DNA, 22 bp, Homo sapiens
cagcagcactctgcgggtcccc

SEQ ID NO: 7254882 - DNA, 22 bp, Homo sapiens
cagcagcacctattatagtgtt

SEQ ID NO: 7254883 - DNA, 22 bp, Homo sapiens
gtatctttatccctcgttggag

SEQ ID NO: 7254884 - DNA, 22 bp, Homo sapiens
gtatctttccacatcttcagta

SEQ ID NO: 7254885 - DNA, 22 bp, Homo sapiens
cagcagcaaggtgagggtggag

SEQ ID NO: 7254886 - DNA, 22 bp, Homo sapiens
cagcagcaacaatagcggtcac

SEQ ID NO: 7254887 - DNA, 22 bp, Homo sapiens
cagcagcaaatctagaagagga

SEQ ID NO: 7254888 - DNA, 22 bp, Homo sapiens
cagcagatcaatgtagaatatt

SEQ ID NO: 7254889 - DNA, 22 bp, Homo sapiens
cagcagcaacaacggaagcctt

SEQ ID NO: 7254890 - DNA, 22 bp, Homo sapiens
cagcagcaacaacggaagcctt

SEQ ID NO: 7254891 - DNA, 22 bp, Homo sapiens
gtattttactgctcaaagctct

SEQ ID NO: 7254892 - DNA, 22 bp, Homo sapiens
gtatttgtagtagcatagaatt

SEQ ID NO: 7254893 - DNA, 22 bp, Homo sapiens
cagccaccatacagcagaagct

SEQ ID NO: 7254894 - DNA, 22 bp, Homo sapiens
cagccagtggttgaagatgcag

SEQ ID NO: 7254895 - DNA, 22 bp, Homo sapiens
cagaaggttccacaagatagaa

SEQ ID NO: 7254896 - DNA, 22 bp, Homo sapiens
cagaaggtgaaggcagaacctt

SEQ ID NO: 7254897 - DNA, 22 bp, Homo sapiens
cagaagtgaatgtgataaacca

SEQ ID NO: 7254898 - DNA, 22 bp, Homo sapiens
cagaaggcatagatgaaggcct

SEQ ID NO: 7254899 - DNA, 22 bp, Homo sapiens
cagaaggcatagatgaaggcct

SEQ ID NO: 7254900 - DNA, 22 bp, Homo sapiens
cagaaggctttgtggagtagac

SEQ ID NO: 7254901 - DNA, 22 bp, Homo sapiens
cactggctgagcttctctaggg

SEQ ID NO: 7254902 - DNA, 22 bp, Homo sapiens
cactggcccagccaggcctgtt

SEQ ID NO: 7254903 - DNA, 22 bp, Homo sapiens
cactggcccataaaggcctggg

SEQ ID NO: 7254904 - DNA, 22 bp, Homo sapiens
gggacagaaggaagtgagcaca

SEQ ID NO: 7254905 - DNA, 22 bp, Homo sapiens
gggactcctgcatttcaagtcc

SEQ ID NO: 7254906 - DNA, 22 bp, Homo sapiens
gggactccataagcacatggat

SEQ ID NO: 7254907 - DNA, 22 bp, Homo sapiens
gggacagacccatgggccaggt

SEQ ID NO: 7254908 - DNA, 19 bp, Homo sapiens
gggactggaggatgtggag

SEQ ID NO: 7254909 - DNA, 22 bp, Homo sapiens
gggactcctttaaggagggtga

SEQ ID NO: 7254910 - DNA, 22 bp, Homo sapiens
gggactggcacagggctgggag

SEQ ID NO: 7254911 - DNA, 22 bp, Homo sapiens
gggactggatagatgtgggtga

SEQ ID NO: 7254912 - DNA, 22 bp, Homo sapiens
gggactggagtagaggccggtg

SEQ ID NO: 7254913 - DNA, 22 bp, Homo sapiens
gggaaggacattctgggctcag

SEQ ID NO: 7254914 - DNA, 23 bp, Homo sapiens
gggaaaggatatgatcctagggg

SEQ ID NO: 7254915 - DNA, 23 bp, Homo sapiens
gggaaaggatatgatcctagggg

SEQ ID NO: 7254916 - DNA, 22 bp, Homo sapiens
gggaaaggatcagtgggaggct

SEQ ID NO: 7254917 - DNA, 18 bp, Homo sapiens
gggaagccgggaagccgg

SEQ ID NO: 7254918 - DNA, 22 bp, Homo sapiens
cagacagggccctgtgatggta

SEQ ID NO: 7254919 - DNA, 22 bp, Homo sapiens
gggatgagagtagggtgtgaaa

SEQ ID NO: 7254920 - DNA, 22 bp, Homo sapiens
gggcaagcagtgaggacagcac

SEQ ID NO: 7254921 - DNA, 17 bp, Homo sapiens
cagacaggctgtcaccc

SEQ ID NO: 7254922 - DNA, 22 bp, Homo sapiens
gggcacaccttgtctgagcaca

SEQ ID NO: 7254923 - DNA, 20 bp, Homo sapiens
gggcaaggaaacagccccca

SEQ ID NO: 7254924 - DNA, 22 bp, Homo sapiens
gggcaaggcagaagagttggag

SEQ ID NO: 7254925 - DNA, 22 bp, Homo sapiens
gggagggccaggctcacccagg

SEQ ID NO: 7254926 - DNA, 22 bp, Homo sapiens
gggagggccaggctcacccagg

SEQ ID NO: 7254927 - DNA, 22 bp, Homo sapiens
gggagggccaggctcacccagg

SEQ ID NO: 7254928 - DNA, 20 bp, Homo sapiens
gggaggccccagagtccagg

SEQ ID NO: 7254929 - DNA, 20 bp, Homo sapiens
gggaggcattggtccctcac

SEQ ID NO: 7254930 - DNA, 22 bp, Homo sapiens
gggagggccagtgctctctaga

SEQ ID NO: 7254931 - DNA, 22 bp, Homo sapiens
gggagggccagtgctctctaga

SEQ ID NO: 7254932 - DNA, 22 bp, Homo sapiens
gggagggcttggacccagatgt

SEQ ID NO: 7254933 - DNA, 22 bp, Homo sapiens
gggaggtcctaaaggggaccag

SEQ ID NO: 7254934 - DNA, 22 bp, Homo sapiens
gggaggtcagggtgcctgctgg

SEQ ID NO: 7254935 - DNA, 22 bp, Homo sapiens
gggaggtcagggtgcctgctgg

SEQ ID NO: 7254936 - DNA, 22 bp, Homo sapiens
gggaggggttgcatgtttgagt

SEQ ID NO: 7254937 - DNA, 22 bp, Homo sapiens
gggaggggttgcatgtttgagt

SEQ ID NO: 7254938 - DNA, 22 bp, Homo sapiens
gggagggtctgagagctgcacc

SEQ ID NO: 7254939 - DNA, 22 bp, Homo sapiens
gggagggtctgccatgctccct

SEQ ID NO: 7254940 - DNA, 22 bp, Homo sapiens
gggagcactgagaggcaggtag

SEQ ID NO: 7254941 - DNA, 19 bp, Homo sapiens
gggagcaggaaagctgtgg

SEQ ID NO: 7254942 - DNA, 22 bp, Homo sapiens
gggagcaggacataatagcaat

SEQ ID NO: 7254943 - DNA, 22 bp, Homo sapiens
cagacaggagactggatcatgg

SEQ ID NO: 7254944 - DNA, 22 bp, Homo sapiens
cagacaggcaggtgagagctcc

SEQ ID NO: 7254945 - DNA, 22 bp, Homo sapiens
cagaagttctttcatataggct

SEQ ID NO: 7254946 - DNA, 22 bp, Homo sapiens
cagacagaaggctccttgaggt

SEQ ID NO: 7254947 - DNA, 22 bp, Homo sapiens
cagacaggaagttcagaagaaa

SEQ ID NO: 7254948 - DNA, 22 bp, Homo sapiens
cagaagtgatgttgagctagtc

SEQ ID NO: 7254949 - DNA, 22 bp, Homo sapiens
cagaagtggcatcattcaagag

SEQ ID NO: 7254950 - DNA, 22 bp, Homo sapiens
cagaagtggatattagagtaat

SEQ ID NO: 7254951 - DNA, 22 bp, Homo sapiens
cagaagtgcaatttaaattagg

SEQ ID NO: 7254952 - DNA, 22 bp, Homo sapiens
cagaagttagtcttaattataa

SEQ ID NO: 7254953 - DNA, 22 bp, Homo sapiens
cagaagtggtattaattagatt

SEQ ID NO: 7254954 - DNA, 22 bp, Homo sapiens
cagaagtggcctcagagggagt

SEQ ID NO: 7254955 - DNA, 22 bp, Homo sapiens
cagaggtgtacagagggaggcc

SEQ ID NO: 7254956 - DNA, 22 bp, Homo sapiens
cagaggtttgatcgagtaggtc

SEQ ID NO: 7254957 - DNA, 22 bp, Homo sapiens
gggtgcaggggaccctagggac

SEQ ID NO: 7254958 - DNA, 22 bp, Homo sapiens
gggtgcagggtctccagcagct

SEQ ID NO: 7254959 - DNA, 22 bp, Homo sapiens
gggtgctcctggcggcctcttt

SEQ ID NO: 7254960 - DNA, 22 bp, Homo sapiens
gggtgctcatggataaggcgaa

SEQ ID NO: 7254961 - DNA, 22 bp, Homo sapiens
gggtgcctgcctcaggcagtgt

SEQ ID NO: 7254962 - DNA, 22 bp, Homo sapiens
gggtgcctgagttagggcagaa

SEQ ID NO: 7254963 - DNA, 22 bp, Homo sapiens
gggtgcagtggttcacgcctgt

SEQ ID NO: 7254964 - DNA, 22 bp, Homo sapiens
gggtgctcttgggaaacgtagt

SEQ ID NO: 7254965 - DNA, 22 bp, Homo sapiens
gggtgctgactggggcctgaaa

SEQ ID NO: 7254966 - DNA, 22 bp, Homo sapiens
gggtgctgaggaagacagcagg

SEQ ID NO: 7254967 - DNA, 22 bp, Homo sapiens
gggtgctgaggaagacagcagg

SEQ ID NO: 7254968 - DNA, 23 bp, Homo sapiens
gggtgctgcctgtagtcatgctg

SEQ ID NO: 7254969 - DNA, 22 bp, Homo sapiens
cagagctgtatttatctttcca

SEQ ID NO: 7254970 - DNA, 22 bp, Homo sapiens
cagagctggtgttacaagtcca

SEQ ID NO: 7254971 - DNA, 20 bp, Homo sapiens
ggggaagaaaaggatgtgat

SEQ ID NO: 7254972 - DNA, 20 bp, Homo sapiens
ggggaagaaaaggatgtgat

SEQ ID NO: 7254973 - DNA, 22 bp, Homo sapiens
ggggaagaaatctgggttcttc

SEQ ID NO: 7254974 - DNA, 22 bp, Homo sapiens
gggcacagaagtctaagacatc

SEQ ID NO: 7254975 - DNA, 22 bp, Homo sapiens
gggcactgtgctaggtgctgag

SEQ ID NO: 7254976 - DNA, 22 bp, Homo sapiens
gggcactgtgctgggtgcttta

SEQ ID NO: 7254977 - DNA, 22 bp, Homo sapiens
gggcactgtgttcagagtgcag

SEQ ID NO: 7254978 - DNA, 22 bp, Homo sapiens
cagagcccctcagctctctccc

SEQ ID NO: 7254979 - DNA, 22 bp, Homo sapiens
cagagcccctcagctctctccc

SEQ ID NO: 7254980 - DNA, 22 bp, Homo sapiens
cagagcccctcgtctccaccac

SEQ ID NO: 7254981 - DNA, 22 bp, Homo sapiens
gggccttctagttagccccaat

SEQ ID NO: 7254982 - DNA, 22 bp, Homo sapiens
gggccttccgactcccaaggcc

SEQ ID NO: 7254983 - DNA, 22 bp, Homo sapiens
gggccttcagccttggactgag

SEQ ID NO: 7254984 - DNA, 22 bp, Homo sapiens
gggcgagggcgaaagcgagagc

SEQ ID NO: 7254985 - DNA, 21 bp, Homo sapiens
gggcgaggcctgatgtggctc

SEQ ID NO: 7254986 - DNA, 22 bp, Homo sapiens
gggcgaggactgactctgggca

SEQ ID NO: 7254987 - DNA, 22 bp, Homo sapiens
cagagctgcaaatgcccctccg

SEQ ID NO: 7254988 - DNA, 22 bp, Homo sapiens
cagagctgagtcttcaaggttg

SEQ ID NO: 7254989 - DNA, 22 bp, Homo sapiens
cagagctgacccaaggattgaa

SEQ ID NO: 7254990 - DNA, 22 bp, Homo sapiens
gggcgccgtgggaaacagccgg

SEQ ID NO: 7254991 - DNA, 22 bp, Homo sapiens
gggcgcagccaatcctggccct

SEQ ID NO: 7254992 - DNA, 22 bp, Homo sapiens
gggcgcagccaatcctggccct

SEQ ID NO: 7254993 - DNA, 22 bp, Homo sapiens
cagagctgcagattgaaggcat

SEQ ID NO: 7254994 - DNA, 22 bp, Homo sapiens
cagagctgcgctttttcctggt

SEQ ID NO: 7254995 - DNA, 19 bp, Homo sapiens
cagagctgctggcctcgtc

SEQ ID NO: 7254996 - DNA, 22 bp, Homo sapiens
cagagctgctcatggtggccag

SEQ ID NO: 7254997 - DNA, 23 bp, Homo sapiens
ggggaaagaccatgcttgaggac

SEQ ID NO: 7254998 - DNA, 22 bp, Homo sapiens
ggggaaagccagccctgcttcc

SEQ ID NO: 7254999 - DNA, 22 bp, Homo sapiens
ggggaaagtgaattgtgtagtg

SEQ ID NO: 7255000 - DNA, 22 bp, Homo sapiens
ggggaaaggccatggcaagaac

SEQ ID NO: 7255001 - DNA, 20 bp, Homo sapiens
ggggaagaaaaggatgtgat

SEQ ID NO: 7255002 - DNA, 22 bp, Homo sapiens
gctgtctgagaacatggtggaa

SEQ ID NO: 7255003 - DNA, 19 bp, Homo sapiens
gctgtctgatgctgaggtc

SEQ ID NO: 7255004 - DNA, 19 bp, Homo sapiens
gctgtctgatgctgaggtc

SEQ ID NO: 7255005 - DNA, 22 bp, Homo sapiens
gctgtctcatgggtgctagtcc

SEQ ID NO: 7255006 - DNA, 22 bp, Homo sapiens
gctgtctccatagctgtgtgtc

SEQ ID NO: 7255007 - DNA, 22 bp, Homo sapiens
caaggcagctgtagggatttgg

SEQ ID NO: 7255008 - DNA, 22 bp, Homo sapiens
caaggcagctattgtctccata

SEQ ID NO: 7255009 - DNA, 22 bp, Homo sapiens
caaggcagcgttcctttctgga

SEQ ID NO: 7255010 - DNA, 22 bp, Homo sapiens
caaggcagcccgctgaaccaca

SEQ ID NO: 7255011 - DNA, 20 bp, Homo sapiens
caaggcagaccagagtgagt

SEQ ID NO: 7255012 - DNA, 20 bp, Homo sapiens
caaggcagaccagagtgagt

SEQ ID NO: 7255013 - DNA, 22 bp, Homo sapiens
caaggcagaattcagactcagg

SEQ ID NO: 7255014 - DNA, 22 bp, Homo sapiens
gctgtggcctccagcactcccc

SEQ ID NO: 7255015 - DNA, 22 bp, Homo sapiens
gcttctcctcccgctcccaggc

SEQ ID NO: 7255016 - DNA, 22 bp, Homo sapiens
gcttggcatacacttagtgcgt

SEQ ID NO: 7255017 - DNA, 22 bp, Homo sapiens
gcttggcatatacttagtgcat

SEQ ID NO: 7255018 - DNA, 23 bp, Homo sapiens
cacaaaggttccattctctcacc

SEQ ID NO: 7255019 - DNA, 22 bp, Homo sapiens
cacaaaggagaatgtcagcata

SEQ ID NO: 7255020 - DNA, 22 bp, Homo sapiens
cacaccagatggcagcgtggga

SEQ ID NO: 7255021 - DNA, 19 bp, Homo sapiens
cacacccatgcttgccaag

SEQ ID NO: 7255022 - DNA, 22 bp, Homo sapiens
cacaatttggtgctaaagaaag

SEQ ID NO: 7255023 - DNA, 22 bp, Homo sapiens
cacacatcaacctagacattgt

SEQ ID NO: 7255024 - DNA, 22 bp, Homo sapiens
caagattactatccactgctgg

SEQ ID NO: 7255025 - DNA, 22 bp, Homo sapiens
caagatgatccctgaaggcagc

SEQ ID NO: 7255026 - DNA, 22 bp, Homo sapiens
caagatcaatcaatactcctta

SEQ ID NO: 7255027 - DNA, 22 bp, Homo sapiens
caagatgaatgatgaagtgtgt

SEQ ID NO: 7255028 - DNA, 22 bp, Homo sapiens
caagatgaagtgaagattagaa

SEQ ID NO: 7255029 - DNA, 22 bp, Homo sapiens
caagagttgagggatgtcagtt

SEQ ID NO: 7255030 - DNA, 22 bp, Homo sapiens
caagataatttattctgagttt

SEQ ID NO: 7255031 - DNA, 22 bp, Homo sapiens
caagaggcaaattgtctagaag

SEQ ID NO: 7255032 - DNA, 22 bp, Homo sapiens
gctgctggaagcatgcgatgaa

SEQ ID NO: 7255033 - DNA, 22 bp, Homo sapiens
gctcctcttatttcatcagggc

SEQ ID NO: 7255034 - DNA, 22 bp, Homo sapiens
gctcctgcaggacccaggagac

SEQ ID NO: 7255035 - DNA, 23 bp, Homo sapiens
gctgccacagggctcaggcaggt

SEQ ID NO: 7255036 - DNA, 23 bp, Homo sapiens
gctgccacagggctcaggcaggt

SEQ ID NO: 7255037 - DNA, 22 bp, Homo sapiens
gctgccacattttcaggactaa

SEQ ID NO: 7255038 - DNA, 22 bp, Homo sapiens
caacagttctcatagcagattc

SEQ ID NO: 7255039 - DNA, 22 bp, Homo sapiens
caacataacaaattggctgggc

SEQ ID NO: 7255040 - DNA, 22 bp, Homo sapiens
cactgcctggaaggagagacat

SEQ ID NO: 7255041 - DNA, 22 bp, Homo sapiens
ggctagggagacagagggcatg

SEQ ID NO: 7255042 - DNA, 19 bp, Homo sapiens
ggctcaagcatccaggtag

SEQ ID NO: 7255043 - DNA, 22 bp, Homo sapiens
ggctagggatctagaccaggac

SEQ ID NO: 7255044 - DNA, 22 bp, Homo sapiens
cactgcagcctctgcctctcag

SEQ ID NO: 7255045 - DNA, 22 bp, Homo sapiens
ggcctctctagcatccagcctg

SEQ ID NO: 7255046 - DNA, 22 bp, Homo sapiens
ggcctctctagcatccagcctg

SEQ ID NO: 7255047 - DNA, 20 bp, Homo sapiens
ggcctcggacttcatcgtag

SEQ ID NO: 7255048 - DNA, 22 bp, Homo sapiens
ggcctcggcccactgctgcggt

SEQ ID NO: 7255049 - DNA, 22 bp, Homo sapiens
ggcctctcagggcagagaccct

SEQ ID NO: 7255050 - DNA, 22 bp, Homo sapiens
ggcctctcatgcccagagccaa

SEQ ID NO: 7255051 - DNA, 23 bp, Homo sapiens
ggcctcctggtctaggctagact

SEQ ID NO: 7255052 - DNA, 22 bp, Homo sapiens
cacccacattccatcactctgc

SEQ ID NO: 7255053 - DNA, 19 bp, Homo sapiens
ggcagctcttgtcttctgc

SEQ ID NO: 7255054 - DNA, 22 bp, Homo sapiens
caccctggctggaggtgcagtg

SEQ ID NO: 7255055 - DNA, 22 bp, Homo sapiens
caccctgactggccctgcagga

SEQ ID NO: 7255056 - DNA, 22 bp, Homo sapiens
cacccctcgccactgcccttgt

SEQ ID NO: 7255057 - DNA, 20 bp, Homo sapiens
caccctcccagcacctatgc

SEQ ID NO: 7255058 - DNA, 22 bp, Homo sapiens
caccccacatcaggcttctcca

SEQ ID NO: 7255059 - DNA, 22 bp, Homo sapiens
caccccacatcaggcttctcca

SEQ ID NO: 7255060 - DNA, 23 bp, Homo sapiens
caccccaccctgaggaggaggga

SEQ ID NO: 7255061 - DNA, 22 bp, Homo sapiens
ggcactgcttcctgagcctgag

SEQ ID NO: 7255062 - DNA, 22 bp, Homo sapiens
ggcactgctgtaggcagtgagg

SEQ ID NO: 7255063 - DNA, 22 bp, Homo sapiens
ggcagagccttctggagctcgc

SEQ ID NO: 7255064 - DNA, 22 bp, Homo sapiens
ggcacagggaggccctggtgtg

SEQ ID NO: 7255065 - DNA, 20 bp, Homo sapiens
ggcagccaatcagcgtgccg

SEQ ID NO: 7255066 - DNA, 22 bp, Homo sapiens
ggcagatggaagaggctgggtc

SEQ ID NO: 7255067 - DNA, 22 bp, Homo sapiens
cacagtgctcaaacacaagtgc

SEQ ID NO: 7255068 - DNA, 22 bp, Homo sapiens
cacagtgcgaaagaaacccagc

SEQ ID NO: 7255069 - DNA, 22 bp, Homo sapiens
ggaggccttgcctgcaggcaca

SEQ ID NO: 7255070 - DNA, 22 bp, Homo sapiens
ggaggcgcggctcggctgtgcc

SEQ ID NO: 7255071 - DNA, 20 bp, Homo sapiens
ggaggcgctgggctcgcgct

SEQ ID NO: 7255072 - DNA, 22 bp, Homo sapiens
ggaggcggaagttgcagtgagc

SEQ ID NO: 7255073 - DNA, 22 bp, Homo sapiens
ggaggcggacacaggtagtgtt

SEQ ID NO: 7255074 - DNA, 22 bp, Homo sapiens
ggaggcggagcttgcagtgagc

SEQ ID NO: 7255075 - DNA, 22 bp, Homo sapiens
cacagctgttttctccaggcag

SEQ ID NO: 7255076 - DNA, 22 bp, Homo sapiens
cacactagcacttcagaggttc

SEQ ID NO: 7255077 - DNA, 22 bp, Homo sapiens
ggatgggcccgggacggcgctg

SEQ ID NO: 7255078 - DNA, 22 bp, Homo sapiens
ggatgggcagacaggacggcac

SEQ ID NO: 7255079 - DNA, 22 bp, Homo sapiens
ggatgtctttactttgggattt

SEQ ID NO: 7255080 - DNA, 22 bp, Homo sapiens
cacagggagaggaacagcgcag

SEQ ID NO: 7255081 - DNA, 23 bp, Homo sapiens
ggatgggcaagcctagtgcctac

SEQ ID NO: 7255082 - DNA, 22 bp, Homo sapiens
ggatgggaacttggtagggcat

SEQ ID NO: 7255083 - DNA, 22 bp, Homo sapiens
ggagggaggttagattcaagct

SEQ ID NO: 7255084 - DNA, 22 bp, Homo sapiens
ggagggagtcagctgattagaa

SEQ ID NO: 7255085 - DNA, 22 bp, Homo sapiens
ggagggagtttcattcctgccc

SEQ ID NO: 7255086 - DNA, 22 bp, Homo sapiens
ggagggagtcagctgattagaa

SEQ ID NO: 7255087 - DNA, 22 bp, Homo sapiens
ggagggagcatccccttgctga

SEQ ID NO: 7255088 - DNA, 22 bp, Homo sapiens
ggagggagggctagaccaaaga

SEQ ID NO: 7255089 - DNA, 22 bp, Homo sapiens
ggaggcggaggctgcagtgagc

SEQ ID NO: 7255090 - DNA, 22 bp, Homo sapiens
ggagggagcagagaacccaacc

SEQ ID NO: 7255091 - DNA, 22 bp, Homo sapiens
atttattggatgcttacttggg

SEQ ID NO: 7255092 - DNA, 22 bp, Homo sapiens
atttattggatgcttacttggg

SEQ ID NO: 7255093 - DNA, 22 bp, Homo sapiens
atttattgagcctttcctatgt

SEQ ID NO: 7255094 - DNA, 22 bp, Homo sapiens
atttattggatgcttacttggg

SEQ ID NO: 7255095 - DNA, 22 bp, Homo sapiens
atttattggtttgcatggtgaa

SEQ ID NO: 7255096 - DNA, 22 bp, Homo sapiens
atttattgagagggaggggaat

SEQ ID NO: 7255097 - DNA, 21 bp, Homo sapiens
atttagaaggaaattttgcaa

SEQ ID NO: 7255098 - DNA, 22 bp, Homo sapiens
atttattgagacttaacaaccc

SEQ ID NO: 7255099 - DNA, 22 bp, Homo sapiens
gccaggccctgggcacttcgtg

SEQ ID NO: 7255100 - DNA, 22 bp, Homo sapiens
gccaggccactcccgggtcctg

SEQ ID NO: 7255101 - DNA, 22 bp, Homo sapiens
gccaggcctgcaagtgctggtg

SEQ ID NO: 7255102 - DNA, 22 bp, Homo sapiens
atttcacaaaccatcctgattt

SEQ ID NO: 7255103 - DNA, 22 bp, Homo sapiens
atttcagattcagaaatgtagg

SEQ ID NO: 7255104 - DNA, 22 bp, Homo sapiens
atttcagatgaccaaatggaaa

SEQ ID NO: 7255105 - DNA, 22 bp, Homo sapiens
atttcagagtgagagtgctcaa

SEQ ID NO: 7255106 - DNA, 22 bp, Homo sapiens
atttcagagctttgcagctaat

SEQ ID NO: 7255107 - DNA, 21 bp, Homo sapiens
atttcagagcacacaagtaaa

SEQ ID NO: 7255108 - DNA, 22 bp, Homo sapiens
atttcagagaatgaacctaatc

SEQ ID NO: 7255109 - DNA, 22 bp, Homo sapiens
atttcagactgtgttggaaaat

SEQ ID NO: 7255110 - DNA, 22 bp, Homo sapiens
atttccttgcaagtttctgtaa

SEQ ID NO: 7255111 - DNA, 22 bp, Homo sapiens
atttctactgtgagaaacatga

SEQ ID NO: 7255112 - DNA, 22 bp, Homo sapiens
atttctataggaggacagtatt

SEQ ID NO: 7255113 - DNA, 22 bp, Homo sapiens
atttctcaaaggaatagagtga

SEQ ID NO: 7255114 - DNA, 21 bp, Homo sapiens
attggcacaccttttattgga

SEQ ID NO: 7255115 - DNA, 22 bp, Homo sapiens
atttagaaattccaaaagtatt

SEQ ID NO: 7255116 - DNA, 22 bp, Homo sapiens
atttactggaaaaactatgagc

SEQ ID NO: 7255117 - DNA, 19 bp, Homo sapiens
atttactgcctaaaatctc

SEQ ID NO: 7255118 - DNA, 22 bp, Homo sapiens
atttactgaggtaaataaactg

SEQ ID NO: 7255119 - DNA, 22 bp, Homo sapiens
atttactgagcagctaccatgt

SEQ ID NO: 7255120 - DNA, 22 bp, Homo sapiens
atttagaactttgtttgccaat

SEQ ID NO: 7255121 - DNA, 22 bp, Homo sapiens
atttacagaagcatgtaatagc

SEQ ID NO: 7255122 - DNA, 22 bp, Homo sapiens
gccaggaggcttaactggacag

SEQ ID NO: 7255123 - DNA, 22 bp, Homo sapiens
gccaggagggaaaggacaattt

SEQ ID NO: 7255124 - DNA, 22 bp, Homo sapiens
gctcaggcaggagtgcagtggc

SEQ ID NO: 7255125 - DNA, 22 bp, Homo sapiens
gctcaggcaggagtgcagtggc

SEQ ID NO: 7255126 - DNA, 22 bp, Homo sapiens
gctcaggcaaatttctggtgaa

SEQ ID NO: 7255127 - DNA, 22 bp, Homo sapiens
gcgagggcacgcggttgaaggc

SEQ ID NO: 7255128 - DNA, 22 bp, Homo sapiens
gcgaggaggggtgctgggcccc

SEQ ID NO: 7255129 - DNA, 22 bp, Homo sapiens
gcgagggcacgcggttgaaggc

SEQ ID NO: 7255130 - DNA, 22 bp, Homo sapiens
gcgagggcacgcggttgaaggc

SEQ ID NO: 7255131 - DNA, 22 bp, Homo sapiens
gcgcactgggcgcacgcgtagg

SEQ ID NO: 7255132 - DNA, 22 bp, Homo sapiens
gcgcacacgcgtgtgactcatc

SEQ ID NO: 7255133 - DNA, 22 bp, Homo sapiens
gcgcaccacctccaggtggccg

SEQ ID NO: 7255134 - DNA, 22 bp, Homo sapiens
gcgcagagtagcagagtgctga

SEQ ID NO: 7255135 - DNA, 22 bp, Homo sapiens
caaaccattaagcatgttgagt

SEQ ID NO: 7255136 - DNA, 22 bp, Homo sapiens
gcctgggagtgcacagtgaggt

SEQ ID NO: 7255137 - DNA, 22 bp, Homo sapiens
caaaaagcttaggtaacaagcc

SEQ ID NO: 7255138 - DNA, 22 bp, Homo sapiens
caaaaaacacagatgtctgtgt

SEQ ID NO: 7255139 - DNA, 22 bp, Homo sapiens
caaaagaagctcttggggctag

SEQ ID NO: 7255140 - DNA, 19 bp, Homo sapiens
gcgaggaagtcactgtggc

SEQ ID NO: 7255141 - DNA, 22 bp, Homo sapiens
gcgagcctctggagtcctctgg

SEQ ID NO: 7255142 - DNA, 19 bp, Homo sapiens
gcgaggaagtcactgtggt

SEQ ID NO: 7255143 - DNA, 22 bp, Homo sapiens
gcctggaggaatgtagctgagg

SEQ ID NO: 7255144 - DNA, 22 bp, Homo sapiens
gcctgggagatgcgttgtggcc

SEQ ID NO: 7255145 - DNA, 22 bp, Homo sapiens
gcctgggagcacatcggggtcc

SEQ ID NO: 7255146 - DNA, 22 bp, Homo sapiens
gcctggagctactggacactga

SEQ ID NO: 7255147 - DNA, 22 bp, Homo sapiens
gcctggagctcatgtgggcatt

SEQ ID NO: 7255148 - DNA, 22 bp, Homo sapiens
gcctggagctctccacttgggg

SEQ ID NO: 7255149 - DNA, 22 bp, Homo sapiens
gcctggagctcggctgagggcg

SEQ ID NO: 7255150 - DNA, 22 bp, Homo sapiens
gcctggagctcggctgagggcg

SEQ ID NO: 7255151 - DNA, 22 bp, Homo sapiens
gcctctctctacccagtatgat

SEQ ID NO: 7255152 - DNA, 22 bp, Homo sapiens
gcctgctggaggagcctcaggg

SEQ ID NO: 7255153 - DNA, 22 bp, Homo sapiens
atttctcaagtaaatgagtcat

SEQ ID NO: 7255154 - DNA, 22 bp, Homo sapiens
atttctcaaccaggtcaaaaag

SEQ ID NO: 7255155 - DNA, 22 bp, Homo sapiens
atttctcactcacagtccatgt

SEQ ID NO: 7255156 - DNA, 22 bp, Homo sapiens
atttctcacaaagttgcttatc

SEQ ID NO: 7255157 - DNA, 22 bp, Homo sapiens
atttctcagaccagagaggtgt

SEQ ID NO: 7255158 - DNA, 22 bp, Homo sapiens
atttctcagcacttcctatctc

SEQ ID NO: 7255159 - DNA, 22 bp, Homo sapiens
atttctcagtaggtgcacagtg

SEQ ID NO: 7255160 - DNA, 22 bp, Homo sapiens
atttctcagtgaaatgacaggc

SEQ ID NO: 7255161 - DNA, 22 bp, Homo sapiens
atttctcagtgtacattatgtt

SEQ ID NO: 7255162 - DNA, 22 bp, Homo sapiens
gcctccagggatgattccttcc

SEQ ID NO: 7255163 - DNA, 22 bp, Homo sapiens
gcctccccaagcagcagggatt

SEQ ID NO: 7255164 - DNA, 22 bp, Homo sapiens
gcctccccaagcagcagggatt

SEQ ID NO: 7255165 - DNA, 22 bp, Homo sapiens
gcctccccaaagtgctgacagc

SEQ ID NO: 7255166 - DNA, 21 bp, Homo sapiens
gcctctccaaatcctgccttc

SEQ ID NO: 7255167 - DNA, 22 bp, Homo sapiens
gcctctccgagccactgcctct

SEQ ID NO: 7255168 - DNA, 22 bp, Homo sapiens
gcctctcctcttaataccatta

SEQ ID NO: 7255169 - DNA, 22 bp, Homo sapiens
gcctctcctggagaaggcaggg

SEQ ID NO: 7255170 - DNA, 22 bp, Homo sapiens
atgtttctgaagtttacagata

SEQ ID NO: 7255171 - DNA, 22 bp, Homo sapiens
atgttttcaaagtaaacttgta

SEQ ID NO: 7255172 - DNA, 22 bp, Homo sapiens
atgttttctccatgttatgctt

SEQ ID NO: 7255173 - DNA, 18 bp, Homo sapiens
atgtttctcttggctctg

SEQ ID NO: 7255174 - DNA, 22 bp, Homo sapiens
atgtgtgtgtatatacacacat

SEQ ID NO: 7255175 - DNA, 22 bp, Homo sapiens
attaaaattccaaggtatgcca

SEQ ID NO: 7255176 - DNA, 22 bp, Homo sapiens
attacaataatacatgctcatt

SEQ ID NO: 7255177 - DNA, 22 bp, Homo sapiens
attaatgacgcagataataatt

SEQ ID NO: 7255178 - DNA, 22 bp, Homo sapiens
attaatgacgcagataataatt

SEQ ID NO: 7255179 - DNA, 22 bp, Homo sapiens
attagaatgaagtataggattt

SEQ ID NO: 7255180 - DNA, 22 bp, Homo sapiens
attagaatgcagggttcattgt

SEQ ID NO: 7255181 - DNA, 23 bp, Homo sapiens
attagacactttgggttgtcttc

SEQ ID NO: 7255182 - DNA, 22 bp, Homo sapiens
attagaattatgcttgctaatg

SEQ ID NO: 7255183 - DNA, 22 bp, Homo sapiens
attagacatcatatgattcagc

SEQ ID NO: 7255184 - DNA, 22 bp, Homo sapiens
attattctttgataaatggcag

SEQ ID NO: 7255185 - DNA, 22 bp, Homo sapiens
attattcatggtcttccacaat

SEQ ID NO: 7255186 - DNA, 22 bp, Homo sapiens
attattcattggtaggcaagct

SEQ ID NO: 7255187 - DNA, 22 bp, Homo sapiens
attattcagtcttgtaaggagt

SEQ ID NO: 7255188 - DNA, 20 bp, Homo sapiens
attattcatacatgtgtgac

SEQ ID NO: 7255189 - DNA, 22 bp, Homo sapiens
attattcaatcatattaaaagt

SEQ ID NO: 7255190 - DNA, 22 bp, Homo sapiens
attattcaatgttatttcagtg

SEQ ID NO: 7255191 - DNA, 22 bp, Homo sapiens
attattcaacacttgagaaatt

SEQ ID NO: 7255192 - DNA, 22 bp, Homo sapiens
attcctttggactcctccttgc

SEQ ID NO: 7255193 - DNA, 22 bp, Homo sapiens
gcagcagggagcaggggtgtca

SEQ ID NO: 7255194 - DNA, 22 bp, Homo sapiens
attctacatgatagaagggaga

SEQ ID NO: 7255195 - DNA, 22 bp, Homo sapiens
attctacacaacatgatgatgg

SEQ ID NO: 7255196 - DNA, 22 bp, Homo sapiens
attctacacaacatgatgatgg

SEQ ID NO: 7255197 - DNA, 22 bp, Homo sapiens
attctactcattgatctatata

SEQ ID NO: 7255198 - DNA, 22 bp, Homo sapiens
gcagcaggcatggccgccctgg

SEQ ID NO: 7255199 - DNA, 22 bp, Homo sapiens
attcctatcattagtgaagccc

SEQ ID NO: 7255200 - DNA, 22 bp, Homo sapiens
attcctattgccagcatagtat

SEQ ID NO: 7255201 - DNA, 22 bp, Homo sapiens
attcagtctcatcaaattcact

SEQ ID NO: 7255202 - DNA, 22 bp, Homo sapiens
attatttatcctcttggtctat

SEQ ID NO: 7255203 - DNA, 22 bp, Homo sapiens
attctgtgttaggatagatggt

SEQ ID NO: 7255204 - DNA, 22 bp, Homo sapiens
attctgtgtgtactgagatggg

SEQ ID NO: 7255205 - DNA, 22 bp, Homo sapiens
attgaagacttggtatccgtgg

SEQ ID NO: 7255206 - DNA, 22 bp, Homo sapiens
attgaagagttgattattatct

SEQ ID NO: 7255207 - DNA, 22 bp, Homo sapiens
attgaagatcagggaaagattc

SEQ ID NO: 7255208 - DNA, 22 bp, Homo sapiens
attgaacagaaaaactcagaga

SEQ ID NO: 7255209 - DNA, 22 bp, Homo sapiens
attgacagaaaagatgttggat

SEQ ID NO: 7255210 - DNA, 22 bp, Homo sapiens
cttttcagagctgagatcaccg

SEQ ID NO: 7255211 - DNA, 22 bp, Homo sapiens
cttttattttgaattaagggct

SEQ ID NO: 7255212 - DNA, 22 bp, Homo sapiens
atgaaattaatcaacacataca

SEQ ID NO: 7255213 - DNA, 22 bp, Homo sapiens
atgaaatatcttgaagaaattc

SEQ ID NO: 7255214 - DNA, 22 bp, Homo sapiens
atcttttacattactgcccaga

SEQ ID NO: 7255215 - DNA, 22 bp, Homo sapiens
atcttttctgtttgctatgtct

SEQ ID NO: 7255216 - DNA, 22 bp, Homo sapiens
atcttttatgagcgttctgaca

SEQ ID NO: 7255217 - DNA, 22 bp, Homo sapiens
atcttttactacaaatcaggtg

SEQ ID NO: 7255218 - DNA, 22 bp, Homo sapiens
atcttggattggagaaagaagt

SEQ ID NO: 7255219 - DNA, 22 bp, Homo sapiens
atcttggactacagaagagagg

SEQ ID NO: 7255220 - DNA, 22 bp, Homo sapiens
atgaaatatcttgaagaaattc

SEQ ID NO: 7255221 - DNA, 22 bp, Homo sapiens
atgaaatatcttgaagaaattc

SEQ ID NO: 7255222 - DNA, 22 bp, Homo sapiens
cttgttctgtgcttcttacatt

SEQ ID NO: 7255223 - DNA, 22 bp, Homo sapiens
cttgtggcaggtggatggtgcc

SEQ ID NO: 7255224 - DNA, 22 bp, Homo sapiens
cttgttaaattatataagcaga

SEQ ID NO: 7255225 - DNA, 22 bp, Homo sapiens
cttgttatctgaaccaaaatta

SEQ ID NO: 7255226 - DNA, 22 bp, Homo sapiens
cttgttattggaaatgtcatgc

SEQ ID NO: 7255227 - DNA, 22 bp, Homo sapiens
atctagattaggtataagagct

SEQ ID NO: 7255228 - DNA, 22 bp, Homo sapiens
atctagaagtggcatgaattac

SEQ ID NO: 7255229 - DNA, 22 bp, Homo sapiens
atctacagccagtctggtttgt

SEQ ID NO: 7255230 - DNA, 22 bp, Homo sapiens
atctacaggatagtttaatatt

SEQ ID NO: 7255231 - DNA, 22 bp, Homo sapiens
atctacaggattttacagagtt

SEQ ID NO: 7255232 - DNA, 22 bp, Homo sapiens
cttggtgcccagcaggtggctg

SEQ ID NO: 7255233 - DNA, 22 bp, Homo sapiens
cttggtgccacagcagcttgcg

SEQ ID NO: 7255234 - DNA, 20 bp, Homo sapiens
atcttcttggccagcttgct

SEQ ID NO: 7255235 - DNA, 22 bp, Homo sapiens
atcttctgggcagtgaaaattg

SEQ ID NO: 7255236 - DNA, 22 bp, Homo sapiens
cttggcctgtggctcaagaatt

SEQ ID NO: 7255237 - DNA, 22 bp, Homo sapiens
cttggcctgggccgcagccact

SEQ ID NO: 7255238 - DNA, 22 bp, Homo sapiens
cttggcctgcccagccagaagg

SEQ ID NO: 7255239 - DNA, 22 bp, Homo sapiens
cttggcctgcaggcagcagcgc

SEQ ID NO: 7255240 - DNA, 22 bp, Homo sapiens
cttggcctgacatgtggcaggg

SEQ ID NO: 7255241 - DNA, 22 bp, Homo sapiens
cttggcattttgctctgatatg

SEQ ID NO: 7255242 - DNA, 22 bp, Homo sapiens
cttggcatgttcatctgcttgg

SEQ ID NO: 7255243 - DNA, 22 bp, Homo sapiens
cttggcattgtgttgatagaag

SEQ ID NO: 7255244 - DNA, 22 bp, Homo sapiens
cttggcatgcagcaggcactca

SEQ ID NO: 7255245 - DNA, 21 bp, Homo sapiens
cttggcctactagaaaacctt

SEQ ID NO: 7255246 - DNA, 22 bp, Homo sapiens
cttggcctcttctcagggtggg

SEQ ID NO: 7255247 - DNA, 21 bp, Homo sapiens
cttggcctctagctagagctg

SEQ ID NO: 7255248 - DNA, 20 bp, Homo sapiens
cttggcctacttagctttgt

SEQ ID NO: 7255249 - DNA, 19 bp, Homo sapiens
cttggcatctgtgaagtga

SEQ ID NO: 7255250 - DNA, 20 bp, Homo sapiens
atgagtttaaacattcagag

SEQ ID NO: 7255251 - DNA, 20 bp, Homo sapiens
atgagtttaaacattcagag

SEQ ID NO: 7255252 - DNA, 22 bp, Homo sapiens
gaaagcagtaaatgggtcccat

SEQ ID NO: 7255253 - DNA, 22 bp, Homo sapiens
atgaggccaccttctacatttc

SEQ ID NO: 7255254 - DNA, 22 bp, Homo sapiens
atgagtaaaaccactatttaca

SEQ ID NO: 7255255 - DNA, 22 bp, Homo sapiens
atgagtaagaccataatttttg

SEQ ID NO: 7255256 - DNA, 22 bp, Homo sapiens
atgagtaagataggcaatgtgt

SEQ ID NO: 7255257 - DNA, 22 bp, Homo sapiens
atgagcttggtccagcaggctt

SEQ ID NO: 7255258 - DNA, 22 bp, Homo sapiens
atgagcttccagacaaaggcat

SEQ ID NO: 7255259 - DNA, 22 bp, Homo sapiens
atgagcttcccagacaggatgg

SEQ ID NO: 7255260 - DNA, 22 bp, Homo sapiens
gaaagcacgatagtagcaaaag

SEQ ID NO: 7255261 - DNA, 22 bp, Homo sapiens
gaaagcacccaagatttccttc

SEQ ID NO: 7255262 - DNA, 22 bp, Homo sapiens
gaaagcacatactataaatcac

SEQ ID NO: 7255263 - DNA, 22 bp, Homo sapiens
gaaagcacagttctgaccatgt

SEQ ID NO: 7255264 - DNA, 22 bp, Homo sapiens
gaaagcacagttcatgagacaa

SEQ ID NO: 7255265 - DNA, 21 bp, Homo sapiens
gaaagcacagaaaggactctt

SEQ ID NO: 7255266 - DNA, 22 bp, Homo sapiens
gaaagcacaggctcaggaacag

SEQ ID NO: 7255267 - DNA, 22 bp, Homo sapiens
atgcattcatgaagattgcaca

SEQ ID NO: 7255268 - DNA, 22 bp, Homo sapiens
atgcatgttactgcccccgtct

SEQ ID NO: 7255269 - DNA, 21 bp, Homo sapiens
atgcatgttacagtatatgcc

SEQ ID NO: 7255270 - DNA, 22 bp, Homo sapiens
atgcatgtgtgaattatttgac

SEQ ID NO: 7255271 - DNA, 22 bp, Homo sapiens
atgcatgtgtacatgcatagca

SEQ ID NO: 7255272 - DNA, 22 bp, Homo sapiens
atgcatgtgcatggctctatct

SEQ ID NO: 7255273 - DNA, 22 bp, Homo sapiens
atgcatgtctgccagttgctta

SEQ ID NO: 7255274 - DNA, 22 bp, Homo sapiens
atgcattctagcctggacaaca

SEQ ID NO: 7255275 - DNA, 22 bp, Homo sapiens
atgcatttatgtgtgtacattg

SEQ ID NO: 7255276 - DNA, 22 bp, Homo sapiens
atgcatttgacgggatatattt

SEQ ID NO: 7255277 - DNA, 22 bp, Homo sapiens
atgcatatgcatggacactcag

SEQ ID NO: 7255278 - DNA, 22 bp, Homo sapiens
atgcatctattcccaagggcag

SEQ ID NO: 7255279 - DNA, 22 bp, Homo sapiens
atgcatatgccgtagaataagt

SEQ ID NO: 7255280 - DNA, 22 bp, Homo sapiens
atgcagatttctttgctgcacc

SEQ ID NO: 7255281 - DNA, 22 bp, Homo sapiens
atgtgtcaattttcaaatgctt

SEQ ID NO: 7255282 - DNA, 22 bp, Homo sapiens
atgtgtgtatatatagtcattt

SEQ ID NO: 7255283 - DNA, 22 bp, Homo sapiens
gaggggagcatgatctagattg

SEQ ID NO: 7255284 - DNA, 16 bp, Homo sapiens
gaggggagcagtaggc

SEQ ID NO: 7255285 - DNA, 22 bp, Homo sapiens
atgtctggtggtcgatgctaca

SEQ ID NO: 7255286 - DNA, 22 bp, Homo sapiens
gaggcctgggcaagggggtctg

SEQ ID NO: 7255287 - DNA, 22 bp, Homo sapiens
gaggcctgggttacctactcgt

SEQ ID NO: 7255288 - DNA, 22 bp, Homo sapiens
atgtctggctaaaatccctggt

SEQ ID NO: 7255289 - DNA, 22 bp, Homo sapiens
atgtctggaggtcatctggtta

SEQ ID NO: 7255290 - DNA, 19 bp, Homo sapiens
atgtctgggtaacagctgc

SEQ ID NO: 7255291 - DNA, 22 bp, Homo sapiens
gaggcctggctgggaggaggtg

SEQ ID NO: 7255292 - DNA, 22 bp, Homo sapiens
gaggcctggctgtcagtcccca

SEQ ID NO: 7255293 - DNA, 22 bp, Homo sapiens
gaggccagggtaccatcaacat

SEQ ID NO: 7255294 - DNA, 22 bp, Homo sapiens
gaggcctggctctgccctcctg

SEQ ID NO: 7255295 - DNA, 22 bp, Homo sapiens
gaggctgccccttcctcagctg

SEQ ID NO: 7255296 - DNA, 20 bp, Homo sapiens
gaggctgcggactgctggac

SEQ ID NO: 7255297 - DNA, 22 bp, Homo sapiens
gaggctgccccttcctcagctg

SEQ ID NO: 7255298 - DNA, 22 bp, Homo sapiens
gaggctgcggggaggagcctgc

SEQ ID NO: 7255299 - DNA, 20 bp, Homo sapiens
gaggctgcggactgctggac

SEQ ID NO: 7255300 - DNA, 22 bp, Homo sapiens
gaggctgcggggaggagcctgc

SEQ ID NO: 7255301 - DNA, 22 bp, Homo sapiens
gaggctgcggggaggagcctgc

SEQ ID NO: 7255302 - DNA, 22 bp, Homo sapiens
gaggagctgcagggggagtcta

SEQ ID NO: 7255303 - DNA, 22 bp, Homo sapiens
gaggagctgggtcagggagaca

SEQ ID NO: 7255304 - DNA, 22 bp, Homo sapiens
gaggccaccctatgggtcccag

SEQ ID NO: 7255305 - DNA, 22 bp, Homo sapiens
gaggagctgggctgagagggtc

SEQ ID NO: 7255306 - DNA, 22 bp, Homo sapiens
gaggagctggctgtcgggaggc

SEQ ID NO: 7255307 - DNA, 22 bp, Homo sapiens
gaggagctgggctgagagggtc

SEQ ID NO: 7255308 - DNA, 22 bp, Homo sapiens
gaggccaggggcctggagatga

SEQ ID NO: 7255309 - DNA, 22 bp, Homo sapiens
gagctgggcctgcgagtgctgc

SEQ ID NO: 7255310 - DNA, 22 bp, Homo sapiens
gagctgggcctgcgagtgctgc

SEQ ID NO: 7255311 - DNA, 22 bp, Homo sapiens
gagctgggctggcttcctccct

SEQ ID NO: 7255312 - DNA, 21 bp, Homo sapiens
gagctgggcgaggctccgggg

SEQ ID NO: 7255313 - DNA, 21 bp, Homo sapiens
gagctgggcgaggctccgggg

SEQ ID NO: 7255314 - DNA, 22 bp, Homo sapiens
atggtattctctaactcagctt

SEQ ID NO: 7255315 - DNA, 22 bp, Homo sapiens
atggggctgggattctcctcgg

SEQ ID NO: 7255316 - DNA, 22 bp, Homo sapiens
atggggctctgcggctgctccc

SEQ ID NO: 7255317 - DNA, 22 bp, Homo sapiens
atggactctggaggagatagag

SEQ ID NO: 7255318 - DNA, 22 bp, Homo sapiens
atggactcactaattcctccac

SEQ ID NO: 7255319 - DNA, 22 bp, Homo sapiens
atggaagaaagagacaatttga

SEQ ID NO: 7255320 - DNA, 22 bp, Homo sapiens
atggagagttcacttctaagtt

SEQ ID NO: 7255321 - DNA, 22 bp, Homo sapiens
atggagagagaaggcttgctgt

SEQ ID NO: 7255322 - DNA, 22 bp, Homo sapiens
gagaaatatggctcagttccac

SEQ ID NO: 7255323 - DNA, 22 bp, Homo sapiens
gagaaatgagtgattcactttt

SEQ ID NO: 7255324 - DNA, 22 bp, Homo sapiens
gacagatgtgggtgacagcagc

SEQ ID NO: 7255325 - DNA, 22 bp, Homo sapiens
gacagaggcaagaccagaagcc

SEQ ID NO: 7255326 - DNA, 23 bp, Homo sapiens
gacagagtgagaccttgtcttac

SEQ ID NO: 7255327 - DNA, 23 bp, Homo sapiens
gacagagtgagaccttgtcttac

SEQ ID NO: 7255328 - DNA, 23 bp, Homo sapiens
gacagagtgagaccttgtcttac

SEQ ID NO: 7255329 - DNA, 22 bp, Homo sapiens
atggaaatgttccatatattga

SEQ ID NO: 7255330 - DNA, 22 bp, Homo sapiens
atggaaattaagatttgtctca

SEQ ID NO: 7255331 - DNA, 22 bp, Homo sapiens
atggaaatgatggaacattaaa

SEQ ID NO: 7255332 - DNA, 22 bp, Homo sapiens
atggaaatggagggtgctagaa

SEQ ID NO: 7255333 - DNA, 22 bp, Homo sapiens
gagaggaactcccagtgcctgg

SEQ ID NO: 7255334 - DNA, 22 bp, Homo sapiens
atggccagcaaggtagggcaat

SEQ ID NO: 7255335 - DNA, 22 bp, Homo sapiens
gagaggaagccagggggtgttg

SEQ ID NO: 7255336 - DNA, 22 bp, Homo sapiens
atggcaggatacccagtccggc

SEQ ID NO: 7255337 - DNA, 22 bp, Homo sapiens
atggcaggatgagacaacaatt

SEQ ID NO: 7255338 - DNA, 22 bp, Homo sapiens
atggcagagggattgaacagct

SEQ ID NO: 7255339 - DNA, 22 bp, Homo sapiens
atggcagggcccttggctccca

SEQ ID NO: 7255340 - DNA, 22 bp, Homo sapiens
gagccagcgccttgcctctggg

SEQ ID NO: 7255341 - DNA, 22 bp, Homo sapiens
atggccagtgtttccctcagtt

SEQ ID NO: 7255342 - DNA, 22 bp, Homo sapiens
atggccagtgttgagatcaggc

SEQ ID NO: 7255343 - DNA, 22 bp, Homo sapiens
atggccagtctgttggacagca

SEQ ID NO: 7255344 - DNA, 22 bp, Homo sapiens
gagccagccttcttctgaggtc

SEQ ID NO: 7255345 - DNA, 21 bp, Homo sapiens
agtgacagaggaaggtgcata

SEQ ID NO: 7255346 - DNA, 22 bp, Homo sapiens
agtgacagctgggaaggtgaaa

SEQ ID NO: 7255347 - DNA, 22 bp, Homo sapiens
ctccactcaggtgcttaagttg

SEQ ID NO: 7255348 - DNA, 22 bp, Homo sapiens
ctccactcaccgaggcagagca

SEQ ID NO: 7255349 - DNA, 22 bp, Homo sapiens
ctccactcaccagatgccagga

SEQ ID NO: 7255350 - DNA, 22 bp, Homo sapiens
ctccagagagaaaggaggccgc

SEQ ID NO: 7255351 - DNA, 22 bp, Homo sapiens
ctccactctggggtgggtgaga

SEQ ID NO: 7255352 - DNA, 21 bp, Homo sapiens
ctcaggcatttgaggagagtc

SEQ ID NO: 7255353 - DNA, 22 bp, Homo sapiens
agtctccttggcctcaatgcct

SEQ ID NO: 7255354 - DNA, 22 bp, Homo sapiens
agtctccttaaatatttcccag

SEQ ID NO: 7255355 - DNA, 22 bp, Homo sapiens
ctcagggacttggatcctggcc

SEQ ID NO: 7255356 - DNA, 22 bp, Homo sapiens
ctcagggacgttagaggacagg

SEQ ID NO: 7255357 - DNA, 22 bp, Homo sapiens
ctcagggaggagcttctgggcc

SEQ ID NO: 7255358 - DNA, 22 bp, Homo sapiens
ctcagggagagccaagagttcc

SEQ ID NO: 7255359 - DNA, 22 bp, Homo sapiens
ctcagctcattgtggatccggt

SEQ ID NO: 7255360 - DNA, 22 bp, Homo sapiens
ctcagctccagccctcagcagc

SEQ ID NO: 7255361 - DNA, 22 bp, Homo sapiens
ctcagccccaatttgccctctt

SEQ ID NO: 7255362 - DNA, 22 bp, Homo sapiens
ctcagccctccccggggaataa

SEQ ID NO: 7255363 - DNA, 22 bp, Homo sapiens
agtctcagctacttgggaggct

SEQ ID NO: 7255364 - DNA, 18 bp, Homo sapiens
agtctcagcggaggagta

SEQ ID NO: 7255365 - DNA, 22 bp, Homo sapiens
ctcagaagaacaaaggctctac

SEQ ID NO: 7255366 - DNA, 22 bp, Homo sapiens
ctcagatcatcagaaacaatgt

SEQ ID NO: 7255367 - DNA, 22 bp, Homo sapiens
ctcagaggtggatgccttgtgg

SEQ ID NO: 7255368 - DNA, 22 bp, Homo sapiens
ctcagagtctgcatttctgtca

SEQ ID NO: 7255369 - DNA, 22 bp, Homo sapiens
ctcagaggtcaagagcagagct

SEQ ID NO: 7255370 - DNA, 22 bp, Homo sapiens
ctcagagggttgaaggtgctct

SEQ ID NO: 7255371 - DNA, 22 bp, Homo sapiens
ctcagagaaaaggagcaagggt

SEQ ID NO: 7255372 - DNA, 22 bp, Homo sapiens
ctcagagggtacaggtgaaccc

SEQ ID NO: 7255373 - DNA, 22 bp, Homo sapiens
ctcagacccccagagctgctaa

SEQ ID NO: 7255374 - DNA, 22 bp, Homo sapiens
ctcagacatctgaaatgggtta

SEQ ID NO: 7255375 - DNA, 22 bp, Homo sapiens
ctcagactggagccccaaggac

SEQ ID NO: 7255376 - DNA, 22 bp, Homo sapiens
ctcagactaaaatgggaatgta

SEQ ID NO: 7255377 - DNA, 22 bp, Homo sapiens
cgggggagttgaggcacatggg

SEQ ID NO: 7255378 - DNA, 22 bp, Homo sapiens
cggggtgggaatagacctgtct

SEQ ID NO: 7255379 - DNA, 22 bp, Homo sapiens
cggggtggcactctaaatagaa

SEQ ID NO: 7255380 - DNA, 22 bp, Homo sapiens
cggggtggcactctaaatagaa

SEQ ID NO: 7255381 - DNA, 22 bp, Homo sapiens
cggggtggcactctaaatagaa

SEQ ID NO: 7255382 - DNA, 22 bp, Homo sapiens
cggggtgggaatagacctgtct

SEQ ID NO: 7255383 - DNA, 22 bp, Homo sapiens
cggggtgggaatagacctgtct

SEQ ID NO: 7255384 - DNA, 22 bp, Homo sapiens
cgggtggagacagagggcataa

SEQ ID NO: 7255385 - DNA, 22 bp, Homo sapiens
cgggtggagacagagggcataa

SEQ ID NO: 7255386 - DNA, 22 bp, Homo sapiens
cgggtggagacagagggcataa

SEQ ID NO: 7255387 - DNA, 22 bp, Homo sapiens
ctcaaaggtattttagctcaca

SEQ ID NO: 7255388 - DNA, 22 bp, Homo sapiens
cgggttttccacaggagtcttt

SEQ ID NO: 7255389 - DNA, 22 bp, Homo sapiens
ctcttcttgtctctggttagaa

SEQ ID NO: 7255390 - DNA, 22 bp, Homo sapiens
ctcttgggatttgcaggctcag

SEQ ID NO: 7255391 - DNA, 22 bp, Homo sapiens
agtggtgtcgtgggagtggaag

SEQ ID NO: 7255392 - DNA, 22 bp, Homo sapiens
agtggtgcaaactggggcagct

SEQ ID NO: 7255393 - DNA, 22 bp, Homo sapiens
agtggtgctgcgcgcggagctc

SEQ ID NO: 7255394 - DNA, 22 bp, Homo sapiens
ctctgtctatcccattctgtgc

SEQ ID NO: 7255395 - DNA, 22 bp, Homo sapiens
ctctgtctatcccattctgtgc

SEQ ID NO: 7255396 - DNA, 22 bp, Homo sapiens
ctctgtcctatgcttgatagaa

SEQ ID NO: 7255397 - DNA, 17 bp, Homo sapiens
ctctggaattggtgaag

SEQ ID NO: 7255398 - DNA, 19 bp, Homo sapiens
ctctggagaacaatagtgc

SEQ ID NO: 7255399 - DNA, 22 bp, Homo sapiens
ctctggagcaccgggctatcca

SEQ ID NO: 7255400 - DNA, 23 bp, Homo sapiens
ctctggagatcctctgcctgggt

SEQ ID NO: 7255401 - DNA, 22 bp, Homo sapiens
ctctggagatggttctcaattg

SEQ ID NO: 7255402 - DNA, 23 bp, Homo sapiens
ctctggagatcctctgcctgggt

SEQ ID NO: 7255403 - DNA, 19 bp, Homo sapiens
ctctggagaacaatagtgc

SEQ ID NO: 7255404 - DNA, 22 bp, Homo sapiens
ctctggagaacgctatggatct

SEQ ID NO: 7255405 - DNA, 22 bp, Homo sapiens
ctctggagaactccttgtgtct

SEQ ID NO: 7255406 - DNA, 22 bp, Homo sapiens
ctctggagaggttcccatggga

SEQ ID NO: 7255407 - DNA, 22 bp, Homo sapiens
ctctgggtcaggacacaaaagt

SEQ ID NO: 7255408 - DNA, 22 bp, Homo sapiens
ctctgggtcccacgtcattgct

SEQ ID NO: 7255409 - DNA, 22 bp, Homo sapiens
ctctgggtcaccatcggggatt

SEQ ID NO: 7255410 - DNA, 22 bp, Homo sapiens
agtgggagaatgaataagggcc

SEQ ID NO: 7255411 - DNA, 22 bp, Homo sapiens
agtgggaatttcagtgctaaaa

SEQ ID NO: 7255412 - DNA, 22 bp, Homo sapiens
ctcctggttcagagagctgaga

SEQ ID NO: 7255413 - DNA, 22 bp, Homo sapiens
ctcctggttcctgtcttaaata

SEQ ID NO: 7255414 - DNA, 22 bp, Homo sapiens
ctccttttcctactcatactat

SEQ ID NO: 7255415 - DNA, 22 bp, Homo sapiens
ctcggagggcaacagaagtgct

SEQ ID NO: 7255416 - DNA, 22 bp, Homo sapiens
agtgctgactctgggcacagtg

SEQ ID NO: 7255417 - DNA, 22 bp, Homo sapiens
agtgctggagggaggcaggttc

SEQ ID NO: 7255418 - DNA, 22 bp, Homo sapiens
agtgctggattacaggcgtgag

SEQ ID NO: 7255419 - DNA, 22 bp, Homo sapiens
ctctcctttgaagcaactgtat

SEQ ID NO: 7255420 - DNA, 22 bp, Homo sapiens
ctctcctttcactaaatattct

SEQ ID NO: 7255421 - DNA, 22 bp, Homo sapiens
ctcgggcttgaggctgtttacc

SEQ ID NO: 7255422 - DNA, 22 bp, Homo sapiens
agtgctggcccatagctgctgg

SEQ ID NO: 7255423 - DNA, 22 bp, Homo sapiens
agtgctgggctatctactgcta

SEQ ID NO: 7255424 - DNA, 22 bp, Homo sapiens
aggtggctctgacagctctggt

SEQ ID NO: 7255425 - DNA, 22 bp, Homo sapiens
aggtgctgggcagcagtcattg

SEQ ID NO: 7255426 - DNA, 22 bp, Homo sapiens
aggtgctgggcagcagtcattg

SEQ ID NO: 7255427 - DNA, 22 bp, Homo sapiens
aggtgctgttggcagcgggcag

SEQ ID NO: 7255428 - DNA, 17 bp, Homo sapiens
aggtgctggagcatcag

SEQ ID NO: 7255429 - DNA, 22 bp, Homo sapiens
aggtgctggagtagaagaaaaa

SEQ ID NO: 7255430 - DNA, 22 bp, Homo sapiens
aggtgctggcgccccaggagac

SEQ ID NO: 7255431 - DNA, 22 bp, Homo sapiens
aggtgctctaggtatctacttt

SEQ ID NO: 7255432 - DNA, 19 bp, Homo sapiens
cctgggacttaggctgggt

SEQ ID NO: 7255433 - DNA, 22 bp, Homo sapiens
aggtggctgcctccccgcgcgg

SEQ ID NO: 7255434 - DNA, 21 bp, Homo sapiens
aggtgggagaccatgtaggtc

SEQ ID NO: 7255435 - DNA, 22 bp, Homo sapiens
ccttctctctgaagaccccaaa

SEQ ID NO: 7255436 - DNA, 21 bp, Homo sapiens
aggtggggctgcacctctgct

SEQ ID NO: 7255437 - DNA, 22 bp, Homo sapiens
ccttggcaggcacgtcctgcgg

SEQ ID NO: 7255438 - DNA, 22 bp, Homo sapiens
ccttggcaggggagaaatatat

SEQ ID NO: 7255439 - DNA, 20 bp, Homo sapiens
agtaggggaatgcaagagca

SEQ ID NO: 7255440 - DNA, 22 bp, Homo sapiens
cggccctgctgagcttgtctgg

SEQ ID NO: 7255441 - DNA, 22 bp, Homo sapiens
cggccctgaccagaccttagtt

SEQ ID NO: 7255442 - DNA, 22 bp, Homo sapiens
cggccctggcggaggcgggaga

SEQ ID NO: 7255443 - DNA, 22 bp, Homo sapiens
agtatatatgaggaaccacaaa

SEQ ID NO: 7255444 - DNA, 22 bp, Homo sapiens
agtatattgctcttaatcatag

SEQ ID NO: 7255445 - DNA, 22 bp, Homo sapiens
agtatattgctcttaatcatag

SEQ ID NO: 7255446 - DNA, 22 bp, Homo sapiens
agtatattggtgttattcctca

SEQ ID NO: 7255447 - DNA, 22 bp, Homo sapiens
agtatatttgttaagattattc

SEQ ID NO: 7255448 - DNA, 22 bp, Homo sapiens
agtatatttgttaagattattc

SEQ ID NO: 7255449 - DNA, 22 bp, Homo sapiens
cggagaggtgggggcagcatct

SEQ ID NO: 7255450 - DNA, 22 bp, Homo sapiens
cggagcagaaggcgccgccggc

SEQ ID NO: 7255451 - DNA, 22 bp, Homo sapiens
cggagcagagccactcgggccg

SEQ ID NO: 7255452 - DNA, 22 bp, Homo sapiens
cggagcgctgggggactctgca

SEQ ID NO: 7255453 - DNA, 22 bp, Homo sapiens
cggaggggatacattttctgaa

SEQ ID NO: 7255454 - DNA, 22 bp, Homo sapiens
cggaggggatacattttctgaa

SEQ ID NO: 7255455 - DNA, 22 bp, Homo sapiens
cggaggggtttgaacagaggag

SEQ ID NO: 7255456 - DNA, 22 bp, Homo sapiens
cggaggggtttgaacagaggag

SEQ ID NO: 7255457 - DNA, 22 bp, Homo sapiens
cggccaggcacagtggcccacg

SEQ ID NO: 7255458 - DNA, 22 bp, Homo sapiens
cctttgtaagatgtgaagactg

SEQ ID NO: 7255459 - DNA, 22 bp, Homo sapiens
cgaggcaggcaggcggaggata

SEQ ID NO: 7255460 - DNA, 22 bp, Homo sapiens
cgaggaggaaacgcggagaact

SEQ ID NO: 7255461 - DNA, 22 bp, Homo sapiens
cgaggagtgtgaaggcttgtcg

SEQ ID NO: 7255462 - DNA, 22 bp, Homo sapiens
ccttttatatggctcatcacag

SEQ ID NO: 7255463 - DNA, 22 bp, Homo sapiens
ccttttatagatcagtgtgtta

SEQ ID NO: 7255464 - DNA, 22 bp, Homo sapiens
ccttttatactctgtcctctgg

SEQ ID NO: 7255465 - DNA, 22 bp, Homo sapiens
ccttttatactcagtgatatca

SEQ ID NO: 7255466 - DNA, 22 bp, Homo sapiens
ccttttataaagttgtattgaa

SEQ ID NO: 7255467 - DNA, 22 bp, Homo sapiens
cgagcatgatgacggctgtggc

SEQ ID NO: 7255468 - DNA, 22 bp, Homo sapiens
ccttttatgaacttgagcaggt

SEQ ID NO: 7255469 - DNA, 19 bp, Homo sapiens
cctgctgcccaccctctgc

SEQ ID NO: 7255470 - DNA, 19 bp, Homo sapiens
cctgctgcaccacttgtta

SEQ ID NO: 7255471 - DNA, 22 bp, Homo sapiens
cctgctctccatacactttcta

SEQ ID NO: 7255472 - DNA, 22 bp, Homo sapiens
cctggctctgtcctcgcgcaaa

SEQ ID NO: 7255473 - DNA, 22 bp, Homo sapiens
cctgccctatgaccagcttcac

SEQ ID NO: 7255474 - DNA, 22 bp, Homo sapiens
cctgccctagagatgacacaat

SEQ ID NO: 7255475 - DNA, 22 bp, Homo sapiens
cctgccctaatccagagactag

SEQ ID NO: 7255476 - DNA, 22 bp, Homo sapiens
cctgcccctcaaggcctggtgc

SEQ ID NO: 7255477 - DNA, 22 bp, Homo sapiens
cctgcccagggtcaccacagag

SEQ ID NO: 7255478 - DNA, 22 bp, Homo sapiens
cctgcccagcttcccgagtgca

SEQ ID NO: 7255479 - DNA, 22 bp, Homo sapiens
cctgcccagcttcccgagtgca

SEQ ID NO: 7255480 - DNA, 22 bp, Homo sapiens
cctctgccacctcccacgaggc

SEQ ID NO: 7255481 - DNA, 22 bp, Homo sapiens
cctgcccagcttcacctcaggc

SEQ ID NO: 7255482 - DNA, 22 bp, Homo sapiens
cctctctctcctgcacacacac

SEQ ID NO: 7255483 - DNA, 22 bp, Homo sapiens
cctctctccaattttcacctca

SEQ ID NO: 7255484 - DNA, 22 bp, Homo sapiens
cctctgagtgctttgagggaga

SEQ ID NO: 7255485 - DNA, 22 bp, Homo sapiens
cctctgagttagagatctagat

SEQ ID NO: 7255486 - DNA, 22 bp, Homo sapiens
agggtctcagagcctgagaacc

SEQ ID NO: 7255487 - DNA, 22 bp, Homo sapiens
agggtctctacgcactagaggg

SEQ ID NO: 7255488 - DNA, 22 bp, Homo sapiens
agggtcaggttaagggagtcat

SEQ ID NO: 7255489 - DNA, 22 bp, Homo sapiens
agggtcagagtcaggtgcagta

SEQ ID NO: 7255490 - DNA, 22 bp, Homo sapiens
agggtcagagtcaggtgcagta

SEQ ID NO: 7255491 - DNA, 22 bp, Homo sapiens
cctgccctgctcactgtcggta

SEQ ID NO: 7255492 - DNA, 20 bp, Homo sapiens
agggtcagagagcgtgagtg

SEQ ID NO: 7255493 - DNA, 22 bp, Homo sapiens
agggtctgtgcaagaacacgcc

SEQ ID NO: 7255494 - DNA, 22 bp, Homo sapiens
agggtctgtggatgcatctggg

SEQ ID NO: 7255495 - DNA, 22 bp, Homo sapiens
agggtctgactgaatggaaaag

SEQ ID NO: 7255496 - DNA, 22 bp, Homo sapiens
agggtctgactgaatggaaaag

SEQ ID NO: 7255497 - DNA, 22 bp, Homo sapiens
agggtctgactcctctggcaag

SEQ ID NO: 7255498 - DNA, 20 bp, Homo sapiens
agggtctggccctgttcctt

SEQ ID NO: 7255499 - DNA, 20 bp, Homo sapiens
agggtctggccctgttcctt

SEQ ID NO: 7255500 - DNA, 22 bp, Homo sapiens
agggtctggtgtagaagttctc

SEQ ID NO: 7255501 - DNA, 20 bp, Homo sapiens
agggtctgctgggtaggaca

SEQ ID NO: 7255502 - DNA, 22 bp, Homo sapiens
agggtctgcagggatcttctgg

SEQ ID NO: 7255503 - DNA, 23 bp, Homo sapiens
agggtctgctcagtgtcgttcaa

SEQ ID NO: 7255504 - DNA, 22 bp, Homo sapiens
agggtctctgggagtagggcac

SEQ ID NO: 7255505 - DNA, 22 bp, Homo sapiens
agggtctctacgcactagaggg

SEQ ID NO: 7255506 - DNA, 22 bp, Homo sapiens
agggtctctggagagctgagga

SEQ ID NO: 7255507 - DNA, 22 bp, Homo sapiens
agggtctgacaatgtgacttag

SEQ ID NO: 7255508 - DNA, 22 bp, Homo sapiens
ataatataatcctacttcccat

SEQ ID NO: 7255509 - DNA, 22 bp, Homo sapiens
ataatacatggttgatcttttc

SEQ ID NO: 7255510 - DNA, 22 bp, Homo sapiens
ctgctctggcgtactcggcatc

SEQ ID NO: 7255511 - DNA, 22 bp, Homo sapiens
ctgcccagaatcactcactcga

SEQ ID NO: 7255512 - DNA, 19 bp, Homo sapiens
ctgctcaggtcagtctgtc

SEQ ID NO: 7255513 - DNA, 22 bp, Homo sapiens
ctgcccacagttctctgccatg

SEQ ID NO: 7255514 - DNA, 22 bp, Homo sapiens
ctgcccaccgtgtgcacgtgcg

SEQ ID NO: 7255515 - DNA, 22 bp, Homo sapiens
atacttctttaagagtaagtct

SEQ ID NO: 7255516 - DNA, 22 bp, Homo sapiens
atactgaaaaatgatttgctgt

SEQ ID NO: 7255517 - DNA, 22 bp, Homo sapiens
ctggagtgcagtggcatgatca

SEQ ID NO: 7255518 - DNA, 22 bp, Homo sapiens
ctggagtgcaatgaacaaggtc

SEQ ID NO: 7255519 - DNA, 22 bp, Homo sapiens
ctggagtgcaacctctgcctcc

SEQ ID NO: 7255520 - DNA, 22 bp, Homo sapiens
ctggagggctgcagcgaggctg

SEQ ID NO: 7255521 - DNA, 22 bp, Homo sapiens
ctggagggctgcagcgaggctg

SEQ ID NO: 7255522 - DNA, 22 bp, Homo sapiens
ctggagggctgcagcgaggctg

SEQ ID NO: 7255523 - DNA, 22 bp, Homo sapiens
ctggagggatgtagggtgtatt

SEQ ID NO: 7255524 - DNA, 22 bp, Homo sapiens
ctggagtgaagtctggcagctt

SEQ ID NO: 7255525 - DNA, 22 bp, Homo sapiens
ctggagtgaggtctgggagcct

SEQ ID NO: 7255526 - DNA, 22 bp, Homo sapiens
atacagatcccacagcatgtga

SEQ ID NO: 7255527 - DNA, 22 bp, Homo sapiens
atacagagcagtaatagaggag

SEQ ID NO: 7255528 - DNA, 22 bp, Homo sapiens
atacagatgaaatactaagcta

SEQ ID NO: 7255529 - DNA, 22 bp, Homo sapiens
atacagatcccacagcatgtga

SEQ ID NO: 7255530 - DNA, 22 bp, Homo sapiens
atacagatgagatcaggcataa

SEQ ID NO: 7255531 - DNA, 22 bp, Homo sapiens
atacagatgcttgctcgtgact

SEQ ID NO: 7255532 - DNA, 22 bp, Homo sapiens
atacagagaaggggtagaggat

SEQ ID NO: 7255533 - DNA, 20 bp, Homo sapiens
atacagatggttccagctgg

SEQ ID NO: 7255534 - DNA, 22 bp, Homo sapiens
ctggagggagattcaaaggagg

SEQ ID NO: 7255535 - DNA, 22 bp, Homo sapiens
ctggagggagattcaaaggagg

SEQ ID NO: 7255536 - DNA, 22 bp, Homo sapiens
ctggagggaggaggctgctatt

SEQ ID NO: 7255537 - DNA, 22 bp, Homo sapiens
ctggagggaggaggctgctatt

SEQ ID NO: 7255538 - DNA, 22 bp, Homo sapiens
ctggagggagttaggacccgga

SEQ ID NO: 7255539 - DNA, 22 bp, Homo sapiens
ctggagggatgtagggtgtatt

SEQ ID NO: 7255540 - DNA, 22 bp, Homo sapiens
ctggagggagttaggacccgga

SEQ ID NO: 7255541 - DNA, 22 bp, Homo sapiens
ctggagggagttaggacccgga

SEQ ID NO: 7255542 - DNA, 22 bp, Homo sapiens
ctggagccccagacagggagag

SEQ ID NO: 7255543 - DNA, 22 bp, Homo sapiens
ctggagcccaggcctggtgtct

SEQ ID NO: 7255544 - DNA, 22 bp, Homo sapiens
atacaagttaatgagaatgaca

SEQ ID NO: 7255545 - DNA, 22 bp, Homo sapiens
ctgaggctttgtgtgcatgcct

SEQ ID NO: 7255546 - DNA, 22 bp, Homo sapiens
ctgaggggtatccaaggggtaa

SEQ ID NO: 7255547 - DNA, 22 bp, Homo sapiens
ctgaggggtatccaaggggtaa

SEQ ID NO: 7255548 - DNA, 22 bp, Homo sapiens
ctgaggggtcgtgggagcccag

SEQ ID NO: 7255549 - DNA, 22 bp, Homo sapiens
ctgaggggtatccaaggggtaa

SEQ ID NO: 7255550 - DNA, 22 bp, Homo sapiens
ctgaggggtatccaaggggtaa

SEQ ID NO: 7255551 - DNA, 20 bp, Homo sapiens
ctgaggggtctgacttggac

SEQ ID NO: 7255552 - DNA, 22 bp, Homo sapiens
ctgaggtacaagaaaggcacct

SEQ ID NO: 7255553 - DNA, 23 bp, Homo sapiens
ctgaggtaaaatattctgaagga

SEQ ID NO: 7255554 - DNA, 22 bp, Homo sapiens
ctgaggtacgctggctccctgg

SEQ ID NO: 7255555 - DNA, 22 bp, Homo sapiens
ctgaggtcaattaatcaacaac

SEQ ID NO: 7255556 - DNA, 22 bp, Homo sapiens
ctgaggcatcatggagaacagt

SEQ ID NO: 7255557 - DNA, 22 bp, Homo sapiens
ctctttggggctggaagcctag

SEQ ID NO: 7255558 - DNA, 22 bp, Homo sapiens
agttctttaacctttctgggca

SEQ ID NO: 7255559 - DNA, 22 bp, Homo sapiens
agttctttaacgagtaagattt

SEQ ID NO: 7255560 - DNA, 22 bp, Homo sapiens
agttctttatatattagggata

SEQ ID NO: 7255561 - DNA, 23 bp, Homo sapiens
agttctttccaatgtcctcctct

SEQ ID NO: 7255562 - DNA, 22 bp, Homo sapiens
agttgggacatgttctttcccc

SEQ ID NO: 7255563 - DNA, 20 bp, Homo sapiens
ataaaataactgccacaaga

SEQ ID NO: 7255564 - DNA, 22 bp, Homo sapiens
ataaaggcagagtagggaggaa

SEQ ID NO: 7255565 - DNA, 22 bp, Homo sapiens
ataaatagtgaagggagccggt

SEQ ID NO: 7255566 - DNA, 22 bp, Homo sapiens
ataaatagtgctgccatgagta

SEQ ID NO: 7255567 - DNA, 22 bp, Homo sapiens
ataaatagtgctgccatgagta

SEQ ID NO: 7255568 - DNA, 22 bp, Homo sapiens
ataaatagtgtgtcataaagtc

SEQ ID NO: 7255569 - DNA, 22 bp, Homo sapiens
ataaatagtgtgtcataaagtc

SEQ ID NO: 7255570 - DNA, 22 bp, Homo sapiens
ataaatatcactgttgtccctc

SEQ ID NO: 7255571 - DNA, 22 bp, Homo sapiens
ctgcatttccacctggccacag

SEQ ID NO: 7255572 - DNA, 22 bp, Homo sapiens
ctgccaggcacgtgcagcatca

SEQ ID NO: 7255573 - DNA, 22 bp, Homo sapiens
ctgccaggcagcagagggagaa

SEQ ID NO: 7255574 - DNA, 22 bp, Homo sapiens
ctgccaggcagggagatggctg

SEQ ID NO: 7255575 - DNA, 22 bp, Homo sapiens
ctgccaggcctcatcccagcca

SEQ ID NO: 7255576 - DNA, 22 bp, Homo sapiens
ataaaagtaggaccaacttaca

SEQ ID NO: 7255577 - DNA, 22 bp, Homo sapiens
ctgccaggcctccgctgtcccc

SEQ ID NO: 7255578 - DNA, 22 bp, Homo sapiens
ctgcagagcagccagtccccca

SEQ ID NO: 7255579 - DNA, 22 bp, Homo sapiens
agtttaattggaggcgtggctc

SEQ ID NO: 7255580 - DNA, 22 bp, Homo sapiens
agtttaattggaggcgtggctc

SEQ ID NO: 7255581 - DNA, 22 bp, Homo sapiens
agtttaatcctccagcccaact

SEQ ID NO: 7255582 - DNA, 22 bp, Homo sapiens
agtttaatcctccagcccaact

SEQ ID NO: 7255583 - DNA, 22 bp, Homo sapiens
agtttaatatccttcaactttc

SEQ ID NO: 7255584 - DNA, 22 bp, Homo sapiens
agtttaatatccttcaactttc

SEQ ID NO: 7255585 - DNA, 22 bp, Homo sapiens
agtttaagctggttataggcaa

SEQ ID NO: 7255586 - DNA, 22 bp, Homo sapiens
atccaagcttcaccctaggatg

SEQ ID NO: 7255587 - DNA, 22 bp, Homo sapiens
atccaagcagaatcacgtgaga

SEQ ID NO: 7255588 - DNA, 22 bp, Homo sapiens
atccaagaatttgcactcctaa

SEQ ID NO: 7255589 - DNA, 22 bp, Homo sapiens
ctgtggagtggggagtactggt

SEQ ID NO: 7255590 - DNA, 22 bp, Homo sapiens
ctgtggaggtaggagcaggaca

SEQ ID NO: 7255591 - DNA, 22 bp, Homo sapiens
ctgtggagatgcagaccaggcc

SEQ ID NO: 7255592 - DNA, 22 bp, Homo sapiens
atcatgttgtatgtaatctttt

SEQ ID NO: 7255593 - DNA, 22 bp, Homo sapiens
atcctctctgttttcgtgtatg

SEQ ID NO: 7255594 - DNA, 22 bp, Homo sapiens
atcctctctgtgacagggaacg

SEQ ID NO: 7255595 - DNA, 22 bp, Homo sapiens
atcctctctcccataccagtct

SEQ ID NO: 7255596 - DNA, 23 bp, Homo sapiens
atcctctctccatcccactgtgc

SEQ ID NO: 7255597 - DNA, 20 bp, Homo sapiens
atcctctcctgattaattca

SEQ ID NO: 7255598 - DNA, 22 bp, Homo sapiens
atccggggttcattttcactga

SEQ ID NO: 7255599 - DNA, 22 bp, Homo sapiens
atccatttgtaaatgttagagt

SEQ ID NO: 7255600 - DNA, 22 bp, Homo sapiens
atccccttatcccaggctgagc

SEQ ID NO: 7255601 - DNA, 22 bp, Homo sapiens
atccccttcacaccctctgcat

SEQ ID NO: 7255602 - DNA, 20 bp, Homo sapiens
atccctcttcctagagtccc

SEQ ID NO: 7255603 - DNA, 22 bp, Homo sapiens
atccctctctgcatgactgtgt

SEQ ID NO: 7255604 - DNA, 22 bp, Homo sapiens
atccctctgcagctggttcctg

SEQ ID NO: 7255605 - DNA, 22 bp, Homo sapiens
atccccagggaggcctgacctg

SEQ ID NO: 7255606 - DNA, 22 bp, Homo sapiens
ctgtccgccgacttggccaggc

SEQ ID NO: 7255607 - DNA, 22 bp, Homo sapiens
ctgtccagtcagaacgtcatta

SEQ ID NO: 7255608 - DNA, 22 bp, Homo sapiens
atatttgttagagtctatgtgt

SEQ ID NO: 7255609 - DNA, 22 bp, Homo sapiens
ctgtcctccagacgacagtccc

SEQ ID NO: 7255610 - DNA, 22 bp, Homo sapiens
ctgtcctccggccacctacagt

SEQ ID NO: 7255611 - DNA, 22 bp, Homo sapiens
atcacatatttaagaaacatgt

SEQ ID NO: 7255612 - DNA, 22 bp, Homo sapiens
atcacatggaatgattttagac

SEQ ID NO: 7255613 - DNA, 22 bp, Homo sapiens
ctgtctctgtcttaactcccag

SEQ ID NO: 7255614 - DNA, 22 bp, Homo sapiens
atcatgtagcactggaacatgg

SEQ ID NO: 7255615 - DNA, 22 bp, Homo sapiens
atcatgcattgtattgagttga

SEQ ID NO: 7255616 - DNA, 22 bp, Homo sapiens
atcatgcagctaatccaattca

SEQ ID NO: 7255617 - DNA, 22 bp, Homo sapiens
atcatcatgcccacttgagact

SEQ ID NO: 7255618 - DNA, 18 bp, Homo sapiens
ctgtgcagcaaactgagc

SEQ ID NO: 7255619 - DNA, 19 bp, Homo sapiens
ctgtgcaggccgggctgag

SEQ ID NO: 7255620 - DNA, 22 bp, Homo sapiens
atatgacagcggattcacatat

SEQ ID NO: 7255621 - DNA, 22 bp, Homo sapiens
atatgacataaaatcatttttg

SEQ ID NO: 7255622 - DNA, 22 bp, Homo sapiens
atatatgaagaagtcttgatta

SEQ ID NO: 7255623 - DNA, 22 bp, Homo sapiens
atatatattgcccaggctggtt

SEQ ID NO: 7255624 - DNA, 22 bp, Homo sapiens
atatggctgtgtttatagccat

SEQ ID NO: 7255625 - DNA, 20 bp, Homo sapiens
atatggctccgttcagtcgg

SEQ ID NO: 7255626 - DNA, 22 bp, Homo sapiens
ctgggcagtggtggcccttccc

SEQ ID NO: 7255627 - DNA, 22 bp, Homo sapiens
atatgctattgctgtaatttaa

SEQ ID NO: 7255628 - DNA, 22 bp, Homo sapiens
ctgggcagtgggcaagttgtat

SEQ ID NO: 7255629 - DNA, 22 bp, Homo sapiens
ctgggcagtggtggcatctttg

SEQ ID NO: 7255630 - DNA, 22 bp, Homo sapiens
ctgggcagtgcagctatagaac

SEQ ID NO: 7255631 - DNA, 20 bp, Homo sapiens
ctgggcaggtgtttgatctc

SEQ ID NO: 7255632 - DNA, 22 bp, Homo sapiens
ctgggcagtatgaatattcaaa

SEQ ID NO: 7255633 - DNA, 22 bp, Homo sapiens
ctgggcagtatgaatattcaaa

SEQ ID NO: 7255634 - DNA, 22 bp, Homo sapiens
ctgggcaggtatacaaaaaatg

SEQ ID NO: 7255635 - DNA, 22 bp, Homo sapiens
ctgggcaggatacttcatggga

SEQ ID NO: 7255636 - DNA, 22 bp, Homo sapiens
ctgggcaggtatacaaaaaatg

SEQ ID NO: 7255637 - DNA, 22 bp, Homo sapiens
ctgggcaggagggctctatgga

SEQ ID NO: 7255638 - DNA, 22 bp, Homo sapiens
atatgcaagcacatagaatact

SEQ ID NO: 7255639 - DNA, 22 bp, Homo sapiens
atatttgtagtgggtaagaagt

SEQ ID NO: 7255640 - DNA, 22 bp, Homo sapiens
atatttggaaagaaaatcattg

SEQ ID NO: 7255641 - DNA, 22 bp, Homo sapiens
atatttataagcaagcaggact

SEQ ID NO: 7255642 - DNA, 22 bp, Homo sapiens
atatttagcaacatccttggcc

SEQ ID NO: 7255643 - DNA, 23 bp, Homo sapiens
atatgttgtgaaattttagtagc

SEQ ID NO: 7255644 - DNA, 22 bp, Homo sapiens
atatggcttatttatagagcaa

SEQ ID NO: 7255645 - DNA, 23 bp, Homo sapiens
atatggctgttgtgtgttaacat

SEQ ID NO: 7255646 - DNA, 22 bp, Homo sapiens
ctgggcacctttgcagcaggct

SEQ ID NO: 7255647 - DNA, 22 bp, Homo sapiens
ctgggcacaggggagcagagtc

SEQ ID NO: 7255648 - DNA, 19 bp, Homo sapiens
ctgggaggtgttcagagaa

SEQ ID NO: 7255649 - DNA, 22 bp, Homo sapiens
ctgggagacaagagagggctga

SEQ ID NO: 7255650 - DNA, 22 bp, Homo sapiens
atatatacaactagattaaaag

SEQ ID NO: 7255651 - DNA, 22 bp, Homo sapiens
atatataagctgatgagccaca

SEQ ID NO: 7255652 - DNA, 22 bp, Homo sapiens
atatataatacttgctgtgggc

SEQ ID NO: 7255653 - DNA, 22 bp, Homo sapiens
atatataatacttgctgtgggc

SEQ ID NO: 7255654 - DNA, 22 bp, Homo sapiens
ctgggaaggggaaggtcctctc

SEQ ID NO: 7255655 - DNA, 22 bp, Homo sapiens
ctgggaagcatggtgatggtat

SEQ ID NO: 7255656 - DNA, 22 bp, Homo sapiens
aggcagcctttagacagtctgc

SEQ ID NO: 7255657 - DNA, 22 bp, Homo sapiens
aggcagcctatggggagctcag

SEQ ID NO: 7255658 - DNA, 22 bp, Homo sapiens
aggcagcctggtttgaatggaa

SEQ ID NO: 7255659 - DNA, 22 bp, Homo sapiens
aggcagtggagctggaataggc

SEQ ID NO: 7255660 - DNA, 22 bp, Homo sapiens
aggcagtctatctctggagcct

SEQ ID NO: 7255661 - DNA, 22 bp, Homo sapiens
aggcagtgagcagggtgtcatg

SEQ ID NO: 7255662 - DNA, 21 bp, Homo sapiens
ccactgctcttccctagggcc

SEQ ID NO: 7255663 - DNA, 21 bp, Homo sapiens
ccactgctcttccctagggcc

SEQ ID NO: 7255664 - DNA, 22 bp, Homo sapiens
ccactggcatccagctgccatc

SEQ ID NO: 7255665 - DNA, 22 bp, Homo sapiens
aggcatttggctgtcatttgta

SEQ ID NO: 7255666 - DNA, 22 bp, Homo sapiens
aggcattgaggcggatgtggct

SEQ ID NO: 7255667 - DNA, 22 bp, Homo sapiens
aggcagtggctgagaccagggg

SEQ ID NO: 7255668 - DNA, 22 bp, Homo sapiens
aggccagctgccacccggtccg

SEQ ID NO: 7255669 - DNA, 22 bp, Homo sapiens
aggccagctctacccttggact

SEQ ID NO: 7255670 - DNA, 22 bp, Homo sapiens
aggccagctcaccctggctcct

SEQ ID NO: 7255671 - DNA, 22 bp, Homo sapiens
aggccagcctcaggcagggacc

SEQ ID NO: 7255672 - DNA, 23 bp, Homo sapiens
aggccagcgcagacaccgagcac

SEQ ID NO: 7255673 - DNA, 22 bp, Homo sapiens
aggccaagctcccagagaagct

SEQ ID NO: 7255674 - DNA, 22 bp, Homo sapiens
aggccaagggcaaagcggagag

SEQ ID NO: 7255675 - DNA, 22 bp, Homo sapiens
aggcccagtcctctgccgtctg

SEQ ID NO: 7255676 - DNA, 20 bp, Homo sapiens
aggcccagtgaatatattgc

SEQ ID NO: 7255677 - DNA, 22 bp, Homo sapiens
aggcccagtgtggcttcctgga

SEQ ID NO: 7255678 - DNA, 22 bp, Homo sapiens
aggcccagtgccattagttttg

SEQ ID NO: 7255679 - DNA, 22 bp, Homo sapiens
aggcccagtagtgctgccttta

SEQ ID NO: 7255680 - DNA, 22 bp, Homo sapiens
aggcccagctgggccaggaaca

SEQ ID NO: 7255681 - DNA, 22 bp, Homo sapiens
aggccaggatagcatggatcag

SEQ ID NO: 7255682 - DNA, 22 bp, Homo sapiens
aggccaggaccattagcccaga

SEQ ID NO: 7255683 - DNA, 22 bp, Homo sapiens
aggccaggacacttaagtaaga

SEQ ID NO: 7255684 - DNA, 22 bp, Homo sapiens
aggccagcttctaccctctgtt

SEQ ID NO: 7255685 - DNA, 22 bp, Homo sapiens
aggccagcttccagaggggcag

SEQ ID NO: 7255686 - DNA, 22 bp, Homo sapiens
aggccaggaatccttgtcccag

SEQ ID NO: 7255687 - DNA, 20 bp, Homo sapiens
aggccaggaaatgtagttct

SEQ ID NO: 7255688 - DNA, 20 bp, Homo sapiens
aggccccaggaaactctcag

SEQ ID NO: 7255689 - DNA, 22 bp, Homo sapiens
aggccccaaagcagtgcaagta

SEQ ID NO: 7255690 - DNA, 20 bp, Homo sapiens
aggccccaggtggacactag

SEQ ID NO: 7255691 - DNA, 22 bp, Homo sapiens
aggccccatcaggaaggaggcc

SEQ ID NO: 7255692 - DNA, 22 bp, Homo sapiens
aggcccagttatcctacttgtt

SEQ ID NO: 7255693 - DNA, 22 bp, Homo sapiens
aggcccatagtagctctgggca

SEQ ID NO: 7255694 - DNA, 22 bp, Homo sapiens
aggccggcgcttcccaggaggc

SEQ ID NO: 7255695 - DNA, 22 bp, Homo sapiens
aggccgcctggggagaggccct

SEQ ID NO: 7255696 - DNA, 22 bp, Homo sapiens
aggccctgggttagggcccact

SEQ ID NO: 7255697 - DNA, 22 bp, Homo sapiens
aggccctgaagtcggcccctca

SEQ ID NO: 7255698 - DNA, 22 bp, Homo sapiens
aggccctattcaatggggccca

SEQ ID NO: 7255699 - DNA, 18 bp, Homo sapiens
aggcccgttgtgtggaat

SEQ ID NO: 7255700 - DNA, 22 bp, Homo sapiens
aggctgagagcaacgtgtcaga

SEQ ID NO: 7255701 - DNA, 22 bp, Homo sapiens
aggctgagataggtggatcatt

SEQ ID NO: 7255702 - DNA, 22 bp, Homo sapiens
aggctgagcaaagggccttacc

SEQ ID NO: 7255703 - DNA, 22 bp, Homo sapiens
aggctgagcctgggcgtggtgg

SEQ ID NO: 7255704 - DNA, 22 bp, Homo sapiens
aggctgagccacggggctggct

SEQ ID NO: 7255705 - DNA, 22 bp, Homo sapiens
aggctctgcagaccccagctgt

SEQ ID NO: 7255706 - DNA, 22 bp, Homo sapiens
aggctctgcagtgctggaggac

SEQ ID NO: 7255707 - DNA, 22 bp, Homo sapiens
ccagtgcaggtgagcaccaggt

SEQ ID NO: 7255708 - DNA, 22 bp, Homo sapiens
aggctgaggcaggtggatcact

SEQ ID NO: 7255709 - DNA, 22 bp, Homo sapiens
aggctgaggcaggtggatcatt

SEQ ID NO: 7255710 - DNA, 22 bp, Homo sapiens
aggctgaggcgggaggatcact

SEQ ID NO: 7255711 - DNA, 22 bp, Homo sapiens
aggctgagctgacctggtttgg

SEQ ID NO: 7255712 - DNA, 23 bp, Homo sapiens
aggctgagctctcccagcttcag

SEQ ID NO: 7255713 - DNA, 22 bp, Homo sapiens
aggctgagcggggtcccagagc

SEQ ID NO: 7255714 - DNA, 22 bp, Homo sapiens
aggctgagcctgggcgtggtgg

SEQ ID NO: 7255715 - DNA, 23 bp, Homo sapiens
ccagtgattgcctggaaggaggt

SEQ ID NO: 7255716 - DNA, 22 bp, Homo sapiens
ccagtgcacagccaggcaggtg

SEQ ID NO: 7255717 - DNA, 22 bp, Homo sapiens
aggcctctctgcttagcttgta

SEQ ID NO: 7255718 - DNA, 22 bp, Homo sapiens
aggcctctctccttggcttgta

SEQ ID NO: 7255719 - DNA, 22 bp, Homo sapiens
aggcctcacacaacagatgcat

SEQ ID NO: 7255720 - DNA, 17 bp, Homo sapiens
aggcctccctccaggcc

SEQ ID NO: 7255721 - DNA, 22 bp, Homo sapiens
aggcctcagtttgtcatctgta

SEQ ID NO: 7255722 - DNA, 22 bp, Homo sapiens
ccaggcccttgcaagtcccacc

SEQ ID NO: 7255723 - DNA, 22 bp, Homo sapiens
ccaggcccgttcccttctccag

SEQ ID NO: 7255724 - DNA, 22 bp, Homo sapiens
ccaggcccgttcccttctccag

SEQ ID NO: 7255725 - DNA, 22 bp, Homo sapiens
ccaggccctgcctgtggttcct

SEQ ID NO: 7255726 - DNA, 22 bp, Homo sapiens
ccaggccctgctcctcacacca

SEQ ID NO: 7255727 - DNA, 22 bp, Homo sapiens
aggctccagtctcctctggcag

SEQ ID NO: 7255728 - DNA, 22 bp, Homo sapiens
aggctccattcatgtgaaggca

SEQ ID NO: 7255729 - DNA, 22 bp, Homo sapiens
ccaggctctgagcctcactctt

SEQ ID NO: 7255730 - DNA, 22 bp, Homo sapiens
ccccattctggccagcccagct

SEQ ID NO: 7255731 - DNA, 22 bp, Homo sapiens
ccccatgaagtagggtctctga

SEQ ID NO: 7255732 - DNA, 22 bp, Homo sapiens
ccccagggtcagtgtgtggagg

SEQ ID NO: 7255733 - DNA, 22 bp, Homo sapiens
ccccagcagactcagggcaggt

SEQ ID NO: 7255734 - DNA, 22 bp, Homo sapiens
ccccagcacttggagtggggag

SEQ ID NO: 7255735 - DNA, 22 bp, Homo sapiens
ccccagggaagctttgcttact

SEQ ID NO: 7255736 - DNA, 22 bp, Homo sapiens
ccccagggactggtttcatgga

SEQ ID NO: 7255737 - DNA, 22 bp, Homo sapiens
agggagagtttgatgtttcctc

SEQ ID NO: 7255738 - DNA, 22 bp, Homo sapiens
agggagagtagatatcaggtgt

SEQ ID NO: 7255739 - DNA, 22 bp, Homo sapiens
agggagagtttgatgtttcctc

SEQ ID NO: 7255740 - DNA, 22 bp, Homo sapiens
agggagcatgggtgaagcaggc

SEQ ID NO: 7255741 - DNA, 22 bp, Homo sapiens
agggagcatgggtgaagcaggc

SEQ ID NO: 7255742 - DNA, 22 bp, Homo sapiens
agggagcatgggtgaagcaggc

SEQ ID NO: 7255743 - DNA, 22 bp, Homo sapiens
agggaaggaggttagaacccac

SEQ ID NO: 7255744 - DNA, 22 bp, Homo sapiens
agggaaggaggttagaacccac

SEQ ID NO: 7255745 - DNA, 22 bp, Homo sapiens
agggaaggaggttagaacccac

SEQ ID NO: 7255746 - DNA, 22 bp, Homo sapiens
aggcttaatgagttaaatcact

SEQ ID NO: 7255747 - DNA, 22 bp, Homo sapiens
agggaagaagctggtagtaggt

SEQ ID NO: 7255748 - DNA, 22 bp, Homo sapiens
agggaagaatcactgggatgtt

SEQ ID NO: 7255749 - DNA, 22 bp, Homo sapiens
agggagaggttgaaacctcagt

SEQ ID NO: 7255750 - DNA, 22 bp, Homo sapiens
agggagaggctgaactatccta

SEQ ID NO: 7255751 - DNA, 23 bp, Homo sapiens
agggaagggggcttattccacag

SEQ ID NO: 7255752 - DNA, 22 bp, Homo sapiens
agggaaggtagaggtcaccggc

SEQ ID NO: 7255753 - DNA, 22 bp, Homo sapiens
agggaaggtagaggtcaccggc

SEQ ID NO: 7255754 - DNA, 22 bp, Homo sapiens
ccataatattaaatgcttttgt

SEQ ID NO: 7255755 - DNA, 22 bp, Homo sapiens
ccagtttgaggtttcaagatgt

SEQ ID NO: 7255756 - DNA, 22 bp, Homo sapiens
ccatctccaaataccatcacat

SEQ ID NO: 7255757 - DNA, 22 bp, Homo sapiens
ccatctccactgtccctgtcaa

SEQ ID NO: 7255758 - DNA, 22 bp, Homo sapiens
ccatctccagtttattcttcct

SEQ ID NO: 7255759 - DNA, 22 bp, Homo sapiens
ccatctggatctgtccactgac

SEQ ID NO: 7255760 - DNA, 22 bp, Homo sapiens
cccagcactcagcaggctcata

SEQ ID NO: 7255761 - DNA, 22 bp, Homo sapiens
cccagcacaggcaattccatac

SEQ ID NO: 7255762 - DNA, 18 bp, Homo sapiens
cccagcctctcctttcta

SEQ ID NO: 7255763 - DNA, 22 bp, Homo sapiens
cccagcctcagctttacttcca

SEQ ID NO: 7255764 - DNA, 22 bp, Homo sapiens
cccagcatctccaggcatggcc

SEQ ID NO: 7255765 - DNA, 22 bp, Homo sapiens
cccagcctctgtttgctcctct

SEQ ID NO: 7255766 - DNA, 22 bp, Homo sapiens
cccagcctctgggttctgccgg

SEQ ID NO: 7255767 - DNA, 22 bp, Homo sapiens
cccagcctctgggttctgccgg

SEQ ID NO: 7255768 - DNA, 22 bp, Homo sapiens
cccagcctctgggctcacccaa

SEQ ID NO: 7255769 - DNA, 22 bp, Homo sapiens
cccagcctctggattctgccct

SEQ ID NO: 7255770 - DNA, 22 bp, Homo sapiens
cccagcctctggattctgccct

SEQ ID NO: 7255771 - DNA, 22 bp, Homo sapiens
cccagcctgatctcggccagct

SEQ ID NO: 7255772 - DNA, 22 bp, Homo sapiens
cccagcctctgtttgctcctct

SEQ ID NO: 7255773 - DNA, 22 bp, Homo sapiens
cccagcctggtgcactgtgggg

SEQ ID NO: 7255774 - DNA, 22 bp, Homo sapiens
cccagctctggaaggtggggga

SEQ ID NO: 7255775 - DNA, 22 bp, Homo sapiens
aggcttaagcctgaggccccag

SEQ ID NO: 7255776 - DNA, 22 bp, Homo sapiens
aggcttaacttaactttagagc

SEQ ID NO: 7255777 - DNA, 22 bp, Homo sapiens
aggcttaactttactgttatgc

SEQ ID NO: 7255778 - DNA, 22 bp, Homo sapiens
aggcttaactacaatttttgcc

SEQ ID NO: 7255779 - DNA, 22 bp, Homo sapiens
aggcttaacctgatcacatgag

SEQ ID NO: 7255780 - DNA, 22 bp, Homo sapiens
aggcttaaatgctgtaaccgaa

SEQ ID NO: 7255781 - DNA, 22 bp, Homo sapiens
aggcttaaatgctcatatcagt

SEQ ID NO: 7255782 - DNA, 23 bp, Homo sapiens
aggcttaaatccttggttttgcc

SEQ ID NO: 7255783 - DNA, 21 bp, Homo sapiens
aggcttaaagccattatttcc

SEQ ID NO: 7255784 - DNA, 22 bp, Homo sapiens
aggcttaaagatagtaagaaac

SEQ ID NO: 7255785 - DNA, 23 bp, Homo sapiens
cctcccaggctgcgagtcccgag

SEQ ID NO: 7255786 - DNA, 22 bp, Homo sapiens
cctcccagtgcctccagagcag

SEQ ID NO: 7255787 - DNA, 22 bp, Homo sapiens
cctcccagtgccggggccggct

SEQ ID NO: 7255788 - DNA, 22 bp, Homo sapiens
cctcgcggcactcgggccggat

SEQ ID NO: 7255789 - DNA, 22 bp, Homo sapiens
cctctccttgcacccgtcccgc

SEQ ID NO: 7255790 - DNA, 22 bp, Homo sapiens
cctctctccaagggaaatccta

SEQ ID NO: 7255791 - DNA, 22 bp, Homo sapiens
cctcagagcctccagaaggaat

SEQ ID NO: 7255792 - DNA, 22 bp, Homo sapiens
cctcagagccatgcctgagttc

SEQ ID NO: 7255793 - DNA, 23 bp, Homo sapiens
cctcagagaggcagagccacatg

SEQ ID NO: 7255794 - DNA, 22 bp, Homo sapiens
cctcagagacagtaactggaat

SEQ ID NO: 7255795 - DNA, 22 bp, Homo sapiens
cctcagacccctgctgagcttc

SEQ ID NO: 7255796 - DNA, 22 bp, Homo sapiens
cctcagagaaaggtatggctga

SEQ ID NO: 7255797 - DNA, 22 bp, Homo sapiens
cctagaattataaacttattag

SEQ ID NO: 7255798 - DNA, 22 bp, Homo sapiens
cctagaatgtgcagacttaggg

SEQ ID NO: 7255799 - DNA, 22 bp, Homo sapiens
cctcaaagcggtatgcagacgg

SEQ ID NO: 7255800 - DNA, 22 bp, Homo sapiens
cctcaaaggcctggcaccagaa

SEQ ID NO: 7255801 - DNA, 22 bp, Homo sapiens
cctcaaagtagagggagatgag

SEQ ID NO: 7255802 - DNA, 19 bp, Homo sapiens
ccctgggggtttctggtac

SEQ ID NO: 7255803 - DNA, 22 bp, Homo sapiens
ccctggggctgagggatggccg

SEQ ID NO: 7255804 - DNA, 22 bp, Homo sapiens
agggccaggaacacctgaaggg

SEQ ID NO: 7255805 - DNA, 22 bp, Homo sapiens
agggccaggaacacctgaaggg

SEQ ID NO: 7255806 - DNA, 18 bp, Homo sapiens
agggccagctgtgagtag

SEQ ID NO: 7255807 - DNA, 22 bp, Homo sapiens
agggccaggaacacctgaaggg

SEQ ID NO: 7255808 - DNA, 22 bp, Homo sapiens
agggccagctagagccctcgcc

SEQ ID NO: 7255809 - DNA, 22 bp, Homo sapiens
agggccagccgacttccagcct

SEQ ID NO: 7255810 - DNA, 22 bp, Homo sapiens
agggccagctgatgagaatgag

SEQ ID NO: 7255811 - DNA, 22 bp, Homo sapiens
ccctggggagcaggcgaaggag

SEQ ID NO: 7255812 - DNA, 22 bp, Homo sapiens
agggccagggaaacgatcagca

SEQ ID NO: 7255813 - DNA, 22 bp, Homo sapiens
agggccaggctcccatgtcagg

SEQ ID NO: 7255814 - DNA, 22 bp, Homo sapiens
agggccagccccaccctctctg

SEQ ID NO: 7255815 - DNA, 22 bp, Homo sapiens
agggccagagtctgtgtagata

SEQ ID NO: 7255816 - DNA, 22 bp, Homo sapiens
agggccagagtctgtgtagata

SEQ ID NO: 7255817 - DNA, 22 bp, Homo sapiens
agggcagctgtgagccactgtg

SEQ ID NO: 7255818 - DNA, 22 bp, Homo sapiens
agggcagcctctcagcctaggt

SEQ ID NO: 7255819 - DNA, 22 bp, Homo sapiens
agggcagctagctgtagaaaga

SEQ ID NO: 7255820 - DNA, 22 bp, Homo sapiens
agggcagagggtgcctcacctg

SEQ ID NO: 7255821 - DNA, 22 bp, Homo sapiens
agggaggaccaatgtgtggtta

SEQ ID NO: 7255822 - DNA, 22 bp, Homo sapiens
aggaaccagaggttgagcaact

SEQ ID NO: 7255823 - DNA, 22 bp, Homo sapiens
aggaaaggggtaggtgtggacg

SEQ ID NO: 7255824 - DNA, 22 bp, Homo sapiens
agctttatataaaagagtacat

SEQ ID NO: 7255825 - DNA, 21 bp, Homo sapiens
aggaaaggaagtccccagggt

SEQ ID NO: 7255826 - DNA, 22 bp, Homo sapiens
aggaaagctcccagtagggctc

SEQ ID NO: 7255827 - DNA, 22 bp, Homo sapiens
cagggccagcgcccaggcccag

SEQ ID NO: 7255828 - DNA, 22 bp, Homo sapiens
caggcctgggcttcggggctga

SEQ ID NO: 7255829 - DNA, 22 bp, Homo sapiens
caggccggtgattctggatgta

SEQ ID NO: 7255830 - DNA, 22 bp, Homo sapiens
caggcctcaggggctcaggctg

SEQ ID NO: 7255831 - DNA, 21 bp, Homo sapiens
caggccccaggcctggggtgc

SEQ ID NO: 7255832 - DNA, 22 bp, Homo sapiens
caggccccattcctcttgggac

SEQ ID NO: 7255833 - DNA, 21 bp, Homo sapiens
caggccccaggcctggggtgc

SEQ ID NO: 7255834 - DNA, 22 bp, Homo sapiens
agcttgcagtttctgctgtttt

SEQ ID NO: 7255835 - DNA, 22 bp, Homo sapiens
agcttgtctttcaaaggagttt

SEQ ID NO: 7255836 - DNA, 22 bp, Homo sapiens
agcttgggtgtgcctgcgagct

SEQ ID NO: 7255837 - DNA, 17 bp, Homo sapiens
agcttggagcagcatga

SEQ ID NO: 7255838 - DNA, 22 bp, Homo sapiens
agcttaaataggagccccaggg

SEQ ID NO: 7255839 - DNA, 22 bp, Homo sapiens
agcttaaagtatttaaatttca

SEQ ID NO: 7255840 - DNA, 22 bp, Homo sapiens
agcttaaactctttgaagttat

SEQ ID NO: 7255841 - DNA, 22 bp, Homo sapiens
agcttaaagccgccatctagta

SEQ ID NO: 7255842 - DNA, 22 bp, Homo sapiens
caggacagaaataaggaatata

SEQ ID NO: 7255843 - DNA, 22 bp, Homo sapiens
caggacagacagaatgcctaac

SEQ ID NO: 7255844 - DNA, 22 bp, Homo sapiens
caggacagacagaatgcctaac

SEQ ID NO: 7255845 - DNA, 22 bp, Homo sapiens
caggacagaccaagatcgtgct

SEQ ID NO: 7255846 - DNA, 19 bp, Homo sapiens
caggacagacttcaaagcc

SEQ ID NO: 7255847 - DNA, 22 bp, Homo sapiens
agctggcatactttgctaggaa

SEQ ID NO: 7255848 - DNA, 22 bp, Homo sapiens
caggagggtgtggaaaactggg

SEQ ID NO: 7255849 - DNA, 22 bp, Homo sapiens
agctggcattgcagggagctgc

SEQ ID NO: 7255850 - DNA, 22 bp, Homo sapiens
agctctgctactctgtggggtg

SEQ ID NO: 7255851 - DNA, 22 bp, Homo sapiens
agctctcccatagggcaagatc

SEQ ID NO: 7255852 - DNA, 22 bp, Homo sapiens
agctctctgataaattgataaa

SEQ ID NO: 7255853 - DNA, 22 bp, Homo sapiens
catgaaatgttagaattagaca

SEQ ID NO: 7255854 - DNA, 22 bp, Homo sapiens
catgaaattcagcaggtgagta

SEQ ID NO: 7255855 - DNA, 22 bp, Homo sapiens
catgaaatctgagtatgtttcc

SEQ ID NO: 7255856 - DNA, 22 bp, Homo sapiens
catgaaatcacaagctgaggac

SEQ ID NO: 7255857 - DNA, 22 bp, Homo sapiens
catgaaatattagtaactgttt

SEQ ID NO: 7255858 - DNA, 22 bp, Homo sapiens
catgaaatggccaaccttcggc

SEQ ID NO: 7255859 - DNA, 22 bp, Homo sapiens
catgaaatgatatttgggtggg

SEQ ID NO: 7255860 - DNA, 22 bp, Homo sapiens
catgaaatgtgttaatctcttg

SEQ ID NO: 7255861 - DNA, 22 bp, Homo sapiens
catgaaatatgctacctgtctt

SEQ ID NO: 7255862 - DNA, 22 bp, Homo sapiens
catgaaaatgtcaagttctgct

SEQ ID NO: 7255863 - DNA, 22 bp, Homo sapiens
aggaggtgctagagaagatgtt

SEQ ID NO: 7255864 - DNA, 22 bp, Homo sapiens
aggaggtggcctgagcgtgccc

SEQ ID NO: 7255865 - DNA, 22 bp, Homo sapiens
aggaggtggctgaacttgaggg

SEQ ID NO: 7255866 - DNA, 22 bp, Homo sapiens
aggaggtggctgaacttgaggg

SEQ ID NO: 7255867 - DNA, 22 bp, Homo sapiens
catgcacttacctgaaattcaa

SEQ ID NO: 7255868 - DNA, 22 bp, Homo sapiens
catgccagttttgagatgcacc

SEQ ID NO: 7255869 - DNA, 22 bp, Homo sapiens
aggcacagcctcccttcacatg

SEQ ID NO: 7255870 - DNA, 22 bp, Homo sapiens
aggcacaggcctcagcacccag

SEQ ID NO: 7255871 - DNA, 22 bp, Homo sapiens
catggccaggcccagggcccag

SEQ ID NO: 7255872 - DNA, 22 bp, Homo sapiens
catggccagggcagatggcagg

SEQ ID NO: 7255873 - DNA, 21 bp, Homo sapiens
aggcagcaggatccagggaca

SEQ ID NO: 7255874 - DNA, 22 bp, Homo sapiens
aggcagcagaggttgaggaaag

SEQ ID NO: 7255875 - DNA, 18 bp, Homo sapiens
aggcagcagcatcttctc

SEQ ID NO: 7255876 - DNA, 19 bp, Homo sapiens
aggcagcattctggggctt

SEQ ID NO: 7255877 - DNA, 22 bp, Homo sapiens
aggcagccagttcaggtttctt

SEQ ID NO: 7255878 - DNA, 22 bp, Homo sapiens
cattcctaaccacatgtgggct

SEQ ID NO: 7255879 - DNA, 19 bp, Homo sapiens
aggcagaggcttggctagc

SEQ ID NO: 7255880 - DNA, 20 bp, Homo sapiens
aggaaggaagtttgcatgga

SEQ ID NO: 7255881 - DNA, 22 bp, Homo sapiens
aggaaggactccatggtccgtc

SEQ ID NO: 7255882 - DNA, 19 bp, Homo sapiens
aggaaggaacctgagtctg

SEQ ID NO: 7255883 - DNA, 22 bp, Homo sapiens
aggaagctggtgtgaggatgaa

SEQ ID NO: 7255884 - DNA, 22 bp, Homo sapiens
cagtctctgccacttctaagct

SEQ ID NO: 7255885 - DNA, 22 bp, Homo sapiens
cagtctctctccttgcaggcgt

SEQ ID NO: 7255886 - DNA, 19 bp, Homo sapiens
aggagaagactctctcccc

SEQ ID NO: 7255887 - DNA, 19 bp, Homo sapiens
aggagaagactctctcccc

SEQ ID NO: 7255888 - DNA, 19 bp, Homo sapiens
aggagaagactctctcccc

SEQ ID NO: 7255889 - DNA, 23 bp, Homo sapiens
aggagaagagatttccacatgca

SEQ ID NO: 7255890 - DNA, 22 bp, Homo sapiens
aggagaagccaagttgtgagca

SEQ ID NO: 7255891 - DNA, 22 bp, Homo sapiens
aggacagcccttgagagcacat

SEQ ID NO: 7255892 - DNA, 21 bp, Homo sapiens
aggacaggaactggctgaata

SEQ ID NO: 7255893 - DNA, 21 bp, Homo sapiens
aggacaggaactggctgaata

SEQ ID NO: 7255894 - DNA, 22 bp, Homo sapiens
aggaggaagggaagacaagtaa

SEQ ID NO: 7255895 - DNA, 22 bp, Homo sapiens
aggaggaaggcttcattaggtt

SEQ ID NO: 7255896 - DNA, 22 bp, Homo sapiens
aggagctgagtcagcccgacag

SEQ ID NO: 7255897 - DNA, 22 bp, Homo sapiens
aggaggaggctggagtacaccc

SEQ ID NO: 7255898 - DNA, 22 bp, Homo sapiens
aggaggaggctggagtacaccc

SEQ ID NO: 7255899 - DNA, 22 bp, Homo sapiens
aggaggaattgacacagaagcc

SEQ ID NO: 7255900 - DNA, 22 bp, Homo sapiens
aggaggactctctgagccagcc

SEQ ID NO: 7255901 - DNA, 22 bp, Homo sapiens
aggaggcaaaggtctctgataa

SEQ ID NO: 7255902 - DNA, 17 bp, Homo sapiens
aggaggatcagagagta

SEQ ID NO: 7255903 - DNA, 22 bp, Homo sapiens
aggaggataagttagttgggta

SEQ ID NO: 7255904 - DNA, 22 bp, Homo sapiens
aggaggaggtgggacacagtga

SEQ ID NO: 7255905 - DNA, 22 bp, Homo sapiens
aggagaggcatcaagaaaatcg

SEQ ID NO: 7255906 - DNA, 22 bp, Homo sapiens
aggagaggtctcccttccccag

SEQ ID NO: 7255907 - DNA, 22 bp, Homo sapiens
aggagagggtggcattaagttt

SEQ ID NO: 7255908 - DNA, 22 bp, Homo sapiens
aggagctcattgaagtggatga

SEQ ID NO: 7255909 - DNA, 22 bp, Homo sapiens
aggagcgtctgtctgtgtctct

SEQ ID NO: 7255910 - DNA, 22 bp, Homo sapiens
atggacagtgctgcttcagagg

SEQ ID NO: 7255911 - DNA, 22 bp, Homo sapiens
atggacagtactgagtggacta

SEQ ID NO: 7255912 - DNA, 22 bp, Homo sapiens
atggagtgggccaattttagtg

SEQ ID NO: 7255913 - DNA, 22 bp, Homo sapiens
atggcagcctgagcagaggaat

SEQ ID NO: 7255914 - DNA, 21 bp, Homo sapiens
atggctcaggccatcaatgga

SEQ ID NO: 7255915 - DNA, 18 bp, Homo sapiens
atggctcaggaatggctt

SEQ ID NO: 7255916 - DNA, 22 bp, Homo sapiens
atggctggctgagcctggttat

SEQ ID NO: 7255917 - DNA, 22 bp, Homo sapiens
atggctggctttacttgctttg

SEQ ID NO: 7255918 - DNA, 22 bp, Homo sapiens
atggaaagtgcatggaagtcat

SEQ ID NO: 7255919 - DNA, 22 bp, Homo sapiens
atggaaagggaagcaaggaaca

SEQ ID NO: 7255920 - DNA, 22 bp, Homo sapiens
atggaaaggctgtggaaactta

SEQ ID NO: 7255921 - DNA, 22 bp, Homo sapiens
atggaaaggctgtggaaactta

SEQ ID NO: 7255922 - DNA, 22 bp, Homo sapiens
atgcagggattaaatgactgcc

SEQ ID NO: 7255923 - DNA, 22 bp, Homo sapiens
atggaaatatctttagagctta

SEQ ID NO: 7255924 - DNA, 22 bp, Homo sapiens
agacgcggtggtgcatgcctgt

SEQ ID NO: 7255925 - DNA, 22 bp, Homo sapiens
atgtctgtacgagttacaatgg

SEQ ID NO: 7255926 - DNA, 19 bp, Homo sapiens
atgtctgttgaatttcata

SEQ ID NO: 7255927 - DNA, 20 bp, Homo sapiens
atgtaaaattataaggctga

SEQ ID NO: 7255928 - DNA, 22 bp, Homo sapiens
atcttatgagacccataaagat

SEQ ID NO: 7255929 - DNA, 19 bp, Homo sapiens
atctttagcaactttcaaa

SEQ ID NO: 7255930 - DNA, 22 bp, Homo sapiens
agaagaatacttgatgttcatg

SEQ ID NO: 7255931 - DNA, 22 bp, Homo sapiens
agaagagaactgccaaacactt

SEQ ID NO: 7255932 - DNA, 22 bp, Homo sapiens
agaagagcctggggaccatggc

SEQ ID NO: 7255933 - DNA, 22 bp, Homo sapiens
agaagagcctggggaccatggc

SEQ ID NO: 7255934 - DNA, 22 bp, Homo sapiens
agaaggcggctcctctggcgcc

SEQ ID NO: 7255935 - DNA, 22 bp, Homo sapiens
agaatacaattgttcagtaata

SEQ ID NO: 7255936 - DNA, 23 bp, Homo sapiens
agaatacaggctttgtataggca

SEQ ID NO: 7255937 - DNA, 22 bp, Homo sapiens
agaatacagtatgcaaaaagat

SEQ ID NO: 7255938 - DNA, 22 bp, Homo sapiens
agaatactaggcttcagaaagg

SEQ ID NO: 7255939 - DNA, 22 bp, Homo sapiens
agaatagaattctcatagaatt

SEQ ID NO: 7255940 - DNA, 22 bp, Homo sapiens
agaatagaattctcatagaatt

SEQ ID NO: 7255941 - DNA, 22 bp, Homo sapiens
agaatagagaaaaaggttattt

SEQ ID NO: 7255942 - DNA, 22 bp, Homo sapiens
agaatagagaaaaaggttattt

SEQ ID NO: 7255943 - DNA, 22 bp, Homo sapiens
agaatacagttcagtaatggat

SEQ ID NO: 7255944 - DNA, 22 bp, Homo sapiens
agaatgcattttgtgtagctat

SEQ ID NO: 7255945 - DNA, 22 bp, Homo sapiens
agaatgtgaagattttgaatta

SEQ ID NO: 7255946 - DNA, 22 bp, Homo sapiens
agaatgtgttattagagaagga

SEQ ID NO: 7255947 - DNA, 22 bp, Homo sapiens
agaatgttgatagcacctattt

SEQ ID NO: 7255948 - DNA, 22 bp, Homo sapiens
agaatgttttcatgagaatgaa

SEQ ID NO: 7255949 - DNA, 22 bp, Homo sapiens
agaatgattttggacaatatgg

SEQ ID NO: 7255950 - DNA, 19 bp, Homo sapiens
agacacacttacgtggaat

SEQ ID NO: 7255951 - DNA, 22 bp, Homo sapiens
agacaatttcaaagtaatatta

SEQ ID NO: 7255952 - DNA, 21 bp, Homo sapiens
agacagtaactcttctactcc

SEQ ID NO: 7255953 - DNA, 22 bp, Homo sapiens
agacagtatgatatatgaatac

SEQ ID NO: 7255954 - DNA, 22 bp, Homo sapiens
agacaggcatgaggctggattg

SEQ ID NO: 7255955 - DNA, 22 bp, Homo sapiens
agacacagtttgggatgggttg

SEQ ID NO: 7255956 - DNA, 22 bp, Homo sapiens
agacacagtgctgggtgctgag

SEQ ID NO: 7255957 - DNA, 22 bp, Homo sapiens
agacacagtctgtctggaggag

SEQ ID NO: 7255958 - DNA, 22 bp, Homo sapiens
agacacagctgcaggaggtggg

SEQ ID NO: 7255959 - DNA, 22 bp, Homo sapiens
attataaagaacatgtgtgtgg

SEQ ID NO: 7255960 - DNA, 22 bp, Homo sapiens
attcacagaatagttttaccag

SEQ ID NO: 7255961 - DNA, 20 bp, Homo sapiens
attcacaggcacaaaaccct

SEQ ID NO: 7255962 - DNA, 22 bp, Homo sapiens
attcacagagtggttagtggta

SEQ ID NO: 7255963 - DNA, 22 bp, Homo sapiens
attcacagagtggttagtggta

SEQ ID NO: 7255964 - DNA, 22 bp, Homo sapiens
attcacagggctttccgcatgg

SEQ ID NO: 7255965 - DNA, 22 bp, Homo sapiens
attcacagggacaatgggagag

SEQ ID NO: 7255966 - DNA, 22 bp, Homo sapiens
attcacagtatggacgaaatga

SEQ ID NO: 7255967 - DNA, 21 bp, Homo sapiens
attcacaggtatcctctccct

SEQ ID NO: 7255968 - DNA, 22 bp, Homo sapiens
attcacagggggagaagggtat

SEQ ID NO: 7255969 - DNA, 22 bp, Homo sapiens
attcacagttactgctgaacca

SEQ ID NO: 7255970 - DNA, 22 bp, Homo sapiens
attcacagttcattagctgtaa

SEQ ID NO: 7255971 - DNA, 22 bp, Homo sapiens
attcacagtatggacgaaatga

SEQ ID NO: 7255972 - DNA, 22 bp, Homo sapiens
attcacagttactgctgaacca

SEQ ID NO: 7255973 - DNA, 22 bp, Homo sapiens
attcacagttcattagctgtaa

SEQ ID NO: 7255974 - DNA, 22 bp, Homo sapiens
attcacagtttcctcatattct

SEQ ID NO: 7255975 - DNA, 22 bp, Homo sapiens
attcagagtctgcacaacagca

SEQ ID NO: 7255976 - DNA, 22 bp, Homo sapiens
attcagatcatatttatagctt

SEQ ID NO: 7255977 - DNA, 21 bp, Homo sapiens
agagggagagtggcccttcca

SEQ ID NO: 7255978 - DNA, 22 bp, Homo sapiens
agagggtgctggagagacattg

SEQ ID NO: 7255979 - DNA, 23 bp, Homo sapiens
agagggtgcaacatggggatcta

SEQ ID NO: 7255980 - DNA, 22 bp, Homo sapiens
agagggtcaaccaggagcgtca

SEQ ID NO: 7255981 - DNA, 22 bp, Homo sapiens
agagggtcaaccaggagcgtca

SEQ ID NO: 7255982 - DNA, 22 bp, Homo sapiens
agagggtatgagtggggctaaa

SEQ ID NO: 7255983 - DNA, 22 bp, Homo sapiens
agaggggctcaagcagtggtct

SEQ ID NO: 7255984 - DNA, 22 bp, Homo sapiens
agaggggctcaagcagtggtct

SEQ ID NO: 7255985 - DNA, 22 bp, Homo sapiens
agaggggctcatatcctgtcat

SEQ ID NO: 7255986 - DNA, 22 bp, Homo sapiens
agagggagtgaaatggaataga

SEQ ID NO: 7255987 - DNA, 22 bp, Homo sapiens
agagggagctttatttttctgt

SEQ ID NO: 7255988 - DNA, 22 bp, Homo sapiens
agagggagcccagtcatagctg

SEQ ID NO: 7255989 - DNA, 23 bp, Homo sapiens
agagggagatgtttttctcaaga

SEQ ID NO: 7255990 - DNA, 22 bp, Homo sapiens
agagggagtgaaatggaataga

SEQ ID NO: 7255991 - DNA, 22 bp, Homo sapiens
agagggataatatgtattgtaa

SEQ ID NO: 7255992 - DNA, 22 bp, Homo sapiens
agagggatggccccgtaactca

SEQ ID NO: 7255993 - DNA, 22 bp, Homo sapiens
atgttacaatccaacaaaatta

SEQ ID NO: 7255994 - DNA, 22 bp, Homo sapiens
atgttaagtttagcaggctagg

SEQ ID NO: 7255995 - DNA, 22 bp, Homo sapiens
atgttaagaatgcagacaaatg

SEQ ID NO: 7255996 - DNA, 22 bp, Homo sapiens
atgtgtgcatgttagagagagt

SEQ ID NO: 7255997 - DNA, 22 bp, Homo sapiens
attagatgtgtttaagtagaga

SEQ ID NO: 7255998 - DNA, 22 bp, Homo sapiens
attaaatactgcaggctaagca

SEQ ID NO: 7255999 - DNA, 22 bp, Homo sapiens
atgtttgttgatcatttatgaa

SEQ ID NO: 7256000 - DNA, 22 bp, Homo sapiens
atttattgaacactgactatgt

SEQ ID NO: 7256001 - DNA, 22 bp, Homo sapiens
atttattgaacactgactatgt

SEQ ID NO: 7256002 - DNA, 22 bp, Homo sapiens
atttagtgaaacccataaagca

SEQ ID NO: 7256003 - DNA, 17 bp, Homo sapiens
atttagcaagtagacag

SEQ ID NO: 7256004 - DNA, 22 bp, Homo sapiens
atttagcaaaaaatgatgaagc

SEQ ID NO: 7256005 - DNA, 22 bp, Homo sapiens
agagtgggcctagctgtaaaag

SEQ ID NO: 7256006 - DNA, 22 bp, Homo sapiens
agagtgggcaggagcctcgact

SEQ ID NO: 7256007 - DNA, 22 bp, Homo sapiens
attcttctctgggttgggttca

SEQ ID NO: 7256008 - DNA, 22 bp, Homo sapiens
agagggtggtgaggcctggttc

SEQ ID NO: 7256009 - DNA, 22 bp, Homo sapiens
agagggtggtgaggcctggttc

SEQ ID NO: 7256010 - DNA, 22 bp, Homo sapiens
agagggtgggcacgtgatggat

SEQ ID NO: 7256011 - DNA, 22 bp, Homo sapiens
agaggtagaggttgcagtgagc

SEQ ID NO: 7256012 - DNA, 22 bp, Homo sapiens
atttaatgggtagacattgtta

SEQ ID NO: 7256013 - DNA, 23 bp, Homo sapiens
atttaatgctgagttgaatgtta

SEQ ID NO: 7256014 - DNA, 22 bp, Homo sapiens
agatgtgcctccaaggggtgca

SEQ ID NO: 7256015 - DNA, 22 bp, Homo sapiens
atttgcttgtgctatgaaagtt

SEQ ID NO: 7256016 - DNA, 22 bp, Homo sapiens
agatgaagcctgtacttagtct

SEQ ID NO: 7256017 - DNA, 22 bp, Homo sapiens
agatgaaatttgtgttgagttg

SEQ ID NO: 7256018 - DNA, 23 bp, Homo sapiens
agatgaaagcttcccatcacagt

SEQ ID NO: 7256019 - DNA, 22 bp, Homo sapiens
agatgaagactcaggagcaggt

SEQ ID NO: 7256020 - DNA, 22 bp, Homo sapiens
agatgaaaagataagcagcaat

SEQ ID NO: 7256021 - DNA, 18 bp, Homo sapiens
agatgaaagcaaatgaca

SEQ ID NO: 7256022 - DNA, 18 bp, Homo sapiens
agatgaaagcaaatgaca

SEQ ID NO: 7256023 - DNA, 22 bp, Homo sapiens
agatgaaagatttttatagaga

SEQ ID NO: 7256024 - DNA, 22 bp, Homo sapiens
agatgtaccaggtattacagga

SEQ ID NO: 7256025 - DNA, 22 bp, Homo sapiens
agcagcacccagagccatgtct

SEQ ID NO: 7256026 - DNA, 22 bp, Homo sapiens
agcagcacctggctatctgatc

SEQ ID NO: 7256027 - DNA, 22 bp, Homo sapiens
agcagcagaagggagacccagg

SEQ ID NO: 7256028 - DNA, 22 bp, Homo sapiens
agcagcagaagggagacccagg

SEQ ID NO: 7256029 - DNA, 22 bp, Homo sapiens
caaggcaggcagttcacttgag

SEQ ID NO: 7256030 - DNA, 22 bp, Homo sapiens
caactgcacaccaagcttgtgt

SEQ ID NO: 7256031 - DNA, 22 bp, Homo sapiens
caacttattttcagtgggcctg

SEQ ID NO: 7256032 - DNA, 22 bp, Homo sapiens
caacttattaagaatgggcctg

SEQ ID NO: 7256033 - DNA, 22 bp, Homo sapiens
caacttatctaatgttgggata

SEQ ID NO: 7256034 - DNA, 22 bp, Homo sapiens
caactcaggcacctcatataag

SEQ ID NO: 7256035 - DNA, 22 bp, Homo sapiens
agcagcatgttcattacattat

SEQ ID NO: 7256036 - DNA, 22 bp, Homo sapiens
agcagcattaagggaactgcag

SEQ ID NO: 7256037 - DNA, 22 bp, Homo sapiens
agcagcatgttgggatgtgaaa

SEQ ID NO: 7256038 - DNA, 22 bp, Homo sapiens
agcagcattctctggtatgggg

SEQ ID NO: 7256039 - DNA, 22 bp, Homo sapiens
agcagcattcctggcttctatc

SEQ ID NO: 7256040 - DNA, 22 bp, Homo sapiens
agcagcattatgatatatctta

SEQ ID NO: 7256041 - DNA, 22 bp, Homo sapiens
agcagcatgtatgagggtgaac

SEQ ID NO: 7256042 - DNA, 22 bp, Homo sapiens
agcagcatggctgactaaagac

SEQ ID NO: 7256043 - DNA, 22 bp, Homo sapiens
agcagcatggatgggcctcagc

SEQ ID NO: 7256044 - DNA, 22 bp, Homo sapiens
agcagcatgatgacagagtctc

SEQ ID NO: 7256045 - DNA, 22 bp, Homo sapiens
agcagcatggagaaaccgttca

SEQ ID NO: 7256046 - DNA, 22 bp, Homo sapiens
agcagcatgatgacagagtctc

SEQ ID NO: 7256047 - DNA, 22 bp, Homo sapiens
agcagcatcttctgttctccgc

SEQ ID NO: 7256048 - DNA, 22 bp, Homo sapiens
agcagcatcttctaagtaaggc

SEQ ID NO: 7256049 - DNA, 22 bp, Homo sapiens
agcagcatttaagtttcttcta

SEQ ID NO: 7256050 - DNA, 22 bp, Homo sapiens
agcagcatttaaggatccaagt

SEQ ID NO: 7256051 - DNA, 20 bp, Homo sapiens
agcagcattgttctagagca

SEQ ID NO: 7256052 - DNA, 22 bp, Homo sapiens
agcagcatctggttctgatgtg

SEQ ID NO: 7256053 - DNA, 22 bp, Homo sapiens
agcagcatctcttattgcagtg

SEQ ID NO: 7256054 - DNA, 22 bp, Homo sapiens
agcagcatccccggcctccacc

SEQ ID NO: 7256055 - DNA, 21 bp, Homo sapiens
agcagcatcagcctcacctga

SEQ ID NO: 7256056 - DNA, 22 bp, Homo sapiens
agcagcatcaaccctcccgtgt

SEQ ID NO: 7256057 - DNA, 22 bp, Homo sapiens
agcagcatattgtgtcttcata

SEQ ID NO: 7256058 - DNA, 22 bp, Homo sapiens
agcagcatatcagagaaagtca

SEQ ID NO: 7256059 - DNA, 22 bp, Homo sapiens
agcagcatagatgctatccgag

SEQ ID NO: 7256060 - DNA, 22 bp, Homo sapiens
agcagcaggtgacctcgatgcc

SEQ ID NO: 7256061 - DNA, 22 bp, Homo sapiens
agcagcatagaagctgggagga

SEQ ID NO: 7256062 - DNA, 22 bp, Homo sapiens
caaggcaggccagtttcaaggc

SEQ ID NO: 7256063 - DNA, 22 bp, Homo sapiens
caaggcaggtctgaggaggttg

SEQ ID NO: 7256064 - DNA, 22 bp, Homo sapiens
caaggcagtgggctaggaacct

SEQ ID NO: 7256065 - DNA, 22 bp, Homo sapiens
caaggcagtccctactccctgc

SEQ ID NO: 7256066 - DNA, 22 bp, Homo sapiens
caaggcagttccccagagggct

SEQ ID NO: 7256067 - DNA, 22 bp, Homo sapiens
agcacagcaagtgggttattaa

SEQ ID NO: 7256068 - DNA, 19 bp, Homo sapiens
agcacagagagtctatagc

SEQ ID NO: 7256069 - DNA, 22 bp, Homo sapiens
attttctatgttgtaattgtta

SEQ ID NO: 7256070 - DNA, 22 bp, Homo sapiens
agcacaaaaacattcccagagt

SEQ ID NO: 7256071 - DNA, 23 bp, Homo sapiens
agcacagactagaaaggtctttc

SEQ ID NO: 7256072 - DNA, 22 bp, Homo sapiens
caaatgttaaatgtgttaagac

SEQ ID NO: 7256073 - DNA, 22 bp, Homo sapiens
caaatgcagtccctttgttgct

SEQ ID NO: 7256074 - DNA, 22 bp, Homo sapiens
caaatgcatagaaagatgaaac

SEQ ID NO: 7256075 - DNA, 22 bp, Homo sapiens
caaatgcaggtcagcaggtgtc

SEQ ID NO: 7256076 - DNA, 22 bp, Homo sapiens
caaatgcaggtcataacctgag

SEQ ID NO: 7256077 - DNA, 22 bp, Homo sapiens
caaatgcaggtcagcaggtgtc

SEQ ID NO: 7256078 - DNA, 22 bp, Homo sapiens
caaatgcagattcaggagttct

SEQ ID NO: 7256079 - DNA, 22 bp, Homo sapiens
agcacagcttagcacctggcac

SEQ ID NO: 7256080 - DNA, 22 bp, Homo sapiens
agcacagctgttcaacaggaat

SEQ ID NO: 7256081 - DNA, 22 bp, Homo sapiens
agcacagctggaaaataaatca

SEQ ID NO: 7256082 - DNA, 22 bp, Homo sapiens
agcacagctgctgaatgataca

SEQ ID NO: 7256083 - DNA, 20 bp, Homo sapiens
agcacagcgcggtgttcctt

SEQ ID NO: 7256084 - DNA, 22 bp, Homo sapiens
agcacagcctctggtttctgac

SEQ ID NO: 7256085 - DNA, 22 bp, Homo sapiens
agcacagccagctttattggcc

SEQ ID NO: 7256086 - DNA, 21 bp, Homo sapiens
agcacagcatatccaatgtca

SEQ ID NO: 7256087 - DNA, 22 bp, Homo sapiens
agcacagcagcgtctaaccgat

SEQ ID NO: 7256088 - DNA, 22 bp, Homo sapiens
agcacagcaccatcctggtacc

SEQ ID NO: 7256089 - DNA, 22 bp, Homo sapiens
caaatgttttttagtataagta

SEQ ID NO: 7256090 - DNA, 22 bp, Homo sapiens
caaatgtttttattctacaaca

SEQ ID NO: 7256091 - DNA, 22 bp, Homo sapiens
caaatgtttggtggcattttgt

SEQ ID NO: 7256092 - DNA, 22 bp, Homo sapiens
caaatgtttgcatcacagggca

SEQ ID NO: 7256093 - DNA, 22 bp, Homo sapiens
caaatgtttcttgaacaccaac

SEQ ID NO: 7256094 - DNA, 22 bp, Homo sapiens
caaatgtttcttatctattgtt

SEQ ID NO: 7256095 - DNA, 22 bp, Homo sapiens
caaatgttgctgtaatgtttgt

SEQ ID NO: 7256096 - DNA, 22 bp, Homo sapiens
caaatgttgactaagagggttt

SEQ ID NO: 7256097 - DNA, 22 bp, Homo sapiens
caaatgttattcattcttgttt

SEQ ID NO: 7256098 - DNA, 22 bp, Homo sapiens
caaatgttagtgcccatccctc

SEQ ID NO: 7256099 - DNA, 22 bp, Homo sapiens
caaatgttaagacaggatcaag

SEQ ID NO: 7256100 - DNA, 22 bp, Homo sapiens
caaattaatgtgtctcaaaata

SEQ ID NO: 7256101 - DNA, 22 bp, Homo sapiens
agcagaagtgccttagcaatca

SEQ ID NO: 7256102 - DNA, 22 bp, Homo sapiens
cacatgaacatgctggaaaagc

SEQ ID NO: 7256103 - DNA, 22 bp, Homo sapiens
agcagggcctgagtgacctaac

SEQ ID NO: 7256104 - DNA, 22 bp, Homo sapiens
cacagtatttgtttttctgagt

SEQ ID NO: 7256105 - DNA, 22 bp, Homo sapiens
caccagggacaatgctaggggt

SEQ ID NO: 7256106 - DNA, 22 bp, Homo sapiens
caccagggacaatgctaggggt

SEQ ID NO: 7256107 - DNA, 22 bp, Homo sapiens
caccagggcagcagcctagtct

SEQ ID NO: 7256108 - DNA, 22 bp, Homo sapiens
caccaggtggaaatgtcacagc

SEQ ID NO: 7256109 - DNA, 22 bp, Homo sapiens
caccagggctctgagctctgaa

SEQ ID NO: 7256110 - DNA, 22 bp, Homo sapiens
caccaggtgctggaggacatca

SEQ ID NO: 7256111 - DNA, 22 bp, Homo sapiens
agcataagttggtacagccact

SEQ ID NO: 7256112 - DNA, 22 bp, Homo sapiens
agcataagttggtacagccact

SEQ ID NO: 7256113 - DNA, 22 bp, Homo sapiens
agcataaaggacatttgtcact

SEQ ID NO: 7256114 - DNA, 22 bp, Homo sapiens
cacaggagggagcgggcagcca

SEQ ID NO: 7256115 - DNA, 22 bp, Homo sapiens
cacaggaggaggccagagcgta

SEQ ID NO: 7256116 - DNA, 22 bp, Homo sapiens
cacagggctttgatggctgagt

SEQ ID NO: 7256117 - DNA, 22 bp, Homo sapiens
cacagtatgatctaaagtaagt

SEQ ID NO: 7256118 - DNA, 22 bp, Homo sapiens
caatgacatggataatcatatt

SEQ ID NO: 7256119 - DNA, 22 bp, Homo sapiens
cacaggagctgtggggcagtgt

SEQ ID NO: 7256120 - DNA, 22 bp, Homo sapiens
cagcacagtacaaggcacggat

SEQ ID NO: 7256121 - DNA, 22 bp, Homo sapiens
cagcacaggtcagttttttaag

SEQ ID NO: 7256122 - DNA, 22 bp, Homo sapiens
cagcacagggcttgagaggtgt

SEQ ID NO: 7256123 - DNA, 22 bp, Homo sapiens
cagcacagtacaaggcacggat

SEQ ID NO: 7256124 - DNA, 22 bp, Homo sapiens
cagcacaggaagtgggccttca

SEQ ID NO: 7256125 - DNA, 22 bp, Homo sapiens
cagcacagctggctctggaagc

SEQ ID NO: 7256126 - DNA, 22 bp, Homo sapiens
cagcacaggcaggggaactata

SEQ ID NO: 7256127 - DNA, 22 bp, Homo sapiens
cagcacaggaatatggtggaca

SEQ ID NO: 7256128 - DNA, 22 bp, Homo sapiens
cagcacagggacaatagcagat

SEQ ID NO: 7256129 - DNA, 22 bp, Homo sapiens
cagcacaggcctgtctttgtct

SEQ ID NO: 7256130 - DNA, 22 bp, Homo sapiens
cagcacaggcccctctctccca

SEQ ID NO: 7256131 - DNA, 22 bp, Homo sapiens
cagcacagggcttgagaggtgt

SEQ ID NO: 7256132 - DNA, 22 bp, Homo sapiens
cagcacagctgaggggctgtct

SEQ ID NO: 7256133 - DNA, 22 bp, Homo sapiens
cagcacagcacagcggtgactc

SEQ ID NO: 7256134 - DNA, 22 bp, Homo sapiens
cagcacagagtattttattgat

SEQ ID NO: 7256135 - DNA, 20 bp, Homo sapiens
cagcacagagcttggctcta

SEQ ID NO: 7256136 - DNA, 22 bp, Homo sapiens
cagaggcgaggcagctgaacct

SEQ ID NO: 7256137 - DNA, 22 bp, Homo sapiens
agcctcagtgtcaccatctacc

SEQ ID NO: 7256138 - DNA, 22 bp, Homo sapiens
agcctccatctcccatctgtga

SEQ ID NO: 7256139 - DNA, 22 bp, Homo sapiens
cagcagcagtggctgcagaaca

SEQ ID NO: 7256140 - DNA, 22 bp, Homo sapiens
cagcagcaggcgcacggccgtc

SEQ ID NO: 7256141 - DNA, 22 bp, Homo sapiens
cagcagcagcttagtggtcccc

SEQ ID NO: 7256142 - DNA, 22 bp, Homo sapiens
cagcagcatgaattcgagccac

SEQ ID NO: 7256143 - DNA, 22 bp, Homo sapiens
cagcagcatcaggtctgtggtt

SEQ ID NO: 7256144 - DNA, 22 bp, Homo sapiens
cagcagcagtgttctagaatct

SEQ ID NO: 7256145 - DNA, 21 bp, Homo sapiens
agctccctgtttcctcactct

SEQ ID NO: 7256146 - DNA, 22 bp, Homo sapiens
agctccctgcacgaccctgccc

SEQ ID NO: 7256147 - DNA, 22 bp, Homo sapiens
agctcctcctgagtgtctggga

SEQ ID NO: 7256148 - DNA, 20 bp, Homo sapiens
agctcctcatcactggaggt

SEQ ID NO: 7256149 - DNA, 20 bp, Homo sapiens
agctcctctgcccattcttc

SEQ ID NO: 7256150 - DNA, 20 bp, Homo sapiens
agctcctctgcccattcttc

SEQ ID NO: 7256151 - DNA, 22 bp, Homo sapiens
cagccctggcgcccccagatct

SEQ ID NO: 7256152 - DNA, 22 bp, Homo sapiens
cagccctgggagttggggccga

SEQ ID NO: 7256153 - DNA, 22 bp, Homo sapiens
cagccctgggagttggggccga

SEQ ID NO: 7256154 - DNA, 22 bp, Homo sapiens
agctccctgagatgccacagca

SEQ ID NO: 7256155 - DNA, 22 bp, Homo sapiens
cagccagagaggaaggaatgca

SEQ ID NO: 7256156 - DNA, 22 bp, Homo sapiens
cagccagctgaatgtaccatga

SEQ ID NO: 7256157 - DNA, 22 bp, Homo sapiens
agctcaagttttcaaatattat

SEQ ID NO: 7256158 - DNA, 22 bp, Homo sapiens
agctcacagcctagcactgtga

SEQ ID NO: 7256159 - DNA, 22 bp, Homo sapiens
agctcagaaatgccagtaggta

SEQ ID NO: 7256160 - DNA, 22 bp, Homo sapiens
agctcagaacctcctcatccca

SEQ ID NO: 7256161 - DNA, 22 bp, Homo sapiens
agctcagaactgcagacatgtg

SEQ ID NO: 7256162 - DNA, 22 bp, Homo sapiens
agctcagaagggaggaaatgag

SEQ ID NO: 7256163 - DNA, 23 bp, Homo sapiens
agccttggaggttgaggctgcag

SEQ ID NO: 7256164 - DNA, 22 bp, Homo sapiens
agccttgaaccaattgtttagc

SEQ ID NO: 7256165 - DNA, 22 bp, Homo sapiens
agccttcggccagagggtggcc

SEQ ID NO: 7256166 - DNA, 22 bp, Homo sapiens
cagcaggaggcatggcttccct

SEQ ID NO: 7256167 - DNA, 22 bp, Homo sapiens
cagaagcattccagcaaatagt

SEQ ID NO: 7256168 - DNA, 21 bp, Homo sapiens
agccaggcaagcacccccact

SEQ ID NO: 7256169 - DNA, 22 bp, Homo sapiens
agccaggcagactctctttctt

SEQ ID NO: 7256170 - DNA, 22 bp, Homo sapiens
agccaggcagggctctcgctct

SEQ ID NO: 7256171 - DNA, 22 bp, Homo sapiens
cagacagacagccgtggccacc

SEQ ID NO: 7256172 - DNA, 22 bp, Homo sapiens
agccaaggacacggagcctcct

SEQ ID NO: 7256173 - DNA, 22 bp, Homo sapiens
agccacacagcttaatgacaga

SEQ ID NO: 7256174 - DNA, 22 bp, Homo sapiens
agccacacctgtcctgccagct

SEQ ID NO: 7256175 - DNA, 22 bp, Homo sapiens
agccacacctgtcctgccagct

SEQ ID NO: 7256176 - DNA, 22 bp, Homo sapiens
cactctgtgattgcagcattcc

SEQ ID NO: 7256177 - DNA, 22 bp, Homo sapiens
agccacacttgccaggggaagg

SEQ ID NO: 7256178 - DNA, 19 bp, Homo sapiens
agccacagaacttgcagga

SEQ ID NO: 7256179 - DNA, 22 bp, Homo sapiens
agccacagcccacaggactctt

SEQ ID NO: 7256180 - DNA, 22 bp, Homo sapiens
cagaaccaggaactgatggaga

SEQ ID NO: 7256181 - DNA, 22 bp, Homo sapiens
cagacagacctgcaagggcaca

SEQ ID NO: 7256182 - DNA, 22 bp, Homo sapiens
cagacagaggctgtatgagggc

SEQ ID NO: 7256183 - DNA, 20 bp, Homo sapiens
agccagggttctggatgcac

SEQ ID NO: 7256184 - DNA, 19 bp, Homo sapiens
agccagtgagcctctgggt

SEQ ID NO: 7256185 - DNA, 22 bp, Homo sapiens
agccagtgatgaagactctgga

SEQ ID NO: 7256186 - DNA, 22 bp, Homo sapiens
cagagagggagcagtagtctct

SEQ ID NO: 7256187 - DNA, 22 bp, Homo sapiens
cagagatgggtcgcagagatgg

SEQ ID NO: 7256188 - DNA, 22 bp, Homo sapiens
cagagatggggccagctgctcc

SEQ ID NO: 7256189 - DNA, 22 bp, Homo sapiens
cagagagggcggccctggcttc

SEQ ID NO: 7256190 - DNA, 23 bp, Homo sapiens
cagagctggctcagagctgcctg

SEQ ID NO: 7256191 - DNA, 22 bp, Homo sapiens
cagagctggagggaaccctggc

SEQ ID NO: 7256192 - DNA, 19 bp, Homo sapiens
agcccccagacagcaggcc

SEQ ID NO: 7256193 - DNA, 22 bp, Homo sapiens
agccccttccagttctcagatc

SEQ ID NO: 7256194 - DNA, 23 bp, Homo sapiens
cagagctggctcagagctgcctg

SEQ ID NO: 7256195 - DNA, 19 bp, Homo sapiens
agccccttggtactgtcct

SEQ ID NO: 7256196 - DNA, 22 bp, Homo sapiens
agccccttgctgccctctagag

SEQ ID NO: 7256197 - DNA, 22 bp, Homo sapiens
agcccagcctgattctacaccc

SEQ ID NO: 7256198 - DNA, 22 bp, Homo sapiens
agcccaggagtccttaaggacc

SEQ ID NO: 7256199 - DNA, 22 bp, Homo sapiens
accttagatttggcttactatg

SEQ ID NO: 7256200 - DNA, 22 bp, Homo sapiens
accttacccagaggggcatgac

SEQ ID NO: 7256201 - DNA, 22 bp, Homo sapiens
actaaaacatagccagtcagtg

SEQ ID NO: 7256202 - DNA, 19 bp, Homo sapiens
actaaagcaataactattt

SEQ ID NO: 7256203 - DNA, 22 bp, Homo sapiens
actaaaaactactgccaatagc

SEQ ID NO: 7256204 - DNA, 22 bp, Homo sapiens
acgggctgggacggggaagctc

SEQ ID NO: 7256205 - DNA, 22 bp, Homo sapiens
actcagtacatctggagttggc

SEQ ID NO: 7256206 - DNA, 22 bp, Homo sapiens
actcatttaaacatttactgaa

SEQ ID NO: 7256207 - DNA, 22 bp, Homo sapiens
actatatgtgaaggtagaattt

SEQ ID NO: 7256208 - DNA, 22 bp, Homo sapiens
actatgaatccacattgatttt

SEQ ID NO: 7256209 - DNA, 22 bp, Homo sapiens
actatgaaagtataatattgaa

SEQ ID NO: 7256210 - DNA, 22 bp, Homo sapiens
actatgaatagccagatagtga

SEQ ID NO: 7256211 - DNA, 22 bp, Homo sapiens
actatgctcattgttaatattt

SEQ ID NO: 7256212 - DNA, 22 bp, Homo sapiens
acctgtacaattcctgcactga

SEQ ID NO: 7256213 - DNA, 22 bp, Homo sapiens
agggtggggtgctacatcttta

SEQ ID NO: 7256214 - DNA, 20 bp, Homo sapiens
agggtggggacgttctgact

SEQ ID NO: 7256215 - DNA, 22 bp, Homo sapiens
agggtggggtgctacatcttta

SEQ ID NO: 7256216 - DNA, 22 bp, Homo sapiens
agggtggttcttttagtggaag

SEQ ID NO: 7256217 - DNA, 22 bp, Homo sapiens
agggtgtcagccacggaatggg

SEQ ID NO: 7256218 - DNA, 22 bp, Homo sapiens
agggtgtcagccacggaatggg

SEQ ID NO: 7256219 - DNA, 22 bp, Homo sapiens
agggtgtgttctcctatgagaa

SEQ ID NO: 7256220 - DNA, 22 bp, Homo sapiens
acctccctcgccgtccactctg

SEQ ID NO: 7256221 - DNA, 20 bp, Homo sapiens
agggtggggacgttctgact

SEQ ID NO: 7256222 - DNA, 22 bp, Homo sapiens
agggtgggctagactcttcccc

SEQ ID NO: 7256223 - DNA, 22 bp, Homo sapiens
agggtgcctggaagccactcac

SEQ ID NO: 7256224 - DNA, 22 bp, Homo sapiens
agggcttgtagggtggctgtag

SEQ ID NO: 7256225 - DNA, 22 bp, Homo sapiens
accctcagagtaggcactgctg

SEQ ID NO: 7256226 - DNA, 22 bp, Homo sapiens
actgctccaccctggggcccag

SEQ ID NO: 7256227 - DNA, 22 bp, Homo sapiens
actgcaacacctcctgggttca

SEQ ID NO: 7256228 - DNA, 22 bp, Homo sapiens
actgcaacctccacctcctggg

SEQ ID NO: 7256229 - DNA, 22 bp, Homo sapiens
actgcaacctccgcctgccagg

SEQ ID NO: 7256230 - DNA, 22 bp, Homo sapiens
actgatgaaaactaataaatta

SEQ ID NO: 7256231 - DNA, 22 bp, Homo sapiens
agtctggattttctacccttct

SEQ ID NO: 7256232 - DNA, 22 bp, Homo sapiens
agtctggatttagaggtgggcc

SEQ ID NO: 7256233 - DNA, 22 bp, Homo sapiens
agtctcttgcacattgtattaa

SEQ ID NO: 7256234 - DNA, 22 bp, Homo sapiens
agtctcttcctcatgcatatgt

SEQ ID NO: 7256235 - DNA, 22 bp, Homo sapiens
agtctctgttccagggcttcag

SEQ ID NO: 7256236 - DNA, 22 bp, Homo sapiens
agtctctgtcgtagatcagcgt

SEQ ID NO: 7256237 - DNA, 20 bp, Homo sapiens
agtctctgtagtgcctgaga

SEQ ID NO: 7256238 - DNA, 22 bp, Homo sapiens
agtctctgcatgatgcagcaca

SEQ ID NO: 7256239 - DNA, 19 bp, Homo sapiens
agtctctgaggcctaagtt

SEQ ID NO: 7256240 - DNA, 22 bp, Homo sapiens
actcatttttactgcaattgag

SEQ ID NO: 7256241 - DNA, 22 bp, Homo sapiens
actccacatttgaacacagttc

SEQ ID NO: 7256242 - DNA, 22 bp, Homo sapiens
actccagatgataagggacagt

SEQ ID NO: 7256243 - DNA, 22 bp, Homo sapiens
actccagaggcagctgtgctga

SEQ ID NO: 7256244 - DNA, 22 bp, Homo sapiens
actccagagctcacatgtctaa

SEQ ID NO: 7256245 - DNA, 22 bp, Homo sapiens
actccagacacagacactatga

SEQ ID NO: 7256246 - DNA, 22 bp, Homo sapiens
actgtgtctagcaccacgtgtc

SEQ ID NO: 7256247 - DNA, 22 bp, Homo sapiens
actgtgtcctcatgtggcagaa

SEQ ID NO: 7256248 - DNA, 22 bp, Homo sapiens
actgtgtcctatttccttgaca

SEQ ID NO: 7256249 - DNA, 22 bp, Homo sapiens
actgtgtcattgatcagaaaca

SEQ ID NO: 7256250 - DNA, 22 bp, Homo sapiens
actgtgtctcattcatcattgt

SEQ ID NO: 7256251 - DNA, 22 bp, Homo sapiens
actgtgtctcacagtggtacca

SEQ ID NO: 7256252 - DNA, 22 bp, Homo sapiens
actgttatgttattacccatgt

SEQ ID NO: 7256253 - DNA, 22 bp, Homo sapiens
actgttatagttcacttttccc

SEQ ID NO: 7256254 - DNA, 22 bp, Homo sapiens
actgttatgatttacacagtcc

SEQ ID NO: 7256255 - DNA, 22 bp, Homo sapiens
actgttatgggtgtcagcttaa

SEQ ID NO: 7256256 - DNA, 22 bp, Homo sapiens
acttccaagtttattcatgtga

SEQ ID NO: 7256257 - DNA, 22 bp, Homo sapiens
acttgcatgatcctgagagtat

SEQ ID NO: 7256258 - DNA, 22 bp, Homo sapiens
acttgggaaaggaagaattgca

SEQ ID NO: 7256259 - DNA, 22 bp, Homo sapiens
acttggaatctgtttccctaga

SEQ ID NO: 7256260 - DNA, 22 bp, Homo sapiens
acttggaatattgcgtttttgc

SEQ ID NO: 7256261 - DNA, 22 bp, Homo sapiens
acttggcaggtcaggggatatt

SEQ ID NO: 7256262 - DNA, 22 bp, Homo sapiens
acttggcaaacaacgtggatat

SEQ ID NO: 7256263 - DNA, 20 bp, Homo sapiens
acttggaactcatttttctt

SEQ ID NO: 7256264 - DNA, 22 bp, Homo sapiens
acttggaaccgaggacctttat

SEQ ID NO: 7256265 - DNA, 22 bp, Homo sapiens
acttgcatgtcaggaaattaac

SEQ ID NO: 7256266 - DNA, 22 bp, Homo sapiens
acttgcatgctatttgttgaac

SEQ ID NO: 7256267 - DNA, 22 bp, Homo sapiens
acttgcatgattaatttggtga

SEQ ID NO: 7256268 - DNA, 22 bp, Homo sapiens
acttgcatgttatttttatagg

SEQ ID NO: 7256269 - DNA, 22 bp, Homo sapiens
acttgcatgtgtaaatcttcct

SEQ ID NO: 7256270 - DNA, 22 bp, Homo sapiens
acttgcatttcaggcacttgtg

SEQ ID NO: 7256271 - DNA, 22 bp, Homo sapiens
acttgcatttaaatattgaata

SEQ ID NO: 7256272 - DNA, 22 bp, Homo sapiens
actgtgtcattgaacatggaaa

SEQ ID NO: 7256273 - DNA, 22 bp, Homo sapiens
actgtgggtgagggcaaatcaa

SEQ ID NO: 7256274 - DNA, 21 bp, Homo sapiens
actgtgggtctgaccacctgg

SEQ ID NO: 7256275 - DNA, 22 bp, Homo sapiens
actgtgggtcccagctgtgtct

SEQ ID NO: 7256276 - DNA, 22 bp, Homo sapiens
actgtggggttcctggtacttg

SEQ ID NO: 7256277 - DNA, 22 bp, Homo sapiens
agtttctaacatatagcattgg

SEQ ID NO: 7256278 - DNA, 18 bp, Homo sapiens
agttgctagatgctgtag

SEQ ID NO: 7256279 - DNA, 22 bp, Homo sapiens
actggcagtagagggagcgcat

SEQ ID NO: 7256280 - DNA, 22 bp, Homo sapiens
agtttataaaacattgcgtggc

SEQ ID NO: 7256281 - DNA, 22 bp, Homo sapiens
agtttacatgacgtgtatttca

SEQ ID NO: 7256282 - DNA, 22 bp, Homo sapiens
actgtaaaatgagatatgtata

SEQ ID NO: 7256283 - DNA, 22 bp, Homo sapiens
actgtaaagaagtaagtatggg

SEQ ID NO: 7256284 - DNA, 22 bp, Homo sapiens
atccagctttgtctggtcttcg

SEQ ID NO: 7256285 - DNA, 22 bp, Homo sapiens
atccagagttgctgtatatctt

SEQ ID NO: 7256286 - DNA, 22 bp, Homo sapiens
atccagagttatatccaagcag

SEQ ID NO: 7256287 - DNA, 22 bp, Homo sapiens
atccagagtgtaattctccatg

SEQ ID NO: 7256288 - DNA, 22 bp, Homo sapiens
atccagagtggccttctttcca

SEQ ID NO: 7256289 - DNA, 22 bp, Homo sapiens
atccagagaggttaggtgacat

SEQ ID NO: 7256290 - DNA, 22 bp, Homo sapiens
atccagagactggggctgggat

SEQ ID NO: 7256291 - DNA, 22 bp, Homo sapiens
atccagagtaatacagaatgca

SEQ ID NO: 7256292 - DNA, 22 bp, Homo sapiens
atccagagggtagcaggattag

SEQ ID NO: 7256293 - DNA, 22 bp, Homo sapiens
atccagaggcactgccctttgt

SEQ ID NO: 7256294 - DNA, 22 bp, Homo sapiens
atccactctcccattcatgcat

SEQ ID NO: 7256295 - DNA, 22 bp, Homo sapiens
atccactctaagatctgtggtg

SEQ ID NO: 7256296 - DNA, 22 bp, Homo sapiens
atcatttgcctcaagtgaaagt

SEQ ID NO: 7256297 - DNA, 22 bp, Homo sapiens
atccagagacccaaggacagaa

SEQ ID NO: 7256298 - DNA, 22 bp, Homo sapiens
atccagacagtctggtgccaga

SEQ ID NO: 7256299 - DNA, 16 bp, Homo sapiens
atccagacagcacagg

SEQ ID NO: 7256300 - DNA, 21 bp, Homo sapiens
atcattgcagagcacattaaa

SEQ ID NO: 7256301 - DNA, 22 bp, Homo sapiens
agaaacagcattagcatcaatt

SEQ ID NO: 7256302 - DNA, 22 bp, Homo sapiens
agaaacatttagattatatgtc

SEQ ID NO: 7256303 - DNA, 22 bp, Homo sapiens
atcaccaggcaaaatgtcagag

SEQ ID NO: 7256304 - DNA, 21 bp, Homo sapiens
atcaccagcagaagctgcaga

SEQ ID NO: 7256305 - DNA, 22 bp, Homo sapiens
atatgaaagtaagcatgtgtgt

SEQ ID NO: 7256306 - DNA, 22 bp, Homo sapiens
atatgaaaatgttttagctgta

SEQ ID NO: 7256307 - DNA, 22 bp, Homo sapiens
atatgaaaagaagtcaccattg

SEQ ID NO: 7256308 - DNA, 22 bp, Homo sapiens
atatcttttagagcaagcttgt

SEQ ID NO: 7256309 - DNA, 22 bp, Homo sapiens
agaaacaacttgtttctcttgc

SEQ ID NO: 7256310 - DNA, 22 bp, Homo sapiens
agaaaatttaaagagacacaca

SEQ ID NO: 7256311 - DNA, 22 bp, Homo sapiens
atatctgtggagggcttacaaa

SEQ ID NO: 7256312 - DNA, 18 bp, Homo sapiens
atatctgtgggatggaga

SEQ ID NO: 7256313 - DNA, 22 bp, Homo sapiens
atatataacctggataaggctt

SEQ ID NO: 7256314 - DNA, 21 bp, Homo sapiens
actttgggcactttcctgccc

SEQ ID NO: 7256315 - DNA, 22 bp, Homo sapiens
atataatttagaaggggaaaca

SEQ ID NO: 7256316 - DNA, 22 bp, Homo sapiens
atataattgttctgaagtgttt

SEQ ID NO: 7256317 - DNA, 22 bp, Homo sapiens
atataattctcaggtttgacta

SEQ ID NO: 7256318 - DNA, 22 bp, Homo sapiens
atataattaatttagctgcctc

SEQ ID NO: 7256319 - DNA, 22 bp, Homo sapiens
atataatttttggttagctcaa

SEQ ID NO: 7256320 - DNA, 22 bp, Homo sapiens
acttgggatggtggccagagcg

SEQ ID NO: 7256321 - DNA, 22 bp, Homo sapiens
acttggtcttcaaatgcatgat

SEQ ID NO: 7256322 - DNA, 22 bp, Homo sapiens
atataatagtttcataaaggct

SEQ ID NO: 7256323 - DNA, 22 bp, Homo sapiens
acttggttgatgtcataaggtt

SEQ ID NO: 7256324 - DNA, 22 bp, Homo sapiens
aggcagggctcatttcttaggc

SEQ ID NO: 7256325 - DNA, 22 bp, Homo sapiens
aggcaggcactccggaagtgtc

SEQ ID NO: 7256326 - DNA, 17 bp, Homo sapiens
aggcaggcagagcggga

SEQ ID NO: 7256327 - DNA, 22 bp, Homo sapiens
acatgcacacctatatacatgt

SEQ ID NO: 7256328 - DNA, 22 bp, Homo sapiens
acatgcaaatgtgcatgcatgt

SEQ ID NO: 7256329 - DNA, 22 bp, Homo sapiens
acatgcaaagggatgcaattat

SEQ ID NO: 7256330 - DNA, 22 bp, Homo sapiens
acatgatattaatgtcttattt

SEQ ID NO: 7256331 - DNA, 22 bp, Homo sapiens
acatgaggaactcaggagtcac

SEQ ID NO: 7256332 - DNA, 22 bp, Homo sapiens
acatggaaaactaactgctttt

SEQ ID NO: 7256333 - DNA, 22 bp, Homo sapiens
aggccctgttgtagcattttgg

SEQ ID NO: 7256334 - DNA, 22 bp, Homo sapiens
aggccctgttatgagccactgt

SEQ ID NO: 7256335 - DNA, 22 bp, Homo sapiens
acatggaagataaaaatactca

SEQ ID NO: 7256336 - DNA, 21 bp, Homo sapiens
acatggaagagaaattaacca

SEQ ID NO: 7256337 - DNA, 21 bp, Homo sapiens
acatggactgtgaatggggac

SEQ ID NO: 7256338 - DNA, 20 bp, Homo sapiens
aggccctgccagggacggag

SEQ ID NO: 7256339 - DNA, 22 bp, Homo sapiens
acatgcataagcctagccatca

SEQ ID NO: 7256340 - DNA, 22 bp, Homo sapiens
acatgcataaactacttcttat

SEQ ID NO: 7256341 - DNA, 22 bp, Homo sapiens
acatgcataaactacttcttat

SEQ ID NO: 7256342 - DNA, 22 bp, Homo sapiens
acatgcagtgagtagttctcca

SEQ ID NO: 7256343 - DNA, 22 bp, Homo sapiens
acatgcagaattcttagagagc

SEQ ID NO: 7256344 - DNA, 22 bp, Homo sapiens
aggccctgtaaggtgtggagat

SEQ ID NO: 7256345 - DNA, 22 bp, Homo sapiens
aggccctggtcaggtctggctg

SEQ ID NO: 7256346 - DNA, 22 bp, Homo sapiens
aggccctgtccatggtgctgaa

SEQ ID NO: 7256347 - DNA, 20 bp, Homo sapiens
aggccctgtgcatcttgttt

SEQ ID NO: 7256348 - DNA, 22 bp, Homo sapiens
acatttattttggcacggcaca

SEQ ID NO: 7256349 - DNA, 22 bp, Homo sapiens
acatttattttcagctgggaaa

SEQ ID NO: 7256350 - DNA, 22 bp, Homo sapiens
acatttattactcaggttgttg

SEQ ID NO: 7256351 - DNA, 22 bp, Homo sapiens
acatttatatttagtggggaat

SEQ ID NO: 7256352 - DNA, 22 bp, Homo sapiens
acatttatataactcactagga

SEQ ID NO: 7256353 - DNA, 22 bp, Homo sapiens
aggctgaggctggcagctccag

SEQ ID NO: 7256354 - DNA, 22 bp, Homo sapiens
aggctgagggctcctgagggca

SEQ ID NO: 7256355 - DNA, 22 bp, Homo sapiens
aggctgaggctttccttggaga

SEQ ID NO: 7256356 - DNA, 22 bp, Homo sapiens
aggctgagtttctcattctcgc

SEQ ID NO: 7256357 - DNA, 22 bp, Homo sapiens
aggctgatgctggctgaggctg

SEQ ID NO: 7256358 - DNA, 20 bp, Homo sapiens
aggctgagttctatgcactt

SEQ ID NO: 7256359 - DNA, 22 bp, Homo sapiens
acatttaaccctcaggtttctg

SEQ ID NO: 7256360 - DNA, 22 bp, Homo sapiens
aggccttgggagcagtgtttgt

SEQ ID NO: 7256361 - DNA, 22 bp, Homo sapiens
aggccttcctcggagacaggga

SEQ ID NO: 7256362 - DNA, 22 bp, Homo sapiens
aggcgcagaaggccaggggcct

SEQ ID NO: 7256363 - DNA, 22 bp, Homo sapiens
aggcgaagggaccagacggtag

SEQ ID NO: 7256364 - DNA, 22 bp, Homo sapiens
aggcgcagacatacagggtctg

SEQ ID NO: 7256365 - DNA, 22 bp, Homo sapiens
aggcgcctgcgggatccttgcc

SEQ ID NO: 7256366 - DNA, 22 bp, Homo sapiens
accctactaaatgtggtatgtc

SEQ ID NO: 7256367 - DNA, 22 bp, Homo sapiens
accctcagacagctgtggccag

SEQ ID NO: 7256368 - DNA, 22 bp, Homo sapiens
accctcaacaaattcactctat

SEQ ID NO: 7256369 - DNA, 22 bp, Homo sapiens
accctagacattgaactagggt

SEQ ID NO: 7256370 - DNA, 22 bp, Homo sapiens
agggcctgggaagaggaaccct

SEQ ID NO: 7256371 - DNA, 22 bp, Homo sapiens
agggcctgggccagcacccttt

SEQ ID NO: 7256372 - DNA, 22 bp, Homo sapiens
agggcagttcagccacaggctc

SEQ ID NO: 7256373 - DNA, 22 bp, Homo sapiens
agggcagttcagccacaggctc

SEQ ID NO: 7256374 - DNA, 22 bp, Homo sapiens
agggcagtgtggtgggactgac

SEQ ID NO: 7256375 - DNA, 22 bp, Homo sapiens
agggcatgaaatgggcagaagc

SEQ ID NO: 7256376 - DNA, 23 bp, Homo sapiens
agggcatgaagcagaggacgtgg

SEQ ID NO: 7256377 - DNA, 20 bp, Homo sapiens
agggcagcttgaggagccgg

SEQ ID NO: 7256378 - DNA, 22 bp, Homo sapiens
agggacagatgaatgactgagt

SEQ ID NO: 7256379 - DNA, 17 bp, Homo sapiens
agggacagcagtttagg

SEQ ID NO: 7256380 - DNA, 20 bp, Homo sapiens
agggacacaatatttctgtg

SEQ ID NO: 7256381 - DNA, 22 bp, Homo sapiens
agggaagaggaccagagtctct

SEQ ID NO: 7256382 - DNA, 22 bp, Homo sapiens
agggaagccccgaggaggcacc

SEQ ID NO: 7256383 - DNA, 19 bp, Homo sapiens
accaggcctcagaggccct

SEQ ID NO: 7256384 - DNA, 20 bp, Homo sapiens
aggctggcactcctggccag

SEQ ID NO: 7256385 - DNA, 22 bp, Homo sapiens
accaaaacctgctactaaagga

SEQ ID NO: 7256386 - DNA, 22 bp, Homo sapiens
accaaaaagatatgttgaagcc

SEQ ID NO: 7256387 - DNA, 22 bp, Homo sapiens
acaggctgcccgctccccacct

SEQ ID NO: 7256388 - DNA, 22 bp, Homo sapiens
acaggctgctgggctccgtgct

SEQ ID NO: 7256389 - DNA, 22 bp, Homo sapiens
acaggctggtggtcctggccat

SEQ ID NO: 7256390 - DNA, 22 bp, Homo sapiens
acaggctgttggggtccagggt

SEQ ID NO: 7256391 - DNA, 22 bp, Homo sapiens
acaggcctgacacacagagggc

SEQ ID NO: 7256392 - DNA, 22 bp, Homo sapiens
acaggcccagctcttcaccaga

SEQ ID NO: 7256393 - DNA, 22 bp, Homo sapiens
acagcttaatcagtatgagcct

SEQ ID NO: 7256394 - DNA, 22 bp, Homo sapiens
acagcttagccagtcaagctct

SEQ ID NO: 7256395 - DNA, 22 bp, Homo sapiens
acagctgtgttttataatcagc

SEQ ID NO: 7256396 - DNA, 22 bp, Homo sapiens
agctgccccatgagaggcaggt

SEQ ID NO: 7256397 - DNA, 22 bp, Homo sapiens
acagccttgtagcatcttagcc

SEQ ID NO: 7256398 - DNA, 23 bp, Homo sapiens
acagccttctggggcttctgggc

SEQ ID NO: 7256399 - DNA, 22 bp, Homo sapiens
acagccttgatattaattgtct

SEQ ID NO: 7256400 - DNA, 22 bp, Homo sapiens
acagcctgctgcctgcttcttg

SEQ ID NO: 7256401 - DNA, 22 bp, Homo sapiens
acagctcctactgaagccatgt

SEQ ID NO: 7256402 - DNA, 22 bp, Homo sapiens
acagctcctggggctttaatgg

SEQ ID NO: 7256403 - DNA, 22 bp, Homo sapiens
acagctcctaacaaaggctctc

SEQ ID NO: 7256404 - DNA, 22 bp, Homo sapiens
acagctctgtgtattgtcatct

SEQ ID NO: 7256405 - DNA, 21 bp, Homo sapiens
acagccttgtgatggagacag

SEQ ID NO: 7256406 - DNA, 19 bp, Homo sapiens
agctggggcggtgtgtgtt

SEQ ID NO: 7256407 - DNA, 23 bp, Homo sapiens
agctgggcaaggatccgggctcc

SEQ ID NO: 7256408 - DNA, 20 bp, Homo sapiens
agctgggcaattatgactat

SEQ ID NO: 7256409 - DNA, 22 bp, Homo sapiens
agctggggttgcacacattttg

SEQ ID NO: 7256410 - DNA, 22 bp, Homo sapiens
agctgggggttggataagggta

SEQ ID NO: 7256411 - DNA, 22 bp, Homo sapiens
agctggggctgcagagaacagg

SEQ ID NO: 7256412 - DNA, 22 bp, Homo sapiens
agctggggctgtggttgtgatt

SEQ ID NO: 7256413 - DNA, 22 bp, Homo sapiens
agctggggctgtggttgtgatt

SEQ ID NO: 7256414 - DNA, 22 bp, Homo sapiens
agctgggggtagtgagaaataa

SEQ ID NO: 7256415 - DNA, 22 bp, Homo sapiens
aggagctgttttgttcagcaaa

SEQ ID NO: 7256416 - DNA, 22 bp, Homo sapiens
acagggtggggatggtgagctt

SEQ ID NO: 7256417 - DNA, 22 bp, Homo sapiens
acagggtggggatggtgagctt

SEQ ID NO: 7256418 - DNA, 22 bp, Homo sapiens
aggaggaactcagaaagaaggt

SEQ ID NO: 7256419 - DNA, 21 bp, Homo sapiens
aggaggaacccgtggctgggc

SEQ ID NO: 7256420 - DNA, 23 bp, Homo sapiens
aggaggaaaagttatctgctgag

SEQ ID NO: 7256421 - DNA, 21 bp, Homo sapiens
aggaggaacccgtggctgggc

SEQ ID NO: 7256422 - DNA, 22 bp, Homo sapiens
acagtacaagcaatgcattttt

SEQ ID NO: 7256423 - DNA, 22 bp, Homo sapiens
aggagggtggcctcatgtgagt

SEQ ID NO: 7256424 - DNA, 22 bp, Homo sapiens
aggagtgagctttggggtcaga

SEQ ID NO: 7256425 - DNA, 22 bp, Homo sapiens
aggagtgagtgtcctcagcaga

SEQ ID NO: 7256426 - DNA, 22 bp, Homo sapiens
aggagtctgaactggtcccctg

SEQ ID NO: 7256427 - DNA, 22 bp, Homo sapiens
aggagtgcaaatagtccagaga

SEQ ID NO: 7256428 - DNA, 22 bp, Homo sapiens
aggagtggaattactgggttct

SEQ ID NO: 7256429 - DNA, 22 bp, Homo sapiens
acagtgttctgctttttaatcc

SEQ ID NO: 7256430 - DNA, 22 bp, Homo sapiens
acagtgttttagaaaagcttga

SEQ ID NO: 7256431 - DNA, 22 bp, Homo sapiens
acagtgttttgtctggcagggc

SEQ ID NO: 7256432 - DNA, 22 bp, Homo sapiens
acagtgcaaaccctcgggaaag

SEQ ID NO: 7256433 - DNA, 23 bp, Homo sapiens
acagttatagctgtgaataacat

SEQ ID NO: 7256434 - DNA, 22 bp, Homo sapiens
acagttatctttgaaatagaga

SEQ ID NO: 7256435 - DNA, 22 bp, Homo sapiens
acagttatatacatgtagctgt

SEQ ID NO: 7256436 - DNA, 22 bp, Homo sapiens
acagttattctttatgcaacca

SEQ ID NO: 7256437 - DNA, 22 bp, Homo sapiens
acagttatttactgcataaact

SEQ ID NO: 7256438 - DNA, 22 bp, Homo sapiens
acagttaatatgtgacagaact

SEQ ID NO: 7256439 - DNA, 22 bp, Homo sapiens
acagttaataagtagtaagtca

SEQ ID NO: 7256440 - DNA, 22 bp, Homo sapiens
aggcaggattgctgacaacaat

SEQ ID NO: 7256441 - DNA, 22 bp, Homo sapiens
aggcaggcaaccacctgggaag

SEQ ID NO: 7256442 - DNA, 22 bp, Homo sapiens
aggcagcatccagaggagaatg

SEQ ID NO: 7256443 - DNA, 22 bp, Homo sapiens
aggcagcatgctctgcttctac

SEQ ID NO: 7256444 - DNA, 22 bp, Homo sapiens
aaacacaagaggcagggtacag

SEQ ID NO: 7256445 - DNA, 22 bp, Homo sapiens
aaacaccaagagctagctatta

SEQ ID NO: 7256446 - DNA, 22 bp, Homo sapiens
aaacaccagtcccagtatacac

SEQ ID NO: 7256447 - DNA, 22 bp, Homo sapiens
aaaattgaggctcatgttaaat

SEQ ID NO: 7256448 - DNA, 22 bp, Homo sapiens
aaaattgaggccagtatgccat

SEQ ID NO: 7256449 - DNA, 22 bp, Homo sapiens
aaaattgagagtcttgtgcaag

SEQ ID NO: 7256450 - DNA, 22 bp, Homo sapiens
aaactgcacatgaggctggtgc

SEQ ID NO: 7256451 - DNA, 22 bp, Homo sapiens
aaactgcagagccatggttcaa

SEQ ID NO: 7256452 - DNA, 22 bp, Homo sapiens
aaactgcacaagggtgcatagc

SEQ ID NO: 7256453 - DNA, 22 bp, Homo sapiens
aaactgcagccttgagttcagg

SEQ ID NO: 7256454 - DNA, 22 bp, Homo sapiens
aaacaggtctgaaaatagctac

SEQ ID NO: 7256455 - DNA, 22 bp, Homo sapiens
aaacaggcgcttactaagaaaa

SEQ ID NO: 7256456 - DNA, 22 bp, Homo sapiens
aaacagtattatcaatatattt

SEQ ID NO: 7256457 - DNA, 22 bp, Homo sapiens
aaaatatgaagttgtcagtatg

SEQ ID NO: 7256458 - DNA, 22 bp, Homo sapiens
aaaatatggggtgagcccagag

SEQ ID NO: 7256459 - DNA, 22 bp, Homo sapiens
aaacagcttgtttcaggaaagt

SEQ ID NO: 7256460 - DNA, 22 bp, Homo sapiens
aaaattcatggcttgggaaaag

SEQ ID NO: 7256461 - DNA, 22 bp, Homo sapiens
aaaattcatggcttgggaaaag

SEQ ID NO: 7256462 - DNA, 22 bp, Homo sapiens
aaaattcatagaactgtacgct

SEQ ID NO: 7256463 - DNA, 22 bp, Homo sapiens
aaaattaagtgtctgggaagcc

SEQ ID NO: 7256464 - DNA, 21 bp, Homo sapiens
aaaatgtttccttgttggtta

SEQ ID NO: 7256465 - DNA, 18 bp, Homo sapiens
aaaatgttcccccattaa

SEQ ID NO: 7256466 - DNA, 22 bp, Homo sapiens
aaaatgttcaagcatgctggtt

SEQ ID NO: 7256467 - DNA, 22 bp, Homo sapiens
aaaaggcatggaggttgatagt

SEQ ID NO: 7256468 - DNA, 22 bp, Homo sapiens
aaaaagtattggccatggttga

SEQ ID NO: 7256469 - DNA, 22 bp, Homo sapiens
aaaaagcttaaatgagcagttc

SEQ ID NO: 7256470 - DNA, 21 bp, Homo sapiens
aaaaagctggggcatgcatgc

SEQ ID NO: 7256471 - DNA, 22 bp, Homo sapiens
aaagccactgcatgtgtagtat

SEQ ID NO: 7256472 - DNA, 22 bp, Homo sapiens
aaacactgaagacctatctggt

SEQ ID NO: 7256473 - DNA, 20 bp, Homo sapiens
aaagccactggcaagagact

SEQ ID NO: 7256474 - DNA, 22 bp, Homo sapiens
aaagccagagcaagctgtcaca

SEQ ID NO: 7256475 - DNA, 22 bp, Homo sapiens
aaagccagagcaagctgtcaca

SEQ ID NO: 7256476 - DNA, 22 bp, Homo sapiens
aaagccagagtgtgttagagac

SEQ ID NO: 7256477 - DNA, 22 bp, Homo sapiens
aaagccagcaaggtgagtttca

SEQ ID NO: 7256478 - DNA, 22 bp, Homo sapiens
aaagccagctctgagctgcacc

SEQ ID NO: 7256479 - DNA, 22 bp, Homo sapiens
aaagccagggacagtgtgcatg

SEQ ID NO: 7256480 - DNA, 22 bp, Homo sapiens
aaacactgtgggacatcttact

SEQ ID NO: 7256481 - DNA, 22 bp, Homo sapiens
aaacactgtgggacatcttact

SEQ ID NO: 7256482 - DNA, 22 bp, Homo sapiens
aaagccaggcagccaagccagt

SEQ ID NO: 7256483 - DNA, 22 bp, Homo sapiens
aaacagagtttggtaaatagcc

SEQ ID NO: 7256484 - DNA, 22 bp, Homo sapiens
aaacagagtttggtaaatagcc

SEQ ID NO: 7256485 - DNA, 22 bp, Homo sapiens
aaacagctccttagtttccatc

SEQ ID NO: 7256486 - DNA, 22 bp, Homo sapiens
aaacagctggtctcaaatgttc

SEQ ID NO: 7256487 - DNA, 22 bp, Homo sapiens
aaacagctgcagtacacggcct

SEQ ID NO: 7256488 - DNA, 22 bp, Homo sapiens
aaacagctaatggccaggaata

SEQ ID NO: 7256489 - DNA, 22 bp, Homo sapiens
aaacagctacttctgtataatg

SEQ ID NO: 7256490 - DNA, 22 bp, Homo sapiens
aaactgtatagggaaaagtaga

SEQ ID NO: 7256491 - DNA, 22 bp, Homo sapiens
aaactgcaattatgtttgcaga

SEQ ID NO: 7256492 - DNA, 22 bp, Homo sapiens
aaactgtaaacacagcagtaca

SEQ ID NO: 7256493 - DNA, 22 bp, Homo sapiens
aaacatgtagtgcatgaggatc

SEQ ID NO: 7256494 - DNA, 22 bp, Homo sapiens
aaagaaatagatggcatttaaa

SEQ ID NO: 7256495 - DNA, 22 bp, Homo sapiens
aaatagttgtttggatcaataa

SEQ ID NO: 7256496 - DNA, 22 bp, Homo sapiens
aaatagtcctgggaatagtact

SEQ ID NO: 7256497 - DNA, 22 bp, Homo sapiens
aaagagaacttttacccaagaa

SEQ ID NO: 7256498 - DNA, 22 bp, Homo sapiens
aaagagaacttttacccaagaa

SEQ ID NO: 7256499 - DNA, 22 bp, Homo sapiens
aaagagaaacttagaagcctga

SEQ ID NO: 7256500 - DNA, 21 bp, Homo sapiens
aaagatgtttcatctgagaaa

SEQ ID NO: 7256501 - DNA, 22 bp, Homo sapiens
aaagagcaccctcaatgtctga

SEQ ID NO: 7256502 - DNA, 22 bp, Homo sapiens
aaagagatgtgccaaatagcct

SEQ ID NO: 7256503 - DNA, 23 bp, Homo sapiens
aaagactgctgagaattttagga

SEQ ID NO: 7256504 - DNA, 22 bp, Homo sapiens
aaagaacagatgtgtggtgcat

SEQ ID NO: 7256505 - DNA, 22 bp, Homo sapiens
aagatcaagatttaggttgagg

SEQ ID NO: 7256506 - DNA, 22 bp, Homo sapiens
aagcctcaccttttagaagcta

SEQ ID NO: 7256507 - DNA, 22 bp, Homo sapiens
aagcctggcacattggagtctg

SEQ ID NO: 7256508 - DNA, 22 bp, Homo sapiens
aagcctggactatcgcgtgtgc

SEQ ID NO: 7256509 - DNA, 22 bp, Homo sapiens
aagcccagatgtgagaactgag

SEQ ID NO: 7256510 - DNA, 22 bp, Homo sapiens
aaagtgaattgatttaagggga

SEQ ID NO: 7256511 - DNA, 19 bp, Homo sapiens
aaagtgaatgctgttttct

SEQ ID NO: 7256512 - DNA, 22 bp, Homo sapiens
aagactgtcttttctgagtgac

SEQ ID NO: 7256513 - DNA, 22 bp, Homo sapiens
aagactaaatgtgttctaaagt

SEQ ID NO: 7256514 - DNA, 22 bp, Homo sapiens
aagataacaggaggagtttgta

SEQ ID NO: 7256515 - DNA, 22 bp, Homo sapiens
aaatacatttacagtcgtggct

SEQ ID NO: 7256516 - DNA, 22 bp, Homo sapiens
aagaggggtggtctgtgaggat

SEQ ID NO: 7256517 - DNA, 22 bp, Homo sapiens
aagaggaggatgctttacagct

SEQ ID NO: 7256518 - DNA, 22 bp, Homo sapiens
aagaggaggattgatgtgggag

SEQ ID NO: 7256519 - DNA, 18 bp, Homo sapiens
aagaggaggagcaggttg

SEQ ID NO: 7256520 - DNA, 22 bp, Homo sapiens
aagaggaggatgctttacagct

SEQ ID NO: 7256521 - DNA, 22 bp, Homo sapiens
aagagggcagcacaggtgggtc

SEQ ID NO: 7256522 - DNA, 22 bp, Homo sapiens
aacactgtggtcttttcagtaa

SEQ ID NO: 7256523 - DNA, 22 bp, Homo sapiens
aaagatgttttataagttatgg

SEQ ID NO: 7256524 - DNA, 22 bp, Homo sapiens
aacatagagacaggaagtgctt

SEQ ID NO: 7256525 - DNA, 22 bp, Homo sapiens
aaagcctcccaggttatgagta

SEQ ID NO: 7256526 - DNA, 22 bp, Homo sapiens
aacatagaattgttatattttc

SEQ ID NO: 7256527 - DNA, 22 bp, Homo sapiens
aacatagaatggctccagagct

SEQ ID NO: 7256528 - DNA, 22 bp, Homo sapiens
aacatacagtgagcagtggact

SEQ ID NO: 7256529 - DNA, 22 bp, Homo sapiens
aacatacatatttcagtgtcca

SEQ ID NO: 7256530 - DNA, 22 bp, Homo sapiens
aacataagggagcttcaaaact

SEQ ID NO: 7256531 - DNA, 23 bp, Homo sapiens
aacacttgcatgaacagctacac

SEQ ID NO: 7256532 - DNA, 22 bp, Homo sapiens
aaagcactctatcctttgtaga

SEQ ID NO: 7256533 - DNA, 22 bp, Homo sapiens
aacccatgttggaagcttatca

SEQ ID NO: 7256534 - DNA, 22 bp, Homo sapiens
aagaacatgagttatgatgatt

SEQ ID NO: 7256535 - DNA, 22 bp, Homo sapiens
aagaacagttgggaggtgagcc

SEQ ID NO: 7256536 - DNA, 22 bp, Homo sapiens
aaagtaattgcagtttctgcca

SEQ ID NO: 7256537 - DNA, 22 bp, Homo sapiens
aaagtaattaagaagctggaca

SEQ ID NO: 7256538 - DNA, 22 bp, Homo sapiens
aactgtgtggtatacctgtgat

SEQ ID NO: 7256539 - DNA, 22 bp, Homo sapiens
aactgtgggatgcattaattca

SEQ ID NO: 7256540 - DNA, 22 bp, Homo sapiens
aactgtggccagggactggagt

SEQ ID NO: 7256541 - DNA, 22 bp, Homo sapiens
aactagaacgtctagttgctgg

SEQ ID NO: 7256542 - DNA, 22 bp, Homo sapiens
aactagtaaaagcaacagtata

SEQ ID NO: 7256543 - DNA, 22 bp, Homo sapiens
aatggctgccagggcaggaggt

SEQ ID NO: 7256544 - DNA, 23 bp, Homo sapiens
aatgacaggcaatgtaattgtgt

SEQ ID NO: 7256545 - DNA, 22 bp, Homo sapiens
aactagaaaaagactttctgag

SEQ ID NO: 7256546 - DNA, 23 bp, Homo sapiens
aatgacagtgtgtgattgaagaa

SEQ ID NO: 7256547 - DNA, 19 bp, Homo sapiens
aactagaaaggttttgaga

SEQ ID NO: 7256548 - DNA, 20 bp, Homo sapiens
aactagaaagcacccatgga

SEQ ID NO: 7256549 - DNA, 22 bp, Homo sapiens
aactagaaaacaagatgctgat

SEQ ID NO: 7256550 - DNA, 22 bp, Homo sapiens
aactagaaagaacatatttcca

SEQ ID NO: 7256551 - DNA, 22 bp, Homo sapiens
aactagaacgagaaagctgaac

SEQ ID NO: 7256552 - DNA, 22 bp, Homo sapiens
aactagaacctgcattttaaca

SEQ ID NO: 7256553 - DNA, 22 bp, Homo sapiens
aactagaaatcactacaggtat

SEQ ID NO: 7256554 - DNA, 22 bp, Homo sapiens
aactagaaccacttgtatttcc

SEQ ID NO: 7256555 - DNA, 22 bp, Homo sapiens
aacccacaaaggatttcagctc

SEQ ID NO: 7256556 - DNA, 22 bp, Homo sapiens
aaccctgattttacaaatgtct

SEQ ID NO: 7256557 - DNA, 22 bp, Homo sapiens
aacctagggcatgaggatggtt

SEQ ID NO: 7256558 - DNA, 22 bp, Homo sapiens
aatgaattcgagtgaaggaaag

SEQ ID NO: 7256559 - DNA, 22 bp, Homo sapiens
aaccttatcatgcataagtaga

SEQ ID NO: 7256560 - DNA, 22 bp, Homo sapiens
aatagactttctttttagaaca

SEQ ID NO: 7256561 - DNA, 22 bp, Homo sapiens
aatagacattatttctctatga

SEQ ID NO: 7256562 - DNA, 22 bp, Homo sapiens
aatagactttgtataatttccc

SEQ ID NO: 7256563 - DNA, 22 bp, Homo sapiens
aatagatactacttagatgtag

SEQ ID NO: 7256564 - DNA, 22 bp, Homo sapiens
aatagatactacttagatgtag

SEQ ID NO: 7256565 - DNA, 22 bp, Homo sapiens
aatagcaaacactggtaaagtt

SEQ ID NO: 7256566 - DNA, 20 bp, Homo sapiens
aatacatgagcacactttca

SEQ ID NO: 7256567 - DNA, 22 bp, Homo sapiens
aacagcttactcaatggtgatt

SEQ ID NO: 7256568 - DNA, 22 bp, Homo sapiens
aacagcttagaaatgttgctaa

SEQ ID NO: 7256569 - DNA, 22 bp, Homo sapiens
aacagcttcatcacatggcata

SEQ ID NO: 7256570 - DNA, 22 bp, Homo sapiens
aacagcttcatcacatggcata

SEQ ID NO: 7256571 - DNA, 20 bp, Homo sapiens
aacacagataccaaaggttg

SEQ ID NO: 7256572 - DNA, 22 bp, Homo sapiens
aacacagaagtgccaagagcca

SEQ ID NO: 7256573 - DNA, 22 bp, Homo sapiens
aaggctggtcagatgtggtgaa

SEQ ID NO: 7256574 - DNA, 22 bp, Homo sapiens
aaggctggttccatccctggtg

SEQ ID NO: 7256575 - DNA, 22 bp, Homo sapiens
aaatttctaagtcaagaagaac

SEQ ID NO: 7256576 - DNA, 22 bp, Homo sapiens
aacagagatcttaattcctgta

SEQ ID NO: 7256577 - DNA, 22 bp, Homo sapiens
aacagagaggccacctcagcag

SEQ ID NO: 7256578 - DNA, 22 bp, Homo sapiens
aacagaagggggtatttacatt

SEQ ID NO: 7256579 - DNA, 22 bp, Homo sapiens
aacagaagggggtatttacatt

SEQ ID NO: 7256580 - DNA, 22 bp, Homo sapiens
aacacagttttccaaaatagag

SEQ ID NO: 7256581 - DNA, 22 bp, Homo sapiens
aacacagtttctctatgagagt

SEQ ID NO: 7256582 - DNA, 22 bp, Homo sapiens
aacactttcttccttgctcagg

SEQ ID NO: 7256583 - DNA, 22 bp, Homo sapiens
aaggaagaggcaggttttgctg

SEQ ID NO: 7256584 - DNA, 22 bp, Homo sapiens
aaggcagccagatcctttgggt

SEQ ID NO: 7256585 - DNA, 22 bp, Homo sapiens
aaattcacaagagcattgcctg

SEQ ID NO: 7256586 - DNA, 22 bp, Homo sapiens
aaggctgggtttgggatgtgat

SEQ ID NO: 7256587 - DNA, 22 bp, Homo sapiens
aaggctgggtaacctgtccact

SEQ ID NO: 7256588 - DNA, 21 bp, Homo sapiens
aaattcacctagtaaaacttc

SEQ ID NO: 7256589 - DNA, 22 bp, Homo sapiens
aagacccacaaggctgaatgtt

SEQ ID NO: 7256590 - DNA, 20 bp, Homo sapiens
aagagaagaagtctttgaaa

SEQ ID NO: 7256591 - DNA, 22 bp, Homo sapiens
aagagaagaaagtgtctacaca

SEQ ID NO: 7256592 - DNA, 22 bp, Homo sapiens
aagagaaagcagactttgtcat

SEQ ID NO: 7256593 - DNA, 21 bp, Homo sapiens
aagagacatttctcatcagca

SEQ ID NO: 7256594 - DNA, 22 bp, Homo sapiens
aagagacagagccatgtttcta

SEQ ID NO: 7256595 - DNA, 22 bp, Homo sapiens
acacaaagttggatgacaaaat

SEQ ID NO: 7256596 - DNA, 22 bp, Homo sapiens
aagagcaccttaattatgcaga

SEQ ID NO: 7256597 - DNA, 22 bp, Homo sapiens
aagagcagcctccaggggtgga

SEQ ID NO: 7256598 - DNA, 22 bp, Homo sapiens
aagaaaatcagttctggtcagt

SEQ ID NO: 7256599 - DNA, 22 bp, Homo sapiens
aagaaactgttgcgtgacagcg

SEQ ID NO: 7256600 - DNA, 22 bp, Homo sapiens
aattcacaattatgttgggaga

SEQ ID NO: 7256601 - DNA, 22 bp, Homo sapiens
aattcacaatgtgtagtcatgc

SEQ ID NO: 7256602 - DNA, 22 bp, Homo sapiens
aattctaaatgtaatttagaat

SEQ ID NO: 7256603 - DNA, 22 bp, Homo sapiens
aagaaatggcttcatctgagta

SEQ ID NO: 7256604 - DNA, 22 bp, Homo sapiens
aagaaatgtgaatattgaatag

SEQ ID NO: 7256605 - DNA, 22 bp, Homo sapiens
aagaaattaaggaatgcaacga

SEQ ID NO: 7256606 - DNA, 22 bp, Homo sapiens
aagatgacagatgcttagagtc

SEQ ID NO: 7256607 - DNA, 22 bp, Homo sapiens
aagatgcggttgaccatggtgt

SEQ ID NO: 7256608 - DNA, 22 bp, Homo sapiens
aagatgcatgctgaagctggct

SEQ ID NO: 7256609 - DNA, 22 bp, Homo sapiens
aagatgcacaatgtggcaatta

SEQ ID NO: 7256610 - DNA, 22 bp, Homo sapiens
aagatgcatgctgaagctggct

SEQ ID NO: 7256611 - DNA, 22 bp, Homo sapiens
aagcaagagttggagtgatgtt

SEQ ID NO: 7256612 - DNA, 22 bp, Homo sapiens
aagcaataaataatttttagta

SEQ ID NO: 7256613 - DNA, 22 bp, Homo sapiens
aagcaataaataatttttagta

SEQ ID NO: 7256614 - DNA, 22 bp, Homo sapiens
aagcaatagcaacaactttaca

SEQ ID NO: 7256615 - DNA, 22 bp, Homo sapiens
acacatttacatgtttacgtat

SEQ ID NO: 7256616 - DNA, 22 bp, Homo sapiens
acacatgataagaaagtttaaa

SEQ ID NO: 7256617 - DNA, 22 bp, Homo sapiens
aagcaatagcaacaactttaca

SEQ ID NO: 7256618 - DNA, 22 bp, Homo sapiens
aagcaatagggtaatctactca

SEQ ID NO: 7256619 - DNA, 22 bp, Homo sapiens
aagcaatagggtaatctactca

SEQ ID NO: 7256620 - DNA, 22 bp, Homo sapiens
aagcaatatactgatatgatta

SEQ ID NO: 7256621 - DNA, 22 bp, Homo sapiens
aagcaattgtcctgtctctaca

SEQ ID NO: 7256622 - DNA, 22 bp, Homo sapiens
aagcagaatttaatagaaaggt

SEQ ID NO: 7256623 - DNA, 22 bp, Homo sapiens
aagcagcttttgaagagtgagg

SEQ ID NO: 7256624 - DNA, 22 bp, Homo sapiens
acagcctggactggctctctgc

SEQ ID NO: 7256625 - DNA, 22 bp, Homo sapiens
acagcagagaactttagagggt

SEQ ID NO: 7256626 - DNA, 21 bp, Homo sapiens
acagcagagatcaagactaag

SEQ ID NO: 7256627 - DNA, 22 bp, Homo sapiens
acagcagagcaccagggccact

SEQ ID NO: 7256628 - DNA, 22 bp, Homo sapiens
agacaattaaaaaattatgctt

SEQ ID NO: 7256629 - DNA, 22 bp, Homo sapiens
agaagcagcaagcccttcaaag

SEQ ID NO: 7256630 - DNA, 22 bp, Homo sapiens
agaagcagactctgaggcaagg

SEQ ID NO: 7256631 - DNA, 23 bp, Homo sapiens
agaagcagcttctggagtatcgg

SEQ ID NO: 7256632 - DNA, 22 bp, Homo sapiens
agaagcagctttcaaggtgatt

SEQ ID NO: 7256633 - DNA, 22 bp, Homo sapiens
aatggtttcaaacacactaagt

SEQ ID NO: 7256634 - DNA, 22 bp, Homo sapiens
aatggtttatggggaccgcaaa

SEQ ID NO: 7256635 - DNA, 22 bp, Homo sapiens
aatggtttagttaagactgagt

SEQ ID NO: 7256636 - DNA, 22 bp, Homo sapiens
aatgtgaggccttggtagttat

SEQ ID NO: 7256637 - DNA, 22 bp, Homo sapiens
aatgtgaggccttggtagttat

SEQ ID NO: 7256638 - DNA, 22 bp, Homo sapiens
aatgtaaaatatcttgtacttg

SEQ ID NO: 7256639 - DNA, 22 bp, Homo sapiens
agaccctctccatgcccactgc

SEQ ID NO: 7256640 - DNA, 20 bp, Homo sapiens
agaccctctggactgggccc

SEQ ID NO: 7256641 - DNA, 18 bp, Homo sapiens
aatgtttgtcctctctaa

SEQ ID NO: 7256642 - DNA, 22 bp, Homo sapiens
aatgtttgtcatcacacagata

SEQ ID NO: 7256643 - DNA, 22 bp, Homo sapiens
aatgttttttggtctgatgaat

SEQ ID NO: 7256644 - DNA, 22 bp, Homo sapiens
agaccctgttagttccagtctt

SEQ ID NO: 7256645 - DNA, 18 bp, Homo sapiens
agagacagcagcaaaaga

SEQ ID NO: 7256646 - DNA, 22 bp, Homo sapiens
agagacagatctgagggacctc

SEQ ID NO: 7256647 - DNA, 22 bp, Homo sapiens
aattaaattggtttagagagga

SEQ ID NO: 7256648 - DNA, 22 bp, Homo sapiens
aattaaattggtttagagagga

SEQ ID NO: 7256649 - DNA, 23 bp, Homo sapiens
aattaaattgctagatccagggc

SEQ ID NO: 7256650 - DNA, 22 bp, Homo sapiens
aattaaatgacaggggaagatg

SEQ ID NO: 7256651 - DNA, 22 bp, Homo sapiens
aattaaaagataacccatgagt

SEQ ID NO: 7256652 - DNA, 22 bp, Homo sapiens
agagccagttacaactgtggag

SEQ ID NO: 7256653 - DNA, 22 bp, Homo sapiens
agagacaggatatctgctcatg

SEQ ID NO: 7256654 - DNA, 22 bp, Homo sapiens
agataagatagtccagcacaat

SEQ ID NO: 7256655 - DNA, 22 bp, Homo sapiens
agataatgaatttattgaatgt

SEQ ID NO: 7256656 - DNA, 22 bp, Homo sapiens
agataatgaatgccatgacatt

SEQ ID NO: 7256657 - DNA, 22 bp, Homo sapiens
acaagaattatttctagttaac

SEQ ID NO: 7256658 - DNA, 22 bp, Homo sapiens
acaagagattatctacagatga

SEQ ID NO: 7256659 - DNA, 20 bp, Homo sapiens
acaacaaacttgcttaagga

SEQ ID NO: 7256660 - DNA, 22 bp, Homo sapiens
agaggggtggtgctctcctgga

SEQ ID NO: 7256661 - DNA, 22 bp, Homo sapiens
acaacaagagctaagggtaagg

SEQ ID NO: 7256662 - DNA, 22 bp, Homo sapiens
acaacaaagacacttgaaatga

SEQ ID NO: 7256663 - DNA, 22 bp, Homo sapiens
agataacatttattgaatgtaa

SEQ ID NO: 7256664 - DNA, 22 bp, Homo sapiens
acaacagagctggactgagagg

SEQ ID NO: 7256665 - DNA, 17 bp, Homo sapiens
acaacagaaatgtattc

SEQ ID NO: 7256666 - DNA, 22 bp, Homo sapiens
acaatgaaccaaatttaccaat

SEQ ID NO: 7256667 - DNA, 22 bp, Homo sapiens
acaatgcaataggagctagaaa

SEQ ID NO: 7256668 - DNA, 22 bp, Homo sapiens
aattgatgggcactgaaatatt

SEQ ID NO: 7256669 - DNA, 22 bp, Homo sapiens
agaggctgaatgatgtcatcat

SEQ ID NO: 7256670 - DNA, 22 bp, Homo sapiens
agaggctgaatgatgtcatcat

SEQ ID NO: 7256671 - DNA, 22 bp, Homo sapiens
agaggctgagaaaccctcttct

SEQ ID NO: 7256672 - DNA, 22 bp, Homo sapiens
agagggggcagcggaccagtga

SEQ ID NO: 7256673 - DNA, 22 bp, Homo sapiens
agagggggaaaatagaggtgtt

SEQ ID NO: 7256674 - DNA, 22 bp, Homo sapiens
agagggggaaaatagaggtgtt

SEQ ID NO: 7256675 - DNA, 22 bp, Homo sapiens
agagggggaaaatagaggtgtt

SEQ ID NO: 7256676 - DNA, 22 bp, Homo sapiens
agagggggcagcggaccagtga

SEQ ID NO: 7256677 - DNA, 22 bp, Homo sapiens
agagggggtgtcagcactgcag

SEQ ID NO: 7256678 - DNA, 22 bp, Homo sapiens
agagggggtgttccagaagcat

SEQ ID NO: 7256679 - DNA, 22 bp, Homo sapiens
agaggggctcatatcctgtcat

SEQ ID NO: 7256680 - DNA, 22 bp, Homo sapiens
acaaaggttgggtcaattgtcc

SEQ ID NO: 7256681 - DNA, 22 bp, Homo sapiens
acaaaggtgagcagaagacaca

SEQ ID NO: 7256682 - DNA, 18 bp, Homo sapiens
acaaaggtctgcaagacc

SEQ ID NO: 7256683 - DNA, 22 bp, Homo sapiens
agaggctgatggagtagtgtct

SEQ ID NO: 7256684 - DNA, 22 bp, Homo sapiens
agaggctgtgcccaccaggcaa

SEQ ID NO: 7256685 - DNA, 22 bp, Homo sapiens
agaggctgttacactcccagat

SEQ ID NO: 7256686 - DNA, 22 bp, Homo sapiens
agaggctgtgcccaccaggcaa

SEQ ID NO: 7256687 - DNA, 22 bp, Homo sapiens
agaggctgtgcccaccaggcaa

SEQ ID NO: 7256688 - DNA, 22 bp, Homo sapiens
agaggctgttacactcccagat

SEQ ID NO: 7256689 - DNA, 22 bp, Homo sapiens
acaaaggcagagaattcaacat

SEQ ID NO: 7256690 - DNA, 22 bp, Homo sapiens
acactttacagaatgttttgat

SEQ ID NO: 7256691 - DNA, 22 bp, Homo sapiens
acactgaatgctgtttagaaat

SEQ ID NO: 7256692 - DNA, 22 bp, Homo sapiens
acacccaggaataaggactggg

SEQ ID NO: 7256693 - DNA, 22 bp, Homo sapiens
acacagggcagagagctggctc

SEQ ID NO: 7256694 - DNA, 19 bp, Homo sapiens
acacagggatcagagggtt

SEQ ID NO: 7256695 - DNA, 17 bp, Homo sapiens
acacagggagagggagc

SEQ ID NO: 7256696 - DNA, 22 bp, Homo sapiens
acacagagttattatgtgaact

SEQ ID NO: 7256697 - DNA, 22 bp, Homo sapiens
acacagagtatttagaaggggt

SEQ ID NO: 7256698 - DNA, 22 bp, Homo sapiens
acacagagtccttactgaggta

SEQ ID NO: 7256699 - DNA, 22 bp, Homo sapiens
acacagaggctccagagataga

SEQ ID NO: 7256700 - DNA, 22 bp, Homo sapiens
acacagaggcatgacagtggct

SEQ ID NO: 7256701 - DNA, 22 bp, Homo sapiens
acacagatattgtacttgatcc

SEQ ID NO: 7256702 - DNA, 22 bp, Homo sapiens
agcagctgggtccggcggagca

SEQ ID NO: 7256703 - DNA, 22 bp, Homo sapiens
acaatgcacctattttaaaact

SEQ ID NO: 7256704 - DNA, 21 bp, Homo sapiens
acaatgcatggaactcatggc

SEQ ID NO: 7256705 - DNA, 22 bp, Homo sapiens
agcagaagaaagccacatgact

SEQ ID NO: 7256706 - DNA, 22 bp, Homo sapiens
acagattatggatatatgtgga

SEQ ID NO: 7256707 - DNA, 21 bp, Homo sapiens
acagattagcacaatgcaggc

SEQ ID NO: 7256708 - DNA, 21 bp, Homo sapiens
acagatgtgatatgcagtctt

SEQ ID NO: 7256709 - DNA, 22 bp, Homo sapiens
acagatgtaccttagtgatggg

SEQ ID NO: 7256710 - DNA, 22 bp, Homo sapiens
acagatgtaatctattcacatt

SEQ ID NO: 7256711 - DNA, 22 bp, Homo sapiens
acagcacagagtggtatggctg

SEQ ID NO: 7256712 - DNA, 22 bp, Homo sapiens
acagcacaatctgagtcccaga

SEQ ID NO: 7256713 - DNA, 22 bp, Homo sapiens
acagatatttggggaaagacgt

SEQ ID NO: 7256714 - DNA, 22 bp, Homo sapiens
acagatatttggggaaagacgt

SEQ ID NO: 7256715 - DNA, 20 bp, Homo sapiens
acagatatttgattttcagt

SEQ ID NO: 7256716 - DNA, 22 bp, Homo sapiens
acagagcctccaggagtgctgg

SEQ ID NO: 7256717 - DNA, 22 bp, Homo sapiens
acagatgagttagaataggcag

SEQ ID NO: 7256718 - DNA, 22 bp, Homo sapiens
acagatgagttaaagcagagtg

SEQ ID NO: 7256719 - DNA, 22 bp, Homo sapiens
acagatgagttagaataggcag

SEQ ID NO: 7256720 - DNA, 22 bp, Homo sapiens
acagatgagttaaagcagagtg

SEQ ID NO: 7256721 - DNA, 22 bp, Homo sapiens
acagatgaggctggcgagggca

SEQ ID NO: 7256722 - DNA, 22 bp, Homo sapiens
acagatgatttttatgaaaaca

SEQ ID NO: 7256723 - DNA, 22 bp, Homo sapiens
acagatgatgtgcacagataga

SEQ ID NO: 7256724 - DNA, 22 bp, Homo sapiens
agcctctgatgatcacaggggg

SEQ ID NO: 7256725 - DNA, 22 bp, Homo sapiens
agcctctgactgtcagcaaggt

SEQ ID NO: 7256726 - DNA, 22 bp, Homo sapiens
acagagcatttgggacagagag

SEQ ID NO: 7256727 - DNA, 22 bp, Homo sapiens
agccctgtttatgccacatcat

SEQ ID NO: 7256728 - DNA, 22 bp, Homo sapiens
agccctgttctgttttagtagc

SEQ ID NO: 7256729 - DNA, 22 bp, Homo sapiens
agccctgttgtctgatgatggg

SEQ ID NO: 7256730 - DNA, 20 bp, Homo sapiens
agccctgtttcctggagaga

SEQ ID NO: 7256731 - DNA, 22 bp, Homo sapiens
acagacagaggctccatgagga

SEQ ID NO: 7256732 - DNA, 22 bp, Homo sapiens
agccaggggattcatcagggac

SEQ ID NO: 7256733 - DNA, 22 bp, Homo sapiens
acagacagattttgtctgatgt

SEQ ID NO: 7256734 - DNA, 22 bp, Homo sapiens
acagacaagtagttcagacaag

SEQ ID NO: 7256735 - DNA, 22 bp, Homo sapiens
acagactgtcccaccacatgga

SEQ ID NO: 7256736 - DNA, 22 bp, Homo sapiens
agccagggtctctcgctctgtt

SEQ ID NO: 7256737 - DNA, 22 bp, Homo sapiens
acagagagctgtgattgagtta

SEQ ID NO: 7256738 - DNA, 22 bp, Homo sapiens
acagagagaggcccgaggctgc

SEQ ID NO: 7256739 - DNA, 22 bp, Homo sapiens
acagagagaattgggtttacag

SEQ ID NO: 7256740 - DNA, 22 bp, Homo sapiens
acagagagaaacaatcagcagc

SEQ ID NO: 7256741 - DNA, 22 bp, Homo sapiens
aagctattgaatttatagcata

SEQ ID NO: 7256742 - DNA, 22 bp, Homo sapiens
aagctccccgaaacccacctct

SEQ ID NO: 7256743 - DNA, 18 bp, Homo sapiens
aagctcttaaatggttca

SEQ ID NO: 7256744 - DNA, 22 bp, Homo sapiens
aagctcttatgatatttattta

SEQ ID NO: 7256745 - DNA, 22 bp, Homo sapiens
aagcattttagtaatgaacttg

SEQ ID NO: 7256746 - DNA, 22 bp, Homo sapiens
acagccttctctattggcctca

SEQ ID NO: 7256747 - DNA, 21 bp, Homo sapiens
acagcctgtcatctcatggtc

SEQ ID NO: 7256748 - DNA, 22 bp, Homo sapiens
acagcctggcctgagttaaggc

SEQ ID NO: 7256749 - DNA, 22 bp, Homo sapiens
acagcctgtgtaccagctggga

SEQ ID NO: 7256750 - DNA, 19 bp, Homo sapiens
acagcctgttggtggggct

SEQ ID NO: 7256751 - DNA, 22 bp, Homo sapiens
acagcctgtttgatctggtgct

SEQ ID NO: 7256752 - DNA, 22 bp, Homo sapiens
aagcctttctctctgggaagga

SEQ ID NO: 7256753 - DNA, 22 bp, Homo sapiens
aagctagatgacgttatttttt

SEQ ID NO: 7256754 - DNA, 22 bp, Homo sapiens
aagctagataacttttatattt

SEQ ID NO: 7256755 - DNA, 22 bp, Homo sapiens
aagctacttttatatgcagtag

SEQ ID NO: 7256756 - DNA, 22 bp, Homo sapiens
aagctagattggcattcatttc

SEQ ID NO: 7256757 - DNA, 22 bp, Homo sapiens
aagcgcccatgcctgagagcgt

SEQ ID NO: 7256758 - DNA, 23 bp, Homo sapiens
aagcgtcttttcaatgtggctgg

SEQ ID NO: 7256759 - DNA, 22 bp, Homo sapiens
aaggagagtacaggagttggta

SEQ ID NO: 7256760 - DNA, 22 bp, Homo sapiens
aaggagagagctttgctggaac

SEQ ID NO: 7256761 - DNA, 22 bp, Homo sapiens
aaggacaggctaacctgacatt

SEQ ID NO: 7256762 - DNA, 22 bp, Homo sapiens
acagtcttgctgtatggtcagg

SEQ ID NO: 7256763 - DNA, 22 bp, Homo sapiens
aaggaggaataaagaggtggtg

SEQ ID NO: 7256764 - DNA, 22 bp, Homo sapiens
aaggcagaggaaggtctagttt

SEQ ID NO: 7256765 - DNA, 22 bp, Homo sapiens
aaggcagagattagcagaatga

SEQ ID NO: 7256766 - DNA, 22 bp, Homo sapiens
aaggcagagtctatcttggaag

SEQ ID NO: 7256767 - DNA, 22 bp, Homo sapiens
aaggcagagtctatcttggaag

SEQ ID NO: 7256768 - DNA, 22 bp, Homo sapiens
aaggcagagggctggatcagag

SEQ ID NO: 7256769 - DNA, 22 bp, Homo sapiens
acatatgagtactatacagtgc

SEQ ID NO: 7256770 - DNA, 22 bp, Homo sapiens
acatagaacttcccagtgagca

SEQ ID NO: 7256771 - DNA, 22 bp, Homo sapiens
acatatgaggtgttattctatg

SEQ ID NO: 7256772 - DNA, 22 bp, Homo sapiens
acatagaacctggcacatagta

SEQ ID NO: 7256773 - DNA, 22 bp, Homo sapiens
aaggaggcactcgctctcaggg

SEQ ID NO: 7256774 - DNA, 22 bp, Homo sapiens
aaggaggagtggggtcctggaa

SEQ ID NO: 7256775 - DNA, 22 bp, Homo sapiens
acagtgtttatgtacagattgt

SEQ ID NO: 7256776 - DNA, 22 bp, Homo sapiens
aaggaggaatttcagggtgaat

SEQ ID NO: 7256777 - DNA, 19 bp, Homo sapiens
acccagagccctttgcagg

SEQ ID NO: 7256778 - DNA, 22 bp, Homo sapiens
aaggggaaaaagtgttaggagt

SEQ ID NO: 7256779 - DNA, 22 bp, Homo sapiens
aaggggaaaaagtgttaggagt

SEQ ID NO: 7256780 - DNA, 22 bp, Homo sapiens
accaggcttgatgatttgctta

SEQ ID NO: 7256781 - DNA, 21 bp, Homo sapiens
accaggcttgtgggagggagc

SEQ ID NO: 7256782 - DNA, 22 bp, Homo sapiens
aagggctgtaagccaagtaaag

SEQ ID NO: 7256783 - DNA, 22 bp, Homo sapiens
acattttacagttgtctggcta

SEQ ID NO: 7256784 - DNA, 22 bp, Homo sapiens
acattttacaccaagacttctt

SEQ ID NO: 7256785 - DNA, 22 bp, Homo sapiens
acccagagtaacagatggattc

SEQ ID NO: 7256786 - DNA, 22 bp, Homo sapiens
acccagagctgggcttggcaaa

SEQ ID NO: 7256787 - DNA, 22 bp, Homo sapiens
acccagaggcggaggttgcagt

SEQ ID NO: 7256788 - DNA, 22 bp, Homo sapiens
acccagagtcatggcacttagc

SEQ ID NO: 7256789 - DNA, 22 bp, Homo sapiens
acccagagtcagacagccatgg

SEQ ID NO: 7256790 - DNA, 22 bp, Homo sapiens
acccagagtgtctgtctcagtc

SEQ ID NO: 7256791 - DNA, 22 bp, Homo sapiens
acccagagtcatggcacttagc

SEQ ID NO: 7256792 - DNA, 22 bp, Homo sapiens
acccaggaggcaaggttgcagt

SEQ ID NO: 7256793 - DNA, 22 bp, Homo sapiens
accctgagatgccacagcatga

SEQ ID NO: 7256794 - DNA, 22 bp, Homo sapiens
accctgccaaggatggccccga

SEQ ID NO: 7256795 - DNA, 22 bp, Homo sapiens
accctgccctctccagctcagg

SEQ ID NO: 7256796 - DNA, 20 bp, Homo sapiens
accctgccaggcatgtgaat

SEQ ID NO: 7256797 - DNA, 22 bp, Homo sapiens
accctgccgtgggctgcttgtg

SEQ ID NO: 7256798 - DNA, 22 bp, Homo sapiens
accgggaagtcctgcactgggc

SEQ ID NO: 7256799 - DNA, 22 bp, Homo sapiens
acatttctgctagaataggtga

SEQ ID NO: 7256800 - DNA, 22 bp, Homo sapiens
acatttaaatacctatgtttct

SEQ ID NO: 7256801 - DNA, 21 bp, Homo sapiens
aaggctggagatgcaggtctg

SEQ ID NO: 7256802 - DNA, 22 bp, Homo sapiens
aaggctggacctggatgaatct

SEQ ID NO: 7256803 - DNA, 22 bp, Homo sapiens
aaggcctttgggggcctggtcc

SEQ ID NO: 7256804 - DNA, 22 bp, Homo sapiens
aaggcctttcttatcagtagat

SEQ ID NO: 7256805 - DNA, 22 bp, Homo sapiens
aaggcctttctagctttgtgct

SEQ ID NO: 7256806 - DNA, 22 bp, Homo sapiens
aaggccttggctctctgtgtgc

SEQ ID NO: 7256807 - DNA, 22 bp, Homo sapiens
aaggccttctcttgtgtctgtg

SEQ ID NO: 7256808 - DNA, 22 bp, Homo sapiens
aaggcagataagaattcagcaa

SEQ ID NO: 7256809 - DNA, 20 bp, Homo sapiens
aaggcagagtgggttggagc

SEQ ID NO: 7256810 - DNA, 20 bp, Homo sapiens
aaggcagagtgggttggagc

SEQ ID NO: 7256811 - DNA, 22 bp, Homo sapiens
aatcagaaagaggtcatgttgc

SEQ ID NO: 7256812 - DNA, 22 bp, Homo sapiens
actttgaaaagacagtagctct

SEQ ID NO: 7256813 - DNA, 22 bp, Homo sapiens
actttcttctactacttggaga

SEQ ID NO: 7256814 - DNA, 22 bp, Homo sapiens
actttcttcttatgcattaagg

SEQ ID NO: 7256815 - DNA, 22 bp, Homo sapiens
actttcttaggctgtataaatg

SEQ ID NO: 7256816 - DNA, 22 bp, Homo sapiens
actgggctggttagttttacta

SEQ ID NO: 7256817 - DNA, 22 bp, Homo sapiens
actgggctggggctcattctcc

SEQ ID NO: 7256818 - DNA, 22 bp, Homo sapiens
actgggctgttccttatttcta

SEQ ID NO: 7256819 - DNA, 22 bp, Homo sapiens
agaagcagaaggaagcagggcc

SEQ ID NO: 7256820 - DNA, 22 bp, Homo sapiens
aatgatttcccctacacagaag

SEQ ID NO: 7256821 - DNA, 22 bp, Homo sapiens
agaaattctaagcatcaatagc

SEQ ID NO: 7256822 - DNA, 22 bp, Homo sapiens
agaaattattagtgaatagtct

SEQ ID NO: 7256823 - DNA, 22 bp, Homo sapiens
agaaatgacacacatgagacat

SEQ ID NO: 7256824 - DNA, 20 bp, Homo sapiens
agaacaagtactaaaggaga

SEQ ID NO: 7256825 - DNA, 22 bp, Homo sapiens
agaacaatgaggtatggatgga

SEQ ID NO: 7256826 - DNA, 23 bp, Homo sapiens
aatgagttgggcagcatacaggc

SEQ ID NO: 7256827 - DNA, 22 bp, Homo sapiens
aatcagtgtgtaaagtggctgc

SEQ ID NO: 7256828 - DNA, 22 bp, Homo sapiens
aatcagtgtggtgacttgtctg

SEQ ID NO: 7256829 - DNA, 22 bp, Homo sapiens
aatcagtggttcccagcccagg

SEQ ID NO: 7256830 - DNA, 22 bp, Homo sapiens
aatcagtgcaaaggagagggta

SEQ ID NO: 7256831 - DNA, 22 bp, Homo sapiens
aatcagtattggtatagaatga

SEQ ID NO: 7256832 - DNA, 22 bp, Homo sapiens
aatcagagcaagacatggaaca

SEQ ID NO: 7256833 - DNA, 22 bp, Homo sapiens
aatcagagaagtttcctatgcc

SEQ ID NO: 7256834 - DNA, 22 bp, Homo sapiens
aatcagagccctctgagcttca

SEQ ID NO: 7256835 - DNA, 21 bp, Homo sapiens
aatcagaggcttcctagttgg

SEQ ID NO: 7256836 - DNA, 22 bp, Homo sapiens
aatcagaggaagtcaacggatc

SEQ ID NO: 7256837 - DNA, 22 bp, Homo sapiens
aatcagagtcccaagatctgta

SEQ ID NO: 7256838 - DNA, 22 bp, Homo sapiens
aatcaggaactcaagtgcattg

SEQ ID NO: 7256839 - DNA, 22 bp, Homo sapiens
aatcagcaaatgcttactcagg

SEQ ID NO: 7256840 - DNA, 22 bp, Homo sapiens
acgtggagccacagatggagca

SEQ ID NO: 7256841 - DNA, 22 bp, Homo sapiens
acgtggagagaatagggcacca

SEQ ID NO: 7256842 - DNA, 22 bp, Homo sapiens
acgtggagagaatagggcacca

SEQ ID NO: 7256843 - DNA, 22 bp, Homo sapiens
acgtggagagaatagggcacca

SEQ ID NO: 7256844 - DNA, 22 bp, Homo sapiens
acctttatgattcacaatgtat

SEQ ID NO: 7256845 - DNA, 22 bp, Homo sapiens
acgtgcaggatctggttggcga

SEQ ID NO: 7256846 - DNA, 22 bp, Homo sapiens
acgtagcactgagagatgcagg

SEQ ID NO: 7256847 - DNA, 22 bp, Homo sapiens
acctagaaactgacagaatatt

SEQ ID NO: 7256848 - DNA, 22 bp, Homo sapiens
actacagaagtcttattagaga

SEQ ID NO: 7256849 - DNA, 22 bp, Homo sapiens
actcaccacagagcagggaacc

SEQ ID NO: 7256850 - DNA, 22 bp, Homo sapiens
actcactcttaatcagactccc

SEQ ID NO: 7256851 - DNA, 22 bp, Homo sapiens
actctccacccactcactctgt

SEQ ID NO: 7256852 - DNA, 22 bp, Homo sapiens
actctcagggctccagggaaag

SEQ ID NO: 7256853 - DNA, 22 bp, Homo sapiens
actctcagagggtggcagcaat

SEQ ID NO: 7256854 - DNA, 22 bp, Homo sapiens
actcagagaaacagcagggtgt

SEQ ID NO: 7256855 - DNA, 22 bp, Homo sapiens
actcagagaatatctagaagga

SEQ ID NO: 7256856 - DNA, 22 bp, Homo sapiens
actgagtatcacttcttatttt

SEQ ID NO: 7256857 - DNA, 22 bp, Homo sapiens
actgaggtagggcacacctagg

SEQ ID NO: 7256858 - DNA, 22 bp, Homo sapiens
actctgcttccacttttgctaa

SEQ ID NO: 7256859 - DNA, 22 bp, Homo sapiens
actgcgggaacccgcggccggc

SEQ ID NO: 7256860 - DNA, 22 bp, Homo sapiens
actggactccccaagggccagg

SEQ ID NO: 7256861 - DNA, 22 bp, Homo sapiens
actggagtagatctgactgagt

SEQ ID NO: 7256862 - DNA, 22 bp, Homo sapiens
actggaggggaaaatggtagta

SEQ ID NO: 7256863 - DNA, 22 bp, Homo sapiens
actggaggcccctcccagtgaa

SEQ ID NO: 7256864 - DNA, 22 bp, Homo sapiens
actggaggcccctcccagtgaa

SEQ ID NO: 7256865 - DNA, 22 bp, Homo sapiens
actggaggattcctggaaggcg

SEQ ID NO: 7256866 - DNA, 19 bp, Homo sapiens
actggagcctgatggagga

SEQ ID NO: 7256867 - DNA, 22 bp, Homo sapiens
actggctgaaagtaaagaacac

SEQ ID NO: 7256868 - DNA, 22 bp, Homo sapiens
actggccaggcagcagtagctt

SEQ ID NO: 7256869 - DNA, 22 bp, Homo sapiens
actggccaggcacagctgtggg

SEQ ID NO: 7256870 - DNA, 22 bp, Homo sapiens
actggccagaactaagtcacat

SEQ ID NO: 7256871 - DNA, 22 bp, Homo sapiens
aatacagaggaaacatttaata

SEQ ID NO: 7256872 - DNA, 20 bp, Homo sapiens
gtgaccagaagacagtgggt

SEQ ID NO: 7256873 - DNA, 22 bp, Homo sapiens
gtgaccagcccatagagaggcg

SEQ ID NO: 7256874 - DNA, 22 bp, Homo sapiens
gtgaccagttggcaggggtggg

SEQ ID NO: 7256875 - DNA, 22 bp, Homo sapiens
gtgcctggaatgcgcctcggcg

SEQ ID NO: 7256876 - DNA, 22 bp, Homo sapiens
gtgacaaatgcaaattgggctg

SEQ ID NO: 7256877 - DNA, 22 bp, Homo sapiens
gtgacaaaggtcaagcttttga

SEQ ID NO: 7256878 - DNA, 22 bp, Homo sapiens
gtgacaaaaacactgattattt

SEQ ID NO: 7256879 - DNA, 22 bp, Homo sapiens
gtgacagatttgctgcgcatgg

SEQ ID NO: 7256880 - DNA, 22 bp, Homo sapiens
gtgacagattatagggagcgtt

SEQ ID NO: 7256881 - DNA, 22 bp, Homo sapiens
gtgacagagttttagatctcat

SEQ ID NO: 7256882 - DNA, 22 bp, Homo sapiens
gtggaacagtattttaaaagct

SEQ ID NO: 7256883 - DNA, 22 bp, Homo sapiens
gtggaacagaactgtttattga

SEQ ID NO: 7256884 - DNA, 16 bp, Homo sapiens
gtggaacacattttgg

SEQ ID NO: 7256885 - DNA, 22 bp, Homo sapiens
gtggaaattttaggatcatctt

SEQ ID NO: 7256886 - DNA, 22 bp, Homo sapiens
gtggaaatgcccccaaatagtg

SEQ ID NO: 7256887 - DNA, 22 bp, Homo sapiens
gtggaaagaacacaaaattagg

SEQ ID NO: 7256888 - DNA, 22 bp, Homo sapiens
gtggaaatagtttggttataga

SEQ ID NO: 7256889 - DNA, 22 bp, Homo sapiens
gtgctaggattacaggcatggg

SEQ ID NO: 7256890 - DNA, 22 bp, Homo sapiens
gtggaaggtgaaggagcagcga

SEQ ID NO: 7256891 - DNA, 22 bp, Homo sapiens
gtggaaggtgaaggagcagcga

SEQ ID NO: 7256892 - DNA, 22 bp, Homo sapiens
gtgcctggcatgcgccggtgct

SEQ ID NO: 7256893 - DNA, 22 bp, Homo sapiens
gtgcgggggttcccagcagccg

SEQ ID NO: 7256894 - DNA, 22 bp, Homo sapiens
gtgcgggggttcccagcagccg

SEQ ID NO: 7256895 - DNA, 22 bp, Homo sapiens
gtgcgcaccctcccggcatccc

SEQ ID NO: 7256896 - DNA, 22 bp, Homo sapiens
gtggatggattgaggcagtggg

SEQ ID NO: 7256897 - DNA, 22 bp, Homo sapiens
gtggatggagctggaagccatt

SEQ ID NO: 7256898 - DNA, 22 bp, Homo sapiens
gtggatggctagttgagaaggg

SEQ ID NO: 7256899 - DNA, 22 bp, Homo sapiens
gtggcacagtgggagagcccca

SEQ ID NO: 7256900 - DNA, 22 bp, Homo sapiens
gtggcagagccaaggctggagc

SEQ ID NO: 7256901 - DNA, 22 bp, Homo sapiens
gtggacagagataataaactga

SEQ ID NO: 7256902 - DNA, 22 bp, Homo sapiens
gtggacactggcagcagctcag

SEQ ID NO: 7256903 - DNA, 22 bp, Homo sapiens
gtggacagacataatcctaatt

SEQ ID NO: 7256904 - DNA, 22 bp, Homo sapiens
gtggacaggcaggctgtcgggg

SEQ ID NO: 7256905 - DNA, 22 bp, Homo sapiens
gtggacttgagatggaccgagg

SEQ ID NO: 7256906 - DNA, 22 bp, Homo sapiens
gtggaggaaaagaagttgggtg

SEQ ID NO: 7256907 - DNA, 22 bp, Homo sapiens
gtggaggaaaagaagttgggtg

SEQ ID NO: 7256908 - DNA, 22 bp, Homo sapiens
gtggagctggacccaggcctct

SEQ ID NO: 7256909 - DNA, 22 bp, Homo sapiens
gtggagctggacccaggcctct

SEQ ID NO: 7256910 - DNA, 19 bp, Homo sapiens
gtggagctaagaaaaggaa

SEQ ID NO: 7256911 - DNA, 22 bp, Homo sapiens
gtggaggaaaagaagttgggtg

SEQ ID NO: 7256912 - DNA, 22 bp, Homo sapiens
gtggaggaagggattcagacca

SEQ ID NO: 7256913 - DNA, 22 bp, Homo sapiens
gtggaggacaaaagaagccttt

SEQ ID NO: 7256914 - DNA, 22 bp, Homo sapiens
gtggagggaatgaatcttctct

SEQ ID NO: 7256915 - DNA, 22 bp, Homo sapiens
gtggagggaatgaatcttctct

SEQ ID NO: 7256916 - DNA, 22 bp, Homo sapiens
gtggagggtgagctcatgtttg

SEQ ID NO: 7256917 - DNA, 22 bp, Homo sapiens
gtggaggagaggcgccttgcgg

SEQ ID NO: 7256918 - DNA, 18 bp, Homo sapiens
gtggagggttctcagaat

SEQ ID NO: 7256919 - DNA, 22 bp, Homo sapiens
gtggagggtttgcaatgtgcag

SEQ ID NO: 7256920 - DNA, 22 bp, Homo sapiens
gtggagggtgattgccggctgt

SEQ ID NO: 7256921 - DNA, 22 bp, Homo sapiens
gtggagggtgattgccggctgt

SEQ ID NO: 7256922 - DNA, 22 bp, Homo sapiens
gtggagggtgagctcatgtttg

SEQ ID NO: 7256923 - DNA, 22 bp, Homo sapiens
gtggatctaaagaaggagggtg

SEQ ID NO: 7256924 - DNA, 22 bp, Homo sapiens
gtggagtggtgatggataggtt

SEQ ID NO: 7256925 - DNA, 22 bp, Homo sapiens
gtggagtggtgatggataggtt

SEQ ID NO: 7256926 - DNA, 22 bp, Homo sapiens
gtggaggtcccgggcaggagca

SEQ ID NO: 7256927 - DNA, 22 bp, Homo sapiens
gtggagggtttgcaatgtgcag

SEQ ID NO: 7256928 - DNA, 22 bp, Homo sapiens
gtggaggtcccgggcaggagca

SEQ ID NO: 7256929 - DNA, 22 bp, Homo sapiens
gtggctgcagagccagcaagct

SEQ ID NO: 7256930 - DNA, 22 bp, Homo sapiens
gtggctgcagagccagcaagct

SEQ ID NO: 7256931 - DNA, 17 bp, Homo sapiens
gtggctgcacacacatg

SEQ ID NO: 7256932 - DNA, 22 bp, Homo sapiens
gtggctgggctccgagcggctt

SEQ ID NO: 7256933 - DNA, 22 bp, Homo sapiens
gtggctggtttcctgcatgcaa

SEQ ID NO: 7256934 - DNA, 22 bp, Homo sapiens
gtggctgcatcggggtgaccag

SEQ ID NO: 7256935 - DNA, 22 bp, Homo sapiens
gtggctgcagagggcacagcat

SEQ ID NO: 7256936 - DNA, 22 bp, Homo sapiens
gtggctgcagcccagcggcacg

SEQ ID NO: 7256937 - DNA, 22 bp, Homo sapiens
gtggctgcagagggcacagcat

SEQ ID NO: 7256938 - DNA, 22 bp, Homo sapiens
gtggctgctacagagctggagg

SEQ ID NO: 7256939 - DNA, 22 bp, Homo sapiens
gtggctgctcgggctccggccc

SEQ ID NO: 7256940 - DNA, 22 bp, Homo sapiens
gtgggatgcagtggtgagtggc

SEQ ID NO: 7256941 - DNA, 22 bp, Homo sapiens
gtgggagtttgaacttcatgtt

SEQ ID NO: 7256942 - DNA, 22 bp, Homo sapiens
gtggcaggatcacggctcactg

SEQ ID NO: 7256943 - DNA, 20 bp, Homo sapiens
gtggcaggcagtgaaggagc

SEQ ID NO: 7256944 - DNA, 22 bp, Homo sapiens
gtggcaggagagacacagccat

SEQ ID NO: 7256945 - DNA, 22 bp, Homo sapiens
gtggcaggatcacggctcactg

SEQ ID NO: 7256946 - DNA, 22 bp, Homo sapiens
gtggcagggtgctcatcatgca

SEQ ID NO: 7256947 - DNA, 22 bp, Homo sapiens
gtggccagccccatggacagtt

SEQ ID NO: 7256948 - DNA, 22 bp, Homo sapiens
gtggccagccagggtgctgatg

SEQ ID NO: 7256949 - DNA, 22 bp, Homo sapiens
gtggccagcaagtgctgcctct

SEQ ID NO: 7256950 - DNA, 22 bp, Homo sapiens
gtggccagaggtcccatgtgtc

SEQ ID NO: 7256951 - DNA, 22 bp, Homo sapiens
gtggccagaatcttgaggcctt

SEQ ID NO: 7256952 - DNA, 22 bp, Homo sapiens
gtggccagaagttaagtggtta

SEQ ID NO: 7256953 - DNA, 22 bp, Homo sapiens
gtggccagaagactgcaatgct

SEQ ID NO: 7256954 - DNA, 22 bp, Homo sapiens
gtggccagaaccaggagaatga

SEQ ID NO: 7256955 - DNA, 22 bp, Homo sapiens
gtggccaggagagggtgggaca

SEQ ID NO: 7256956 - DNA, 22 bp, Homo sapiens
gtggccagctgtcagcaccctt

SEQ ID NO: 7256957 - DNA, 22 bp, Homo sapiens
gtggccaggacattgccaggca

SEQ ID NO: 7256958 - DNA, 22 bp, Homo sapiens
gtggcccaggctggagtgcagt

SEQ ID NO: 7256959 - DNA, 22 bp, Homo sapiens
gtggcccaggcttggcgctggc

SEQ ID NO: 7256960 - DNA, 22 bp, Homo sapiens
gtggcccaggttggagtgcagt

SEQ ID NO: 7256961 - DNA, 22 bp, Homo sapiens
ggtgcaggagcggggtgctcgg

SEQ ID NO: 7256962 - DNA, 22 bp, Homo sapiens
ggtgcaggcggtggggcaagta

SEQ ID NO: 7256963 - DNA, 22 bp, Homo sapiens
ggtggcagaggtgcatcagccc

SEQ ID NO: 7256964 - DNA, 22 bp, Homo sapiens
ggtggcagagaggaggtagttt

SEQ ID NO: 7256965 - DNA, 22 bp, Homo sapiens
ggtggcagaggtgcatcagccc

SEQ ID NO: 7256966 - DNA, 22 bp, Homo sapiens
ggtgatccaccagcctcggcct

SEQ ID NO: 7256967 - DNA, 22 bp, Homo sapiens
ggtgcaggaaaattacctggag

SEQ ID NO: 7256968 - DNA, 22 bp, Homo sapiens
gggtggggttcaggaatcttca

SEQ ID NO: 7256969 - DNA, 22 bp, Homo sapiens
gggtgggcctgtctggccatgt

SEQ ID NO: 7256970 - DNA, 22 bp, Homo sapiens
gggtggggcccaggaaatctat

SEQ ID NO: 7256971 - DNA, 22 bp, Homo sapiens
ggtgaggggcgcctctgcccag

SEQ ID NO: 7256972 - DNA, 22 bp, Homo sapiens
ggtgaggggcacctctgcccgg

SEQ ID NO: 7256973 - DNA, 22 bp, Homo sapiens
ggtgaggggagagtgaaagaaa

SEQ ID NO: 7256974 - DNA, 22 bp, Homo sapiens
ggtgaggggctcctctgcccgg

SEQ ID NO: 7256975 - DNA, 22 bp, Homo sapiens
ggtgaggggcgcctctgcccgg

SEQ ID NO: 7256976 - DNA, 22 bp, Homo sapiens
ggtgagggtaaactaaaacatc

SEQ ID NO: 7256977 - DNA, 22 bp, Homo sapiens
ggtgagggtaaatataggcaaa

SEQ ID NO: 7256978 - DNA, 22 bp, Homo sapiens
ggtgtcagcctgggagcctagc

SEQ ID NO: 7256979 - DNA, 22 bp, Homo sapiens
ggtgtcagtctgggatgagact

SEQ ID NO: 7256980 - DNA, 20 bp, Homo sapiens
ggtgtcagggccatgcctgg

SEQ ID NO: 7256981 - DNA, 22 bp, Homo sapiens
ggtgtcagtgaaggtagagttt

SEQ ID NO: 7256982 - DNA, 22 bp, Homo sapiens
ggtgtcagtgagagcacagtac

SEQ ID NO: 7256983 - DNA, 22 bp, Homo sapiens
ggtggtgtttggaaggaggtgc

SEQ ID NO: 7256984 - DNA, 22 bp, Homo sapiens
ggtggccataggaccagcctgg

SEQ ID NO: 7256985 - DNA, 22 bp, Homo sapiens
ggtgtcctcatgattttctaga

SEQ ID NO: 7256986 - DNA, 22 bp, Homo sapiens
gtaaactatgggctttggagga

SEQ ID NO: 7256987 - DNA, 22 bp, Homo sapiens
gtaaagctccttggccagtgcc

SEQ ID NO: 7256988 - DNA, 22 bp, Homo sapiens
gtaaagctctcatttaatatca

SEQ ID NO: 7256989 - DNA, 22 bp, Homo sapiens
gtaaataactggtaattggggt

SEQ ID NO: 7256990 - DNA, 22 bp, Homo sapiens
gtaaagtctggctgaaacatgc

SEQ ID NO: 7256991 - DNA, 22 bp, Homo sapiens
gtaaagtcctacatatgtcagg

SEQ ID NO: 7256992 - DNA, 22 bp, Homo sapiens
gtaaagaagtttttgaatgcat

SEQ ID NO: 7256993 - DNA, 22 bp, Homo sapiens
gtaaataactggtaattggggt

SEQ ID NO: 7256994 - DNA, 22 bp, Homo sapiens
gtacagaaggatttctagtagt

SEQ ID NO: 7256995 - DNA, 22 bp, Homo sapiens
gtatagaaacccagaaagatag

SEQ ID NO: 7256996 - DNA, 22 bp, Homo sapiens
gtatagaacctcatcatgccca

SEQ ID NO: 7256997 - DNA, 22 bp, Homo sapiens
gtatagaacttttggaggctgc

SEQ ID NO: 7256998 - DNA, 22 bp, Homo sapiens
gtatagaagctttgctctctct

SEQ ID NO: 7256999 - DNA, 20 bp, Homo sapiens
gtatataaccatagtgacta

SEQ ID NO: 7257000 - DNA, 22 bp, Homo sapiens
gtacatattataaaatacagct

SEQ ID NO: 7257001 - DNA, 22 bp, Homo sapiens
gtacatattacagacaaagctt

SEQ ID NO: 7257002 - DNA, 22 bp, Homo sapiens
gtacatatggcacatgctattt

SEQ ID NO: 7257003 - DNA, 22 bp, Homo sapiens
gtacagtagtaaaagtgaatga

SEQ ID NO: 7257004 - DNA, 22 bp, Homo sapiens
gtccagggaaatagcgacaggg

SEQ ID NO: 7257005 - DNA, 22 bp, Homo sapiens
gtcaggccctggcagccgtgac

SEQ ID NO: 7257006 - DNA, 22 bp, Homo sapiens
gtcaggccaatactctccagca

SEQ ID NO: 7257007 - DNA, 22 bp, Homo sapiens
gtccagggccccgagcaccagg

SEQ ID NO: 7257008 - DNA, 22 bp, Homo sapiens
gtcccataagtagtgcaacttg

SEQ ID NO: 7257009 - DNA, 22 bp, Homo sapiens
gtcctgggtccccgcaggtcag

SEQ ID NO: 7257010 - DNA, 22 bp, Homo sapiens
gtctggagtggtggatttaaag

SEQ ID NO: 7257011 - DNA, 20 bp, Homo sapiens
gtctgcagtaagagggaata

SEQ ID NO: 7257012 - DNA, 22 bp, Homo sapiens
gtctgggcaagggagatggcgc

SEQ ID NO: 7257013 - DNA, 22 bp, Homo sapiens
gtctgggcttagggacatggca

SEQ ID NO: 7257014 - DNA, 22 bp, Homo sapiens
gtctgggctcctggcaggcagc

SEQ ID NO: 7257015 - DNA, 22 bp, Homo sapiens
gtctgggctcccagggtcggcg

SEQ ID NO: 7257016 - DNA, 22 bp, Homo sapiens
gtctgggccaggcgagccgagg

SEQ ID NO: 7257017 - DNA, 22 bp, Homo sapiens
gtctgggggtccgggtgcctgc

SEQ ID NO: 7257018 - DNA, 22 bp, Homo sapiens
gtctggggcagcaaggcgcgcg

SEQ ID NO: 7257019 - DNA, 22 bp, Homo sapiens
gtctgggggtccgggtgcctgc

SEQ ID NO: 7257020 - DNA, 22 bp, Homo sapiens
gtctggggaagtcagggcatca

SEQ ID NO: 7257021 - DNA, 22 bp, Homo sapiens
gtcctttttgtaaaatattcat

SEQ ID NO: 7257022 - DNA, 22 bp, Homo sapiens
gtccttggaaagtctaatctct

SEQ ID NO: 7257023 - DNA, 22 bp, Homo sapiens
gtctgacacctagagtccagga

SEQ ID NO: 7257024 - DNA, 19 bp, Homo sapiens
gtctctgctccagggtctc

SEQ ID NO: 7257025 - DNA, 22 bp, Homo sapiens
gttattttcattggctcagact

SEQ ID NO: 7257026 - DNA, 22 bp, Homo sapiens
gttcaaggaagggaggaaagcc

SEQ ID NO: 7257027 - DNA, 18 bp, Homo sapiens
gttcaaggtcaagagaga

SEQ ID NO: 7257028 - DNA, 22 bp, Homo sapiens
gttcaaggttttacagagtgta

SEQ ID NO: 7257029 - DNA, 22 bp, Homo sapiens
gttctcagcgtgggaggcagag

SEQ ID NO: 7257030 - DNA, 22 bp, Homo sapiens
gtgtctataatgaaatgcactt

SEQ ID NO: 7257031 - DNA, 22 bp, Homo sapiens
gtgtccttttatgtgactggtt

SEQ ID NO: 7257032 - DNA, 22 bp, Homo sapiens
gtgtggggctcagtgggaatgt

SEQ ID NO: 7257033 - DNA, 22 bp, Homo sapiens
gtgtgcagtctgctaggcaggg

SEQ ID NO: 7257034 - DNA, 22 bp, Homo sapiens
gtgtgggcagggccgtgctccc

SEQ ID NO: 7257035 - DNA, 22 bp, Homo sapiens
gtgtgggctatgtgcgtgggca

SEQ ID NO: 7257036 - DNA, 18 bp, Homo sapiens
gtgtgggctcctccgagt

SEQ ID NO: 7257037 - DNA, 22 bp, Homo sapiens
gtgtgggctgcagaggcacagc

SEQ ID NO: 7257038 - DNA, 22 bp, Homo sapiens
gtgtggggtcttctcttggcct

SEQ ID NO: 7257039 - DNA, 22 bp, Homo sapiens
gtgtgcaggtgtcagtgcagct

SEQ ID NO: 7257040 - DNA, 22 bp, Homo sapiens
gtgtgcagggggccagcgcagc

SEQ ID NO: 7257041 - DNA, 22 bp, Homo sapiens
gtgtgcaggccacaggccaggg

SEQ ID NO: 7257042 - DNA, 22 bp, Homo sapiens
gtgtgcagggctgcctgtgccg

SEQ ID NO: 7257043 - DNA, 22 bp, Homo sapiens
gtgtgcagggatgagtgcaggt

SEQ ID NO: 7257044 - DNA, 22 bp, Homo sapiens
gtgtgcagcagagacaggactc

SEQ ID NO: 7257045 - DNA, 22 bp, Homo sapiens
gtgtgagggcaacacagcaaac

SEQ ID NO: 7257046 - DNA, 18 bp, Homo sapiens
gtggggtgttgtgaggat

SEQ ID NO: 7257047 - DNA, 22 bp, Homo sapiens
gtgggtgcggggagccgaggcg

SEQ ID NO: 7257048 - DNA, 22 bp, Homo sapiens
gtggggtgtccagcagcgagct

SEQ ID NO: 7257049 - DNA, 22 bp, Homo sapiens
gtggggtgtccagcagcgagct

SEQ ID NO: 7257050 - DNA, 18 bp, Homo sapiens
gtggggtgttgtgaggat

SEQ ID NO: 7257051 - DNA, 22 bp, Homo sapiens
gtggggtgtccagcagcgagct

SEQ ID NO: 7257052 - DNA, 22 bp, Homo sapiens
gtggggtgggctgagttaggcc

SEQ ID NO: 7257053 - DNA, 22 bp, Homo sapiens
gtggggtgggctgagttaggcc

SEQ ID NO: 7257054 - DNA, 22 bp, Homo sapiens
gtggggtgcagcagtactgtgt

SEQ ID NO: 7257055 - DNA, 22 bp, Homo sapiens
gtgggggctggctcgtcctgtg

SEQ ID NO: 7257056 - DNA, 22 bp, Homo sapiens
gtgggggctggctcgtcctgtg

SEQ ID NO: 7257057 - DNA, 22 bp, Homo sapiens
gtggggggagctgcaagctgga

SEQ ID NO: 7257058 - DNA, 22 bp, Homo sapiens
gtgggggtttcattaagacaat

SEQ ID NO: 7257059 - DNA, 22 bp, Homo sapiens
gtgggggtggaaaggcaagttg

SEQ ID NO: 7257060 - DNA, 22 bp, Homo sapiens
gtggtgcaggaagcatctggct

SEQ ID NO: 7257061 - DNA, 22 bp, Homo sapiens
gtggtgtttttggggcagagga

SEQ ID NO: 7257062 - DNA, 22 bp, Homo sapiens
gtggtgtttgccagttaataac

SEQ ID NO: 7257063 - DNA, 22 bp, Homo sapiens
gtggtgaagccccatctctgct

SEQ ID NO: 7257064 - DNA, 22 bp, Homo sapiens
gtgggccaggacccgctgtccg

SEQ ID NO: 7257065 - DNA, 22 bp, Homo sapiens
gtgggcagttggtgattctcgt

SEQ ID NO: 7257066 - DNA, 22 bp, Homo sapiens
gtgggcagttcaattctgggag

SEQ ID NO: 7257067 - DNA, 22 bp, Homo sapiens
gtgggcaggaggccctgccctg

SEQ ID NO: 7257068 - DNA, 22 bp, Homo sapiens
gtgggcagtggtttgcgcggtc

SEQ ID NO: 7257069 - DNA, 22 bp, Homo sapiens
gtgggcagtgtgtcagtatctt

SEQ ID NO: 7257070 - DNA, 22 bp, Homo sapiens
gtgggcagcctgtccggagacc

SEQ ID NO: 7257071 - DNA, 22 bp, Homo sapiens
gtgggcagcctcctttattttc

SEQ ID NO: 7257072 - DNA, 22 bp, Homo sapiens
gtgggcagccccttcaaggcca

SEQ ID NO: 7257073 - DNA, 20 bp, Homo sapiens
gtgggcagcaggcatactgg

SEQ ID NO: 7257074 - DNA, 22 bp, Homo sapiens
gtgggcagattatagatgatgc

SEQ ID NO: 7257075 - DNA, 22 bp, Homo sapiens
gtgggcagcaccagggaagtgt

SEQ ID NO: 7257076 - DNA, 20 bp, Homo sapiens
gtgggcagatgtgtgcatgg

SEQ ID NO: 7257077 - DNA, 22 bp, Homo sapiens
gtgggcagatacatttgatatg

SEQ ID NO: 7257078 - DNA, 22 bp, Homo sapiens
gtgggcagaggagagaacatta

SEQ ID NO: 7257079 - DNA, 22 bp, Homo sapiens
gtgggcagattaatttctcaat

SEQ ID NO: 7257080 - DNA, 22 bp, Homo sapiens
gtgggcagagcaagggaactca

SEQ ID NO: 7257081 - DNA, 22 bp, Homo sapiens
gtgggcagacatgatagaagga

SEQ ID NO: 7257082 - DNA, 22 bp, Homo sapiens
gtgggcagagcaagggaactca

SEQ ID NO: 7257083 - DNA, 20 bp, Homo sapiens
gtgggcagagcaccacctgg

SEQ ID NO: 7257084 - DNA, 22 bp, Homo sapiens
gtgggcagacagtgctttgcag

SEQ ID NO: 7257085 - DNA, 22 bp, Homo sapiens
gtgggcagaacatttgtaggct

SEQ ID NO: 7257086 - DNA, 22 bp, Homo sapiens
gtgggcagaattgaatctttaa

SEQ ID NO: 7257087 - DNA, 22 bp, Homo sapiens
gtgggcagacagtgctttgcag

SEQ ID NO: 7257088 - DNA, 22 bp, Homo sapiens
gtggggaaaggagtggggctca

SEQ ID NO: 7257089 - DNA, 22 bp, Homo sapiens
gtggggaaaggagtggggctca

SEQ ID NO: 7257090 - DNA, 22 bp, Homo sapiens
gtggggaaaggagtggggctca

SEQ ID NO: 7257091 - DNA, 22 bp, Homo sapiens
gtgggcttttgacagtgcctgg

SEQ ID NO: 7257092 - DNA, 22 bp, Homo sapiens
gtggggaggcctaagcaagttg

SEQ ID NO: 7257093 - DNA, 22 bp, Homo sapiens
gtgggggatgctgagttggaaa

SEQ ID NO: 7257094 - DNA, 22 bp, Homo sapiens
gtgggggcagtgggcttcgagc

SEQ ID NO: 7257095 - DNA, 22 bp, Homo sapiens
gtggggcttcctggggcaagtt

SEQ ID NO: 7257096 - DNA, 22 bp, Homo sapiens
gtgggccaggcgtctaggccct

SEQ ID NO: 7257097 - DNA, 22 bp, Homo sapiens
gtgggctcaggcctctgtgggg

SEQ ID NO: 7257098 - DNA, 22 bp, Homo sapiens
gtgggcgatcatctcagccgtc

SEQ ID NO: 7257099 - DNA, 22 bp, Homo sapiens
gtgggctcccctggcatgtcca

SEQ ID NO: 7257100 - DNA, 22 bp, Homo sapiens
gtgggctgcccttgaggtcagc

SEQ ID NO: 7257101 - DNA, 22 bp, Homo sapiens
gtgggctgcttcctccttccac

SEQ ID NO: 7257102 - DNA, 22 bp, Homo sapiens
gtgggctggatttgcttgcaga

SEQ ID NO: 7257103 - DNA, 22 bp, Homo sapiens
gtgggctggaccctcctgctcc

SEQ ID NO: 7257104 - DNA, 22 bp, Homo sapiens
taaaacacataaactctctatt

SEQ ID NO: 7257105 - DNA, 22 bp, Homo sapiens
gtttaataatgttgaattacta

SEQ ID NO: 7257106 - DNA, 22 bp, Homo sapiens
gtttaagaaaattcatgttgtt

SEQ ID NO: 7257107 - DNA, 19 bp, Homo sapiens
gttgtttttcttattatgg

SEQ ID NO: 7257108 - DNA, 22 bp, Homo sapiens
taaaaccattcctgctttcatg

SEQ ID NO: 7257109 - DNA, 22 bp, Homo sapiens
taaaaccataaggctggaagga

SEQ ID NO: 7257110 - DNA, 22 bp, Homo sapiens
taaaacagcagggcagagaagt

SEQ ID NO: 7257111 - DNA, 21 bp, Homo sapiens
taaagctcgttcaggaaagtc

SEQ ID NO: 7257112 - DNA, 22 bp, Homo sapiens
taaagctatgcttaatttatca

SEQ ID NO: 7257113 - DNA, 22 bp, Homo sapiens
taaagctctagtgttttggata

SEQ ID NO: 7257114 - DNA, 22 bp, Homo sapiens
taaagctctgggtttctagatc

SEQ ID NO: 7257115 - DNA, 22 bp, Homo sapiens
taaagctgttcagtgcagaaag

SEQ ID NO: 7257116 - DNA, 22 bp, Homo sapiens
taaaggattttgtataatataa

SEQ ID NO: 7257117 - DNA, 22 bp, Homo sapiens
taacactgtccaaagaattcca

SEQ ID NO: 7257118 - DNA, 22 bp, Homo sapiens
taacactgtggtgttctttgtc

SEQ ID NO: 7257119 - DNA, 22 bp, Homo sapiens
taacagaatagcagaaacagaa

SEQ ID NO: 7257120 - DNA, 22 bp, Homo sapiens
taacagaatagcagaaacagaa

SEQ ID NO: 7257121 - DNA, 22 bp, Homo sapiens
taacactggcttttgctgaggc

SEQ ID NO: 7257122 - DNA, 22 bp, Homo sapiens
taacactggagagttggttgtg

SEQ ID NO: 7257123 - DNA, 22 bp, Homo sapiens
taacactgatttgttctcaggg

SEQ ID NO: 7257124 - DNA, 22 bp, Homo sapiens
taacactgcttcattttggaga

SEQ ID NO: 7257125 - DNA, 22 bp, Homo sapiens
taaatctcactgggtatattgg

SEQ ID NO: 7257126 - DNA, 22 bp, Homo sapiens
taaatctcaataaagtctgtgg

SEQ ID NO: 7257127 - DNA, 22 bp, Homo sapiens
taaatcagtagatatggtatag

SEQ ID NO: 7257128 - DNA, 20 bp, Homo sapiens
ggcaggtgctcgcttggtct

SEQ ID NO: 7257129 - DNA, 20 bp, Homo sapiens
ggcaggtgctgtcccctcct

SEQ ID NO: 7257130 - DNA, 22 bp, Homo sapiens
ggcaggtgcttgtcgaaggcct

SEQ ID NO: 7257131 - DNA, 22 bp, Homo sapiens
ggcaggtggaaggtctccattc

SEQ ID NO: 7257132 - DNA, 17 bp, Homo sapiens
ggccagaggcggggctg

SEQ ID NO: 7257133 - DNA, 22 bp, Homo sapiens
ggccagaggccatcctcctgct

SEQ ID NO: 7257134 - DNA, 17 bp, Homo sapiens
ggccagaggcggggctg

SEQ ID NO: 7257135 - DNA, 18 bp, Homo sapiens
ggccagagggagggtccc

SEQ ID NO: 7257136 - DNA, 22 bp, Homo sapiens
ggcccagccggcgagtctcgcg

SEQ ID NO: 7257137 - DNA, 22 bp, Homo sapiens
ggcccagcccgagtcagccttc

SEQ ID NO: 7257138 - DNA, 22 bp, Homo sapiens
ggcccacatggaagcatcgagg

SEQ ID NO: 7257139 - DNA, 22 bp, Homo sapiens
ggcccacatggaagcatcgagg

SEQ ID NO: 7257140 - DNA, 22 bp, Homo sapiens
ggcccacactgacagctgagct

SEQ ID NO: 7257141 - DNA, 22 bp, Homo sapiens
ggcccaaggcccaggtcgagct

SEQ ID NO: 7257142 - DNA, 19 bp, Homo sapiens
ggcccaagtactgagtgcc

SEQ ID NO: 7257143 - DNA, 20 bp, Homo sapiens
ggccatgggttgcctgaggt

SEQ ID NO: 7257144 - DNA, 22 bp, Homo sapiens
ggccatggtcatgggtgagctt

SEQ ID NO: 7257145 - DNA, 22 bp, Homo sapiens
ggccccagattctgggctgggt

SEQ ID NO: 7257146 - DNA, 22 bp, Homo sapiens
ggccccaggtctgaacacgctg

SEQ ID NO: 7257147 - DNA, 22 bp, Homo sapiens
ggccccagcagaccctcctctg

SEQ ID NO: 7257148 - DNA, 22 bp, Homo sapiens
ggcccagcctcagacatgccct

SEQ ID NO: 7257149 - DNA, 22 bp, Homo sapiens
ggcccagccggcgagtctcgcg

SEQ ID NO: 7257150 - DNA, 22 bp, Homo sapiens
ggcccagcctggcaacaatgac

SEQ ID NO: 7257151 - DNA, 22 bp, Homo sapiens
ggcccagcctcagacatgccct

SEQ ID NO: 7257152 - DNA, 22 bp, Homo sapiens
ggcccagccttggggtttcttt

SEQ ID NO: 7257153 - DNA, 22 bp, Homo sapiens
ggcccagcgaggccacctacag

SEQ ID NO: 7257154 - DNA, 22 bp, Homo sapiens
ggccccagttcactcctggccg

SEQ ID NO: 7257155 - DNA, 21 bp, Homo sapiens
ggccccgcagacccagcacgt

SEQ ID NO: 7257156 - DNA, 22 bp, Homo sapiens
ggcccctcagcatctgagtcag

SEQ ID NO: 7257157 - DNA, 22 bp, Homo sapiens
ggctcaggtttccttcccagct

SEQ ID NO: 7257158 - DNA, 22 bp, Homo sapiens
ggctcaggtttccttcccagct

SEQ ID NO: 7257159 - DNA, 21 bp, Homo sapiens
ggctcctgctttgtgaggggc

SEQ ID NO: 7257160 - DNA, 22 bp, Homo sapiens
ggctcagcttggtgcgcagaaa

SEQ ID NO: 7257161 - DNA, 22 bp, Homo sapiens
ggctcagcttatctgggcaggc

SEQ ID NO: 7257162 - DNA, 22 bp, Homo sapiens
ggctcaggatgagccttctcat

SEQ ID NO: 7257163 - DNA, 22 bp, Homo sapiens
ggctcaggactgcagcgtagag

SEQ ID NO: 7257164 - DNA, 18 bp, Homo sapiens
ggctcagcaggctctctc

SEQ ID NO: 7257165 - DNA, 22 bp, Homo sapiens
ggctcagcacagggctggcatc

SEQ ID NO: 7257166 - DNA, 22 bp, Homo sapiens
ggctcagccccgtaacacagca

SEQ ID NO: 7257167 - DNA, 22 bp, Homo sapiens
ggctcagcgcgctgggagggag

SEQ ID NO: 7257168 - DNA, 22 bp, Homo sapiens
ggccttccttcccagcctactg

SEQ ID NO: 7257169 - DNA, 22 bp, Homo sapiens
ggccttccagggaagacagggc

SEQ ID NO: 7257170 - DNA, 22 bp, Homo sapiens
ggccttgctgcttccagaaggt

SEQ ID NO: 7257171 - DNA, 22 bp, Homo sapiens
ggccttgcggaacgctcaggcg

SEQ ID NO: 7257172 - DNA, 22 bp, Homo sapiens
ggccttgccaaggagcccttaa

SEQ ID NO: 7257173 - DNA, 22 bp, Homo sapiens
ggccttgatgttcttgggagat

SEQ ID NO: 7257174 - DNA, 19 bp, Homo sapiens
ggccttgatgagtggggag

SEQ ID NO: 7257175 - DNA, 22 bp, Homo sapiens
ggccttgatctctctaactgct

SEQ ID NO: 7257176 - DNA, 22 bp, Homo sapiens
ggccttgagagccagtgcaggc

SEQ ID NO: 7257177 - DNA, 22 bp, Homo sapiens
ggccttgacctcagtgggtttg

SEQ ID NO: 7257178 - DNA, 22 bp, Homo sapiens
ggccttgagcagggagaaacca

SEQ ID NO: 7257179 - DNA, 22 bp, Homo sapiens
ggccttgacagttaagagacct

SEQ ID NO: 7257180 - DNA, 22 bp, Homo sapiens
ggccttgatcctccagagcact

SEQ ID NO: 7257181 - DNA, 22 bp, Homo sapiens
ggccctccctgagccaggtggg

SEQ ID NO: 7257182 - DNA, 22 bp, Homo sapiens
ggccctgagtctagctgctctt

SEQ ID NO: 7257183 - DNA, 22 bp, Homo sapiens
ggccctgcatgagattaaggtt

SEQ ID NO: 7257184 - DNA, 22 bp, Homo sapiens
ggccctgcaaggtacccaggcc

SEQ ID NO: 7257185 - DNA, 22 bp, Homo sapiens
ggccctgcgattaggtggcagg

SEQ ID NO: 7257186 - DNA, 22 bp, Homo sapiens
gggaaatctcgtcctctattta

SEQ ID NO: 7257187 - DNA, 23 bp, Homo sapiens
gggaaatcaaaagatatttcttc

SEQ ID NO: 7257188 - DNA, 22 bp, Homo sapiens
gggaaaggatttacagtttgat

SEQ ID NO: 7257189 - DNA, 22 bp, Homo sapiens
gggaaaggatcagtgggaggct

SEQ ID NO: 7257190 - DNA, 22 bp, Homo sapiens
gggaagaagacatggtgaaggc

SEQ ID NO: 7257191 - DNA, 22 bp, Homo sapiens
gggaacagggcctgagctgggg

SEQ ID NO: 7257192 - DNA, 18 bp, Homo sapiens
gggaagaggatctggccc

SEQ ID NO: 7257193 - DNA, 22 bp, Homo sapiens
ggctgtggtctgggtgctcccc

SEQ ID NO: 7257194 - DNA, 22 bp, Homo sapiens
ggctggctgcatgccccctcct

SEQ ID NO: 7257195 - DNA, 22 bp, Homo sapiens
ggctggctatctgtggttgcct

SEQ ID NO: 7257196 - DNA, 22 bp, Homo sapiens
ggcttccccacagtcctgagct

SEQ ID NO: 7257197 - DNA, 22 bp, Homo sapiens
ggcttcccagcagagggcgcac

SEQ ID NO: 7257198 - DNA, 22 bp, Homo sapiens
ggcttcccaaggagccaggatg

SEQ ID NO: 7257199 - DNA, 22 bp, Homo sapiens
ggctctagagactctagagaaa

SEQ ID NO: 7257200 - DNA, 19 bp, Homo sapiens
ggctcctgtggctgcagcc

SEQ ID NO: 7257201 - DNA, 22 bp, Homo sapiens
ggctcctggggaggtgagcttg

SEQ ID NO: 7257202 - DNA, 22 bp, Homo sapiens
ggctcctggaaagccctcgctc

SEQ ID NO: 7257203 - DNA, 22 bp, Homo sapiens
ggctgcagaagtacttccggat

SEQ ID NO: 7257204 - DNA, 19 bp, Homo sapiens
ggctgcagagccccggcgc

SEQ ID NO: 7257205 - DNA, 22 bp, Homo sapiens
ggctgcagagctgggtgggcct

SEQ ID NO: 7257206 - DNA, 22 bp, Homo sapiens
ggctgcagaggcgatctgaggt

SEQ ID NO: 7257207 - DNA, 22 bp, Homo sapiens
ggctgcagaggcccccagtggg

SEQ ID NO: 7257208 - DNA, 22 bp, Homo sapiens
ggctgagttgagaggattactt

SEQ ID NO: 7257209 - DNA, 22 bp, Homo sapiens
ggctgctgaacaagggaaccct

SEQ ID NO: 7257210 - DNA, 22 bp, Homo sapiens
ggctggcgctctcccagcgctg

SEQ ID NO: 7257211 - DNA, 22 bp, Homo sapiens
ggctggcctctacagggaggca

SEQ ID NO: 7257212 - DNA, 22 bp, Homo sapiens
ggctgctcttcttggcgacctc

SEQ ID NO: 7257213 - DNA, 22 bp, Homo sapiens
ggctgctcttcttggcgacctc

SEQ ID NO: 7257214 - DNA, 22 bp, Homo sapiens
ggctgctctccatcccaggcct

SEQ ID NO: 7257215 - DNA, 22 bp, Homo sapiens
ggctgctcggcagctcctgagc

SEQ ID NO: 7257216 - DNA, 22 bp, Homo sapiens
ggctgctcggagcctcctgtga

SEQ ID NO: 7257217 - DNA, 22 bp, Homo sapiens
ggctgccttcagactccagctt

SEQ ID NO: 7257218 - DNA, 22 bp, Homo sapiens
ggctgcaggcagaggctgtctg

SEQ ID NO: 7257219 - DNA, 22 bp, Homo sapiens
ggctgcaggcagggtatccact

SEQ ID NO: 7257220 - DNA, 22 bp, Homo sapiens
ggctgcaggcagaggctgtctg

SEQ ID NO: 7257221 - DNA, 22 bp, Homo sapiens
ggctgcaggatgcccagccgtg

SEQ ID NO: 7257222 - DNA, 22 bp, Homo sapiens
ggctgcaggatgcccagccgtg

SEQ ID NO: 7257223 - DNA, 22 bp, Homo sapiens
ggctgcaggatgcccagccgtg

SEQ ID NO: 7257224 - DNA, 22 bp, Homo sapiens
ggctgcaggaacgacggagggg

SEQ ID NO: 7257225 - DNA, 22 bp, Homo sapiens
gggggctcctcccagctgccag

SEQ ID NO: 7257226 - DNA, 22 bp, Homo sapiens
gggggctctgactccctcagct

SEQ ID NO: 7257227 - DNA, 22 bp, Homo sapiens
gggggctctgactccctcagct

SEQ ID NO: 7257228 - DNA, 22 bp, Homo sapiens
ggggacgggacttagcatgagt

SEQ ID NO: 7257229 - DNA, 22 bp, Homo sapiens
ggggacgcagaaagagtggcag

SEQ ID NO: 7257230 - DNA, 22 bp, Homo sapiens
gggggctggaatatccatcaac

SEQ ID NO: 7257231 - DNA, 22 bp, Homo sapiens
gggggctggactttcccacaca

SEQ ID NO: 7257232 - DNA, 22 bp, Homo sapiens
gggggctggactttcccacaca

SEQ ID NO: 7257233 - DNA, 22 bp, Homo sapiens
gggggcttggcccggtctggtt

SEQ ID NO: 7257234 - DNA, 23 bp, Homo sapiens
gggggctggttgactctctgcag

SEQ ID NO: 7257235 - DNA, 22 bp, Homo sapiens
gggtccaggcgtggcccagatg

SEQ ID NO: 7257236 - DNA, 22 bp, Homo sapiens
gggggtggttctaagtcctata

SEQ ID NO: 7257237 - DNA, 22 bp, Homo sapiens
gggggtggttctaagtcctata

SEQ ID NO: 7257238 - DNA, 22 bp, Homo sapiens
gggggtggttctaagtcctata

SEQ ID NO: 7257239 - DNA, 22 bp, Homo sapiens
ggggggctgttctggacaggaa

SEQ ID NO: 7257240 - DNA, 22 bp, Homo sapiens
ggggggctgttctggacaggaa

SEQ ID NO: 7257241 - DNA, 22 bp, Homo sapiens
ggggggcagctgtcctggccat

SEQ ID NO: 7257242 - DNA, 20 bp, Homo sapiens
ggggggcttcagggcctgtg

SEQ ID NO: 7257243 - DNA, 22 bp, Homo sapiens
gggtctggacggctgcaggaag

SEQ ID NO: 7257244 - DNA, 22 bp, Homo sapiens
gggtctctcagaaggctgcaat

SEQ ID NO: 7257245 - DNA, 22 bp, Homo sapiens
gggtgaaccagagctgttttct

SEQ ID NO: 7257246 - DNA, 22 bp, Homo sapiens
gggtgaagctcctgcaggggcc

SEQ ID NO: 7257247 - DNA, 22 bp, Homo sapiens
gggtgggccccaggtatctgta

SEQ ID NO: 7257248 - DNA, 22 bp, Homo sapiens
gggtgggccccaggtatctgta

SEQ ID NO: 7257249 - DNA, 22 bp, Homo sapiens
gggtgggcccagcccagagaag

SEQ ID NO: 7257250 - DNA, 22 bp, Homo sapiens
gggtgggccactgagcagcgtg

SEQ ID NO: 7257251 - DNA, 23 bp, Homo sapiens
gggtgggccaaattaggtagcct

SEQ ID NO: 7257252 - DNA, 23 bp, Homo sapiens
gggtgggccaaattaggtagcct

SEQ ID NO: 7257253 - DNA, 17 bp, Homo sapiens
gggtgggcactgctggc

SEQ ID NO: 7257254 - DNA, 17 bp, Homo sapiens
gggtgggcactgctggc

SEQ ID NO: 7257255 - DNA, 22 bp, Homo sapiens
gggtgggatggcaggagccgct

SEQ ID NO: 7257256 - DNA, 22 bp, Homo sapiens
gggtggctgagaacaggacccc

SEQ ID NO: 7257257 - DNA, 22 bp, Homo sapiens
gggtgaggagctgccagtcatg

SEQ ID NO: 7257258 - DNA, 20 bp, Homo sapiens
gggtgagatgtaggagaggg

SEQ ID NO: 7257259 - DNA, 22 bp, Homo sapiens
gggctgagaattcagctttcct

SEQ ID NO: 7257260 - DNA, 22 bp, Homo sapiens
gggctctgtggcttccttctta

SEQ ID NO: 7257261 - DNA, 22 bp, Homo sapiens
gggctgagacgatggggtcttc

SEQ ID NO: 7257262 - DNA, 22 bp, Homo sapiens
gggctggacatctaaggtagct

SEQ ID NO: 7257263 - DNA, 22 bp, Homo sapiens
gggctgcttttttcttagcaga

SEQ ID NO: 7257264 - DNA, 22 bp, Homo sapiens
gggctgcttggaggaggcgctc

SEQ ID NO: 7257265 - DNA, 22 bp, Homo sapiens
gggctgcttgctggagacagac

SEQ ID NO: 7257266 - DNA, 22 bp, Homo sapiens
gggctgcttcctggggaatgct

SEQ ID NO: 7257267 - DNA, 22 bp, Homo sapiens
gggctgctgtgttcctgaggca

SEQ ID NO: 7257268 - DNA, 22 bp, Homo sapiens
gggctctgtggatgtgagagct

SEQ ID NO: 7257269 - DNA, 22 bp, Homo sapiens
gggctctgtggatgtgagagct

SEQ ID NO: 7257270 - DNA, 22 bp, Homo sapiens
gggctctggtacttcctggctc

SEQ ID NO: 7257271 - DNA, 22 bp, Homo sapiens
gggctctggtacttcctggctc

SEQ ID NO: 7257272 - DNA, 20 bp, Homo sapiens
gggctctgtaaggttgaaag

SEQ ID NO: 7257273 - DNA, 22 bp, Homo sapiens
gggctctggggtgccctggcat

SEQ ID NO: 7257274 - DNA, 22 bp, Homo sapiens
gggctagcctcttccctgctcc

SEQ ID NO: 7257275 - DNA, 17 bp, Homo sapiens
gggctggatggccatgg

SEQ ID NO: 7257276 - DNA, 22 bp, Homo sapiens
gggctggcatcagttgccgaga

SEQ ID NO: 7257277 - DNA, 23 bp, Homo sapiens
ggggacagttcccactggggtct

SEQ ID NO: 7257278 - DNA, 23 bp, Homo sapiens
ggggacagttcccactggggtct

SEQ ID NO: 7257279 - DNA, 22 bp, Homo sapiens
ggggacagttaaagaccaagac

SEQ ID NO: 7257280 - DNA, 22 bp, Homo sapiens
ggggacagttaaagaccaagac

SEQ ID NO: 7257281 - DNA, 22 bp, Homo sapiens
ggggacagtcgatctagtgatt

SEQ ID NO: 7257282 - DNA, 23 bp, Homo sapiens
ggggacagagggcagcccgcatc

SEQ ID NO: 7257283 - DNA, 23 bp, Homo sapiens
ggggaagtggcagtgagtgaggc

SEQ ID NO: 7257284 - DNA, 16 bp, Homo sapiens
ggggaaggcaagaggg

SEQ ID NO: 7257285 - DNA, 22 bp, Homo sapiens
ggggaaggattgagttgaccca

SEQ ID NO: 7257286 - DNA, 22 bp, Homo sapiens
ggggaagggagtccaagtgtta

SEQ ID NO: 7257287 - DNA, 16 bp, Homo sapiens
ggggaaggcaagaggg

SEQ ID NO: 7257288 - DNA, 22 bp, Homo sapiens
gggagggaaggtacctgtgtga

SEQ ID NO: 7257289 - DNA, 22 bp, Homo sapiens
gggatgaggatcaatcagggag

SEQ ID NO: 7257290 - DNA, 22 bp, Homo sapiens
gggaggcttgagccatactgcc

SEQ ID NO: 7257291 - DNA, 22 bp, Homo sapiens
gggaggctggctctggccacag

SEQ ID NO: 7257292 - DNA, 22 bp, Homo sapiens
gggaggctggctctggccacag

SEQ ID NO: 7257293 - DNA, 22 bp, Homo sapiens
gggaggctgccatccttcagga

SEQ ID NO: 7257294 - DNA, 22 bp, Homo sapiens
gggaggcttgagccatactgcc

SEQ ID NO: 7257295 - DNA, 22 bp, Homo sapiens
gggagggaaggaccttatgaat

SEQ ID NO: 7257296 - DNA, 22 bp, Homo sapiens
gggagggaaagcttgatctgtc

SEQ ID NO: 7257297 - DNA, 22 bp, Homo sapiens
gggagggaaggtacctgtgtga

SEQ ID NO: 7257298 - DNA, 22 bp, Homo sapiens
gggagggaaggaggcgccgtgt

SEQ ID NO: 7257299 - DNA, 22 bp, Homo sapiens
gggatggctttgtggctgactc

SEQ ID NO: 7257300 - DNA, 22 bp, Homo sapiens
gggatggggagctggaaagggg

SEQ ID NO: 7257301 - DNA, 22 bp, Homo sapiens
gggatggagggtagagcaagtg

SEQ ID NO: 7257302 - DNA, 22 bp, Homo sapiens
gggatggatcttggctgaggct

SEQ ID NO: 7257303 - DNA, 22 bp, Homo sapiens
gggagaaggagctagttcttga

SEQ ID NO: 7257304 - DNA, 22 bp, Homo sapiens
gggagaaggaggactgtgctgt

SEQ ID NO: 7257305 - DNA, 20 bp, Homo sapiens
gggagaagggctgatgagag

SEQ ID NO: 7257306 - DNA, 20 bp, Homo sapiens
gggagaagggctgatgagag

SEQ ID NO: 7257307 - DNA, 22 bp, Homo sapiens
gggaggagcttggagattcact

SEQ ID NO: 7257308 - DNA, 22 bp, Homo sapiens
gggaggaggaatgttttgtgta

SEQ ID NO: 7257309 - DNA, 22 bp, Homo sapiens
gggaggctgccatccttcagga

SEQ ID NO: 7257310 - DNA, 22 bp, Homo sapiens
gggaggctctgctcagcccccg

SEQ ID NO: 7257311 - DNA, 22 bp, Homo sapiens
gggaggcgccgagggtagctaa

SEQ ID NO: 7257312 - DNA, 22 bp, Homo sapiens
gggaggctcagtggtgtcctct

SEQ ID NO: 7257313 - DNA, 20 bp, Homo sapiens
gggaggcgagggctgagcag

SEQ ID NO: 7257314 - DNA, 18 bp, Homo sapiens
gggaggccccagcaggag

SEQ ID NO: 7257315 - DNA, 22 bp, Homo sapiens
gggagaagaatgtgtcaattgt

SEQ ID NO: 7257316 - DNA, 22 bp, Homo sapiens
gggagaagaatgtgtcaattgt

SEQ ID NO: 7257317 - DNA, 22 bp, Homo sapiens
gggagaaggagctagttcttga

SEQ ID NO: 7257318 - DNA, 22 bp, Homo sapiens
gggactccaaaactgtacccaa

SEQ ID NO: 7257319 - DNA, 22 bp, Homo sapiens
gggactccagggccactgggcc

SEQ ID NO: 7257320 - DNA, 22 bp, Homo sapiens
gggacgggcagtccaaggggtc

SEQ ID NO: 7257321 - DNA, 22 bp, Homo sapiens
gggacgggcacggagggccctc

SEQ ID NO: 7257322 - DNA, 22 bp, Homo sapiens
gggacgagatcttggcagtgtg

SEQ ID NO: 7257323 - DNA, 22 bp, Homo sapiens
gggcggggggagctggaatgaa

SEQ ID NO: 7257324 - DNA, 22 bp, Homo sapiens
gggcgtcctggaccctcccctg

SEQ ID NO: 7257325 - DNA, 22 bp, Homo sapiens
gggcggtgcctgtctccgaagc

SEQ ID NO: 7257326 - DNA, 22 bp, Homo sapiens
gggccagtgggacctgggtctc

SEQ ID NO: 7257327 - DNA, 23 bp, Homo sapiens
gggcccagcacaggacctggcag

SEQ ID NO: 7257328 - DNA, 22 bp, Homo sapiens
gggcccagcactggctgggatc

SEQ ID NO: 7257329 - DNA, 22 bp, Homo sapiens
gggcctggtgcttctgactcct

SEQ ID NO: 7257330 - DNA, 22 bp, Homo sapiens
gggcccaggcctccttccttcc

SEQ ID NO: 7257331 - DNA, 22 bp, Homo sapiens
gggcccagccctctgctcactg

SEQ ID NO: 7257332 - DNA, 22 bp, Homo sapiens
gggcccagcgtggttccatctg

SEQ ID NO: 7257333 - DNA, 19 bp, Homo sapiens
gggcccagcatggagggtt

SEQ ID NO: 7257334 - DNA, 22 bp, Homo sapiens
gggcccagcactggctgggatc

SEQ ID NO: 7257335 - DNA, 22 bp, Homo sapiens
gggccagtctgactctgctggt

SEQ ID NO: 7257336 - DNA, 22 bp, Homo sapiens
gggccagtagcacctgtgtgga

SEQ ID NO: 7257337 - DNA, 22 bp, Homo sapiens
gggccaggtggaccccagcctc

SEQ ID NO: 7257338 - DNA, 22 bp, Homo sapiens
gggccaggtggaccccagcctc

SEQ ID NO: 7257339 - DNA, 22 bp, Homo sapiens
gggccaggtggaccccagcctc

SEQ ID NO: 7257340 - DNA, 22 bp, Homo sapiens
gggccaggtatcgtctttagta

SEQ ID NO: 7257341 - DNA, 22 bp, Homo sapiens
gggccaggagtggagatatggg

SEQ ID NO: 7257342 - DNA, 22 bp, Homo sapiens
gggccaggtcggtgaatggtca

SEQ ID NO: 7257343 - DNA, 21 bp, Homo sapiens
gggccacaccttctgcagacc

SEQ ID NO: 7257344 - DNA, 20 bp, Homo sapiens
gggcagcctcgggagtgggt

SEQ ID NO: 7257345 - DNA, 22 bp, Homo sapiens
gggcagcctcggtgcctgctgc

SEQ ID NO: 7257346 - DNA, 22 bp, Homo sapiens
gggcagcagaattggacagaaa

SEQ ID NO: 7257347 - DNA, 20 bp, Homo sapiens
gggcagcctcgggagtgggt

SEQ ID NO: 7257348 - DNA, 22 bp, Homo sapiens
gggcagcacgtttcaggaggat

SEQ ID NO: 7257349 - DNA, 22 bp, Homo sapiens
gggcagaggttcaacttcaaca

SEQ ID NO: 7257350 - DNA, 22 bp, Homo sapiens
gggcagaggggcgcttccctct

SEQ ID NO: 7257351 - DNA, 17 bp, Homo sapiens
ggcaggtgcggggccgc

SEQ ID NO: 7257352 - DNA, 22 bp, Homo sapiens
ggcaggtgaggcatgtgcctgg

SEQ ID NO: 7257353 - DNA, 22 bp, Homo sapiens
ggcaggtgaggcatgtgcctgg

SEQ ID NO: 7257354 - DNA, 18 bp, Homo sapiens
ggcaggctctctgggtca

SEQ ID NO: 7257355 - DNA, 22 bp, Homo sapiens
ggcaggctccaagcatcctatg

SEQ ID NO: 7257356 - DNA, 22 bp, Homo sapiens
ggcaggcgtggtggcctcagaa

SEQ ID NO: 7257357 - DNA, 16 bp, Homo sapiens
ggcaggcgcggagccc

SEQ ID NO: 7257358 - DNA, 22 bp, Homo sapiens
ggcaggcgtggtggcctcagaa

SEQ ID NO: 7257359 - DNA, 22 bp, Homo sapiens
ggcagctgggttggccagaaac

SEQ ID NO: 7257360 - DNA, 22 bp, Homo sapiens
ggcagctggggcagtgccctgt

SEQ ID NO: 7257361 - DNA, 22 bp, Homo sapiens
ggcagctgtgaagtgcctcaca

SEQ ID NO: 7257362 - DNA, 22 bp, Homo sapiens
ggcagctctgctccttggctcc

SEQ ID NO: 7257363 - DNA, 22 bp, Homo sapiens
ggcagctctgctccacatgagt

SEQ ID NO: 7257364 - DNA, 22 bp, Homo sapiens
ggcagctctgctaattgagcct

SEQ ID NO: 7257365 - DNA, 22 bp, Homo sapiens
ggcagctctgtgtctgggaagc

SEQ ID NO: 7257366 - DNA, 22 bp, Homo sapiens
ggcagctgcacgttgtcccgtc

SEQ ID NO: 7257367 - DNA, 22 bp, Homo sapiens
ggcagctggcctcctcgcccac

SEQ ID NO: 7257368 - DNA, 22 bp, Homo sapiens
ggcagctctgatgatgctctgg

SEQ ID NO: 7257369 - DNA, 23 bp, Homo sapiens
ggcagctctcatctgatgactga

SEQ ID NO: 7257370 - DNA, 20 bp, Homo sapiens
ggcagctctagtcgaggccc

SEQ ID NO: 7257371 - DNA, 22 bp, Homo sapiens
ggcagctcgtcaggctgcggcg

SEQ ID NO: 7257372 - DNA, 22 bp, Homo sapiens
ggcagaggaagctggaagtggg

SEQ ID NO: 7257373 - DNA, 22 bp, Homo sapiens
ggcagaggaagctggaagtggg

SEQ ID NO: 7257374 - DNA, 22 bp, Homo sapiens
ggcagacctctccagccccaca

SEQ ID NO: 7257375 - DNA, 18 bp, Homo sapiens
ggcagacgcgaggggcgg

SEQ ID NO: 7257376 - DNA, 22 bp, Homo sapiens
ggcagagactgggttggcagag

SEQ ID NO: 7257377 - DNA, 23 bp, Homo sapiens
ggcagagagcatggctggggccc

SEQ ID NO: 7257378 - DNA, 22 bp, Homo sapiens
ggcacagcactgtaggcctggg

SEQ ID NO: 7257379 - DNA, 22 bp, Homo sapiens
ggcacagcactgtaggcctggg

SEQ ID NO: 7257380 - DNA, 22 bp, Homo sapiens
ggcacagcaccttttcacattg

SEQ ID NO: 7257381 - DNA, 22 bp, Homo sapiens
ggcacagcacagtggacccagg

SEQ ID NO: 7257382 - DNA, 22 bp, Homo sapiens
ggcacagcacagagcacatgta

SEQ ID NO: 7257383 - DNA, 22 bp, Homo sapiens
ggcacagcaagaagggaaatga

SEQ ID NO: 7257384 - DNA, 22 bp, Homo sapiens
ggcacacagatggagcactagc

SEQ ID NO: 7257385 - DNA, 22 bp, Homo sapiens
ggcacacagatggagcactagc

SEQ ID NO: 7257386 - DNA, 22 bp, Homo sapiens
ggcacacagcttggcaggagat

SEQ ID NO: 7257387 - DNA, 22 bp, Homo sapiens
ggcacacatagatctgcactgg

SEQ ID NO: 7257388 - DNA, 23 bp, Homo sapiens
ggagtgtgaagacctgatatagc

SEQ ID NO: 7257389 - DNA, 22 bp, Homo sapiens
ggagtggtgtcactgagaggaa

SEQ ID NO: 7257390 - DNA, 22 bp, Homo sapiens
ggagtggcagcgaggatcagat

SEQ ID NO: 7257391 - DNA, 22 bp, Homo sapiens
ggagtggcagctaggctgtcag

SEQ ID NO: 7257392 - DNA, 22 bp, Homo sapiens
ggagtgggaacaatgacatggt

SEQ ID NO: 7257393 - DNA, 22 bp, Homo sapiens
ggagtggctatttgtgctggtt

SEQ ID NO: 7257394 - DNA, 22 bp, Homo sapiens
ggagtgggcagcactgccctgt

SEQ ID NO: 7257395 - DNA, 22 bp, Homo sapiens
ggagtgggcagcactgccctgt

SEQ ID NO: 7257396 - DNA, 22 bp, Homo sapiens
ggagtgggcagcactgccctgt

SEQ ID NO: 7257397 - DNA, 19 bp, Homo sapiens
ggagtgggtagttagtggt

SEQ ID NO: 7257398 - DNA, 22 bp, Homo sapiens
ggaggctctgctccgtgtgttc

SEQ ID NO: 7257399 - DNA, 22 bp, Homo sapiens
ggaggctcttgagaggggagta

SEQ ID NO: 7257400 - DNA, 22 bp, Homo sapiens
ggaggctcttgagaggggagta

SEQ ID NO: 7257401 - DNA, 22 bp, Homo sapiens
ggaggctgagaagtccaagatc

SEQ ID NO: 7257402 - DNA, 22 bp, Homo sapiens
ggaggctgaggcccctcacagg

SEQ ID NO: 7257403 - DNA, 22 bp, Homo sapiens
ggaggctgaggcccctcacagg

SEQ ID NO: 7257404 - DNA, 22 bp, Homo sapiens
ggaggctgctgcctcacgtggg

SEQ ID NO: 7257405 - DNA, 19 bp, Homo sapiens
ggaggcttcttggggtcgg

SEQ ID NO: 7257406 - DNA, 22 bp, Homo sapiens
ggaggctgctgcctcacgtggg

SEQ ID NO: 7257407 - DNA, 22 bp, Homo sapiens
ggaggctgaggcaggcggatca

SEQ ID NO: 7257408 - DNA, 22 bp, Homo sapiens
ggaggccttgaggccaggagct

SEQ ID NO: 7257409 - DNA, 22 bp, Homo sapiens
ggaggcctcctgggggaggttc

SEQ ID NO: 7257410 - DNA, 22 bp, Homo sapiens
ggaggcctcctgggggaggttc

SEQ ID NO: 7257411 - DNA, 22 bp, Homo sapiens
ggaggcctcatcttgccccgtg

SEQ ID NO: 7257412 - DNA, 22 bp, Homo sapiens
ggaggcctagccagctccagtt

SEQ ID NO: 7257413 - DNA, 22 bp, Homo sapiens
ggaggcctcagtaccttgcttt

SEQ ID NO: 7257414 - DNA, 22 bp, Homo sapiens
ggaggcctagccagctccagtt

SEQ ID NO: 7257415 - DNA, 22 bp, Homo sapiens
ggaggcccagaaggaagcccag

SEQ ID NO: 7257416 - DNA, 22 bp, Homo sapiens
ggaggctccatgagctcctgca

SEQ ID NO: 7257417 - DNA, 22 bp, Homo sapiens
ggaggctccatgagctcctgca

SEQ ID NO: 7257418 - DNA, 22 bp, Homo sapiens
ggaggctcagactccatcctca

SEQ ID NO: 7257419 - DNA, 22 bp, Homo sapiens
ggaggcggggaaggcatcccat

SEQ ID NO: 7257420 - DNA, 22 bp, Homo sapiens
ggaggcggaggttgcagtgagt

SEQ ID NO: 7257421 - DNA, 22 bp, Homo sapiens
ggaggcggaggttgcagtgagc

SEQ ID NO: 7257422 - DNA, 22 bp, Homo sapiens
ggagggctcgtcatccaccact

SEQ ID NO: 7257423 - DNA, 22 bp, Homo sapiens
ggagggctgagactggggtctg

SEQ ID NO: 7257424 - DNA, 22 bp, Homo sapiens
ggagggctgagactggggtctg

SEQ ID NO: 7257425 - DNA, 22 bp, Homo sapiens
ggagggctgccacccgctcacg

SEQ ID NO: 7257426 - DNA, 22 bp, Homo sapiens
ggagggctcaattgactcctga

SEQ ID NO: 7257427 - DNA, 22 bp, Homo sapiens
ggagggctgccaggtggagcgg

SEQ ID NO: 7257428 - DNA, 23 bp, Homo sapiens
ggagggcttcatcagacccccag

SEQ ID NO: 7257429 - DNA, 18 bp, Homo sapiens
ggagggctttggggactg

SEQ ID NO: 7257430 - DNA, 22 bp, Homo sapiens
ggagggacccactctagaggtg

SEQ ID NO: 7257431 - DNA, 22 bp, Homo sapiens
ggagggacccactctagaggtg

SEQ ID NO: 7257432 - DNA, 22 bp, Homo sapiens
ggagggagagtgaccctaccaa

SEQ ID NO: 7257433 - DNA, 20 bp, Homo sapiens
ggagggcagctgagagttgg

SEQ ID NO: 7257434 - DNA, 22 bp, Homo sapiens
ggagggcccctccagtgggcag

SEQ ID NO: 7257435 - DNA, 22 bp, Homo sapiens
ggagggcccctccagtgggcag

SEQ ID NO: 7257436 - DNA, 22 bp, Homo sapiens
ggagggccatcttgggtgtgat

SEQ ID NO: 7257437 - DNA, 22 bp, Homo sapiens
ggaggtggcagggaacataatt

SEQ ID NO: 7257438 - DNA, 22 bp, Homo sapiens
ggaggtgggagacataggcggc

SEQ ID NO: 7257439 - DNA, 22 bp, Homo sapiens
ggaggtgggagacataggcggc

SEQ ID NO: 7257440 - DNA, 22 bp, Homo sapiens
ggaggtgggagcctccagtggt

SEQ ID NO: 7257441 - DNA, 22 bp, Homo sapiens
ggaggtggtggcagtgacaatt

SEQ ID NO: 7257442 - DNA, 22 bp, Homo sapiens
ggaggtggtggcagtgacaatt

SEQ ID NO: 7257443 - DNA, 22 bp, Homo sapiens
ggaggtgggctaaggactctct

SEQ ID NO: 7257444 - DNA, 22 bp, Homo sapiens
ggaggtcccaggcctggcagca

SEQ ID NO: 7257445 - DNA, 22 bp, Homo sapiens
ggaggtggaggttgcagtgagc

SEQ ID NO: 7257446 - DNA, 22 bp, Homo sapiens
ggaggtggaggttgcagtgagc

SEQ ID NO: 7257447 - DNA, 20 bp, Homo sapiens
ggagggtggaagaaagcaag

SEQ ID NO: 7257448 - DNA, 22 bp, Homo sapiens
ggagggtggcagcgtcctgggc

SEQ ID NO: 7257449 - DNA, 22 bp, Homo sapiens
ggagggttagcaaaggcacaga

SEQ ID NO: 7257450 - DNA, 22 bp, Homo sapiens
ggagggtgggtcattcttacat

SEQ ID NO: 7257451 - DNA, 22 bp, Homo sapiens
ggagggggaaactttggctgcc

SEQ ID NO: 7257452 - DNA, 22 bp, Homo sapiens
ggaggggctgagcaactttcag

SEQ ID NO: 7257453 - DNA, 22 bp, Homo sapiens
ggaggggctgagcaactttcag

SEQ ID NO: 7257454 - DNA, 22 bp, Homo sapiens
ggaggggctcctgttcgccccc

SEQ ID NO: 7257455 - DNA, 22 bp, Homo sapiens
ggaggggctcctgttcgccccc

SEQ ID NO: 7257456 - DNA, 22 bp, Homo sapiens
ggagggggaagaagctaaagac

SEQ ID NO: 7257457 - DNA, 22 bp, Homo sapiens
ggagggggaagaagctaaagac

SEQ ID NO: 7257458 - DNA, 22 bp, Homo sapiens
ggaggggaggattaatgacaaa

SEQ ID NO: 7257459 - DNA, 22 bp, Homo sapiens
ggaggggagatgtttgggctca

SEQ ID NO: 7257460 - DNA, 22 bp, Homo sapiens
ggaggggaggtccagctgatct

SEQ ID NO: 7257461 - DNA, 22 bp, Homo sapiens
ggaggggtctctagcgaggaga

SEQ ID NO: 7257462 - DNA, 22 bp, Homo sapiens
ggagggggactgacactgattt

SEQ ID NO: 7257463 - DNA, 22 bp, Homo sapiens
ggaggggtgagaatggctgcct

SEQ ID NO: 7257464 - DNA, 22 bp, Homo sapiens
ggaggggtgagaatggctgcct

SEQ ID NO: 7257465 - DNA, 22 bp, Homo sapiens
ggaggggtctctagcgaggaga

SEQ ID NO: 7257466 - DNA, 22 bp, Homo sapiens
ggaggggtgctcagctgtcacg

SEQ ID NO: 7257467 - DNA, 22 bp, Homo sapiens
ggaggggtgctcagctgtcacg

SEQ ID NO: 7257468 - DNA, 22 bp, Homo sapiens
ggagggtgcagaccctttgcaa

SEQ ID NO: 7257469 - DNA, 22 bp, Homo sapiens
ggagggtccccagcagcatgaa

SEQ ID NO: 7257470 - DNA, 22 bp, Homo sapiens
ggagggtccactgtgaggcaga

SEQ ID NO: 7257471 - DNA, 22 bp, Homo sapiens
ggagggtgcattttaccctgtg

SEQ ID NO: 7257472 - DNA, 20 bp, Homo sapiens
ggagggtggaagaaagcaag

SEQ ID NO: 7257473 - DNA, 22 bp, Homo sapiens
ggaggggtggtcacctggcagg

SEQ ID NO: 7257474 - DNA, 22 bp, Homo sapiens
ggaggggtggaaggagtgcctg

SEQ ID NO: 7257475 - DNA, 22 bp, Homo sapiens
ggaggggtggtcgcgaagagca

SEQ ID NO: 7257476 - DNA, 19 bp, Homo sapiens
ggaaacaggggccagagga

SEQ ID NO: 7257477 - DNA, 22 bp, Homo sapiens
ggaaagagctaaaagggtgaga

SEQ ID NO: 7257478 - DNA, 22 bp, Homo sapiens
ggaaagccaggtgctctggtgt

SEQ ID NO: 7257479 - DNA, 22 bp, Homo sapiens
ggaactcctgctccaagcagct

SEQ ID NO: 7257480 - DNA, 22 bp, Homo sapiens
ggaaagaatagagactttatca

SEQ ID NO: 7257481 - DNA, 22 bp, Homo sapiens
ggaaggggtgggtgagcctcag

SEQ ID NO: 7257482 - DNA, 21 bp, Homo sapiens
ggaaggggtcctcccaacagt

SEQ ID NO: 7257483 - DNA, 22 bp, Homo sapiens
ggaagggcaaaagagatgaact

SEQ ID NO: 7257484 - DNA, 22 bp, Homo sapiens
ggaagggcaataaaatctcagg

SEQ ID NO: 7257485 - DNA, 22 bp, Homo sapiens
ggaaggggtcacctcctgatga

SEQ ID NO: 7257486 - DNA, 18 bp, Homo sapiens
ggaaggtgatgtgaaaag

SEQ ID NO: 7257487 - DNA, 22 bp, Homo sapiens
ggaaggtgctccctggacagag

SEQ ID NO: 7257488 - DNA, 19 bp, Homo sapiens
ggaaggtgacagtggtgaa

SEQ ID NO: 7257489 - DNA, 22 bp, Homo sapiens
ggaagggtttaagcaggagagt

SEQ ID NO: 7257490 - DNA, 22 bp, Homo sapiens
ggaaggggttaggggtccctga

SEQ ID NO: 7257491 - DNA, 22 bp, Homo sapiens
ggaaggggtgtcgcccatggat

SEQ ID NO: 7257492 - DNA, 22 bp, Homo sapiens
gcttctagggaaggcagtcaca

SEQ ID NO: 7257493 - DNA, 22 bp, Homo sapiens
gcttctgcagggtcctcgctgt

SEQ ID NO: 7257494 - DNA, 22 bp, Homo sapiens
gcttctgcgcctagcctcaggt

SEQ ID NO: 7257495 - DNA, 22 bp, Homo sapiens
gcttcagcctcacactgatatc

SEQ ID NO: 7257496 - DNA, 22 bp, Homo sapiens
gctgggctgagctagacttggc

SEQ ID NO: 7257497 - DNA, 22 bp, Homo sapiens
gctgggccagactttcaatgtc

SEQ ID NO: 7257498 - DNA, 22 bp, Homo sapiens
gctgggccagagcagcagcact

SEQ ID NO: 7257499 - DNA, 22 bp, Homo sapiens
gctgggctcagacctagtgaac

SEQ ID NO: 7257500 - DNA, 22 bp, Homo sapiens
ggagctctctcagggggtccaa

SEQ ID NO: 7257501 - DNA, 22 bp, Homo sapiens
ggagctcaccttggagtctctg

SEQ ID NO: 7257502 - DNA, 22 bp, Homo sapiens
ggagctgatggtagaagaatga

SEQ ID NO: 7257503 - DNA, 22 bp, Homo sapiens
ggagctgatgacgtcaccatgg

SEQ ID NO: 7257504 - DNA, 22 bp, Homo sapiens
ggaggagcatgagagggtagtg

SEQ ID NO: 7257505 - DNA, 22 bp, Homo sapiens
ggaggagcatgagagggtagtg

SEQ ID NO: 7257506 - DNA, 22 bp, Homo sapiens
ggaggagcatgagagggtagtg

SEQ ID NO: 7257507 - DNA, 22 bp, Homo sapiens
ggaggagcccactcaaagggga

SEQ ID NO: 7257508 - DNA, 22 bp, Homo sapiens
ggaggaagaggttgttctctca

SEQ ID NO: 7257509 - DNA, 22 bp, Homo sapiens
ggaggaagggtagcataatgta

SEQ ID NO: 7257510 - DNA, 22 bp, Homo sapiens
ggaggaagtgcagttctactac

SEQ ID NO: 7257511 - DNA, 22 bp, Homo sapiens
ggaggccagcctgaggctgagg

SEQ ID NO: 7257512 - DNA, 22 bp, Homo sapiens
ggaggccaggatgggaactcaa

SEQ ID NO: 7257513 - DNA, 22 bp, Homo sapiens
ggaggccaggaagagccgccct

SEQ ID NO: 7257514 - DNA, 22 bp, Homo sapiens
ggaggccagggacccagtcagc

SEQ ID NO: 7257515 - DNA, 22 bp, Homo sapiens
ggaggccatcagggagggcatt

SEQ ID NO: 7257516 - DNA, 22 bp, Homo sapiens
ggaggccatgaggctctaggtg

SEQ ID NO: 7257517 - DNA, 22 bp, Homo sapiens
ggaggccacctgacctgctgtt

SEQ ID NO: 7257518 - DNA, 22 bp, Homo sapiens
ggaggaggcaagtaccagatgc

SEQ ID NO: 7257519 - DNA, 22 bp, Homo sapiens
ggaggaggcaagtaccagatgc

SEQ ID NO: 7257520 - DNA, 22 bp, Homo sapiens
ggaggcagaatagagtgtgggt

SEQ ID NO: 7257521 - DNA, 22 bp, Homo sapiens
ggagacagcaggaagaaatatc

SEQ ID NO: 7257522 - DNA, 22 bp, Homo sapiens
ggagaaggtggctcagcaaagg

SEQ ID NO: 7257523 - DNA, 22 bp, Homo sapiens
ggagaaggaatattggagtagg

SEQ ID NO: 7257524 - DNA, 21 bp, Homo sapiens
ggagaaggacaatgttgagta

SEQ ID NO: 7257525 - DNA, 22 bp, Homo sapiens
ggaagtgaggaattaggtttat

SEQ ID NO: 7257526 - DNA, 22 bp, Homo sapiens
ggaagtgaggaaatattttgtt

SEQ ID NO: 7257527 - DNA, 18 bp, Homo sapiens
ggaaggtgctggagtgca

SEQ ID NO: 7257528 - DNA, 19 bp, Homo sapiens
ggagaagcatctagaaata

SEQ ID NO: 7257529 - DNA, 22 bp, Homo sapiens
ggagaagccacacattgggtgt

SEQ ID NO: 7257530 - DNA, 19 bp, Homo sapiens
ggagaagcccaggaatcct

SEQ ID NO: 7257531 - DNA, 22 bp, Homo sapiens
ggagctaggcaaagctcacgga

SEQ ID NO: 7257532 - DNA, 22 bp, Homo sapiens
ggagcgtgcactccaggccctt

SEQ ID NO: 7257533 - DNA, 22 bp, Homo sapiens
ggagcggcagatggagtgggag

SEQ ID NO: 7257534 - DNA, 22 bp, Homo sapiens
ggagatgctttccagtggggat

SEQ ID NO: 7257535 - DNA, 20 bp, Homo sapiens
ggagatgcagcccaggtgcc

SEQ ID NO: 7257536 - DNA, 22 bp, Homo sapiens
ggagatgccagaattgcaaatt

SEQ ID NO: 7257537 - DNA, 22 bp, Homo sapiens
ggagatgctatgtagtttggtt

SEQ ID NO: 7257538 - DNA, 22 bp, Homo sapiens
ggagaggtgaatggctgctcta

SEQ ID NO: 7257539 - DNA, 22 bp, Homo sapiens
ggagagggtaggggtcctgccc

SEQ ID NO: 7257540 - DNA, 22 bp, Homo sapiens
ggagagggtgtggaaagttatc

SEQ ID NO: 7257541 - DNA, 22 bp, Homo sapiens
ggagagggtaggggtcctgccc

SEQ ID NO: 7257542 - DNA, 23 bp, Homo sapiens
ggagaggggtgtgggcatcttta

SEQ ID NO: 7257543 - DNA, 23 bp, Homo sapiens
ggagaggggtgtgggcatcttta

SEQ ID NO: 7257544 - DNA, 22 bp, Homo sapiens
ggagagggtaggggtcctgccc

SEQ ID NO: 7257545 - DNA, 22 bp, Homo sapiens
ggagagggggctccctgcttgg

SEQ ID NO: 7257546 - DNA, 22 bp, Homo sapiens
ggagaggggaacttgttgcttg

SEQ ID NO: 7257547 - DNA, 22 bp, Homo sapiens
ggagaggggaacttgttgcttg

SEQ ID NO: 7257548 - DNA, 22 bp, Homo sapiens
ggagaggggcaagtttatctag

SEQ ID NO: 7257549 - DNA, 22 bp, Homo sapiens
gccggggctggggagagacatg

SEQ ID NO: 7257550 - DNA, 22 bp, Homo sapiens
gccgggccctgacctcagagtt

SEQ ID NO: 7257551 - DNA, 19 bp, Homo sapiens
gccgggcccgggttggccg

SEQ ID NO: 7257552 - DNA, 22 bp, Homo sapiens
gccgaggctctgcccagctgct

SEQ ID NO: 7257553 - DNA, 22 bp, Homo sapiens
gccgcgtcgatgccctctagtt

SEQ ID NO: 7257554 - DNA, 22 bp, Homo sapiens
gccggtggcttttgtctcccct

SEQ ID NO: 7257555 - DNA, 19 bp, Homo sapiens
gccgggggcgccccgctct

SEQ ID NO: 7257556 - DNA, 22 bp, Homo sapiens
gcctcctgtcccaggctgagga

SEQ ID NO: 7257557 - DNA, 22 bp, Homo sapiens
gccgtgggtgtcatggcccata

SEQ ID NO: 7257558 - DNA, 22 bp, Homo sapiens
gccgtggggagagagggtgcgt

SEQ ID NO: 7257559 - DNA, 22 bp, Homo sapiens
gcctctgcaactccgccttggt

SEQ ID NO: 7257560 - DNA, 22 bp, Homo sapiens
gcctctgcatcttcgccgcact

SEQ ID NO: 7257561 - DNA, 22 bp, Homo sapiens
gcctctgccaagggggctgcgg

SEQ ID NO: 7257562 - DNA, 22 bp, Homo sapiens
gcctctgcatgctcagcaccca

SEQ ID NO: 7257563 - DNA, 22 bp, Homo sapiens
gcctctgcggggcccgagcccg

SEQ ID NO: 7257564 - DNA, 22 bp, Homo sapiens
gcctctgcgcctcagccgacct

SEQ ID NO: 7257565 - DNA, 22 bp, Homo sapiens
gccctctgatgctcaccgagga

SEQ ID NO: 7257566 - DNA, 22 bp, Homo sapiens
gccctctcttctgcagcctcca

SEQ ID NO: 7257567 - DNA, 22 bp, Homo sapiens
gccctctgccacaggacgccag

SEQ ID NO: 7257568 - DNA, 22 bp, Homo sapiens
gccctctgcacagctctgagca

SEQ ID NO: 7257569 - DNA, 16 bp, Homo sapiens
gccctctgcataagga

SEQ ID NO: 7257570 - DNA, 20 bp, Homo sapiens
gccctctgcctccctcagcg

SEQ ID NO: 7257571 - DNA, 22 bp, Homo sapiens
gccctctgctcagctcctcagc

SEQ ID NO: 7257572 - DNA, 22 bp, Homo sapiens
gccctctggcacagagatgcag

SEQ ID NO: 7257573 - DNA, 22 bp, Homo sapiens
gccctctgctggcctcacctcg

SEQ ID NO: 7257574 - DNA, 22 bp, Homo sapiens
gcccttccttagacagcaggat

SEQ ID NO: 7257575 - DNA, 22 bp, Homo sapiens
gcccttccaacccagagggcaa

SEQ ID NO: 7257576 - DNA, 22 bp, Homo sapiens
gccctttcttcttctggactgg

SEQ ID NO: 7257577 - DNA, 16 bp, Homo sapiens
gccctttccttggctg

SEQ ID NO: 7257578 - DNA, 22 bp, Homo sapiens
gcccaggctggagtgcagtggc

SEQ ID NO: 7257579 - DNA, 22 bp, Homo sapiens
gccctcagatgggaaaggaggg

SEQ ID NO: 7257580 - DNA, 22 bp, Homo sapiens
gccctcagcaggaaagatcaac

SEQ ID NO: 7257581 - DNA, 22 bp, Homo sapiens
gccctctcggcatagcaggggc

SEQ ID NO: 7257582 - DNA, 22 bp, Homo sapiens
gccctcctttgcttctcctagt

SEQ ID NO: 7257583 - DNA, 20 bp, Homo sapiens
gcccaggatctctgaggcat

SEQ ID NO: 7257584 - DNA, 22 bp, Homo sapiens
gcccaggatggctggaggtgct

SEQ ID NO: 7257585 - DNA, 22 bp, Homo sapiens
gcccaggctggagtgcagtagc

SEQ ID NO: 7257586 - DNA, 22 bp, Homo sapiens
gccattgtgaaatgttaatgta

SEQ ID NO: 7257587 - DNA, 22 bp, Homo sapiens
gcccaggaggagaggctgcagt

SEQ ID NO: 7257588 - DNA, 22 bp, Homo sapiens
gcccaggagttggaggctgcag

SEQ ID NO: 7257589 - DNA, 22 bp, Homo sapiens
gccatcatatcccctgtgacct

SEQ ID NO: 7257590 - DNA, 23 bp, Homo sapiens
gccatcacgttcaaccaaagcct

SEQ ID NO: 7257591 - DNA, 22 bp, Homo sapiens
gccagtggtcactgaggaagaa

SEQ ID NO: 7257592 - DNA, 22 bp, Homo sapiens
gccagggaaactgcagaccagc

SEQ ID NO: 7257593 - DNA, 22 bp, Homo sapiens
gccaggctgtttttattactgt

SEQ ID NO: 7257594 - DNA, 22 bp, Homo sapiens
gccataggcagcgtggccagca

SEQ ID NO: 7257595 - DNA, 22 bp, Homo sapiens
gccataatagagtgtgaggaat

SEQ ID NO: 7257596 - DNA, 22 bp, Homo sapiens
gccaggctgactcccccggcct

SEQ ID NO: 7257597 - DNA, 22 bp, Homo sapiens
gcctggagggatagaatgcaag

SEQ ID NO: 7257598 - DNA, 22 bp, Homo sapiens
gcctggaggcgagaacccaatg

SEQ ID NO: 7257599 - DNA, 20 bp, Homo sapiens
gcctggaggcagagataaag

SEQ ID NO: 7257600 - DNA, 20 bp, Homo sapiens
gcctggaggcaatgggaaga

SEQ ID NO: 7257601 - DNA, 22 bp, Homo sapiens
gcctggagcctcagcaaggagg

SEQ ID NO: 7257602 - DNA, 22 bp, Homo sapiens
gcctggagcctcagcaaggagg

SEQ ID NO: 7257603 - DNA, 22 bp, Homo sapiens
gcctggaggggccagggtggta

SEQ ID NO: 7257604 - DNA, 22 bp, Homo sapiens
gcctggaggggacagtctctgg

SEQ ID NO: 7257605 - DNA, 22 bp, Homo sapiens
gcctggagggctctagagaggc

SEQ ID NO: 7257606 - DNA, 22 bp, Homo sapiens
gcctggaggggccagggtggta

SEQ ID NO: 7257607 - DNA, 22 bp, Homo sapiens
gcctggagggtccctctctgga

SEQ ID NO: 7257608 - DNA, 20 bp, Homo sapiens
gcctctggagccaaggacca

SEQ ID NO: 7257609 - DNA, 22 bp, Homo sapiens
gcctctggaagtgggaaggggt

SEQ ID NO: 7257610 - DNA, 23 bp, Homo sapiens
gcctgggactggtagtgtgacct

SEQ ID NO: 7257611 - DNA, 22 bp, Homo sapiens
gcctgtggggctgaggctgcct

SEQ ID NO: 7257612 - DNA, 19 bp, Homo sapiens
gcctgtacctgctttttac

SEQ ID NO: 7257613 - DNA, 22 bp, Homo sapiens
gcctggcattggagccggggca

SEQ ID NO: 7257614 - DNA, 22 bp, Homo sapiens
gcctggagtagcatggcaagcc

SEQ ID NO: 7257615 - DNA, 22 bp, Homo sapiens
gcctggagtagcatggcaagcc

SEQ ID NO: 7257616 - DNA, 22 bp, Homo sapiens
gcctggagtactccttgaagtg

SEQ ID NO: 7257617 - DNA, 22 bp, Homo sapiens
gcctggagggttgaggttttgt

SEQ ID NO: 7257618 - DNA, 17 bp, Homo sapiens
gcctggcccagcctggc

SEQ ID NO: 7257619 - DNA, 22 bp, Homo sapiens
gcctgggaaatggtggggtcag

SEQ ID NO: 7257620 - DNA, 22 bp, Homo sapiens
gcctgggaaatggtggggtcag

SEQ ID NO: 7257621 - DNA, 21 bp, Homo sapiens
gcctgggaaatctgggaagcc

SEQ ID NO: 7257622 - DNA, 22 bp, Homo sapiens
gcctggcctgaactaggaggtg

SEQ ID NO: 7257623 - DNA, 22 bp, Homo sapiens
gcctggcctgaactaggaggtg

SEQ ID NO: 7257624 - DNA, 22 bp, Homo sapiens
gctgctctgggtctgcccagct

SEQ ID NO: 7257625 - DNA, 21 bp, Homo sapiens
gctgctgcccctagtgaggcc

SEQ ID NO: 7257626 - DNA, 22 bp, Homo sapiens
gctgctgcaagagccagctctt

SEQ ID NO: 7257627 - DNA, 22 bp, Homo sapiens
gctgctgctggtctggggccac

SEQ ID NO: 7257628 - DNA, 22 bp, Homo sapiens
gctgctgcctgtagccagggtg

SEQ ID NO: 7257629 - DNA, 22 bp, Homo sapiens
gctgctgccgcggccgctggga

SEQ ID NO: 7257630 - DNA, 21 bp, Homo sapiens
gctgctcgagatccagtgctt

SEQ ID NO: 7257631 - DNA, 22 bp, Homo sapiens
gctgcctgatcatacaccaggg

SEQ ID NO: 7257632 - DNA, 22 bp, Homo sapiens
gctgaggcaaaccaagaatgta

SEQ ID NO: 7257633 - DNA, 22 bp, Homo sapiens
gctgaggcaaatagttttaagt

SEQ ID NO: 7257634 - DNA, 22 bp, Homo sapiens
gctgaggcaagatttgaaccca

SEQ ID NO: 7257635 - DNA, 22 bp, Homo sapiens
gctgagcaggtgtaaggaaggc

SEQ ID NO: 7257636 - DNA, 22 bp, Homo sapiens
gctggagatagtaggatccata

SEQ ID NO: 7257637 - DNA, 22 bp, Homo sapiens
gctggagcgggttcgggccgct

SEQ ID NO: 7257638 - DNA, 22 bp, Homo sapiens
gctggccagtgtcccagggatc

SEQ ID NO: 7257639 - DNA, 22 bp, Homo sapiens
gctggccagggctgctcgcgga

SEQ ID NO: 7257640 - DNA, 22 bp, Homo sapiens
gctgggagttactgtctccttt

SEQ ID NO: 7257641 - DNA, 22 bp, Homo sapiens
gctggcggcagtggtgtctctg

SEQ ID NO: 7257642 - DNA, 22 bp, Homo sapiens
gctggcggcagtggtgtctctg

SEQ ID NO: 7257643 - DNA, 22 bp, Homo sapiens
gctgggcaatgccagagaggag

SEQ ID NO: 7257644 - DNA, 22 bp, Homo sapiens
gctgggcaagtgccttgggttt

SEQ ID NO: 7257645 - DNA, 22 bp, Homo sapiens
gctgggcagcctggccgctgcc

SEQ ID NO: 7257646 - DNA, 22 bp, Homo sapiens
gctgggcagcaggctctccggg

SEQ ID NO: 7257647 - DNA, 22 bp, Homo sapiens
gctgggcaggcctcgtgagggc

SEQ ID NO: 7257648 - DNA, 22 bp, Homo sapiens
gctgggcagctgaggcctctca

SEQ ID NO: 7257649 - DNA, 22 bp, Homo sapiens
gctctgtttctccatgctgtgg

SEQ ID NO: 7257650 - DNA, 22 bp, Homo sapiens
gctctgcccaatgtccctacac

SEQ ID NO: 7257651 - DNA, 22 bp, Homo sapiens
gctctgcccaaagctgtggctg

SEQ ID NO: 7257652 - DNA, 22 bp, Homo sapiens
gctctgccagcccaaggcgcag

SEQ ID NO: 7257653 - DNA, 22 bp, Homo sapiens
gctctgccagacactgtggcca

SEQ ID NO: 7257654 - DNA, 20 bp, Homo sapiens
gctgaagaagtagcatgtac

SEQ ID NO: 7257655 - DNA, 22 bp, Homo sapiens
gctgagagtgggtgcagtgctt

SEQ ID NO: 7257656 - DNA, 22 bp, Homo sapiens
gctgagcacagcaaagagacaa

SEQ ID NO: 7257657 - DNA, 22 bp, Homo sapiens
gctgagcagggtggggaaaggc

SEQ ID NO: 7257658 - DNA, 22 bp, Homo sapiens
gctgagcacacctagggtagag

SEQ ID NO: 7257659 - DNA, 22 bp, Homo sapiens
gctctgaggctgtgaggtgctg

SEQ ID NO: 7257660 - DNA, 22 bp, Homo sapiens
gctctgagccgggggcctgtcc

SEQ ID NO: 7257661 - DNA, 23 bp, Homo sapiens
gctctgaggaagttgggcacggg

SEQ ID NO: 7257662 - DNA, 22 bp, Homo sapiens
gctctgagctgtcttgcaggtc

SEQ ID NO: 7257663 - DNA, 22 bp, Homo sapiens
gctctgccaaggacccattctc

SEQ ID NO: 7257664 - DNA, 22 bp, Homo sapiens
gctctgccaacagtttgggcaa

SEQ ID NO: 7257665 - DNA, 22 bp, Homo sapiens
gctctgccaacagtttgggcaa

SEQ ID NO: 7257666 - DNA, 18 bp, Homo sapiens
gctctgcagctgaggctt

SEQ ID NO: 7257667 - DNA, 18 bp, Homo sapiens
gctctgcagctgaggctt

SEQ ID NO: 7257668 - DNA, 22 bp, Homo sapiens
gctctgagtgatcagctgggaa

SEQ ID NO: 7257669 - DNA, 22 bp, Homo sapiens
gctctgagtcacactgccctgt

SEQ ID NO: 7257670 - DNA, 22 bp, Homo sapiens
gctctctttaaactgcatggct

SEQ ID NO: 7257671 - DNA, 22 bp, Homo sapiens
gctctgagcactgtgcggctgg

SEQ ID NO: 7257672 - DNA, 22 bp, Homo sapiens
gctcagaccccaccctggcaga

SEQ ID NO: 7257673 - DNA, 22 bp, Homo sapiens
gctcagaaatggcagatggaga

SEQ ID NO: 7257674 - DNA, 22 bp, Homo sapiens
gctcagagatgttcagtagctt

SEQ ID NO: 7257675 - DNA, 22 bp, Homo sapiens
gctcagagcagatggtactcag

SEQ ID NO: 7257676 - DNA, 22 bp, Homo sapiens
gctcagagcatcccagtgaatg

SEQ ID NO: 7257677 - DNA, 19 bp, Homo sapiens
gctcagagccatgggggct

SEQ ID NO: 7257678 - DNA, 22 bp, Homo sapiens
gctcctggcaggcagtgtgtgt

SEQ ID NO: 7257679 - DNA, 22 bp, Homo sapiens
gctccaggaggatgaccttcct

SEQ ID NO: 7257680 - DNA, 22 bp, Homo sapiens
gctccaggagctcacagctcgc

SEQ ID NO: 7257681 - DNA, 22 bp, Homo sapiens
gctcctctgtcaaatgagagtg

SEQ ID NO: 7257682 - DNA, 22 bp, Homo sapiens
gctcctctcccagagctgcagg

SEQ ID NO: 7257683 - DNA, 22 bp, Homo sapiens
gctcctctcctcggagtcgggg

SEQ ID NO: 7257684 - DNA, 22 bp, Homo sapiens
gctccagcacctagagcaggtc

SEQ ID NO: 7257685 - DNA, 22 bp, Homo sapiens
gctccagatgaatgcacttgtt

SEQ ID NO: 7257686 - DNA, 22 bp, Homo sapiens
gctccagagtgtggcatctggg

SEQ ID NO: 7257687 - DNA, 22 bp, Homo sapiens
gctccagctctgttctggggaa

SEQ ID NO: 7257688 - DNA, 22 bp, Homo sapiens
gctccagctctgttctggggaa

SEQ ID NO: 7257689 - DNA, 22 bp, Homo sapiens
gctccagctcgtggctcccagc

SEQ ID NO: 7257690 - DNA, 21 bp, Homo sapiens
gctccagaactctatgctaac

SEQ ID NO: 7257691 - DNA, 22 bp, Homo sapiens
gctccacttgcagctaggcttg

SEQ ID NO: 7257692 - DNA, 22 bp, Homo sapiens
gctccacttgattgttacagca

SEQ ID NO: 7257693 - DNA, 22 bp, Homo sapiens
gctccacttccttctgccctca

SEQ ID NO: 7257694 - DNA, 22 bp, Homo sapiens
gctccactgtttattggcagaa

SEQ ID NO: 7257695 - DNA, 22 bp, Homo sapiens
gctccactgtcccatgggactt

SEQ ID NO: 7257696 - DNA, 22 bp, Homo sapiens
gctccactgcccctgggcaccg

SEQ ID NO: 7257697 - DNA, 22 bp, Homo sapiens
gctccactaggaatctgctctt

SEQ ID NO: 7257698 - DNA, 20 bp, Homo sapiens
gctccaagcccctttagagg

SEQ ID NO: 7257699 - DNA, 20 bp, Homo sapiens
gcatgtcagaaatcaatggg

SEQ ID NO: 7257700 - DNA, 22 bp, Homo sapiens
gccaatttatagccaaaaatca

SEQ ID NO: 7257701 - DNA, 23 bp, Homo sapiens
gccaatttagtaaaggcagtggg

SEQ ID NO: 7257702 - DNA, 22 bp, Homo sapiens
gccaatttagggtttattgatt

SEQ ID NO: 7257703 - DNA, 22 bp, Homo sapiens
gccacagcccgagcaccatgag

SEQ ID NO: 7257704 - DNA, 16 bp, Homo sapiens
gccacagcccctgtct

SEQ ID NO: 7257705 - DNA, 20 bp, Homo sapiens
gccaatttttctatgtatac

SEQ ID NO: 7257706 - DNA, 23 bp, Homo sapiens
gccaatttttgactgtcagtagg

SEQ ID NO: 7257707 - DNA, 22 bp, Homo sapiens
gccaatttggggagccgtggtg

SEQ ID NO: 7257708 - DNA, 22 bp, Homo sapiens
gccaatttgactagacctcttg

SEQ ID NO: 7257709 - DNA, 22 bp, Homo sapiens
gccaatttgaattggttttctg

SEQ ID NO: 7257710 - DNA, 22 bp, Homo sapiens
gccaatttcctgaggtaaagct

SEQ ID NO: 7257711 - DNA, 22 bp, Homo sapiens
gccaatttatcttactcgtgct

SEQ ID NO: 7257712 - DNA, 20 bp, Homo sapiens
gccagaggccggcaggggct

SEQ ID NO: 7257713 - DNA, 22 bp, Homo sapiens
gccagcaccttctcatatgttt

SEQ ID NO: 7257714 - DNA, 22 bp, Homo sapiens
gccagcaccttagcatgaatca

SEQ ID NO: 7257715 - DNA, 19 bp, Homo sapiens
gccagcacccagctgtgtc

SEQ ID NO: 7257716 - DNA, 22 bp, Homo sapiens
gccagcaccagctactagtcac

SEQ ID NO: 7257717 - DNA, 19 bp, Homo sapiens
gccagcacatgtcttctag

SEQ ID NO: 7257718 - DNA, 20 bp, Homo sapiens
gccagcacagggagcagttc

SEQ ID NO: 7257719 - DNA, 22 bp, Homo sapiens
gccagcagccacagaagtcact

SEQ ID NO: 7257720 - DNA, 22 bp, Homo sapiens
gccagcagccacagaagtcact

SEQ ID NO: 7257721 - DNA, 22 bp, Homo sapiens
gcagtagagcttcttttgatga

SEQ ID NO: 7257722 - DNA, 22 bp, Homo sapiens
gcagtagagcagagattttcct

SEQ ID NO: 7257723 - DNA, 22 bp, Homo sapiens
gcagtagagaagccaggctgta

SEQ ID NO: 7257724 - DNA, 20 bp, Homo sapiens
gcagtagaccatgcttggaa

SEQ ID NO: 7257725 - DNA, 22 bp, Homo sapiens
gcagtagaaggtgctttctgga

SEQ ID NO: 7257726 - DNA, 22 bp, Homo sapiens
gcagtagaactgtcatgatgtt

SEQ ID NO: 7257727 - DNA, 22 bp, Homo sapiens
gcagtagaacgtgttgaatcaa

SEQ ID NO: 7257728 - DNA, 22 bp, Homo sapiens
gcagtagaaatttcattgctct

SEQ ID NO: 7257729 - DNA, 22 bp, Homo sapiens
gcagtatacactgatacatgag

SEQ ID NO: 7257730 - DNA, 22 bp, Homo sapiens
gcagtgggagcttaggcagtgc

SEQ ID NO: 7257731 - DNA, 22 bp, Homo sapiens
gcagtagatctggaagagaatt

SEQ ID NO: 7257732 - DNA, 18 bp, Homo sapiens
gcagtaggcgcgcaggac

SEQ ID NO: 7257733 - DNA, 19 bp, Homo sapiens
gcagtgtcatggtaggagc

SEQ ID NO: 7257734 - DNA, 22 bp, Homo sapiens
gcagtgtcagtgcctgggtggt

SEQ ID NO: 7257735 - DNA, 22 bp, Homo sapiens
gcagtgtccagggtggtctgca

SEQ ID NO: 7257736 - DNA, 22 bp, Homo sapiens
gcagtgggcaacaagagctgga

SEQ ID NO: 7257737 - DNA, 22 bp, Homo sapiens
gcagtggggaatgctggggaga

SEQ ID NO: 7257738 - DNA, 22 bp, Homo sapiens
gcagtgggcctgaggaagggtg

SEQ ID NO: 7257739 - DNA, 22 bp, Homo sapiens
gcagtgggcctgaggaagggtg

SEQ ID NO: 7257740 - DNA, 22 bp, Homo sapiens
gcagtggggaatgctggggaga

SEQ ID NO: 7257741 - DNA, 22 bp, Homo sapiens
gcagggtgccgacttcagggat

SEQ ID NO: 7257742 - DNA, 22 bp, Homo sapiens
gcagggtggatggcagggccag

SEQ ID NO: 7257743 - DNA, 22 bp, Homo sapiens
gcagggtgacgttgcccacctc

SEQ ID NO: 7257744 - DNA, 22 bp, Homo sapiens
gcagggtgacgttgcccacctc

SEQ ID NO: 7257745 - DNA, 22 bp, Homo sapiens
gcagggtgatagtgaggctcag

SEQ ID NO: 7257746 - DNA, 22 bp, Homo sapiens
gcaggtgggagccgctgcctga

SEQ ID NO: 7257747 - DNA, 22 bp, Homo sapiens
gcaggtggggctgctaccagaa

SEQ ID NO: 7257748 - DNA, 22 bp, Homo sapiens
gcaggtggtggcgcgcgccctg

SEQ ID NO: 7257749 - DNA, 22 bp, Homo sapiens
gcaggtggtcactcatccccag

SEQ ID NO: 7257750 - DNA, 22 bp, Homo sapiens
gcaggtggtgggggagccgttc

SEQ ID NO: 7257751 - DNA, 22 bp, Homo sapiens
gcaggtggttaaggtcccatgt

SEQ ID NO: 7257752 - DNA, 22 bp, Homo sapiens
gcagagcctgggggtctgcgga

SEQ ID NO: 7257753 - DNA, 22 bp, Homo sapiens
gcagagcctgtgtctgagcaaa

SEQ ID NO: 7257754 - DNA, 21 bp, Homo sapiens
gcagagccggggcgagaaggc

SEQ ID NO: 7257755 - DNA, 20 bp, Homo sapiens
gcagagcctcactgcaaggg

SEQ ID NO: 7257756 - DNA, 22 bp, Homo sapiens
gcagagcggtgatcaggcgcag

SEQ ID NO: 7257757 - DNA, 22 bp, Homo sapiens
gcagctcccatcagggcacaga

SEQ ID NO: 7257758 - DNA, 22 bp, Homo sapiens
gcagctcccagcttgaaaggtc

SEQ ID NO: 7257759 - DNA, 22 bp, Homo sapiens
gcagctcctcctgggctggaga

SEQ ID NO: 7257760 - DNA, 22 bp, Homo sapiens
gcagctccctggctgcaaatga

SEQ ID NO: 7257761 - DNA, 22 bp, Homo sapiens
gcagctcccttgaacttctcct

SEQ ID NO: 7257762 - DNA, 22 bp, Homo sapiens
gcagctcctttaggctgcaaag

SEQ ID NO: 7257763 - DNA, 22 bp, Homo sapiens
gcagctcctggcacagtttttt

SEQ ID NO: 7257764 - DNA, 22 bp, Homo sapiens
gcagctccttcaatctcaccat

SEQ ID NO: 7257765 - DNA, 22 bp, Homo sapiens
gcagctgagagaagaacagggc

SEQ ID NO: 7257766 - DNA, 22 bp, Homo sapiens
gcaggagacaactgtaaggaga

SEQ ID NO: 7257767 - DNA, 22 bp, Homo sapiens
gcaggagctcgtttccaggctg

SEQ ID NO: 7257768 - DNA, 22 bp, Homo sapiens
gcaggagccaggccgagctggt

SEQ ID NO: 7257769 - DNA, 22 bp, Homo sapiens
gcaggagccacttcagggatgc

SEQ ID NO: 7257770 - DNA, 19 bp, Homo sapiens
gcaggcacagccctgggtg

SEQ ID NO: 7257771 - DNA, 19 bp, Homo sapiens
gcaggcacagccctgggtg

SEQ ID NO: 7257772 - DNA, 22 bp, Homo sapiens
gcaggcaccacggctcaggtct

SEQ ID NO: 7257773 - DNA, 22 bp, Homo sapiens
gcaggggctactctgagcttcc

SEQ ID NO: 7257774 - DNA, 22 bp, Homo sapiens
gcaggggctaaggacacagaga

SEQ ID NO: 7257775 - DNA, 22 bp, Homo sapiens
gcaggggctgagcaccagcggg

SEQ ID NO: 7257776 - DNA, 22 bp, Homo sapiens
gcagggggtcattcacgctggc

SEQ ID NO: 7257777 - DNA, 22 bp, Homo sapiens
gcagggcagaaggtgctgagga

SEQ ID NO: 7257778 - DNA, 22 bp, Homo sapiens
gcagggcacagacagtgccaag

SEQ ID NO: 7257779 - DNA, 22 bp, Homo sapiens
gcagggcaaatgtggaaaggag

SEQ ID NO: 7257780 - DNA, 22 bp, Homo sapiens
gcaggctggggtagccccactt

SEQ ID NO: 7257781 - DNA, 22 bp, Homo sapiens
gcaggctggggtagccccactt

SEQ ID NO: 7257782 - DNA, 21 bp, Homo sapiens
gcaggctggtcaaacctcagt

SEQ ID NO: 7257783 - DNA, 22 bp, Homo sapiens
gcaggctggtctgaccatccct

SEQ ID NO: 7257784 - DNA, 22 bp, Homo sapiens
gcaggcagagaggggtttccag

SEQ ID NO: 7257785 - DNA, 22 bp, Homo sapiens
gcaggcagaggtggaggagaca

SEQ ID NO: 7257786 - DNA, 21 bp, Homo sapiens
gcaggcactctagaggagctg

SEQ ID NO: 7257787 - DNA, 22 bp, Homo sapiens
gattatgactgtcctagaaaaa

SEQ ID NO: 7257788 - DNA, 22 bp, Homo sapiens
gattatgatgcgaggtcagagc

SEQ ID NO: 7257789 - DNA, 23 bp, Homo sapiens
gattcacagggtggtttatgggg

SEQ ID NO: 7257790 - DNA, 22 bp, Homo sapiens
gattcaatgttgcagatggaat

SEQ ID NO: 7257791 - DNA, 22 bp, Homo sapiens
gatgttttttaggatctcagca

SEQ ID NO: 7257792 - DNA, 21 bp, Homo sapiens
gattaaatttaagctacatgc

SEQ ID NO: 7257793 - DNA, 22 bp, Homo sapiens
gatttacagatctaagggtcac

SEQ ID NO: 7257794 - DNA, 22 bp, Homo sapiens
gatttataaaggttgcactgga

SEQ ID NO: 7257795 - DNA, 21 bp, Homo sapiens
gatttataagccttaagccta

SEQ ID NO: 7257796 - DNA, 22 bp, Homo sapiens
gatttatgacagagctgactct

SEQ ID NO: 7257797 - DNA, 22 bp, Homo sapiens
gatttatagtatgtgctttcag

SEQ ID NO: 7257798 - DNA, 22 bp, Homo sapiens
gatgtacatggattcctttcct

SEQ ID NO: 7257799 - DNA, 22 bp, Homo sapiens
gatgggtgccccagacaagctg

SEQ ID NO: 7257800 - DNA, 22 bp, Homo sapiens
gatggggatgagaagtgagcag

SEQ ID NO: 7257801 - DNA, 22 bp, Homo sapiens
gatgggggccagggcctgcttt

SEQ ID NO: 7257802 - DNA, 22 bp, Homo sapiens
gatggaggagatggcagggtgc

SEQ ID NO: 7257803 - DNA, 22 bp, Homo sapiens
gatggaggaaaagttggaatgc

SEQ ID NO: 7257804 - DNA, 22 bp, Homo sapiens
gatggctaggggactggagtta

SEQ ID NO: 7257805 - DNA, 20 bp, Homo sapiens
gatgggaatcggagctggta

SEQ ID NO: 7257806 - DNA, 18 bp, Homo sapiens
gatgggagcaagagaaga

SEQ ID NO: 7257807 - DNA, 22 bp, Homo sapiens
gatgctgggaccacagagtgtt

SEQ ID NO: 7257808 - DNA, 22 bp, Homo sapiens
gatgcattgcatcgagtagctt

SEQ ID NO: 7257809 - DNA, 22 bp, Homo sapiens
gatgcattcgggatgtttactt

SEQ ID NO: 7257810 - DNA, 20 bp, Homo sapiens
gatgcattagatgcagggta

SEQ ID NO: 7257811 - DNA, 22 bp, Homo sapiens
gatgcattacaaaagtgattat

SEQ ID NO: 7257812 - DNA, 22 bp, Homo sapiens
gatgcctgtggtgagcacacat

SEQ ID NO: 7257813 - DNA, 22 bp, Homo sapiens
gcagagcccctcaagccagcct

SEQ ID NO: 7257814 - DNA, 22 bp, Homo sapiens
gcagagccaggctggggcaggt

SEQ ID NO: 7257815 - DNA, 22 bp, Homo sapiens
gcagagccaggagagacccttg

SEQ ID NO: 7257816 - DNA, 22 bp, Homo sapiens
gcagaaggatccgcaggtgcaa

SEQ ID NO: 7257817 - DNA, 22 bp, Homo sapiens
gcagaagaccatggtggaaaga

SEQ ID NO: 7257818 - DNA, 22 bp, Homo sapiens
gcagaagaccatggtggaaaga

SEQ ID NO: 7257819 - DNA, 16 bp, Homo sapiens
gcacacacatcaatga

SEQ ID NO: 7257820 - DNA, 22 bp, Homo sapiens
gcacccctgcgtgccttccctt

SEQ ID NO: 7257821 - DNA, 22 bp, Homo sapiens
gcaccctgctctatccttgcta

SEQ ID NO: 7257822 - DNA, 22 bp, Homo sapiens
gcacctgcaggatgagccaggg

SEQ ID NO: 7257823 - DNA, 20 bp, Homo sapiens
gcacttggctgctgcttctc

SEQ ID NO: 7257824 - DNA, 22 bp, Homo sapiens
gcacctggacagtgaccctagc

SEQ ID NO: 7257825 - DNA, 22 bp, Homo sapiens
gattttctgagccttcaaattt

SEQ ID NO: 7257826 - DNA, 22 bp, Homo sapiens
gatttcacccacttcccagtgt

SEQ ID NO: 7257827 - DNA, 22 bp, Homo sapiens
gcaaacatgctgagaaataaga

SEQ ID NO: 7257828 - DNA, 22 bp, Homo sapiens
gcacaaaggtggaaggaggaag

SEQ ID NO: 7257829 - DNA, 22 bp, Homo sapiens
gcacaaagatgaatacagaatg

SEQ ID NO: 7257830 - DNA, 22 bp, Homo sapiens
gaggtgtcagggtagtcatgat

SEQ ID NO: 7257831 - DNA, 22 bp, Homo sapiens
gaggtgggtgtatcacaggtca

SEQ ID NO: 7257832 - DNA, 19 bp, Homo sapiens
gaggtgggtccccgcagcc

SEQ ID NO: 7257833 - DNA, 19 bp, Homo sapiens
gaggtgggtccccgcagcc

SEQ ID NO: 7257834 - DNA, 22 bp, Homo sapiens
gaggtggggttttgttcttgaa

SEQ ID NO: 7257835 - DNA, 22 bp, Homo sapiens
gagtcctcaacggggagaggcg

SEQ ID NO: 7257836 - DNA, 22 bp, Homo sapiens
gagtcctcagatagaaagtgcg

SEQ ID NO: 7257837 - DNA, 22 bp, Homo sapiens
gagtccaccacagctcaaagag

SEQ ID NO: 7257838 - DNA, 22 bp, Homo sapiens
gagtcaggctagaggtgagtct

SEQ ID NO: 7257839 - DNA, 22 bp, Homo sapiens
gagtcaggctagggtgacaggc

SEQ ID NO: 7257840 - DNA, 22 bp, Homo sapiens
gaggggcgtcctgagtgggcct

SEQ ID NO: 7257841 - DNA, 22 bp, Homo sapiens
gaggggcgtcctgagtgggcct

SEQ ID NO: 7257842 - DNA, 22 bp, Homo sapiens
gaggggccggcatgtgcctctc

SEQ ID NO: 7257843 - DNA, 22 bp, Homo sapiens
gaggggcagttgattgtgctat

SEQ ID NO: 7257844 - DNA, 22 bp, Homo sapiens
gaggggcctggcgaggacatgt

SEQ ID NO: 7257845 - DNA, 22 bp, Homo sapiens
gaggggcctggcgaggacatgt

SEQ ID NO: 7257846 - DNA, 22 bp, Homo sapiens
gaggtaacactgttcagtgggc

SEQ ID NO: 7257847 - DNA, 22 bp, Homo sapiens
gaggtaggtgtaggaggcctgc

SEQ ID NO: 7257848 - DNA, 22 bp, Homo sapiens
gaggtgggatgtgtgtgctact

SEQ ID NO: 7257849 - DNA, 22 bp, Homo sapiens
gaggtgggcggatcacaaggtc

SEQ ID NO: 7257850 - DNA, 22 bp, Homo sapiens
gaggtgggcggatcacaaggtc

SEQ ID NO: 7257851 - DNA, 22 bp, Homo sapiens
gaggtgggagggcagtccctaa

SEQ ID NO: 7257852 - DNA, 22 bp, Homo sapiens
gagggccaactagcaccacttt

SEQ ID NO: 7257853 - DNA, 22 bp, Homo sapiens
gagggccaatgtgtccctgagc

SEQ ID NO: 7257854 - DNA, 22 bp, Homo sapiens
gaggggaaagtgtgaggctgcg

SEQ ID NO: 7257855 - DNA, 22 bp, Homo sapiens
gaggggaaagttctgcacaagg

SEQ ID NO: 7257856 - DNA, 22 bp, Homo sapiens
gaggggaagacttctggacagt

SEQ ID NO: 7257857 - DNA, 22 bp, Homo sapiens
gaggggagtgtcctccgggccc

SEQ ID NO: 7257858 - DNA, 22 bp, Homo sapiens
gaggggagtgtcctccgggccc

SEQ ID NO: 7257859 - DNA, 22 bp, Homo sapiens
gaggggagtaaagtcatgttac

SEQ ID NO: 7257860 - DNA, 22 bp, Homo sapiens
gaggggagtgtcctccgggccc

SEQ ID NO: 7257861 - DNA, 22 bp, Homo sapiens
gaggggcaatgagggaaagagt

SEQ ID NO: 7257862 - DNA, 22 bp, Homo sapiens
gaggggcagtgcacccgggccc

SEQ ID NO: 7257863 - DNA, 22 bp, Homo sapiens
gaggggcagaggtagagaacaa

SEQ ID NO: 7257864 - DNA, 22 bp, Homo sapiens
gaggggcacagcagctgttgca

SEQ ID NO: 7257865 - DNA, 22 bp, Homo sapiens
gaggggcacagtaaagggtccc

SEQ ID NO: 7257866 - DNA, 22 bp, Homo sapiens
gaggggcagaatgtgatcaggg

SEQ ID NO: 7257867 - DNA, 22 bp, Homo sapiens
gaggggcacagtaaagggtccc

SEQ ID NO: 7257868 - DNA, 16 bp, Homo sapiens
gagggcagaggcggaa

SEQ ID NO: 7257869 - DNA, 16 bp, Homo sapiens
gagggcagaggcggaa

SEQ ID NO: 7257870 - DNA, 22 bp, Homo sapiens
gagggatgcagaaacagaggcc

SEQ ID NO: 7257871 - DNA, 22 bp, Homo sapiens
gagggatgcagaaacagaggcc

SEQ ID NO: 7257872 - DNA, 22 bp, Homo sapiens
gaggctgggggctgccttcctc

SEQ ID NO: 7257873 - DNA, 22 bp, Homo sapiens
gaggctgggaagtccaagacca

SEQ ID NO: 7257874 - DNA, 22 bp, Homo sapiens
gaggctgggaagtccaagatca

SEQ ID NO: 7257875 - DNA, 22 bp, Homo sapiens
gaggctggaggtcaaagatgaa

SEQ ID NO: 7257876 - DNA, 22 bp, Homo sapiens
gaggctggaggtcaaagatgaa

SEQ ID NO: 7257877 - DNA, 22 bp, Homo sapiens
gaggctggcagaaaagcacagg

SEQ ID NO: 7257878 - DNA, 22 bp, Homo sapiens
gaggctgcccaactggagtgga

SEQ ID NO: 7257879 - DNA, 22 bp, Homo sapiens
gaggctgcccacacctgcgccg

SEQ ID NO: 7257880 - DNA, 22 bp, Homo sapiens
gaggctgcccacacctgcgccg

SEQ ID NO: 7257881 - DNA, 22 bp, Homo sapiens
gagataaatttttgataaatat

SEQ ID NO: 7257882 - DNA, 22 bp, Homo sapiens
gagatacagttggctgcaggct

SEQ ID NO: 7257883 - DNA, 22 bp, Homo sapiens
gagatatgttggcagctggtat

SEQ ID NO: 7257884 - DNA, 22 bp, Homo sapiens
gagagtctagtgcacctagttt

SEQ ID NO: 7257885 - DNA, 22 bp, Homo sapiens
gagagtctagtgcacctagttt

SEQ ID NO: 7257886 - DNA, 22 bp, Homo sapiens
gagagtgagatcctcctgggga

SEQ ID NO: 7257887 - DNA, 22 bp, Homo sapiens
gagagtgaggcatcaggggcag

SEQ ID NO: 7257888 - DNA, 22 bp, Homo sapiens
gagagtgaggcctgggaatcta

SEQ ID NO: 7257889 - DNA, 22 bp, Homo sapiens
gagagtggatggagctgcgaag

SEQ ID NO: 7257890 - DNA, 22 bp, Homo sapiens
gagagtggatggagctgcgaag

SEQ ID NO: 7257891 - DNA, 22 bp, Homo sapiens
gagctgggaagatagcttgagc

SEQ ID NO: 7257892 - DNA, 22 bp, Homo sapiens
gagctgggacatgggtcctctc

SEQ ID NO: 7257893 - DNA, 22 bp, Homo sapiens
gagatccataagtgatagaaat

SEQ ID NO: 7257894 - DNA, 22 bp, Homo sapiens
gagctgggagttatagcatgtt

SEQ ID NO: 7257895 - DNA, 23 bp, Homo sapiens
gagctgggatacaggcttactgc

SEQ ID NO: 7257896 - DNA, 22 bp, Homo sapiens
gaggaagggctgcctgccgggc

SEQ ID NO: 7257897 - DNA, 22 bp, Homo sapiens
gaggaagggctgcctgccgggc

SEQ ID NO: 7257898 - DNA, 22 bp, Homo sapiens
gagctgggagttatagcatgtt

SEQ ID NO: 7257899 - DNA, 22 bp, Homo sapiens
gagctgggaggactgggaactt

SEQ ID NO: 7257900 - DNA, 22 bp, Homo sapiens
gaggacagagccgcctggcaag

SEQ ID NO: 7257901 - DNA, 22 bp, Homo sapiens
gaggacagagccgcctggcaag

SEQ ID NO: 7257902 - DNA, 22 bp, Homo sapiens
gaggacagcttagggcttcctg

SEQ ID NO: 7257903 - DNA, 22 bp, Homo sapiens
gaggacagcttagggcttcctg

SEQ ID NO: 7257904 - DNA, 22 bp, Homo sapiens
gaggacagctctaactaaagtc

SEQ ID NO: 7257905 - DNA, 22 bp, Homo sapiens
gaggccctgaagacagctgggg

SEQ ID NO: 7257906 - DNA, 22 bp, Homo sapiens
gaggcccagtcctgcaagcacg

SEQ ID NO: 7257907 - DNA, 22 bp, Homo sapiens
gaggcctgaggctgcctggagc

SEQ ID NO: 7257908 - DNA, 22 bp, Homo sapiens
gaggcctcatgaggtgagcatt

SEQ ID NO: 7257909 - DNA, 22 bp, Homo sapiens
gaggcctcaggcgtgggaaggg

SEQ ID NO: 7257910 - DNA, 22 bp, Homo sapiens
gaggcctcagcctgccctgaac

SEQ ID NO: 7257911 - DNA, 22 bp, Homo sapiens
gaggcctcaggaatgtcgtgtg

SEQ ID NO: 7257912 - DNA, 22 bp, Homo sapiens
gaggcctctgtcccaccaggga

SEQ ID NO: 7257913 - DNA, 22 bp, Homo sapiens
gaggcctctgtcccgccaggga

SEQ ID NO: 7257914 - DNA, 22 bp, Homo sapiens
gaggcagcaggctgaggaggat

SEQ ID NO: 7257915 - DNA, 22 bp, Homo sapiens
gaggcagcgggtcaggaccgtg

SEQ ID NO: 7257916 - DNA, 22 bp, Homo sapiens
gaggcagcaggctgaggaggat

SEQ ID NO: 7257917 - DNA, 22 bp, Homo sapiens
gaggcagctgaaggagtgacag

SEQ ID NO: 7257918 - DNA, 22 bp, Homo sapiens
gaggcagctgggctggtggttt

SEQ ID NO: 7257919 - DNA, 22 bp, Homo sapiens
gaggcccagcagcgcaggtctt

SEQ ID NO: 7257920 - DNA, 22 bp, Homo sapiens
gaggaggctgaacaatgccctg

SEQ ID NO: 7257921 - DNA, 22 bp, Homo sapiens
gaggaggctggcgccgcctgcc

SEQ ID NO: 7257922 - DNA, 22 bp, Homo sapiens
gaggagggagaattaggcttaa

SEQ ID NO: 7257923 - DNA, 22 bp, Homo sapiens
gaggaggcttccgggaggcacg

SEQ ID NO: 7257924 - DNA, 22 bp, Homo sapiens
gaggagggagctggaagctctt

SEQ ID NO: 7257925 - DNA, 23 bp, Homo sapiens
gaggagggtctgacaagtgtagc

SEQ ID NO: 7257926 - DNA, 22 bp, Homo sapiens
gaggcagcagaacatggaagag

SEQ ID NO: 7257927 - DNA, 22 bp, Homo sapiens
gaggagggttggccttaggtag

SEQ ID NO: 7257928 - DNA, 22 bp, Homo sapiens
gagtgtggtgaacaggagcacc

SEQ ID NO: 7257929 - DNA, 22 bp, Homo sapiens
gagtgtctgtggggcatggaca

SEQ ID NO: 7257930 - DNA, 22 bp, Homo sapiens
gagtgttttactcaaagaaaga

SEQ ID NO: 7257931 - DNA, 22 bp, Homo sapiens
gagtgtggtgaacaggagcacc

SEQ ID NO: 7257932 - DNA, 22 bp, Homo sapiens
gagtgtggtgaacaggagcacc

SEQ ID NO: 7257933 - DNA, 22 bp, Homo sapiens
gagtgtctgaattagagcacaa

SEQ ID NO: 7257934 - DNA, 22 bp, Homo sapiens
gagtggggtctgggcatcagtc

SEQ ID NO: 7257935 - DNA, 22 bp, Homo sapiens
gagtggggggtccgtctcagtg

SEQ ID NO: 7257936 - DNA, 22 bp, Homo sapiens
gagtggggtctgggcatcagtc

SEQ ID NO: 7257937 - DNA, 22 bp, Homo sapiens
gagtggggggtccgtctcagtg

SEQ ID NO: 7257938 - DNA, 22 bp, Homo sapiens
gataaagtagatttgttctaga

SEQ ID NO: 7257939 - DNA, 22 bp, Homo sapiens
gataaagcaaggatgactgaag

SEQ ID NO: 7257940 - DNA, 22 bp, Homo sapiens
gataaagcaggtaggagaagat

SEQ ID NO: 7257941 - DNA, 22 bp, Homo sapiens
gataaacattcttgcacatgtg

SEQ ID NO: 7257942 - DNA, 22 bp, Homo sapiens
gataaacactgatgatatgggg

SEQ ID NO: 7257943 - DNA, 22 bp, Homo sapiens
gataaacactgatgatatgggg

SEQ ID NO: 7257944 - DNA, 22 bp, Homo sapiens
gataaacacaaggtgatttcat

SEQ ID NO: 7257945 - DNA, 22 bp, Homo sapiens
gagtttcttcatggtgcagagg

SEQ ID NO: 7257946 - DNA, 22 bp, Homo sapiens
gagtttcttaacaggtggaagc

SEQ ID NO: 7257947 - DNA, 22 bp, Homo sapiens
gagtttctgctctaggtctggt

SEQ ID NO: 7257948 - DNA, 22 bp, Homo sapiens
gagtttctgatttagtaggtct

SEQ ID NO: 7257949 - DNA, 22 bp, Homo sapiens
gagtttctgattcagtctgtgt

SEQ ID NO: 7257950 - DNA, 22 bp, Homo sapiens
gagtttctaggatggaggtgag

SEQ ID NO: 7257951 - DNA, 22 bp, Homo sapiens
gagtttctccagtgctagttgt

SEQ ID NO: 7257952 - DNA, 22 bp, Homo sapiens
gagtttatttgactggattctc

SEQ ID NO: 7257953 - DNA, 22 bp, Homo sapiens
gagtttattgtcttccaggctt

SEQ ID NO: 7257954 - DNA, 23 bp, Homo sapiens
gagtttcttccaggagccctggg

SEQ ID NO: 7257955 - DNA, 22 bp, Homo sapiens
gagtttaaagcatacatatttt

SEQ ID NO: 7257956 - DNA, 22 bp, Homo sapiens
gagtttaaaacgcttgtattta

SEQ ID NO: 7257957 - DNA, 22 bp, Homo sapiens
gagtttaaaaagcctggtttgt

SEQ ID NO: 7257958 - DNA, 22 bp, Homo sapiens
gagtttaatcattgttctatcc

SEQ ID NO: 7257959 - DNA, 22 bp, Homo sapiens
gagtttattcaggaaatagcca

SEQ ID NO: 7257960 - DNA, 22 bp, Homo sapiens
gagtttatgtctttcattgttc

SEQ ID NO: 7257961 - DNA, 19 bp, Homo sapiens
gagtttatctcctagccct

SEQ ID NO: 7257962 - DNA, 22 bp, Homo sapiens
gagtcgagcagaaagccgtcgg

SEQ ID NO: 7257963 - DNA, 22 bp, Homo sapiens
gagtccttttcatagcagtggg

SEQ ID NO: 7257964 - DNA, 22 bp, Homo sapiens
gagtccttggcatcatcagtac

SEQ ID NO: 7257965 - DNA, 22 bp, Homo sapiens
gagtccttgtcataattcagtg

SEQ ID NO: 7257966 - DNA, 22 bp, Homo sapiens
gagtccttgacacatagtaggt

SEQ ID NO: 7257967 - DNA, 22 bp, Homo sapiens
gagtccttctggctggcaggat

SEQ ID NO: 7257968 - DNA, 22 bp, Homo sapiens
gagtctggtcattttctctccc

SEQ ID NO: 7257969 - DNA, 22 bp, Homo sapiens
gagtgagtggccaggaggcaga

SEQ ID NO: 7257970 - DNA, 22 bp, Homo sapiens
gagtgagtgctgggctgaggct

SEQ ID NO: 7257971 - DNA, 22 bp, Homo sapiens
gagtgagggccaacatccagct

SEQ ID NO: 7257972 - DNA, 22 bp, Homo sapiens
gagtgagggcagcaggggctgc

SEQ ID NO: 7257973 - DNA, 22 bp, Homo sapiens
gagtgaggctggaatcatggct

SEQ ID NO: 7257974 - DNA, 22 bp, Homo sapiens
gagtgagggcagcaggggctgc

SEQ ID NO: 7257975 - DNA, 22 bp, Homo sapiens
gagtgctggaggtgtgagtggg

SEQ ID NO: 7257976 - DNA, 22 bp, Homo sapiens
gagtgctgcttgggatagtgag

SEQ ID NO: 7257977 - DNA, 22 bp, Homo sapiens
gagtgctggggtgcagagaggt

SEQ ID NO: 7257978 - DNA, 17 bp, Homo sapiens
gagtgctggtggagctc

SEQ ID NO: 7257979 - DNA, 22 bp, Homo sapiens
gagtgctgtaggactgagccct

SEQ ID NO: 7257980 - DNA, 22 bp, Homo sapiens
gagtgctcgggtgtcccgcggg

SEQ ID NO: 7257981 - DNA, 22 bp, Homo sapiens
gagtgcagttggggtgagggga

SEQ ID NO: 7257982 - DNA, 23 bp, Homo sapiens
gagtgcagaatagacatgcagtg

SEQ ID NO: 7257983 - DNA, 22 bp, Homo sapiens
gagtgcagtatgagaggctgct

SEQ ID NO: 7257984 - DNA, 22 bp, Homo sapiens
gagtgcagtatgagaggctgct

SEQ ID NO: 7257985 - DNA, 21 bp, Homo sapiens
gagtggaacgctcttcacacc

SEQ ID NO: 7257986 - DNA, 22 bp, Homo sapiens
gagtggagatcgtgccactgca

SEQ ID NO: 7257987 - DNA, 21 bp, Homo sapiens
gagtggaacgctcttcacacc

SEQ ID NO: 7257988 - DNA, 22 bp, Homo sapiens
gagtggagatcgtgccactgca

SEQ ID NO: 7257989 - DNA, 22 bp, Homo sapiens
gagtggagcaaaagaggtagat

SEQ ID NO: 7257990 - DNA, 22 bp, Homo sapiens
gagtggagcaaaagaggtagat

SEQ ID NO: 7257991 - DNA, 22 bp, Homo sapiens
gagtgggcaaaagaaagtaggc

SEQ ID NO: 7257992 - DNA, 21 bp, Homo sapiens
gagtgggacatgggagtggtt

SEQ ID NO: 7257993 - DNA, 22 bp, Homo sapiens
gagtgggcaccgtgggcacact

SEQ ID NO: 7257994 - DNA, 22 bp, Homo sapiens
gatgaaatttgggcaggttaaa

SEQ ID NO: 7257995 - DNA, 22 bp, Homo sapiens
gatgagctgctcaatctgtggt

SEQ ID NO: 7257996 - DNA, 22 bp, Homo sapiens
gatgagctgtgtgtgagggtca

SEQ ID NO: 7257997 - DNA, 22 bp, Homo sapiens
gatgacatgatggacactcagt

SEQ ID NO: 7257998 - DNA, 20 bp, Homo sapiens
gatgaaatcactgggcagcc

SEQ ID NO: 7257999 - DNA, 22 bp, Homo sapiens
gatgaaatagcaaaggcatttg

SEQ ID NO: 7258000 - DNA, 22 bp, Homo sapiens
gatgaaatagcaaaggcatttg

SEQ ID NO: 7258001 - DNA, 17 bp, Homo sapiens
gatgaaatgatgcacac

SEQ ID NO: 7258002 - DNA, 22 bp, Homo sapiens
gatgaaatccagatcacaggtg

SEQ ID NO: 7258003 - DNA, 22 bp, Homo sapiens
gatgaaatttgaaaatagtgtt

SEQ ID NO: 7258004 - DNA, 22 bp, Homo sapiens
gatgaaattgttttgatacttt

SEQ ID NO: 7258005 - DNA, 22 bp, Homo sapiens
gatgaaattcagaattgagggg

SEQ ID NO: 7258006 - DNA, 22 bp, Homo sapiens
gatgaaatgctgagcctgagtt

SEQ ID NO: 7258007 - DNA, 22 bp, Homo sapiens
gatgaaatgtgaaagttctggg

SEQ ID NO: 7258008 - DNA, 22 bp, Homo sapiens
gatgaaatagaattaatttagg

SEQ ID NO: 7258009 - DNA, 22 bp, Homo sapiens
gatcttttcagaatttatcagt

SEQ ID NO: 7258010 - DNA, 22 bp, Homo sapiens
gatcttttcagtcttggtagtt

SEQ ID NO: 7258011 - DNA, 22 bp, Homo sapiens
gatcttttcaggtttctctagt

SEQ ID NO: 7258012 - DNA, 22 bp, Homo sapiens
gatccagatatttgggctggta

SEQ ID NO: 7258013 - DNA, 22 bp, Homo sapiens
gatacattccatttctacttaa

SEQ ID NO: 7258014 - DNA, 22 bp, Homo sapiens
gataataagcacagcaggatgt

SEQ ID NO: 7258015 - DNA, 22 bp, Homo sapiens
gataactgaacagattcacaaa

SEQ ID NO: 7258016 - DNA, 22 bp, Homo sapiens
gatagtcacctcccttaacttt

SEQ ID NO: 7258017 - DNA, 22 bp, Homo sapiens
gatagaaagaatatagattcca

SEQ ID NO: 7258018 - DNA, 22 bp, Homo sapiens
gatactcttcaggtcttgcaga

SEQ ID NO: 7258019 - DNA, 22 bp, Homo sapiens
gatagaaaggtgttgaaatcca

SEQ ID NO: 7258020 - DNA, 22 bp, Homo sapiens
gatcaaagcctagttccaagat

SEQ ID NO: 7258021 - DNA, 22 bp, Homo sapiens
gatatttttgcagacacctggg

SEQ ID NO: 7258022 - DNA, 22 bp, Homo sapiens
gatcacagtattttagatgtgt

SEQ ID NO: 7258023 - DNA, 22 bp, Homo sapiens
gatatttttaggtgatgcaggc

SEQ ID NO: 7258024 - DNA, 22 bp, Homo sapiens
gatatttttaggtgatgcaggc

SEQ ID NO: 7258025 - DNA, 22 bp, Homo sapiens
gatattttgagaaatcctatga

SEQ ID NO: 7258026 - DNA, 22 bp, Homo sapiens
gatattttgagaaatcctatga

SEQ ID NO: 7258027 - DNA, 22 bp, Homo sapiens
gatattttcagtctcctttcaa

SEQ ID NO: 7258028 - DNA, 22 bp, Homo sapiens
gaacccagtccaggtgcagcct

SEQ ID NO: 7258029 - DNA, 22 bp, Homo sapiens
gaacccaggaggttgcagtgag

SEQ ID NO: 7258030 - DNA, 23 bp, Homo sapiens
gaacccagctctgccacttgcca

SEQ ID NO: 7258031 - DNA, 22 bp, Homo sapiens
gaacccagccagactccctaca

SEQ ID NO: 7258032 - DNA, 19 bp, Homo sapiens
gaactctgcagactgggaa

SEQ ID NO: 7258033 - DNA, 22 bp, Homo sapiens
gaacctttttccaagtaaacaa

SEQ ID NO: 7258034 - DNA, 22 bp, Homo sapiens
gaaattgtgcatttagcaacac

SEQ ID NO: 7258035 - DNA, 22 bp, Homo sapiens
gaaataagagtccatgccaggt

SEQ ID NO: 7258036 - DNA, 22 bp, Homo sapiens
gaaagttgcaatcatggctttt

SEQ ID NO: 7258037 - DNA, 22 bp, Homo sapiens
gaaagggagtggacaacaggca

SEQ ID NO: 7258038 - DNA, 22 bp, Homo sapiens
gaaaggggcatgtagggatcac

SEQ ID NO: 7258039 - DNA, 22 bp, Homo sapiens
gaaaggggcatgtagggatcac

SEQ ID NO: 7258040 - DNA, 22 bp, Homo sapiens
gaaaggttgggtgaatggtgga

SEQ ID NO: 7258041 - DNA, 22 bp, Homo sapiens
gaaagggagtgaagatggtata

SEQ ID NO: 7258042 - DNA, 22 bp, Homo sapiens
gaaaagggcaagagagagggca

SEQ ID NO: 7258043 - DNA, 22 bp, Homo sapiens
ctttgttactgatttcagtggg

SEQ ID NO: 7258044 - DNA, 22 bp, Homo sapiens
ctttgtctcctaagaactctca

SEQ ID NO: 7258045 - DNA, 22 bp, Homo sapiens
cttgggatgtaacctttgttcc

SEQ ID NO: 7258046 - DNA, 22 bp, Homo sapiens
cttgggccagcccagggggcat

SEQ ID NO: 7258047 - DNA, 22 bp, Homo sapiens
cttgggctcagcaccgtgtgga

SEQ ID NO: 7258048 - DNA, 22 bp, Homo sapiens
cttgaagttgcaaaacattaat

SEQ ID NO: 7258049 - DNA, 22 bp, Homo sapiens
cttgaagattgatccagtttga

SEQ ID NO: 7258050 - DNA, 22 bp, Homo sapiens
cttgaagagtgggaaggatttg

SEQ ID NO: 7258051 - DNA, 22 bp, Homo sapiens
cttgaagacaatggcagattcc

SEQ ID NO: 7258052 - DNA, 22 bp, Homo sapiens
cttgaagagtaaattggtacac

SEQ ID NO: 7258053 - DNA, 22 bp, Homo sapiens
cttggcaccaccaagtggccat

SEQ ID NO: 7258054 - DNA, 22 bp, Homo sapiens
cttggcacgtgataggtgttga

SEQ ID NO: 7258055 - DNA, 22 bp, Homo sapiens
cttggcttttgctcccagatca

SEQ ID NO: 7258056 - DNA, 22 bp, Homo sapiens
ctttagatttctatgtatcact

SEQ ID NO: 7258057 - DNA, 22 bp, Homo sapiens
ctttagtttgtaagagcaagag

SEQ ID NO: 7258058 - DNA, 22 bp, Homo sapiens
ctttgtagctgcttctgattta

SEQ ID NO: 7258059 - DNA, 22 bp, Homo sapiens
ctttgtagtcaaactgatacat

SEQ ID NO: 7258060 - DNA, 22 bp, Homo sapiens
ctttgtcattttgtctctcagt

SEQ ID NO: 7258061 - DNA, 22 bp, Homo sapiens
ctttatgaacctgttcagcttg

SEQ ID NO: 7258062 - DNA, 22 bp, Homo sapiens
ctttatgaaaacctgaattatg

SEQ ID NO: 7258063 - DNA, 22 bp, Homo sapiens
ctttatgaaggaacaatgctcc

SEQ ID NO: 7258064 - DNA, 22 bp, Homo sapiens
ctttatgactgagttgtcaatt

SEQ ID NO: 7258065 - DNA, 22 bp, Homo sapiens
ctttatgagccttgtgaaggag

SEQ ID NO: 7258066 - DNA, 22 bp, Homo sapiens
ctttggcagacattaggggtga

SEQ ID NO: 7258067 - DNA, 22 bp, Homo sapiens
ctttatatattcccaggctgcc

SEQ ID NO: 7258068 - DNA, 22 bp, Homo sapiens
ctttatatccagatgtttggtg

SEQ ID NO: 7258069 - DNA, 22 bp, Homo sapiens
ctttatgaaaaccagattgggg

SEQ ID NO: 7258070 - DNA, 22 bp, Homo sapiens
ctggctggaggtgagtcactga

SEQ ID NO: 7258071 - DNA, 22 bp, Homo sapiens
ctggctggtcctcggggacagc

SEQ ID NO: 7258072 - DNA, 22 bp, Homo sapiens
cttctcagtcttggttagagag

SEQ ID NO: 7258073 - DNA, 22 bp, Homo sapiens
ctggctggttccctgctccagg

SEQ ID NO: 7258074 - DNA, 22 bp, Homo sapiens
cttctcttgggtgtggtgtctt

SEQ ID NO: 7258075 - DNA, 17 bp, Homo sapiens
cttctctggcagaagat

SEQ ID NO: 7258076 - DNA, 22 bp, Homo sapiens
cttcttttgaagggcgttgtgt

SEQ ID NO: 7258077 - DNA, 22 bp, Homo sapiens
cttgaagaaatggagacaggat

SEQ ID NO: 7258078 - DNA, 22 bp, Homo sapiens
cttgaagaaagtatgttgggat

SEQ ID NO: 7258079 - DNA, 18 bp, Homo sapiens
cttgaagaattttgcagt

SEQ ID NO: 7258080 - DNA, 22 bp, Homo sapiens
cttcttttacaggtcttgggtt

SEQ ID NO: 7258081 - DNA, 22 bp, Homo sapiens
cttcttttcatggcttgggaag

SEQ ID NO: 7258082 - DNA, 22 bp, Homo sapiens
cttctttgaaaaaggcagtcag

SEQ ID NO: 7258083 - DNA, 21 bp, Homo sapiens
gacaggactagaccagagctc

SEQ ID NO: 7258084 - DNA, 22 bp, Homo sapiens
gacaggaacataaatgtaggag

SEQ ID NO: 7258085 - DNA, 19 bp, Homo sapiens
gacaggaaggctaccagta

SEQ ID NO: 7258086 - DNA, 22 bp, Homo sapiens
gacacagcttgatgagggcttt

SEQ ID NO: 7258087 - DNA, 22 bp, Homo sapiens
gacacagcactgtacaaggaat

SEQ ID NO: 7258088 - DNA, 22 bp, Homo sapiens
gacacagatatctctgagatta

SEQ ID NO: 7258089 - DNA, 22 bp, Homo sapiens
gaattctaaccattaagccaag

SEQ ID NO: 7258090 - DNA, 21 bp, Homo sapiens
gaattgtgccccttggtgttg

SEQ ID NO: 7258091 - DNA, 22 bp, Homo sapiens
gaattcagttatctaattcaag

SEQ ID NO: 7258092 - DNA, 22 bp, Homo sapiens
gaattacatttgtgttactgca

SEQ ID NO: 7258093 - DNA, 22 bp, Homo sapiens
gaattacatgaccctgagtaga

SEQ ID NO: 7258094 - DNA, 22 bp, Homo sapiens
gaattagtgttgaaatcagggc

SEQ ID NO: 7258095 - DNA, 22 bp, Homo sapiens
gaaggaagtcattagtgcagac

SEQ ID NO: 7258096 - DNA, 20 bp, Homo sapiens
gaaggaagggggcaaggtga

SEQ ID NO: 7258097 - DNA, 22 bp, Homo sapiens
gaaggacccacgaagtcactgg

SEQ ID NO: 7258098 - DNA, 22 bp, Homo sapiens
gaaggaccctctggggtctcag

SEQ ID NO: 7258099 - DNA, 22 bp, Homo sapiens
gaaggacctgtccgtggtgctg

SEQ ID NO: 7258100 - DNA, 21 bp, Homo sapiens
gaaggagaaagcaagtgctgc

SEQ ID NO: 7258101 - DNA, 22 bp, Homo sapiens
gaaggaagctgtctggatgtgt

SEQ ID NO: 7258102 - DNA, 22 bp, Homo sapiens
gaaggagaggattgtgaggctg

SEQ ID NO: 7258103 - DNA, 22 bp, Homo sapiens
gaaggcctaggaaggaagcctt

SEQ ID NO: 7258104 - DNA, 22 bp, Homo sapiens
gaaggagagggtcaaggataat

SEQ ID NO: 7258105 - DNA, 22 bp, Homo sapiens
gaaggagagggtcaaggataat

SEQ ID NO: 7258106 - DNA, 22 bp, Homo sapiens
gaaggagagggtcaaggataat

SEQ ID NO: 7258107 - DNA, 22 bp, Homo sapiens
gaaggctaaaggggcagaggtt

SEQ ID NO: 7258108 - DNA, 19 bp, Homo sapiens
gaaggctgaaatgaagcac

SEQ ID NO: 7258109 - DNA, 22 bp, Homo sapiens
gaaggctgagcagacaggccaa

SEQ ID NO: 7258110 - DNA, 22 bp, Homo sapiens
gaaggctgagtgggtacggagg

SEQ ID NO: 7258111 - DNA, 22 bp, Homo sapiens
gaaggctgcgaggggagtgccg

SEQ ID NO: 7258112 - DNA, 22 bp, Homo sapiens
gaagtacaaaggacatggaaac

SEQ ID NO: 7258113 - DNA, 18 bp, Homo sapiens
gaagtgaagtgactcaat

SEQ ID NO: 7258114 - DNA, 22 bp, Homo sapiens
gaagtgaaggttactctagatt

SEQ ID NO: 7258115 - DNA, 22 bp, Homo sapiens
gaagtgaagagattagaaatca

SEQ ID NO: 7258116 - DNA, 22 bp, Homo sapiens
gaagtggaagccatcggcagtc

SEQ ID NO: 7258117 - DNA, 22 bp, Homo sapiens
gaagtggaattactgggtcata

SEQ ID NO: 7258118 - DNA, 22 bp, Homo sapiens
gaagtggaagccatcggcagtc

SEQ ID NO: 7258119 - DNA, 22 bp, Homo sapiens
gaagtggaattactgggtcata

SEQ ID NO: 7258120 - DNA, 22 bp, Homo sapiens
gacccagggtttctgcacaggg

SEQ ID NO: 7258121 - DNA, 22 bp, Homo sapiens
gactggggtaaggtgaggaggt

SEQ ID NO: 7258122 - DNA, 22 bp, Homo sapiens
gactgtggggggcggacacaag

SEQ ID NO: 7258123 - DNA, 22 bp, Homo sapiens
gactgtggggaagcagatgcca

SEQ ID NO: 7258124 - DNA, 22 bp, Homo sapiens
gactgtggccttggaccatggg

SEQ ID NO: 7258125 - DNA, 22 bp, Homo sapiens
gactgtggcaggctcagcactg

SEQ ID NO: 7258126 - DNA, 22 bp, Homo sapiens
gactgtggatagaacactgcag

SEQ ID NO: 7258127 - DNA, 22 bp, Homo sapiens
gactgtggactctcatgataga

SEQ ID NO: 7258128 - DNA, 22 bp, Homo sapiens
gacccaggaagctacttctggt

SEQ ID NO: 7258129 - DNA, 22 bp, Homo sapiens
gaccatttccaccatgggcaca

SEQ ID NO: 7258130 - DNA, 22 bp, Homo sapiens
gaccatttcaggggcagggact

SEQ ID NO: 7258131 - DNA, 22 bp, Homo sapiens
gacccagaggcctgacagtgtg

SEQ ID NO: 7258132 - DNA, 22 bp, Homo sapiens
gacccacctcaccaagcatgtg

SEQ ID NO: 7258133 - DNA, 22 bp, Homo sapiens
gacaggaggcagagctcaggtg

SEQ ID NO: 7258134 - DNA, 22 bp, Homo sapiens
gacaggcaggccagggctgtgg

SEQ ID NO: 7258135 - DNA, 17 bp, Homo sapiens
gagagtctaatgggaga

SEQ ID NO: 7258136 - DNA, 22 bp, Homo sapiens
gagagtctaggaacctcatata

SEQ ID NO: 7258137 - DNA, 22 bp, Homo sapiens
gagagctgggggactgtggatg

SEQ ID NO: 7258138 - DNA, 20 bp, Homo sapiens
gagagctggggatgaggctg

SEQ ID NO: 7258139 - DNA, 22 bp, Homo sapiens
gagagctgatagatgagctact

SEQ ID NO: 7258140 - DNA, 22 bp, Homo sapiens
gagacacaagaagacatgcaca

SEQ ID NO: 7258141 - DNA, 22 bp, Homo sapiens
gagacacagttatcaggcatac

SEQ ID NO: 7258142 - DNA, 22 bp, Homo sapiens
gacttttagaatggtgaggaat

SEQ ID NO: 7258143 - DNA, 22 bp, Homo sapiens
gagaaaatcttgggtcaagaat

SEQ ID NO: 7258144 - DNA, 22 bp, Homo sapiens
gagaaaatagcatgtgtagtat

SEQ ID NO: 7258145 - DNA, 22 bp, Homo sapiens
gagaaaatgtcagacttggtcg

SEQ ID NO: 7258146 - DNA, 22 bp, Homo sapiens
ttcattctgcagttctcagctc

SEQ ID NO: 7258147 - DNA, 20 bp, Homo sapiens
ttcattcattccacaacttc

SEQ ID NO: 7258148 - DNA, 21 bp, Homo sapiens
cggctcagtgcctgctccttc

SEQ ID NO: 7258149 - DNA, 22 bp, Homo sapiens
cggctctgtcctcagcactgct

SEQ ID NO: 7258150 - DNA, 22 bp, Homo sapiens
cggctgagacggccatagacac

SEQ ID NO: 7258151 - DNA, 22 bp, Homo sapiens
cggctgagcagtgctgatggaa

SEQ ID NO: 7258152 - DNA, 22 bp, Homo sapiens
cggctgaggatctccaggcctg

SEQ ID NO: 7258153 - DNA, 22 bp, Homo sapiens
cggctggggctgtccccatgac

SEQ ID NO: 7258154 - DNA, 22 bp, Homo sapiens
cggctgggtagaggtgccgggt

SEQ ID NO: 7258155 - DNA, 22 bp, Homo sapiens
cggctggggctgtccccatgac

SEQ ID NO: 7258156 - DNA, 22 bp, Homo sapiens
cggctcaggccacaggacggca

SEQ ID NO: 7258157 - DNA, 22 bp, Homo sapiens
cggacaggctcctggagctcct

SEQ ID NO: 7258158 - DNA, 21 bp, Homo sapiens
cggaaaggactagggctcaga

SEQ ID NO: 7258159 - DNA, 22 bp, Homo sapiens
cgctgggggaacttcagccaat

SEQ ID NO: 7258160 - DNA, 22 bp, Homo sapiens
cgctgggcgccgacctgctggc

SEQ ID NO: 7258161 - DNA, 22 bp, Homo sapiens
cgctgggcatggtgccttattt

SEQ ID NO: 7258162 - DNA, 22 bp, Homo sapiens
ttcacattacaaggccatattt

SEQ ID NO: 7258163 - DNA, 22 bp, Homo sapiens
cgctgggcgcgctccgaacccg

SEQ ID NO: 7258164 - DNA, 22 bp, Homo sapiens
cgctggggctttttgcttgaga

SEQ ID NO: 7258165 - DNA, 22 bp, Homo sapiens
cgctgggggaacagcgagggtg

SEQ ID NO: 7258166 - DNA, 22 bp, Homo sapiens
ttcacataaatagatcacatca

SEQ ID NO: 7258167 - DNA, 22 bp, Homo sapiens
cctgggtggttccggcaaggag

SEQ ID NO: 7258168 - DNA, 22 bp, Homo sapiens
ttcccacagtcactgggagaag

SEQ ID NO: 7258169 - DNA, 22 bp, Homo sapiens
ttcccacaggatgagagctgag

SEQ ID NO: 7258170 - DNA, 22 bp, Homo sapiens
ttcccacagtgttgaatcctct

SEQ ID NO: 7258171 - DNA, 22 bp, Homo sapiens
ttcccacagtgactccagagaa

SEQ ID NO: 7258172 - DNA, 22 bp, Homo sapiens
ttcccacattctttacattcat

SEQ ID NO: 7258173 - DNA, 22 bp, Homo sapiens
ttccggggatagtgtttcccat

SEQ ID NO: 7258174 - DNA, 22 bp, Homo sapiens
ttcccaaagctttgtctgtgaa

SEQ ID NO: 7258175 - DNA, 22 bp, Homo sapiens
ttcccacacaattaagtcattt

SEQ ID NO: 7258176 - DNA, 22 bp, Homo sapiens
ttcccacaacagatctgtatta

SEQ ID NO: 7258177 - DNA, 22 bp, Homo sapiens
ttgacctttgtttttacagagt

SEQ ID NO: 7258178 - DNA, 22 bp, Homo sapiens
ttgaccttggcttttaaaatat

SEQ ID NO: 7258179 - DNA, 22 bp, Homo sapiens
ttgagaaaagctgtgtaaggat

SEQ ID NO: 7258180 - DNA, 22 bp, Homo sapiens
ttgagaaaagctgtgtaaggat

SEQ ID NO: 7258181 - DNA, 22 bp, Homo sapiens
ttgagaaacctggcagtagaga

SEQ ID NO: 7258182 - DNA, 22 bp, Homo sapiens
ttgagaaacatctaatctttgt

SEQ ID NO: 7258183 - DNA, 22 bp, Homo sapiens
ttgaggagaagactttgcttcc

SEQ ID NO: 7258184 - DNA, 22 bp, Homo sapiens
ttgaggagcaggatgggaggct

SEQ ID NO: 7258185 - DNA, 22 bp, Homo sapiens
ttgaggaggaactgtgaggcaa

SEQ ID NO: 7258186 - DNA, 22 bp, Homo sapiens
ttgaggaggaaaagggggtacc

SEQ ID NO: 7258187 - DNA, 22 bp, Homo sapiens
ttgagtttcctgacagcgaagg

SEQ ID NO: 7258188 - DNA, 22 bp, Homo sapiens
ttgagtttacattgtattagcc

SEQ ID NO: 7258189 - DNA, 23 bp, Homo sapiens
ttgaggagtgctttttctatcca

SEQ ID NO: 7258190 - DNA, 21 bp, Homo sapiens
ttgaggagtgagagtgggttt

SEQ ID NO: 7258191 - DNA, 22 bp, Homo sapiens
ctatttttctgtaccctaattt

SEQ ID NO: 7258192 - DNA, 22 bp, Homo sapiens
ctattttgtccttagtgcaggg

SEQ ID NO: 7258193 - DNA, 17 bp, Homo sapiens
ctattttggagattaaa

SEQ ID NO: 7258194 - DNA, 22 bp, Homo sapiens
ctcagaggggatgcttggagaa

SEQ ID NO: 7258195 - DNA, 17 bp, Homo sapiens
ctcagcagggctcactt

SEQ ID NO: 7258196 - DNA, 22 bp, Homo sapiens
ctattttgcctgcctagaaatc

SEQ ID NO: 7258197 - DNA, 22 bp, Homo sapiens
ctattttaagaggccattaggt

SEQ ID NO: 7258198 - DNA, 22 bp, Homo sapiens
ttcttgtttattaagatataaa

SEQ ID NO: 7258199 - DNA, 22 bp, Homo sapiens
ttcttgttctggttctgttagc

SEQ ID NO: 7258200 - DNA, 22 bp, Homo sapiens
ttcttgttctcctcatttagag

SEQ ID NO: 7258201 - DNA, 22 bp, Homo sapiens
ttcttgttccatgaaagacaga

SEQ ID NO: 7258202 - DNA, 22 bp, Homo sapiens
ttccttttcttaaacatatgtg

SEQ ID NO: 7258203 - DNA, 22 bp, Homo sapiens
ttccttttctcacggggatcca

SEQ ID NO: 7258204 - DNA, 22 bp, Homo sapiens
ttccttttcttatgcatcatta

SEQ ID NO: 7258205 - DNA, 22 bp, Homo sapiens
ttccttttcttctaccacatgt

SEQ ID NO: 7258206 - DNA, 22 bp, Homo sapiens
ttccttttgcaaggtcctctag

SEQ ID NO: 7258207 - DNA, 22 bp, Homo sapiens
ttccttttatttgtccaggctt

SEQ ID NO: 7258208 - DNA, 22 bp, Homo sapiens
ttccttttcatatgccccgcgt

SEQ ID NO: 7258209 - DNA, 20 bp, Homo sapiens
ttccttttcgcctctctccc

SEQ ID NO: 7258210 - DNA, 22 bp, Homo sapiens
ttccttttagaatcatgaagac

SEQ ID NO: 7258211 - DNA, 22 bp, Homo sapiens
ttccttttacaaatagcctcct

SEQ ID NO: 7258212 - DNA, 22 bp, Homo sapiens
ttcctttctctggactgcagcc

SEQ ID NO: 7258213 - DNA, 22 bp, Homo sapiens
ttccttctaattttacacctga

SEQ ID NO: 7258214 - DNA, 22 bp, Homo sapiens
ctaggccagttaggaagagaag

SEQ ID NO: 7258215 - DNA, 22 bp, Homo sapiens
ctaggccacagggcaaaaagga

SEQ ID NO: 7258216 - DNA, 22 bp, Homo sapiens
ctagggagcactagctgccttg

SEQ ID NO: 7258217 - DNA, 22 bp, Homo sapiens
ctagggagactcgcaggactca

SEQ ID NO: 7258218 - DNA, 22 bp, Homo sapiens
ttctgtccactgctggggcctc

SEQ ID NO: 7258219 - DNA, 22 bp, Homo sapiens
ttctgtcaaatgccagtagaga

SEQ ID NO: 7258220 - DNA, 22 bp, Homo sapiens
ttctgtcagcgtcagaaattct

SEQ ID NO: 7258221 - DNA, 22 bp, Homo sapiens
ttctgtatttagtttgaggaca

SEQ ID NO: 7258222 - DNA, 22 bp, Homo sapiens
ttctgtatacgttacaattgag

SEQ ID NO: 7258223 - DNA, 22 bp, Homo sapiens
ctagggagtggcagagctggga

SEQ ID NO: 7258224 - DNA, 22 bp, Homo sapiens
ctagggagtggcagagctggga

SEQ ID NO: 7258225 - DNA, 23 bp, Homo sapiens
ctagggcagtatttcacagacac

SEQ ID NO: 7258226 - DNA, 22 bp, Homo sapiens
ttgggcaggctggcagactgct

SEQ ID NO: 7258227 - DNA, 22 bp, Homo sapiens
ttgggcaggatgacaccacttg

SEQ ID NO: 7258228 - DNA, 22 bp, Homo sapiens
ttgggcaggcacatagagttta

SEQ ID NO: 7258229 - DNA, 22 bp, Homo sapiens
ttgggcagcattgcagttccct

SEQ ID NO: 7258230 - DNA, 22 bp, Homo sapiens
ttgggcagatgtttcctgtgga

SEQ ID NO: 7258231 - DNA, 23 bp, Homo sapiens
ttgggcaggagagtaatgtgatc

SEQ ID NO: 7258232 - DNA, 22 bp, Homo sapiens
ttgggcaggaacagatgcttga

SEQ ID NO: 7258233 - DNA, 22 bp, Homo sapiens
ttgggcagaggctgtgcagagg

SEQ ID NO: 7258234 - DNA, 22 bp, Homo sapiens
ttgggcagaggccaggaggatg

SEQ ID NO: 7258235 - DNA, 22 bp, Homo sapiens
ctcatccagtcaagcttttaga

SEQ ID NO: 7258236 - DNA, 22 bp, Homo sapiens
ctcatccacgtgcttttctagt

SEQ ID NO: 7258237 - DNA, 20 bp, Homo sapiens
ctcatctctgagcctcctgg

SEQ ID NO: 7258238 - DNA, 22 bp, Homo sapiens
ttgggatctcaaatccagctat

SEQ ID NO: 7258239 - DNA, 22 bp, Homo sapiens
ctcatatatttctgcattcaat

SEQ ID NO: 7258240 - DNA, 22 bp, Homo sapiens
ttgatatgttaggaagactgat

SEQ ID NO: 7258241 - DNA, 22 bp, Homo sapiens
ctcagtttcctcaactgcaaaa

SEQ ID NO: 7258242 - DNA, 22 bp, Homo sapiens
ctcagttgttagtattttgcct

SEQ ID NO: 7258243 - DNA, 22 bp, Homo sapiens
ttgggtgggtcaggactcggag

SEQ ID NO: 7258244 - DNA, 22 bp, Homo sapiens
ttggtagaagaatatgagtatt

SEQ ID NO: 7258245 - DNA, 22 bp, Homo sapiens
ctccagtgcgcaggacagcccc

SEQ ID NO: 7258246 - DNA, 22 bp, Homo sapiens
ttgttaagttcatggaggtcaa

SEQ ID NO: 7258247 - DNA, 22 bp, Homo sapiens
tttacatttccctctgtcagtt

SEQ ID NO: 7258248 - DNA, 22 bp, Homo sapiens
tttaacacccaggtagttctga

SEQ ID NO: 7258249 - DNA, 22 bp, Homo sapiens
ctcctctccatcagcgccaccc

SEQ ID NO: 7258250 - DNA, 22 bp, Homo sapiens
ctcctcccaattgccaagtgct

SEQ ID NO: 7258251 - DNA, 22 bp, Homo sapiens
ctcctctctggagttatgcaga

SEQ ID NO: 7258252 - DNA, 16 bp, Homo sapiens
ctcctctccttcagga

SEQ ID NO: 7258253 - DNA, 17 bp, Homo sapiens
ctcctctctgggttact

SEQ ID NO: 7258254 - DNA, 22 bp, Homo sapiens
ctcctgagaattttcagttgga

SEQ ID NO: 7258255 - DNA, 22 bp, Homo sapiens
ctcctctttagccccagctgga

SEQ ID NO: 7258256 - DNA, 22 bp, Homo sapiens
ctcctgggagcagggatggatg

SEQ ID NO: 7258257 - DNA, 22 bp, Homo sapiens
ctcctgggagctgtggcagagc

SEQ ID NO: 7258258 - DNA, 22 bp, Homo sapiens
ctcctgggctatgtctgcttgg

SEQ ID NO: 7258259 - DNA, 18 bp, Homo sapiens
ctcctgggctgcagatgc

SEQ ID NO: 7258260 - DNA, 18 bp, Homo sapiens
ctcctgggctgcagatgc

SEQ ID NO: 7258261 - DNA, 22 bp, Homo sapiens
ctctccactgtcctttgctggt

SEQ ID NO: 7258262 - DNA, 22 bp, Homo sapiens
ctctccactcagcgtcatgtcc

SEQ ID NO: 7258263 - DNA, 22 bp, Homo sapiens
ctctcccttgggtgggctttgg

SEQ ID NO: 7258264 - DNA, 22 bp, Homo sapiens
ctctcctcagaacaggccctct

SEQ ID NO: 7258265 - DNA, 22 bp, Homo sapiens
ctctcctccaggaactcacagt

SEQ ID NO: 7258266 - DNA, 23 bp, Homo sapiens
ttttattgatatgtagctgttgt

SEQ ID NO: 7258267 - DNA, 22 bp, Homo sapiens
ttttattctaagtatgatggga

SEQ ID NO: 7258268 - DNA, 22 bp, Homo sapiens
ctctgggccaccgctggtgtat

SEQ ID NO: 7258269 - DNA, 22 bp, Homo sapiens
ttttagtttggatttctaaagc

SEQ ID NO: 7258270 - DNA, 22 bp, Homo sapiens
ctctgggcaccaaagagcagct

SEQ ID NO: 7258271 - DNA, 22 bp, Homo sapiens
ctctcctggggagcacacacac

SEQ ID NO: 7258272 - DNA, 22 bp, Homo sapiens
ctctcctgggctgaccgtccga

SEQ ID NO: 7258273 - DNA, 23 bp, Homo sapiens
ctctcctgaaggacaagctgccg

SEQ ID NO: 7258274 - DNA, 22 bp, Homo sapiens
tttgtgaataggttggcttcca

SEQ ID NO: 7258275 - DNA, 19 bp, Homo sapiens
tttgtgaagaaaatgatgc

SEQ ID NO: 7258276 - DNA, 22 bp, Homo sapiens
tttgtgaacttaggcaattagg

SEQ ID NO: 7258277 - DNA, 22 bp, Homo sapiens
ctctggcttagtatgctccaaa

SEQ ID NO: 7258278 - DNA, 22 bp, Homo sapiens
ctctggctggcattgctggact

SEQ ID NO: 7258279 - DNA, 22 bp, Homo sapiens
ctctggctggctgggcctcagt

SEQ ID NO: 7258280 - DNA, 22 bp, Homo sapiens
ctgaagaagtctctaggctatt

SEQ ID NO: 7258281 - DNA, 22 bp, Homo sapiens
ctgaagagaaatgtacacatgg

SEQ ID NO: 7258282 - DNA, 19 bp, Homo sapiens
tttttaatgggctggagca

SEQ ID NO: 7258283 - DNA, 22 bp, Homo sapiens
ctgaaattgatgacagggatgg

SEQ ID NO: 7258284 - DNA, 22 bp, Homo sapiens
ctgaaattctttggagttttct

SEQ ID NO: 7258285 - DNA, 22 bp, Homo sapiens
ctgagaaatacccaagtctggt

SEQ ID NO: 7258286 - DNA, 17 bp, Homo sapiens
ctgaagataatggcaac

SEQ ID NO: 7258287 - DNA, 22 bp, Homo sapiens
ctgaagaggacgcagcagcaag

SEQ ID NO: 7258288 - DNA, 21 bp, Homo sapiens
ttttattgatgaatggccact

SEQ ID NO: 7258289 - DNA, 23 bp, Homo sapiens
ttttattgatatgtagctgttgt

SEQ ID NO: 7258290 - DNA, 22 bp, Homo sapiens
ctctgggttcactgaggctctg

SEQ ID NO: 7258291 - DNA, 22 bp, Homo sapiens
ctctgggttcagaacagcaagc

SEQ ID NO: 7258292 - DNA, 22 bp, Homo sapiens
ctctgggttttgtcagctgagg

SEQ ID NO: 7258293 - DNA, 22 bp, Homo sapiens
ctctgggttcagccccggccct

SEQ ID NO: 7258294 - DNA, 22 bp, Homo sapiens
ctctgggttctggcctgcaccc

SEQ ID NO: 7258295 - DNA, 22 bp, Homo sapiens
ctctggttcagggctccctggc

SEQ ID NO: 7258296 - DNA, 22 bp, Homo sapiens
ctctggtcttcaaggccacctc

SEQ ID NO: 7258297 - DNA, 22 bp, Homo sapiens
ctctttgtagcctttgcatatt

SEQ ID NO: 7258298 - DNA, 22 bp, Homo sapiens
ctctttgtaaagaagtggtagg

SEQ ID NO: 7258299 - DNA, 22 bp, Homo sapiens
ctctttggcgttggcagagcca

SEQ ID NO: 7258300 - DNA, 22 bp, Homo sapiens
ctcttttagagatgaaaattgg

SEQ ID NO: 7258301 - DNA, 22 bp, Homo sapiens
ctcttttatgtgacgtgtgtga

SEQ ID NO: 7258302 - DNA, 22 bp, Homo sapiens
ctcttttaattgtcataacaac

SEQ ID NO: 7258303 - DNA, 22 bp, Homo sapiens
ctcttttacaccaaaaggccta

SEQ ID NO: 7258304 - DNA, 22 bp, Homo sapiens
ctgcagcaggaggctcctgcag

SEQ ID NO: 7258305 - DNA, 22 bp, Homo sapiens
ctgcagagggtttgagcatcct

SEQ ID NO: 7258306 - DNA, 22 bp, Homo sapiens
ctgcagagggtttgagcatcct

SEQ ID NO: 7258307 - DNA, 22 bp, Homo sapiens
ctgcagaggcctcgcctcctct

SEQ ID NO: 7258308 - DNA, 22 bp, Homo sapiens
ctgcagaggcctcgcctcctct

SEQ ID NO: 7258309 - DNA, 22 bp, Homo sapiens
ctgcagagctaggctgagtgaa

SEQ ID NO: 7258310 - DNA, 22 bp, Homo sapiens
ctgcagagctaggctgagtgaa

SEQ ID NO: 7258311 - DNA, 22 bp, Homo sapiens
ctgccagctctctggaggctct

SEQ ID NO: 7258312 - DNA, 22 bp, Homo sapiens
ctgccaggactgacgtcttcag

SEQ ID NO: 7258313 - DNA, 22 bp, Homo sapiens
ctgccagctggagaccaaggaa

SEQ ID NO: 7258314 - DNA, 22 bp, Homo sapiens
ctgccaggggcctcacaggcca

SEQ ID NO: 7258315 - DNA, 22 bp, Homo sapiens
ctgccctgggttttatgggagt

SEQ ID NO: 7258316 - DNA, 22 bp, Homo sapiens
ctgccctgggtgctggggatcc

SEQ ID NO: 7258317 - DNA, 22 bp, Homo sapiens
ctgccctggggggcctccttgc

SEQ ID NO: 7258318 - DNA, 22 bp, Homo sapiens
ctgccaggttggcgctcgctct

SEQ ID NO: 7258319 - DNA, 22 bp, Homo sapiens
ctgccatcctcaccagagcagc

SEQ ID NO: 7258320 - DNA, 22 bp, Homo sapiens
ctgccatcctcaccagagcagc

SEQ ID NO: 7258321 - DNA, 22 bp, Homo sapiens
ctgcctcatgctgcctgcagcc

SEQ ID NO: 7258322 - DNA, 22 bp, Homo sapiens
ctgcctccaggctcaccttgac

SEQ ID NO: 7258323 - DNA, 22 bp, Homo sapiens
ctgagaattactctgatgagta

SEQ ID NO: 7258324 - DNA, 22 bp, Homo sapiens
ctgagacccagacacctgagga

SEQ ID NO: 7258325 - DNA, 22 bp, Homo sapiens
ctgaggagaaatgggatggttc

SEQ ID NO: 7258326 - DNA, 22 bp, Homo sapiens
ctgaggagctgaaggccctcca

SEQ ID NO: 7258327 - DNA, 22 bp, Homo sapiens
ctgaggaggggcctgagtgaga

SEQ ID NO: 7258328 - DNA, 22 bp, Homo sapiens
ctgaggagtgggtgggcagtga

SEQ ID NO: 7258329 - DNA, 22 bp, Homo sapiens
ctgatcttaagtaacattattt

SEQ ID NO: 7258330 - DNA, 22 bp, Homo sapiens
ctgatgttcatttcttttgtac

SEQ ID NO: 7258331 - DNA, 22 bp, Homo sapiens
ctgcagacctctgaggtccatg

SEQ ID NO: 7258332 - DNA, 22 bp, Homo sapiens
ctgatttctacatggaccacat

SEQ ID NO: 7258333 - DNA, 22 bp, Homo sapiens
ctgatttctcagttctaggaag

SEQ ID NO: 7258334 - DNA, 22 bp, Homo sapiens
ctgatttcatgctatcaatgtt

SEQ ID NO: 7258335 - DNA, 22 bp, Homo sapiens
ctgattcctgattcatgctctt

SEQ ID NO: 7258336 - DNA, 22 bp, Homo sapiens
ctgattccagagtctgtgttct

SEQ ID NO: 7258337 - DNA, 22 bp, Homo sapiens
ctgattccaaagccaaagctat

SEQ ID NO: 7258338 - DNA, 22 bp, Homo sapiens
ctgctttgtggaatcacactgg

SEQ ID NO: 7258339 - DNA, 22 bp, Homo sapiens
ctggacaggaagaattgggagc

SEQ ID NO: 7258340 - DNA, 22 bp, Homo sapiens
ctgctttatattgagcttgaaa

SEQ ID NO: 7258341 - DNA, 21 bp, Homo sapiens
ctgctttacttcagaggatct

SEQ ID NO: 7258342 - DNA, 22 bp, Homo sapiens
ctgcctgggccatgcccagtcc

SEQ ID NO: 7258343 - DNA, 22 bp, Homo sapiens
ctgcctggaccggcagccctcc

SEQ ID NO: 7258344 - DNA, 22 bp, Homo sapiens
ctgcctgctcaccagggctctg

SEQ ID NO: 7258345 - DNA, 22 bp, Homo sapiens
ctgcctggaaggagcaagggga

SEQ ID NO: 7258346 - DNA, 22 bp, Homo sapiens
ctggagggacaaggtatgcatt

SEQ ID NO: 7258347 - DNA, 22 bp, Homo sapiens
ctggagggactttctcacggat

SEQ ID NO: 7258348 - DNA, 22 bp, Homo sapiens
ctggagggactttctcacggat

SEQ ID NO: 7258349 - DNA, 22 bp, Homo sapiens
ctggagggctggactaaggaaa

SEQ ID NO: 7258350 - DNA, 22 bp, Homo sapiens
ctggagggctggactaaggaaa

SEQ ID NO: 7258351 - DNA, 22 bp, Homo sapiens
ctggaggggctggcatggtagc

SEQ ID NO: 7258352 - DNA, 22 bp, Homo sapiens
ctggaggggctggcatggtagc

SEQ ID NO: 7258353 - DNA, 22 bp, Homo sapiens
ctggaggggccatccacagtct

SEQ ID NO: 7258354 - DNA, 22 bp, Homo sapiens
ctggaggggccatccacagtct

SEQ ID NO: 7258355 - DNA, 22 bp, Homo sapiens
ctggagggcttctgcaggttac

SEQ ID NO: 7258356 - DNA, 22 bp, Homo sapiens
ctggagggcttctgcaggttac

SEQ ID NO: 7258357 - DNA, 22 bp, Homo sapiens
ctggagggggaaatgttcattg

SEQ ID NO: 7258358 - DNA, 22 bp, Homo sapiens
ctggagggggaaatgttcattg

SEQ ID NO: 7258359 - DNA, 21 bp, Homo sapiens
ctggagggtagagttgggctg

SEQ ID NO: 7258360 - DNA, 21 bp, Homo sapiens
ctggagggtagagttgggctg

SEQ ID NO: 7258361 - DNA, 21 bp, Homo sapiens
ctggagggtagagttgggctg

SEQ ID NO: 7258362 - DNA, 22 bp, Homo sapiens
ctggaggtcatgtaatatggaa

SEQ ID NO: 7258363 - DNA, 22 bp, Homo sapiens
ctggaggtagatggtggtaatg

SEQ ID NO: 7258364 - DNA, 22 bp, Homo sapiens
ctggagggtggagagaagtctc

SEQ ID NO: 7258365 - DNA, 22 bp, Homo sapiens
ctggagggtgagcctcatctct

SEQ ID NO: 7258366 - DNA, 22 bp, Homo sapiens
ctggagggtgagcctcatctct

SEQ ID NO: 7258367 - DNA, 22 bp, Homo sapiens
ctggagtaagttaagatgttcc

SEQ ID NO: 7258368 - DNA, 22 bp, Homo sapiens
ctggaggttgggtccaggccag

SEQ ID NO: 7258369 - DNA, 22 bp, Homo sapiens
ctggaggtgcttcgctggccac

SEQ ID NO: 7258370 - DNA, 22 bp, Homo sapiens
ctggaggtgggggcaagagtgt

SEQ ID NO: 7258371 - DNA, 22 bp, Homo sapiens
ctggaggtgcctagatgagctc

SEQ ID NO: 7258372 - DNA, 22 bp, Homo sapiens
ctggaggtgcctagatgagctc

SEQ ID NO: 7258373 - DNA, 22 bp, Homo sapiens
ctggagtcacacacaccaaggt

SEQ ID NO: 7258374 - DNA, 22 bp, Homo sapiens
ctggagttcgactgagttgaat

SEQ ID NO: 7258375 - DNA, 22 bp, Homo sapiens
ctggagttttggaaaaatgctt

SEQ ID NO: 7258376 - DNA, 20 bp, Homo sapiens
ctggagtgtagcagtggctg

SEQ ID NO: 7258377 - DNA, 22 bp, Homo sapiens
ctggagtgtaaagagcatagaa

SEQ ID NO: 7258378 - DNA, 22 bp, Homo sapiens
ctggactcactatggcttcaga

SEQ ID NO: 7258379 - DNA, 22 bp, Homo sapiens
ctggacagtgggcagaggagac

SEQ ID NO: 7258380 - DNA, 22 bp, Homo sapiens
ctggactctgcagagaaaagta

SEQ ID NO: 7258381 - DNA, 22 bp, Homo sapiens
ctggactcatccatagaggtga

SEQ ID NO: 7258382 - DNA, 22 bp, Homo sapiens
ctggactcagggtgctccagcg

SEQ ID NO: 7258383 - DNA, 23 bp, Homo sapiens
ctggactcaggggatgtgaagga

SEQ ID NO: 7258384 - DNA, 22 bp, Homo sapiens
ctggaggaatcacagaaggctt

SEQ ID NO: 7258385 - DNA, 21 bp, Homo sapiens
ctggaggcaggtggtgccagg

SEQ ID NO: 7258386 - DNA, 22 bp, Homo sapiens
ctggaggcagttgccccagtca

SEQ ID NO: 7258387 - DNA, 22 bp, Homo sapiens
ctggaggccactgtacagattg

SEQ ID NO: 7258388 - DNA, 22 bp, Homo sapiens
ctggaggctggcttcccctggc

SEQ ID NO: 7258389 - DNA, 22 bp, Homo sapiens
ctggaggctgagttgggtctcc

SEQ ID NO: 7258390 - DNA, 22 bp, Homo sapiens
ctggaggctggcttcccctggc

SEQ ID NO: 7258391 - DNA, 22 bp, Homo sapiens
ctggaggaccacagaagctggt

SEQ ID NO: 7258392 - DNA, 22 bp, Homo sapiens
ctggaggagagtctgaatgaca

SEQ ID NO: 7258393 - DNA, 22 bp, Homo sapiens
ctggaggcaaagcagaggcatg

SEQ ID NO: 7258394 - DNA, 22 bp, Homo sapiens
ctggaggcaaagcagaggcatg

SEQ ID NO: 7258395 - DNA, 22 bp, Homo sapiens
ctggaggcacccttagagaggc

SEQ ID NO: 7258396 - DNA, 22 bp, Homo sapiens
ctggatcccgtctgagcctcct

SEQ ID NO: 7258397 - DNA, 22 bp, Homo sapiens
ctggccagtgcctgtgggcccc

SEQ ID NO: 7258398 - DNA, 22 bp, Homo sapiens
ctggccaggcggcccctgcatg

SEQ ID NO: 7258399 - DNA, 22 bp, Homo sapiens
ctggccacaactagcccaggac

SEQ ID NO: 7258400 - DNA, 22 bp, Homo sapiens
ctggcagggctggtattcaaaa

SEQ ID NO: 7258401 - DNA, 22 bp, Homo sapiens
ctggcagggctctttgggtgct

SEQ ID NO: 7258402 - DNA, 22 bp, Homo sapiens
ctggcagggtgggctttgcttt

SEQ ID NO: 7258403 - DNA, 22 bp, Homo sapiens
ctggcaggtatctaaagttgtc

SEQ ID NO: 7258404 - DNA, 22 bp, Homo sapiens
ctggcaggtccagctggactca

SEQ ID NO: 7258405 - DNA, 22 bp, Homo sapiens
ctggcctggcagggagggcatg

SEQ ID NO: 7258406 - DNA, 22 bp, Homo sapiens
ctggcctgctgggtgaggtcct

SEQ ID NO: 7258407 - DNA, 22 bp, Homo sapiens
ctggcccaggctcctggggcac

SEQ ID NO: 7258408 - DNA, 22 bp, Homo sapiens
ctggccagttgccttcctgggt

SEQ ID NO: 7258409 - DNA, 22 bp, Homo sapiens
ccctggagctagtctgagcaga

SEQ ID NO: 7258410 - DNA, 22 bp, Homo sapiens
ccctggagatcgggagaggaag

SEQ ID NO: 7258411 - DNA, 22 bp, Homo sapiens
ccctggagatcgggagaggaag

SEQ ID NO: 7258412 - DNA, 19 bp, Homo sapiens
ccctcaggtctgagcagtc

SEQ ID NO: 7258413 - DNA, 23 bp, Homo sapiens
ccctggccttggggcacaggctg

SEQ ID NO: 7258414 - DNA, 22 bp, Homo sapiens
ccctggcctacaggcccagaga

SEQ ID NO: 7258415 - DNA, 22 bp, Homo sapiens
ccctggcctacaggcccagaga

SEQ ID NO: 7258416 - DNA, 20 bp, Homo sapiens
ccctggcctgtttcatgccc

SEQ ID NO: 7258417 - DNA, 22 bp, Homo sapiens
ccctggcccctcactccgaggc

SEQ ID NO: 7258418 - DNA, 22 bp, Homo sapiens
cctagggatacagcagagtaca

SEQ ID NO: 7258419 - DNA, 22 bp, Homo sapiens
cctagggagcctgagagcagtg

SEQ ID NO: 7258420 - DNA, 23 bp, Homo sapiens
tggccaggcataaaggtgggtgg

SEQ ID NO: 7258421 - DNA, 22 bp, Homo sapiens
tggccaggcattcagataagac

SEQ ID NO: 7258422 - DNA, 23 bp, Homo sapiens
tggccaggcataaaggtgggtgg

SEQ ID NO: 7258423 - DNA, 22 bp, Homo sapiens
tggccaggaggctgcttctgac

SEQ ID NO: 7258424 - DNA, 22 bp, Homo sapiens
tggccaggcaggtagaacggcc

SEQ ID NO: 7258425 - DNA, 22 bp, Homo sapiens
tggccacaaagagaacgaggtc

SEQ ID NO: 7258426 - DNA, 22 bp, Homo sapiens
tggcaaggctgtgggggcagag

SEQ ID NO: 7258427 - DNA, 22 bp, Homo sapiens
tggcagaggtatattgggagga

SEQ ID NO: 7258428 - DNA, 22 bp, Homo sapiens
cctcgtccacaatccttgcaca

SEQ ID NO: 7258429 - DNA, 22 bp, Homo sapiens
cctcggggcaccgcggcctgct

SEQ ID NO: 7258430 - DNA, 22 bp, Homo sapiens
cctcggctgcccagcccagctg

SEQ ID NO: 7258431 - DNA, 22 bp, Homo sapiens
cctcggaggcggaggctgcagt

SEQ ID NO: 7258432 - DNA, 22 bp, Homo sapiens
cctcggagcgggtcagagaggg

SEQ ID NO: 7258433 - DNA, 18 bp, Homo sapiens
cctcggagcctccgtgtc

SEQ ID NO: 7258434 - DNA, 22 bp, Homo sapiens
cctcctctgggaagattcagag

SEQ ID NO: 7258435 - DNA, 23 bp, Homo sapiens
tggctgaggtccaggtagtttca

SEQ ID NO: 7258436 - DNA, 22 bp, Homo sapiens
tggctgaggtctggggcttctg

SEQ ID NO: 7258437 - DNA, 22 bp, Homo sapiens
tggctgaggtaactatgaataa

SEQ ID NO: 7258438 - DNA, 22 bp, Homo sapiens
tggctgagggggctctgctcag

SEQ ID NO: 7258439 - DNA, 22 bp, Homo sapiens
tggctgagagcaattgactctg

SEQ ID NO: 7258440 - DNA, 22 bp, Homo sapiens
tggctgagggggcagttcagga

SEQ ID NO: 7258441 - DNA, 22 bp, Homo sapiens
cctccactctggcctctcaggt

SEQ ID NO: 7258442 - DNA, 22 bp, Homo sapiens
cctccaagtttgactcaggaca

SEQ ID NO: 7258443 - DNA, 22 bp, Homo sapiens
cctccagagggaagtactttct

SEQ ID NO: 7258444 - DNA, 20 bp, Homo sapiens
cctccactgtcactgacctg

SEQ ID NO: 7258445 - DNA, 22 bp, Homo sapiens
cctccactgcttcccagctttg

SEQ ID NO: 7258446 - DNA, 22 bp, Homo sapiens
cctccagagggtttcccatgaa

SEQ ID NO: 7258447 - DNA, 22 bp, Homo sapiens
tggcccagcagttctgccccag

SEQ ID NO: 7258448 - DNA, 22 bp, Homo sapiens
tggcccagccctgctctagggc

SEQ ID NO: 7258449 - DNA, 22 bp, Homo sapiens
tggcccagtgcttatgctctga

SEQ ID NO: 7258450 - DNA, 22 bp, Homo sapiens
tggcccagtgcttatgctctga

SEQ ID NO: 7258451 - DNA, 22 bp, Homo sapiens
tggccccattttacagatgaaa

SEQ ID NO: 7258452 - DNA, 22 bp, Homo sapiens
tggccccatcaagggatgagtt

SEQ ID NO: 7258453 - DNA, 22 bp, Homo sapiens
tggccccacagggccttttcag

SEQ ID NO: 7258454 - DNA, 20 bp, Homo sapiens
tggcccagtggggcagggtg

SEQ ID NO: 7258455 - DNA, 20 bp, Homo sapiens
tggcccagtggggcagggtg

SEQ ID NO: 7258456 - DNA, 22 bp, Homo sapiens
tggccctgctatgatcctgcaa

SEQ ID NO: 7258457 - DNA, 22 bp, Homo sapiens
tggcccgccggaagaagatgtc

SEQ ID NO: 7258458 - DNA, 22 bp, Homo sapiens
tggccctgctggacacgcctgc

SEQ ID NO: 7258459 - DNA, 21 bp, Homo sapiens
tggctcagttgctgggcacag

SEQ ID NO: 7258460 - DNA, 22 bp, Homo sapiens
tggccctgctgtatcatctgct

SEQ ID NO: 7258461 - DNA, 22 bp, Homo sapiens
tggccctgctggccaaaggcta

SEQ ID NO: 7258462 - DNA, 22 bp, Homo sapiens
tggccctgctgggtcagagctg

SEQ ID NO: 7258463 - DNA, 22 bp, Homo sapiens
tggctcagtttcagtcctggtt

SEQ ID NO: 7258464 - DNA, 22 bp, Homo sapiens
tggctcagtttctgcccagctg

SEQ ID NO: 7258465 - DNA, 22 bp, Homo sapiens
cctctgggttagtttagggagc

SEQ ID NO: 7258466 - DNA, 22 bp, Homo sapiens
cctctggtcccagctctgctgc

SEQ ID NO: 7258467 - DNA, 18 bp, Homo sapiens
cctctgggttttgttccc

SEQ ID NO: 7258468 - DNA, 22 bp, Homo sapiens
cctctggggtgagtgggccact

SEQ ID NO: 7258469 - DNA, 22 bp, Homo sapiens
cctctggggtctagcaatagca

SEQ ID NO: 7258470 - DNA, 22 bp, Homo sapiens
cctctgggtgggaggccgggcg

SEQ ID NO: 7258471 - DNA, 22 bp, Homo sapiens
cctctgggtatctgtggaagta

SEQ ID NO: 7258472 - DNA, 22 bp, Homo sapiens
cctctgagcctgtgtgcggcac

SEQ ID NO: 7258473 - DNA, 22 bp, Homo sapiens
cctctgagccagcgtcttctct

SEQ ID NO: 7258474 - DNA, 22 bp, Homo sapiens
cctctgagaacacctggcgtcc

SEQ ID NO: 7258475 - DNA, 22 bp, Homo sapiens
cctctgagaccagctctgcacc

SEQ ID NO: 7258476 - DNA, 22 bp, Homo sapiens
cctctgaggtcatggacttggc

SEQ ID NO: 7258477 - DNA, 22 bp, Homo sapiens
cctctgagctggcctgtggggc

SEQ ID NO: 7258478 - DNA, 22 bp, Homo sapiens
cctctgggctgcctgcacgggt

SEQ ID NO: 7258479 - DNA, 22 bp, Homo sapiens
cctctgggggcttccttaccct

SEQ ID NO: 7258480 - DNA, 22 bp, Homo sapiens
cctctgggggcttccttaccct

SEQ ID NO: 7258481 - DNA, 22 bp, Homo sapiens
cctctctgtaagggtccctccc

SEQ ID NO: 7258482 - DNA, 22 bp, Homo sapiens
cctctctgtagcagcccccagt

SEQ ID NO: 7258483 - DNA, 22 bp, Homo sapiens
cctctctgtcacaccagtggcc

SEQ ID NO: 7258484 - DNA, 22 bp, Homo sapiens
cctctctgtgtggcctctccat

SEQ ID NO: 7258485 - DNA, 20 bp, Homo sapiens
cctctctgcatgctccctga

SEQ ID NO: 7258486 - DNA, 22 bp, Homo sapiens
cctctcccgggtgccgctgggc

SEQ ID NO: 7258487 - DNA, 22 bp, Homo sapiens
cctctcctggctgtaggacctc

SEQ ID NO: 7258488 - DNA, 22 bp, Homo sapiens
tggctgcctgaatgcaagacag

SEQ ID NO: 7258489 - DNA, 22 bp, Homo sapiens
tggctgcctgatcgagcaggtg

SEQ ID NO: 7258490 - DNA, 22 bp, Homo sapiens
tggctgcctagtccctcagcct

SEQ ID NO: 7258491 - DNA, 18 bp, Homo sapiens
cctctacctacccctaga

SEQ ID NO: 7258492 - DNA, 22 bp, Homo sapiens
cctctacagggcatagcccaaa

SEQ ID NO: 7258493 - DNA, 22 bp, Homo sapiens
cctctaggatgtggctggagga

SEQ ID NO: 7258494 - DNA, 22 bp, Homo sapiens
cctctacttaccactcagccag

SEQ ID NO: 7258495 - DNA, 23 bp, Homo sapiens
cctctaggagattagggggcttc

SEQ ID NO: 7258496 - DNA, 23 bp, Homo sapiens
cctctccagacactgggccttgt

SEQ ID NO: 7258497 - DNA, 20 bp, Homo sapiens
tgctgcagacagggccattg

SEQ ID NO: 7258498 - DNA, 22 bp, Homo sapiens
tgctgaccttgttctgtgagga

SEQ ID NO: 7258499 - DNA, 22 bp, Homo sapiens
tgctgaagttcttcccctaatg

SEQ ID NO: 7258500 - DNA, 22 bp, Homo sapiens
tgctgaagttactagagactat

SEQ ID NO: 7258501 - DNA, 19 bp, Homo sapiens
tgctgaagttgtcagtctg

SEQ ID NO: 7258502 - DNA, 22 bp, Homo sapiens
cccagggaggcccaggctctgc

SEQ ID NO: 7258503 - DNA, 22 bp, Homo sapiens
tgctgaagtccaagagctccaa

SEQ ID NO: 7258504 - DNA, 23 bp, Homo sapiens
tgctgaagtgttggccctgccca

SEQ ID NO: 7258505 - DNA, 22 bp, Homo sapiens
tgctgaagtccatctgtttgac

SEQ ID NO: 7258506 - DNA, 22 bp, Homo sapiens
tgctccaggtgtgcctctcatg

SEQ ID NO: 7258507 - DNA, 23 bp, Homo sapiens
tgctccaggtacagaactccagg

SEQ ID NO: 7258508 - DNA, 22 bp, Homo sapiens
tgctccagggctgccagaccct

SEQ ID NO: 7258509 - DNA, 22 bp, Homo sapiens
cccaggctcctagaggcccaga

SEQ ID NO: 7258510 - DNA, 22 bp, Homo sapiens
ccctcaggagatgtcagctgga

SEQ ID NO: 7258511 - DNA, 22 bp, Homo sapiens
cccctctggtcaaccagtcaca

SEQ ID NO: 7258512 - DNA, 22 bp, Homo sapiens
cccctctgcaaatagccaggct

SEQ ID NO: 7258513 - DNA, 22 bp, Homo sapiens
cccctcctggccacactgtcag

SEQ ID NO: 7258514 - DNA, 22 bp, Homo sapiens
cccctctgcaaatagccaggct

SEQ ID NO: 7258515 - DNA, 22 bp, Homo sapiens
cccctcctgcagcacctttctt

SEQ ID NO: 7258516 - DNA, 22 bp, Homo sapiens
cccccagctctgctgggtcccg

SEQ ID NO: 7258517 - DNA, 22 bp, Homo sapiens
cccccagctctgctgggtcccg

SEQ ID NO: 7258518 - DNA, 22 bp, Homo sapiens
cccccagccagcagtgctcagc

SEQ ID NO: 7258519 - DNA, 22 bp, Homo sapiens
cccccactaagttgagggccct

SEQ ID NO: 7258520 - DNA, 22 bp, Homo sapiens
cccccactaagttgagggccct

SEQ ID NO: 7258521 - DNA, 22 bp, Homo sapiens
cccccagatgcgagccatagcc

SEQ ID NO: 7258522 - DNA, 18 bp, Homo sapiens
cccccagccaaattctct

SEQ ID NO: 7258523 - DNA, 22 bp, Homo sapiens
cccccagccagcagtgctcagc

SEQ ID NO: 7258524 - DNA, 22 bp, Homo sapiens
cccctcattacaggcggggagc

SEQ ID NO: 7258525 - DNA, 22 bp, Homo sapiens
cccctcataggtcagacacgca

SEQ ID NO: 7258526 - DNA, 22 bp, Homo sapiens
tgctggagcatctgagagcatc

SEQ ID NO: 7258527 - DNA, 22 bp, Homo sapiens
tgctggagatgaaagggccctg

SEQ ID NO: 7258528 - DNA, 22 bp, Homo sapiens
tgctggagaggaaggtggggtc

SEQ ID NO: 7258529 - DNA, 22 bp, Homo sapiens
tgctggagacatagcaggcagc

SEQ ID NO: 7258530 - DNA, 23 bp, Homo sapiens
tgctggagacaagtgtgagaagg

SEQ ID NO: 7258531 - DNA, 22 bp, Homo sapiens
ccccagccttccatgggaattg

SEQ ID NO: 7258532 - DNA, 22 bp, Homo sapiens
ccccagcccacaagcatattaa

SEQ ID NO: 7258533 - DNA, 22 bp, Homo sapiens
ccccagccagcttgtagtagaa

SEQ ID NO: 7258534 - DNA, 22 bp, Homo sapiens
ccccagccagcaggacctctga

SEQ ID NO: 7258535 - DNA, 22 bp, Homo sapiens
ccccagccagcaggacctctga

SEQ ID NO: 7258536 - DNA, 22 bp, Homo sapiens
ccccagcatatcatggtttcgt

SEQ ID NO: 7258537 - DNA, 18 bp, Homo sapiens
ccccagcagtgtggtgcc

SEQ ID NO: 7258538 - DNA, 22 bp, Homo sapiens
ccccagcaggaatacaggggtc

SEQ ID NO: 7258539 - DNA, 22 bp, Homo sapiens
ccccagcagcacctggggcagt

SEQ ID NO: 7258540 - DNA, 22 bp, Homo sapiens
ccccagcagactcagggcaggt

SEQ ID NO: 7258541 - DNA, 22 bp, Homo sapiens
tgctgcagacgaagcccatgcc

SEQ ID NO: 7258542 - DNA, 22 bp, Homo sapiens
cccaggcagagagctggtgagc

SEQ ID NO: 7258543 - DNA, 22 bp, Homo sapiens
tgccaggctaagtggaggactt

SEQ ID NO: 7258544 - DNA, 21 bp, Homo sapiens
tgccaggcctgagctggggtc

SEQ ID NO: 7258545 - DNA, 22 bp, Homo sapiens
tgccaggcgattgctatcagca

SEQ ID NO: 7258546 - DNA, 22 bp, Homo sapiens
tgccaggcgtggtggtgcgcac

SEQ ID NO: 7258547 - DNA, 22 bp, Homo sapiens
cccaggaggtgtgcccaactcg

SEQ ID NO: 7258548 - DNA, 22 bp, Homo sapiens
cccaggagggtggcctctgccc

SEQ ID NO: 7258549 - DNA, 22 bp, Homo sapiens
tgccaagataacacagctagta

SEQ ID NO: 7258550 - DNA, 22 bp, Homo sapiens
tgccacactcacttctgtggac

SEQ ID NO: 7258551 - DNA, 22 bp, Homo sapiens
tgccacaccaacatctttcagc

SEQ ID NO: 7258552 - DNA, 22 bp, Homo sapiens
tgccacacattgtcaggttagt

SEQ ID NO: 7258553 - DNA, 22 bp, Homo sapiens
tgccacacagtctggtagaata

SEQ ID NO: 7258554 - DNA, 22 bp, Homo sapiens
tgccacacagctgtatgaggga

SEQ ID NO: 7258555 - DNA, 22 bp, Homo sapiens
tgccacacaattactgctgcta

SEQ ID NO: 7258556 - DNA, 22 bp, Homo sapiens
tgccacactcccctgctgcagt

SEQ ID NO: 7258557 - DNA, 22 bp, Homo sapiens
cccagctgtaacgggtctgcac

SEQ ID NO: 7258558 - DNA, 17 bp, Homo sapiens
cccagctgcgtctgagg

SEQ ID NO: 7258559 - DNA, 22 bp, Homo sapiens
cccagctcttcctgggagctaa

SEQ ID NO: 7258560 - DNA, 22 bp, Homo sapiens
cccagcctactctgccatagca

SEQ ID NO: 7258561 - DNA, 20 bp, Homo sapiens
tctgtggcaggtggcgcttg

SEQ ID NO: 7258562 - DNA, 22 bp, Homo sapiens
cccagccttccaccctggacta

SEQ ID NO: 7258563 - DNA, 22 bp, Homo sapiens
cccagcctgtgacagccgtcct

SEQ ID NO: 7258564 - DNA, 22 bp, Homo sapiens
cccagcctgtgacagccgtcct

SEQ ID NO: 7258565 - DNA, 22 bp, Homo sapiens
cccagcctgtctttcccaatga

SEQ ID NO: 7258566 - DNA, 22 bp, Homo sapiens
cccagcctttgcttcctggttc

SEQ ID NO: 7258567 - DNA, 22 bp, Homo sapiens
cccagctcaagcagagagctaa

SEQ ID NO: 7258568 - DNA, 23 bp, Homo sapiens
cccagcgctgagccctgcaggca

SEQ ID NO: 7258569 - DNA, 22 bp, Homo sapiens
tgcagggaatgcttgcagcatg

SEQ ID NO: 7258570 - DNA, 22 bp, Homo sapiens
tgcagggaatgcttgcagcatg

SEQ ID NO: 7258571 - DNA, 22 bp, Homo sapiens
tgcagggacacgaagacaaata

SEQ ID NO: 7258572 - DNA, 22 bp, Homo sapiens
tgcagggaggccccgcagccct

SEQ ID NO: 7258573 - DNA, 22 bp, Homo sapiens
tgcagggagctctggggtgcag

SEQ ID NO: 7258574 - DNA, 22 bp, Homo sapiens
cctggccagtttccaggccctg

SEQ ID NO: 7258575 - DNA, 22 bp, Homo sapiens
cctggcagcaggtgggcccgtg

SEQ ID NO: 7258576 - DNA, 22 bp, Homo sapiens
cctggcagtcaggggagtcctt

SEQ ID NO: 7258577 - DNA, 22 bp, Homo sapiens
tgtcctctccaacagcctctgt

SEQ ID NO: 7258578 - DNA, 22 bp, Homo sapiens
tgtctctggcccatgagcagag

SEQ ID NO: 7258579 - DNA, 22 bp, Homo sapiens
tgtctcttggctctatcactta

SEQ ID NO: 7258580 - DNA, 22 bp, Homo sapiens
cctggccgcggagcccttccag

SEQ ID NO: 7258581 - DNA, 22 bp, Homo sapiens
cctggccggtatcccacctcct

SEQ ID NO: 7258582 - DNA, 22 bp, Homo sapiens
cctggagcacagcccagtccca

SEQ ID NO: 7258583 - DNA, 22 bp, Homo sapiens
cctggagcacatggcaggaggc

SEQ ID NO: 7258584 - DNA, 19 bp, Homo sapiens
cctggaggtgaaggttctc

SEQ ID NO: 7258585 - DNA, 22 bp, Homo sapiens
cctggcacatagcaacccctcc

SEQ ID NO: 7258586 - DNA, 22 bp, Homo sapiens
tgtagggagaagagaggcacct

SEQ ID NO: 7258587 - DNA, 22 bp, Homo sapiens
tgtatgtctgtgaattcatatt

SEQ ID NO: 7258588 - DNA, 22 bp, Homo sapiens
tgtattatcaagtaaatacatg

SEQ ID NO: 7258589 - DNA, 22 bp, Homo sapiens
cctggagacgaggctggaccat

SEQ ID NO: 7258590 - DNA, 22 bp, Homo sapiens
tggtgctgccaggctcctgcca

SEQ ID NO: 7258591 - DNA, 22 bp, Homo sapiens
tggtgctgcaggtgggcacagt

SEQ ID NO: 7258592 - DNA, 22 bp, Homo sapiens
tggtgctgcctcagatgcctta

SEQ ID NO: 7258593 - DNA, 22 bp, Homo sapiens
tggtgctgtggaggggcagaag

SEQ ID NO: 7258594 - DNA, 18 bp, Homo sapiens
cctgccagtctggagcag

SEQ ID NO: 7258595 - DNA, 22 bp, Homo sapiens
tggtccgggatggacgcgggct

SEQ ID NO: 7258596 - DNA, 22 bp, Homo sapiens
cctgccagtgcctcccactggt

SEQ ID NO: 7258597 - DNA, 22 bp, Homo sapiens
cctgcccacagagagggtgcat

SEQ ID NO: 7258598 - DNA, 22 bp, Homo sapiens
cctgcccactccaggagcaact

SEQ ID NO: 7258599 - DNA, 17 bp, Homo sapiens
cctgcccagagacagat

SEQ ID NO: 7258600 - DNA, 22 bp, Homo sapiens
tggtgctcttatgttttcatca

SEQ ID NO: 7258601 - DNA, 22 bp, Homo sapiens
tggtgctcccaagattgttcta

SEQ ID NO: 7258602 - DNA, 19 bp, Homo sapiens
tggtgcgcccggcccttct

SEQ ID NO: 7258603 - DNA, 18 bp, Homo sapiens
tggtgaagggtggaggag

SEQ ID NO: 7258604 - DNA, 19 bp, Homo sapiens
tggtcccatactgctggcc

SEQ ID NO: 7258605 - DNA, 19 bp, Homo sapiens
tgtggggagtcagggggct

SEQ ID NO: 7258606 - DNA, 22 bp, Homo sapiens
cctgggcctatcctagaaccaa

SEQ ID NO: 7258607 - DNA, 22 bp, Homo sapiens
cctgggcctcacccagctcttg

SEQ ID NO: 7258608 - DNA, 22 bp, Homo sapiens
tgtgggggtacacgtacacatg

SEQ ID NO: 7258609 - DNA, 21 bp, Homo sapiens
tgtgtgggcatatctgctgca

SEQ ID NO: 7258610 - DNA, 21 bp, Homo sapiens
cctgggccaaattccctggac

SEQ ID NO: 7258611 - DNA, 22 bp, Homo sapiens
cctgggccaggcttgggaatgc

SEQ ID NO: 7258612 - DNA, 22 bp, Homo sapiens
cctgggccctcaccgccggtgg

SEQ ID NO: 7258613 - DNA, 22 bp, Homo sapiens
cctgggccctcaccgccggtgg

SEQ ID NO: 7258614 - DNA, 21 bp, Homo sapiens
cctgggccaaattccctggac

SEQ ID NO: 7258615 - DNA, 21 bp, Homo sapiens
cctgggccaaattccctggac

SEQ ID NO: 7258616 - DNA, 22 bp, Homo sapiens
cctgggaggcggaggttgcagg

SEQ ID NO: 7258617 - DNA, 19 bp, Homo sapiens
cctgggaggcggaggttgc

SEQ ID NO: 7258618 - DNA, 22 bp, Homo sapiens
cctgggaggcggaggttgcagt

SEQ ID NO: 7258619 - DNA, 22 bp, Homo sapiens
tgtggaaaaaccacaagtttgg

SEQ ID NO: 7258620 - DNA, 20 bp, Homo sapiens
tgtggaaaaacagaagcaga

SEQ ID NO: 7258621 - DNA, 22 bp, Homo sapiens
tgtggcagctggaggtggagaa

SEQ ID NO: 7258622 - DNA, 22 bp, Homo sapiens
tgtggcaggaagagcttctgag

SEQ ID NO: 7258623 - DNA, 20 bp, Homo sapiens
tgtggcaggatgagggcgga

SEQ ID NO: 7258624 - DNA, 20 bp, Homo sapiens
tgtggcaggatgagggcgga

SEQ ID NO: 7258625 - DNA, 22 bp, Homo sapiens
tgtggcaggcaagatgtacaga

SEQ ID NO: 7258626 - DNA, 22 bp, Homo sapiens
tgtggcaggcattctgaggctg

SEQ ID NO: 7258627 - DNA, 22 bp, Homo sapiens
tgtggcagggatactgaggcag

SEQ ID NO: 7258628 - DNA, 22 bp, Homo sapiens
cctgggaggcagaggttgcagt

SEQ ID NO: 7258629 - DNA, 22 bp, Homo sapiens
cctgggagctgtggaaaggctg

SEQ ID NO: 7258630 - DNA, 22 bp, Homo sapiens
tgtgggaaatgggagtggaaga

SEQ ID NO: 7258631 - DNA, 22 bp, Homo sapiens
cctggggctcaagatggcgccg

SEQ ID NO: 7258632 - DNA, 23 bp, Homo sapiens
tgtgttctcacacagatgcagta

SEQ ID NO: 7258633 - DNA, 22 bp, Homo sapiens
cctgggcctctcaaagtgctgg

SEQ ID NO: 7258634 - DNA, 22 bp, Homo sapiens
cctgggcctgaaaacatttctc

SEQ ID NO: 7258635 - DNA, 22 bp, Homo sapiens
cctgggcctggcgggtcggctc

SEQ ID NO: 7258636 - DNA, 22 bp, Homo sapiens
cctgggcctcacccagctcttg

SEQ ID NO: 7258637 - DNA, 19 bp, Homo sapiens
cctgggcctccatcacccc

SEQ ID NO: 7258638 - DNA, 22 bp, Homo sapiens
tgtgtgggtggtaaggaaggcc

SEQ ID NO: 7258639 - DNA, 22 bp, Homo sapiens
tgtgtgggtggtaaggaaggcc

SEQ ID NO: 7258640 - DNA, 22 bp, Homo sapiens
cctgggccttgacctcgtgggc

SEQ ID NO: 7258641 - DNA, 22 bp, Homo sapiens
cctgggctttgctggcaaggcc

SEQ ID NO: 7258642 - DNA, 22 bp, Homo sapiens
tgtctggtgggttgacaggcag

SEQ ID NO: 7258643 - DNA, 22 bp, Homo sapiens
tgtctgtctgcaagccagaaag

SEQ ID NO: 7258644 - DNA, 22 bp, Homo sapiens
tgtctgtccatctgtctgggac

SEQ ID NO: 7258645 - DNA, 22 bp, Homo sapiens
tgtctgtcagcagtgggtcagg

SEQ ID NO: 7258646 - DNA, 23 bp, Homo sapiens
tgtctttgaatgggctgtagaca

SEQ ID NO: 7258647 - DNA, 18 bp, Homo sapiens
tgtctttggaccactgaa

SEQ ID NO: 7258648 - DNA, 22 bp, Homo sapiens
tgtgaagatagctgttacatct

SEQ ID NO: 7258649 - DNA, 22 bp, Homo sapiens
tgtgaaggagatgaagggagtg

SEQ ID NO: 7258650 - DNA, 22 bp, Homo sapiens
tgtgaaggagcatgcagagggg

SEQ ID NO: 7258651 - DNA, 22 bp, Homo sapiens
tgtgaaggcagagccagtgaaa

SEQ ID NO: 7258652 - DNA, 22 bp, Homo sapiens
tgtgaaggcagcagctctgtcc

SEQ ID NO: 7258653 - DNA, 22 bp, Homo sapiens
tgtgaaggtaaggaggggcaag

SEQ ID NO: 7258654 - DNA, 22 bp, Homo sapiens
tgtgaaggtaaggaggggcaag

SEQ ID NO: 7258655 - DNA, 22 bp, Homo sapiens
tgtgaagggcactgtctggaat

SEQ ID NO: 7258656 - DNA, 23 bp, Homo sapiens
tgtgaaggtgggtccaagggctg

SEQ ID NO: 7258657 - DNA, 22 bp, Homo sapiens
tgtgagggttttaagggaatga

SEQ ID NO: 7258658 - DNA, 22 bp, Homo sapiens
tgtgaggataaaaaggaaggag

SEQ ID NO: 7258659 - DNA, 22 bp, Homo sapiens
cctggcttccttcatgacctgg

SEQ ID NO: 7258660 - DNA, 20 bp, Homo sapiens
cctggctttgcagcatgaga

SEQ ID NO: 7258661 - DNA, 21 bp, Homo sapiens
cctgggagaattgggtgtggc

SEQ ID NO: 7258662 - DNA, 22 bp, Homo sapiens
cctgggagagctgcccgggtga

SEQ ID NO: 7258663 - DNA, 22 bp, Homo sapiens
cctgggagagccatctgtggcc

SEQ ID NO: 7258664 - DNA, 22 bp, Homo sapiens
cctgggagagtctgtggtctcc

SEQ ID NO: 7258665 - DNA, 22 bp, Homo sapiens
tgtgccagcctctggctgtgtc

SEQ ID NO: 7258666 - DNA, 22 bp, Homo sapiens
tgtgccaggccctggggaccaa

SEQ ID NO: 7258667 - DNA, 22 bp, Homo sapiens
tgtgctggtacatgtgaggatg

SEQ ID NO: 7258668 - DNA, 22 bp, Homo sapiens
tgtgctggggtccagctgagcc

SEQ ID NO: 7258669 - DNA, 22 bp, Homo sapiens
tgtgctgggaaatggcaggata

SEQ ID NO: 7258670 - DNA, 22 bp, Homo sapiens
tgtgctgggaaatggcaggata

SEQ ID NO: 7258671 - DNA, 21 bp, Homo sapiens
tgtgccagggatggggagccc

SEQ ID NO: 7258672 - DNA, 22 bp, Homo sapiens
tgtgccaggccggggcaggaca

SEQ ID NO: 7258673 - DNA, 22 bp, Homo sapiens
gttattcttttatagcaataca

SEQ ID NO: 7258674 - DNA, 21 bp, Homo sapiens
gttattgacctccaggctggc

SEQ ID NO: 7258675 - DNA, 22 bp, Homo sapiens
gttattgaggtggagtctcact

SEQ ID NO: 7258676 - DNA, 22 bp, Homo sapiens
gttattctaccactatgtacag

SEQ ID NO: 7258677 - DNA, 22 bp, Homo sapiens
gttacattaaaaacattcactg

SEQ ID NO: 7258678 - DNA, 22 bp, Homo sapiens
gttattcaacttgtgtctctta

SEQ ID NO: 7258679 - DNA, 22 bp, Homo sapiens
gttattcaatggcttataagga

SEQ ID NO: 7258680 - DNA, 20 bp, Homo sapiens
cagcttggatgagaggctga

SEQ ID NO: 7258681 - DNA, 22 bp, Homo sapiens
cagcttgtgcaaaggtcctggg

SEQ ID NO: 7258682 - DNA, 22 bp, Homo sapiens
cagcttgtttacatgcttattc

SEQ ID NO: 7258683 - DNA, 22 bp, Homo sapiens
gttaaataacctcatgtccgtt

SEQ ID NO: 7258684 - DNA, 22 bp, Homo sapiens
gtgtgtgtatatatacacacac

SEQ ID NO: 7258685 - DNA, 22 bp, Homo sapiens
gtgtgtctttataagaagaggg

SEQ ID NO: 7258686 - DNA, 22 bp, Homo sapiens
gtgtgtctgaagttgagtagac

SEQ ID NO: 7258687 - DNA, 22 bp, Homo sapiens
cagcttcaactgcacagtcaac

SEQ ID NO: 7258688 - DNA, 22 bp, Homo sapiens
cagcttattcagtaagcacata

SEQ ID NO: 7258689 - DNA, 22 bp, Homo sapiens
gtttattgataaaagctggaca

SEQ ID NO: 7258690 - DNA, 22 bp, Homo sapiens
gtttattgggtattgtggagcc

SEQ ID NO: 7258691 - DNA, 22 bp, Homo sapiens
gtttacatgtaatgtgttattg

SEQ ID NO: 7258692 - DNA, 22 bp, Homo sapiens
gtttacattaagtattagcatc

SEQ ID NO: 7258693 - DNA, 22 bp, Homo sapiens
gtttattattcaacttcatgtt

SEQ ID NO: 7258694 - DNA, 22 bp, Homo sapiens
gtttcctttctattgccttgat

SEQ ID NO: 7258695 - DNA, 22 bp, Homo sapiens
gtttcctttctattgccttgat

SEQ ID NO: 7258696 - DNA, 22 bp, Homo sapiens
gtttcctgatgtgggagatctt

SEQ ID NO: 7258697 - DNA, 22 bp, Homo sapiens
caggaacagagtggcattgtct

SEQ ID NO: 7258698 - DNA, 22 bp, Homo sapiens
caggaagattgtggaggtggtt

SEQ ID NO: 7258699 - DNA, 22 bp, Homo sapiens
gtttacatgcagaaaatcaatg

SEQ ID NO: 7258700 - DNA, 20 bp, Homo sapiens
gttggaaagttcactctgct

SEQ ID NO: 7258701 - DNA, 22 bp, Homo sapiens
gttgctgggagcagggatcctg

SEQ ID NO: 7258702 - DNA, 22 bp, Homo sapiens
gttgctgattaacactttgagt

SEQ ID NO: 7258703 - DNA, 22 bp, Homo sapiens
gttgctgatggcaagattccag

SEQ ID NO: 7258704 - DNA, 22 bp, Homo sapiens
gttgctgaaggcatgccagaga

SEQ ID NO: 7258705 - DNA, 22 bp, Homo sapiens
gttgctgaaattaatattggag

SEQ ID NO: 7258706 - DNA, 22 bp, Homo sapiens
gttgctgaaagccctgactggc

SEQ ID NO: 7258707 - DNA, 19 bp, Homo sapiens
gttccgggagtaggccggg

SEQ ID NO: 7258708 - DNA, 22 bp, Homo sapiens
caggaacaatcttactactatt

SEQ ID NO: 7258709 - DNA, 22 bp, Homo sapiens
caggaaagtctgtaaaggaacc

SEQ ID NO: 7258710 - DNA, 22 bp, Homo sapiens
gttggcatgaggtagtcactgt

SEQ ID NO: 7258711 - DNA, 22 bp, Homo sapiens
caggaaaggtagtcacaatgta

SEQ ID NO: 7258712 - DNA, 22 bp, Homo sapiens
caggaaaggtgtgtcatgatgg

SEQ ID NO: 7258713 - DNA, 22 bp, Homo sapiens
gtgggtgtggaactgtgagacc

SEQ ID NO: 7258714 - DNA, 22 bp, Homo sapiens
gtgggtgtggttcgtttaagac

SEQ ID NO: 7258715 - DNA, 22 bp, Homo sapiens
gtggtaagactaacatttctca

SEQ ID NO: 7258716 - DNA, 22 bp, Homo sapiens
gtgtctggcttatgggaactgg

SEQ ID NO: 7258717 - DNA, 22 bp, Homo sapiens
gtgtctgttatacagaggagac

SEQ ID NO: 7258718 - DNA, 20 bp, Homo sapiens
gtgtctggagtactagagag

SEQ ID NO: 7258719 - DNA, 22 bp, Homo sapiens
gtgtctggaacgggtggtactc

SEQ ID NO: 7258720 - DNA, 22 bp, Homo sapiens
gtgtggaaacagagagggcaac

SEQ ID NO: 7258721 - DNA, 22 bp, Homo sapiens
gtgtggaaacagagagggcaac

SEQ ID NO: 7258722 - DNA, 22 bp, Homo sapiens
gtgtgcgcgcgcgtcccgggtg

SEQ ID NO: 7258723 - DNA, 22 bp, Homo sapiens
cagctggggcagccacgtgcgg

SEQ ID NO: 7258724 - DNA, 22 bp, Homo sapiens
cagctggggagagacatggcag

SEQ ID NO: 7258725 - DNA, 22 bp, Homo sapiens
cagctgctgttcagttttgttt

SEQ ID NO: 7258726 - DNA, 22 bp, Homo sapiens
cagctgcttctcctccagagct

SEQ ID NO: 7258727 - DNA, 22 bp, Homo sapiens
gtgggtggaggcgtcgagggca

SEQ ID NO: 7258728 - DNA, 22 bp, Homo sapiens
cagctgcctatgacctagcctc

SEQ ID NO: 7258729 - DNA, 22 bp, Homo sapiens
cagctgatttgagaaagaatga

SEQ ID NO: 7258730 - DNA, 22 bp, Homo sapiens
gtggggctgagtggagccagaa

SEQ ID NO: 7258731 - DNA, 22 bp, Homo sapiens
gtggggctcccatctcctggct

SEQ ID NO: 7258732 - DNA, 22 bp, Homo sapiens
gtggggcctgtggcttccgtgg

SEQ ID NO: 7258733 - DNA, 22 bp, Homo sapiens
gtggggcagtggcctgggagca

SEQ ID NO: 7258734 - DNA, 22 bp, Homo sapiens
gtggggcatgcacgctgctcct

SEQ ID NO: 7258735 - DNA, 22 bp, Homo sapiens
gtggggagtgttctgtgattgg

SEQ ID NO: 7258736 - DNA, 22 bp, Homo sapiens
gtggggcagtggcctgggagca

SEQ ID NO: 7258737 - DNA, 22 bp, Homo sapiens
gtggggcagtggcctgggagca

SEQ ID NO: 7258738 - DNA, 22 bp, Homo sapiens
gtggcaggtcccattggagcag

SEQ ID NO: 7258739 - DNA, 22 bp, Homo sapiens
gtggcaggtcccattggagcag

SEQ ID NO: 7258740 - DNA, 22 bp, Homo sapiens
gtggcaggttccgtagacagca

SEQ ID NO: 7258741 - DNA, 22 bp, Homo sapiens
cagcccagccgagggcctggct

SEQ ID NO: 7258742 - DNA, 22 bp, Homo sapiens
cagctctgtgcaggcctgggga

SEQ ID NO: 7258743 - DNA, 22 bp, Homo sapiens
cagctctgtgcaggcctgggga

SEQ ID NO: 7258744 - DNA, 22 bp, Homo sapiens
cagctctggctttggggagctt

SEQ ID NO: 7258745 - DNA, 22 bp, Homo sapiens
cagctctggctattgaggacca

SEQ ID NO: 7258746 - DNA, 19 bp, Homo sapiens
gtggccagggcaggggctg

SEQ ID NO: 7258747 - DNA, 22 bp, Homo sapiens
gtggccaggcgtccgcgcggct

SEQ ID NO: 7258748 - DNA, 22 bp, Homo sapiens
gtggccaggtcagggacttgtg

SEQ ID NO: 7258749 - DNA, 22 bp, Homo sapiens
gtggccagggcccacaggatga

SEQ ID NO: 7258750 - DNA, 22 bp, Homo sapiens
gtggccagtgggaatgggctca

SEQ ID NO: 7258751 - DNA, 22 bp, Homo sapiens
gtgggacaggtcaaatcttaaa

SEQ ID NO: 7258752 - DNA, 22 bp, Homo sapiens
gtgggacagctggagggtccct

SEQ ID NO: 7258753 - DNA, 22 bp, Homo sapiens
gtgggacagcggggtgggacag

SEQ ID NO: 7258754 - DNA, 22 bp, Homo sapiens
gtgggcaggaggccctgccctg

SEQ ID NO: 7258755 - DNA, 22 bp, Homo sapiens
gtgggcaggccccaaagcaggg

SEQ ID NO: 7258756 - DNA, 22 bp, Homo sapiens
gtgggcaggagtgagcaacagg

SEQ ID NO: 7258757 - DNA, 22 bp, Homo sapiens
gtgggcaggtaggcaccagcta

SEQ ID NO: 7258758 - DNA, 22 bp, Homo sapiens
gtgggcagggttgctttctccg

SEQ ID NO: 7258759 - DNA, 22 bp, Homo sapiens
gtgggcaggccctaggcgattt

SEQ ID NO: 7258760 - DNA, 22 bp, Homo sapiens
gtgggcagtcatgaaatctaga

SEQ ID NO: 7258761 - DNA, 22 bp, Homo sapiens
gtgggcaggtaggcaccagcta

SEQ ID NO: 7258762 - DNA, 22 bp, Homo sapiens
gtgggcagtgcctgacggatga

SEQ ID NO: 7258763 - DNA, 22 bp, Homo sapiens
gtgggcagtggtttgcgcggtc

SEQ ID NO: 7258764 - DNA, 22 bp, Homo sapiens
gtgggcagtggggtcttctgcc

SEQ ID NO: 7258765 - DNA, 22 bp, Homo sapiens
gtggccttgggcactgaccttg

SEQ ID NO: 7258766 - DNA, 22 bp, Homo sapiens
gtggccttggcttctaccctga

SEQ ID NO: 7258767 - DNA, 22 bp, Homo sapiens
gtggcgcagagggtggcagaga

SEQ ID NO: 7258768 - DNA, 22 bp, Homo sapiens
gtgggaagtctctcggaggaag

SEQ ID NO: 7258769 - DNA, 22 bp, Homo sapiens
gtggcttgaccatccctgctac

SEQ ID NO: 7258770 - DNA, 22 bp, Homo sapiens
gtggccttaggacacgtttatt

SEQ ID NO: 7258771 - DNA, 22 bp, Homo sapiens
cagctgaagagaggtgctgagt

SEQ ID NO: 7258772 - DNA, 23 bp, Homo sapiens
cagctgaagcagcctgggctgga

SEQ ID NO: 7258773 - DNA, 22 bp, Homo sapiens
cagctctttattgaaacaaaaa

SEQ ID NO: 7258774 - DNA, 22 bp, Homo sapiens
cagctctttattgccaatattc

SEQ ID NO: 7258775 - DNA, 22 bp, Homo sapiens
cagctcttggagcctccagtaa

SEQ ID NO: 7258776 - DNA, 22 bp, Homo sapiens
cagctctttactctgcaatgat

SEQ ID NO: 7258777 - DNA, 18 bp, Homo sapiens
cagctcttctccagtaac

SEQ ID NO: 7258778 - DNA, 22 bp, Homo sapiens
cagctcttggagaaaccagagc

SEQ ID NO: 7258779 - DNA, 22 bp, Homo sapiens
cagctcttcctcccaccggaca

SEQ ID NO: 7258780 - DNA, 17 bp, Homo sapiens
cagctcttcctccctct

SEQ ID NO: 7258781 - DNA, 22 bp, Homo sapiens
cagctcttcctaccctagttgg

SEQ ID NO: 7258782 - DNA, 22 bp, Homo sapiens
cagctcttcctagccatgccac

SEQ ID NO: 7258783 - DNA, 22 bp, Homo sapiens
cagctcttttttgcagcagctg

SEQ ID NO: 7258784 - DNA, 22 bp, Homo sapiens
cagctctttgagtattccattt

SEQ ID NO: 7258785 - DNA, 22 bp, Homo sapiens
cagctctttttcacacaacatg

SEQ ID NO: 7258786 - DNA, 22 bp, Homo sapiens
cagctgaagaaagagtggttag

SEQ ID NO: 7258787 - DNA, 22 bp, Homo sapiens
cagctcttccatttccttcagc

SEQ ID NO: 7258788 - DNA, 22 bp, Homo sapiens
cagctcttccctcttcttgtag

SEQ ID NO: 7258789 - DNA, 22 bp, Homo sapiens
cagctcttcagtgcctgagata

SEQ ID NO: 7258790 - DNA, 22 bp, Homo sapiens
cagctcttcagagtgagcaatg

SEQ ID NO: 7258791 - DNA, 22 bp, Homo sapiens
cagctcttagagggagacagac

SEQ ID NO: 7258792 - DNA, 22 bp, Homo sapiens
cagctcttattttctctcctaa

SEQ ID NO: 7258793 - DNA, 22 bp, Homo sapiens
cagctcttaacacagcttgtat

SEQ ID NO: 7258794 - DNA, 22 bp, Homo sapiens
caggccctgggcaggatcagcc

SEQ ID NO: 7258795 - DNA, 22 bp, Homo sapiens
tacatcaaatcaatgttccagt

SEQ ID NO: 7258796 - DNA, 22 bp, Homo sapiens
tacaagtccgtaaagggcagat

SEQ ID NO: 7258797 - DNA, 22 bp, Homo sapiens
tacaagtactgtggctttgaat

SEQ ID NO: 7258798 - DNA, 22 bp, Homo sapiens
tacagggctgagtgagacatgg

SEQ ID NO: 7258799 - DNA, 22 bp, Homo sapiens
tacaaggaaaatcttgaagtac

SEQ ID NO: 7258800 - DNA, 22 bp, Homo sapiens
taatttaatttcatgccagcct

SEQ ID NO: 7258801 - DNA, 22 bp, Homo sapiens
taatttaatccaagtgttacat

SEQ ID NO: 7258802 - DNA, 22 bp, Homo sapiens
taatttaattccatggattcta

SEQ ID NO: 7258803 - DNA, 22 bp, Homo sapiens
caggcagactttgagaatgatg

SEQ ID NO: 7258804 - DNA, 22 bp, Homo sapiens
caggcagcctgagggatctggg

SEQ ID NO: 7258805 - DNA, 22 bp, Homo sapiens
caggcagcctgcggtctgcaca

SEQ ID NO: 7258806 - DNA, 22 bp, Homo sapiens
caggcagctgcgacaagagagc

SEQ ID NO: 7258807 - DNA, 20 bp, Homo sapiens
caggatgattggacacgatg

SEQ ID NO: 7258808 - DNA, 19 bp, Homo sapiens
caggatgatcccatgacac

SEQ ID NO: 7258809 - DNA, 18 bp, Homo sapiens
caggatgagtgatgggga

SEQ ID NO: 7258810 - DNA, 22 bp, Homo sapiens
caggatgaggtagaggcagata

SEQ ID NO: 7258811 - DNA, 22 bp, Homo sapiens
taacagaaatagaaatgagagt

SEQ ID NO: 7258812 - DNA, 22 bp, Homo sapiens
taacattgttatgaatcaggtc

SEQ ID NO: 7258813 - DNA, 22 bp, Homo sapiens
taacagaagttgttcattgtgg

SEQ ID NO: 7258814 - DNA, 22 bp, Homo sapiens
taacaactggacaatgttgctc

SEQ ID NO: 7258815 - DNA, 22 bp, Homo sapiens
taagatgtacaaccacttctct

SEQ ID NO: 7258816 - DNA, 22 bp, Homo sapiens
taagattacagtgagaaataaa

SEQ ID NO: 7258817 - DNA, 22 bp, Homo sapiens
caggcacagctaagactggcca

SEQ ID NO: 7258818 - DNA, 22 bp, Homo sapiens
caggacagtataggctttagga

SEQ ID NO: 7258819 - DNA, 22 bp, Homo sapiens
gttttccaggtaccttggtatt

SEQ ID NO: 7258820 - DNA, 22 bp, Homo sapiens
gttttccactggattgtttgga

SEQ ID NO: 7258821 - DNA, 18 bp, Homo sapiens
gttttccatttgttcctc

SEQ ID NO: 7258822 - DNA, 22 bp, Homo sapiens
gttttccatggaggtctgacct

SEQ ID NO: 7258823 - DNA, 22 bp, Homo sapiens
caggacaggtgttctagatcag

SEQ ID NO: 7258824 - DNA, 22 bp, Homo sapiens
caggacagctcaacacctcctc

SEQ ID NO: 7258825 - DNA, 22 bp, Homo sapiens
caggacagctgggccaccacca

SEQ ID NO: 7258826 - DNA, 22 bp, Homo sapiens
caggacaggagtggggtcaaag

SEQ ID NO: 7258827 - DNA, 22 bp, Homo sapiens
caggaattcatagcattgttct

SEQ ID NO: 7258828 - DNA, 22 bp, Homo sapiens
gtttggagccccgtgggaagga

SEQ ID NO: 7258829 - DNA, 18 bp, Homo sapiens
gtttggacttttctccct

SEQ ID NO: 7258830 - DNA, 22 bp, Homo sapiens
caggaatagtggagcaacaaga

SEQ ID NO: 7258831 - DNA, 22 bp, Homo sapiens
caggaaggaaagggtgtggaga

SEQ ID NO: 7258832 - DNA, 22 bp, Homo sapiens
taaaatagcatgtgcagtgaaa

SEQ ID NO: 7258833 - DNA, 22 bp, Homo sapiens
taaaaagcagctgagattttct

SEQ ID NO: 7258834 - DNA, 22 bp, Homo sapiens
taaaaagtagtgagaatggcgc

SEQ ID NO: 7258835 - DNA, 22 bp, Homo sapiens
gttttctgcctgaaggtgacca

SEQ ID NO: 7258836 - DNA, 22 bp, Homo sapiens
caggacagtgcaggtccatcct

SEQ ID NO: 7258837 - DNA, 22 bp, Homo sapiens
caggacagtgcaggtccatcct

SEQ ID NO: 7258838 - DNA, 22 bp, Homo sapiens
taaacatttgttattcttgttt

SEQ ID NO: 7258839 - DNA, 22 bp, Homo sapiens
taaaccattcagactgaaccac

SEQ ID NO: 7258840 - DNA, 22 bp, Homo sapiens
taaaccatgcagacagctccat

SEQ ID NO: 7258841 - DNA, 22 bp, Homo sapiens
taaaccattcacatcccagaaa

SEQ ID NO: 7258842 - DNA, 21 bp, Homo sapiens
taaaccaggtaatttccattc

SEQ ID NO: 7258843 - DNA, 22 bp, Homo sapiens
taaaccatccatcccacctgtg

SEQ ID NO: 7258844 - DNA, 22 bp, Homo sapiens
caggagaagtctctagggggtg

SEQ ID NO: 7258845 - DNA, 22 bp, Homo sapiens
caggagaagtctctagggggtg

SEQ ID NO: 7258846 - DNA, 22 bp, Homo sapiens
caggagaaggtttggagtgcag

SEQ ID NO: 7258847 - DNA, 22 bp, Homo sapiens
caggagaagtctctagggggtg

SEQ ID NO: 7258848 - DNA, 22 bp, Homo sapiens
caggacagttggcatctgctgc

SEQ ID NO: 7258849 - DNA, 19 bp, Homo sapiens
caggacagtttgccaagaa

SEQ ID NO: 7258850 - DNA, 22 bp, Homo sapiens
caggacagtttgctttgccctg

SEQ ID NO: 7258851 - DNA, 22 bp, Homo sapiens
caggaggaagaactctgcaaca

SEQ ID NO: 7258852 - DNA, 22 bp, Homo sapiens
caggaggcagcgctctcaggac

SEQ ID NO: 7258853 - DNA, 22 bp, Homo sapiens
taaatgtctcccgtgagcctca

SEQ ID NO: 7258854 - DNA, 22 bp, Homo sapiens
taacaaagtattgtttgtgtat

SEQ ID NO: 7258855 - DNA, 22 bp, Homo sapiens
taacaaagtaccatagattggg

SEQ ID NO: 7258856 - DNA, 22 bp, Homo sapiens
caggagtgtctccacacagcaa

SEQ ID NO: 7258857 - DNA, 22 bp, Homo sapiens
caggagtgcaggtggtgaggca

SEQ ID NO: 7258858 - DNA, 22 bp, Homo sapiens
caggagggggtggagtttcgcc

SEQ ID NO: 7258859 - DNA, 22 bp, Homo sapiens
caggagggcccgagactcttcc

SEQ ID NO: 7258860 - DNA, 20 bp, Homo sapiens
caggagggacatttcagcat

SEQ ID NO: 7258861 - DNA, 15 bp, Homo sapiens
caggagaggaaggtt

SEQ ID NO: 7258862 - DNA, 19 bp, Homo sapiens
caggagagcatgcactttg

SEQ ID NO: 7258863 - DNA, 22 bp, Homo sapiens
caggagaggaggctacttctta

SEQ ID NO: 7258864 - DNA, 22 bp, Homo sapiens
caggagaggctgtacgtttctc

SEQ ID NO: 7258865 - DNA, 22 bp, Homo sapiens
taaatagggtaagcgtgtttac

SEQ ID NO: 7258866 - DNA, 22 bp, Homo sapiens
taaatagggaatagaagaggaa

SEQ ID NO: 7258867 - DNA, 22 bp, Homo sapiens
taaagctacacattattaatcc

SEQ ID NO: 7258868 - DNA, 22 bp, Homo sapiens
taaagccatactgaaagccact

SEQ ID NO: 7258869 - DNA, 22 bp, Homo sapiens
taaagtccttgaaccggatgta

SEQ ID NO: 7258870 - DNA, 22 bp, Homo sapiens
taaagtcatctttacatctttg

SEQ ID NO: 7258871 - DNA, 18 bp, Homo sapiens
tcctggtggagaagtggt

SEQ ID NO: 7258872 - DNA, 22 bp, Homo sapiens
tcctggtgcttgtatttgaagt

SEQ ID NO: 7258873 - DNA, 19 bp, Homo sapiens
tcctggtgcttgacactga

SEQ ID NO: 7258874 - DNA, 20 bp, Homo sapiens
tcctggtggatactgcttaa

SEQ ID NO: 7258875 - DNA, 22 bp, Homo sapiens
tcctggtggatagaagccaagg

SEQ ID NO: 7258876 - DNA, 22 bp, Homo sapiens
ccacagggtgtcatcagcttga

SEQ ID NO: 7258877 - DNA, 23 bp, Homo sapiens
tcctggtgacatgcctgagcatc

SEQ ID NO: 7258878 - DNA, 19 bp, Homo sapiens
tcctggtgaccctgaaatt

SEQ ID NO: 7258879 - DNA, 22 bp, Homo sapiens
tcctggtgaggactccaagata

SEQ ID NO: 7258880 - DNA, 22 bp, Homo sapiens
tcctggtgaggctagaagtgtc

SEQ ID NO: 7258881 - DNA, 22 bp, Homo sapiens
tcctggtgatcaaaattcattt

SEQ ID NO: 7258882 - DNA, 22 bp, Homo sapiens
tcctggtgcctggagctctcca

SEQ ID NO: 7258883 - DNA, 22 bp, Homo sapiens
tcctggtgctgacacccatagc

SEQ ID NO: 7258884 - DNA, 22 bp, Homo sapiens
tcctggtgaatgactttttatt

SEQ ID NO: 7258885 - DNA, 22 bp, Homo sapiens
tcctggggagggttctggctcc

SEQ ID NO: 7258886 - DNA, 22 bp, Homo sapiens
ccacagtgagtgtcatacttgg

SEQ ID NO: 7258887 - DNA, 22 bp, Homo sapiens
ccacagtgacacgggctggccc

SEQ ID NO: 7258888 - DNA, 22 bp, Homo sapiens
ccacagtcctggcttctgtctg

SEQ ID NO: 7258889 - DNA, 21 bp, Homo sapiens
ccactctgagtgttgaacaga

SEQ ID NO: 7258890 - DNA, 22 bp, Homo sapiens
ccactctgattttggctccact

SEQ ID NO: 7258891 - DNA, 22 bp, Homo sapiens
ccactctgctgtgctccatgat

SEQ ID NO: 7258892 - DNA, 22 bp, Homo sapiens
ccactgcctctccagggccatc

SEQ ID NO: 7258893 - DNA, 22 bp, Homo sapiens
ccactgccgtgggccttgggga

SEQ ID NO: 7258894 - DNA, 22 bp, Homo sapiens
ccactgccagccgcccggaggc

SEQ ID NO: 7258895 - DNA, 22 bp, Homo sapiens
ccactgccgatgttccatcttg

SEQ ID NO: 7258896 - DNA, 22 bp, Homo sapiens
ccactgccccctgaagaccagg

SEQ ID NO: 7258897 - DNA, 22 bp, Homo sapiens
ccactgcccaccccgacgtcta

SEQ ID NO: 7258898 - DNA, 22 bp, Homo sapiens
ccactgccccctgaagaccagg

SEQ ID NO: 7258899 - DNA, 22 bp, Homo sapiens
ccagaatcatcatctgaagcct

SEQ ID NO: 7258900 - DNA, 22 bp, Homo sapiens
ccagaataggagtaataaaacc

SEQ ID NO: 7258901 - DNA, 22 bp, Homo sapiens
ccagagcctgctgagccccatt

SEQ ID NO: 7258902 - DNA, 22 bp, Homo sapiens
ccagaatgttctagagccaccc

SEQ ID NO: 7258903 - DNA, 22 bp, Homo sapiens
ccagaggaaaaatatctcccta

SEQ ID NO: 7258904 - DNA, 22 bp, Homo sapiens
tctcctgggaggacaaggaagg

SEQ ID NO: 7258905 - DNA, 21 bp, Homo sapiens
tctcccaaggaggtcctgagg

SEQ ID NO: 7258906 - DNA, 20 bp, Homo sapiens
tctctctggttggaggagct

SEQ ID NO: 7258907 - DNA, 22 bp, Homo sapiens
ccagaggaggggggtctttctg

SEQ ID NO: 7258908 - DNA, 22 bp, Homo sapiens
ccagaggagcaggctggctcca

SEQ ID NO: 7258909 - DNA, 22 bp, Homo sapiens
ccagaggacttgggggctgaat

SEQ ID NO: 7258910 - DNA, 22 bp, Homo sapiens
ccagaggagatgcctcctctgt

SEQ ID NO: 7258911 - DNA, 22 bp, Homo sapiens
tctctacctgctccatagccat

SEQ ID NO: 7258912 - DNA, 22 bp, Homo sapiens
catttatgatagtaatatgaaa

SEQ ID NO: 7258913 - DNA, 22 bp, Homo sapiens
catttatgaagcactttagagt

SEQ ID NO: 7258914 - DNA, 22 bp, Homo sapiens
catttatgaagcactttagagt

SEQ ID NO: 7258915 - DNA, 22 bp, Homo sapiens
catttatataaaatgtccagaa

SEQ ID NO: 7258916 - DNA, 22 bp, Homo sapiens
catttattagttagttcgatgt

SEQ ID NO: 7258917 - DNA, 22 bp, Homo sapiens
catttatgttttacttggtcac

SEQ ID NO: 7258918 - DNA, 22 bp, Homo sapiens
tcccagggtcagtggtgaggcc

SEQ ID NO: 7258919 - DNA, 22 bp, Homo sapiens
catttacttaaatctttacaag

SEQ ID NO: 7258920 - DNA, 19 bp, Homo sapiens
catttagaagtacatatta

SEQ ID NO: 7258921 - DNA, 22 bp, Homo sapiens
catttgaatgagattgctgtaa

SEQ ID NO: 7258922 - DNA, 22 bp, Homo sapiens
catttgaagacttagaagagga

SEQ ID NO: 7258923 - DNA, 22 bp, Homo sapiens
catttgaagacttagaagagga

SEQ ID NO: 7258924 - DNA, 22 bp, Homo sapiens
catttgaacctggatgttctta

SEQ ID NO: 7258925 - DNA, 22 bp, Homo sapiens
catttgaactaataactgtgct

SEQ ID NO: 7258926 - DNA, 22 bp, Homo sapiens
catttgaattgttctgtgggaa

SEQ ID NO: 7258927 - DNA, 22 bp, Homo sapiens
tccctgcctctcagacttcctt

SEQ ID NO: 7258928 - DNA, 22 bp, Homo sapiens
catttgcagagggtgacactct

SEQ ID NO: 7258929 - DNA, 20 bp, Homo sapiens
tccctgccttttactgctgg

SEQ ID NO: 7258930 - DNA, 22 bp, Homo sapiens
ccaattgtcctaattaattaga

SEQ ID NO: 7258931 - DNA, 22 bp, Homo sapiens
tcctgcagttacatcccagcca

SEQ ID NO: 7258932 - DNA, 22 bp, Homo sapiens
tcctgcagtgtgtctcctgcac

SEQ ID NO: 7258933 - DNA, 22 bp, Homo sapiens
ccacacagggggatgagttatt

SEQ ID NO: 7258934 - DNA, 22 bp, Homo sapiens
ccaaatagtctttcattgaatt

SEQ ID NO: 7258935 - DNA, 22 bp, Homo sapiens
ccaaatattaacaaagtaattt

SEQ ID NO: 7258936 - DNA, 22 bp, Homo sapiens
tcctcccacataggacaatggg

SEQ ID NO: 7258937 - DNA, 22 bp, Homo sapiens
ccaagggcatcttgcatgctgg

SEQ ID NO: 7258938 - DNA, 22 bp, Homo sapiens
ccacagaggacaactgcctggc

SEQ ID NO: 7258939 - DNA, 20 bp, Homo sapiens
ccacagaggacagggctgtg

SEQ ID NO: 7258940 - DNA, 22 bp, Homo sapiens
ccacagagttacaaaacagtca

SEQ ID NO: 7258941 - DNA, 22 bp, Homo sapiens
ccacagagttgatgcaataaga

SEQ ID NO: 7258942 - DNA, 22 bp, Homo sapiens
ccacagagttacaaaacagtca

SEQ ID NO: 7258943 - DNA, 22 bp, Homo sapiens
tctgcctgaaccactcttggag

SEQ ID NO: 7258944 - DNA, 22 bp, Homo sapiens
tctgcctgaaattcacatgtaa

SEQ ID NO: 7258945 - DNA, 22 bp, Homo sapiens
tctgcgtgggactgaggaggct

SEQ ID NO: 7258946 - DNA, 22 bp, Homo sapiens
tctgcgtgatgagggtgcagca

SEQ ID NO: 7258947 - DNA, 22 bp, Homo sapiens
tctgcgtgaaactagatggcag

SEQ ID NO: 7258948 - DNA, 22 bp, Homo sapiens
ccagctgggtccctgctggggc

SEQ ID NO: 7258949 - DNA, 22 bp, Homo sapiens
tctggagcgaggtccctgtctg

SEQ ID NO: 7258950 - DNA, 19 bp, Homo sapiens
tctggagctgatgcaggtg

SEQ ID NO: 7258951 - DNA, 22 bp, Homo sapiens
tctggagccttggatgggaaag

SEQ ID NO: 7258952 - DNA, 22 bp, Homo sapiens
tctggaggcaactaacctagtt

SEQ ID NO: 7258953 - DNA, 22 bp, Homo sapiens
tctggagctggagggcaaggca

SEQ ID NO: 7258954 - DNA, 21 bp, Homo sapiens
tctggagctgcaggctgggca

SEQ ID NO: 7258955 - DNA, 19 bp, Homo sapiens
tctggagctgatgcaggtg

SEQ ID NO: 7258956 - DNA, 19 bp, Homo sapiens
tctggagctgatgcaggtg

SEQ ID NO: 7258957 - DNA, 22 bp, Homo sapiens
tctggctgttgttaggttcctg

SEQ ID NO: 7258958 - DNA, 22 bp, Homo sapiens
tctggcttcaagtcccagctct

SEQ ID NO: 7258959 - DNA, 22 bp, Homo sapiens
tctggcttgaacaattaggtaa

SEQ ID NO: 7258960 - DNA, 22 bp, Homo sapiens
tctggctttattttcatcatct

SEQ ID NO: 7258961 - DNA, 22 bp, Homo sapiens
tctgtctgtagttttacatgat

SEQ ID NO: 7258962 - DNA, 22 bp, Homo sapiens
tctgtctgggtgcctcgagtac

SEQ ID NO: 7258963 - DNA, 23 bp, Homo sapiens
tctgtcactttctgctgtggagt

SEQ ID NO: 7258964 - DNA, 22 bp, Homo sapiens
ccaggaggcggaaggtacagtg

SEQ ID NO: 7258965 - DNA, 22 bp, Homo sapiens
ccaggaggcaatatcaagtcca

SEQ ID NO: 7258966 - DNA, 22 bp, Homo sapiens
ccaggaggatggttgttaggtg

SEQ ID NO: 7258967 - DNA, 22 bp, Homo sapiens
ccagccagtcccgcatgaccgc

SEQ ID NO: 7258968 - DNA, 22 bp, Homo sapiens
ccagccataaacccagatgact

SEQ ID NO: 7258969 - DNA, 22 bp, Homo sapiens
tctcttggaggttcttcctgtt

SEQ ID NO: 7258970 - DNA, 22 bp, Homo sapiens
tctctctgtgacagctttgctg

SEQ ID NO: 7258971 - DNA, 22 bp, Homo sapiens
ccagcccctatcctcgctccac

SEQ ID NO: 7258972 - DNA, 22 bp, Homo sapiens
ccagccccgggaacctggccgt

SEQ ID NO: 7258973 - DNA, 19 bp, Homo sapiens
ccagcccatagtccatcac

SEQ ID NO: 7258974 - DNA, 22 bp, Homo sapiens
ccagccccgggaacctggccgt

SEQ ID NO: 7258975 - DNA, 22 bp, Homo sapiens
ccagccataatacgaacccagc

SEQ ID NO: 7258976 - DNA, 22 bp, Homo sapiens
ccagctcctgagcatggtttcc

SEQ ID NO: 7258977 - DNA, 22 bp, Homo sapiens
ccagctccttctgtctgtggag

SEQ ID NO: 7258978 - DNA, 22 bp, Homo sapiens
ccagctcctgggtcttagtcag

SEQ ID NO: 7258979 - DNA, 22 bp, Homo sapiens
ccagctcctcttcccagtgtca

SEQ ID NO: 7258980 - DNA, 22 bp, Homo sapiens
ccagctccaggactgggagctg

SEQ ID NO: 7258981 - DNA, 21 bp, Homo sapiens
ccagctccaggaccttggatc

SEQ ID NO: 7258982 - DNA, 22 bp, Homo sapiens
ccagctcctcttgtctctagca

SEQ ID NO: 7258983 - DNA, 22 bp, Homo sapiens
ccagctcctcttgtctctagca

SEQ ID NO: 7258984 - DNA, 22 bp, Homo sapiens
tctgccacttgaggtcattggc

SEQ ID NO: 7258985 - DNA, 22 bp, Homo sapiens
tctgcctcgctaacagcagcca

SEQ ID NO: 7258986 - DNA, 22 bp, Homo sapiens
ccagctccaagtttgggcatca

SEQ ID NO: 7258987 - DNA, 22 bp, Homo sapiens
ccagctccagcatagccaccat

SEQ ID NO: 7258988 - DNA, 22 bp, Homo sapiens
ccagctccactgtcagatgaga

SEQ ID NO: 7258989 - DNA, 21 bp, Homo sapiens
ccagctccaggaccttggatc

SEQ ID NO: 7258990 - DNA, 22 bp, Homo sapiens
ccagcctggttcagaattggct

SEQ ID NO: 7258991 - DNA, 22 bp, Homo sapiens
ccagcctgggtgttagaagaca

SEQ ID NO: 7258992 - DNA, 22 bp, Homo sapiens
ccagccttcacctgctctggtc

SEQ ID NO: 7258993 - DNA, 22 bp, Homo sapiens
ccagcctggggaggcagcttct

SEQ ID NO: 7258994 - DNA, 22 bp, Homo sapiens
ccagcctggagggcagtggtgg

SEQ ID NO: 7258995 - DNA, 22 bp, Homo sapiens
tctgagtgatgttgagtcagaa

SEQ ID NO: 7258996 - DNA, 22 bp, Homo sapiens
tctgagttgaggaaatgcattt

SEQ ID NO: 7258997 - DNA, 22 bp, Homo sapiens
tcaggtgggacctgctaggaca

SEQ ID NO: 7258998 - DNA, 22 bp, Homo sapiens
tcaggtggcttcggggagtggc

SEQ ID NO: 7258999 - DNA, 22 bp, Homo sapiens
tcaggtggctggttgctggcta

SEQ ID NO: 7259000 - DNA, 22 bp, Homo sapiens
tcaggtgggagtagaatgctag

SEQ ID NO: 7259001 - DNA, 22 bp, Homo sapiens
tcaggtgggacctgctaggaca

SEQ ID NO: 7259002 - DNA, 22 bp, Homo sapiens
tcagttgctagaagggggaacc

SEQ ID NO: 7259003 - DNA, 22 bp, Homo sapiens
tcagttcttagtaatgcagtct

SEQ ID NO: 7259004 - DNA, 21 bp, Homo sapiens
tcagttctctgcctgtgcttg

SEQ ID NO: 7259005 - DNA, 22 bp, Homo sapiens
catgatctggtcctactgtggg

SEQ ID NO: 7259006 - DNA, 22 bp, Homo sapiens
catgagaaggttttggcatata

SEQ ID NO: 7259007 - DNA, 22 bp, Homo sapiens
tcatgtcccgttgctggctgcc

SEQ ID NO: 7259008 - DNA, 22 bp, Homo sapiens
tcatttgttgaactttagtgcg

SEQ ID NO: 7259009 - DNA, 18 bp, Homo sapiens
tcatttgttttgcatgaa

SEQ ID NO: 7259010 - DNA, 22 bp, Homo sapiens
tcatgggaacaccagtattctc

SEQ ID NO: 7259011 - DNA, 22 bp, Homo sapiens
tcatggggtgacagaagggagg

SEQ ID NO: 7259012 - DNA, 22 bp, Homo sapiens
tcatgggtgctccaggtggctg

SEQ ID NO: 7259013 - DNA, 22 bp, Homo sapiens
catgtgcagtgtaagacatgct

SEQ ID NO: 7259014 - DNA, 22 bp, Homo sapiens
catgtgaattccaaagctaggt

SEQ ID NO: 7259015 - DNA, 22 bp, Homo sapiens
catggccaggcacgcgcatagc

SEQ ID NO: 7259016 - DNA, 22 bp, Homo sapiens
catgcaattttttcttgtcagt

SEQ ID NO: 7259017 - DNA, 22 bp, Homo sapiens
catcacagatgttgtgtggagt

SEQ ID NO: 7259018 - DNA, 22 bp, Homo sapiens
tcagggccatcttttgcctcaa

SEQ ID NO: 7259019 - DNA, 22 bp, Homo sapiens
catcacaggtcctgatgacatt

SEQ ID NO: 7259020 - DNA, 22 bp, Homo sapiens
catcacaggcattttgagtgtc

SEQ ID NO: 7259021 - DNA, 22 bp, Homo sapiens
catccactagaatgacagagtt

SEQ ID NO: 7259022 - DNA, 22 bp, Homo sapiens
catccagagtccaaggctgggc

SEQ ID NO: 7259023 - DNA, 22 bp, Homo sapiens
catatgaaatatgagttgaaca

SEQ ID NO: 7259024 - DNA, 23 bp, Homo sapiens
catatgaattttagaggcagttt

SEQ ID NO: 7259025 - DNA, 22 bp, Homo sapiens
catatgaagttcaacagagatg

SEQ ID NO: 7259026 - DNA, 22 bp, Homo sapiens
catatccaggtttctttggttt

SEQ ID NO: 7259027 - DNA, 22 bp, Homo sapiens
catatcataggtcttggataat

SEQ ID NO: 7259028 - DNA, 22 bp, Homo sapiens
catatcatggcactgagggaat

SEQ ID NO: 7259029 - DNA, 22 bp, Homo sapiens
catatcatttgcttataaatct

SEQ ID NO: 7259030 - DNA, 20 bp, Homo sapiens
catatatacctagaagtgga

SEQ ID NO: 7259031 - DNA, 22 bp, Homo sapiens
catatacttttctatagctttc

SEQ ID NO: 7259032 - DNA, 20 bp, Homo sapiens
catatatacctagaagtgga

SEQ ID NO: 7259033 - DNA, 22 bp, Homo sapiens
catataatgtttgaagatgtgg

SEQ ID NO: 7259034 - DNA, 22 bp, Homo sapiens
catataattacctaccagctgg

SEQ ID NO: 7259035 - DNA, 22 bp, Homo sapiens
catatacacttccacctctgtg

SEQ ID NO: 7259036 - DNA, 22 bp, Homo sapiens
catagacagatggtaagaagct

SEQ ID NO: 7259037 - DNA, 22 bp, Homo sapiens
catagacaaagatcagaagagt

SEQ ID NO: 7259038 - DNA, 22 bp, Homo sapiens
catagaatgtaataaagagtag

SEQ ID NO: 7259039 - DNA, 22 bp, Homo sapiens
catagaaaagagtaggtaatgt

SEQ ID NO: 7259040 - DNA, 22 bp, Homo sapiens
catagaaaagagtaggtaatgt

SEQ ID NO: 7259041 - DNA, 22 bp, Homo sapiens
catactgtcagagcctgaaggg

SEQ ID NO: 7259042 - DNA, 22 bp, Homo sapiens
tcagctgcagcaggcaccattt

SEQ ID NO: 7259043 - DNA, 22 bp, Homo sapiens
cataatttttttaagtcagaac

SEQ ID NO: 7259044 - DNA, 22 bp, Homo sapiens
tcagccctgggcttcctcatgg

SEQ ID NO: 7259045 - DNA, 20 bp, Homo sapiens
tcagccctgagtccaggctg

SEQ ID NO: 7259046 - DNA, 22 bp, Homo sapiens
tcagccctagcctcagtccagg

SEQ ID NO: 7259047 - DNA, 22 bp, Homo sapiens
cagtttcttcaattcagacact

SEQ ID NO: 7259048 - DNA, 22 bp, Homo sapiens
cagtttcttcatcagttaagca

SEQ ID NO: 7259049 - DNA, 22 bp, Homo sapiens
cagtttcttcatctgcagaatc

SEQ ID NO: 7259050 - DNA, 17 bp, Homo sapiens
cagtttcttccccctct

SEQ ID NO: 7259051 - DNA, 22 bp, Homo sapiens
cagtttcttcctcccccagaga

SEQ ID NO: 7259052 - DNA, 22 bp, Homo sapiens
cagtttcttctattttgaacta

SEQ ID NO: 7259053 - DNA, 22 bp, Homo sapiens
cagtttcttagtgacacaaatc

SEQ ID NO: 7259054 - DNA, 22 bp, Homo sapiens
cagtttcttatcttcaaaattg

SEQ ID NO: 7259055 - DNA, 22 bp, Homo sapiens
cagtttcttaagactgagatct

SEQ ID NO: 7259056 - DNA, 22 bp, Homo sapiens
cagtttctttccattgttacct

SEQ ID NO: 7259057 - DNA, 22 bp, Homo sapiens
cagtttcttggatgccaatttc

SEQ ID NO: 7259058 - DNA, 22 bp, Homo sapiens
cagtttctgccaggatgtgtta

SEQ ID NO: 7259059 - DNA, 22 bp, Homo sapiens
cagtttctgaggttccaggttt

SEQ ID NO: 7259060 - DNA, 15 bp, Homo sapiens
cagtttctgatcatc

SEQ ID NO: 7259061 - DNA, 15 bp, Homo sapiens
cagtttctgcttgaa

SEQ ID NO: 7259062 - DNA, 22 bp, Homo sapiens
cagtttctgggcgttcacaggt

SEQ ID NO: 7259063 - DNA, 22 bp, Homo sapiens
cagtttctgggaggaaaggaag

SEQ ID NO: 7259064 - DNA, 22 bp, Homo sapiens
cagtttctgtctgttcttatcc

SEQ ID NO: 7259065 - DNA, 22 bp, Homo sapiens
cagtttctgtctgttcttatcc

SEQ ID NO: 7259066 - DNA, 22 bp, Homo sapiens
cagtttctgttttaaatagcag

SEQ ID NO: 7259067 - DNA, 22 bp, Homo sapiens
cagtttctgtggtctcttttca

SEQ ID NO: 7259068 - DNA, 22 bp, Homo sapiens
cagtttctgagccctgtcattt

SEQ ID NO: 7259069 - DNA, 22 bp, Homo sapiens
tcagaagtcccagaattcacat

SEQ ID NO: 7259070 - DNA, 22 bp, Homo sapiens
tcagaaggtacagaagggaggt

SEQ ID NO: 7259071 - DNA, 22 bp, Homo sapiens
tattaaatatatctgttagttg

SEQ ID NO: 7259072 - DNA, 22 bp, Homo sapiens
tattgcttttatttctatggac

SEQ ID NO: 7259073 - DNA, 17 bp, Homo sapiens
tatctctgcttcatggt

SEQ ID NO: 7259074 - DNA, 22 bp, Homo sapiens
tatctctgttccaagccttatc

SEQ ID NO: 7259075 - DNA, 22 bp, Homo sapiens
tatggcttctgctttcttgact

SEQ ID NO: 7259076 - DNA, 22 bp, Homo sapiens
tatggcttctcagtcatgaaaa

SEQ ID NO: 7259077 - DNA, 23 bp, Homo sapiens
tatggcttacagtgctttaggta

SEQ ID NO: 7259078 - DNA, 22 bp, Homo sapiens
tatggctgtattctatgttact

SEQ ID NO: 7259079 - DNA, 22 bp, Homo sapiens
tataagaagtgaagaagagtta

SEQ ID NO: 7259080 - DNA, 22 bp, Homo sapiens
tataagaaattgccaacctgtt

SEQ ID NO: 7259081 - DNA, 22 bp, Homo sapiens
tataatctggttttattaagag

SEQ ID NO: 7259082 - DNA, 22 bp, Homo sapiens
tataatctcctgagttaggtag

SEQ ID NO: 7259083 - DNA, 22 bp, Homo sapiens
tataatattccttgttgtaggt

SEQ ID NO: 7259084 - DNA, 22 bp, Homo sapiens
tataatatgaggcaggagtgat

SEQ ID NO: 7259085 - DNA, 22 bp, Homo sapiens
caggggcctggctgtctaggaa

SEQ ID NO: 7259086 - DNA, 22 bp, Homo sapiens
cagggtgcttccgtggagctgt

SEQ ID NO: 7259087 - DNA, 22 bp, Homo sapiens
caggggccggctgtccgtgccc

SEQ ID NO: 7259088 - DNA, 22 bp, Homo sapiens
caggggcagtctgtgtgcgtgg

SEQ ID NO: 7259089 - DNA, 22 bp, Homo sapiens
caggggcaggtgtgagatcatc

SEQ ID NO: 7259090 - DNA, 22 bp, Homo sapiens
tatacagtcttttgctatattc

SEQ ID NO: 7259091 - DNA, 22 bp, Homo sapiens
cagggtggcacatcacagcatt

SEQ ID NO: 7259092 - DNA, 22 bp, Homo sapiens
cagggtggcacatcacagcatt

SEQ ID NO: 7259093 - DNA, 22 bp, Homo sapiens
tatacagatggaaagatacaca

SEQ ID NO: 7259094 - DNA, 22 bp, Homo sapiens
cagggtggaatggaatgctggc

SEQ ID NO: 7259095 - DNA, 22 bp, Homo sapiens
cagggtggaatggaatgctggc

SEQ ID NO: 7259096 - DNA, 22 bp, Homo sapiens
cagggtggaagctgtagagtgg

SEQ ID NO: 7259097 - DNA, 17 bp, Homo sapiens
caggtctgaggccaggc

SEQ ID NO: 7259098 - DNA, 22 bp, Homo sapiens
tattggcttggagcattttcct

SEQ ID NO: 7259099 - DNA, 22 bp, Homo sapiens
tattggctgcagcttcctctgt

SEQ ID NO: 7259100 - DNA, 22 bp, Homo sapiens
tatttagtgatagaagcaagga

SEQ ID NO: 7259101 - DNA, 22 bp, Homo sapiens
cagtgcacacaatcctctgccg

SEQ ID NO: 7259102 - DNA, 22 bp, Homo sapiens
cagtgagggcccccttccaggt

SEQ ID NO: 7259103 - DNA, 19 bp, Homo sapiens
cagtgcccgacgcaggtct

SEQ ID NO: 7259104 - DNA, 22 bp, Homo sapiens
tcaccaggctcctgttaagatg

SEQ ID NO: 7259105 - DNA, 22 bp, Homo sapiens
tcaccaggctggaatgcagtgg

SEQ ID NO: 7259106 - DNA, 22 bp, Homo sapiens
tcaccaggctggagtgcagtgg

SEQ ID NO: 7259107 - DNA, 22 bp, Homo sapiens
tcaccagggagcttgtcctctg

SEQ ID NO: 7259108 - DNA, 22 bp, Homo sapiens
tcagaaggatgtgcaggtggca

SEQ ID NO: 7259109 - DNA, 19 bp, Homo sapiens
tcagaaggcaggagaggcc

SEQ ID NO: 7259110 - DNA, 20 bp, Homo sapiens
tcagaaggctccagagcaga

SEQ ID NO: 7259111 - DNA, 22 bp, Homo sapiens
tcactcaggttcatgtctttgt

SEQ ID NO: 7259112 - DNA, 22 bp, Homo sapiens
ttaataaagtatgaattggaaa

SEQ ID NO: 7259113 - DNA, 22 bp, Homo sapiens
ttacagaaaatgtgttttaact

SEQ ID NO: 7259114 - DNA, 22 bp, Homo sapiens
ttacacaaaaataagatatggc

SEQ ID NO: 7259115 - DNA, 22 bp, Homo sapiens
ttacagagataaactgtaagtg

SEQ ID NO: 7259116 - DNA, 22 bp, Homo sapiens
ttacagatactttgtaggcaag

SEQ ID NO: 7259117 - DNA, 22 bp, Homo sapiens
ttacagatactttgtaggcaag

SEQ ID NO: 7259118 - DNA, 19 bp, Homo sapiens
ttacaatggtgattaggtt

SEQ ID NO: 7259119 - DNA, 22 bp, Homo sapiens
ttacaagtactgaatatgattt

SEQ ID NO: 7259120 - DNA, 22 bp, Homo sapiens
ttacaagatatgtgagaactag

SEQ ID NO: 7259121 - DNA, 22 bp, Homo sapiens
ttacaagatatgtgagaactag

SEQ ID NO: 7259122 - DNA, 22 bp, Homo sapiens
ttacagattaaaatgctgaggt

SEQ ID NO: 7259123 - DNA, 22 bp, Homo sapiens
ttacagatgtaggaactgaagt

SEQ ID NO: 7259124 - DNA, 22 bp, Homo sapiens
ttacagatggggttgcaataaa

SEQ ID NO: 7259125 - DNA, 22 bp, Homo sapiens
ttacagatcatcaaggtataat

SEQ ID NO: 7259126 - DNA, 22 bp, Homo sapiens
ttacagctagccaattatttag

SEQ ID NO: 7259127 - DNA, 22 bp, Homo sapiens
ttacagctagccaattatttag

SEQ ID NO: 7259128 - DNA, 23 bp, Homo sapiens
ttacagctaactgctgttattag

SEQ ID NO: 7259129 - DNA, 22 bp, Homo sapiens
ttacatgccattttgaaatcag

SEQ ID NO: 7259130 - DNA, 22 bp, Homo sapiens
ttacatgtaatctaaaataatt

SEQ ID NO: 7259131 - DNA, 22 bp, Homo sapiens
ttacattagacccactttcatg

SEQ ID NO: 7259132 - DNA, 22 bp, Homo sapiens
ttacattaagccaatggattct

SEQ ID NO: 7259133 - DNA, 22 bp, Homo sapiens
ttacattgtccagaaattattg

SEQ ID NO: 7259134 - DNA, 22 bp, Homo sapiens
ttatttatgttaacagtcgaga

SEQ ID NO: 7259135 - DNA, 22 bp, Homo sapiens
ttattcttggatctgagtctct

SEQ ID NO: 7259136 - DNA, 22 bp, Homo sapiens
ttatttccaaactggatatacc

SEQ ID NO: 7259137 - DNA, 22 bp, Homo sapiens
ttatttccctgagggttgcagg

SEQ ID NO: 7259138 - DNA, 19 bp, Homo sapiens
ttattcttaaagtagctta

SEQ ID NO: 7259139 - DNA, 22 bp, Homo sapiens
ttattctgagagttgaagtaat

SEQ ID NO: 7259140 - DNA, 22 bp, Homo sapiens
ttattccattcagttcaacaag

SEQ ID NO: 7259141 - DNA, 22 bp, Homo sapiens
ttatgatttgccacagattggt

SEQ ID NO: 7259142 - DNA, 22 bp, Homo sapiens
ttatgaaaacaatcagtaggca

SEQ ID NO: 7259143 - DNA, 22 bp, Homo sapiens
ttatgaaagacatttctgttgg

SEQ ID NO: 7259144 - DNA, 22 bp, Homo sapiens
ttatgaaagacatttctgttgg

SEQ ID NO: 7259145 - DNA, 19 bp, Homo sapiens
ttatctgtgttgcagtggt

SEQ ID NO: 7259146 - DNA, 22 bp, Homo sapiens
ttagaacagtagaagaaagggt

SEQ ID NO: 7259147 - DNA, 22 bp, Homo sapiens
ttagatatgtttttgctaatgc

SEQ ID NO: 7259148 - DNA, 22 bp, Homo sapiens
ttagaaaggagcttatttcttt

SEQ ID NO: 7259149 - DNA, 22 bp, Homo sapiens
ttagaaaggaatcttcatttca

SEQ ID NO: 7259150 - DNA, 22 bp, Homo sapiens
ttacattttggggtaaggataa

SEQ ID NO: 7259151 - DNA, 22 bp, Homo sapiens
ttagaaaggttttgctctgaaa

SEQ ID NO: 7259152 - DNA, 22 bp, Homo sapiens
ttagaaaggggtgaatcaatgg

SEQ ID NO: 7259153 - DNA, 22 bp, Homo sapiens
ttagaaagggtgtctgaatctg

SEQ ID NO: 7259154 - DNA, 22 bp, Homo sapiens
ttagaaatgtcacagatctgat

SEQ ID NO: 7259155 - DNA, 22 bp, Homo sapiens
ttagcagctaaactgacagacc

SEQ ID NO: 7259156 - DNA, 22 bp, Homo sapiens
ttagcattctgcctcctatatc

SEQ ID NO: 7259157 - DNA, 22 bp, Homo sapiens
ttagatttgtagtgagttcaga

SEQ ID NO: 7259158 - DNA, 22 bp, Homo sapiens
ttagatttacaagcactgttta

SEQ ID NO: 7259159 - DNA, 22 bp, Homo sapiens
ttagatttatatgtgagaatgg

SEQ ID NO: 7259160 - DNA, 22 bp, Homo sapiens
ttagatgtgtatatacatgtca

SEQ ID NO: 7259161 - DNA, 22 bp, Homo sapiens
ttagatgtttatatacagattt

SEQ ID NO: 7259162 - DNA, 22 bp, Homo sapiens
ttagtaatgtgttaatatgaat

SEQ ID NO: 7259163 - DNA, 22 bp, Homo sapiens
ttcacattggtgatatgtttct

SEQ ID NO: 7259164 - DNA, 22 bp, Homo sapiens
ttcacatttcataccacagctt

SEQ ID NO: 7259165 - DNA, 22 bp, Homo sapiens
ttcaccatcattaacttcatgt

SEQ ID NO: 7259166 - DNA, 18 bp, Homo sapiens
ttcaccagtgtgatgggt

SEQ ID NO: 7259167 - DNA, 22 bp, Homo sapiens
ttatttcttgtctatgtagcca

SEQ ID NO: 7259168 - DNA, 22 bp, Homo sapiens
ttatttggttgctgacttggaa

SEQ ID NO: 7259169 - DNA, 22 bp, Homo sapiens
ttatttggttattgtaattggg

SEQ ID NO: 7259170 - DNA, 22 bp, Homo sapiens
ttatttgggtttgagtgtggca

SEQ ID NO: 7259171 - DNA, 22 bp, Homo sapiens
ttatttggatttagcttatcaa

SEQ ID NO: 7259172 - DNA, 22 bp, Homo sapiens
ttatttggaaatatggcttctg

SEQ ID NO: 7259173 - DNA, 22 bp, Homo sapiens
ttatttggaaatatggcttctg

SEQ ID NO: 7259174 - DNA, 22 bp, Homo sapiens
ttatttggcaatgcttcaccat

SEQ ID NO: 7259175 - DNA, 23 bp, Homo sapiens
ttatttggattttagtggaaaga

SEQ ID NO: 7259176 - DNA, 22 bp, Homo sapiens
ttcattaattcattcagtgact

SEQ ID NO: 7259177 - DNA, 21 bp, Homo sapiens
ttcattcatggcataatatag

SEQ ID NO: 7259178 - DNA, 20 bp, Homo sapiens
ttcattcacgtagctgttga

SEQ ID NO: 7259179 - DNA, 22 bp, Homo sapiens
ttccagaggctctaggggagaa

SEQ ID NO: 7259180 - DNA, 22 bp, Homo sapiens
ttccagaggcctgggcacactc

SEQ ID NO: 7259181 - DNA, 22 bp, Homo sapiens
tgttttagttctgtcttgcatg

SEQ ID NO: 7259182 - DNA, 22 bp, Homo sapiens
tgtttggaaacactggcagaaa

SEQ ID NO: 7259183 - DNA, 22 bp, Homo sapiens
tgtttggaaacactggcagaaa

SEQ ID NO: 7259184 - DNA, 22 bp, Homo sapiens
tgtttgttccctctctttcctg

SEQ ID NO: 7259185 - DNA, 23 bp, Homo sapiens
tgttgtgactggatgctttgtcc

SEQ ID NO: 7259186 - DNA, 22 bp, Homo sapiens
tgtttaaatagaacatactgca

SEQ ID NO: 7259187 - DNA, 20 bp, Homo sapiens
tgttgaattcatggtgactt

SEQ ID NO: 7259188 - DNA, 22 bp, Homo sapiens
tgttgactggtaactttaaaca

SEQ ID NO: 7259189 - DNA, 22 bp, Homo sapiens
tgttgattagtgtttagactta

SEQ ID NO: 7259190 - DNA, 22 bp, Homo sapiens
tgttgggaattgtgagtaatgg

SEQ ID NO: 7259191 - DNA, 22 bp, Homo sapiens
tgtttattcatggctaatgaaa

SEQ ID NO: 7259192 - DNA, 22 bp, Homo sapiens
tgtttattcatggctaatgaaa

SEQ ID NO: 7259193 - DNA, 22 bp, Homo sapiens
tgtttattgctgcaattgtgcc

SEQ ID NO: 7259194 - DNA, 22 bp, Homo sapiens
tgtttattgcagtgctgggctg

SEQ ID NO: 7259195 - DNA, 22 bp, Homo sapiens
tgttctttcagttagacacagt

SEQ ID NO: 7259196 - DNA, 22 bp, Homo sapiens
tgttctttagcagaccatgttg

SEQ ID NO: 7259197 - DNA, 22 bp, Homo sapiens
tgttcttgagcctttagaccta

SEQ ID NO: 7259198 - DNA, 22 bp, Homo sapiens
tgttcttttctctaaactgata

SEQ ID NO: 7259199 - DNA, 22 bp, Homo sapiens
tgttctttggcttcctttccgt

SEQ ID NO: 7259200 - DNA, 22 bp, Homo sapiens
tgttctttggcttcacagctct

SEQ ID NO: 7259201 - DNA, 22 bp, Homo sapiens
tgttctttgccagtgatttaat

SEQ ID NO: 7259202 - DNA, 22 bp, Homo sapiens
tgttctttgctgttgatgtaga

SEQ ID NO: 7259203 - DNA, 22 bp, Homo sapiens
tgttacatttctctttcttgga

SEQ ID NO: 7259204 - DNA, 22 bp, Homo sapiens
tgtgtgggagcacgggctgttg

SEQ ID NO: 7259205 - DNA, 22 bp, Homo sapiens
tgtgtgggagcacgggctgttg

SEQ ID NO: 7259206 - DNA, 22 bp, Homo sapiens
tgtgtggatgcagcgtgggtct

SEQ ID NO: 7259207 - DNA, 22 bp, Homo sapiens
tgtgggcactaatgacatgcag

SEQ ID NO: 7259208 - DNA, 22 bp, Homo sapiens
tgtgggccaggaggcctcagtg

SEQ ID NO: 7259209 - DNA, 23 bp, Homo sapiens
tgtgggcgcattgtaagggtagc

SEQ ID NO: 7259210 - DNA, 22 bp, Homo sapiens
tgtggaatgtcctcagcatcct

SEQ ID NO: 7259211 - DNA, 22 bp, Homo sapiens
tgtggctgactcctggtcccca

SEQ ID NO: 7259212 - DNA, 22 bp, Homo sapiens
tgtgggagaaggaagcaagctg

SEQ ID NO: 7259213 - DNA, 22 bp, Homo sapiens
tgtgggaatgctgatgggatct

SEQ ID NO: 7259214 - DNA, 22 bp, Homo sapiens
tgtggctgcagacactggagcc

SEQ ID NO: 7259215 - DNA, 22 bp, Homo sapiens
tgtgggaagagcagtggcagca

SEQ ID NO: 7259216 - DNA, 22 bp, Homo sapiens
tgtctgcaaagtccagcacagg

SEQ ID NO: 7259217 - DNA, 22 bp, Homo sapiens
tgtctgagtggtgcaaggctga

SEQ ID NO: 7259218 - DNA, 22 bp, Homo sapiens
tgtctgagtgcatatgtgctgg

SEQ ID NO: 7259219 - DNA, 22 bp, Homo sapiens
tgtctgagctttatgatggaag

SEQ ID NO: 7259220 - DNA, 22 bp, Homo sapiens
tgtctgagctggggcagacaga

SEQ ID NO: 7259221 - DNA, 22 bp, Homo sapiens
tgtctgagcgagaaagtagtgt

SEQ ID NO: 7259222 - DNA, 22 bp, Homo sapiens
tgtctctgccagctagcagaat

SEQ ID NO: 7259223 - DNA, 22 bp, Homo sapiens
tgtctctttggcctcccatatg

SEQ ID NO: 7259224 - DNA, 22 bp, Homo sapiens
tgtctccttgcttttccctgta

SEQ ID NO: 7259225 - DNA, 22 bp, Homo sapiens
tgtctcgggagaaaggagtggg

SEQ ID NO: 7259226 - DNA, 22 bp, Homo sapiens
tgtctcctctgtcctgtcagga

SEQ ID NO: 7259227 - DNA, 22 bp, Homo sapiens
tgtctcctgagagctggacaga

SEQ ID NO: 7259228 - DNA, 22 bp, Homo sapiens
tgtctcctgcaggggtgtgggc

SEQ ID NO: 7259229 - DNA, 22 bp, Homo sapiens
tgtctcctgggccctggccctg

SEQ ID NO: 7259230 - DNA, 22 bp, Homo sapiens
tgtctcctgggtcccttccacc

SEQ ID NO: 7259231 - DNA, 22 bp, Homo sapiens
tgtctcctgggccctggccctg

SEQ ID NO: 7259232 - DNA, 21 bp, Homo sapiens
tgtctcctgttggcacatggc

SEQ ID NO: 7259233 - DNA, 22 bp, Homo sapiens
tgtctcctcatactgtcatatt

SEQ ID NO: 7259234 - DNA, 22 bp, Homo sapiens
tgtctcctcaactcatgctcga

SEQ ID NO: 7259235 - DNA, 19 bp, Homo sapiens
tgtctcctcatgcaagtgt

SEQ ID NO: 7259236 - DNA, 19 bp, Homo sapiens
tgtctcctccccgccgtct

SEQ ID NO: 7259237 - DNA, 22 bp, Homo sapiens
tgtctcctcggctgtccagcca

SEQ ID NO: 7259238 - DNA, 22 bp, Homo sapiens
tgtctcctcaactcatgctcga

SEQ ID NO: 7259239 - DNA, 22 bp, Homo sapiens
tgtctcctatttcctgctaagg

SEQ ID NO: 7259240 - DNA, 22 bp, Homo sapiens
tgtctcctactgcctgtggatc

SEQ ID NO: 7259241 - DNA, 22 bp, Homo sapiens
tgtctcctaatgtctgtttcct

SEQ ID NO: 7259242 - DNA, 22 bp, Homo sapiens
tgtctcctaatgtctgtttcct

SEQ ID NO: 7259243 - DNA, 21 bp, Homo sapiens
tgtctagacctcatcctacag

SEQ ID NO: 7259244 - DNA, 22 bp, Homo sapiens
tgtctatgcaatggaaggactg

SEQ ID NO: 7259245 - DNA, 22 bp, Homo sapiens
tgtctatgtatacatgtgtata

SEQ ID NO: 7259246 - DNA, 22 bp, Homo sapiens
tgtctttgttattgtggacagg

SEQ ID NO: 7259247 - DNA, 22 bp, Homo sapiens
tgtctttgtgtacaggatcgcc

SEQ ID NO: 7259248 - DNA, 22 bp, Homo sapiens
tgtcttcagtaaaatacactat

SEQ ID NO: 7259249 - DNA, 22 bp, Homo sapiens
tgtctggatggtggagattgag

SEQ ID NO: 7259250 - DNA, 22 bp, Homo sapiens
tgtctggatcagtgggtgcttg

SEQ ID NO: 7259251 - DNA, 22 bp, Homo sapiens
tgtctggatagagcctaggccc

SEQ ID NO: 7259252 - DNA, 23 bp, Homo sapiens
tgtctggagttttgcactgttgc

SEQ ID NO: 7259253 - DNA, 22 bp, Homo sapiens
tgtctggaggtcaggtcctggg

SEQ ID NO: 7259254 - DNA, 22 bp, Homo sapiens
tgtctggaggggatgttatggt

SEQ ID NO: 7259255 - DNA, 22 bp, Homo sapiens
tgtctggagggctggctccctg

SEQ ID NO: 7259256 - DNA, 23 bp, Homo sapiens
tgtctggagcctgagcaggtgct

SEQ ID NO: 7259257 - DNA, 23 bp, Homo sapiens
tgtctggagagggcttgctctcc

SEQ ID NO: 7259258 - DNA, 22 bp, Homo sapiens
tgtctggactgctcacagtacc

SEQ ID NO: 7259259 - DNA, 22 bp, Homo sapiens
tgtctggacattgacaatcatg

SEQ ID NO: 7259260 - DNA, 22 bp, Homo sapiens
tgtctggacagagattctcaat

SEQ ID NO: 7259261 - DNA, 22 bp, Homo sapiens
tgtctggaatttctattttgtc

SEQ ID NO: 7259262 - DNA, 22 bp, Homo sapiens
tgtctggaagtaccagggaagc

SEQ ID NO: 7259263 - DNA, 22 bp, Homo sapiens
tgtctggaagggctatgtgacc

SEQ ID NO: 7259264 - DNA, 19 bp, Homo sapiens
tgtctggaagagctgcagg

SEQ ID NO: 7259265 - DNA, 22 bp, Homo sapiens
tgtctggattgctgagccccag

SEQ ID NO: 7259266 - DNA, 23 bp, Homo sapiens
tgtctggattcgactgtggttgg

SEQ ID NO: 7259267 - DNA, 20 bp, Homo sapiens
tgtctggatgtttaagcaga

SEQ ID NO: 7259268 - DNA, 22 bp, Homo sapiens
tgtctggatgtctggagcatcg

SEQ ID NO: 7259269 - DNA, 22 bp, Homo sapiens
tgtctgggatgttggcagccac

SEQ ID NO: 7259270 - DNA, 22 bp, Homo sapiens
tgtgaaattcttgaaatgcaca

SEQ ID NO: 7259271 - DNA, 22 bp, Homo sapiens
tgtgaatgttaatattggatta

SEQ ID NO: 7259272 - DNA, 22 bp, Homo sapiens
tgtgaatggacaattaaatcta

SEQ ID NO: 7259273 - DNA, 22 bp, Homo sapiens
tgtgaatggcagttggatagca

SEQ ID NO: 7259274 - DNA, 22 bp, Homo sapiens
tgtgagatacctgttcaaatta

SEQ ID NO: 7259275 - DNA, 22 bp, Homo sapiens
tgtgagacgtgttagaacagtg

SEQ ID NO: 7259276 - DNA, 23 bp, Homo sapiens
tgtgctggcatctcaggctttgg

SEQ ID NO: 7259277 - DNA, 22 bp, Homo sapiens
tgtgctgctctcagtgacagcc

SEQ ID NO: 7259278 - DNA, 22 bp, Homo sapiens
tgtggaaagtggtctaagcaca

SEQ ID NO: 7259279 - DNA, 22 bp, Homo sapiens
tgtgctccacactcccagtcct

SEQ ID NO: 7259280 - DNA, 22 bp, Homo sapiens
tgtgctccaacaatttatattc

SEQ ID NO: 7259281 - DNA, 22 bp, Homo sapiens
tgtgctagaagaggatggacct

SEQ ID NO: 7259282 - DNA, 22 bp, Homo sapiens
tgtgcgtggttcccggggccat

SEQ ID NO: 7259283 - DNA, 23 bp, Homo sapiens
tgtgctcccaaatgtaggtctat

SEQ ID NO: 7259284 - DNA, 22 bp, Homo sapiens
tgtgctccatcatccataatct

SEQ ID NO: 7259285 - DNA, 22 bp, Homo sapiens
tgtgcgtgatggaccgggcctg

SEQ ID NO: 7259286 - DNA, 22 bp, Homo sapiens
tgtgcgggtgcgcatgcagagg

SEQ ID NO: 7259287 - DNA, 22 bp, Homo sapiens
tgtgcagctctagagccaagcc

SEQ ID NO: 7259288 - DNA, 22 bp, Homo sapiens
tgtgcatgtgtttcatggatct

SEQ ID NO: 7259289 - DNA, 22 bp, Homo sapiens
tgtgcatgcacatatatgttgc

SEQ ID NO: 7259290 - DNA, 22 bp, Homo sapiens
tgtgcatgaatcaatgattccg

SEQ ID NO: 7259291 - DNA, 22 bp, Homo sapiens
tggtgcaagtctctgaggaggg

SEQ ID NO: 7259292 - DNA, 22 bp, Homo sapiens
tggtgcagacaggagccccgct

SEQ ID NO: 7259293 - DNA, 22 bp, Homo sapiens
tggtgcagagagggatctaggg

SEQ ID NO: 7259294 - DNA, 22 bp, Homo sapiens
tggtgaggtcatagagaactgt

SEQ ID NO: 7259295 - DNA, 22 bp, Homo sapiens
tggtgaggccaaagccatgaca

SEQ ID NO: 7259296 - DNA, 18 bp, Homo sapiens
tggtgaagggtggaggag

SEQ ID NO: 7259297 - DNA, 22 bp, Homo sapiens
tggtctcccagagcagggacgc

SEQ ID NO: 7259298 - DNA, 22 bp, Homo sapiens
tggtctctgcaggccaggctca

SEQ ID NO: 7259299 - DNA, 22 bp, Homo sapiens
tggtcctggggtgcaggctgac

SEQ ID NO: 7259300 - DNA, 22 bp, Homo sapiens
tggtcctcaccctacccagctg

SEQ ID NO: 7259301 - DNA, 22 bp, Homo sapiens
tggtcctgccccgtgcacagag

SEQ ID NO: 7259302 - DNA, 22 bp, Homo sapiens
tggtgcagtagagctgtctggg

SEQ ID NO: 7259303 - DNA, 22 bp, Homo sapiens
tggtgcagtagagctgtctggg

SEQ ID NO: 7259304 - DNA, 22 bp, Homo sapiens
tggtgcagtagagctgtctggg

SEQ ID NO: 7259305 - DNA, 22 bp, Homo sapiens
tggtgcagtagaaggccgactt

SEQ ID NO: 7259306 - DNA, 22 bp, Homo sapiens
tggtgcagtagaaggccgactt

SEQ ID NO: 7259307 - DNA, 22 bp, Homo sapiens
tggtgcaggagttggcagggac

SEQ ID NO: 7259308 - DNA, 22 bp, Homo sapiens
tggtgcaggagttggcagggac

SEQ ID NO: 7259309 - DNA, 22 bp, Homo sapiens
tggtgccatcatagctcactgc

SEQ ID NO: 7259310 - DNA, 22 bp, Homo sapiens
tggtgccaccctccttcagctg

SEQ ID NO: 7259311 - DNA, 22 bp, Homo sapiens
tggtgccattagccctgctgtt

SEQ ID NO: 7259312 - DNA, 22 bp, Homo sapiens
tggtgcagtccaaagggagcag

SEQ ID NO: 7259313 - DNA, 22 bp, Homo sapiens
tggtgcagtcattggcccaggg

SEQ ID NO: 7259314 - DNA, 22 bp, Homo sapiens
tggtgcagttcccagggccggg

SEQ ID NO: 7259315 - DNA, 22 bp, Homo sapiens
tggtgcagttcccagggccggg

SEQ ID NO: 7259316 - DNA, 22 bp, Homo sapiens
tggtgcagtccaaagggagcag

SEQ ID NO: 7259317 - DNA, 22 bp, Homo sapiens
tggtgctgtggaggggcagaag

SEQ ID NO: 7259318 - DNA, 22 bp, Homo sapiens
tggtggagagacagtgtattgg

SEQ ID NO: 7259319 - DNA, 20 bp, Homo sapiens
tggtggagagaagctatttg

SEQ ID NO: 7259320 - DNA, 22 bp, Homo sapiens
tggtggagacctcgctaacccc

SEQ ID NO: 7259321 - DNA, 22 bp, Homo sapiens
tggtggagacctcgctaacccc

SEQ ID NO: 7259322 - DNA, 22 bp, Homo sapiens
tggtggagcctaggctaagtct

SEQ ID NO: 7259323 - DNA, 22 bp, Homo sapiens
tggtggagctgtggccacgacc

SEQ ID NO: 7259324 - DNA, 22 bp, Homo sapiens
tggtggagggaactatttccag

SEQ ID NO: 7259325 - DNA, 19 bp, Homo sapiens
tggtggaggccccatgttc

SEQ ID NO: 7259326 - DNA, 22 bp, Homo sapiens
tggtggaggtgcatttcggagc

SEQ ID NO: 7259327 - DNA, 19 bp, Homo sapiens
tggtggaggtgcacctgac

SEQ ID NO: 7259328 - DNA, 19 bp, Homo sapiens
tggtggaggtgcacctgac

SEQ ID NO: 7259329 - DNA, 21 bp, Homo sapiens
tggtggagtgtgctgagcatg

SEQ ID NO: 7259330 - DNA, 22 bp, Homo sapiens
tggtggagtttctctttcaaac

SEQ ID NO: 7259331 - DNA, 22 bp, Homo sapiens
tggtggcagctgggacagaggt

SEQ ID NO: 7259332 - DNA, 22 bp, Homo sapiens
tggtgggagtgacgttgccttc

SEQ ID NO: 7259333 - DNA, 22 bp, Homo sapiens
tggtgggctgagtctcatcgga

SEQ ID NO: 7259334 - DNA, 23 bp, Homo sapiens
tggtgggccctgcttgctcactg

SEQ ID NO: 7259335 - DNA, 22 bp, Homo sapiens
tggtgggcacagtgcccaggct

SEQ ID NO: 7259336 - DNA, 22 bp, Homo sapiens
tggtgtcctaagtggaaggaca

SEQ ID NO: 7259337 - DNA, 22 bp, Homo sapiens
tggtgtctcttagtacatagat

SEQ ID NO: 7259338 - DNA, 18 bp, Homo sapiens
tggtggtgacagggtcat

SEQ ID NO: 7259339 - DNA, 22 bp, Homo sapiens
tggtgttggagatggttgcatt

SEQ ID NO: 7259340 - DNA, 22 bp, Homo sapiens
tggtgttgcaaataaagtccaa

SEQ ID NO: 7259341 - DNA, 21 bp, Homo sapiens
tggtgttgacatcaagttata

SEQ ID NO: 7259342 - DNA, 22 bp, Homo sapiens
tggtgttgaacctcagcagggg

SEQ ID NO: 7259343 - DNA, 22 bp, Homo sapiens
tggtgttacctattgactgagt

SEQ ID NO: 7259344 - DNA, 22 bp, Homo sapiens
tggtgtgggcagcagcaggtac

SEQ ID NO: 7259345 - DNA, 22 bp, Homo sapiens
tggtgtcttggaagtaggtgct

SEQ ID NO: 7259346 - DNA, 22 bp, Homo sapiens
tggtgtctggcacacaggaagc

SEQ ID NO: 7259347 - DNA, 22 bp, Homo sapiens
tggtttcagtgccaatacagta

SEQ ID NO: 7259348 - DNA, 19 bp, Homo sapiens
tggttgtgcacgggttggt

SEQ ID NO: 7259349 - DNA, 22 bp, Homo sapiens
tggttttctggtggtggcagtg

SEQ ID NO: 7259350 - DNA, 22 bp, Homo sapiens
tggttttcaacaagggcagcga

SEQ ID NO: 7259351 - DNA, 22 bp, Homo sapiens
tgtaaaaagcccagccgctgag

SEQ ID NO: 7259352 - DNA, 22 bp, Homo sapiens
tgtaagaataatgatttctaag

SEQ ID NO: 7259353 - DNA, 22 bp, Homo sapiens
tgtaagaaaacctgtacaaaga

SEQ ID NO: 7259354 - DNA, 22 bp, Homo sapiens
tgtacacatttttatgttaaca

SEQ ID NO: 7259355 - DNA, 22 bp, Homo sapiens
tgtacacatgcccacttgaagc

SEQ ID NO: 7259356 - DNA, 22 bp, Homo sapiens
tgtacagatatcaggagtgagg

SEQ ID NO: 7259357 - DNA, 22 bp, Homo sapiens
tgtatgaacctttaatatagtg

SEQ ID NO: 7259358 - DNA, 22 bp, Homo sapiens
tgtatgcaaatttattagcaca

SEQ ID NO: 7259359 - DNA, 22 bp, Homo sapiens
tgtatattgcctgagtctttcc

SEQ ID NO: 7259360 - DNA, 22 bp, Homo sapiens
tgtatatgtttgtatgtacaca

SEQ ID NO: 7259361 - DNA, 22 bp, Homo sapiens
tgtatatgtgatgtacatgtac

SEQ ID NO: 7259362 - DNA, 22 bp, Homo sapiens
tgtatatgtcctggcatgtcat

SEQ ID NO: 7259363 - DNA, 22 bp, Homo sapiens
tgtatatgagtctgagtgtaca

SEQ ID NO: 7259364 - DNA, 22 bp, Homo sapiens
tgtacttctggtgactttatag

SEQ ID NO: 7259365 - DNA, 22 bp, Homo sapiens
tgtacttcaaaccctttggttt

SEQ ID NO: 7259366 - DNA, 18 bp, Homo sapiens
tgtagaaaagataggaat

SEQ ID NO: 7259367 - DNA, 22 bp, Homo sapiens
tgtagaaattagtaagatcaac

SEQ ID NO: 7259368 - DNA, 18 bp, Homo sapiens
tgtagagccaggtttgcc

SEQ ID NO: 7259369 - DNA, 22 bp, Homo sapiens
tgtattttctgaagataatcaa

SEQ ID NO: 7259370 - DNA, 17 bp, Homo sapiens
tgtatttgtaccacagc

SEQ ID NO: 7259371 - DNA, 22 bp, Homo sapiens
tgtatttgggtcacaagatggg

SEQ ID NO: 7259372 - DNA, 22 bp, Homo sapiens
tgtcacagtgcacagctaagaa

SEQ ID NO: 7259373 - DNA, 22 bp, Homo sapiens
tgtcacagagcgtgcaacagaa

SEQ ID NO: 7259374 - DNA, 22 bp, Homo sapiens
tgtccttttctttagtgcagct

SEQ ID NO: 7259375 - DNA, 22 bp, Homo sapiens
tgtccttttggctgtctatggt

SEQ ID NO: 7259376 - DNA, 22 bp, Homo sapiens
tgtcctttgtgtatctatagta

SEQ ID NO: 7259377 - DNA, 22 bp, Homo sapiens
tgtcctttgttccctgtctctg

SEQ ID NO: 7259378 - DNA, 22 bp, Homo sapiens
tgtcactttggggagagttttg

SEQ ID NO: 7259379 - DNA, 20 bp, Homo sapiens
tgtcatttatttatcaaatg

SEQ ID NO: 7259380 - DNA, 22 bp, Homo sapiens
tgtcatatgttgatgaaagaga

SEQ ID NO: 7259381 - DNA, 22 bp, Homo sapiens
tgtcatatgctgtcatagccat

SEQ ID NO: 7259382 - DNA, 22 bp, Homo sapiens
tgtcatcttaaatcattcccac

SEQ ID NO: 7259383 - DNA, 22 bp, Homo sapiens
tggggctcacctaggctggaag

SEQ ID NO: 7259384 - DNA, 22 bp, Homo sapiens
tggggctcatgcctgctggaac

SEQ ID NO: 7259385 - DNA, 22 bp, Homo sapiens
tggggctcctcctggcaggagg

SEQ ID NO: 7259386 - DNA, 22 bp, Homo sapiens
tggggctcctcctggcaggagg

SEQ ID NO: 7259387 - DNA, 22 bp, Homo sapiens
tggggctcctcctggcaggagg

SEQ ID NO: 7259388 - DNA, 22 bp, Homo sapiens
tggggctctccacagtgtctca

SEQ ID NO: 7259389 - DNA, 23 bp, Homo sapiens
tggggctctggcaggcctgaggt

SEQ ID NO: 7259390 - DNA, 22 bp, Homo sapiens
tggggctgaggagcctcactct

SEQ ID NO: 7259391 - DNA, 23 bp, Homo sapiens
tggggctgatggagacggaccag

SEQ ID NO: 7259392 - DNA, 22 bp, Homo sapiens
tggggcgcccccactccacaga

SEQ ID NO: 7259393 - DNA, 22 bp, Homo sapiens
tggggccatctcacccactgtt

SEQ ID NO: 7259394 - DNA, 22 bp, Homo sapiens
tggggccaggtggctgcaggtc

SEQ ID NO: 7259395 - DNA, 22 bp, Homo sapiens
tggggccagggaggaccagaca

SEQ ID NO: 7259396 - DNA, 22 bp, Homo sapiens
tggggccagggaggaccagaca

SEQ ID NO: 7259397 - DNA, 22 bp, Homo sapiens
tggggccagcggggaggactca

SEQ ID NO: 7259398 - DNA, 22 bp, Homo sapiens
tggggccagcggggaggactca

SEQ ID NO: 7259399 - DNA, 22 bp, Homo sapiens
tggggccagagctgcagggagc

SEQ ID NO: 7259400 - DNA, 22 bp, Homo sapiens
tggggccagagatggggcgcag

SEQ ID NO: 7259401 - DNA, 22 bp, Homo sapiens
tggggccacagcctcctagctt

SEQ ID NO: 7259402 - DNA, 22 bp, Homo sapiens
tggggccacactgatctcccag

SEQ ID NO: 7259403 - DNA, 22 bp, Homo sapiens
tggggcagcagacctttcttgg

SEQ ID NO: 7259404 - DNA, 22 bp, Homo sapiens
tggggcagagtaggattttggc

SEQ ID NO: 7259405 - DNA, 22 bp, Homo sapiens
tggggcagagtaggattttggc

SEQ ID NO: 7259406 - DNA, 22 bp, Homo sapiens
tggggctgtcccggtttggcga

SEQ ID NO: 7259407 - DNA, 22 bp, Homo sapiens
tggggctggctattgtctccct

SEQ ID NO: 7259408 - DNA, 22 bp, Homo sapiens
tggggctggcacagtctctatt

SEQ ID NO: 7259409 - DNA, 22 bp, Homo sapiens
tgggggagattgtgcatctcta

SEQ ID NO: 7259410 - DNA, 22 bp, Homo sapiens
tgggggagattagagcttctta

SEQ ID NO: 7259411 - DNA, 22 bp, Homo sapiens
tgggggagattagagcttctta

SEQ ID NO: 7259412 - DNA, 22 bp, Homo sapiens
tgggggagattagagcttctta

SEQ ID NO: 7259413 - DNA, 22 bp, Homo sapiens
tgggggagatagagtctgatgg

SEQ ID NO: 7259414 - DNA, 22 bp, Homo sapiens
tgggggagagtttagatgattt

SEQ ID NO: 7259415 - DNA, 22 bp, Homo sapiens
tgggggagagtttagatgattt

SEQ ID NO: 7259416 - DNA, 22 bp, Homo sapiens
tgggggagagtgcaagcatgaa

SEQ ID NO: 7259417 - DNA, 22 bp, Homo sapiens
tgggggagagaggcattctttc

SEQ ID NO: 7259418 - DNA, 22 bp, Homo sapiens
tgggggcacttcgaggtcgcct

SEQ ID NO: 7259419 - DNA, 22 bp, Homo sapiens
tgggggctccaggctccaggga

SEQ ID NO: 7259420 - DNA, 22 bp, Homo sapiens
tgggggcatggaccagcctggc

SEQ ID NO: 7259421 - DNA, 22 bp, Homo sapiens
tgggggagtatagtctggcctc

SEQ ID NO: 7259422 - DNA, 22 bp, Homo sapiens
tgggggagctcagtccagccca

SEQ ID NO: 7259423 - DNA, 22 bp, Homo sapiens
tgggggagattgtgcatctcta

SEQ ID NO: 7259424 - DNA, 22 bp, Homo sapiens
tgggggagcgacagacataatt

SEQ ID NO: 7259425 - DNA, 22 bp, Homo sapiens
tgggggagccttcacagtagct

SEQ ID NO: 7259426 - DNA, 22 bp, Homo sapiens
tggggaagacagcagacactgt

SEQ ID NO: 7259427 - DNA, 17 bp, Homo sapiens
tggggaagctcagattt

SEQ ID NO: 7259428 - DNA, 22 bp, Homo sapiens
tggggaaggcggagcttgcagc

SEQ ID NO: 7259429 - DNA, 22 bp, Homo sapiens
tggggaaggcggagcttgcagc

SEQ ID NO: 7259430 - DNA, 16 bp, Homo sapiens
tggggaagctcgtgag

SEQ ID NO: 7259431 - DNA, 22 bp, Homo sapiens
tggggacacagagccaaactat

SEQ ID NO: 7259432 - DNA, 22 bp, Homo sapiens
tgggcttaggtcggaggcggcc

SEQ ID NO: 7259433 - DNA, 22 bp, Homo sapiens
tgggcttaggtcggaggcggcc

SEQ ID NO: 7259434 - DNA, 17 bp, Homo sapiens
tggggatggttcatgag

SEQ ID NO: 7259435 - DNA, 22 bp, Homo sapiens
tggggatgtaaatgaggtgata

SEQ ID NO: 7259436 - DNA, 21 bp, Homo sapiens
tggggaggggacctgattatg

SEQ ID NO: 7259437 - DNA, 21 bp, Homo sapiens
tggggaggggacctgattatg

SEQ ID NO: 7259438 - DNA, 22 bp, Homo sapiens
tggggaggttcgggaatcttgt

SEQ ID NO: 7259439 - DNA, 22 bp, Homo sapiens
tggggaggttcgggaatcttgt

SEQ ID NO: 7259440 - DNA, 22 bp, Homo sapiens
tggggaggtaacaatttcaggc

SEQ ID NO: 7259441 - DNA, 22 bp, Homo sapiens
tggggaggtaacaatttcaggc

SEQ ID NO: 7259442 - DNA, 22 bp, Homo sapiens
tggggaggttcgggaatcttgt

SEQ ID NO: 7259443 - DNA, 22 bp, Homo sapiens
tggggacagggctcagcaattt

SEQ ID NO: 7259444 - DNA, 22 bp, Homo sapiens
tggggaggaagtcagatttcag

SEQ ID NO: 7259445 - DNA, 22 bp, Homo sapiens
tggggaggaagtcagatttcag

SEQ ID NO: 7259446 - DNA, 23 bp, Homo sapiens
tggggagggaagtcatttctgta

SEQ ID NO: 7259447 - DNA, 23 bp, Homo sapiens
tggggagggaagtcatttctgta

SEQ ID NO: 7259448 - DNA, 22 bp, Homo sapiens
tggggaggatatgtgagttatt

SEQ ID NO: 7259449 - DNA, 22 bp, Homo sapiens
tggggaggatatgtgagttatt

SEQ ID NO: 7259450 - DNA, 22 bp, Homo sapiens
tggggaggacgggcgccttcct

SEQ ID NO: 7259451 - DNA, 22 bp, Homo sapiens
tggggaggacgggcgccttcct

SEQ ID NO: 7259452 - DNA, 22 bp, Homo sapiens
tgggttttgtgaccatagatta

SEQ ID NO: 7259453 - DNA, 22 bp, Homo sapiens
tgggttttgtcctgatccatca

SEQ ID NO: 7259454 - DNA, 22 bp, Homo sapiens
tgggttttgtgaccatagatta

SEQ ID NO: 7259455 - DNA, 22 bp, Homo sapiens
tgggtttttgtttctctggtat

SEQ ID NO: 7259456 - DNA, 22 bp, Homo sapiens
tgggttttccatctatttactc

SEQ ID NO: 7259457 - DNA, 22 bp, Homo sapiens
tgggttttccacatatgccatg

SEQ ID NO: 7259458 - DNA, 22 bp, Homo sapiens
tgggttttccatctatttactc

SEQ ID NO: 7259459 - DNA, 22 bp, Homo sapiens
tgggttttctgccgattgttcc

SEQ ID NO: 7259460 - DNA, 22 bp, Homo sapiens
tgggttttccacatatgccatg

SEQ ID NO: 7259461 - DNA, 22 bp, Homo sapiens
tgggttttcagcatgagtttat

SEQ ID NO: 7259462 - DNA, 22 bp, Homo sapiens
tgggttttatatgtggtggaca

SEQ ID NO: 7259463 - DNA, 22 bp, Homo sapiens
tggtattacttctagacacaag

SEQ ID NO: 7259464 - DNA, 16 bp, Homo sapiens
tgggtgggaggagcgg

SEQ ID NO: 7259465 - DNA, 21 bp, Homo sapiens
tgggtgggcagagtctcttca

SEQ ID NO: 7259466 - DNA, 17 bp, Homo sapiens
tgggtggtagggagagg

SEQ ID NO: 7259467 - DNA, 21 bp, Homo sapiens
tgggtgggcagagtctcttca

SEQ ID NO: 7259468 - DNA, 22 bp, Homo sapiens
tgggtgggagcgccctgtctgg

SEQ ID NO: 7259469 - DNA, 16 bp, Homo sapiens
tgggtgggaggagcgg

SEQ ID NO: 7259470 - DNA, 22 bp, Homo sapiens
tgggtggtttatgagtgggttt

SEQ ID NO: 7259471 - DNA, 22 bp, Homo sapiens
tgggtggttgctgaggctcctt

SEQ ID NO: 7259472 - DNA, 22 bp, Homo sapiens
tgggtgtgcccagatggtgtcc

SEQ ID NO: 7259473 - DNA, 22 bp, Homo sapiens
tgggtgtgagcccgggagccgc

SEQ ID NO: 7259474 - DNA, 22 bp, Homo sapiens
tgggtgagtggagggcattcta

SEQ ID NO: 7259475 - DNA, 22 bp, Homo sapiens
tgggtgagtggagggcattcta

SEQ ID NO: 7259476 - DNA, 22 bp, Homo sapiens
tgggtgagccacaggagttgtc

SEQ ID NO: 7259477 - DNA, 22 bp, Homo sapiens
tgggtgctctgcttccctgcac

SEQ ID NO: 7259478 - DNA, 21 bp, Homo sapiens
tgggtggaagcgggaggccgc

SEQ ID NO: 7259479 - DNA, 21 bp, Homo sapiens
tgggtggaagcgggaggccgc

SEQ ID NO: 7259480 - DNA, 22 bp, Homo sapiens
tgggtgggagcgccctgtctgg

SEQ ID NO: 7259481 - DNA, 23 bp, Homo sapiens
tgggtgctaatctgctctgtgga

SEQ ID NO: 7259482 - DNA, 22 bp, Homo sapiens
tgggtgctctgcgaccgtaggg

SEQ ID NO: 7259483 - DNA, 22 bp, Homo sapiens
tgggtaaatatcctttgtgaaa

SEQ ID NO: 7259484 - DNA, 22 bp, Homo sapiens
tggggttgcctcccgccctgga

SEQ ID NO: 7259485 - DNA, 22 bp, Homo sapiens
tgggtaggccaggaagcagtgt

SEQ ID NO: 7259486 - DNA, 22 bp, Homo sapiens
tgggtagggcctgcgcctgtgc

SEQ ID NO: 7259487 - DNA, 22 bp, Homo sapiens
tgggtccttcaaagctgggtct

SEQ ID NO: 7259488 - DNA, 22 bp, Homo sapiens
tgggggtgctgagaagacagga

SEQ ID NO: 7259489 - DNA, 22 bp, Homo sapiens
tggggtctgagtatctgcattt

SEQ ID NO: 7259490 - DNA, 22 bp, Homo sapiens
tgggggtgctgagaagacagga

SEQ ID NO: 7259491 - DNA, 22 bp, Homo sapiens
tgggggtgccctatgaggaagc

SEQ ID NO: 7259492 - DNA, 22 bp, Homo sapiens
tgggggtgactatctcgggaat

SEQ ID NO: 7259493 - DNA, 22 bp, Homo sapiens
tgggggtgaaagtctggacagt

SEQ ID NO: 7259494 - DNA, 21 bp, Homo sapiens
tgggggtcttcacggtgttgt

SEQ ID NO: 7259495 - DNA, 22 bp, Homo sapiens
tggggggatacttgctactggc

SEQ ID NO: 7259496 - DNA, 22 bp, Homo sapiens
tgggggctgtgcacaggctcac

SEQ ID NO: 7259497 - DNA, 22 bp, Homo sapiens
tggggggcacttcagcacaatg

SEQ ID NO: 7259498 - DNA, 18 bp, Homo sapiens
tggggggcttgtctgaag

SEQ ID NO: 7259499 - DNA, 22 bp, Homo sapiens
tggggtggaacccttctgctgg

SEQ ID NO: 7259500 - DNA, 22 bp, Homo sapiens
tggggtgccgacagggagggca

SEQ ID NO: 7259501 - DNA, 22 bp, Homo sapiens
tggggtgacagtgcagtggtca

SEQ ID NO: 7259502 - DNA, 22 bp, Homo sapiens
tggggtgacagtgcagtggtca

SEQ ID NO: 7259503 - DNA, 22 bp, Homo sapiens
tggggtgccgacagggagggca

SEQ ID NO: 7259504 - DNA, 22 bp, Homo sapiens
tggggtggaacccttctgctgg

SEQ ID NO: 7259505 - DNA, 22 bp, Homo sapiens
tggggtggaacccttctgctgg

SEQ ID NO: 7259506 - DNA, 22 bp, Homo sapiens
tggggtggatagaaagtgatgt

SEQ ID NO: 7259507 - DNA, 22 bp, Homo sapiens
tggggtggatagaaagtgatgt

SEQ ID NO: 7259508 - DNA, 22 bp, Homo sapiens
tggggtgggcatgcgctgtcct

SEQ ID NO: 7259509 - DNA, 22 bp, Homo sapiens
tggggtgggcatgcgctgtcct

SEQ ID NO: 7259510 - DNA, 22 bp, Homo sapiens
tggggtggggttactcattctg

SEQ ID NO: 7259511 - DNA, 22 bp, Homo sapiens
tggggtgggcatgcgctgtcct

SEQ ID NO: 7259512 - DNA, 22 bp, Homo sapiens
tggggtggtaatacaccgttct

SEQ ID NO: 7259513 - DNA, 22 bp, Homo sapiens
tggggtggggttactcattctg

SEQ ID NO: 7259514 - DNA, 22 bp, Homo sapiens
tggggtggtaatacaccgttct

SEQ ID NO: 7259515 - DNA, 22 bp, Homo sapiens
tggggtggtgggaaccaagtag

SEQ ID NO: 7259516 - DNA, 22 bp, Homo sapiens
tggggtggtgggaaccaagtag

SEQ ID NO: 7259517 - DNA, 17 bp, Homo sapiens
tggggtgttgaagggtt

SEQ ID NO: 7259518 - DNA, 22 bp, Homo sapiens
tggggtgtgctcagagcagggg

SEQ ID NO: 7259519 - DNA, 22 bp, Homo sapiens
tggggtgtgagaagtagaggga

SEQ ID NO: 7259520 - DNA, 22 bp, Homo sapiens
tgggcagactgagccctgtccc

SEQ ID NO: 7259521 - DNA, 22 bp, Homo sapiens
tgggcagagtcatacaggagac

SEQ ID NO: 7259522 - DNA, 22 bp, Homo sapiens
tgggcagaggctctgaagtcca

SEQ ID NO: 7259523 - DNA, 22 bp, Homo sapiens
tgggcagagtagctcagaagaa

SEQ ID NO: 7259524 - DNA, 22 bp, Homo sapiens
tgggcagagatctggatcaaac

SEQ ID NO: 7259525 - DNA, 22 bp, Homo sapiens
tgggcagagagtagaggcaacg

SEQ ID NO: 7259526 - DNA, 22 bp, Homo sapiens
tgggcagaggacagggaagatc

SEQ ID NO: 7259527 - DNA, 22 bp, Homo sapiens
tgggcagaggcagcagaaacct

SEQ ID NO: 7259528 - DNA, 21 bp, Homo sapiens
tgggcaagtttgggggtcctc

SEQ ID NO: 7259529 - DNA, 22 bp, Homo sapiens
tgggcaagtcacttctgtcttt

SEQ ID NO: 7259530 - DNA, 22 bp, Homo sapiens
tgggcaagtatcggactctgag

SEQ ID NO: 7259531 - DNA, 22 bp, Homo sapiens
tgggcaaagtcacatacatgat

SEQ ID NO: 7259532 - DNA, 22 bp, Homo sapiens
tgggcaaactgtcaaccatgtc

SEQ ID NO: 7259533 - DNA, 22 bp, Homo sapiens
tgggatgggatctcgctgtgtc

SEQ ID NO: 7259534 - DNA, 23 bp, Homo sapiens
tgggatggattcaccagtgtgct

SEQ ID NO: 7259535 - DNA, 22 bp, Homo sapiens
tgggatggcatcctgggccttg

SEQ ID NO: 7259536 - DNA, 18 bp, Homo sapiens
tgggatggagagtaactg

SEQ ID NO: 7259537 - DNA, 18 bp, Homo sapiens
tgggagtgggagtggata

SEQ ID NO: 7259538 - DNA, 22 bp, Homo sapiens
tgggaggcccaggcctggcagg

SEQ ID NO: 7259539 - DNA, 22 bp, Homo sapiens
tgggaggcaggtaggtgatgat

SEQ ID NO: 7259540 - DNA, 22 bp, Homo sapiens
tgggaggcaggtaggtgatgat

SEQ ID NO: 7259541 - DNA, 22 bp, Homo sapiens
tgggaggcaggtaggtgatgat

SEQ ID NO: 7259542 - DNA, 22 bp, Homo sapiens
tgggaggccaaggcaggcggat

SEQ ID NO: 7259543 - DNA, 22 bp, Homo sapiens
tgggaggccgaggcaggtggat

SEQ ID NO: 7259544 - DNA, 22 bp, Homo sapiens
tgggaggtctcttgcggcctag

SEQ ID NO: 7259545 - DNA, 22 bp, Homo sapiens
tgggaggcttccagaccttgct

SEQ ID NO: 7259546 - DNA, 22 bp, Homo sapiens
tgggagtgaggcagagtctatc

SEQ ID NO: 7259547 - DNA, 22 bp, Homo sapiens
tgggagtgatacagtatggaat

SEQ ID NO: 7259548 - DNA, 22 bp, Homo sapiens
tgggcagggatctcttttgcaa

SEQ ID NO: 7259549 - DNA, 22 bp, Homo sapiens
tgggcagggagctggaaccaca

SEQ ID NO: 7259550 - DNA, 22 bp, Homo sapiens
tgggcaggagagaagctaaaga

SEQ ID NO: 7259551 - DNA, 22 bp, Homo sapiens
tgggcagccatcccagcctctc

SEQ ID NO: 7259552 - DNA, 19 bp, Homo sapiens
tgggcagctccctctgtcc

SEQ ID NO: 7259553 - DNA, 23 bp, Homo sapiens
tgggcagcttctgcatgcccacc

SEQ ID NO: 7259554 - DNA, 19 bp, Homo sapiens
tgggcagctccctctgtcc

SEQ ID NO: 7259555 - DNA, 23 bp, Homo sapiens
tgggcagcttctgcatgcccacc

SEQ ID NO: 7259556 - DNA, 16 bp, Homo sapiens
tgggcagatgagaaga

SEQ ID NO: 7259557 - DNA, 22 bp, Homo sapiens
tgggcagatctttggtggctag

SEQ ID NO: 7259558 - DNA, 22 bp, Homo sapiens
tgggcagagttgtgatgaactg

SEQ ID NO: 7259559 - DNA, 22 bp, Homo sapiens
tgggcagagtcgtggggaatag

SEQ ID NO: 7259560 - DNA, 15 bp, Homo sapiens
tgggcagatcacttg

SEQ ID NO: 7259561 - DNA, 22 bp, Homo sapiens
tgggcagatgtcctctgaagtg

SEQ ID NO: 7259562 - DNA, 21 bp, Homo sapiens
tgggcagatggcagtgtggct

SEQ ID NO: 7259563 - DNA, 22 bp, Homo sapiens
tgggcagatgtggctctccttg

SEQ ID NO: 7259564 - DNA, 22 bp, Homo sapiens
tgggcagattaatgcagtggct

SEQ ID NO: 7259565 - DNA, 22 bp, Homo sapiens
tgggcagcagaaccaggccgac

SEQ ID NO: 7259566 - DNA, 20 bp, Homo sapiens
tgggcagcactgctggctgg

SEQ ID NO: 7259567 - DNA, 22 bp, Homo sapiens
tgggcagcagcaaagccagact

SEQ ID NO: 7259568 - DNA, 22 bp, Homo sapiens
tgggcagcatcctccacagtca

SEQ ID NO: 7259569 - DNA, 22 bp, Homo sapiens
tgggccagcaattgctgctcag

SEQ ID NO: 7259570 - DNA, 22 bp, Homo sapiens
tgggccacgggggtggagagct

SEQ ID NO: 7259571 - DNA, 22 bp, Homo sapiens
tgggccacacacagaagaatca

SEQ ID NO: 7259572 - DNA, 22 bp, Homo sapiens
tgggccagcactgggtgctcat

SEQ ID NO: 7259573 - DNA, 22 bp, Homo sapiens
tgggccagctgaagtgccgccc

SEQ ID NO: 7259574 - DNA, 22 bp, Homo sapiens
tgggccagctccctgcccctgg

SEQ ID NO: 7259575 - DNA, 19 bp, Homo sapiens
tgggcaggttcagtaatgg

SEQ ID NO: 7259576 - DNA, 22 bp, Homo sapiens
tgggcaggtgctattttccatg

SEQ ID NO: 7259577 - DNA, 19 bp, Homo sapiens
tgggcaggttcagtaatgg

SEQ ID NO: 7259578 - DNA, 22 bp, Homo sapiens
tgggcagggtctctgttatcag

SEQ ID NO: 7259579 - DNA, 22 bp, Homo sapiens
tgggcaggggccctgcttccgt

SEQ ID NO: 7259580 - DNA, 22 bp, Homo sapiens
tgggcatggactgtggagccgc

SEQ ID NO: 7259581 - DNA, 22 bp, Homo sapiens
tgggcatgaagaaggaagtggg

SEQ ID NO: 7259582 - DNA, 22 bp, Homo sapiens
tgggcatcccgcgtctggctgc

SEQ ID NO: 7259583 - DNA, 22 bp, Homo sapiens
tgggcagtcatcagcacaccgg

SEQ ID NO: 7259584 - DNA, 22 bp, Homo sapiens
tgggcaggttgttatttgacat

SEQ ID NO: 7259585 - DNA, 22 bp, Homo sapiens
tgggcagtggctgggcctctct

SEQ ID NO: 7259586 - DNA, 21 bp, Homo sapiens
tgggctctttaacccaggcac

SEQ ID NO: 7259587 - DNA, 22 bp, Homo sapiens
tgggctgaaatgctgtggacta

SEQ ID NO: 7259588 - DNA, 22 bp, Homo sapiens
tgggctgagtggcagccagagt

SEQ ID NO: 7259589 - DNA, 22 bp, Homo sapiens
tgggctgagtgtggaactagtt

SEQ ID NO: 7259590 - DNA, 20 bp, Homo sapiens
tgggctgaggatcaggtgcc

SEQ ID NO: 7259591 - DNA, 22 bp, Homo sapiens
tgggctgagcactgaggaagga

SEQ ID NO: 7259592 - DNA, 22 bp, Homo sapiens
tgggctgccggcaggctctgcc

SEQ ID NO: 7259593 - DNA, 22 bp, Homo sapiens
tgggctgccctgatggtcctca

SEQ ID NO: 7259594 - DNA, 22 bp, Homo sapiens
tgggctgcccaaggtggccatg

SEQ ID NO: 7259595 - DNA, 22 bp, Homo sapiens
tgggctgcccaaggtggccatg

SEQ ID NO: 7259596 - DNA, 22 bp, Homo sapiens
tgggctgccagctctccagatg

SEQ ID NO: 7259597 - DNA, 22 bp, Homo sapiens
tgggctgcaggggttgagagct

SEQ ID NO: 7259598 - DNA, 22 bp, Homo sapiens
tgggctgcagagcccggccttc

SEQ ID NO: 7259599 - DNA, 22 bp, Homo sapiens
tgggctgcaggggttgagagct

SEQ ID NO: 7259600 - DNA, 22 bp, Homo sapiens
tgggctgcactgctctttatcg

SEQ ID NO: 7259601 - DNA, 22 bp, Homo sapiens
tgggctgcactccattttctgc

SEQ ID NO: 7259602 - DNA, 22 bp, Homo sapiens
tgggctgcacctttgtaaatct

SEQ ID NO: 7259603 - DNA, 22 bp, Homo sapiens
tgggctgcaccctcagcctctg

SEQ ID NO: 7259604 - DNA, 22 bp, Homo sapiens
tgggctgcaccctcagcctctg

SEQ ID NO: 7259605 - DNA, 22 bp, Homo sapiens
tgggctctgggtggcctgagca

SEQ ID NO: 7259606 - DNA, 22 bp, Homo sapiens
tgggctctggagggcctaggat

SEQ ID NO: 7259607 - DNA, 22 bp, Homo sapiens
tgggctctgcatcagtgcccat

SEQ ID NO: 7259608 - DNA, 22 bp, Homo sapiens
tgggctctctttacctcataac

SEQ ID NO: 7259609 - DNA, 22 bp, Homo sapiens
tgggctcactggggcagggacc

SEQ ID NO: 7259610 - DNA, 22 bp, Homo sapiens
tgggctcagctcccaagggaag

SEQ ID NO: 7259611 - DNA, 22 bp, Homo sapiens
tgggctcagctcccaagggaag

SEQ ID NO: 7259612 - DNA, 22 bp, Homo sapiens
tgggctcaggaccccagaggcc

SEQ ID NO: 7259613 - DNA, 22 bp, Homo sapiens
tgggctcagggaagcttggcct

SEQ ID NO: 7259614 - DNA, 22 bp, Homo sapiens
tgggctcagtctgcacctgcgg

SEQ ID NO: 7259615 - DNA, 22 bp, Homo sapiens
tgggctcagggtcgaggacttt

SEQ ID NO: 7259616 - DNA, 22 bp, Homo sapiens
tgggcggtgtgcaggctctgct

SEQ ID NO: 7259617 - DNA, 23 bp, Homo sapiens
tgggcggggcttttcactctgcc

SEQ ID NO: 7259618 - DNA, 22 bp, Homo sapiens
tgggcgggcaggagcgcacctg

SEQ ID NO: 7259619 - DNA, 22 bp, Homo sapiens
tgggcggactcgggcatggaat

SEQ ID NO: 7259620 - DNA, 22 bp, Homo sapiens
tgggcgaggcccagggctgcgt

SEQ ID NO: 7259621 - DNA, 23 bp, Homo sapiens
tgggcgaggcaggagtggagcac

SEQ ID NO: 7259622 - DNA, 18 bp, Homo sapiens
tgggctcaaaggatcctc

SEQ ID NO: 7259623 - DNA, 22 bp, Homo sapiens
tgggctagatatttttgggctg

SEQ ID NO: 7259624 - DNA, 22 bp, Homo sapiens
tgggctagatttggtgacccag

SEQ ID NO: 7259625 - DNA, 22 bp, Homo sapiens
tgggctcaaactggaggttgtt

SEQ ID NO: 7259626 - DNA, 22 bp, Homo sapiens
tgggcgaggagaatgctgtgaa

SEQ ID NO: 7259627 - DNA, 20 bp, Homo sapiens
tgggcctgtggcagaagtct

SEQ ID NO: 7259628 - DNA, 20 bp, Homo sapiens
tgggcctgtggcagaagtct

SEQ ID NO: 7259629 - DNA, 22 bp, Homo sapiens
tgggccaggtctgtgtcagctg

SEQ ID NO: 7259630 - DNA, 22 bp, Homo sapiens
tgggccagggcacccagtccag

SEQ ID NO: 7259631 - DNA, 23 bp, Homo sapiens
tgggccagggagtccggtttctt

SEQ ID NO: 7259632 - DNA, 22 bp, Homo sapiens
tgggccaggggcctcttctgat

SEQ ID NO: 7259633 - DNA, 22 bp, Homo sapiens
tgggccagttatttcacctctg

SEQ ID NO: 7259634 - DNA, 22 bp, Homo sapiens
tgggccagtccagccccaggga

SEQ ID NO: 7259635 - DNA, 22 bp, Homo sapiens
tgggccagtcctgcctaaggtg

SEQ ID NO: 7259636 - DNA, 22 bp, Homo sapiens
tgggccagttctttactcgtcc

SEQ ID NO: 7259637 - DNA, 22 bp, Homo sapiens
tgggcctcccatgtcttaggga

SEQ ID NO: 7259638 - DNA, 22 bp, Homo sapiens
tgggcctcctgccctggcctag

SEQ ID NO: 7259639 - DNA, 22 bp, Homo sapiens
tgggcctcatgcccagccaccc

SEQ ID NO: 7259640 - DNA, 22 bp, Homo sapiens
tgggcctcagtttccttaggat

SEQ ID NO: 7259641 - DNA, 22 bp, Homo sapiens
tgggcctctgtttcctcatctg

SEQ ID NO: 7259642 - DNA, 20 bp, Homo sapiens
tgggcctctggtgcctctgg

SEQ ID NO: 7259643 - DNA, 22 bp, Homo sapiens
tgggcctctgggttagtcccta

SEQ ID NO: 7259644 - DNA, 22 bp, Homo sapiens
tgggcctctgccacgctccccc

SEQ ID NO: 7259645 - DNA, 22 bp, Homo sapiens
tgggcctcggggaagcccgtgt

SEQ ID NO: 7259646 - DNA, 22 bp, Homo sapiens
tgggcctcctttccattcagag

SEQ ID NO: 7259647 - DNA, 22 bp, Homo sapiens
tggccttggcagtgagaagagt

SEQ ID NO: 7259648 - DNA, 22 bp, Homo sapiens
tggccttggagaggcacggccc

SEQ ID NO: 7259649 - DNA, 22 bp, Homo sapiens
tggccttggacagagcgctcct

SEQ ID NO: 7259650 - DNA, 22 bp, Homo sapiens
tggccttgcccagcgcctaggt

SEQ ID NO: 7259651 - DNA, 22 bp, Homo sapiens
tggccttgccacatttgtcagc

SEQ ID NO: 7259652 - DNA, 22 bp, Homo sapiens
tggccttgattatgccagtaga

SEQ ID NO: 7259653 - DNA, 22 bp, Homo sapiens
tggccttgataactggggagag

SEQ ID NO: 7259654 - DNA, 22 bp, Homo sapiens
tggccttgagtggtctccgccc

SEQ ID NO: 7259655 - DNA, 22 bp, Homo sapiens
tggccttgagatgcagcagcca

SEQ ID NO: 7259656 - DNA, 21 bp, Homo sapiens
tggccttgagagtctccttgc

SEQ ID NO: 7259657 - DNA, 22 bp, Homo sapiens
tggccttgagagatcaaaaggt

SEQ ID NO: 7259658 - DNA, 22 bp, Homo sapiens
tggccttgagaatgtccctagg

SEQ ID NO: 7259659 - DNA, 18 bp, Homo sapiens
tggccttgaatcatatca

SEQ ID NO: 7259660 - DNA, 22 bp, Homo sapiens
tggcctgtggcatgacctctag

SEQ ID NO: 7259661 - DNA, 22 bp, Homo sapiens
tggccttgaactcatcacgtgg

SEQ ID NO: 7259662 - DNA, 22 bp, Homo sapiens
tggccttgaaccaggtctccac

SEQ ID NO: 7259663 - DNA, 22 bp, Homo sapiens
tggccttgtgttttagagaaag

SEQ ID NO: 7259664 - DNA, 22 bp, Homo sapiens
tggccttgtgtttaagcaagaa

SEQ ID NO: 7259665 - DNA, 15 bp, Homo sapiens
tggccttgtggttgt

SEQ ID NO: 7259666 - DNA, 22 bp, Homo sapiens
tggccttgtctctcagaaccgc

SEQ ID NO: 7259667 - DNA, 22 bp, Homo sapiens
tggccttggtcctctttgcaat

SEQ ID NO: 7259668 - DNA, 22 bp, Homo sapiens
tggccttggtcacaatgcaaac

SEQ ID NO: 7259669 - DNA, 22 bp, Homo sapiens
tggccttgggtccttagcatca

SEQ ID NO: 7259670 - DNA, 20 bp, Homo sapiens
tggccttggggagctcacac

SEQ ID NO: 7259671 - DNA, 22 bp, Homo sapiens
tggccttgggcaggtggcctgc

SEQ ID NO: 7259672 - DNA, 22 bp, Homo sapiens
tggccttggctgagagatttaa

SEQ ID NO: 7259673 - DNA, 22 bp, Homo sapiens
tggccttggccttttctgctcc

SEQ ID NO: 7259674 - DNA, 22 bp, Homo sapiens
tggccttggccgtgctggggtc

SEQ ID NO: 7259675 - DNA, 22 bp, Homo sapiens
tggccttgttctctctcccatc

SEQ ID NO: 7259676 - DNA, 22 bp, Homo sapiens
tggcctggtgctcaggcagtag

SEQ ID NO: 7259677 - DNA, 22 bp, Homo sapiens
tggcctggtccttgtcaaggca

SEQ ID NO: 7259678 - DNA, 22 bp, Homo sapiens
tggcctggtgtctgcgaggcct

SEQ ID NO: 7259679 - DNA, 22 bp, Homo sapiens
tggcctggccctgaggccctgt

SEQ ID NO: 7259680 - DNA, 20 bp, Homo sapiens
tggcggggatgagggagtta

SEQ ID NO: 7259681 - DNA, 22 bp, Homo sapiens
tggcggtgacggcggcgcctgg

SEQ ID NO: 7259682 - DNA, 17 bp, Homo sapiens
tggcgctcccagggtgc

SEQ ID NO: 7259683 - DNA, 22 bp, Homo sapiens
tggcgcgctcgctctcgctgag

SEQ ID NO: 7259684 - DNA, 21 bp, Homo sapiens
tggcggggacttgtggctgcc

SEQ ID NO: 7259685 - DNA, 22 bp, Homo sapiens
tggctcagaagaaaaggtaaac

SEQ ID NO: 7259686 - DNA, 22 bp, Homo sapiens
tggctcagaactacttctagtt

SEQ ID NO: 7259687 - DNA, 22 bp, Homo sapiens
tggctatttacaaggtaggtga

SEQ ID NO: 7259688 - DNA, 22 bp, Homo sapiens
tggctatgcaatttaggagttc

SEQ ID NO: 7259689 - DNA, 22 bp, Homo sapiens
tggctcagagcagggactctgg

SEQ ID NO: 7259690 - DNA, 22 bp, Homo sapiens
tggctcagagagggagtgtgga

SEQ ID NO: 7259691 - DNA, 22 bp, Homo sapiens
tggctcagatgctcttccagtg

SEQ ID NO: 7259692 - DNA, 22 bp, Homo sapiens
tggctcagataattcaaggggc

SEQ ID NO: 7259693 - DNA, 22 bp, Homo sapiens
tggctcagaggggaagtggttt

SEQ ID NO: 7259694 - DNA, 22 bp, Homo sapiens
tggctcaggcctacgacgcctt

SEQ ID NO: 7259695 - DNA, 22 bp, Homo sapiens
tggctcaggatctaagcagaat

SEQ ID NO: 7259696 - DNA, 22 bp, Homo sapiens
tggctcaggagggatctttgct

SEQ ID NO: 7259697 - DNA, 22 bp, Homo sapiens
tggctcagctttccccatctgg

SEQ ID NO: 7259698 - DNA, 22 bp, Homo sapiens
tggctcagcttacttttgaggg

SEQ ID NO: 7259699 - DNA, 22 bp, Homo sapiens
tggctcagtagcagtgtggtca

SEQ ID NO: 7259700 - DNA, 22 bp, Homo sapiens
tggctcagtaatcgagtctcct

SEQ ID NO: 7259701 - DNA, 22 bp, Homo sapiens
tggctcaggtgtgagctgaaga

SEQ ID NO: 7259702 - DNA, 22 bp, Homo sapiens
tggctcaggggtctggctctgt

SEQ ID NO: 7259703 - DNA, 22 bp, Homo sapiens
tggctcagtgcattcacagtaa

SEQ ID NO: 7259704 - DNA, 22 bp, Homo sapiens
tggctcagttccatcatctgga

SEQ ID NO: 7259705 - DNA, 22 bp, Homo sapiens
tggctcagtggcagccgcagct

SEQ ID NO: 7259706 - DNA, 22 bp, Homo sapiens
tggctgagaagttctggtggga

SEQ ID NO: 7259707 - DNA, 22 bp, Homo sapiens
tggctgagaaaatggttttagg

SEQ ID NO: 7259708 - DNA, 22 bp, Homo sapiens
tggctgagaaaaaagagctata

SEQ ID NO: 7259709 - DNA, 22 bp, Homo sapiens
tggctgagccacttgttcagat

SEQ ID NO: 7259710 - DNA, 23 bp, Homo sapiens
tggctgagatcctactgtttgct

SEQ ID NO: 7259711 - DNA, 22 bp, Homo sapiens
tggctgagagtcatcctgtgtg

SEQ ID NO: 7259712 - DNA, 23 bp, Homo sapiens
tggctgagcccactatcttggcc

SEQ ID NO: 7259713 - DNA, 22 bp, Homo sapiens
tggctgagcctttggggctttc

SEQ ID NO: 7259714 - DNA, 21 bp, Homo sapiens
tggctgagccaggtgtgtgga

SEQ ID NO: 7259715 - DNA, 22 bp, Homo sapiens
tggctgaggttatgctggttgt

SEQ ID NO: 7259716 - DNA, 22 bp, Homo sapiens
tggctgagtaagttgtgatatg

SEQ ID NO: 7259717 - DNA, 22 bp, Homo sapiens
tggctgagtgaacatgtccatt

SEQ ID NO: 7259718 - DNA, 22 bp, Homo sapiens
tggctgagggcactatgaagcc

SEQ ID NO: 7259719 - DNA, 22 bp, Homo sapiens
tggctgaggcttttcttaaaga

SEQ ID NO: 7259720 - DNA, 22 bp, Homo sapiens
tggctgaggctggagtgcagtg

SEQ ID NO: 7259721 - DNA, 22 bp, Homo sapiens
tggctgagctgcagcgtggctt

SEQ ID NO: 7259722 - DNA, 22 bp, Homo sapiens
tggctgagctccctgtgtgttg

SEQ ID NO: 7259723 - DNA, 19 bp, Homo sapiens
tggctgagctggactgagg

SEQ ID NO: 7259724 - DNA, 22 bp, Homo sapiens
tggctgaggcacagctgccgcc

SEQ ID NO: 7259725 - DNA, 22 bp, Homo sapiens
tggctgaggagggtcttctggt

SEQ ID NO: 7259726 - DNA, 22 bp, Homo sapiens
tggctgaggagagggcggaagt

SEQ ID NO: 7259727 - DNA, 22 bp, Homo sapiens
tggctgccaagcaggtcagaga

SEQ ID NO: 7259728 - DNA, 22 bp, Homo sapiens
tggctgcagtgcttgagatgtc

SEQ ID NO: 7259729 - DNA, 22 bp, Homo sapiens
tggctgcagttcacaggagcaa

SEQ ID NO: 7259730 - DNA, 20 bp, Homo sapiens
tggctgcccgaggcacacac

SEQ ID NO: 7259731 - DNA, 22 bp, Homo sapiens
tggctgagtttcatgcatcatg

SEQ ID NO: 7259732 - DNA, 22 bp, Homo sapiens
tggctgcagacacctatggcag

SEQ ID NO: 7259733 - DNA, 22 bp, Homo sapiens
tggctgcagatcaagggcaggc

SEQ ID NO: 7259734 - DNA, 22 bp, Homo sapiens
tggctgcagatcaagggcaggc

SEQ ID NO: 7259735 - DNA, 22 bp, Homo sapiens
tggctgagttacgaacagagca

SEQ ID NO: 7259736 - DNA, 22 bp, Homo sapiens
tggctgagttcctggcacacgg

SEQ ID NO: 7259737 - DNA, 22 bp, Homo sapiens
tggctgagttctccaggagtag

SEQ ID NO: 7259738 - DNA, 22 bp, Homo sapiens
tggctgagtgatatttgcaaag

SEQ ID NO: 7259739 - DNA, 21 bp, Homo sapiens
tggctgagtggatgcatgaat

SEQ ID NO: 7259740 - DNA, 22 bp, Homo sapiens
tggctgagtgttccaaggagca

SEQ ID NO: 7259741 - DNA, 22 bp, Homo sapiens
tggctctggccaccgggagggc

SEQ ID NO: 7259742 - DNA, 22 bp, Homo sapiens
tggctctggagctggcggctga

SEQ ID NO: 7259743 - DNA, 23 bp, Homo sapiens
tggctctgagcttcctggtggcc

SEQ ID NO: 7259744 - DNA, 23 bp, Homo sapiens
tggctctagaaggccattttcct

SEQ ID NO: 7259745 - DNA, 22 bp, Homo sapiens
tggctctgctgaacctagtgca

SEQ ID NO: 7259746 - DNA, 22 bp, Homo sapiens
tggctctggagctcctgggccc

SEQ ID NO: 7259747 - DNA, 22 bp, Homo sapiens
tggctctgcagcagtgtgcgtg

SEQ ID NO: 7259748 - DNA, 22 bp, Homo sapiens
tgggaagggagagtgtcctgga

SEQ ID NO: 7259749 - DNA, 22 bp, Homo sapiens
tgggaagggagtttcttggagt

SEQ ID NO: 7259750 - DNA, 22 bp, Homo sapiens
tgggaaggtgattttccaaaag

SEQ ID NO: 7259751 - DNA, 22 bp, Homo sapiens
tgggaaggtacacgggaaagag

SEQ ID NO: 7259752 - DNA, 22 bp, Homo sapiens
tgggaagggtcaacagctggaa

SEQ ID NO: 7259753 - DNA, 22 bp, Homo sapiens
tgggaaggggagctggaaagga

SEQ ID NO: 7259754 - DNA, 22 bp, Homo sapiens
tgggaagggtcaacagctggaa

SEQ ID NO: 7259755 - DNA, 22 bp, Homo sapiens
tgggaagggccgatggagcctc

SEQ ID NO: 7259756 - DNA, 22 bp, Homo sapiens
tgggaaggggagctggaaagga

SEQ ID NO: 7259757 - DNA, 22 bp, Homo sapiens
tgggacacaaaccagaccagga

SEQ ID NO: 7259758 - DNA, 22 bp, Homo sapiens
tgggacacctcagatagtgtct

SEQ ID NO: 7259759 - DNA, 22 bp, Homo sapiens
tgggacagggaatctgatcccc

SEQ ID NO: 7259760 - DNA, 21 bp, Homo sapiens
tgggacagtgatggctcctcc

SEQ ID NO: 7259761 - DNA, 21 bp, Homo sapiens
tgggacagtgatggctcctcc

SEQ ID NO: 7259762 - DNA, 22 bp, Homo sapiens
tgggacagtgaccccagaggtc

SEQ ID NO: 7259763 - DNA, 22 bp, Homo sapiens
tgggacagtgtgccttgctcct

SEQ ID NO: 7259764 - DNA, 22 bp, Homo sapiens
tgggaggaagtgctaatgggag

SEQ ID NO: 7259765 - DNA, 22 bp, Homo sapiens
tgggaggacttgtgggcttcat

SEQ ID NO: 7259766 - DNA, 22 bp, Homo sapiens
tgggaggcagaagttgactgga

SEQ ID NO: 7259767 - DNA, 22 bp, Homo sapiens
tgggaggcagaagttgactgga

SEQ ID NO: 7259768 - DNA, 22 bp, Homo sapiens
tgggaggagccctctgggaagg

SEQ ID NO: 7259769 - DNA, 22 bp, Homo sapiens
tgggaggatctcttgaggccag

SEQ ID NO: 7259770 - DNA, 22 bp, Homo sapiens
tgggagcaccctgaggagcttc

SEQ ID NO: 7259771 - DNA, 22 bp, Homo sapiens
tgggagcaccttgagggcagaa

SEQ ID NO: 7259772 - DNA, 22 bp, Homo sapiens
tgggagaagcagtgggacagta

SEQ ID NO: 7259773 - DNA, 22 bp, Homo sapiens
tgggagaagcatggggtgcaga

SEQ ID NO: 7259774 - DNA, 22 bp, Homo sapiens
tgggagacactggtgggagctt

SEQ ID NO: 7259775 - DNA, 22 bp, Homo sapiens
tgggagactccagaactgatcc

SEQ ID NO: 7259776 - DNA, 22 bp, Homo sapiens
tgggagaacccagggtcaggct

SEQ ID NO: 7259777 - DNA, 19 bp, Homo sapiens
tgggagaggcaacagagta

SEQ ID NO: 7259778 - DNA, 19 bp, Homo sapiens
tgggagaggcaacagagta

SEQ ID NO: 7259779 - DNA, 22 bp, Homo sapiens
tgggagagcttcatgccttcag

SEQ ID NO: 7259780 - DNA, 22 bp, Homo sapiens
tgggagagtaaccaattccttc

SEQ ID NO: 7259781 - DNA, 21 bp, Homo sapiens
tgggagagggctcagctaccc

SEQ ID NO: 7259782 - DNA, 21 bp, Homo sapiens
tgggagagggctcagctaccc

SEQ ID NO: 7259783 - DNA, 22 bp, Homo sapiens
tgggagaggctgccatcttgca

SEQ ID NO: 7259784 - DNA, 22 bp, Homo sapiens
tgggagagtttgtttagagtga

SEQ ID NO: 7259785 - DNA, 22 bp, Homo sapiens
tgggagagtgctcaatgtgcaa

SEQ ID NO: 7259786 - DNA, 22 bp, Homo sapiens
tgggagagtctaaaaccgaggt

SEQ ID NO: 7259787 - DNA, 22 bp, Homo sapiens
tgggagagtctaaaaccgaggt

SEQ ID NO: 7259788 - DNA, 18 bp, Homo sapiens
tgggaaagtttatagaat

SEQ ID NO: 7259789 - DNA, 22 bp, Homo sapiens
tgggaaagtgttgaggtgtctt

SEQ ID NO: 7259790 - DNA, 22 bp, Homo sapiens
tgggaaagtgtagcctgcaggc

SEQ ID NO: 7259791 - DNA, 22 bp, Homo sapiens
tgggaaagtctttatttctctt

SEQ ID NO: 7259792 - DNA, 22 bp, Homo sapiens
tgggaaatcagtatagtatcag

SEQ ID NO: 7259793 - DNA, 22 bp, Homo sapiens
tgggaaattgtatttctatttc

SEQ ID NO: 7259794 - DNA, 22 bp, Homo sapiens
tgggaaagactcaggacaggag

SEQ ID NO: 7259795 - DNA, 19 bp, Homo sapiens
tgggaaagtaacatacaaa

SEQ ID NO: 7259796 - DNA, 19 bp, Homo sapiens
tgggaaagtaacatacaaa

SEQ ID NO: 7259797 - DNA, 22 bp, Homo sapiens
tgggaaagctgcagaaattctc

SEQ ID NO: 7259798 - DNA, 22 bp, Homo sapiens
tgggaaagccagcagtgtcacc

SEQ ID NO: 7259799 - DNA, 20 bp, Homo sapiens
tgggaaagtctaagtgcctc

SEQ ID NO: 7259800 - DNA, 22 bp, Homo sapiens
tgggaaagtaattgtcatcctt

SEQ ID NO: 7259801 - DNA, 17 bp, Homo sapiens
tggcttcagatgtacat

SEQ ID NO: 7259802 - DNA, 22 bp, Homo sapiens
tggcttctcagtttcataatga

SEQ ID NO: 7259803 - DNA, 22 bp, Homo sapiens
tggcttctggtttatccttata

SEQ ID NO: 7259804 - DNA, 22 bp, Homo sapiens
tggcttctggctggtgagaaat

SEQ ID NO: 7259805 - DNA, 22 bp, Homo sapiens
tggcttctgctcccagaatgat

SEQ ID NO: 7259806 - DNA, 22 bp, Homo sapiens
tggcttctccctccccatctag

SEQ ID NO: 7259807 - DNA, 22 bp, Homo sapiens
tggcttctccctacaacatgcc

SEQ ID NO: 7259808 - DNA, 22 bp, Homo sapiens
tggcttctcccgacaccctggc

SEQ ID NO: 7259809 - DNA, 22 bp, Homo sapiens
tggctggggccacagttttcct

SEQ ID NO: 7259810 - DNA, 22 bp, Homo sapiens
tggctggggcctgaatcctgca

SEQ ID NO: 7259811 - DNA, 19 bp, Homo sapiens
tggctgggcgtgcctccgt

SEQ ID NO: 7259812 - DNA, 22 bp, Homo sapiens
tggctggggagccccgactccc

SEQ ID NO: 7259813 - DNA, 22 bp, Homo sapiens
tggctgggggtgctatagctgc

SEQ ID NO: 7259814 - DNA, 19 bp, Homo sapiens
tggctgggtgccaatggcc

SEQ ID NO: 7259815 - DNA, 22 bp, Homo sapiens
tggctgggtgctatccagtact

SEQ ID NO: 7259816 - DNA, 22 bp, Homo sapiens
tggctgtgaacaaagagaataa

SEQ ID NO: 7259817 - DNA, 22 bp, Homo sapiens
tggcttaatttctctgtgcctc

SEQ ID NO: 7259818 - DNA, 22 bp, Homo sapiens
tggcttaatatttcatatttaa

SEQ ID NO: 7259819 - DNA, 22 bp, Homo sapiens
tggcttaagcgcaactctgtct

SEQ ID NO: 7259820 - DNA, 22 bp, Homo sapiens
tggcttaagatttatgctttta

SEQ ID NO: 7259821 - DNA, 22 bp, Homo sapiens
tggcttaagacgaaaagaaggg

SEQ ID NO: 7259822 - DNA, 22 bp, Homo sapiens
tggcttaaccttgtgagtgtta

SEQ ID NO: 7259823 - DNA, 23 bp, Homo sapiens
tggcttaacctcttcctatgtct

SEQ ID NO: 7259824 - DNA, 22 bp, Homo sapiens
tggctgggccgggccttgtgcc

SEQ ID NO: 7259825 - DNA, 22 bp, Homo sapiens
tggctgggcccccacctgcctc

SEQ ID NO: 7259826 - DNA, 22 bp, Homo sapiens
tggctggcgccgggctagccac

SEQ ID NO: 7259827 - DNA, 22 bp, Homo sapiens
tggctggcagtaggctagtggc

SEQ ID NO: 7259828 - DNA, 22 bp, Homo sapiens
tggctggcatagccattgctcc

SEQ ID NO: 7259829 - DNA, 22 bp, Homo sapiens
tggctggagtgggagaagttta

SEQ ID NO: 7259830 - DNA, 22 bp, Homo sapiens
tggctggatgtgagatcaagag

SEQ ID NO: 7259831 - DNA, 22 bp, Homo sapiens
tggcagggtgccagttgcgagt

SEQ ID NO: 7259832 - DNA, 22 bp, Homo sapiens
tggcagggtggcaacttttggt

SEQ ID NO: 7259833 - DNA, 22 bp, Homo sapiens
tggcagggtcttgctgtgttgc

SEQ ID NO: 7259834 - DNA, 22 bp, Homo sapiens
tggcatcacctccacgatcatc

SEQ ID NO: 7259835 - DNA, 22 bp, Homo sapiens
tggccaggcctcttggtgccca

SEQ ID NO: 7259836 - DNA, 17 bp, Homo sapiens
tggccaggccccgccag

SEQ ID NO: 7259837 - DNA, 17 bp, Homo sapiens
tggccaggccccgccag

SEQ ID NO: 7259838 - DNA, 22 bp, Homo sapiens
tggccaggccggggacagaact

SEQ ID NO: 7259839 - DNA, 22 bp, Homo sapiens
tggccaggcattcagataagac

SEQ ID NO: 7259840 - DNA, 22 bp, Homo sapiens
tggccagcagagttcactctct

SEQ ID NO: 7259841 - DNA, 22 bp, Homo sapiens
tggccagccctcttcccacact

SEQ ID NO: 7259842 - DNA, 22 bp, Homo sapiens
tggccagccagaaagaagcctt

SEQ ID NO: 7259843 - DNA, 22 bp, Homo sapiens
tggccagcccttcagccatgcc

SEQ ID NO: 7259844 - DNA, 22 bp, Homo sapiens
tggccaggggagttcccctcca

SEQ ID NO: 7259845 - DNA, 22 bp, Homo sapiens
tggccaggctggtctggaacgc

SEQ ID NO: 7259846 - DNA, 23 bp, Homo sapiens
tggccagggtactacacccaccc

SEQ ID NO: 7259847 - DNA, 22 bp, Homo sapiens
tggccaggggagttcccctcca

SEQ ID NO: 7259848 - DNA, 19 bp, Homo sapiens
tggccaggtactgtctgct

SEQ ID NO: 7259849 - DNA, 23 bp, Homo sapiens
tggccagggtactacacccaccc

SEQ ID NO: 7259850 - DNA, 22 bp, Homo sapiens
tggccaggttgggctttgcagc

SEQ ID NO: 7259851 - DNA, 19 bp, Homo sapiens
tggccaggtactgtctgct

SEQ ID NO: 7259852 - DNA, 23 bp, Homo sapiens
tggccaggtagaggaggtagtga

SEQ ID NO: 7259853 - DNA, 22 bp, Homo sapiens
tggccaggtgtgggttctcaga

SEQ ID NO: 7259854 - DNA, 23 bp, Homo sapiens
tggccaggtagaggaggtagtga

SEQ ID NO: 7259855 - DNA, 22 bp, Homo sapiens
tggccacacccacctagaggag

SEQ ID NO: 7259856 - DNA, 22 bp, Homo sapiens
tggccacacccacctagaggag

SEQ ID NO: 7259857 - DNA, 22 bp, Homo sapiens
tggccacatatgtgggacagct

SEQ ID NO: 7259858 - DNA, 23 bp, Homo sapiens
tggccacagtccatgcatgccca

SEQ ID NO: 7259859 - DNA, 22 bp, Homo sapiens
tggccacagtgtccagcagcag

SEQ ID NO: 7259860 - DNA, 22 bp, Homo sapiens
tggccacagtgtccagcagcag

SEQ ID NO: 7259861 - DNA, 22 bp, Homo sapiens
tggccacatgcgtctgtgaggc

SEQ ID NO: 7259862 - DNA, 22 bp, Homo sapiens
tggccaccaccaatacttgcct

SEQ ID NO: 7259863 - DNA, 22 bp, Homo sapiens
tggccacccctttctctgcact

SEQ ID NO: 7259864 - DNA, 22 bp, Homo sapiens
tggcctggaacctggcagggac

SEQ ID NO: 7259865 - DNA, 22 bp, Homo sapiens
tggcctggaagagaggtcgagg

SEQ ID NO: 7259866 - DNA, 22 bp, Homo sapiens
tggccctgtgtgcaggctgcac

SEQ ID NO: 7259867 - DNA, 22 bp, Homo sapiens
tggccctgtgtcctgctgccag

SEQ ID NO: 7259868 - DNA, 23 bp, Homo sapiens
tggccctgtgcatgctgcttccc

SEQ ID NO: 7259869 - DNA, 22 bp, Homo sapiens
tggccctgtggaggtcagtgag

SEQ ID NO: 7259870 - DNA, 22 bp, Homo sapiens
tggccctgtggcttcagaacag

SEQ ID NO: 7259871 - DNA, 22 bp, Homo sapiens
tggccctgttctgtacctcata

SEQ ID NO: 7259872 - DNA, 20 bp, Homo sapiens
tggccctgttttctccaggc

SEQ ID NO: 7259873 - DNA, 22 bp, Homo sapiens
tggccggggctgatggacagtg

SEQ ID NO: 7259874 - DNA, 22 bp, Homo sapiens
tggccgggccgggcgcctccac

SEQ ID NO: 7259875 - DNA, 22 bp, Homo sapiens
tggccgggaagggacagtgtgg

SEQ ID NO: 7259876 - DNA, 22 bp, Homo sapiens
tggccctgggcatctttcgtga

SEQ ID NO: 7259877 - DNA, 22 bp, Homo sapiens
tggccctgggcagaggcaacat

SEQ ID NO: 7259878 - DNA, 22 bp, Homo sapiens
tggccctggctgagttagattt

SEQ ID NO: 7259879 - DNA, 21 bp, Homo sapiens
tggccctggccacggctgcca

SEQ ID NO: 7259880 - DNA, 22 bp, Homo sapiens
tggccctgccgccacgacgtct

SEQ ID NO: 7259881 - DNA, 22 bp, Homo sapiens
tggccctgccgcactatcctca

SEQ ID NO: 7259882 - DNA, 22 bp, Homo sapiens
tggccctgccctcttcatcttt

SEQ ID NO: 7259883 - DNA, 22 bp, Homo sapiens
tggccctgccactcactgctga

SEQ ID NO: 7259884 - DNA, 22 bp, Homo sapiens
tggccctgggtggaatgtccca

SEQ ID NO: 7259885 - DNA, 22 bp, Homo sapiens
tggccctgtccctggagcctgg

SEQ ID NO: 7259886 - DNA, 22 bp, Homo sapiens
tggccctggtggcacagcctgc

SEQ ID NO: 7259887 - DNA, 22 bp, Homo sapiens
tggccctgtcctcatttcatct

SEQ ID NO: 7259888 - DNA, 22 bp, Homo sapiens
tggccctgtctgcacacaggat

SEQ ID NO: 7259889 - DNA, 22 bp, Homo sapiens
tggccctgtgactgagttctag

SEQ ID NO: 7259890 - DNA, 22 bp, Homo sapiens
tggccctgacacgtggtactgg

SEQ ID NO: 7259891 - DNA, 22 bp, Homo sapiens
tggccctgacaggtcctgggca

SEQ ID NO: 7259892 - DNA, 22 bp, Homo sapiens
tggccctgaggacccagtgtgg

SEQ ID NO: 7259893 - DNA, 22 bp, Homo sapiens
tggccctgacttggaggcctga

SEQ ID NO: 7259894 - DNA, 22 bp, Homo sapiens
tggccctgacttggaggcctga

SEQ ID NO: 7259895 - DNA, 22 bp, Homo sapiens
tggccctgactgatgtggaggg

SEQ ID NO: 7259896 - DNA, 22 bp, Homo sapiens
tggccctgaggggctgtgcccc

SEQ ID NO: 7259897 - DNA, 22 bp, Homo sapiens
tggccctgagggctcggagcca

SEQ ID NO: 7259898 - DNA, 22 bp, Homo sapiens
tggccctgcacccagagcagtt

SEQ ID NO: 7259899 - DNA, 22 bp, Homo sapiens
tggccctgcagaactagcctgg

SEQ ID NO: 7259900 - DNA, 22 bp, Homo sapiens
tggccctgaatcaaggccagca

SEQ ID NO: 7259901 - DNA, 22 bp, Homo sapiens
tggccctgaatcaaggccagca

SEQ ID NO: 7259902 - DNA, 22 bp, Homo sapiens
tggccctgaaggccttgagcat

SEQ ID NO: 7259903 - DNA, 23 bp, Homo sapiens
tggccctgaatctgtcctggagg

SEQ ID NO: 7259904 - DNA, 22 bp, Homo sapiens
tggcccagtagaaaagggatcg

SEQ ID NO: 7259905 - DNA, 22 bp, Homo sapiens
tggcccaggtgcacccagaggc

SEQ ID NO: 7259906 - DNA, 22 bp, Homo sapiens
tggcccaggtgcaagagacaga

SEQ ID NO: 7259907 - DNA, 22 bp, Homo sapiens
tggcccaggtgcacccagaggc

SEQ ID NO: 7259908 - DNA, 22 bp, Homo sapiens
tggcccaggtgcaagagacaga

SEQ ID NO: 7259909 - DNA, 22 bp, Homo sapiens
tggcccagtatgtataatctta

SEQ ID NO: 7259910 - DNA, 22 bp, Homo sapiens
tggcccagtcagcaggagaggg

SEQ ID NO: 7259911 - DNA, 22 bp, Homo sapiens
tggcccagtcagcaggagaggg

SEQ ID NO: 7259912 - DNA, 22 bp, Homo sapiens
tggcccggctctgagctgtgct

SEQ ID NO: 7259913 - DNA, 22 bp, Homo sapiens
tggcccaggccaaagccctgga

SEQ ID NO: 7259914 - DNA, 22 bp, Homo sapiens
tggcccaggcgaggtgggcaga

SEQ ID NO: 7259915 - DNA, 22 bp, Homo sapiens
tggcccagggagttcatggtgt

SEQ ID NO: 7259916 - DNA, 22 bp, Homo sapiens
tggcccaggcgaggtgggcaga

SEQ ID NO: 7259917 - DNA, 22 bp, Homo sapiens
tggcccaggaggccagagggca

SEQ ID NO: 7259918 - DNA, 22 bp, Homo sapiens
tggcccaggccaaagccctgga

SEQ ID NO: 7259919 - DNA, 22 bp, Homo sapiens
tggcccaggtctctctgagccc

SEQ ID NO: 7259920 - DNA, 22 bp, Homo sapiens
tggcccagggtctacagcctca

SEQ ID NO: 7259921 - DNA, 22 bp, Homo sapiens
tggcccaggggctcttggtgtt

SEQ ID NO: 7259922 - DNA, 22 bp, Homo sapiens
tggcccagggcacagcagggag

SEQ ID NO: 7259923 - DNA, 22 bp, Homo sapiens
tggcccagggcacagcagggag

SEQ ID NO: 7259924 - DNA, 22 bp, Homo sapiens
tggcccagggagttcatggtgt

SEQ ID NO: 7259925 - DNA, 22 bp, Homo sapiens
tggccagtggggttgagcagga

SEQ ID NO: 7259926 - DNA, 22 bp, Homo sapiens
tggccatgggatagtgcagggg

SEQ ID NO: 7259927 - DNA, 22 bp, Homo sapiens
tggcccagccctgctctagggc

SEQ ID NO: 7259928 - DNA, 22 bp, Homo sapiens
tggcccagctcagggtgggcgg

SEQ ID NO: 7259929 - DNA, 22 bp, Homo sapiens
tggcccagctcagggtgggcgg

SEQ ID NO: 7259930 - DNA, 22 bp, Homo sapiens
tggcccagctgcagatggtgga

SEQ ID NO: 7259931 - DNA, 22 bp, Homo sapiens
tggcccagactctgctcttatc

SEQ ID NO: 7259932 - DNA, 22 bp, Homo sapiens
tggcccagagcactgctgggca

SEQ ID NO: 7259933 - DNA, 21 bp, Homo sapiens
tggcaggggtagtagtacagc

SEQ ID NO: 7259934 - DNA, 22 bp, Homo sapiens
tggcagggtacaccttaacacc

SEQ ID NO: 7259935 - DNA, 18 bp, Homo sapiens
tggcaggggcagtacgcc

SEQ ID NO: 7259936 - DNA, 22 bp, Homo sapiens
tggcaggggaggtgcttgctta

SEQ ID NO: 7259937 - DNA, 22 bp, Homo sapiens
tggcagggcctgctcatcatcc

SEQ ID NO: 7259938 - DNA, 22 bp, Homo sapiens
tggcagggcctgaatcttatac

SEQ ID NO: 7259939 - DNA, 22 bp, Homo sapiens
tggcagggagttgcaggatttc

SEQ ID NO: 7259940 - DNA, 22 bp, Homo sapiens
tggcagggcctaccccaatatc

SEQ ID NO: 7259941 - DNA, 22 bp, Homo sapiens
tggcagggagttgcaggatttc

SEQ ID NO: 7259942 - DNA, 22 bp, Homo sapiens
tggcagggagttcgttcacaac

SEQ ID NO: 7259943 - DNA, 19 bp, Homo sapiens
tggcagggagtgatattag

SEQ ID NO: 7259944 - DNA, 18 bp, Homo sapiens
tggcagggaggaaatata

SEQ ID NO: 7259945 - DNA, 22 bp, Homo sapiens
tggcaggaggatgaggcggcta

SEQ ID NO: 7259946 - DNA, 22 bp, Homo sapiens
tggcaggagacacatggcatag

SEQ ID NO: 7259947 - DNA, 18 bp, Homo sapiens
tggcaggaaatgcacttt

SEQ ID NO: 7259948 - DNA, 22 bp, Homo sapiens
tggcaggaaaaagggccagagg

SEQ ID NO: 7259949 - DNA, 22 bp, Homo sapiens
tggcaggaaagtaacagagcac

SEQ ID NO: 7259950 - DNA, 22 bp, Homo sapiens
tggcagagtctgggcttgggca

SEQ ID NO: 7259951 - DNA, 22 bp, Homo sapiens
tggcagagttggaggtggaaga

SEQ ID NO: 7259952 - DNA, 22 bp, Homo sapiens
tggcagcagtagccaccccagc

SEQ ID NO: 7259953 - DNA, 22 bp, Homo sapiens
tggcacaagggctattccttag

SEQ ID NO: 7259954 - DNA, 22 bp, Homo sapiens
tggcacagactgggccaaggaa

SEQ ID NO: 7259955 - DNA, 22 bp, Homo sapiens
tggcacagactgggccaaggaa

SEQ ID NO: 7259956 - DNA, 20 bp, Homo sapiens
tggattccctcctgggactc

SEQ ID NO: 7259957 - DNA, 22 bp, Homo sapiens
tggcagagacaaggccgggcct

SEQ ID NO: 7259958 - DNA, 22 bp, Homo sapiens
tggcagagagagtgcagtcgac

SEQ ID NO: 7259959 - DNA, 22 bp, Homo sapiens
tggcacttaaaaattattcttc

SEQ ID NO: 7259960 - DNA, 22 bp, Homo sapiens
tggcacatggttaatcataatt

SEQ ID NO: 7259961 - DNA, 22 bp, Homo sapiens
tggcacatggtaagtgcttaac

SEQ ID NO: 7259962 - DNA, 22 bp, Homo sapiens
tggcacatatttttagtgctca

SEQ ID NO: 7259963 - DNA, 22 bp, Homo sapiens
tggcactcactctcagagtctg

SEQ ID NO: 7259964 - DNA, 22 bp, Homo sapiens
tggaaggaagccaaggaaggtt

SEQ ID NO: 7259965 - DNA, 22 bp, Homo sapiens
tggaaggaaaggtagcagagaa

SEQ ID NO: 7259966 - DNA, 22 bp, Homo sapiens
tggaagcttttgagattgttgc

SEQ ID NO: 7259967 - DNA, 17 bp, Homo sapiens
tggaagcttcatgttgg

SEQ ID NO: 7259968 - DNA, 22 bp, Homo sapiens
tggaagcttctgaccatttttg

SEQ ID NO: 7259969 - DNA, 22 bp, Homo sapiens
tggaagcttcctgttcttgagg

SEQ ID NO: 7259970 - DNA, 22 bp, Homo sapiens
tggaagagaaaggagtggatct

SEQ ID NO: 7259971 - DNA, 19 bp, Homo sapiens
tggaagaggaagggaaata

SEQ ID NO: 7259972 - DNA, 22 bp, Homo sapiens
tggaagagggagctgggtggcc

SEQ ID NO: 7259973 - DNA, 19 bp, Homo sapiens
tggaatcagcaagaatatt

SEQ ID NO: 7259974 - DNA, 22 bp, Homo sapiens
tggaatcagactcctgcatttt

SEQ ID NO: 7259975 - DNA, 22 bp, Homo sapiens
tggaatcacctgttggtttgca

SEQ ID NO: 7259976 - DNA, 22 bp, Homo sapiens
tggaatcaagaactttggttat

SEQ ID NO: 7259977 - DNA, 18 bp, Homo sapiens
tggaatcattgtcaccat

SEQ ID NO: 7259978 - DNA, 22 bp, Homo sapiens
tggaatcattggagagctgtaa

SEQ ID NO: 7259979 - DNA, 22 bp, Homo sapiens
tggaatcattgctgtgttgctt

SEQ ID NO: 7259980 - DNA, 22 bp, Homo sapiens
tggaatcagttacatgtggttg

SEQ ID NO: 7259981 - DNA, 23 bp, Homo sapiens
tggaatcagccttttttccaagg

SEQ ID NO: 7259982 - DNA, 22 bp, Homo sapiens
tggaagtgctcttctgaccaac

SEQ ID NO: 7259983 - DNA, 22 bp, Homo sapiens
tggaaggggccaggcgcggagt

SEQ ID NO: 7259984 - DNA, 22 bp, Homo sapiens
tggaaggggagctggaaagggg

SEQ ID NO: 7259985 - DNA, 22 bp, Homo sapiens
tggaaggggagttgttccacgt

SEQ ID NO: 7259986 - DNA, 22 bp, Homo sapiens
tggaaggggccaggcgcggagt

SEQ ID NO: 7259987 - DNA, 22 bp, Homo sapiens
tggaagggggaagacagctctg

SEQ ID NO: 7259988 - DNA, 16 bp, Homo sapiens
tggaaggggtctccgg

SEQ ID NO: 7259989 - DNA, 22 bp, Homo sapiens
tggaaggggttacgcagcagga

SEQ ID NO: 7259990 - DNA, 22 bp, Homo sapiens
tggaaggagctaaggacctggg

SEQ ID NO: 7259991 - DNA, 22 bp, Homo sapiens
tggaaggaagccaaggaaggtt

SEQ ID NO: 7259992 - DNA, 22 bp, Homo sapiens
tggaagggagtgacagtcagag

SEQ ID NO: 7259993 - DNA, 22 bp, Homo sapiens
tggaagggagtgacagtcagag

SEQ ID NO: 7259994 - DNA, 22 bp, Homo sapiens
tggaatggaaacaaactgagga

SEQ ID NO: 7259995 - DNA, 22 bp, Homo sapiens
tggacagccatgcaaatgagct

SEQ ID NO: 7259996 - DNA, 22 bp, Homo sapiens
tggacagcaaacatggagagaa

SEQ ID NO: 7259997 - DNA, 22 bp, Homo sapiens
tggacaggatctgagactgaga

SEQ ID NO: 7259998 - DNA, 22 bp, Homo sapiens
tggacaggcaagcaagacatac

SEQ ID NO: 7259999 - DNA, 21 bp, Homo sapiens
tggaccaggaaggtggtggtg

SEQ ID NO: 7260000 - DNA, 22 bp, Homo sapiens
tggacaggggctgctgttgtca

SEQ ID NO: 7260001 - DNA, 22 bp, Homo sapiens
tggacagggcagagaccgagtc

SEQ ID NO: 7260002 - DNA, 22 bp, Homo sapiens
tggactcccagagctgctctcc

SEQ ID NO: 7260003 - DNA, 22 bp, Homo sapiens
tggactccagtgtctgtgttct

SEQ ID NO: 7260004 - DNA, 22 bp, Homo sapiens
tggactcagagttggtggcagt

SEQ ID NO: 7260005 - DNA, 22 bp, Homo sapiens
tggaccggcagtggctatacag

SEQ ID NO: 7260006 - DNA, 22 bp, Homo sapiens
tggaccctttatgcggaacagg

SEQ ID NO: 7260007 - DNA, 22 bp, Homo sapiens
tgctttaaaatggactgttttg

SEQ ID NO: 7260008 - DNA, 22 bp, Homo sapiens
tgcttctggggacaggctgcct

SEQ ID NO: 7260009 - DNA, 22 bp, Homo sapiens
tgcttctgggtaggcctcagga

SEQ ID NO: 7260010 - DNA, 22 bp, Homo sapiens
tgcttctgttctttcacctacg

SEQ ID NO: 7260011 - DNA, 22 bp, Homo sapiens
tgcttctgtttcattgatctta

SEQ ID NO: 7260012 - DNA, 20 bp, Homo sapiens
tgctttgatggaaatacagc

SEQ ID NO: 7260013 - DNA, 22 bp, Homo sapiens
tgctttgacagggatgacatga

SEQ ID NO: 7260014 - DNA, 21 bp, Homo sapiens
tgctttatgggaaaaatgtca

SEQ ID NO: 7260015 - DNA, 22 bp, Homo sapiens
tgcttttaagaacaatgctgct

SEQ ID NO: 7260016 - DNA, 20 bp, Homo sapiens
tgcttttatacctataatga

SEQ ID NO: 7260017 - DNA, 22 bp, Homo sapiens
tgcttttaggagattaaaatta

SEQ ID NO: 7260018 - DNA, 22 bp, Homo sapiens
tggaaaatgtgactattctaaa

SEQ ID NO: 7260019 - DNA, 22 bp, Homo sapiens
tggaaacacccacgcatgcata

SEQ ID NO: 7260020 - DNA, 22 bp, Homo sapiens
tggaaacaaagtcataagctca

SEQ ID NO: 7260021 - DNA, 22 bp, Homo sapiens
tggaagaaaattcaatcgagtt

SEQ ID NO: 7260022 - DNA, 23 bp, Homo sapiens
tggaaatctgggtgaggacagaa

SEQ ID NO: 7260023 - DNA, 22 bp, Homo sapiens
tggaaatagctccagtttcatt

SEQ ID NO: 7260024 - DNA, 22 bp, Homo sapiens
tggaaatagatagtatcattca

SEQ ID NO: 7260025 - DNA, 22 bp, Homo sapiens
tggaaatagttgtgagtcaggc

SEQ ID NO: 7260026 - DNA, 22 bp, Homo sapiens
tggaaatagtaatgcataagtg

SEQ ID NO: 7260027 - DNA, 22 bp, Homo sapiens
tggaaatatgctccattctttt

SEQ ID NO: 7260028 - DNA, 22 bp, Homo sapiens
tggaaatacttgccataaaact

SEQ ID NO: 7260029 - DNA, 22 bp, Homo sapiens
tggaaagtttctgatttcctaa

SEQ ID NO: 7260030 - DNA, 22 bp, Homo sapiens
tggaaagtgagacatatttata

SEQ ID NO: 7260031 - DNA, 22 bp, Homo sapiens
tggaaaggtgtaaagcagaacc

SEQ ID NO: 7260032 - DNA, 22 bp, Homo sapiens
tggaaaggtgtaaagcagaacc

SEQ ID NO: 7260033 - DNA, 22 bp, Homo sapiens
tggaaaggtaggatttcaagac

SEQ ID NO: 7260034 - DNA, 22 bp, Homo sapiens
tggaaagtgagacatatttata

SEQ ID NO: 7260035 - DNA, 22 bp, Homo sapiens
tggaaagggacttatgagttcc

SEQ ID NO: 7260036 - DNA, 22 bp, Homo sapiens
tggaaaggaggcttgtggaata

SEQ ID NO: 7260037 - DNA, 22 bp, Homo sapiens
tggaaaggacagttgctgatag

SEQ ID NO: 7260038 - DNA, 23 bp, Homo sapiens
tggagttgatgtccttctgtgct

SEQ ID NO: 7260039 - DNA, 22 bp, Homo sapiens
tggagttcttgttctatgcaag

SEQ ID NO: 7260040 - DNA, 22 bp, Homo sapiens
tggagttctttttcaagataga

SEQ ID NO: 7260041 - DNA, 22 bp, Homo sapiens
tggagtggacttcatgaggcca

SEQ ID NO: 7260042 - DNA, 22 bp, Homo sapiens
tggagtgggcaatgtaggcaag

SEQ ID NO: 7260043 - DNA, 22 bp, Homo sapiens
tggatggatctcaagggaatta

SEQ ID NO: 7260044 - DNA, 22 bp, Homo sapiens
tggatggattgacgaaggcagc

SEQ ID NO: 7260045 - DNA, 22 bp, Homo sapiens
tggatggattgacgaaggcagc

SEQ ID NO: 7260046 - DNA, 22 bp, Homo sapiens
tggatacaaaaacaatctctac

SEQ ID NO: 7260047 - DNA, 22 bp, Homo sapiens
tggatacagctgatagcaggat

SEQ ID NO: 7260048 - DNA, 22 bp, Homo sapiens
tggaggtgtccaactcgtgggt

SEQ ID NO: 7260049 - DNA, 22 bp, Homo sapiens
tggagtcctagtattggaaaca

SEQ ID NO: 7260050 - DNA, 20 bp, Homo sapiens
tggagtgctgtgttgagaag

SEQ ID NO: 7260051 - DNA, 22 bp, Homo sapiens
tggagtgaagtaaagaggacaa

SEQ ID NO: 7260052 - DNA, 18 bp, Homo sapiens
tggagggcttgctgcagc

SEQ ID NO: 7260053 - DNA, 22 bp, Homo sapiens
tggagggcgcttagatggaggg

SEQ ID NO: 7260054 - DNA, 22 bp, Homo sapiens
tggagggctaagctgagggata

SEQ ID NO: 7260055 - DNA, 22 bp, Homo sapiens
tggagggctaagctgagggata

SEQ ID NO: 7260056 - DNA, 22 bp, Homo sapiens
tggaggtggcacaagggaggtc

SEQ ID NO: 7260057 - DNA, 22 bp, Homo sapiens
tggaggtggcatctgacagctg

SEQ ID NO: 7260058 - DNA, 22 bp, Homo sapiens
tggaggtgggagggactgtcct

SEQ ID NO: 7260059 - DNA, 22 bp, Homo sapiens
tggaggtgtataaggtagcttc

SEQ ID NO: 7260060 - DNA, 22 bp, Homo sapiens
tggaggctgtgtgcatgagacc

SEQ ID NO: 7260061 - DNA, 22 bp, Homo sapiens
tggaggctggtttctgctgagg

SEQ ID NO: 7260062 - DNA, 22 bp, Homo sapiens
tggagggaacaaaggagtccca

SEQ ID NO: 7260063 - DNA, 22 bp, Homo sapiens
tggagggaacaaaggagtccca

SEQ ID NO: 7260064 - DNA, 22 bp, Homo sapiens
tggagggaacccaggctgctct

SEQ ID NO: 7260065 - DNA, 22 bp, Homo sapiens
tggagggcatctgtggtcaggc

SEQ ID NO: 7260066 - DNA, 22 bp, Homo sapiens
tggagggcatgctgtccatggg

SEQ ID NO: 7260067 - DNA, 22 bp, Homo sapiens
tggagggcgcttagatggaggg

SEQ ID NO: 7260068 - DNA, 22 bp, Homo sapiens
tggagggcatagctgttctttc

SEQ ID NO: 7260069 - DNA, 20 bp, Homo sapiens
tggagggattgttggcaaat

SEQ ID NO: 7260070 - DNA, 22 bp, Homo sapiens
tggagggatacaaagatgaaaa

SEQ ID NO: 7260071 - DNA, 22 bp, Homo sapiens
tggaggaaaaaaccaggcagag

SEQ ID NO: 7260072 - DNA, 22 bp, Homo sapiens
tggaggaaaaaaccaggcagag

SEQ ID NO: 7260073 - DNA, 22 bp, Homo sapiens
tggaggagaactccctggctac

SEQ ID NO: 7260074 - DNA, 22 bp, Homo sapiens
tggaggaaaattactggggtct

SEQ ID NO: 7260075 - DNA, 22 bp, Homo sapiens
tggaggaggaacttcttatctc

SEQ ID NO: 7260076 - DNA, 22 bp, Homo sapiens
tggaggagggctggtgtctgta

SEQ ID NO: 7260077 - DNA, 22 bp, Homo sapiens
tggaggagggctggtgtctgta

SEQ ID NO: 7260078 - DNA, 22 bp, Homo sapiens
tggaggagtagattttcagagg

SEQ ID NO: 7260079 - DNA, 22 bp, Homo sapiens
tggaggagggctggtgtctgta

SEQ ID NO: 7260080 - DNA, 22 bp, Homo sapiens
tggaggagtgtgattgtctgcc

SEQ ID NO: 7260081 - DNA, 22 bp, Homo sapiens
tggaggcccccaggcaacagca

SEQ ID NO: 7260082 - DNA, 22 bp, Homo sapiens
tggaggccgcgtagtctgagca

SEQ ID NO: 7260083 - DNA, 22 bp, Homo sapiens
tggaggccggactgagaggcat

SEQ ID NO: 7260084 - DNA, 19 bp, Homo sapiens
tggaggccaggacacaggt

SEQ ID NO: 7260085 - DNA, 22 bp, Homo sapiens
tggaggccatgccagagcccta

SEQ ID NO: 7260086 - DNA, 22 bp, Homo sapiens
tggaggcccacactgggtagat

SEQ ID NO: 7260087 - DNA, 22 bp, Homo sapiens
tggaggcaggttagccagacga

SEQ ID NO: 7260088 - DNA, 22 bp, Homo sapiens
tggaggcaggtggaggagtgaa

SEQ ID NO: 7260089 - DNA, 22 bp, Homo sapiens
tggaggcaggtggaggagtgaa

SEQ ID NO: 7260090 - DNA, 23 bp, Homo sapiens
tggaggcaggatgctaaggagtc

SEQ ID NO: 7260091 - DNA, 20 bp, Homo sapiens
tggaggcagagccagaggga

SEQ ID NO: 7260092 - DNA, 22 bp, Homo sapiens
tggaggcagccgtgaaccacct

SEQ ID NO: 7260093 - DNA, 22 bp, Homo sapiens
tggaggcaactgaagatgtagt

SEQ ID NO: 7260094 - DNA, 22 bp, Homo sapiens
tggagagtggatatgggagcaa

SEQ ID NO: 7260095 - DNA, 22 bp, Homo sapiens
tggagagtctcaaggcaggaaa

SEQ ID NO: 7260096 - DNA, 22 bp, Homo sapiens
tggagagtaatttctgaagacc

SEQ ID NO: 7260097 - DNA, 22 bp, Homo sapiens
tggagagtaaatggcagaatca

SEQ ID NO: 7260098 - DNA, 19 bp, Homo sapiens
tggagaggaaatgctgctc

SEQ ID NO: 7260099 - DNA, 22 bp, Homo sapiens
tggagaggagcaccatggccat

SEQ ID NO: 7260100 - DNA, 22 bp, Homo sapiens
tggagcagcacaagaaagggga

SEQ ID NO: 7260101 - DNA, 22 bp, Homo sapiens
tggagcagcacaagaaagggga

SEQ ID NO: 7260102 - DNA, 22 bp, Homo sapiens
tggagcagcattcatccagcag

SEQ ID NO: 7260103 - DNA, 22 bp, Homo sapiens
tggagcagccatgatgacagag

SEQ ID NO: 7260104 - DNA, 22 bp, Homo sapiens
tggagaagattggtcaccattc

SEQ ID NO: 7260105 - DNA, 22 bp, Homo sapiens
tggagaagctgtaggtggactc

SEQ ID NO: 7260106 - DNA, 22 bp, Homo sapiens
tggagaagctgtaggtggactc

SEQ ID NO: 7260107 - DNA, 22 bp, Homo sapiens
tggagaagctgtaggtggactc

SEQ ID NO: 7260108 - DNA, 22 bp, Homo sapiens
tggagaaggacagcctgagaaa

SEQ ID NO: 7260109 - DNA, 22 bp, Homo sapiens
tggagaaggccggccaggagtg

SEQ ID NO: 7260110 - DNA, 22 bp, Homo sapiens
tggagaaggggcagggtctcca

SEQ ID NO: 7260111 - DNA, 22 bp, Homo sapiens
tggagaagtcaaagtgaacagg

SEQ ID NO: 7260112 - DNA, 22 bp, Homo sapiens
tggagagaaaaaagacagttct

SEQ ID NO: 7260113 - DNA, 22 bp, Homo sapiens
tggagagaagaggcagtgtgct

SEQ ID NO: 7260114 - DNA, 22 bp, Homo sapiens
tggagagcctggagtccctgat

SEQ ID NO: 7260115 - DNA, 22 bp, Homo sapiens
tggagagcaagtcgcagacatg

SEQ ID NO: 7260116 - DNA, 22 bp, Homo sapiens
tggagccaggctggccctgcca

SEQ ID NO: 7260117 - DNA, 18 bp, Homo sapiens
tggagccattgccaccat

SEQ ID NO: 7260118 - DNA, 22 bp, Homo sapiens
tggagcccctcacccacacctg

SEQ ID NO: 7260119 - DNA, 22 bp, Homo sapiens
tggagcccatgagccataccag

SEQ ID NO: 7260120 - DNA, 22 bp, Homo sapiens
tggagcccagacactggcattg

SEQ ID NO: 7260121 - DNA, 22 bp, Homo sapiens
tggagcgagctcaaaggcagga

SEQ ID NO: 7260122 - DNA, 22 bp, Homo sapiens
tggagccaggagcctgggagtc

SEQ ID NO: 7260123 - DNA, 22 bp, Homo sapiens
tggagccagcccaggcccctct

SEQ ID NO: 7260124 - DNA, 22 bp, Homo sapiens
tggagccagcggcctgctgagg

SEQ ID NO: 7260125 - DNA, 20 bp, Homo sapiens
tggagccacagtcaggttcc

SEQ ID NO: 7260126 - DNA, 22 bp, Homo sapiens
tggagccaatgaacatttgctg

SEQ ID NO: 7260127 - DNA, 22 bp, Homo sapiens
tggagccagcaggactcagagg

SEQ ID NO: 7260128 - DNA, 22 bp, Homo sapiens
tggagcaggtgctcagggtaat

SEQ ID NO: 7260129 - DNA, 22 bp, Homo sapiens
tggagccaaaaagggaaggaga

SEQ ID NO: 7260130 - DNA, 23 bp, Homo sapiens
tggagccaaacatcacatgcctg

SEQ ID NO: 7260131 - DNA, 22 bp, Homo sapiens
tggagcagctctagcgggcgcc

SEQ ID NO: 7260132 - DNA, 22 bp, Homo sapiens
tggagcagctctagcgggcgcc

SEQ ID NO: 7260133 - DNA, 22 bp, Homo sapiens
tggagcagctaagcctctgaga

SEQ ID NO: 7260134 - DNA, 22 bp, Homo sapiens
tggagcaggacggggagtggta

SEQ ID NO: 7260135 - DNA, 22 bp, Homo sapiens
tgcgcaggagctctgccaggag

SEQ ID NO: 7260136 - DNA, 22 bp, Homo sapiens
tgcgcgggtgcctatctgtata

SEQ ID NO: 7260137 - DNA, 22 bp, Homo sapiens
tgcgcggctcagtcatctccag

SEQ ID NO: 7260138 - DNA, 22 bp, Homo sapiens
tgcggggccctcccgtgcactg

SEQ ID NO: 7260139 - DNA, 22 bp, Homo sapiens
tgcgggagtgcgccgagctctc

SEQ ID NO: 7260140 - DNA, 22 bp, Homo sapiens
tgcgggagggcaacgcggcatt

SEQ ID NO: 7260141 - DNA, 22 bp, Homo sapiens
tgcggcggcgggcagaggacta

SEQ ID NO: 7260142 - DNA, 22 bp, Homo sapiens
tgcggcagccaccgcgtggccc

SEQ ID NO: 7260143 - DNA, 22 bp, Homo sapiens
tgcgggggaagctgtgggagaa

SEQ ID NO: 7260144 - DNA, 22 bp, Homo sapiens
tgctcacaattatcagaagtat

SEQ ID NO: 7260145 - DNA, 22 bp, Homo sapiens
tgctcacagcccagaacataat

SEQ ID NO: 7260146 - DNA, 22 bp, Homo sapiens
tgctcagctaggctgaagaaga

SEQ ID NO: 7260147 - DNA, 22 bp, Homo sapiens
tgctcagcagtcaaggtcatag

SEQ ID NO: 7260148 - DNA, 22 bp, Homo sapiens
tgctcagcagatctcaggagat

SEQ ID NO: 7260149 - DNA, 22 bp, Homo sapiens
tgctcagcacagaccaggccag

SEQ ID NO: 7260150 - DNA, 22 bp, Homo sapiens
tgctcagactagctccagggaa

SEQ ID NO: 7260151 - DNA, 18 bp, Homo sapiens
tgctcagctggtgctgaa

SEQ ID NO: 7260152 - DNA, 22 bp, Homo sapiens
tgctcagctggtgccagggtcc

SEQ ID NO: 7260153 - DNA, 22 bp, Homo sapiens
tgctcagcttcagaggatcccc

SEQ ID NO: 7260154 - DNA, 22 bp, Homo sapiens
tgctccagcaacaggcttagct

SEQ ID NO: 7260155 - DNA, 22 bp, Homo sapiens
tgctccagaacctgaccatgct

SEQ ID NO: 7260156 - DNA, 22 bp, Homo sapiens
tgccttcttctccctggctcag

SEQ ID NO: 7260157 - DNA, 22 bp, Homo sapiens
tgcctgggtgctggctggtcac

SEQ ID NO: 7260158 - DNA, 22 bp, Homo sapiens
tgcctgggtccaggccaagcct

SEQ ID NO: 7260159 - DNA, 22 bp, Homo sapiens
tgcctgggtgccctctgctcct

SEQ ID NO: 7260160 - DNA, 22 bp, Homo sapiens
tgcctgggtgtaaagggccaac

SEQ ID NO: 7260161 - DNA, 22 bp, Homo sapiens
tgcctggggattgctctgggcc

SEQ ID NO: 7260162 - DNA, 22 bp, Homo sapiens
tgcctgggctcaccgcctcttt

SEQ ID NO: 7260163 - DNA, 22 bp, Homo sapiens
tgctgagcgcatccggcggccg

SEQ ID NO: 7260164 - DNA, 22 bp, Homo sapiens
tgctgaagggaaggtcttgaat

SEQ ID NO: 7260165 - DNA, 20 bp, Homo sapiens
tgctgaagaatcacagatgg

SEQ ID NO: 7260166 - DNA, 22 bp, Homo sapiens
tgctgaaggcaggggaggtggc

SEQ ID NO: 7260167 - DNA, 22 bp, Homo sapiens
tgctgaaggcaggggaggtggc

SEQ ID NO: 7260168 - DNA, 22 bp, Homo sapiens
tgctgaggaggtggctgtgctt

SEQ ID NO: 7260169 - DNA, 21 bp, Homo sapiens
tgctctggtagaaactctttc

SEQ ID NO: 7260170 - DNA, 18 bp, Homo sapiens
tgctctggtctcacttgg

SEQ ID NO: 7260171 - DNA, 20 bp, Homo sapiens
tgctgaggcctgaggcctgg

SEQ ID NO: 7260172 - DNA, 22 bp, Homo sapiens
tgctgaggcagatgtctgtgac

SEQ ID NO: 7260173 - DNA, 22 bp, Homo sapiens
tgctgaggtcaccttgctgcta

SEQ ID NO: 7260174 - DNA, 22 bp, Homo sapiens
tgctgaggttgtggagtgcatt

SEQ ID NO: 7260175 - DNA, 22 bp, Homo sapiens
tgctgcaggccttggctgggaa

SEQ ID NO: 7260176 - DNA, 22 bp, Homo sapiens
tgctctccggcttccgtggcct

SEQ ID NO: 7260177 - DNA, 22 bp, Homo sapiens
tgctcctggcatctctgcgtcc

SEQ ID NO: 7260178 - DNA, 22 bp, Homo sapiens
tgctcgaggtccccaccggctc

SEQ ID NO: 7260179 - DNA, 22 bp, Homo sapiens
tgctcgccccacatgccctcat

SEQ ID NO: 7260180 - DNA, 22 bp, Homo sapiens
tgctcctgacagttttaggctc

SEQ ID NO: 7260181 - DNA, 22 bp, Homo sapiens
tgctccagggcctccagtgggg

SEQ ID NO: 7260182 - DNA, 22 bp, Homo sapiens
tgctccgggaaagagcagccgc

SEQ ID NO: 7260183 - DNA, 19 bp, Homo sapiens
tgctccaggccttgccgca

SEQ ID NO: 7260184 - DNA, 22 bp, Homo sapiens
tgctccaggccgcctggggctg

SEQ ID NO: 7260185 - DNA, 18 bp, Homo sapiens
tgctccaggcccatgggc

SEQ ID NO: 7260186 - DNA, 21 bp, Homo sapiens
tgctccaggagggggcagtcc

SEQ ID NO: 7260187 - DNA, 22 bp, Homo sapiens
tgctccagcctatgctctccgg

SEQ ID NO: 7260188 - DNA, 22 bp, Homo sapiens
tgctccagcccctggtgcacag

SEQ ID NO: 7260189 - DNA, 22 bp, Homo sapiens
tgctccagcatgaccctcaatg

SEQ ID NO: 7260190 - DNA, 22 bp, Homo sapiens
tgctccagcaccaagagctcca

SEQ ID NO: 7260191 - DNA, 22 bp, Homo sapiens
tgctccagcgctgccaccagtt

SEQ ID NO: 7260192 - DNA, 20 bp, Homo sapiens
tgctccaggaacactggccg

SEQ ID NO: 7260193 - DNA, 22 bp, Homo sapiens
tgcttaaaatgatgattatttt

SEQ ID NO: 7260194 - DNA, 22 bp, Homo sapiens
tgcttaaaaagtaactgctgat

SEQ ID NO: 7260195 - DNA, 22 bp, Homo sapiens
tgcttaaaatagttcatttttg

SEQ ID NO: 7260196 - DNA, 22 bp, Homo sapiens
tgcttaaaaagctccatcaata

SEQ ID NO: 7260197 - DNA, 22 bp, Homo sapiens
tgctgtctttcattgtctgcct

SEQ ID NO: 7260198 - DNA, 22 bp, Homo sapiens
tgcttaaagtgttaaccctgtt

SEQ ID NO: 7260199 - DNA, 22 bp, Homo sapiens
tgcttaaatttcagcagcttaa

SEQ ID NO: 7260200 - DNA, 22 bp, Homo sapiens
tgcttaaatagctggaggctac

SEQ ID NO: 7260201 - DNA, 22 bp, Homo sapiens
tgcttaaaattttccaaggatt

SEQ ID NO: 7260202 - DNA, 22 bp, Homo sapiens
tgcttaaacacatacatacata

SEQ ID NO: 7260203 - DNA, 22 bp, Homo sapiens
tgcttaaacatactatttatat

SEQ ID NO: 7260204 - DNA, 22 bp, Homo sapiens
tgcttaaacatccagacagtat

SEQ ID NO: 7260205 - DNA, 22 bp, Homo sapiens
tgcttaaaccctgatcatgtgt

SEQ ID NO: 7260206 - DNA, 22 bp, Homo sapiens
tgcttaaaggatagtttaaact

SEQ ID NO: 7260207 - DNA, 22 bp, Homo sapiens
tgcttaaagctgctcagttgta

SEQ ID NO: 7260208 - DNA, 22 bp, Homo sapiens
tgcttaaagtagtggattgtta

SEQ ID NO: 7260209 - DNA, 22 bp, Homo sapiens
tgcttctgagttgcaggacttg

SEQ ID NO: 7260210 - DNA, 22 bp, Homo sapiens
tgcttctgaaatgcaggtcttc

SEQ ID NO: 7260211 - DNA, 22 bp, Homo sapiens
tgctgggcttgaaagctgctaa

SEQ ID NO: 7260212 - DNA, 22 bp, Homo sapiens
tgctgggcttcacccccacagt

SEQ ID NO: 7260213 - DNA, 22 bp, Homo sapiens
tgctgggcttcaactgcctgag

SEQ ID NO: 7260214 - DNA, 22 bp, Homo sapiens
tgctgggctgttcctgtccatg

SEQ ID NO: 7260215 - DNA, 22 bp, Homo sapiens
tgctgggctggggcctcagacc

SEQ ID NO: 7260216 - DNA, 21 bp, Homo sapiens
tgctgggctgcaggggatgca

SEQ ID NO: 7260217 - DNA, 22 bp, Homo sapiens
tgctgggctggagctgccaggg

SEQ ID NO: 7260218 - DNA, 22 bp, Homo sapiens
tgctgggctgcacccccagagt

SEQ ID NO: 7260219 - DNA, 22 bp, Homo sapiens
tgctgggctcaacctccagagc

SEQ ID NO: 7260220 - DNA, 22 bp, Homo sapiens
tgctgggctagggtggagctct

SEQ ID NO: 7260221 - DNA, 22 bp, Homo sapiens
tgctgggcggtgggctcatccc

SEQ ID NO: 7260222 - DNA, 22 bp, Homo sapiens
tgctgggcctttacctccaggg

SEQ ID NO: 7260223 - DNA, 22 bp, Homo sapiens
tgctgggctagaagctgaggcc

SEQ ID NO: 7260224 - DNA, 22 bp, Homo sapiens
tgctgggcctgcccctgtcagc

SEQ ID NO: 7260225 - DNA, 22 bp, Homo sapiens
tgctgggcctcttccctggata

SEQ ID NO: 7260226 - DNA, 22 bp, Homo sapiens
tgctgggcccccagtgaccttc

SEQ ID NO: 7260227 - DNA, 22 bp, Homo sapiens
tgctgggcccagggagcctctg

SEQ ID NO: 7260228 - DNA, 20 bp, Homo sapiens
tgctgggccatcttgcatgc

SEQ ID NO: 7260229 - DNA, 22 bp, Homo sapiens
tgctgggccaaagcagggtttt

SEQ ID NO: 7260230 - DNA, 22 bp, Homo sapiens
tgctgggcatttttatggctcc

SEQ ID NO: 7260231 - DNA, 22 bp, Homo sapiens
tgctgggcatttatgcagatgg

SEQ ID NO: 7260232 - DNA, 18 bp, Homo sapiens
tgctgggcattaggctta

SEQ ID NO: 7260233 - DNA, 20 bp, Homo sapiens
tgctgggcatgcagtggaaa

SEQ ID NO: 7260234 - DNA, 22 bp, Homo sapiens
tgctgggcactgtctctgggga

SEQ ID NO: 7260235 - DNA, 23 bp, Homo sapiens
tgctgggcagagctggtgctgag

SEQ ID NO: 7260236 - DNA, 20 bp, Homo sapiens
tgctgggcatgcagtggaaa

SEQ ID NO: 7260237 - DNA, 22 bp, Homo sapiens
tgctgggcagtgtgccctcgag

SEQ ID NO: 7260238 - DNA, 22 bp, Homo sapiens
tgctgggcatcgtaggaggtac

SEQ ID NO: 7260239 - DNA, 23 bp, Homo sapiens
tgctggggtagtttgtggcacag

SEQ ID NO: 7260240 - DNA, 22 bp, Homo sapiens
tgctggggtcatggggcgcccg

SEQ ID NO: 7260241 - DNA, 22 bp, Homo sapiens
tgctggggtctctccggtgccc

SEQ ID NO: 7260242 - DNA, 20 bp, Homo sapiens
tgctggggacatacagggtg

SEQ ID NO: 7260243 - DNA, 22 bp, Homo sapiens
tgctggggagtgattgaccatc

SEQ ID NO: 7260244 - DNA, 22 bp, Homo sapiens
tgctggggcagaagagccaaga

SEQ ID NO: 7260245 - DNA, 16 bp, Homo sapiens
tgctggggcgccgtcc

SEQ ID NO: 7260246 - DNA, 22 bp, Homo sapiens
tgctggggatccgtaccaaccc

SEQ ID NO: 7260247 - DNA, 22 bp, Homo sapiens
tgctggttctttccttcccttc

SEQ ID NO: 7260248 - DNA, 22 bp, Homo sapiens
tgctgtcaatttagtttacctg

SEQ ID NO: 7260249 - DNA, 22 bp, Homo sapiens
tgctggtgaggtccttgctgga

SEQ ID NO: 7260250 - DNA, 22 bp, Homo sapiens
tgctggcatttcaggactcacc

SEQ ID NO: 7260251 - DNA, 22 bp, Homo sapiens
tgctggcattgcataggcagtt

SEQ ID NO: 7260252 - DNA, 21 bp, Homo sapiens
tgctggcattaccacaaaccc

SEQ ID NO: 7260253 - DNA, 22 bp, Homo sapiens
tgctggagtggcactgtgtggc

SEQ ID NO: 7260254 - DNA, 23 bp, Homo sapiens
tgctggagtttactcaggccagc

SEQ ID NO: 7260255 - DNA, 17 bp, Homo sapiens
tgctggcaacatacaaa

SEQ ID NO: 7260256 - DNA, 18 bp, Homo sapiens
tgctggcaactactattg

SEQ ID NO: 7260257 - DNA, 21 bp, Homo sapiens
tgctggcaagactcaggaata

SEQ ID NO: 7260258 - DNA, 22 bp, Homo sapiens
tgctggcaaggtaggtttcatt

SEQ ID NO: 7260259 - DNA, 22 bp, Homo sapiens
tgctggcaagtcttggaattgt

SEQ ID NO: 7260260 - DNA, 22 bp, Homo sapiens
tgctggcaatgctcttgacgtc

SEQ ID NO: 7260261 - DNA, 22 bp, Homo sapiens
tgctggcacatagagactggct

SEQ ID NO: 7260262 - DNA, 22 bp, Homo sapiens
tgctggcaccagaatgactgca

SEQ ID NO: 7260263 - DNA, 22 bp, Homo sapiens
tgctggcaccattttcggacat

SEQ ID NO: 7260264 - DNA, 22 bp, Homo sapiens
tgctggcacgaaagggtgtcca

SEQ ID NO: 7260265 - DNA, 20 bp, Homo sapiens
tgctggcacgggtggactcc

SEQ ID NO: 7260266 - DNA, 22 bp, Homo sapiens
tgctggcacgtgactgggaagt

SEQ ID NO: 7260267 - DNA, 22 bp, Homo sapiens
tgctggcacgtggaccaggaga

SEQ ID NO: 7260268 - DNA, 22 bp, Homo sapiens
tgctggcagaaggctcgtggaa

SEQ ID NO: 7260269 - DNA, 22 bp, Homo sapiens
tgctggcagccatgccttggaa

SEQ ID NO: 7260270 - DNA, 22 bp, Homo sapiens
tgctggcagccccagctttaac

SEQ ID NO: 7260271 - DNA, 22 bp, Homo sapiens
tgctggcagcttctttaaatgt

SEQ ID NO: 7260272 - DNA, 22 bp, Homo sapiens
tgctggcaggcacctcctgggg

SEQ ID NO: 7260273 - DNA, 22 bp, Homo sapiens
tgctggcagtggcagtgatggt

SEQ ID NO: 7260274 - DNA, 22 bp, Homo sapiens
tgctggcataccacctagttca

SEQ ID NO: 7260275 - DNA, 22 bp, Homo sapiens
tgctggcatactctctttgttg

SEQ ID NO: 7260276 - DNA, 22 bp, Homo sapiens
tgctggcatatgaaaatcctta

SEQ ID NO: 7260277 - DNA, 22 bp, Homo sapiens
tgctggcatcttaatgttctgt

SEQ ID NO: 7260278 - DNA, 20 bp, Homo sapiens
tgctggcatgcaagagggaa

SEQ ID NO: 7260279 - DNA, 22 bp, Homo sapiens
tgctggcatgcatgctgtagga

SEQ ID NO: 7260280 - DNA, 22 bp, Homo sapiens
tgctggcatggtcttggtgaca

SEQ ID NO: 7260281 - DNA, 19 bp, Homo sapiens
tgctggagggtagtgagtc

SEQ ID NO: 7260282 - DNA, 22 bp, Homo sapiens
tgctggaggattaaacaagtca

SEQ ID NO: 7260283 - DNA, 22 bp, Homo sapiens
tgctggaggcagtggaggtgcc

SEQ ID NO: 7260284 - DNA, 22 bp, Homo sapiens
tgctggaggccgagaagcagca

SEQ ID NO: 7260285 - DNA, 20 bp, Homo sapiens
tgctggaaaaagtcactcat

SEQ ID NO: 7260286 - DNA, 23 bp, Homo sapiens
tgctggagaagcaaagttctgag

SEQ ID NO: 7260287 - DNA, 23 bp, Homo sapiens
tgctggaatttgtaccctggcag

SEQ ID NO: 7260288 - DNA, 22 bp, Homo sapiens
tgctggaagctcctgcatgtct

SEQ ID NO: 7260289 - DNA, 21 bp, Homo sapiens
tgctgccatcatgcagagatg

SEQ ID NO: 7260290 - DNA, 21 bp, Homo sapiens
tgctgccatagacctgaggga

SEQ ID NO: 7260291 - DNA, 22 bp, Homo sapiens
tgctgccagggctctgcccaca

SEQ ID NO: 7260292 - DNA, 22 bp, Homo sapiens
tgctgccacctggtggctgaag

SEQ ID NO: 7260293 - DNA, 22 bp, Homo sapiens
tgctgccagccaggccatggag

SEQ ID NO: 7260294 - DNA, 22 bp, Homo sapiens
tgctgccagagagacagggact

SEQ ID NO: 7260295 - DNA, 22 bp, Homo sapiens
tgctgccacccctcaccagagc

SEQ ID NO: 7260296 - DNA, 22 bp, Homo sapiens
tgctgccacatttaaagagggg

SEQ ID NO: 7260297 - DNA, 22 bp, Homo sapiens
tgctgccacaaattcagctgcc

SEQ ID NO: 7260298 - DNA, 17 bp, Homo sapiens
tgctgccaagtcccaac

SEQ ID NO: 7260299 - DNA, 23 bp, Homo sapiens
tgctgccaagcacgagttgagtt

SEQ ID NO: 7260300 - DNA, 22 bp, Homo sapiens
tgaggaaatatggtgaactctt

SEQ ID NO: 7260301 - DNA, 22 bp, Homo sapiens
tgaggaaattgaggctcacaga

SEQ ID NO: 7260302 - DNA, 22 bp, Homo sapiens
tgaggaggcccaggttggggct

SEQ ID NO: 7260303 - DNA, 22 bp, Homo sapiens
tgaggaggtgggcacacagagt

SEQ ID NO: 7260304 - DNA, 22 bp, Homo sapiens
tgaggaggtcagagtctggctg

SEQ ID NO: 7260305 - DNA, 21 bp, Homo sapiens
tgaggataagtaaagctgaag

SEQ ID NO: 7260306 - DNA, 22 bp, Homo sapiens
tgaggatatagtggtaaacagt

SEQ ID NO: 7260307 - DNA, 22 bp, Homo sapiens
tgaggataacccaggcaaactg

SEQ ID NO: 7260308 - DNA, 22 bp, Homo sapiens
tgaggagtttagatatagggaa

SEQ ID NO: 7260309 - DNA, 22 bp, Homo sapiens
tgaggagtcgagaaggggtaat

SEQ ID NO: 7260310 - DNA, 22 bp, Homo sapiens
tgaggaggtgggcacacagagt

SEQ ID NO: 7260311 - DNA, 22 bp, Homo sapiens
tgaggcaggactgagcgggatg

SEQ ID NO: 7260312 - DNA, 22 bp, Homo sapiens
tgaggcaggagaatcaccggaa

SEQ ID NO: 7260313 - DNA, 20 bp, Homo sapiens
tgaggcaggagaatggcatg

SEQ ID NO: 7260314 - DNA, 22 bp, Homo sapiens
tgaggccaagcctcctctgcca

SEQ ID NO: 7260315 - DNA, 22 bp, Homo sapiens
tgaggccaactagggagatgga

SEQ ID NO: 7260316 - DNA, 22 bp, Homo sapiens
tgaggcagttgagcttcctgag

SEQ ID NO: 7260317 - DNA, 22 bp, Homo sapiens
tgaggcaggagttcaggctgcg

SEQ ID NO: 7260318 - DNA, 22 bp, Homo sapiens
tgaggcaggagaatggcgggaa

SEQ ID NO: 7260319 - DNA, 22 bp, Homo sapiens
tgaggccacttccccacagccc

SEQ ID NO: 7260320 - DNA, 21 bp, Homo sapiens
tgaggccaatagcccctggac

SEQ ID NO: 7260321 - DNA, 21 bp, Homo sapiens
tgaggccaatagcccctggac

SEQ ID NO: 7260322 - DNA, 19 bp, Homo sapiens
tgaggccaaggtcacagat

SEQ ID NO: 7260323 - DNA, 18 bp, Homo sapiens
tgaggccagagtgggcat

SEQ ID NO: 7260324 - DNA, 22 bp, Homo sapiens
tgaggccagcttcagcagtgga

SEQ ID NO: 7260325 - DNA, 22 bp, Homo sapiens
tgaggccaggatcccaggctct

SEQ ID NO: 7260326 - DNA, 22 bp, Homo sapiens
tgaggccaggacccccagcagg

SEQ ID NO: 7260327 - DNA, 22 bp, Homo sapiens
tgaggccaggacccccagcagg

SEQ ID NO: 7260328 - DNA, 21 bp, Homo sapiens
tgaggcctctcctgggctggc

SEQ ID NO: 7260329 - DNA, 22 bp, Homo sapiens
tgaggcctcatttagggagagg

SEQ ID NO: 7260330 - DNA, 22 bp, Homo sapiens
tgaggccctctgggctggtcct

SEQ ID NO: 7260331 - DNA, 22 bp, Homo sapiens
tgaggcctgaagcctgaagtga

SEQ ID NO: 7260332 - DNA, 22 bp, Homo sapiens
tgaggcctctgtgccatccagg

SEQ ID NO: 7260333 - DNA, 22 bp, Homo sapiens
tgaggcctcttggtatggtgtg

SEQ ID NO: 7260334 - DNA, 22 bp, Homo sapiens
tgaggcctgaagcctggagcct

SEQ ID NO: 7260335 - DNA, 22 bp, Homo sapiens
tgaggcctgcattgaactagaa

SEQ ID NO: 7260336 - DNA, 22 bp, Homo sapiens
tgaggctctgcttctgtggctc

SEQ ID NO: 7260337 - DNA, 22 bp, Homo sapiens
tgaggctgccttgggaagaggg

SEQ ID NO: 7260338 - DNA, 22 bp, Homo sapiens
tgaggctggatgggatgcctcc

SEQ ID NO: 7260339 - DNA, 22 bp, Homo sapiens
tgaggctggcaaggctggtatt

SEQ ID NO: 7260340 - DNA, 22 bp, Homo sapiens
tgaggctgttctaccagggcca

SEQ ID NO: 7260341 - DNA, 22 bp, Homo sapiens
tgaggcctggagggaggagttt

SEQ ID NO: 7260342 - DNA, 22 bp, Homo sapiens
tgaggcctggactctgcatgga

SEQ ID NO: 7260343 - DNA, 22 bp, Homo sapiens
tgaggcctgcttggaattgaat

SEQ ID NO: 7260344 - DNA, 19 bp, Homo sapiens
tgaggccttggatgaaagg

SEQ ID NO: 7260345 - DNA, 22 bp, Homo sapiens
tgaggctcacgaacagaagact

SEQ ID NO: 7260346 - DNA, 22 bp, Homo sapiens
tgagggagagggcgaaaatgaa

SEQ ID NO: 7260347 - DNA, 19 bp, Homo sapiens
tgagggacattgggagcag

SEQ ID NO: 7260348 - DNA, 20 bp, Homo sapiens
tgagggagtattgatttccc

SEQ ID NO: 7260349 - DNA, 22 bp, Homo sapiens
tgagggaggcctccatctgcca

SEQ ID NO: 7260350 - DNA, 22 bp, Homo sapiens
tgagggaggccctttgagcaga

SEQ ID NO: 7260351 - DNA, 22 bp, Homo sapiens
tgagggagctgacctttctgtg

SEQ ID NO: 7260352 - DNA, 22 bp, Homo sapiens
tgagggagcacacactgaagtg

SEQ ID NO: 7260353 - DNA, 22 bp, Homo sapiens
tgagggagtcatgattaaggaa

SEQ ID NO: 7260354 - DNA, 22 bp, Homo sapiens
tgagggagtgtggatacagtag

SEQ ID NO: 7260355 - DNA, 22 bp, Homo sapiens
tgagggagttgggtgtatagga

SEQ ID NO: 7260356 - DNA, 22 bp, Homo sapiens
tgaggggaggttggggcacatc

SEQ ID NO: 7260357 - DNA, 19 bp, Homo sapiens
tgaggggaggagaggcctg

SEQ ID NO: 7260358 - DNA, 22 bp, Homo sapiens
tgaggggagacagagtggactc

SEQ ID NO: 7260359 - DNA, 22 bp, Homo sapiens
tgaggggagcccgccctggacg

SEQ ID NO: 7260360 - DNA, 22 bp, Homo sapiens
tgagtagcggctatgtgtaact

SEQ ID NO: 7260361 - DNA, 22 bp, Homo sapiens
tgagtaaaagtgaatcttatgt

SEQ ID NO: 7260362 - DNA, 22 bp, Homo sapiens
tgagtaaaaattctacatttcc

SEQ ID NO: 7260363 - DNA, 22 bp, Homo sapiens
tgaggtgggtgtcaggtcagag

SEQ ID NO: 7260364 - DNA, 22 bp, Homo sapiens
tgaggtggttactgtggtgctc

SEQ ID NO: 7260365 - DNA, 22 bp, Homo sapiens
tgagggtgtgcggcccagacag

SEQ ID NO: 7260366 - DNA, 22 bp, Homo sapiens
tgagggtgggcctgcaggaaga

SEQ ID NO: 7260367 - DNA, 22 bp, Homo sapiens
tgagggtgggcctgcaggaaga

SEQ ID NO: 7260368 - DNA, 22 bp, Homo sapiens
tgagggtggccttgtgtggact

SEQ ID NO: 7260369 - DNA, 22 bp, Homo sapiens
tgagggtggcacaggcacaaag

SEQ ID NO: 7260370 - DNA, 22 bp, Homo sapiens
tgagggtgggccctgggcatct

SEQ ID NO: 7260371 - DNA, 22 bp, Homo sapiens
tgaggggccgcccaagcacttc

SEQ ID NO: 7260372 - DNA, 22 bp, Homo sapiens
tgaggggccgcccaagcacttc

SEQ ID NO: 7260373 - DNA, 22 bp, Homo sapiens
tgaggggccagaccccacctag

SEQ ID NO: 7260374 - DNA, 22 bp, Homo sapiens
tgaggggccagaccccacctag

SEQ ID NO: 7260375 - DNA, 22 bp, Homo sapiens
tgaggggcatgtgtttacacat

SEQ ID NO: 7260376 - DNA, 22 bp, Homo sapiens
tgaggggcatgtgtttacacat

SEQ ID NO: 7260377 - DNA, 22 bp, Homo sapiens
tgaggggcagagaggtgtccag

SEQ ID NO: 7260378 - DNA, 22 bp, Homo sapiens
tgaggggcagagaggtgtccag

SEQ ID NO: 7260379 - DNA, 22 bp, Homo sapiens
tgaggggcgctggcaggttcct

SEQ ID NO: 7260380 - DNA, 22 bp, Homo sapiens
tgaggggcgctggcaggttcct

SEQ ID NO: 7260381 - DNA, 22 bp, Homo sapiens
tgaggggcggcctgcagaggcc

SEQ ID NO: 7260382 - DNA, 22 bp, Homo sapiens
tgaggggcggcctgcagaggcc

SEQ ID NO: 7260383 - DNA, 22 bp, Homo sapiens
tgaggggggtaatcactgggtt

SEQ ID NO: 7260384 - DNA, 19 bp, Homo sapiens
tgaggggctcacagtctca

SEQ ID NO: 7260385 - DNA, 19 bp, Homo sapiens
tgaggggctcacagtctca

SEQ ID NO: 7260386 - DNA, 22 bp, Homo sapiens
tgagggggttaattaggagagt

SEQ ID NO: 7260387 - DNA, 22 bp, Homo sapiens
tgaggggtaagtaaaggaattg

SEQ ID NO: 7260388 - DNA, 19 bp, Homo sapiens
tgagggtgagctttggaga

SEQ ID NO: 7260389 - DNA, 22 bp, Homo sapiens
tgaggggttgtgagaaatgtag

SEQ ID NO: 7260390 - DNA, 21 bp, Homo sapiens
tgaggggttataacagggtgg

SEQ ID NO: 7260391 - DNA, 22 bp, Homo sapiens
tgagaagctgctgacttagcct

SEQ ID NO: 7260392 - DNA, 22 bp, Homo sapiens
tgagaagctgcttgtgctgtat

SEQ ID NO: 7260393 - DNA, 22 bp, Homo sapiens
tgagaagctgctgacttagcct

SEQ ID NO: 7260394 - DNA, 21 bp, Homo sapiens
tgagaatttactctggagagt

SEQ ID NO: 7260395 - DNA, 19 bp, Homo sapiens
tgagacagagaccagttct

SEQ ID NO: 7260396 - DNA, 19 bp, Homo sapiens
tgagacagggattcaggtg

SEQ ID NO: 7260397 - DNA, 18 bp, Homo sapiens
tgagacagctaccacttg

SEQ ID NO: 7260398 - DNA, 22 bp, Homo sapiens
tgagacagcagtcagggaaata

SEQ ID NO: 7260399 - DNA, 17 bp, Homo sapiens
tgagacagggcaggccc

SEQ ID NO: 7260400 - DNA, 22 bp, Homo sapiens
tgagacagtcaccaggcaggcc

SEQ ID NO: 7260401 - DNA, 22 bp, Homo sapiens
tgagaacttgtgctattgcaca

SEQ ID NO: 7260402 - DNA, 22 bp, Homo sapiens
tgagaactggtttctattcatg

SEQ ID NO: 7260403 - DNA, 22 bp, Homo sapiens
tgagaacatttgcagggagagt

SEQ ID NO: 7260404 - DNA, 22 bp, Homo sapiens
tgagaacatacaaacagagaaa

SEQ ID NO: 7260405 - DNA, 22 bp, Homo sapiens
tgagaagcagcttacaggtgtc

SEQ ID NO: 7260406 - DNA, 22 bp, Homo sapiens
tgagaagcagtttcagtaagaa

SEQ ID NO: 7260407 - DNA, 23 bp, Homo sapiens
tgagaagccaggggagcgtgagg

SEQ ID NO: 7260408 - DNA, 23 bp, Homo sapiens
tgagaagccattagagcaggtgg

SEQ ID NO: 7260409 - DNA, 22 bp, Homo sapiens
tgagaaaggtatttcatgcact

SEQ ID NO: 7260410 - DNA, 22 bp, Homo sapiens
tgagaaagcctttagtcccagg

SEQ ID NO: 7260411 - DNA, 22 bp, Homo sapiens
tgagaaagcctttagtcccagg

SEQ ID NO: 7260412 - DNA, 22 bp, Homo sapiens
tgagaaagcctttagtcccagg

SEQ ID NO: 7260413 - DNA, 22 bp, Homo sapiens
tgagaaagacagacattcctaa

SEQ ID NO: 7260414 - DNA, 22 bp, Homo sapiens
tgagaaaggtatttcatgcact

SEQ ID NO: 7260415 - DNA, 20 bp, Homo sapiens
tgagaaagtagagactcagg

SEQ ID NO: 7260416 - DNA, 22 bp, Homo sapiens
tgagaaagtgggtgcctagcaa

SEQ ID NO: 7260417 - DNA, 22 bp, Homo sapiens
tgagaggccccagctcttggcc

SEQ ID NO: 7260418 - DNA, 22 bp, Homo sapiens
tgagagggcccagagcacacca

SEQ ID NO: 7260419 - DNA, 22 bp, Homo sapiens
tgagagggttcccaggggtttc

SEQ ID NO: 7260420 - DNA, 22 bp, Homo sapiens
tgagagcttgagtatcactggc

SEQ ID NO: 7260421 - DNA, 22 bp, Homo sapiens
tgagaggaacaggcagtaggtt

SEQ ID NO: 7260422 - DNA, 22 bp, Homo sapiens
tgagaggaacaggcagtaggtt

SEQ ID NO: 7260423 - DNA, 22 bp, Homo sapiens
tgagaggcagaatggtgcctgc

SEQ ID NO: 7260424 - DNA, 22 bp, Homo sapiens
tgagaggatattttgggaggat

SEQ ID NO: 7260425 - DNA, 21 bp, Homo sapiens
tgagagagtagcaggacatat

SEQ ID NO: 7260426 - DNA, 22 bp, Homo sapiens
tgagagagcgcctgggatcatt

SEQ ID NO: 7260427 - DNA, 22 bp, Homo sapiens
tgagatagtatgtagcacctga

SEQ ID NO: 7260428 - DNA, 22 bp, Homo sapiens
tgagatgaagtgatgtaaaaca

SEQ ID NO: 7260429 - DNA, 22 bp, Homo sapiens
tgagatgaataactcctgctaa

SEQ ID NO: 7260430 - DNA, 21 bp, Homo sapiens
tgagcaaaatttagagtgatg

SEQ ID NO: 7260431 - DNA, 22 bp, Homo sapiens
tgagcaaaagttgatggtgctt

SEQ ID NO: 7260432 - DNA, 22 bp, Homo sapiens
tgagatttggaaaatttgatat

SEQ ID NO: 7260433 - DNA, 22 bp, Homo sapiens
tgagatttcgccgacagtattt

SEQ ID NO: 7260434 - DNA, 22 bp, Homo sapiens
tgagcaagacccggcctctgcc

SEQ ID NO: 7260435 - DNA, 22 bp, Homo sapiens
tgagcaagagaaactgactgta

SEQ ID NO: 7260436 - DNA, 22 bp, Homo sapiens
tgagcaagagaaactgactgta

SEQ ID NO: 7260437 - DNA, 23 bp, Homo sapiens
tgagcaagtgaccaactgtctgt

SEQ ID NO: 7260438 - DNA, 22 bp, Homo sapiens
tgagcaggactgaccggcctta

SEQ ID NO: 7260439 - DNA, 22 bp, Homo sapiens
tgagcaggactcactgcagcct

SEQ ID NO: 7260440 - DNA, 22 bp, Homo sapiens
tgagcaggcgcagcaggaggtc

SEQ ID NO: 7260441 - DNA, 22 bp, Homo sapiens
tgagcagggactttgagtgtag

SEQ ID NO: 7260442 - DNA, 22 bp, Homo sapiens
tgagcaggattcgcctcttgca

SEQ ID NO: 7260443 - DNA, 22 bp, Homo sapiens
tgagcatggtgggtgcagagca

SEQ ID NO: 7260444 - DNA, 19 bp, Homo sapiens
tgagcatgcgagctgagaa

SEQ ID NO: 7260445 - DNA, 22 bp, Homo sapiens
tgagcagggactttggagtctg

SEQ ID NO: 7260446 - DNA, 22 bp, Homo sapiens
tgagcatggtgggtgcagagca

SEQ ID NO: 7260447 - DNA, 22 bp, Homo sapiens
tgagctgacacccaatcatact

SEQ ID NO: 7260448 - DNA, 22 bp, Homo sapiens
tgagctctgttagggctggaac

SEQ ID NO: 7260449 - DNA, 22 bp, Homo sapiens
tgaggaaaatgtcttatagatt

SEQ ID NO: 7260450 - DNA, 22 bp, Homo sapiens
tgaggaaaatgtcttatagatt

SEQ ID NO: 7260451 - DNA, 22 bp, Homo sapiens
tgaggaaaacgtattgaaagga

SEQ ID NO: 7260452 - DNA, 22 bp, Homo sapiens
tgaggaaactgaggcacagatg

SEQ ID NO: 7260453 - DNA, 22 bp, Homo sapiens
tgagcttttaatatacaggtgt

SEQ ID NO: 7260454 - DNA, 22 bp, Homo sapiens
tgagcttgcagtgccagccttg

SEQ ID NO: 7260455 - DNA, 17 bp, Homo sapiens
tgagcttcaatcaggtg

SEQ ID NO: 7260456 - DNA, 22 bp, Homo sapiens
tgagcttagagcctccaagttc

SEQ ID NO: 7260457 - DNA, 22 bp, Homo sapiens
tgagctaggtcctgtgtcagct

SEQ ID NO: 7260458 - DNA, 22 bp, Homo sapiens
tgagcccatgtagcacttccat

SEQ ID NO: 7260459 - DNA, 22 bp, Homo sapiens
tgagccctgacctagcctggcc

SEQ ID NO: 7260460 - DNA, 22 bp, Homo sapiens
tgagccaggttaagacaggagc

SEQ ID NO: 7260461 - DNA, 22 bp, Homo sapiens
tgaaggagctgatgtaaggggt

SEQ ID NO: 7260462 - DNA, 22 bp, Homo sapiens
tgaaggagctgatgtaaggggt

SEQ ID NO: 7260463 - DNA, 22 bp, Homo sapiens
tgaaggagatttttagggaggc

SEQ ID NO: 7260464 - DNA, 22 bp, Homo sapiens
tgaagcttgtatttaaataagt

SEQ ID NO: 7260465 - DNA, 22 bp, Homo sapiens
tgaagctgcctgctcacagcca

SEQ ID NO: 7260466 - DNA, 22 bp, Homo sapiens
tgaagctggcttgacatggcct

SEQ ID NO: 7260467 - DNA, 22 bp, Homo sapiens
tgaaggagggaagaaggctctg

SEQ ID NO: 7260468 - DNA, 22 bp, Homo sapiens
tgaaggagggaagaaggctctg

SEQ ID NO: 7260469 - DNA, 22 bp, Homo sapiens
tgaaggcacttgcctaggggca

SEQ ID NO: 7260470 - DNA, 22 bp, Homo sapiens
tgaagccaatctgccaggcaga

SEQ ID NO: 7260471 - DNA, 22 bp, Homo sapiens
tgaagccacactagcttgtcct

SEQ ID NO: 7260472 - DNA, 22 bp, Homo sapiens
tgaagccacagagcatctgcct

SEQ ID NO: 7260473 - DNA, 22 bp, Homo sapiens
tgaagccaccgaaccagaagag

SEQ ID NO: 7260474 - DNA, 22 bp, Homo sapiens
tgaagccactttccagaatcac

SEQ ID NO: 7260475 - DNA, 22 bp, Homo sapiens
tgaagccactttccagaatcac

SEQ ID NO: 7260476 - DNA, 22 bp, Homo sapiens
tgaagccagctttggaagacac

SEQ ID NO: 7260477 - DNA, 22 bp, Homo sapiens
tgaagccagtcaatgttaagtt

SEQ ID NO: 7260478 - DNA, 22 bp, Homo sapiens
tgaagccagtcaatgttaagtt

SEQ ID NO: 7260479 - DNA, 22 bp, Homo sapiens
tgaagccataggacagaggata

SEQ ID NO: 7260480 - DNA, 22 bp, Homo sapiens
tgaagccatcaggaagccagca

SEQ ID NO: 7260481 - DNA, 22 bp, Homo sapiens
tgaagccatcaggaagccagca

SEQ ID NO: 7260482 - DNA, 22 bp, Homo sapiens
tgaagccatctcagagtcaaga

SEQ ID NO: 7260483 - DNA, 22 bp, Homo sapiens
tgaagccatccctcagatggcc

SEQ ID NO: 7260484 - DNA, 22 bp, Homo sapiens
tgaagccattactgtgttaggg

SEQ ID NO: 7260485 - DNA, 22 bp, Homo sapiens
tgaagccattactgtgttaggg

SEQ ID NO: 7260486 - DNA, 22 bp, Homo sapiens
tgaaggtgacctgacagtggct

SEQ ID NO: 7260487 - DNA, 22 bp, Homo sapiens
tgaaggtgaatgtctatgggga

SEQ ID NO: 7260488 - DNA, 22 bp, Homo sapiens
tgaaggtggcataggagagatg

SEQ ID NO: 7260489 - DNA, 22 bp, Homo sapiens
tgaagtttgaactgtgttgctg

SEQ ID NO: 7260490 - DNA, 22 bp, Homo sapiens
tgaagtttcttgaatcttggag

SEQ ID NO: 7260491 - DNA, 22 bp, Homo sapiens
tgaagtttcctctgaggccagt

SEQ ID NO: 7260492 - DNA, 22 bp, Homo sapiens
tgaagtttcacgcgtcattcaa

SEQ ID NO: 7260493 - DNA, 22 bp, Homo sapiens
tgaagtttataacatagcctcc

SEQ ID NO: 7260494 - DNA, 22 bp, Homo sapiens
tgaagtttaattttggacatga

SEQ ID NO: 7260495 - DNA, 22 bp, Homo sapiens
tgaagtttaaggttagataagt

SEQ ID NO: 7260496 - DNA, 22 bp, Homo sapiens
tgaagttttactaggtgaattt

SEQ ID NO: 7260497 - DNA, 22 bp, Homo sapiens
tgaagttttacatcctctccaa

SEQ ID NO: 7260498 - DNA, 22 bp, Homo sapiens
tgaagtttggtggaaatttcct

SEQ ID NO: 7260499 - DNA, 22 bp, Homo sapiens
tgaagtttttccagacaagtcc

SEQ ID NO: 7260500 - DNA, 22 bp, Homo sapiens
tgaagttttctggttgattaag

SEQ ID NO: 7260501 - DNA, 22 bp, Homo sapiens
tgaaggcattgatgaaggaatc

SEQ ID NO: 7260502 - DNA, 22 bp, Homo sapiens
tgaagggcaaccccaggcccag

SEQ ID NO: 7260503 - DNA, 22 bp, Homo sapiens
tgaaggggttcagcatgggggt

SEQ ID NO: 7260504 - DNA, 21 bp, Homo sapiens
tgaaggggtggcagtgtgctt

SEQ ID NO: 7260505 - DNA, 22 bp, Homo sapiens
tgaagggggagatatatgtgtg

SEQ ID NO: 7260506 - DNA, 21 bp, Homo sapiens
tgaaggggccatcacaaaggc

SEQ ID NO: 7260507 - DNA, 19 bp, Homo sapiens
tgaattaaagattaaagtc

SEQ ID NO: 7260508 - DNA, 22 bp, Homo sapiens
tgaatgttctctaaatactcct

SEQ ID NO: 7260509 - DNA, 19 bp, Homo sapiens
tgaatacagagatacagaa

SEQ ID NO: 7260510 - DNA, 22 bp, Homo sapiens
tgaatagtccttggaataactg

SEQ ID NO: 7260511 - DNA, 22 bp, Homo sapiens
tgaatcagtataaattctcaaa

SEQ ID NO: 7260512 - DNA, 22 bp, Homo sapiens
tgaatttaagcactgatgttaa

SEQ ID NO: 7260513 - DNA, 22 bp, Homo sapiens
tgaatttaaaataaatgtagtt

SEQ ID NO: 7260514 - DNA, 21 bp, Homo sapiens
tgaatttcggtatggctataa

SEQ ID NO: 7260515 - DNA, 22 bp, Homo sapiens
tgacaaaggtgttgccagaggg

SEQ ID NO: 7260516 - DNA, 22 bp, Homo sapiens
tgacaaaggcaggccagaagag

SEQ ID NO: 7260517 - DNA, 23 bp, Homo sapiens
tgacaaagcgagactccagctca

SEQ ID NO: 7260518 - DNA, 22 bp, Homo sapiens
tgacaaagcctcatccttcaga

SEQ ID NO: 7260519 - DNA, 22 bp, Homo sapiens
tgacaaagcatgatggtgacag

SEQ ID NO: 7260520 - DNA, 20 bp, Homo sapiens
tgacaaagagtaagaggagg

SEQ ID NO: 7260521 - DNA, 22 bp, Homo sapiens
tgacaaagaggaacagcagggg

SEQ ID NO: 7260522 - DNA, 22 bp, Homo sapiens
tgacaaagaccttcaacaagat

SEQ ID NO: 7260523 - DNA, 22 bp, Homo sapiens
tgacaaagacaaagatatgtcc

SEQ ID NO: 7260524 - DNA, 22 bp, Homo sapiens
tgacaaagtggttgtttggttg

SEQ ID NO: 7260525 - DNA, 23 bp, Homo sapiens
tgacaaagtggtcgttcaaggtg

SEQ ID NO: 7260526 - DNA, 22 bp, Homo sapiens
tgacaaagtgctagtcggtgaa

SEQ ID NO: 7260527 - DNA, 22 bp, Homo sapiens
tgacaaagtgaggtcttcagta

SEQ ID NO: 7260528 - DNA, 20 bp, Homo sapiens
tgacaaagtcccttcttttc

SEQ ID NO: 7260529 - DNA, 23 bp, Homo sapiens
tgacaaagtcatctctccttctt

SEQ ID NO: 7260530 - DNA, 22 bp, Homo sapiens
tgactatgtggccttgaccaag

SEQ ID NO: 7260531 - DNA, 22 bp, Homo sapiens
tgacctttgtgctagaaacata

SEQ ID NO: 7260532 - DNA, 22 bp, Homo sapiens
tgactagacctatatctttttg

SEQ ID NO: 7260533 - DNA, 22 bp, Homo sapiens
tgactagaattgtatttagtgt

SEQ ID NO: 7260534 - DNA, 22 bp, Homo sapiens
tgacatttcggtgtatgtgatg

SEQ ID NO: 7260535 - DNA, 22 bp, Homo sapiens
tgacatttttataagagtcaaa

SEQ ID NO: 7260536 - DNA, 22 bp, Homo sapiens
tgacattccgcagtaaggttaa

SEQ ID NO: 7260537 - DNA, 21 bp, Homo sapiens
tgacatttagtagcattgtca

SEQ ID NO: 7260538 - DNA, 22 bp, Homo sapiens
tgacatttatcaaagaaatggt

SEQ ID NO: 7260539 - DNA, 22 bp, Homo sapiens
tgacatttatcttctacaatga

SEQ ID NO: 7260540 - DNA, 22 bp, Homo sapiens
tgacatttcagatatggtattt

SEQ ID NO: 7260541 - DNA, 18 bp, Homo sapiens
tgacatttccagagtgta

SEQ ID NO: 7260542 - DNA, 22 bp, Homo sapiens
tgacagtaccaccaaatctgat

SEQ ID NO: 7260543 - DNA, 22 bp, Homo sapiens
tgacagggtgtttgtgagacta

SEQ ID NO: 7260544 - DNA, 22 bp, Homo sapiens
tgacagggggcagaggtggctg

SEQ ID NO: 7260545 - DNA, 22 bp, Homo sapiens
tgacagggtcagagctgagctg

SEQ ID NO: 7260546 - DNA, 22 bp, Homo sapiens
tgacagggtgattatgagagct

SEQ ID NO: 7260547 - DNA, 22 bp, Homo sapiens
tgacagggacagtggagatgga

SEQ ID NO: 7260548 - DNA, 22 bp, Homo sapiens
tgacagggaggtggaataagta

SEQ ID NO: 7260549 - DNA, 22 bp, Homo sapiens
tgacagggccatgctgcactgc

SEQ ID NO: 7260550 - DNA, 22 bp, Homo sapiens
tgacagggcaggcttactggtt

SEQ ID NO: 7260551 - DNA, 22 bp, Homo sapiens
tgacagggcttccctttaatca

SEQ ID NO: 7260552 - DNA, 22 bp, Homo sapiens
tgacagggctgttctgttttag

SEQ ID NO: 7260553 - DNA, 22 bp, Homo sapiens
tgacagggctagaggcaatgca

SEQ ID NO: 7260554 - DNA, 22 bp, Homo sapiens
tgacaggggctggtggataaat

SEQ ID NO: 7260555 - DNA, 22 bp, Homo sapiens
tgacagcagcatagtgagcaat

SEQ ID NO: 7260556 - DNA, 22 bp, Homo sapiens
tgacaggaggcttgaggccagg

SEQ ID NO: 7260557 - DNA, 22 bp, Homo sapiens
tgacagggaaaggtcctctttt

SEQ ID NO: 7260558 - DNA, 22 bp, Homo sapiens
tgacagatgaagctggggacca

SEQ ID NO: 7260559 - DNA, 22 bp, Homo sapiens
tgacagcaataattttatcttc

SEQ ID NO: 7260560 - DNA, 22 bp, Homo sapiens
tgacagattttttctgagctaa

SEQ ID NO: 7260561 - DNA, 22 bp, Homo sapiens
tgacagattttgatggctaata

SEQ ID NO: 7260562 - DNA, 18 bp, Homo sapiens
tgacagaacctggagcct

SEQ ID NO: 7260563 - DNA, 22 bp, Homo sapiens
tgacagaaagaatatgtcaatc

SEQ ID NO: 7260564 - DNA, 22 bp, Homo sapiens
tgacacacagggggatggagtt

SEQ ID NO: 7260565 - DNA, 22 bp, Homo sapiens
tgacacctcgatcttggacttc

SEQ ID NO: 7260566 - DNA, 22 bp, Homo sapiens
tgacaccttcatcttggacttc

SEQ ID NO: 7260567 - DNA, 22 bp, Homo sapiens
tgacaccttgatcttggactta

SEQ ID NO: 7260568 - DNA, 22 bp, Homo sapiens
tgacaccttgatcttggacttc

SEQ ID NO: 7260569 - DNA, 22 bp, Homo sapiens
tgacaccttgatcttggacttt

SEQ ID NO: 7260570 - DNA, 22 bp, Homo sapiens
tgacaccttgctcttggacttc

SEQ ID NO: 7260571 - DNA, 22 bp, Homo sapiens
tgaagaatgttgcagtgagcat

SEQ ID NO: 7260572 - DNA, 22 bp, Homo sapiens
tgaagaagccaattggtaggct

SEQ ID NO: 7260573 - DNA, 22 bp, Homo sapiens
tgaaattatgcattgttgtacc

SEQ ID NO: 7260574 - DNA, 22 bp, Homo sapiens
tgaaattagtgaagttacagtt

SEQ ID NO: 7260575 - DNA, 22 bp, Homo sapiens
tgaaattattcttaccaaggtg

SEQ ID NO: 7260576 - DNA, 22 bp, Homo sapiens
tgaacagtggttcatgtcacgg

SEQ ID NO: 7260577 - DNA, 22 bp, Homo sapiens
tgaacatacaattattaagaac

SEQ ID NO: 7260578 - DNA, 22 bp, Homo sapiens
tgaaccttttgaataaggacca

SEQ ID NO: 7260579 - DNA, 22 bp, Homo sapiens
tgaacattagttgagtaaagtc

SEQ ID NO: 7260580 - DNA, 22 bp, Homo sapiens
tgaacatacaattattaagaac

SEQ ID NO: 7260581 - DNA, 22 bp, Homo sapiens
tgaactcctgacctcatgatcc

SEQ ID NO: 7260582 - DNA, 22 bp, Homo sapiens
tgaaataatatctggatcaatc

SEQ ID NO: 7260583 - DNA, 22 bp, Homo sapiens
tgaaatatgctcccattcactt

SEQ ID NO: 7260584 - DNA, 22 bp, Homo sapiens
tgaaatagacttgcactatatg

SEQ ID NO: 7260585 - DNA, 22 bp, Homo sapiens
tgaaagtgaatgtcactgttga

SEQ ID NO: 7260586 - DNA, 22 bp, Homo sapiens
tgaaatctgcatgcaaagtcct

SEQ ID NO: 7260587 - DNA, 22 bp, Homo sapiens
tgaaatcttcactaagtctctt

SEQ ID NO: 7260588 - DNA, 22 bp, Homo sapiens
tgaaatgctgtagagactgtat

SEQ ID NO: 7260589 - DNA, 22 bp, Homo sapiens
tgaaatgtacataaaaacgcac

SEQ ID NO: 7260590 - DNA, 22 bp, Homo sapiens
tgaaatgtgatctgagcttggc

SEQ ID NO: 7260591 - DNA, 22 bp, Homo sapiens
tgaaattagaaatatgtatggg

SEQ ID NO: 7260592 - DNA, 22 bp, Homo sapiens
tctttgtctgaacagggacatt

SEQ ID NO: 7260593 - DNA, 22 bp, Homo sapiens
tctttgtcattaaactagtaac

SEQ ID NO: 7260594 - DNA, 22 bp, Homo sapiens
tctttgtaagttatatgtagta

SEQ ID NO: 7260595 - DNA, 22 bp, Homo sapiens
tctttgtaagacatgtaagtcc

SEQ ID NO: 7260596 - DNA, 22 bp, Homo sapiens
tctttggacatgttgaggttgc

SEQ ID NO: 7260597 - DNA, 23 bp, Homo sapiens
tctttggagtgctaggggttggg

SEQ ID NO: 7260598 - DNA, 22 bp, Homo sapiens
tctttggatctcaaggtggcag

SEQ ID NO: 7260599 - DNA, 17 bp, Homo sapiens
tctttgcaatgagactg

SEQ ID NO: 7260600 - DNA, 22 bp, Homo sapiens
tctttgcagaacgatgaagatg

SEQ ID NO: 7260601 - DNA, 22 bp, Homo sapiens
tctttgtttgtactgttagaat

SEQ ID NO: 7260602 - DNA, 22 bp, Homo sapiens
tcttttaaaagccctgctgtct

SEQ ID NO: 7260603 - DNA, 22 bp, Homo sapiens
tctttgttattgctttatctat

SEQ ID NO: 7260604 - DNA, 20 bp, Homo sapiens
tctttgttaattttatctcc

SEQ ID NO: 7260605 - DNA, 22 bp, Homo sapiens
tcttttatagtgaattttcttg

SEQ ID NO: 7260606 - DNA, 22 bp, Homo sapiens
tcttttaacctaactagcttgg

SEQ ID NO: 7260607 - DNA, 22 bp, Homo sapiens
tcttttatctgttgtgtaacaa

SEQ ID NO: 7260608 - DNA, 22 bp, Homo sapiens
tcttttatcctacatttagctc

SEQ ID NO: 7260609 - DNA, 22 bp, Homo sapiens
tcttttatcctacatttagctc

SEQ ID NO: 7260610 - DNA, 22 bp, Homo sapiens
tcttttattaggctgaaatggg

SEQ ID NO: 7260611 - DNA, 22 bp, Homo sapiens
tcttttcacagacaaatggaga

SEQ ID NO: 7260612 - DNA, 22 bp, Homo sapiens
tcttttcacaaaggagctggag

SEQ ID NO: 7260613 - DNA, 23 bp, Homo sapiens
tcttttcaatggttctttatgtg

SEQ ID NO: 7260614 - DNA, 20 bp, Homo sapiens
tcttttattggcagatcctg

SEQ ID NO: 7260615 - DNA, 22 bp, Homo sapiens
tcttttcaggaatggctctagt

SEQ ID NO: 7260616 - DNA, 19 bp, Homo sapiens
tcttttcacgcattttgaa

SEQ ID NO: 7260617 - DNA, 22 bp, Homo sapiens
tcttttcatcatttaataggta

SEQ ID NO: 7260618 - DNA, 22 bp, Homo sapiens
tcttttcattgagaacacactg

SEQ ID NO: 7260619 - DNA, 21 bp, Homo sapiens
tcttttctctgcaggattcct

SEQ ID NO: 7260620 - DNA, 22 bp, Homo sapiens
tgaaaacactttagtttaggtc

SEQ ID NO: 7260621 - DNA, 22 bp, Homo sapiens
tgaaaatatagttttccagact

SEQ ID NO: 7260622 - DNA, 22 bp, Homo sapiens
tgaaaatgccctctatgtctca

SEQ ID NO: 7260623 - DNA, 22 bp, Homo sapiens
tgaaaattaagcagatgaatga

SEQ ID NO: 7260624 - DNA, 22 bp, Homo sapiens
tgaaaatgccctctatgtctca

SEQ ID NO: 7260625 - DNA, 22 bp, Homo sapiens
tgaaacattaggaaatcattat

SEQ ID NO: 7260626 - DNA, 22 bp, Homo sapiens
tgaaacattgcactgtatgaat

SEQ ID NO: 7260627 - DNA, 22 bp, Homo sapiens
tgaaagaactagcatcttcaag

SEQ ID NO: 7260628 - DNA, 22 bp, Homo sapiens
tgaaagaactagcatcttcaag

SEQ ID NO: 7260629 - DNA, 22 bp, Homo sapiens
tgcagggattatgtaggggttg

SEQ ID NO: 7260630 - DNA, 22 bp, Homo sapiens
tgcagggatcctagctgaagag

SEQ ID NO: 7260631 - DNA, 22 bp, Homo sapiens
tgcagggatgctagaggtaaga

SEQ ID NO: 7260632 - DNA, 22 bp, Homo sapiens
tgcagggccatggtggcggctg

SEQ ID NO: 7260633 - DNA, 22 bp, Homo sapiens
tgcaggctgtaatctgaggcta

SEQ ID NO: 7260634 - DNA, 22 bp, Homo sapiens
tgcagggaaaacccaggatgct

SEQ ID NO: 7260635 - DNA, 22 bp, Homo sapiens
tgcagggaaaacccaggatgct

SEQ ID NO: 7260636 - DNA, 22 bp, Homo sapiens
tgcagggaacttggacagctag

SEQ ID NO: 7260637 - DNA, 22 bp, Homo sapiens
tgcagggaagcaagggtggctc

SEQ ID NO: 7260638 - DNA, 22 bp, Homo sapiens
tgcagtgttcagtgatctctcc

SEQ ID NO: 7260639 - DNA, 22 bp, Homo sapiens
tgcagtgtgacctgtagcgagc

SEQ ID NO: 7260640 - DNA, 22 bp, Homo sapiens
tgcagtcctaaatatatagctg

SEQ ID NO: 7260641 - DNA, 22 bp, Homo sapiens
tgcagtgggccggaggccaggg

SEQ ID NO: 7260642 - DNA, 22 bp, Homo sapiens
tgcagtgggccggaggccaggg

SEQ ID NO: 7260643 - DNA, 22 bp, Homo sapiens
tgcagtggtggtaaagatgctc

SEQ ID NO: 7260644 - DNA, 22 bp, Homo sapiens
tgcaggtcaatcttcaggttcc

SEQ ID NO: 7260645 - DNA, 19 bp, Homo sapiens
tgcagggctgcgcctgggg

SEQ ID NO: 7260646 - DNA, 19 bp, Homo sapiens
tgcagggctgcgcctgggg

SEQ ID NO: 7260647 - DNA, 20 bp, Homo sapiens
tgcagggctgcctcccagct

SEQ ID NO: 7260648 - DNA, 22 bp, Homo sapiens
tgcaggggcttgtctgggcctg

SEQ ID NO: 7260649 - DNA, 23 bp, Homo sapiens
tgcaggggaggcttaaagcaggt

SEQ ID NO: 7260650 - DNA, 22 bp, Homo sapiens
tgcattttcttccaccaatatc

SEQ ID NO: 7260651 - DNA, 22 bp, Homo sapiens
tgcattttacttacctgttagt

SEQ ID NO: 7260652 - DNA, 22 bp, Homo sapiens
tgcatttgttcagtgaaatgtt

SEQ ID NO: 7260653 - DNA, 20 bp, Homo sapiens
tgcatttgttatttgtactc

SEQ ID NO: 7260654 - DNA, 22 bp, Homo sapiens
tgcatttgtcttgtctcatgaa

SEQ ID NO: 7260655 - DNA, 22 bp, Homo sapiens
tgcatttgacatttagtggggt

SEQ ID NO: 7260656 - DNA, 22 bp, Homo sapiens
tgcatttggggcagactagcag

SEQ ID NO: 7260657 - DNA, 22 bp, Homo sapiens
tgcatttacctggaggtcattt

SEQ ID NO: 7260658 - DNA, 22 bp, Homo sapiens
tgcattgttgaccagttgtgca

SEQ ID NO: 7260659 - DNA, 22 bp, Homo sapiens
tgcattgagaatttctcaggga

SEQ ID NO: 7260660 - DNA, 19 bp, Homo sapiens
tgcattgagggctgtctca

SEQ ID NO: 7260661 - DNA, 22 bp, Homo sapiens
tgccaccccggaccccgaagtg

SEQ ID NO: 7260662 - DNA, 22 bp, Homo sapiens
tgccacccctctgcaccctcag

SEQ ID NO: 7260663 - DNA, 22 bp, Homo sapiens
tgccaccctctctgctacccgc

SEQ ID NO: 7260664 - DNA, 22 bp, Homo sapiens
tgccagcacttctggctgtctg

SEQ ID NO: 7260665 - DNA, 22 bp, Homo sapiens
tgccagccaggttctgaggcta

SEQ ID NO: 7260666 - DNA, 22 bp, Homo sapiens
tgccagccaggttctgaggcta

SEQ ID NO: 7260667 - DNA, 22 bp, Homo sapiens
tgcatacacaagcatacatgta

SEQ ID NO: 7260668 - DNA, 22 bp, Homo sapiens
tgcatacacatgtgcacatacg

SEQ ID NO: 7260669 - DNA, 22 bp, Homo sapiens
tgcagttttatcacatatatag

SEQ ID NO: 7260670 - DNA, 22 bp, Homo sapiens
tgcagtttgccctttgctcact

SEQ ID NO: 7260671 - DNA, 22 bp, Homo sapiens
tgcagtttcctttctagtcttt

SEQ ID NO: 7260672 - DNA, 22 bp, Homo sapiens
tgcagtttaaacttggcaactt

SEQ ID NO: 7260673 - DNA, 22 bp, Homo sapiens
tgcagttttgccaggcaatgga

SEQ ID NO: 7260674 - DNA, 21 bp, Homo sapiens
tgcagttttgcttgatctctg

SEQ ID NO: 7260675 - DNA, 22 bp, Homo sapiens
tgcatgcatgctactgggaggt

SEQ ID NO: 7260676 - DNA, 22 bp, Homo sapiens
tgcattccacagtagtattttg

SEQ ID NO: 7260677 - DNA, 22 bp, Homo sapiens
tgcatgttccaactccatcact

SEQ ID NO: 7260678 - DNA, 20 bp, Homo sapiens
tgccagggccagcagaggct

SEQ ID NO: 7260679 - DNA, 22 bp, Homo sapiens
tgccaggcttagagcaggggct

SEQ ID NO: 7260680 - DNA, 22 bp, Homo sapiens
tgccaggcttagagcaggggct

SEQ ID NO: 7260681 - DNA, 22 bp, Homo sapiens
tgccaggctttggtcaaaggct

SEQ ID NO: 7260682 - DNA, 22 bp, Homo sapiens
tgccaggctccggaacgacagt

SEQ ID NO: 7260683 - DNA, 22 bp, Homo sapiens
tgccaggctgaacagggtctta

SEQ ID NO: 7260684 - DNA, 20 bp, Homo sapiens
tgccaggctgcacgcctgcc

SEQ ID NO: 7260685 - DNA, 22 bp, Homo sapiens
tgccaggctgccctccagtctg

SEQ ID NO: 7260686 - DNA, 22 bp, Homo sapiens
tgccaggctgtcaattcaccca

SEQ ID NO: 7260687 - DNA, 22 bp, Homo sapiens
tgccaggctgtcctgggcctgg

SEQ ID NO: 7260688 - DNA, 22 bp, Homo sapiens
tgccagggtgtcaggagagcta

SEQ ID NO: 7260689 - DNA, 22 bp, Homo sapiens
tgccagtctcaccctgggtcct

SEQ ID NO: 7260690 - DNA, 22 bp, Homo sapiens
tgccatcctgtgtcatgctcat

SEQ ID NO: 7260691 - DNA, 18 bp, Homo sapiens
tgccagccgactggcctg

SEQ ID NO: 7260692 - DNA, 22 bp, Homo sapiens
tgccaggcaactgcccagccat

SEQ ID NO: 7260693 - DNA, 22 bp, Homo sapiens
tgccaggcaactgcccagccat

SEQ ID NO: 7260694 - DNA, 20 bp, Homo sapiens
tgccaggcacggagtgcatg

SEQ ID NO: 7260695 - DNA, 20 bp, Homo sapiens
tgccaggcacggagtgcatg

SEQ ID NO: 7260696 - DNA, 22 bp, Homo sapiens
tgccaggcacgtgagagtggcc

SEQ ID NO: 7260697 - DNA, 22 bp, Homo sapiens
tgccaggcaggaccctagaacc

SEQ ID NO: 7260698 - DNA, 22 bp, Homo sapiens
tgccaggcagtgtcagattgag

SEQ ID NO: 7260699 - DNA, 22 bp, Homo sapiens
tgccaggcatatggcctctttg

SEQ ID NO: 7260700 - DNA, 22 bp, Homo sapiens
tgccaggcatgtagtagacttg

SEQ ID NO: 7260701 - DNA, 22 bp, Homo sapiens
tgccaggcatttgacagacact

SEQ ID NO: 7260702 - DNA, 22 bp, Homo sapiens
tgccaggccaatgaaggcaggg

SEQ ID NO: 7260703 - DNA, 22 bp, Homo sapiens
tgccaggccaatgaaggcaggg

SEQ ID NO: 7260704 - DNA, 22 bp, Homo sapiens
tgccaggccaattctatttgac

SEQ ID NO: 7260705 - DNA, 22 bp, Homo sapiens
tgccaggccacgtagcttcaag

SEQ ID NO: 7260706 - DNA, 22 bp, Homo sapiens
tgccaggcccagcagggcggcc

SEQ ID NO: 7260707 - DNA, 22 bp, Homo sapiens
tgccaggcccagctccagagct

SEQ ID NO: 7260708 - DNA, 22 bp, Homo sapiens
tgccaggccctcccacagatta

SEQ ID NO: 7260709 - DNA, 22 bp, Homo sapiens
tgccaggccctgcggggtccca

SEQ ID NO: 7260710 - DNA, 22 bp, Homo sapiens
tgccaggccctgtgctggatgc

SEQ ID NO: 7260711 - DNA, 22 bp, Homo sapiens
tgccaggcctcaggagtctcca

SEQ ID NO: 7260712 - DNA, 22 bp, Homo sapiens
tgccaggctaagtggaggactt

SEQ ID NO: 7260713 - DNA, 22 bp, Homo sapiens
tgccaggctcagcccctatctt

SEQ ID NO: 7260714 - DNA, 22 bp, Homo sapiens
tgccaggctcaggatgtccctg

SEQ ID NO: 7260715 - DNA, 22 bp, Homo sapiens
tgcccacaggaagacaccagcg

SEQ ID NO: 7260716 - DNA, 22 bp, Homo sapiens
tgcccacagctcagggctgctc

SEQ ID NO: 7260717 - DNA, 21 bp, Homo sapiens
tgcccacagcaaatgcagagg

SEQ ID NO: 7260718 - DNA, 22 bp, Homo sapiens
tgcccacagctcagggctgctc

SEQ ID NO: 7260719 - DNA, 22 bp, Homo sapiens
tgcccacagatatgtgcagtct

SEQ ID NO: 7260720 - DNA, 20 bp, Homo sapiens
tgcccacaattcacaatgcc

SEQ ID NO: 7260721 - DNA, 22 bp, Homo sapiens
tgcccaagtgtttggctgagtc

SEQ ID NO: 7260722 - DNA, 22 bp, Homo sapiens
tgccatttacgagcagtatgac

SEQ ID NO: 7260723 - DNA, 22 bp, Homo sapiens
tgccatttaaaaatgaccaaat

SEQ ID NO: 7260724 - DNA, 22 bp, Homo sapiens
tgccatttctttcaatattctt

SEQ ID NO: 7260725 - DNA, 22 bp, Homo sapiens
tgccatttctcacatatgtatg

SEQ ID NO: 7260726 - DNA, 23 bp, Homo sapiens
tgccattttccatctcatgcaga

SEQ ID NO: 7260727 - DNA, 21 bp, Homo sapiens
tgccattttaaccaagtgtgc

SEQ ID NO: 7260728 - DNA, 22 bp, Homo sapiens
tgcccagcactgtgccagtcac

SEQ ID NO: 7260729 - DNA, 22 bp, Homo sapiens
tgcccagcacccagcatgatgc

SEQ ID NO: 7260730 - DNA, 20 bp, Homo sapiens
tgcccagcaagagtgcagtt

SEQ ID NO: 7260731 - DNA, 22 bp, Homo sapiens
tgcccagcaataaaccagaaga

SEQ ID NO: 7260732 - DNA, 22 bp, Homo sapiens
tgcccagcaataaaccagaaga

SEQ ID NO: 7260733 - DNA, 22 bp, Homo sapiens
tgcccagcactgtgccagtcac

SEQ ID NO: 7260734 - DNA, 22 bp, Homo sapiens
tgcccagcactgtgccagtcac

SEQ ID NO: 7260735 - DNA, 22 bp, Homo sapiens
tgcccagcagggagctacctgg

SEQ ID NO: 7260736 - DNA, 22 bp, Homo sapiens
tgcccagccaatttgttatgtt

SEQ ID NO: 7260737 - DNA, 20 bp, Homo sapiens
tgcccagcaagagtgcagtt

SEQ ID NO: 7260738 - DNA, 22 bp, Homo sapiens
tgcccacatggtgccatggcca

SEQ ID NO: 7260739 - DNA, 22 bp, Homo sapiens
tgcccacattctgaagctccct

SEQ ID NO: 7260740 - DNA, 22 bp, Homo sapiens
tgccccctggtggccagagccg

SEQ ID NO: 7260741 - DNA, 22 bp, Homo sapiens
tgccccagactctgctcacctc

SEQ ID NO: 7260742 - DNA, 22 bp, Homo sapiens
tgccccagacctactgaatggg

SEQ ID NO: 7260743 - DNA, 20 bp, Homo sapiens
tgccccaggcctgcacctgc

SEQ ID NO: 7260744 - DNA, 22 bp, Homo sapiens
tgccccaggtgctgaggttgga

SEQ ID NO: 7260745 - DNA, 22 bp, Homo sapiens
tgcccagggtttctaagagcag

SEQ ID NO: 7260746 - DNA, 22 bp, Homo sapiens
tgcccagggtggagtgcagcgg

SEQ ID NO: 7260747 - DNA, 22 bp, Homo sapiens
tgcccatgtttctctgtatccc

SEQ ID NO: 7260748 - DNA, 22 bp, Homo sapiens
tgcccaggattgtgaggtcagg

SEQ ID NO: 7260749 - DNA, 22 bp, Homo sapiens
tgcctgagggagtaagagtcct

SEQ ID NO: 7260750 - DNA, 22 bp, Homo sapiens
tgcctcagctgaggccgctcca

SEQ ID NO: 7260751 - DNA, 22 bp, Homo sapiens
tgcctggaaggcccatgggaag

SEQ ID NO: 7260752 - DNA, 22 bp, Homo sapiens
tgcctggatctgaggacccatt

SEQ ID NO: 7260753 - DNA, 22 bp, Homo sapiens
tgccctgctaaccttggttcca

SEQ ID NO: 7260754 - DNA, 22 bp, Homo sapiens
tgccctgctaaatataggtagc

SEQ ID NO: 7260755 - DNA, 22 bp, Homo sapiens
tgccctgcggctatctagatga

SEQ ID NO: 7260756 - DNA, 22 bp, Homo sapiens
tgccctgcctgagagacagtaa

SEQ ID NO: 7260757 - DNA, 22 bp, Homo sapiens
tgccctgcccttgctatttcta

SEQ ID NO: 7260758 - DNA, 19 bp, Homo sapiens
tgccctgcccgcagccttg

SEQ ID NO: 7260759 - DNA, 22 bp, Homo sapiens
tgccctgcccatctaccctgtc

SEQ ID NO: 7260760 - DNA, 22 bp, Homo sapiens
tgccctgccaagactgagtggt

SEQ ID NO: 7260761 - DNA, 22 bp, Homo sapiens
tgccctgcatgcagggagctgt

SEQ ID NO: 7260762 - DNA, 22 bp, Homo sapiens
tgccctgccaagaccaagtggt

SEQ ID NO: 7260763 - DNA, 22 bp, Homo sapiens
tgccctgccaagactcagtggt

SEQ ID NO: 7260764 - DNA, 22 bp, Homo sapiens
tgccctgcagtgagtgcgtctg

SEQ ID NO: 7260765 - DNA, 22 bp, Homo sapiens
tgccctgcagaccctgcagtgt

SEQ ID NO: 7260766 - DNA, 19 bp, Homo sapiens
tgccctgcacgctgtcctg

SEQ ID NO: 7260767 - DNA, 22 bp, Homo sapiens
tgccctggctcctcccacgctg

SEQ ID NO: 7260768 - DNA, 22 bp, Homo sapiens
tgccctgctgtggctctgccca

SEQ ID NO: 7260769 - DNA, 22 bp, Homo sapiens
tgccctgctgtgcctggagcca

SEQ ID NO: 7260770 - DNA, 22 bp, Homo sapiens
tgccctgcttggtttattttca

SEQ ID NO: 7260771 - DNA, 22 bp, Homo sapiens
tgccctgcttctcttgggacag

SEQ ID NO: 7260772 - DNA, 22 bp, Homo sapiens
tgccctgtgccagacttcctgg

SEQ ID NO: 7260773 - DNA, 17 bp, Homo sapiens
tgccctgtgcctggtgt

SEQ ID NO: 7260774 - DNA, 22 bp, Homo sapiens
tgccctgtgggtatctgatggc

SEQ ID NO: 7260775 - DNA, 22 bp, Homo sapiens
tgccctgtggggatttccagcc

SEQ ID NO: 7260776 - DNA, 22 bp, Homo sapiens
tgccctgtgctggaatcttccc

SEQ ID NO: 7260777 - DNA, 20 bp, Homo sapiens
tgccctgtggaggggaaagg

SEQ ID NO: 7260778 - DNA, 22 bp, Homo sapiens
tgccctgtgtgtgcaagcactg

SEQ ID NO: 7260779 - DNA, 22 bp, Homo sapiens
tgccctgttcctgcctccagct

SEQ ID NO: 7260780 - DNA, 22 bp, Homo sapiens
tgccctgttcacttcatggttc

SEQ ID NO: 7260781 - DNA, 22 bp, Homo sapiens
tgccctgtgttgggaatccaca

SEQ ID NO: 7260782 - DNA, 22 bp, Homo sapiens
tgccctgttatcttggaagagt

SEQ ID NO: 7260783 - DNA, 22 bp, Homo sapiens
tgccctgggacatgcagcggag

SEQ ID NO: 7260784 - DNA, 22 bp, Homo sapiens
tgccctgtctaagctgtcagta

SEQ ID NO: 7260785 - DNA, 22 bp, Homo sapiens
tgccctgggaacacagatgcca

SEQ ID NO: 7260786 - DNA, 22 bp, Homo sapiens
tgcctaggctggagtgtagtgg

SEQ ID NO: 7260787 - DNA, 22 bp, Homo sapiens
tgcagagcagcaactgcgtgcg

SEQ ID NO: 7260788 - DNA, 20 bp, Homo sapiens
tgcagagctggctggctcct

SEQ ID NO: 7260789 - DNA, 22 bp, Homo sapiens
tgcagaggagctggaaggctgg

SEQ ID NO: 7260790 - DNA, 22 bp, Homo sapiens
tgcagaggagtcagcctgggca

SEQ ID NO: 7260791 - DNA, 22 bp, Homo sapiens
tgcagaggagtcagcctgggca

SEQ ID NO: 7260792 - DNA, 22 bp, Homo sapiens
tgcagaggagctggaaggctgg

SEQ ID NO: 7260793 - DNA, 22 bp, Homo sapiens
tgcagaggcatttattgatgta

SEQ ID NO: 7260794 - DNA, 22 bp, Homo sapiens
tgcagaggcatttattgatgta

SEQ ID NO: 7260795 - DNA, 22 bp, Homo sapiens
tgcagaggctggctcgccgggt

SEQ ID NO: 7260796 - DNA, 22 bp, Homo sapiens
tgcagaggcgccgtgggtgggg

SEQ ID NO: 7260797 - DNA, 22 bp, Homo sapiens
tgcagaggcgccgtgggtgggg

SEQ ID NO: 7260798 - DNA, 22 bp, Homo sapiens
tgcagatgaatgctgagacact

SEQ ID NO: 7260799 - DNA, 22 bp, Homo sapiens
tgcagagtcctctggagggact

SEQ ID NO: 7260800 - DNA, 22 bp, Homo sapiens
tgcagagtagtgaggggacaga

SEQ ID NO: 7260801 - DNA, 19 bp, Homo sapiens
tgcagagggtaggaaggcc

SEQ ID NO: 7260802 - DNA, 22 bp, Homo sapiens
tgcagagggagtgacggttcac

SEQ ID NO: 7260803 - DNA, 23 bp, Homo sapiens
tgcagagggactgaagccagctt

SEQ ID NO: 7260804 - DNA, 22 bp, Homo sapiens
tgcagagggaaaaggtgctcct

SEQ ID NO: 7260805 - DNA, 22 bp, Homo sapiens
tgcagcaagaaggcactgtctg

SEQ ID NO: 7260806 - DNA, 22 bp, Homo sapiens
tgcagatgagggatgaaaatga

SEQ ID NO: 7260807 - DNA, 20 bp, Homo sapiens
tgcagcacgggccctttcca

SEQ ID NO: 7260808 - DNA, 20 bp, Homo sapiens
tgcagcagaagcccatgctc

SEQ ID NO: 7260809 - DNA, 18 bp, Homo sapiens
tgcacagctgtgggctgg

SEQ ID NO: 7260810 - DNA, 20 bp, Homo sapiens
tgcacagctgtgaataggat

SEQ ID NO: 7260811 - DNA, 22 bp, Homo sapiens
tgcacagctggctctccttttc

SEQ ID NO: 7260812 - DNA, 22 bp, Homo sapiens
tgcacagctgcctcctctctgc

SEQ ID NO: 7260813 - DNA, 22 bp, Homo sapiens
tgcacagcgggtgtctgtcagg

SEQ ID NO: 7260814 - DNA, 22 bp, Homo sapiens
tgcacagcgcttgtcgggtgtg

SEQ ID NO: 7260815 - DNA, 21 bp, Homo sapiens
tgcacagccataccctccttg

SEQ ID NO: 7260816 - DNA, 22 bp, Homo sapiens
tgcacagcaaatattgactacc

SEQ ID NO: 7260817 - DNA, 22 bp, Homo sapiens
tgcacacagttctcaggaaaga

SEQ ID NO: 7260818 - DNA, 22 bp, Homo sapiens
tgcacattcacttaggtattgt

SEQ ID NO: 7260819 - DNA, 22 bp, Homo sapiens
tgcacatttgttattttgaggt

SEQ ID NO: 7260820 - DNA, 21 bp, Homo sapiens
tgcagaaatggtttttctaag

SEQ ID NO: 7260821 - DNA, 22 bp, Homo sapiens
tgcagaaagcattgactcttcc

SEQ ID NO: 7260822 - DNA, 21 bp, Homo sapiens
tgcaggaagtatggtgcctat

SEQ ID NO: 7260823 - DNA, 22 bp, Homo sapiens
tgcaggagcaccagctcaccct

SEQ ID NO: 7260824 - DNA, 22 bp, Homo sapiens
tgcaggagcagagatggctgga

SEQ ID NO: 7260825 - DNA, 22 bp, Homo sapiens
tgcaggagagctggtctggccc

SEQ ID NO: 7260826 - DNA, 18 bp, Homo sapiens
tgcaggagtgaccccggc

SEQ ID NO: 7260827 - DNA, 23 bp, Homo sapiens
tgcaggctaggaagagagccttc

SEQ ID NO: 7260828 - DNA, 22 bp, Homo sapiens
tgcagcagaatatggctgcagg

SEQ ID NO: 7260829 - DNA, 22 bp, Homo sapiens
tgcagcagagtgggcctgggtg

SEQ ID NO: 7260830 - DNA, 22 bp, Homo sapiens
tgcagcaggagccaggcctggt

SEQ ID NO: 7260831 - DNA, 22 bp, Homo sapiens
tgcagcccagccccagaacctt

SEQ ID NO: 7260832 - DNA, 22 bp, Homo sapiens
tgcagctctgcatggctggttc

SEQ ID NO: 7260833 - DNA, 22 bp, Homo sapiens
tgcagctctgaacagtcatgaa

SEQ ID NO: 7260834 - DNA, 22 bp, Homo sapiens
tgcagctcgggcttagggtggg

SEQ ID NO: 7260835 - DNA, 22 bp, Homo sapiens
tgcagctcctctggctgcctga

SEQ ID NO: 7260836 - DNA, 22 bp, Homo sapiens
tgcagctcctgtgctgagtgtg

SEQ ID NO: 7260837 - DNA, 22 bp, Homo sapiens
tgcagctcattggtgtcctggt

SEQ ID NO: 7260838 - DNA, 22 bp, Homo sapiens
tgcagctcattgctggggtctg

SEQ ID NO: 7260839 - DNA, 22 bp, Homo sapiens
tgcagctcaggattctcagggc

SEQ ID NO: 7260840 - DNA, 19 bp, Homo sapiens
tgcagctcagggcaggggc

SEQ ID NO: 7260841 - DNA, 22 bp, Homo sapiens
tgcagctcatattagagagaag

SEQ ID NO: 7260842 - DNA, 23 bp, Homo sapiens
tgcagctcaaagatgggtaaatg

SEQ ID NO: 7260843 - DNA, 22 bp, Homo sapiens
tgcagctcaagctggtgaggtg

SEQ ID NO: 7260844 - DNA, 22 bp, Homo sapiens
tgcagctctgtatgctgattat

SEQ ID NO: 7260845 - DNA, 22 bp, Homo sapiens
tgcagctcttacggagggcggg

SEQ ID NO: 7260846 - DNA, 22 bp, Homo sapiens
tgcagctctgggcaagtgcctt

SEQ ID NO: 7260847 - DNA, 22 bp, Homo sapiens
tgcagctctggggtaaggggtg

SEQ ID NO: 7260848 - DNA, 22 bp, Homo sapiens
tgcagctctgggtgtagaggct

SEQ ID NO: 7260849 - DNA, 21 bp, Homo sapiens
tgcaagaatcaggaagctgcc

SEQ ID NO: 7260850 - DNA, 21 bp, Homo sapiens
tgcaagaatcaggaagctgcc

SEQ ID NO: 7260851 - DNA, 22 bp, Homo sapiens
tgcaagaaaggtggggccaggc

SEQ ID NO: 7260852 - DNA, 22 bp, Homo sapiens
tgcaagaaacatattccacaag

SEQ ID NO: 7260853 - DNA, 17 bp, Homo sapiens
tgcaagaagattaggaa

SEQ ID NO: 7260854 - DNA, 22 bp, Homo sapiens
tgcaagggtagaagtgatggca

SEQ ID NO: 7260855 - DNA, 22 bp, Homo sapiens
tgcaatgaattacttcccaaac

SEQ ID NO: 7260856 - DNA, 22 bp, Homo sapiens
tgcacacaagttggagaatgaa

SEQ ID NO: 7260857 - DNA, 22 bp, Homo sapiens
tgcacaagtcagagtaacattt

SEQ ID NO: 7260858 - DNA, 17 bp, Homo sapiens
tgcacaagagacaatag

SEQ ID NO: 7260859 - DNA, 22 bp, Homo sapiens
tgcacaaatttgtgtatgctca

SEQ ID NO: 7260860 - DNA, 22 bp, Homo sapiens
tgcacaaaggctccctgctgag

SEQ ID NO: 7260861 - DNA, 22 bp, Homo sapiens
tgcacaaagcattctagacgca

SEQ ID NO: 7260862 - DNA, 21 bp, Homo sapiens
tgcacaaactttctgtggctt

SEQ ID NO: 7260863 - DNA, 22 bp, Homo sapiens
tgcacaaacttgtgtcccaggg

SEQ ID NO: 7260864 - DNA, 22 bp, Homo sapiens
tgcacaaacacagagaatagat

SEQ ID NO: 7260865 - DNA, 22 bp, Homo sapiens
tgcacaaacacagagaatagat

SEQ ID NO: 7260866 - DNA, 22 bp, Homo sapiens
tgcacacacggagataggcttt

SEQ ID NO: 7260867 - DNA, 22 bp, Homo sapiens
tgcacacacatgcagagggaga

SEQ ID NO: 7260868 - DNA, 22 bp, Homo sapiens
tgcacacacatgaagtagcatg

SEQ ID NO: 7260869 - DNA, 22 bp, Homo sapiens
tgcacacacacgtagagaaaag

SEQ ID NO: 7260870 - DNA, 22 bp, Homo sapiens
tgcacacactctgcatatactt

SEQ ID NO: 7260871 - DNA, 22 bp, Homo sapiens
tgcacacagccagtgagtggca

SEQ ID NO: 7260872 - DNA, 22 bp, Homo sapiens
tgcacacaggtctaggacatgg

SEQ ID NO: 7260873 - DNA, 22 bp, Homo sapiens
tgcacacaggtctaggacatgg

SEQ ID NO: 7260874 - DNA, 17 bp, Homo sapiens
tgcaaacaatcacatat

SEQ ID NO: 7260875 - DNA, 22 bp, Homo sapiens
tgcaaacaccacagagacaatt

SEQ ID NO: 7260876 - DNA, 23 bp, Homo sapiens
tgcaaattaggccgggactcagc

SEQ ID NO: 7260877 - DNA, 22 bp, Homo sapiens
tgcaaattgcatgatgtgtatc

SEQ ID NO: 7260878 - DNA, 22 bp, Homo sapiens
tgattttgtcatgtttctgata

SEQ ID NO: 7260879 - DNA, 22 bp, Homo sapiens
tgattttgaggtttcaggtctt

SEQ ID NO: 7260880 - DNA, 22 bp, Homo sapiens
tgatttcaagtagtgacatgct

SEQ ID NO: 7260881 - DNA, 20 bp, Homo sapiens
tgagtgagtttgtggcagga

SEQ ID NO: 7260882 - DNA, 22 bp, Homo sapiens
tgagtggacacctgcttcttta

SEQ ID NO: 7260883 - DNA, 19 bp, Homo sapiens
tgagtgggagcccaggtat

SEQ ID NO: 7260884 - DNA, 22 bp, Homo sapiens
tgagtgggacctgcgtgtgtca

SEQ ID NO: 7260885 - DNA, 19 bp, Homo sapiens
tgagtgggcccctgcagac

SEQ ID NO: 7260886 - DNA, 22 bp, Homo sapiens
tgagttcaaagacaggtatagg

SEQ ID NO: 7260887 - DNA, 22 bp, Homo sapiens
tgatagaagcagaagcatacca

SEQ ID NO: 7260888 - DNA, 22 bp, Homo sapiens
tgatagaaaggaaattaattgg

SEQ ID NO: 7260889 - DNA, 22 bp, Homo sapiens
tgatagaaaatgctgtcaagct

SEQ ID NO: 7260890 - DNA, 22 bp, Homo sapiens
tgagttctgactgtgatgccag

SEQ ID NO: 7260891 - DNA, 22 bp, Homo sapiens
tgagttctcatgaaatctagtt

SEQ ID NO: 7260892 - DNA, 22 bp, Homo sapiens
tgatatctaagaaattctacca

SEQ ID NO: 7260893 - DNA, 22 bp, Homo sapiens
tgatcaaattcaggagtctgga

SEQ ID NO: 7260894 - DNA, 23 bp, Homo sapiens
tgatctctcttgggaggcaatat

SEQ ID NO: 7260895 - DNA, 23 bp, Homo sapiens
tgatggaaatgatctgggtctgt

SEQ ID NO: 7260896 - DNA, 22 bp, Homo sapiens
tgatgaaaatgttcagcaatta

SEQ ID NO: 7260897 - DNA, 22 bp, Homo sapiens
tgatgaatgtcatacataatga

SEQ ID NO: 7260898 - DNA, 22 bp, Homo sapiens
tgatgaataaccttgagcatat

SEQ ID NO: 7260899 - DNA, 22 bp, Homo sapiens
tgatctttggtaatctggcaca

SEQ ID NO: 7260900 - DNA, 22 bp, Homo sapiens
tgatgctctcctaatatgaaaa

SEQ ID NO: 7260901 - DNA, 22 bp, Homo sapiens
tgatgttattagatacaaacca

SEQ ID NO: 7260902 - DNA, 22 bp, Homo sapiens
tgattaactgtctattaatcat

SEQ ID NO: 7260903 - DNA, 22 bp, Homo sapiens
tcttattgtctagattgagatg

SEQ ID NO: 7260904 - DNA, 22 bp, Homo sapiens
tcttattattgttgtaaaagca

SEQ ID NO: 7260905 - DNA, 22 bp, Homo sapiens
tcttattgtttaaaagtacaca

SEQ ID NO: 7260906 - DNA, 22 bp, Homo sapiens
tcttcagattgcactgagcaag

SEQ ID NO: 7260907 - DNA, 22 bp, Homo sapiens
tcttcagatggccagttgtccc

SEQ ID NO: 7260908 - DNA, 22 bp, Homo sapiens
tcttcacatattccttgagcta

SEQ ID NO: 7260909 - DNA, 22 bp, Homo sapiens
tcttcagtcaatccagatgttt

SEQ ID NO: 7260910 - DNA, 22 bp, Homo sapiens
tcttccaattagaatatttggg

SEQ ID NO: 7260911 - DNA, 22 bp, Homo sapiens
tcttccaattagaatatttggg

SEQ ID NO: 7260912 - DNA, 22 bp, Homo sapiens
tcttccaatggtttctagattt

SEQ ID NO: 7260913 - DNA, 22 bp, Homo sapiens
tcttccaatggtttctagattt

SEQ ID NO: 7260914 - DNA, 22 bp, Homo sapiens
tcttccaaggttgcacactatc

SEQ ID NO: 7260915 - DNA, 21 bp, Homo sapiens
tcttccaagggctgctgagac

SEQ ID NO: 7260916 - DNA, 18 bp, Homo sapiens
tcttccaacactgacacc

SEQ ID NO: 7260917 - DNA, 22 bp, Homo sapiens
tcttccaaatgcagctaaagct

SEQ ID NO: 7260918 - DNA, 22 bp, Homo sapiens
tcttccaaaattagtctcagtt

SEQ ID NO: 7260919 - DNA, 22 bp, Homo sapiens
tcttcctgctttggtgaggctt

SEQ ID NO: 7260920 - DNA, 22 bp, Homo sapiens
tcttcctggatgggggttgatg

SEQ ID NO: 7260921 - DNA, 22 bp, Homo sapiens
tcttcctgaaaccctgttccag

SEQ ID NO: 7260922 - DNA, 22 bp, Homo sapiens
tcttctttggatgaaagaatat

SEQ ID NO: 7260923 - DNA, 22 bp, Homo sapiens
tcttctttttgtcccacagaat

SEQ ID NO: 7260924 - DNA, 22 bp, Homo sapiens
tcttcttaaagtatgttctctt

SEQ ID NO: 7260925 - DNA, 22 bp, Homo sapiens
tcttctttgaatcatagtgacc

SEQ ID NO: 7260926 - DNA, 22 bp, Homo sapiens
tcttctttatgtcatatgccag

SEQ ID NO: 7260927 - DNA, 22 bp, Homo sapiens
tcttctctacaccagcagcccc

SEQ ID NO: 7260928 - DNA, 22 bp, Homo sapiens
tctttcccctacatttggttaa

SEQ ID NO: 7260929 - DNA, 20 bp, Homo sapiens
tctttagatttatcttatgt

SEQ ID NO: 7260930 - DNA, 22 bp, Homo sapiens
tctttgaagtatcttaaatggt

SEQ ID NO: 7260931 - DNA, 22 bp, Homo sapiens
tctttgaacttggctgatctct

SEQ ID NO: 7260932 - DNA, 22 bp, Homo sapiens
tctttctacattttatatgctt

SEQ ID NO: 7260933 - DNA, 22 bp, Homo sapiens
tctttcgggggagttccggaca

SEQ ID NO: 7260934 - DNA, 22 bp, Homo sapiens
tctttagaaacttttcttcatg

SEQ ID NO: 7260935 - DNA, 22 bp, Homo sapiens
tcttggcttctgtatttcctgt

SEQ ID NO: 7260936 - DNA, 19 bp, Homo sapiens
tcttgaggaaagtaaggca

SEQ ID NO: 7260937 - DNA, 22 bp, Homo sapiens
tcttgaaaggagattggaggca

SEQ ID NO: 7260938 - DNA, 22 bp, Homo sapiens
tcttggagactcttgtatattt

SEQ ID NO: 7260939 - DNA, 22 bp, Homo sapiens
tcttggaagggttgtgggatga

SEQ ID NO: 7260940 - DNA, 22 bp, Homo sapiens
tctgtcacccaggctggagtgc

SEQ ID NO: 7260941 - DNA, 22 bp, Homo sapiens
tctgtctcctcagatgactcca

SEQ ID NO: 7260942 - DNA, 22 bp, Homo sapiens
tctgtctacagggagaatgata

SEQ ID NO: 7260943 - DNA, 23 bp, Homo sapiens
tctgtctgaataatttactcttt

SEQ ID NO: 7260944 - DNA, 21 bp, Homo sapiens
tctgtacatcattgagtcccc

SEQ ID NO: 7260945 - DNA, 22 bp, Homo sapiens
tctgtacagtaccagatagtaa

SEQ ID NO: 7260946 - DNA, 22 bp, Homo sapiens
tctgtagtaggttgtagttctt

SEQ ID NO: 7260947 - DNA, 22 bp, Homo sapiens
tctgtactgagcatggtgctta

SEQ ID NO: 7260948 - DNA, 22 bp, Homo sapiens
tctgtactttacatgcagtgct

SEQ ID NO: 7260949 - DNA, 22 bp, Homo sapiens
tctgtacttgttagtcttcatg

SEQ ID NO: 7260950 - DNA, 22 bp, Homo sapiens
tctgtacttcctttaaacttta

SEQ ID NO: 7260951 - DNA, 22 bp, Homo sapiens
tctgtacttacaacggagttca

SEQ ID NO: 7260952 - DNA, 23 bp, Homo sapiens
tctgtacttagactggggcagaa

SEQ ID NO: 7260953 - DNA, 20 bp, Homo sapiens
tctgtactggagacctttat

SEQ ID NO: 7260954 - DNA, 22 bp, Homo sapiens
tctgtacttttattttggcact

SEQ ID NO: 7260955 - DNA, 21 bp, Homo sapiens
tctgtactttgcttccatgct

SEQ ID NO: 7260956 - DNA, 22 bp, Homo sapiens
tctgtaaaacaatattgtattc

SEQ ID NO: 7260957 - DNA, 22 bp, Homo sapiens
tctgggtgtagggcctggcaac

SEQ ID NO: 7260958 - DNA, 22 bp, Homo sapiens
tctgggtgtcactcctgcctgc

SEQ ID NO: 7260959 - DNA, 22 bp, Homo sapiens
tctgggtgtagggcctggcaac

SEQ ID NO: 7260960 - DNA, 22 bp, Homo sapiens
tctgggtggtgtcttccaagac

SEQ ID NO: 7260961 - DNA, 22 bp, Homo sapiens
tctgggtgggcccgagaaatct

SEQ ID NO: 7260962 - DNA, 22 bp, Homo sapiens
tctgggtggcttcagaggccac

SEQ ID NO: 7260963 - DNA, 22 bp, Homo sapiens
tctgggtggcagtgatggcgtg

SEQ ID NO: 7260964 - DNA, 22 bp, Homo sapiens
tctgggtggctgccaatctgcc

SEQ ID NO: 7260965 - DNA, 22 bp, Homo sapiens
tctgggtgaccctgggcaaggc

SEQ ID NO: 7260966 - DNA, 22 bp, Homo sapiens
tctgggtgaccctgggcaaggc

SEQ ID NO: 7260967 - DNA, 22 bp, Homo sapiens
tctgggtgagctgcctcgggtc

SEQ ID NO: 7260968 - DNA, 22 bp, Homo sapiens
tctgggtgatgaaatgcactgt

SEQ ID NO: 7260969 - DNA, 22 bp, Homo sapiens
tctgggtgccactgtctgtaca

SEQ ID NO: 7260970 - DNA, 22 bp, Homo sapiens
tctgggtgccctttgctctgtt

SEQ ID NO: 7260971 - DNA, 22 bp, Homo sapiens
tctgggtgctacaaacagtatt

SEQ ID NO: 7260972 - DNA, 22 bp, Homo sapiens
tctggggttgagtctgggtcag

SEQ ID NO: 7260973 - DNA, 22 bp, Homo sapiens
tctggggttttcacgctgtctc

SEQ ID NO: 7260974 - DNA, 22 bp, Homo sapiens
tctggggtcacctggggtgctt

SEQ ID NO: 7260975 - DNA, 22 bp, Homo sapiens
tctgggggttaagtgaggacaa

SEQ ID NO: 7260976 - DNA, 19 bp, Homo sapiens
tctggggtgtggcctggca

SEQ ID NO: 7260977 - DNA, 22 bp, Homo sapiens
tctggggtggagccctggagtc

SEQ ID NO: 7260978 - DNA, 22 bp, Homo sapiens
tctgggctgggagcgtgtggac

SEQ ID NO: 7260979 - DNA, 22 bp, Homo sapiens
tctgggcttggattggctctgc

SEQ ID NO: 7260980 - DNA, 22 bp, Homo sapiens
tctgggcttgcctggttgtgca

SEQ ID NO: 7260981 - DNA, 22 bp, Homo sapiens
tctgggcttggttagggctgtt

SEQ ID NO: 7260982 - DNA, 21 bp, Homo sapiens
tctgggctttcttataaggca

SEQ ID NO: 7260983 - DNA, 22 bp, Homo sapiens
tctgggctttagtttgttatct

SEQ ID NO: 7260984 - DNA, 21 bp, Homo sapiens
tctgggggtgagcctagaaat

SEQ ID NO: 7260985 - DNA, 22 bp, Homo sapiens
tctgggggcgaccagggactgc

SEQ ID NO: 7260986 - DNA, 22 bp, Homo sapiens
tctgggggcgaccagggactgc

SEQ ID NO: 7260987 - DNA, 22 bp, Homo sapiens
tctgggggaggaggcatggccc

SEQ ID NO: 7260988 - DNA, 22 bp, Homo sapiens
tctggggcagttactggggcct

SEQ ID NO: 7260989 - DNA, 22 bp, Homo sapiens
tctggggcagttactggggcct

SEQ ID NO: 7260990 - DNA, 22 bp, Homo sapiens
tctgggggaggaggcatggccc

SEQ ID NO: 7260991 - DNA, 22 bp, Homo sapiens
tctgttttctctgtattttgac

SEQ ID NO: 7260992 - DNA, 22 bp, Homo sapiens
tctgttttgcataatgttcttt

SEQ ID NO: 7260993 - DNA, 22 bp, Homo sapiens
tctgtttcttcttctgttatat

SEQ ID NO: 7260994 - DNA, 22 bp, Homo sapiens
tctgttttgtaccagatacagc

SEQ ID NO: 7260995 - DNA, 22 bp, Homo sapiens
tctgttttggtcacctttatat

SEQ ID NO: 7260996 - DNA, 22 bp, Homo sapiens
tcttataatctctattttaatg

SEQ ID NO: 7260997 - DNA, 22 bp, Homo sapiens
tcttatatgcacatacattggg

SEQ ID NO: 7260998 - DNA, 22 bp, Homo sapiens
tcttatatgcacatacattggg

SEQ ID NO: 7260999 - DNA, 20 bp, Homo sapiens
tcttaaatccccagggccat

SEQ ID NO: 7261000 - DNA, 22 bp, Homo sapiens
tcttaaatgactgataagagga

SEQ ID NO: 7261001 - DNA, 22 bp, Homo sapiens
tcttaagcagagaagaagttga

SEQ ID NO: 7261002 - DNA, 22 bp, Homo sapiens
tctgtgtgatttcagggaagtc

SEQ ID NO: 7261003 - DNA, 22 bp, Homo sapiens
tctgtgtgatttcagggaagtc

SEQ ID NO: 7261004 - DNA, 22 bp, Homo sapiens
tctgtgttttactccaattata

SEQ ID NO: 7261005 - DNA, 18 bp, Homo sapiens
tctgtgttctgtcattgc

SEQ ID NO: 7261006 - DNA, 22 bp, Homo sapiens
tctgttataaatcacactgcat

SEQ ID NO: 7261007 - DNA, 22 bp, Homo sapiens
tctgttatatagataatgtgtg

SEQ ID NO: 7261008 - DNA, 22 bp, Homo sapiens
tctgttatctcaagtcacaaga

SEQ ID NO: 7261009 - DNA, 22 bp, Homo sapiens
tctgttatacaacaagtaacag

SEQ ID NO: 7261010 - DNA, 22 bp, Homo sapiens
tctgttatacagtctgtggcac

SEQ ID NO: 7261011 - DNA, 22 bp, Homo sapiens
tctgttatgcataagcatcagt

SEQ ID NO: 7261012 - DNA, 20 bp, Homo sapiens
tctgttattattacattgcc

SEQ ID NO: 7261013 - DNA, 20 bp, Homo sapiens
tctgttattattacattgcc

SEQ ID NO: 7261014 - DNA, 22 bp, Homo sapiens
tctgttattctgctcagtatag

SEQ ID NO: 7261015 - DNA, 22 bp, Homo sapiens
tctgttattctgtctattgcca

SEQ ID NO: 7261016 - DNA, 22 bp, Homo sapiens
tctgtttaatgggaatgatact

SEQ ID NO: 7261017 - DNA, 22 bp, Homo sapiens
tctgttgcaatgtgcatggtga

SEQ ID NO: 7261018 - DNA, 22 bp, Homo sapiens
tctgtgcaggatttgaggaacc

SEQ ID NO: 7261019 - DNA, 22 bp, Homo sapiens
tctgtctgcctgtgtccccacc

SEQ ID NO: 7261020 - DNA, 22 bp, Homo sapiens
tctgtctgccccagcaagtcac

SEQ ID NO: 7261021 - DNA, 22 bp, Homo sapiens
tctgtctgcacctaagcacagt

SEQ ID NO: 7261022 - DNA, 22 bp, Homo sapiens
tctgtgataggaaaataaatgg

SEQ ID NO: 7261023 - DNA, 22 bp, Homo sapiens
tctgtgacttacaagaagggac

SEQ ID NO: 7261024 - DNA, 22 bp, Homo sapiens
tctgtgaatatagggcttgtta

SEQ ID NO: 7261025 - DNA, 22 bp, Homo sapiens
tctgtggagttgaggaaggttg

SEQ ID NO: 7261026 - DNA, 22 bp, Homo sapiens
tctgtgtctgcagaagttcagc

SEQ ID NO: 7261027 - DNA, 23 bp, Homo sapiens
tctgtgtctccacccaaatctca

SEQ ID NO: 7261028 - DNA, 22 bp, Homo sapiens
tctgtgtctcaatcccatgctg

SEQ ID NO: 7261029 - DNA, 22 bp, Homo sapiens
tctgtgtctgggcctccgcctg

SEQ ID NO: 7261030 - DNA, 22 bp, Homo sapiens
tctgtgtctgttacttcactgc

SEQ ID NO: 7261031 - DNA, 22 bp, Homo sapiens
tctgtgtctggttgggccagta

SEQ ID NO: 7261032 - DNA, 22 bp, Homo sapiens
tctgtgtcagaagatatcatgg

SEQ ID NO: 7261033 - DNA, 22 bp, Homo sapiens
tctgtgtcactgaggcctgtgt

SEQ ID NO: 7261034 - DNA, 22 bp, Homo sapiens
tctgtgtcagcagcactcagcc

SEQ ID NO: 7261035 - DNA, 22 bp, Homo sapiens
tctgtgtcgttctgtgctctgg

SEQ ID NO: 7261036 - DNA, 22 bp, Homo sapiens
tctgtgtcccttctaatttcag

SEQ ID NO: 7261037 - DNA, 23 bp, Homo sapiens
tctgtgtcctcctggaccacaga

SEQ ID NO: 7261038 - DNA, 22 bp, Homo sapiens
tctgtgtcctgctagctgtctt

SEQ ID NO: 7261039 - DNA, 22 bp, Homo sapiens
tctgtgggtttcagggggctgt

SEQ ID NO: 7261040 - DNA, 22 bp, Homo sapiens
tctgtgggtgcctccagcagtg

SEQ ID NO: 7261041 - DNA, 22 bp, Homo sapiens
tctgtgggtagagtgagtactt

SEQ ID NO: 7261042 - DNA, 22 bp, Homo sapiens
tctgtgggtttcagggggctgt

SEQ ID NO: 7261043 - DNA, 22 bp, Homo sapiens
tctgtgggttttgcagagttgc

SEQ ID NO: 7261044 - DNA, 22 bp, Homo sapiens
tctgtgggggtgtcttaaccta

SEQ ID NO: 7261045 - DNA, 22 bp, Homo sapiens
tctgtggggagcaggagccggg

SEQ ID NO: 7261046 - DNA, 22 bp, Homo sapiens
tctgtggggagcaggagccggg

SEQ ID NO: 7261047 - DNA, 22 bp, Homo sapiens
tctgtgggcatttataatctgg

SEQ ID NO: 7261048 - DNA, 18 bp, Homo sapiens
tctgtgggatcagtgagg

SEQ ID NO: 7261049 - DNA, 22 bp, Homo sapiens
tctgctggccttagcaggtcta

SEQ ID NO: 7261050 - DNA, 22 bp, Homo sapiens
tctgctgtgaggaggcaggatg

SEQ ID NO: 7261051 - DNA, 22 bp, Homo sapiens
tctgctgcctgcagggcagaga

SEQ ID NO: 7261052 - DNA, 22 bp, Homo sapiens
tctggaataaccctgcttccaa

SEQ ID NO: 7261053 - DNA, 22 bp, Homo sapiens
tctggaatcagacctaatccca

SEQ ID NO: 7261054 - DNA, 22 bp, Homo sapiens
tctggaatgatttccttcccct

SEQ ID NO: 7261055 - DNA, 22 bp, Homo sapiens
tctggagaggggcctagaattt

SEQ ID NO: 7261056 - DNA, 22 bp, Homo sapiens
tctggagagatcttccacaaca

SEQ ID NO: 7261057 - DNA, 22 bp, Homo sapiens
tctggagaagaaacttgctctg

SEQ ID NO: 7261058 - DNA, 22 bp, Homo sapiens
tctggatgatatgtgaacttga

SEQ ID NO: 7261059 - DNA, 22 bp, Homo sapiens
tctggatctccctcatcctggg

SEQ ID NO: 7261060 - DNA, 22 bp, Homo sapiens
tctggatcccaccgccacacac

SEQ ID NO: 7261061 - DNA, 22 bp, Homo sapiens
tctggagttgtgcagtggacct

SEQ ID NO: 7261062 - DNA, 22 bp, Homo sapiens
tctggagtggagctgatcattt

SEQ ID NO: 7261063 - DNA, 22 bp, Homo sapiens
tctggaggggtttagagggaca

SEQ ID NO: 7261064 - DNA, 22 bp, Homo sapiens
tctggagggggatgcctcatcc

SEQ ID NO: 7261065 - DNA, 23 bp, Homo sapiens
tctggaggggacactgcagatgc

SEQ ID NO: 7261066 - DNA, 22 bp, Homo sapiens
tctggagggcccacatccacaa

SEQ ID NO: 7261067 - DNA, 18 bp, Homo sapiens
tctggagggaagctttga

SEQ ID NO: 7261068 - DNA, 22 bp, Homo sapiens
tctggaggctctgagggtgagt

SEQ ID NO: 7261069 - DNA, 22 bp, Homo sapiens
tctggagcaacagagcaggaca

SEQ ID NO: 7261070 - DNA, 21 bp, Homo sapiens
tctggagccctaagctgagaa

SEQ ID NO: 7261071 - DNA, 22 bp, Homo sapiens
tctggagccacaaacctcagct

SEQ ID NO: 7261072 - DNA, 22 bp, Homo sapiens
tctggcagtaataggggagaga

SEQ ID NO: 7261073 - DNA, 20 bp, Homo sapiens
tctggcacactgagaagctc

SEQ ID NO: 7261074 - DNA, 22 bp, Homo sapiens
tctggcagaggaaggaggcctg

SEQ ID NO: 7261075 - DNA, 22 bp, Homo sapiens
tctggccactaataggtctcac

SEQ ID NO: 7261076 - DNA, 22 bp, Homo sapiens
tctggccacccgaggcccctgc

SEQ ID NO: 7261077 - DNA, 22 bp, Homo sapiens
tctggccagaaagacttgatgt

SEQ ID NO: 7261078 - DNA, 22 bp, Homo sapiens
tctggccaaccctcaagttgta

SEQ ID NO: 7261079 - DNA, 22 bp, Homo sapiens
tctggccaatgttgtgatcaca

SEQ ID NO: 7261080 - DNA, 22 bp, Homo sapiens
tctggctgggctgacattgaac

SEQ ID NO: 7261081 - DNA, 22 bp, Homo sapiens
tctggctgtcattggaggcccc

SEQ ID NO: 7261082 - DNA, 22 bp, Homo sapiens
tctggctgtgtaaggtagcacc

SEQ ID NO: 7261083 - DNA, 22 bp, Homo sapiens
tctggctgtgtaaggtagcacc

SEQ ID NO: 7261084 - DNA, 22 bp, Homo sapiens
tctggctggctcggccgggagt

SEQ ID NO: 7261085 - DNA, 22 bp, Homo sapiens
tctggctggcagtgatggtgtg

SEQ ID NO: 7261086 - DNA, 22 bp, Homo sapiens
tctggcccctggcagtcctgga

SEQ ID NO: 7261087 - DNA, 22 bp, Homo sapiens
tctggccccggtcttcacagct

SEQ ID NO: 7261088 - DNA, 21 bp, Homo sapiens
tctggccctaggttgggcctc

SEQ ID NO: 7261089 - DNA, 22 bp, Homo sapiens
tctggctcctgagtccatgctc

SEQ ID NO: 7261090 - DNA, 19 bp, Homo sapiens
tctggctcctgccaggctg

SEQ ID NO: 7261091 - DNA, 22 bp, Homo sapiens
tctggctgaaaggggctgtgcc

SEQ ID NO: 7261092 - DNA, 22 bp, Homo sapiens
tctgggagtttctgtgggagct

SEQ ID NO: 7261093 - DNA, 22 bp, Homo sapiens
tctgggagtgtgtctggccatc

SEQ ID NO: 7261094 - DNA, 22 bp, Homo sapiens
tctgggaggtggcagggtgcat

SEQ ID NO: 7261095 - DNA, 22 bp, Homo sapiens
tctgggaggtggcagggtgcat

SEQ ID NO: 7261096 - DNA, 22 bp, Homo sapiens
tctgggaggtaaccatgctgat

SEQ ID NO: 7261097 - DNA, 22 bp, Homo sapiens
tctgggaggtactgggaggtgt

SEQ ID NO: 7261098 - DNA, 22 bp, Homo sapiens
tctgggagagcacgtggctgac

SEQ ID NO: 7261099 - DNA, 22 bp, Homo sapiens
tctgggagagctgctgtcagag

SEQ ID NO: 7261100 - DNA, 22 bp, Homo sapiens
tctgggagagcacgtggctgac

SEQ ID NO: 7261101 - DNA, 22 bp, Homo sapiens
tctgggagagcacgtggctgac

SEQ ID NO: 7261102 - DNA, 22 bp, Homo sapiens
tctgggcagcctcaggccaggg

SEQ ID NO: 7261103 - DNA, 22 bp, Homo sapiens
tctgggagtttctgtgggagct

SEQ ID NO: 7261104 - DNA, 22 bp, Homo sapiens
tctgggctgctatgaggcagag

SEQ ID NO: 7261105 - DNA, 22 bp, Homo sapiens
tctgggctgctatgaggcagag

SEQ ID NO: 7261106 - DNA, 23 bp, Homo sapiens
tctgggctgagacttggaaggtc

SEQ ID NO: 7261107 - DNA, 22 bp, Homo sapiens
tctgggcccactcaacttcact

SEQ ID NO: 7261108 - DNA, 22 bp, Homo sapiens
tctgggccagtgatttttccag

SEQ ID NO: 7261109 - DNA, 22 bp, Homo sapiens
tctgggccagatctagggatct

SEQ ID NO: 7261110 - DNA, 23 bp, Homo sapiens
tctgggccacttgtctgcacttc

SEQ ID NO: 7261111 - DNA, 22 bp, Homo sapiens
tctgggccaacccttccatggg

SEQ ID NO: 7261112 - DNA, 22 bp, Homo sapiens
tctgggccctaaaccagctcta

SEQ ID NO: 7261113 - DNA, 21 bp, Homo sapiens
tctgggcccatgctgcctcac

SEQ ID NO: 7261114 - DNA, 22 bp, Homo sapiens
tctgctcagcatccctctgaga

SEQ ID NO: 7261115 - DNA, 22 bp, Homo sapiens
tctgctcagccgatctgctccg

SEQ ID NO: 7261116 - DNA, 22 bp, Homo sapiens
tctgctcacatggctccatgca

SEQ ID NO: 7261117 - DNA, 22 bp, Homo sapiens
tctgcctggatgatggcagggc

SEQ ID NO: 7261118 - DNA, 22 bp, Homo sapiens
tctgcctgggtgtggagcagag

SEQ ID NO: 7261119 - DNA, 22 bp, Homo sapiens
tctgcctgcggctgcaggtggc

SEQ ID NO: 7261120 - DNA, 22 bp, Homo sapiens
tctgcctgcgctcacggggccg

SEQ ID NO: 7261121 - DNA, 22 bp, Homo sapiens
tctgcctgcagtgtggcagggc

SEQ ID NO: 7261122 - DNA, 22 bp, Homo sapiens
tctgcctgccagtctggtcctc

SEQ ID NO: 7261123 - DNA, 22 bp, Homo sapiens
tctgcctgagggagctgaggaa

SEQ ID NO: 7261124 - DNA, 22 bp, Homo sapiens
tctgccctgcagggagcagtaa

SEQ ID NO: 7261125 - DNA, 18 bp, Homo sapiens
tctgccctgccattcact

SEQ ID NO: 7261126 - DNA, 22 bp, Homo sapiens
tctgccctgccattcactggaa

SEQ ID NO: 7261127 - DNA, 22 bp, Homo sapiens
tctgccctggggtcagcctcca

SEQ ID NO: 7261128 - DNA, 22 bp, Homo sapiens
tctgcccttggctctcttgttg

SEQ ID NO: 7261129 - DNA, 20 bp, Homo sapiens
tctgcccaccccggctccca

SEQ ID NO: 7261130 - DNA, 18 bp, Homo sapiens
tctgcccaggacttggac

SEQ ID NO: 7261131 - DNA, 22 bp, Homo sapiens
tctgccctcattgctgcctgga

SEQ ID NO: 7261132 - DNA, 21 bp, Homo sapiens
tctgccctccaggagctcata

SEQ ID NO: 7261133 - DNA, 23 bp, Homo sapiens
tctgccctctgcctgtttttgta

SEQ ID NO: 7261134 - DNA, 22 bp, Homo sapiens
tctgccctcgaggagcttgtgt

SEQ ID NO: 7261135 - DNA, 22 bp, Homo sapiens
tctgccctcagggtaatgatca

SEQ ID NO: 7261136 - DNA, 22 bp, Homo sapiens
tctgccctaattcagtgcttag

SEQ ID NO: 7261137 - DNA, 22 bp, Homo sapiens
tctgcagaactttatgagcaaa

SEQ ID NO: 7261138 - DNA, 22 bp, Homo sapiens
tctgcaagtagatgacagtgag

SEQ ID NO: 7261139 - DNA, 22 bp, Homo sapiens
tctgcaggactgaggcctgttt

SEQ ID NO: 7261140 - DNA, 18 bp, Homo sapiens
tctgcaggacctcagggc

SEQ ID NO: 7261141 - DNA, 22 bp, Homo sapiens
tctgcaggaagctggcggctga

SEQ ID NO: 7261142 - DNA, 22 bp, Homo sapiens
tctgcagctttttggtggggtg

SEQ ID NO: 7261143 - DNA, 22 bp, Homo sapiens
tctgcaggaggctggctgcagg

SEQ ID NO: 7261144 - DNA, 22 bp, Homo sapiens
tctgcaggagcagggcgtggag

SEQ ID NO: 7261145 - DNA, 22 bp, Homo sapiens
tctgcaggagagtgccctagag

SEQ ID NO: 7261146 - DNA, 22 bp, Homo sapiens
tctgcaggatcagagccagagg

SEQ ID NO: 7261147 - DNA, 17 bp, Homo sapiens
tctgcagggggccgtgt

SEQ ID NO: 7261148 - DNA, 22 bp, Homo sapiens
tctgcagggcccttggctcctg

SEQ ID NO: 7261149 - DNA, 22 bp, Homo sapiens
tctgcagggatgtgaggggtga

SEQ ID NO: 7261150 - DNA, 22 bp, Homo sapiens
tctgcaggcttataggatgggt

SEQ ID NO: 7261151 - DNA, 22 bp, Homo sapiens
tctgcaggtgggcccctagaat

SEQ ID NO: 7261152 - DNA, 21 bp, Homo sapiens
tctgcccacactggccactgc

SEQ ID NO: 7261153 - DNA, 22 bp, Homo sapiens
tctgagacccatacaggcccac

SEQ ID NO: 7261154 - DNA, 17 bp, Homo sapiens
tctgagaaaggagaatc

SEQ ID NO: 7261155 - DNA, 19 bp, Homo sapiens
tctgacagccccagtcaac

SEQ ID NO: 7261156 - DNA, 22 bp, Homo sapiens
tctgacagttatataagcacca

SEQ ID NO: 7261157 - DNA, 20 bp, Homo sapiens
tctgaggtatgatagggtct

SEQ ID NO: 7261158 - DNA, 22 bp, Homo sapiens
tctgagggttgtagagagggac

SEQ ID NO: 7261159 - DNA, 22 bp, Homo sapiens
tctgagggttgtagagagggac

SEQ ID NO: 7261160 - DNA, 22 bp, Homo sapiens
tctgagggttggctggctgtag

SEQ ID NO: 7261161 - DNA, 22 bp, Homo sapiens
tctgagggtgggagaaggagct

SEQ ID NO: 7261162 - DNA, 22 bp, Homo sapiens
tctgagggcttgaggggaagta

SEQ ID NO: 7261163 - DNA, 18 bp, Homo sapiens
tctgagggtgcgggagct

SEQ ID NO: 7261164 - DNA, 18 bp, Homo sapiens
tctgagggtgcgggagct

SEQ ID NO: 7261165 - DNA, 22 bp, Homo sapiens
tctgaggcctagagaggggctt

SEQ ID NO: 7261166 - DNA, 21 bp, Homo sapiens
tctgatggtagatgagatgtg

SEQ ID NO: 7261167 - DNA, 22 bp, Homo sapiens
tctgatatttgaagaccattag

SEQ ID NO: 7261168 - DNA, 22 bp, Homo sapiens
tctgaggtcagtgctgcagtta

SEQ ID NO: 7261169 - DNA, 18 bp, Homo sapiens
tctgaggtggacgaggag

SEQ ID NO: 7261170 - DNA, 22 bp, Homo sapiens
tctgcaacattcctctccccac

SEQ ID NO: 7261171 - DNA, 22 bp, Homo sapiens
tctgcaacagtgccctgtaaat

SEQ ID NO: 7261172 - DNA, 22 bp, Homo sapiens
tctagagctttttcctcttgta

SEQ ID NO: 7261173 - DNA, 22 bp, Homo sapiens
tctaggagaaccatcagggagg

SEQ ID NO: 7261174 - DNA, 17 bp, Homo sapiens
tctaggagagcagagct

SEQ ID NO: 7261175 - DNA, 18 bp, Homo sapiens
tctaggagagtacctacc

SEQ ID NO: 7261176 - DNA, 19 bp, Homo sapiens
tctaggagatctgaacctt

SEQ ID NO: 7261177 - DNA, 22 bp, Homo sapiens
tctaggagcatgaagggaaggc

SEQ ID NO: 7261178 - DNA, 22 bp, Homo sapiens
tctaggagctgagagtgtgtac

SEQ ID NO: 7261179 - DNA, 22 bp, Homo sapiens
tctaggagcttaaaggaggcca

SEQ ID NO: 7261180 - DNA, 22 bp, Homo sapiens
tctaggaggcacacaagtagtt

SEQ ID NO: 7261181 - DNA, 22 bp, Homo sapiens
tctaggaggcggagattgcagt

SEQ ID NO: 7261182 - DNA, 22 bp, Homo sapiens
tctaggagtaatgagctagcac

SEQ ID NO: 7261183 - DNA, 22 bp, Homo sapiens
tctaggagttgataaaagggct

SEQ ID NO: 7261184 - DNA, 23 bp, Homo sapiens
tctagcctgtcatcagcctctcc

SEQ ID NO: 7261185 - DNA, 22 bp, Homo sapiens
tctagaaacaggtttctagaaa

SEQ ID NO: 7261186 - DNA, 22 bp, Homo sapiens
tctacagccattttgagcagtg

SEQ ID NO: 7261187 - DNA, 22 bp, Homo sapiens
tctagggggacagctggctgtg

SEQ ID NO: 7261188 - DNA, 22 bp, Homo sapiens
tctagggagaagctctgtctgt

SEQ ID NO: 7261189 - DNA, 22 bp, Homo sapiens
tctagggaacctatcctatgat

SEQ ID NO: 7261190 - DNA, 22 bp, Homo sapiens
tctagggtgtgcggcagggcta

SEQ ID NO: 7261191 - DNA, 22 bp, Homo sapiens
tctagggtgatgattcaggatg

SEQ ID NO: 7261192 - DNA, 20 bp, Homo sapiens
tctagggtggctgtagcagc

SEQ ID NO: 7261193 - DNA, 22 bp, Homo sapiens
tctagggtgtataaggaagcct

SEQ ID NO: 7261194 - DNA, 22 bp, Homo sapiens
tctagttctagatccctgagga

SEQ ID NO: 7261195 - DNA, 22 bp, Homo sapiens
tctataaaactcaagagcaatt

SEQ ID NO: 7261196 - DNA, 22 bp, Homo sapiens
tctataaaactcaagagcaatt

SEQ ID NO: 7261197 - DNA, 22 bp, Homo sapiens
tctataaagggccagatagtag

SEQ ID NO: 7261198 - DNA, 22 bp, Homo sapiens
tctatgaatgacacagataata

SEQ ID NO: 7261199 - DNA, 22 bp, Homo sapiens
tctatgaatgacacagataata

SEQ ID NO: 7261200 - DNA, 22 bp, Homo sapiens
tctatgaagtgcgaagaggcac

SEQ ID NO: 7261201 - DNA, 22 bp, Homo sapiens
tctatgaagtgcaattaactgt

SEQ ID NO: 7261202 - DNA, 22 bp, Homo sapiens
tctatgaacctctgcaatgaca

SEQ ID NO: 7261203 - DNA, 22 bp, Homo sapiens
tctcaatattatatgtcataaa

SEQ ID NO: 7261204 - DNA, 22 bp, Homo sapiens
tctattttcttgccaaaactgc

SEQ ID NO: 7261205 - DNA, 22 bp, Homo sapiens
tctattttatactcaaatcttc

SEQ ID NO: 7261206 - DNA, 22 bp, Homo sapiens
tctatttttatagttgaagtgc

SEQ ID NO: 7261207 - DNA, 22 bp, Homo sapiens
tctcaaactgtgtattataatt

SEQ ID NO: 7261208 - DNA, 22 bp, Homo sapiens
tccttggctagtactggccagc

SEQ ID NO: 7261209 - DNA, 22 bp, Homo sapiens
tcctttctatcttgggtatcta

SEQ ID NO: 7261210 - DNA, 22 bp, Homo sapiens
tcctttcttgtgtatcaaatgg

SEQ ID NO: 7261211 - DNA, 22 bp, Homo sapiens
tcctttcttcttctgcccatgg

SEQ ID NO: 7261212 - DNA, 19 bp, Homo sapiens
tcctttctgttcctgagat

SEQ ID NO: 7261213 - DNA, 22 bp, Homo sapiens
tcctttctgtctttactctgga

SEQ ID NO: 7261214 - DNA, 18 bp, Homo sapiens
tcctttctccctcatctt

SEQ ID NO: 7261215 - DNA, 22 bp, Homo sapiens
tcctttctccttccgacttcat

SEQ ID NO: 7261216 - DNA, 18 bp, Homo sapiens
tccttttctcccacccac

SEQ ID NO: 7261217 - DNA, 22 bp, Homo sapiens
tcgcaccattgcactccagcca

SEQ ID NO: 7261218 - DNA, 22 bp, Homo sapiens
tcgagctctggagccaaggatg

SEQ ID NO: 7261219 - DNA, 22 bp, Homo sapiens
tcgaaataatttagaatataga

SEQ ID NO: 7261220 - DNA, 22 bp, Homo sapiens
tccttttttatgaagctttgag

SEQ ID NO: 7261221 - DNA, 22 bp, Homo sapiens
tcgtcctgtgcacctgcctgca

SEQ ID NO: 7261222 - DNA, 22 bp, Homo sapiens
tcgccagggatgctgtaaggaa

SEQ ID NO: 7261223 - DNA, 22 bp, Homo sapiens
tcgttttaccaaattgaatgtt

SEQ ID NO: 7261224 - DNA, 19 bp, Homo sapiens
tcgtggggaggtgggcagc

SEQ ID NO: 7261225 - DNA, 22 bp, Homo sapiens
tctaaaatgcagatctactggt

SEQ ID NO: 7261226 - DNA, 20 bp, Homo sapiens
tccttaagtacctaagagtg

SEQ ID NO: 7261227 - DNA, 22 bp, Homo sapiens
tccttaaatgaactctgcatga

SEQ ID NO: 7261228 - DNA, 22 bp, Homo sapiens
tccttaaatccttcagagatta

SEQ ID NO: 7261229 - DNA, 22 bp, Homo sapiens
tccttagacaaagagtgggctt

SEQ ID NO: 7261230 - DNA, 22 bp, Homo sapiens
tccttgaagcaacgtgcagaca

SEQ ID NO: 7261231 - DNA, 22 bp, Homo sapiens
tccttcagggggccgcctgcac

SEQ ID NO: 7261232 - DNA, 23 bp, Homo sapiens
tccttcctttgagaggctccatc

SEQ ID NO: 7261233 - DNA, 22 bp, Homo sapiens
tccttctctacaaatccaggca

SEQ ID NO: 7261234 - DNA, 19 bp, Homo sapiens
tccttctccggccaccccg

SEQ ID NO: 7261235 - DNA, 22 bp, Homo sapiens
tcctggtggctctttgggaagg

SEQ ID NO: 7261236 - DNA, 22 bp, Homo sapiens
tcctggtggcagattttaggtc

SEQ ID NO: 7261237 - DNA, 22 bp, Homo sapiens
tcctggggtgtgttttgctgct

SEQ ID NO: 7261238 - DNA, 22 bp, Homo sapiens
tcctggggtgtgttttgctgct

SEQ ID NO: 7261239 - DNA, 22 bp, Homo sapiens
tcctggggtcctgactgcttcc

SEQ ID NO: 7261240 - DNA, 20 bp, Homo sapiens
tcctggggtaagccatggtc

SEQ ID NO: 7261241 - DNA, 22 bp, Homo sapiens
tcctggggttttggccgcagct

SEQ ID NO: 7261242 - DNA, 22 bp, Homo sapiens
tcctggggtttagagggaagtg

SEQ ID NO: 7261243 - DNA, 22 bp, Homo sapiens
tcctggggctctgagcgagaca

SEQ ID NO: 7261244 - DNA, 22 bp, Homo sapiens
tcctggggctctttgatgtgat

SEQ ID NO: 7261245 - DNA, 22 bp, Homo sapiens
tcctggggctgcaaggcctgtc

SEQ ID NO: 7261246 - DNA, 21 bp, Homo sapiens
tcctggggggtaggtgagttt

SEQ ID NO: 7261247 - DNA, 22 bp, Homo sapiens
tcctggggctcatgggatttgt

SEQ ID NO: 7261248 - DNA, 22 bp, Homo sapiens
tcctggggccaggcacctctgg

SEQ ID NO: 7261249 - DNA, 22 bp, Homo sapiens
tcctggggccagcactggtgga

SEQ ID NO: 7261250 - DNA, 22 bp, Homo sapiens
tcctggggaggtcgaggctgag

SEQ ID NO: 7261251 - DNA, 16 bp, Homo sapiens
tcctggggatactgga

SEQ ID NO: 7261252 - DNA, 19 bp, Homo sapiens
tcctggggatgtggtcacc

SEQ ID NO: 7261253 - DNA, 22 bp, Homo sapiens
tcctggtgtcctggtctgctag

SEQ ID NO: 7261254 - DNA, 22 bp, Homo sapiens
tcctggtgtcgcctggtcagtt

SEQ ID NO: 7261255 - DNA, 22 bp, Homo sapiens
tcctggtgttactaaattgaaa

SEQ ID NO: 7261256 - DNA, 22 bp, Homo sapiens
tcctggtgtttatgtcacatag

SEQ ID NO: 7261257 - DNA, 22 bp, Homo sapiens
tcctggtggtttgaaaactgaa

SEQ ID NO: 7261258 - DNA, 22 bp, Homo sapiens
tcctggtgtaatggtaagcatg

SEQ ID NO: 7261259 - DNA, 22 bp, Homo sapiens
tcctggtggtgccagctgcagg

SEQ ID NO: 7261260 - DNA, 22 bp, Homo sapiens
tcctggtggtgccggtgcccgg

SEQ ID NO: 7261261 - DNA, 22 bp, Homo sapiens
tcctggtggtctgtgcttcttc

SEQ ID NO: 7261262 - DNA, 22 bp, Homo sapiens
tcctggtggctttccctgcctt

SEQ ID NO: 7261263 - DNA, 22 bp, Homo sapiens
tcctggtgggacagaaaacctc

SEQ ID NO: 7261264 - DNA, 22 bp, Homo sapiens
tcctgtcctctgggtgccccat

SEQ ID NO: 7261265 - DNA, 22 bp, Homo sapiens
tcctgtggagaggactggaggt

SEQ ID NO: 7261266 - DNA, 19 bp, Homo sapiens
tcctgggctgggccaggtc

SEQ ID NO: 7261267 - DNA, 22 bp, Homo sapiens
tcctggggagggttctggctcc

SEQ ID NO: 7261268 - DNA, 22 bp, Homo sapiens
taagaatagtccctagatgtgt

SEQ ID NO: 7261269 - DNA, 22 bp, Homo sapiens
taagaattgtgttgaatagagt

SEQ ID NO: 7261270 - DNA, 22 bp, Homo sapiens
taagaattatctcatggataat

SEQ ID NO: 7261271 - DNA, 22 bp, Homo sapiens
tcctggcccggccgggcctgct

SEQ ID NO: 7261272 - DNA, 22 bp, Homo sapiens
tcctggcccgatccctgtgaag

SEQ ID NO: 7261273 - DNA, 22 bp, Homo sapiens
tcctggccgccgcgtggggccg

SEQ ID NO: 7261274 - DNA, 22 bp, Homo sapiens
tcctggcctcacagtcctgggt

SEQ ID NO: 7261275 - DNA, 22 bp, Homo sapiens
tcctggccaagtagatgtggcg

SEQ ID NO: 7261276 - DNA, 21 bp, Homo sapiens
tcctggccagggcactaggca

SEQ ID NO: 7261277 - DNA, 22 bp, Homo sapiens
tcctggccatgcaagatgagga

SEQ ID NO: 7261278 - DNA, 22 bp, Homo sapiens
tctcgggtcatgatttccatca

SEQ ID NO: 7261279 - DNA, 22 bp, Homo sapiens
tctcgggtttaggtgatagtat

SEQ ID NO: 7261280 - DNA, 22 bp, Homo sapiens
tctcctgggtaaaagggttgat

SEQ ID NO: 7261281 - DNA, 22 bp, Homo sapiens
tctcctgggcttggttgaagtt

SEQ ID NO: 7261282 - DNA, 22 bp, Homo sapiens
tctcctggccctgtcgccatct

SEQ ID NO: 7261283 - DNA, 22 bp, Homo sapiens
tctcctgggcttggttgaagtt

SEQ ID NO: 7261284 - DNA, 18 bp, Homo sapiens
tctcctgggtaggggcct

SEQ ID NO: 7261285 - DNA, 22 bp, Homo sapiens
tctcctgggtaaaagggttgat

SEQ ID NO: 7261286 - DNA, 21 bp, Homo sapiens
tctcctgggtccaacccatgc

SEQ ID NO: 7261287 - DNA, 22 bp, Homo sapiens
tctcctggtacccttcctagca

SEQ ID NO: 7261288 - DNA, 22 bp, Homo sapiens
tctcctgggtgctttatcagaa

SEQ ID NO: 7261289 - DNA, 22 bp, Homo sapiens
tctcctggtatgtatgcacctg

SEQ ID NO: 7261290 - DNA, 20 bp, Homo sapiens
tctcctggtctggtccgtgc

SEQ ID NO: 7261291 - DNA, 22 bp, Homo sapiens
tctcctggtcacctcagaagtc

SEQ ID NO: 7261292 - DNA, 20 bp, Homo sapiens
tctcctggtgacagtaccca

SEQ ID NO: 7261293 - DNA, 22 bp, Homo sapiens
tctcctggtttgttaaataatt

SEQ ID NO: 7261294 - DNA, 22 bp, Homo sapiens
tctcctctgtgccacagcttgg

SEQ ID NO: 7261295 - DNA, 22 bp, Homo sapiens
tctcctctgcgcggcagtgccc

SEQ ID NO: 7261296 - DNA, 22 bp, Homo sapiens
tctcctctactgggtctgcaga

SEQ ID NO: 7261297 - DNA, 22 bp, Homo sapiens
tctcctctatttctgtatgtat

SEQ ID NO: 7261298 - DNA, 22 bp, Homo sapiens
tctcctggaagaataccacact

SEQ ID NO: 7261299 - DNA, 22 bp, Homo sapiens
tctcctggaagtgattcccctg

SEQ ID NO: 7261300 - DNA, 22 bp, Homo sapiens
tctcctggagcaggaaggtggg

SEQ ID NO: 7261301 - DNA, 22 bp, Homo sapiens
tctcctggatagatactatcca

SEQ ID NO: 7261302 - DNA, 22 bp, Homo sapiens
tctcctggagcccagatgctgg

SEQ ID NO: 7261303 - DNA, 22 bp, Homo sapiens
tctcctggcatgtgggtcatct

SEQ ID NO: 7261304 - DNA, 22 bp, Homo sapiens
tctcctggcatttggttgagta

SEQ ID NO: 7261305 - DNA, 22 bp, Homo sapiens
tctcctggcatttggttgagta

SEQ ID NO: 7261306 - DNA, 22 bp, Homo sapiens
tctcctggatggaccttctctt

SEQ ID NO: 7261307 - DNA, 20 bp, Homo sapiens
tctcagggtcttagatggaa

SEQ ID NO: 7261308 - DNA, 17 bp, Homo sapiens
tctcaggggctagccct

SEQ ID NO: 7261309 - DNA, 22 bp, Homo sapiens
tctcaggggcctggagtcctgg

SEQ ID NO: 7261310 - DNA, 22 bp, Homo sapiens
tctcagggctcagagctcaggc

SEQ ID NO: 7261311 - DNA, 22 bp, Homo sapiens
tctcagggcgcagtgaggcagt

SEQ ID NO: 7261312 - DNA, 22 bp, Homo sapiens
tctcagggtttcctgggggctg

SEQ ID NO: 7261313 - DNA, 20 bp, Homo sapiens
tctcagggttcagcaaagta

SEQ ID NO: 7261314 - DNA, 22 bp, Homo sapiens
tctcagggtgaggaaagaattt

SEQ ID NO: 7261315 - DNA, 22 bp, Homo sapiens
tctcatttggctttgttttaaa

SEQ ID NO: 7261316 - DNA, 22 bp, Homo sapiens
tctccaagaaaagatctcagct

SEQ ID NO: 7261317 - DNA, 22 bp, Homo sapiens
tctcagggaccatgatgatgac

SEQ ID NO: 7261318 - DNA, 22 bp, Homo sapiens
tctcagggagggcgagtcagcg

SEQ ID NO: 7261319 - DNA, 22 bp, Homo sapiens
tctcagggcaattctcagcgac

SEQ ID NO: 7261320 - DNA, 22 bp, Homo sapiens
tctcagggagttgaggctgcct

SEQ ID NO: 7261321 - DNA, 18 bp, Homo sapiens
tctcagggcatacccaga

SEQ ID NO: 7261322 - DNA, 22 bp, Homo sapiens
tctcagggcagcaaggaagcat

SEQ ID NO: 7261323 - DNA, 18 bp, Homo sapiens
tctcagcccagctccggc

SEQ ID NO: 7261324 - DNA, 22 bp, Homo sapiens
tctcaggctagtaaaagatggg

SEQ ID NO: 7261325 - DNA, 22 bp, Homo sapiens
tctcagagtttacggggctgaa

SEQ ID NO: 7261326 - DNA, 22 bp, Homo sapiens
tctcagagtttagagctgagcc

SEQ ID NO: 7261327 - DNA, 22 bp, Homo sapiens
tctcagaggtgccctggcatct

SEQ ID NO: 7261328 - DNA, 22 bp, Homo sapiens
tctcagagggaggattactgcc

SEQ ID NO: 7261329 - DNA, 22 bp, Homo sapiens
tctcagagttcctctggagtcc

SEQ ID NO: 7261330 - DNA, 22 bp, Homo sapiens
tctcagagtaattctttaaggt

SEQ ID NO: 7261331 - DNA, 22 bp, Homo sapiens
tctcacagttgtccactgaaaa

SEQ ID NO: 7261332 - DNA, 22 bp, Homo sapiens
tctcagagaggggccgggcctt

SEQ ID NO: 7261333 - DNA, 23 bp, Homo sapiens
tctcagaggattcctgggccttg

SEQ ID NO: 7261334 - DNA, 22 bp, Homo sapiens
tctcagagattcagggagaagt

SEQ ID NO: 7261335 - DNA, 22 bp, Homo sapiens
tctgaaggtgctagagaaagct

SEQ ID NO: 7261336 - DNA, 22 bp, Homo sapiens
tctgaagggctgagtggaggag

SEQ ID NO: 7261337 - DNA, 22 bp, Homo sapiens
tctgaaggtctgagaaccagga

SEQ ID NO: 7261338 - DNA, 23 bp, Homo sapiens
tctctttcaagagcttaatgtgc

SEQ ID NO: 7261339 - DNA, 22 bp, Homo sapiens
tctctttaagtataatcttata

SEQ ID NO: 7261340 - DNA, 22 bp, Homo sapiens
tctcttttctttctggataaaa

SEQ ID NO: 7261341 - DNA, 18 bp, Homo sapiens
tctcttttcccctcattg

SEQ ID NO: 7261342 - DNA, 22 bp, Homo sapiens
tctcttttatgtacaccctgac

SEQ ID NO: 7261343 - DNA, 20 bp, Homo sapiens
tctcttttagcttacagctg

SEQ ID NO: 7261344 - DNA, 22 bp, Homo sapiens
tctctgtcacacaatctacaca

SEQ ID NO: 7261345 - DNA, 22 bp, Homo sapiens
tctcttccatgtttcagcccca

SEQ ID NO: 7261346 - DNA, 22 bp, Homo sapiens
tctcttccagtaagagtcttta

SEQ ID NO: 7261347 - DNA, 22 bp, Homo sapiens
tctcttattttgcctttgacaa

SEQ ID NO: 7261348 - DNA, 22 bp, Homo sapiens
tctcttctaattagggtccatg

SEQ ID NO: 7261349 - DNA, 22 bp, Homo sapiens
tctcttctaattttcccgagta

SEQ ID NO: 7261350 - DNA, 20 bp, Homo sapiens
tctcttctggggagataaaa

SEQ ID NO: 7261351 - DNA, 18 bp, Homo sapiens
tctcttcttggcagtcaa

SEQ ID NO: 7261352 - DNA, 22 bp, Homo sapiens
tctctggggatggacctgggag

SEQ ID NO: 7261353 - DNA, 22 bp, Homo sapiens
tctctgggatcgttttgggctc

SEQ ID NO: 7261354 - DNA, 21 bp, Homo sapiens
tctctgggccctcctgtgggg

SEQ ID NO: 7261355 - DNA, 22 bp, Homo sapiens
tctctggcagacacctccctga

SEQ ID NO: 7261356 - DNA, 22 bp, Homo sapiens
tctctggcagaggccctatccc

SEQ ID NO: 7261357 - DNA, 22 bp, Homo sapiens
tctctggcagggatatctggct

SEQ ID NO: 7261358 - DNA, 21 bp, Homo sapiens
tctctggagttagcagagaga

SEQ ID NO: 7261359 - DNA, 22 bp, Homo sapiens
tctctggaattggctgaggcaa

SEQ ID NO: 7261360 - DNA, 19 bp, Homo sapiens
tctctgcttctcttggcat

SEQ ID NO: 7261361 - DNA, 23 bp, Homo sapiens
tctctggaactggagagtacggt

SEQ ID NO: 7261362 - DNA, 22 bp, Homo sapiens
tctctggagtataaccagggat

SEQ ID NO: 7261363 - DNA, 22 bp, Homo sapiens
tctctggagggctccaggcggg

SEQ ID NO: 7261364 - DNA, 22 bp, Homo sapiens
tctctggagctgcagatccagg

SEQ ID NO: 7261365 - DNA, 22 bp, Homo sapiens
tctctggacttccacctctatt

SEQ ID NO: 7261366 - DNA, 22 bp, Homo sapiens
tctctatttgcctaggcttgtg

SEQ ID NO: 7261367 - DNA, 22 bp, Homo sapiens
tctctcagaggaagaggcagtg

SEQ ID NO: 7261368 - DNA, 22 bp, Homo sapiens
tctctcagggggaaggctgaag

SEQ ID NO: 7261369 - DNA, 22 bp, Homo sapiens
tctctgagcatgccatattgct

SEQ ID NO: 7261370 - DNA, 22 bp, Homo sapiens
tctctgagacagtagcctctgc

SEQ ID NO: 7261371 - DNA, 22 bp, Homo sapiens
tctctgagcccaatgtagcaat

SEQ ID NO: 7261372 - DNA, 22 bp, Homo sapiens
tctctgagcccagtgtccccct

SEQ ID NO: 7261373 - DNA, 22 bp, Homo sapiens
tctctgagcgcattcctccggc

SEQ ID NO: 7261374 - DNA, 22 bp, Homo sapiens
tctctgagctgcttcttgcata

SEQ ID NO: 7261375 - DNA, 20 bp, Homo sapiens
tctctgagcttctcttgggg

SEQ ID NO: 7261376 - DNA, 22 bp, Homo sapiens
tctctgaggttgtttccagcac

SEQ ID NO: 7261377 - DNA, 22 bp, Homo sapiens
tctctgagttctcctccagccc

SEQ ID NO: 7261378 - DNA, 22 bp, Homo sapiens
tctctgagaagttcctttgtga

SEQ ID NO: 7261379 - DNA, 22 bp, Homo sapiens
actgcactccagcctgggtgac

SEQ ID NO: 7261380 - DNA, 22 bp, Homo sapiens
actgcactccaacctgggtgac

SEQ ID NO: 7261381 - DNA, 22 bp, Homo sapiens
actcagaagatataatgactca

SEQ ID NO: 7261382 - DNA, 22 bp, Homo sapiens
actagtttgaaaatatctgatt

SEQ ID NO: 7261383 - DNA, 22 bp, Homo sapiens
aagtcgtggcaggcttgcacga

SEQ ID NO: 7261384 - DNA, 22 bp, Homo sapiens
aatcagaaattctacatcacaa

SEQ ID NO: 7261385 - DNA, 19 bp, Homo sapiens
aatcaggctgaagtgtgtt

SEQ ID NO: 7261386 - DNA, 22 bp, Homo sapiens
aatcaggccatggagaagagat

SEQ ID NO: 7261387 - DNA, 22 bp, Homo sapiens
aatcaggcgtcaggaaagatag

SEQ ID NO: 7261388 - DNA, 22 bp, Homo sapiens
agaaatagaggaaaggtttgac

SEQ ID NO: 7261389 - DNA, 22 bp, Homo sapiens
agaacaaaattagaggagtgca

SEQ ID NO: 7261390 - DNA, 22 bp, Homo sapiens
aatgatttcccctacacagaag

SEQ ID NO: 7261391 - DNA, 22 bp, Homo sapiens
aatactatgtagccaaaataat

SEQ ID NO: 7261392 - DNA, 22 bp, Homo sapiens
actttcttggtcccatgtttga

SEQ ID NO: 7261393 - DNA, 22 bp, Homo sapiens
actttaaaactgatcatcagag

SEQ ID NO: 7261394 - DNA, 22 bp, Homo sapiens
acattcttcttgtgaatttact

SEQ ID NO: 7261395 - DNA, 22 bp, Homo sapiens
aaggagacatttgcagagcacc

SEQ ID NO: 7261396 - DNA, 22 bp, Homo sapiens
aagcattttagataaagcatca

SEQ ID NO: 7261397 - DNA, 22 bp, Homo sapiens
aagcattttgccacttgaagtt

SEQ ID NO: 7261398 - DNA, 22 bp, Homo sapiens
aagcattttgttttaagaatga

SEQ ID NO: 7261399 - DNA, 22 bp, Homo sapiens
acagagagaaacaatcagcagc

SEQ ID NO: 7261400 - DNA, 22 bp, Homo sapiens
acactttgttgtggcatatacg

SEQ ID NO: 7261401 - DNA, 22 bp, Homo sapiens
acagcacaatctgagtcccaga

SEQ ID NO: 7261402 - DNA, 22 bp, Homo sapiens
acagcacaggagttgaatgggc

SEQ ID NO: 7261403 - DNA, 22 bp, Homo sapiens
acagcacagagtggtatggctg

SEQ ID NO: 7261404 - DNA, 19 bp, Homo sapiens
acagcacagaaatatttca

SEQ ID NO: 7261405 - DNA, 22 bp, Homo sapiens
acacagatattttgaatacata

SEQ ID NO: 7261406 - DNA, 22 bp, Homo sapiens
acacatgtgattctaagacagc

SEQ ID NO: 7261407 - DNA, 22 bp, Homo sapiens
acacatgtacagattagtattt

SEQ ID NO: 7261408 - DNA, 22 bp, Homo sapiens
acactttactcttacaccattg

SEQ ID NO: 7261409 - DNA, 22 bp, Homo sapiens
agaggctgtgcccaccaggcaa

SEQ ID NO: 7261410 - DNA, 22 bp, Homo sapiens
aattcttggaaacattactgga

SEQ ID NO: 7261411 - DNA, 22 bp, Homo sapiens
aattcttaatcccataaagtga

SEQ ID NO: 7261412 - DNA, 22 bp, Homo sapiens
acaatgaatatcatgaagtact

SEQ ID NO: 7261413 - DNA, 22 bp, Homo sapiens
acaatgaaccaaatttaccaat

SEQ ID NO: 7261414 - DNA, 22 bp, Homo sapiens
acaatgaacgctttttaactgt

SEQ ID NO: 7261415 - DNA, 22 bp, Homo sapiens
acaatgaacacacaaggaattc

SEQ ID NO: 7261416 - DNA, 22 bp, Homo sapiens
acaatgaaaggtattctgaact

SEQ ID NO: 7261417 - DNA, 22 bp, Homo sapiens
acaagcataagtgagatgaata

SEQ ID NO: 7261418 - DNA, 22 bp, Homo sapiens
acaagcatgtggtaaaaagacc

SEQ ID NO: 7261419 - DNA, 22 bp, Homo sapiens
acaagcatcaggttcagcaata

SEQ ID NO: 7261420 - DNA, 22 bp, Homo sapiens
acaacacatgtgtatatgtgtg

SEQ ID NO: 7261421 - DNA, 22 bp, Homo sapiens
aattaaaagataacccatgagt

SEQ ID NO: 7261422 - DNA, 22 bp, Homo sapiens
aattaaaaaaggagagcttgct

SEQ ID NO: 7261423 - DNA, 22 bp, Homo sapiens
aatgtcttcagtgtatacatgg

SEQ ID NO: 7261424 - DNA, 22 bp, Homo sapiens
aatggtaaatgtaacagcattc

SEQ ID NO: 7261425 - DNA, 22 bp, Homo sapiens
agacaatatgtatattaagaat

SEQ ID NO: 7261426 - DNA, 22 bp, Homo sapiens
agacaattaaaaaattatgctt

SEQ ID NO: 7261427 - DNA, 22 bp, Homo sapiens
aatggagaccctaaggaagagg

SEQ ID NO: 7261428 - DNA, 22 bp, Homo sapiens
aatgggaagtcactactgttac

SEQ ID NO: 7261429 - DNA, 22 bp, Homo sapiens
aagcaatagggtaatctactca

SEQ ID NO: 7261430 - DNA, 22 bp, Homo sapiens
aagcaatagcaacaactttaca

SEQ ID NO: 7261431 - DNA, 22 bp, Homo sapiens
aagcaataaataatttttagta

SEQ ID NO: 7261432 - DNA, 22 bp, Homo sapiens
aatttaagagcatagctccaac

SEQ ID NO: 7261433 - DNA, 22 bp, Homo sapiens
aagaacagattcagcctgaact

SEQ ID NO: 7261434 - DNA, 22 bp, Homo sapiens
aattctataggcaagctatttt

SEQ ID NO: 7261435 - DNA, 22 bp, Homo sapiens
aagaaaatcagttctggtcagt

SEQ ID NO: 7261436 - DNA, 22 bp, Homo sapiens
aatgggaaaagagtatgattta

SEQ ID NO: 7261437 - DNA, 22 bp, Homo sapiens
aatgggaaaagagtatgattta

SEQ ID NO: 7261438 - DNA, 22 bp, Homo sapiens
aaattattttcagaatggagaa

SEQ ID NO: 7261439 - DNA, 23 bp, Homo sapiens
aaattattgctcttcaattgcct

SEQ ID NO: 7261440 - DNA, 22 bp, Homo sapiens
aaatgcattaagtcagaacaat

SEQ ID NO: 7261441 - DNA, 22 bp, Homo sapiens
aaatttctaagtcaagaagaac

SEQ ID NO: 7261442 - DNA, 22 bp, Homo sapiens
aaatttgtcaacttcatatgtt

SEQ ID NO: 7261443 - DNA, 22 bp, Homo sapiens
aaatttgttcaatgtctatttg

SEQ ID NO: 7261444 - DNA, 22 bp, Homo sapiens
aacacagaagtgccaagagcca

SEQ ID NO: 7261445 - DNA, 22 bp, Homo sapiens
aacatatttggctgatattccc

SEQ ID NO: 7261446 - DNA, 22 bp, Homo sapiens
aacatcttgtctaatgtcagct

SEQ ID NO: 7261447 - DNA, 22 bp, Homo sapiens
aaaggttttggtaaggctttaa

SEQ ID NO: 7261448 - DNA, 22 bp, Homo sapiens
aaagtaacctagtaatagtgtc

SEQ ID NO: 7261449 - DNA, 22 bp, Homo sapiens
aaagcagagatcatggcttgta

SEQ ID NO: 7261450 - DNA, 22 bp, Homo sapiens
aagaggaggatgctttacagct

SEQ ID NO: 7261451 - DNA, 22 bp, Homo sapiens
aaagttttagctgtccagttcc

SEQ ID NO: 7261452 - DNA, 22 bp, Homo sapiens
aaagttttagaactaggaagca

SEQ ID NO: 7261453 - DNA, 22 bp, Homo sapiens
aaagtttggatccagcaaaaga

SEQ ID NO: 7261454 - DNA, 22 bp, Homo sapiens
aagcctccttattaaaggatat

SEQ ID NO: 7261455 - DNA, 22 bp, Homo sapiens
aaatctttccctttactatcca

SEQ ID NO: 7261456 - DNA, 22 bp, Homo sapiens
aagatgttgtcgttagtgatga

SEQ ID NO: 7261457 - DNA, 22 bp, Homo sapiens
aaagagatgtgccaaatagcct

SEQ ID NO: 7261458 - DNA, 22 bp, Homo sapiens
aaatagttagccctgcatatat

SEQ ID NO: 7261459 - DNA, 22 bp, Homo sapiens
aaatagttcagcttgtaaaccc

SEQ ID NO: 7261460 - DNA, 22 bp, Homo sapiens
aaagaaatagatggcatttaaa

SEQ ID NO: 7261461 - DNA, 22 bp, Homo sapiens
aaacattagacaccatatgctc

SEQ ID NO: 7261462 - DNA, 20 bp, Homo sapiens
aaacattcatgtacaagtga

SEQ ID NO: 7261463 - DNA, 22 bp, Homo sapiens
aaacatctcaaagaggtatttg

SEQ ID NO: 7261464 - DNA, 22 bp, Homo sapiens
aaaacataaactgacagcccat

SEQ ID NO: 7261465 - DNA, 22 bp, Homo sapiens
aaaacttagctaggcaagtttt

SEQ ID NO: 7261466 - DNA, 22 bp, Homo sapiens
aaaattatggagtatcccaaag

SEQ ID NO: 7261467 - DNA, 20 bp, Homo sapiens
aaaatatgtataactcttct

SEQ ID NO: 7261468 - DNA, 22 bp, Homo sapiens
aaaatactgtggagtgttgaaa

SEQ ID NO: 7261469 - DNA, 20 bp, Homo sapiens
aaaatatgtataactcttct

SEQ ID NO: 7261470 - DNA, 22 bp, Homo sapiens
aaaattcattcctcagactgcc

SEQ ID NO: 7261471 - DNA, 22 bp, Homo sapiens
acagtttgccctgacattctcc

SEQ ID NO: 7261472 - DNA, 22 bp, Homo sapiens
acagtttgttccttttcattgc

SEQ ID NO: 7261473 - DNA, 22 bp, Homo sapiens
acagtaattaaacattctgatt

SEQ ID NO: 7261474 - DNA, 22 bp, Homo sapiens
acagcactttacttctcagtga

SEQ ID NO: 7261475 - DNA, 19 bp, Homo sapiens
aggaatggaattaattctg

SEQ ID NO: 7261476 - DNA, 19 bp, Homo sapiens
aggaatggaattaattctg

SEQ ID NO: 7261477 - DNA, 21 bp, Homo sapiens
accaaaacctatactttctgt

SEQ ID NO: 7261478 - DNA, 22 bp, Homo sapiens
accaggcccaccgcatgctcct

SEQ ID NO: 7261479 - DNA, 22 bp, Homo sapiens
acccaggcctgagagacaggag

SEQ ID NO: 7261480 - DNA, 22 bp, Homo sapiens
acccgatgttggtgctctagta

SEQ ID NO: 7261481 - DNA, 22 bp, Homo sapiens
acattgtgatccgactgattaa

SEQ ID NO: 7261482 - DNA, 22 bp, Homo sapiens
aggctgagggctcctgagggca

SEQ ID NO: 7261483 - DNA, 22 bp, Homo sapiens
acatttatataactcactagga

SEQ ID NO: 7261484 - DNA, 22 bp, Homo sapiens
acatttatatttagtggggaat

SEQ ID NO: 7261485 - DNA, 22 bp, Homo sapiens
acatttattactcaggttgttg

SEQ ID NO: 7261486 - DNA, 22 bp, Homo sapiens
acatttattttcagctgggaaa

SEQ ID NO: 7261487 - DNA, 22 bp, Homo sapiens
acatttattttggcacggcaca

SEQ ID NO: 7261488 - DNA, 21 bp, Homo sapiens
acatggactgtgaatggggac

SEQ ID NO: 7261489 - DNA, 22 bp, Homo sapiens
acatgagagaaaagtattctga

SEQ ID NO: 7261490 - DNA, 22 bp, Homo sapiens
atcatttacaaactcagcattg

SEQ ID NO: 7261491 - DNA, 22 bp, Homo sapiens
agaacctttctttagaaattca

SEQ ID NO: 7261492 - DNA, 22 bp, Homo sapiens
actgtgactgagcattcacatg

SEQ ID NO: 7261493 - DNA, 22 bp, Homo sapiens
actgtgactgtgtcttctgggc

SEQ ID NO: 7261494 - DNA, 22 bp, Homo sapiens
actgtgaacggactgaagccca

SEQ ID NO: 7261495 - DNA, 22 bp, Homo sapiens
acttccagaattagaatttaag

SEQ ID NO: 7261496 - DNA, 22 bp, Homo sapiens
acttctttcacaatgtttctag

SEQ ID NO: 7261497 - DNA, 22 bp, Homo sapiens
actccaaggccacatgcattcc

SEQ ID NO: 7261498 - DNA, 22 bp, Homo sapiens
actcatttgacactttaaactg

SEQ ID NO: 7261499 - DNA, 22 bp, Homo sapiens
agtctgggctgtctgcaggagt

SEQ ID NO: 7261500 - DNA, 22 bp, Homo sapiens
actgaattagggaacactgaac

SEQ ID NO: 7261501 - DNA, 22 bp, Homo sapiens
acctggacttgaatcctgactt

SEQ ID NO: 7261502 - DNA, 22 bp, Homo sapiens
acctggacctgccacctatgag

SEQ ID NO: 7261503 - DNA, 22 bp, Homo sapiens
acctggacacctgctgtcatct

SEQ ID NO: 7261504 - DNA, 22 bp, Homo sapiens
actatagatgctggcgaggctg

SEQ ID NO: 7261505 - DNA, 22 bp, Homo sapiens
actcattaaataggatgatttt

SEQ ID NO: 7261506 - DNA, 22 bp, Homo sapiens
actaaagatgtctaaatatatt

SEQ ID NO: 7261507 - DNA, 22 bp, Homo sapiens
actaaaacatagccagtcagtg

SEQ ID NO: 7261508 - DNA, 19 bp, Homo sapiens
actaaaaatgatgtttgag

SEQ ID NO: 7261509 - DNA, 17 bp, Homo sapiens
agcccccactcccaagt

SEQ ID NO: 7261510 - DNA, 22 bp, Homo sapiens
cagaaggagcgctaaggtccca

SEQ ID NO: 7261511 - DNA, 22 bp, Homo sapiens
agccaggatggtctcgatcggc

SEQ ID NO: 7261512 - DNA, 22 bp, Homo sapiens
cagaagctggtacaaggcctag

SEQ ID NO: 7261513 - DNA, 19 bp, Homo sapiens
cagaagctgcagtcggata

SEQ ID NO: 7261514 - DNA, 22 bp, Homo sapiens
cagcagaaacccagcaaagcca

SEQ ID NO: 7261515 - DNA, 22 bp, Homo sapiens
agcctccatcccatgcacaaag

SEQ ID NO: 7261516 - DNA, 18 bp, Homo sapiens
agccctccaggtgattct

SEQ ID NO: 7261517 - DNA, 22 bp, Homo sapiens
agccctcctcacatcagcgtcc

SEQ ID NO: 7261518 - DNA, 22 bp, Homo sapiens
cacagtcaatgtagaaatatga

SEQ ID NO: 7261519 - DNA, 22 bp, Homo sapiens
agcaggtgatgtgagtctggaa

SEQ ID NO: 7261520 - DNA, 22 bp, Homo sapiens
cacatcagggctgcttgggggt

SEQ ID NO: 7261521 - DNA, 22 bp, Homo sapiens
agcagaagtgccttagcaatca

SEQ ID NO: 7261522 - DNA, 17 bp, Homo sapiens
agcagaagtcagaggga

SEQ ID NO: 7261523 - DNA, 22 bp, Homo sapiens
agcagaagaggtcttgttgctg

SEQ ID NO: 7261524 - DNA, 22 bp, Homo sapiens
agcagaagaaagccacatgact

SEQ ID NO: 7261525 - DNA, 22 bp, Homo sapiens
caaatgttaagacaggatcaag

SEQ ID NO: 7261526 - DNA, 22 bp, Homo sapiens
attttctatgttgtaattgtta

SEQ ID NO: 7261527 - DNA, 22 bp, Homo sapiens
agcacagagctaggagtggagg

SEQ ID NO: 7261528 - DNA, 22 bp, Homo sapiens
agcacagatttgtcaacataga

SEQ ID NO: 7261529 - DNA, 22 bp, Homo sapiens
caactcctggctgttaggcaca

SEQ ID NO: 7261530 - DNA, 22 bp, Homo sapiens
caactcctccccagcatgccaa

SEQ ID NO: 7261531 - DNA, 22 bp, Homo sapiens
caacttcttggcttcctaatgg

SEQ ID NO: 7261532 - DNA, 22 bp, Homo sapiens
atttcattgaagttaattcttc

SEQ ID NO: 7261533 - DNA, 22 bp, Homo sapiens
agatgtgatgttaggcccttgg

SEQ ID NO: 7261534 - DNA, 22 bp, Homo sapiens
agatgtgagtggctgtacagtg

SEQ ID NO: 7261535 - DNA, 22 bp, Homo sapiens
agatgtgatctgttcaggacaa

SEQ ID NO: 7261536 - DNA, 22 bp, Homo sapiens
agatgtgattcctgctgagctg

SEQ ID NO: 7261537 - DNA, 22 bp, Homo sapiens
agatgtgagaatcaagtgacca

SEQ ID NO: 7261538 - DNA, 22 bp, Homo sapiens
attgttaataactattacattg

SEQ ID NO: 7261539 - DNA, 22 bp, Homo sapiens
atttaagactgacttcaccagt

SEQ ID NO: 7261540 - DNA, 22 bp, Homo sapiens
atttaagactgacttcaccagt

SEQ ID NO: 7261541 - DNA, 22 bp, Homo sapiens
atttattcctttatggctggag

SEQ ID NO: 7261542 - DNA, 22 bp, Homo sapiens
atttattctccagatggcgaga

SEQ ID NO: 7261543 - DNA, 22 bp, Homo sapiens
atttattcctgattcctggctt

SEQ ID NO: 7261544 - DNA, 22 bp, Homo sapiens
atgtttgtcaggattgtaatta

SEQ ID NO: 7261545 - DNA, 22 bp, Homo sapiens
attaaacaatgtaaagttcttg

SEQ ID NO: 7261546 - DNA, 23 bp, Homo sapiens
atgtttgcagtaacccatcctgg

SEQ ID NO: 7261547 - DNA, 22 bp, Homo sapiens
atgtttatgttgggctatattt

SEQ ID NO: 7261548 - DNA, 22 bp, Homo sapiens
atgtttctgaagtttacagata

SEQ ID NO: 7261549 - DNA, 22 bp, Homo sapiens
agacacagcaataactactgtt

SEQ ID NO: 7261550 - DNA, 22 bp, Homo sapiens
atctttagtgtgaatttattga

SEQ ID NO: 7261551 - DNA, 22 bp, Homo sapiens
agaagattatgaattagagcag

SEQ ID NO: 7261552 - DNA, 22 bp, Homo sapiens
agaagaatttctctcatgattt

SEQ ID NO: 7261553 - DNA, 22 bp, Homo sapiens
agaagaatacttgatgttcatg

SEQ ID NO: 7261554 - DNA, 19 bp, Homo sapiens
atctttagcaactttcaaa

SEQ ID NO: 7261555 - DNA, 22 bp, Homo sapiens
atctttagacaggaagcaatca

SEQ ID NO: 7261556 - DNA, 22 bp, Homo sapiens
atctttagcattactttattca

SEQ ID NO: 7261557 - DNA, 22 bp, Homo sapiens
atctttaggcaagttacttaac

SEQ ID NO: 7261558 - DNA, 22 bp, Homo sapiens
atgtccaagtcacagattttca

SEQ ID NO: 7261559 - DNA, 22 bp, Homo sapiens
atggagttctgccagcgctgct

SEQ ID NO: 7261560 - DNA, 22 bp, Homo sapiens
aggagagtaccattgggccgca

SEQ ID NO: 7261561 - DNA, 22 bp, Homo sapiens
aggagagttcacactggtcaga

SEQ ID NO: 7261562 - DNA, 22 bp, Homo sapiens
aggactttagagccagaaagac

SEQ ID NO: 7261563 - DNA, 20 bp, Homo sapiens
aggaaggaagtttgcatgga

SEQ ID NO: 7261564 - DNA, 22 bp, Homo sapiens
aggaaggaagagacaccatttg

SEQ ID NO: 7261565 - DNA, 22 bp, Homo sapiens
cattaagatttttttctactgg

SEQ ID NO: 7261566 - DNA, 22 bp, Homo sapiens
catgcacagtgatatctgaaga

SEQ ID NO: 7261567 - DNA, 22 bp, Homo sapiens
catgcacactgcaacaaggact

SEQ ID NO: 7261568 - DNA, 22 bp, Homo sapiens
catgaaacatcagagatttctc

SEQ ID NO: 7261569 - DNA, 22 bp, Homo sapiens
cagctttgtcatttgatttggg

SEQ ID NO: 7261570 - DNA, 22 bp, Homo sapiens
agcttgaaacgtaccaacattg

SEQ ID NO: 7261571 - DNA, 22 bp, Homo sapiens
agcttgaacctaaaacaataat

SEQ ID NO: 7261572 - DNA, 22 bp, Homo sapiens
agcttgaagccttggcgagatt

SEQ ID NO: 7261573 - DNA, 22 bp, Homo sapiens
agcttgaattattctgctctta

SEQ ID NO: 7261574 - DNA, 22 bp, Homo sapiens
agcttgacagacagatggtagc

SEQ ID NO: 7261575 - DNA, 22 bp, Homo sapiens
agcttgtagaaggccacgagca

SEQ ID NO: 7261576 - DNA, 22 bp, Homo sapiens
agctgtttccataaatgagaca

SEQ ID NO: 7261577 - DNA, 22 bp, Homo sapiens
caggcctgggttcaaatccctt

SEQ ID NO: 7261578 - DNA, 22 bp, Homo sapiens
cctcccagtgcctccagagcag

SEQ ID NO: 7261579 - DNA, 22 bp, Homo sapiens
cctccaggaggaaatggaacac

SEQ ID NO: 7261580 - DNA, 22 bp, Homo sapiens
cccagctccttgtttgcatctc

SEQ ID NO: 7261581 - DNA, 22 bp, Homo sapiens
ccaggccaaattcagtcagcag

SEQ ID NO: 7261582 - DNA, 22 bp, Homo sapiens
aggctgagcctgggcgtggtgg

SEQ ID NO: 7261583 - DNA, 22 bp, Homo sapiens
aggctgagccacggggctggct

SEQ ID NO: 7261584 - DNA, 22 bp, Homo sapiens
aggctgagcaaagggccttacc

SEQ ID NO: 7261585 - DNA, 22 bp, Homo sapiens
atatatactttgacacattctg

SEQ ID NO: 7261586 - DNA, 22 bp, Homo sapiens
atccacagagaggaagaatagt

SEQ ID NO: 7261587 - DNA, 22 bp, Homo sapiens
atcccttgtgctcagcctcttg

SEQ ID NO: 7261588 - DNA, 22 bp, Homo sapiens
atcatttttaagagactcttct

SEQ ID NO: 7261589 - DNA, 22 bp, Homo sapiens
atcattttatggctgagaggac

SEQ ID NO: 7261590 - DNA, 22 bp, Homo sapiens
agtttaatatccttcaactttc

SEQ ID NO: 7261591 - DNA, 22 bp, Homo sapiens
agtttaatcctccagcccaact

SEQ ID NO: 7261592 - DNA, 22 bp, Homo sapiens
agtttaattggaggcgtggctc

SEQ ID NO: 7261593 - DNA, 22 bp, Homo sapiens
agtttaaatcatgttttgtaac

SEQ ID NO: 7261594 - DNA, 22 bp, Homo sapiens
ctgcagcctccaccttttgggt

SEQ ID NO: 7261595 - DNA, 20 bp, Homo sapiens
ataaaataactgccacaaga

SEQ ID NO: 7261596 - DNA, 22 bp, Homo sapiens
agttgcttctcaggaaaggagc

SEQ ID NO: 7261597 - DNA, 22 bp, Homo sapiens
atacttctttaagagtaagtct

SEQ ID NO: 7261598 - DNA, 22 bp, Homo sapiens
atacttctttagcatattgaac

SEQ ID NO: 7261599 - DNA, 22 bp, Homo sapiens
atacttctggtgacaaagtctt

SEQ ID NO: 7261600 - DNA, 22 bp, Homo sapiens
atacttctcatgggctctgagc

SEQ ID NO: 7261601 - DNA, 22 bp, Homo sapiens
atacttctagaaatactatgca

SEQ ID NO: 7261602 - DNA, 22 bp, Homo sapiens
atactttagagctagattgcct

SEQ ID NO: 7261603 - DNA, 22 bp, Homo sapiens
ataatacatggttaacctcttt

SEQ ID NO: 7261604 - DNA, 22 bp, Homo sapiens
cctctgagttggcctgtcttgt

SEQ ID NO: 7261605 - DNA, 22 bp, Homo sapiens
cggagcgctgggggactctgca

SEQ ID NO: 7261606 - DNA, 22 bp, Homo sapiens
agtatatttgttaagattattc

SEQ ID NO: 7261607 - DNA, 22 bp, Homo sapiens
ccttggccctagcctcaggcaa

SEQ ID NO: 7261608 - DNA, 22 bp, Homo sapiens
aggtgctggcgccccaggagac

SEQ ID NO: 7261609 - DNA, 22 bp, Homo sapiens
aggtgctgccccgagaaggatg

SEQ ID NO: 7261610 - DNA, 22 bp, Homo sapiens
ctctcccagtcaggctcaggat

SEQ ID NO: 7261611 - DNA, 20 bp, Homo sapiens
ctctcccagcacagcttcct

SEQ ID NO: 7261612 - DNA, 22 bp, Homo sapiens
ctctgtagaaagagcccaggtg

SEQ ID NO: 7261613 - DNA, 22 bp, Homo sapiens
ctcttcttggcccccatgaggg

SEQ ID NO: 7261614 - DNA, 22 bp, Homo sapiens
ctcagaaattacaaaagggaca

SEQ ID NO: 7261615 - DNA, 22 bp, Homo sapiens
ctcagaaatcccactctgtgta

SEQ ID NO: 7261616 - DNA, 22 bp, Homo sapiens
ctcagcctgtgaagagcagagg

SEQ ID NO: 7261617 - DNA, 23 bp, Homo sapiens
gagaacagccacagagagctgtg

SEQ ID NO: 7261618 - DNA, 22 bp, Homo sapiens
gagaacagatttttctgctgtc

SEQ ID NO: 7261619 - DNA, 22 bp, Homo sapiens
gagaacagagataattttactt

SEQ ID NO: 7261620 - DNA, 22 bp, Homo sapiens
gagaacagaagcattcctaatt

SEQ ID NO: 7261621 - DNA, 22 bp, Homo sapiens
atgccactgcgctctagcctgg

SEQ ID NO: 7261622 - DNA, 22 bp, Homo sapiens
atgccactgcgctccagcctgg

SEQ ID NO: 7261623 - DNA, 22 bp, Homo sapiens
gaggccaggagtgctgtaagtt

SEQ ID NO: 7261624 - DNA, 22 bp, Homo sapiens
atgtgaaaaatttcttattaca

SEQ ID NO: 7261625 - DNA, 19 bp, Homo sapiens
atgaggaactgaggctcag

SEQ ID NO: 7261626 - DNA, 22 bp, Homo sapiens
atgagtgcctaactgtcagatt

SEQ ID NO: 7261627 - DNA, 20 bp, Homo sapiens
atgattttgcactaacttca

SEQ ID NO: 7261628 - DNA, 20 bp, Homo sapiens
atgattttgcactaacttca

SEQ ID NO: 7261629 - DNA, 22 bp, Homo sapiens
atgcaaaagtaactgtgatttt

SEQ ID NO: 7261630 - DNA, 22 bp, Homo sapiens
atgattttttctaacacagtcg

SEQ ID NO: 7261631 - DNA, 22 bp, Homo sapiens
cttggtacctgccctgggcctt

SEQ ID NO: 7261632 - DNA, 22 bp, Homo sapiens
cttgtaaatgcagattctgatt

SEQ ID NO: 7261633 - DNA, 22 bp, Homo sapiens
atctatcacctttaggtttgtt

SEQ ID NO: 7261634 - DNA, 22 bp, Homo sapiens
cttgttctgtgcttcttacatt

SEQ ID NO: 7261635 - DNA, 22 bp, Homo sapiens
atgaaaacggaccagagctatt

SEQ ID NO: 7261636 - DNA, 22 bp, Homo sapiens
atgaaatatcttgaagaaattc

SEQ ID NO: 7261637 - DNA, 22 bp, Homo sapiens
cttttattttgaattaagggct

SEQ ID NO: 7261638 - DNA, 22 bp, Homo sapiens
attgaacagaaaccatcagagt

SEQ ID NO: 7261639 - DNA, 22 bp, Homo sapiens
attgaacagaaaaactcagaga

SEQ ID NO: 7261640 - DNA, 22 bp, Homo sapiens
attgaacattgttctaggaggc

SEQ ID NO: 7261641 - DNA, 23 bp, Homo sapiens
attgaacagagagaaaaacatcc

SEQ ID NO: 7261642 - DNA, 22 bp, Homo sapiens
attgaacagcccaggtttacct

SEQ ID NO: 7261643 - DNA, 22 bp, Homo sapiens
attgaacatacatatccacacc

SEQ ID NO: 7261644 - DNA, 22 bp, Homo sapiens
attctcagctttcaaatagaca

SEQ ID NO: 7261645 - DNA, 22 bp, Homo sapiens
attctacacaacatgatgatgg

SEQ ID NO: 7261646 - DNA, 22 bp, Homo sapiens
attagaatgcagggttcattgt

SEQ ID NO: 7261647 - DNA, 22 bp, Homo sapiens
attaagctccaagttgctctga

SEQ ID NO: 7261648 - DNA, 22 bp, Homo sapiens
attacaataaggtttatttgta

SEQ ID NO: 7261649 - DNA, 22 bp, Homo sapiens
attaaaattccaaggtatgcca

SEQ ID NO: 7261650 - DNA, 22 bp, Homo sapiens
gatgagtgaggacagggtggca

SEQ ID NO: 7261651 - DNA, 22 bp, Homo sapiens
atgtgtttataattactcaatc

SEQ ID NO: 7261652 - DNA, 22 bp, Homo sapiens
atgttttgctggatgttggcta

SEQ ID NO: 7261653 - DNA, 22 bp, Homo sapiens
atgttttatattttgcagcagt

SEQ ID NO: 7261654 - DNA, 22 bp, Homo sapiens
gcctcactgcagccccaggaag

SEQ ID NO: 7261655 - DNA, 22 bp, Homo sapiens
caaaacattctctgcagcaggg

SEQ ID NO: 7261656 - DNA, 22 bp, Homo sapiens
gcctgtgactcgtcttgggcca

SEQ ID NO: 7261657 - DNA, 22 bp, Homo sapiens
caaacttacgtagtcttactac

SEQ ID NO: 7261658 - DNA, 22 bp, Homo sapiens
atttaatttggagagagaaacc

SEQ ID NO: 7261659 - DNA, 22 bp, Homo sapiens
atttaattttctcaacagtgct

SEQ ID NO: 7261660 - DNA, 22 bp, Homo sapiens
attgcttttagtgaaattatat

SEQ ID NO: 7261661 - DNA, 22 bp, Homo sapiens
attgcttttccttaacacatgc

SEQ ID NO: 7261662 - DNA, 22 bp, Homo sapiens
attgcttttgagctagaatttt

SEQ ID NO: 7261663 - DNA, 22 bp, Homo sapiens
atttccttgcaagtttctgtaa

SEQ ID NO: 7261664 - DNA, 22 bp, Homo sapiens
atttccttcccagatttggttc

SEQ ID NO: 7261665 - DNA, 22 bp, Homo sapiens
atttcagtgttggttagcaagc

SEQ ID NO: 7261666 - DNA, 22 bp, Homo sapiens
ggcctcgcggcttctggtggct

SEQ ID NO: 7261667 - DNA, 22 bp, Homo sapiens
cactggcatctaagggtggtag

SEQ ID NO: 7261668 - DNA, 22 bp, Homo sapiens
caacatatgattttgtatataa

SEQ ID NO: 7261669 - DNA, 22 bp, Homo sapiens
caacatatataaggatttacta

SEQ ID NO: 7261670 - DNA, 22 bp, Homo sapiens
caacatcagtcctcatgagaca

SEQ ID NO: 7261671 - DNA, 22 bp, Homo sapiens
caacatttcaaggtctttagga

SEQ ID NO: 7261672 - DNA, 22 bp, Homo sapiens
caacatttgtgatgagcaaact

SEQ ID NO: 7261673 - DNA, 22 bp, Homo sapiens
caacattttcatggccagggag

SEQ ID NO: 7261674 - DNA, 22 bp, Homo sapiens
caacatttgagtaaagaaatgg

SEQ ID NO: 7261675 - DNA, 22 bp, Homo sapiens
caacatttgagtaaagaaatgg

SEQ ID NO: 7261676 - DNA, 22 bp, Homo sapiens
gctgcagtgagccaagatcgtg

SEQ ID NO: 7261677 - DNA, 22 bp, Homo sapiens
caaagtatatttcatagtctca

SEQ ID NO: 7261678 - DNA, 22 bp, Homo sapiens
gctgcagagtgatgaagtgggg

SEQ ID NO: 7261679 - DNA, 22 bp, Homo sapiens
caaggacactccctgctgggca

SEQ ID NO: 7261680 - DNA, 22 bp, Homo sapiens
caaggacagcgtcaggtgcaac

SEQ ID NO: 7261681 - DNA, 21 bp, Homo sapiens
caaggacaggttgcagggcaa

SEQ ID NO: 7261682 - DNA, 22 bp, Homo sapiens
gcttggccagcagccgggatgc

SEQ ID NO: 7261683 - DNA, 22 bp, Homo sapiens
caaggattaatagaatgaatca

SEQ ID NO: 7261684 - DNA, 22 bp, Homo sapiens
gggtgcctacatgtcctccatg

SEQ ID NO: 7261685 - DNA, 22 bp, Homo sapiens
gggagcaggagcctgcctgcca

SEQ ID NO: 7261686 - DNA, 22 bp, Homo sapiens
cagaagcagtgagagatgtgca

SEQ ID NO: 7261687 - DNA, 22 bp, Homo sapiens
cagaaggtgaaggcagaacctt

SEQ ID NO: 7261688 - DNA, 22 bp, Homo sapiens
gggaaagacttattttgacttc

SEQ ID NO: 7261689 - DNA, 22 bp, Homo sapiens
gggaaagaccctgagtcttatt

SEQ ID NO: 7261690 - DNA, 22 bp, Homo sapiens
gtatccatgggggattggttcc

SEQ ID NO: 7261691 - DNA, 20 bp, Homo sapiens
gtaaaatatggtctttgggt

SEQ ID NO: 7261692 - DNA, 22 bp, Homo sapiens
cagcaataaggtaagcttctcc

SEQ ID NO: 7261693 - DNA, 22 bp, Homo sapiens
tcagaagctggtgtcctttgaa

SEQ ID NO: 7261694 - DNA, 22 bp, Homo sapiens
tcagaagctgggtctcagaagc

SEQ ID NO: 7261695 - DNA, 22 bp, Homo sapiens
tcagaagctaaatttgatattt

SEQ ID NO: 7261696 - DNA, 22 bp, Homo sapiens
tcagaaatttaggctggacttg

SEQ ID NO: 7261697 - DNA, 22 bp, Homo sapiens
tcagaaataatgaatgatgggg

SEQ ID NO: 7261698 - DNA, 22 bp, Homo sapiens
tcacccaagaccatcggaagtg

SEQ ID NO: 7261699 - DNA, 22 bp, Homo sapiens
tatttagaacagacaatagaaa

SEQ ID NO: 7261700 - DNA, 22 bp, Homo sapiens
tatctattccaaatatcagcgt

SEQ ID NO: 7261701 - DNA, 22 bp, Homo sapiens
tatacagctatggcaagacaaa

SEQ ID NO: 7261702 - DNA, 22 bp, Homo sapiens
tagttttagtcccattttacag

SEQ ID NO: 7261703 - DNA, 22 bp, Homo sapiens
tatgcacacattagcacagggt

SEQ ID NO: 7261704 - DNA, 22 bp, Homo sapiens
tattaaatatatctgttagttg

SEQ ID NO: 7261705 - DNA, 22 bp, Homo sapiens
tatgtttttcagacgtcctaca

SEQ ID NO: 7261706 - DNA, 22 bp, Homo sapiens
tattaaagggaagttatgcatg

SEQ ID NO: 7261707 - DNA, 22 bp, Homo sapiens
tattaaagagagaatcatcatc

SEQ ID NO: 7261708 - DNA, 22 bp, Homo sapiens
tatgtttttaagagaatgcatt

SEQ ID NO: 7261709 - DNA, 22 bp, Homo sapiens
tatgttttaggaattaattgtt

SEQ ID NO: 7261710 - DNA, 22 bp, Homo sapiens
tcagaagggaaacacaagtgac

SEQ ID NO: 7261711 - DNA, 19 bp, Homo sapiens
cagtttgtccagaggggac

SEQ ID NO: 7261712 - DNA, 22 bp, Homo sapiens
catgcacaaaggtaagatgcgt

SEQ ID NO: 7261713 - DNA, 22 bp, Homo sapiens
catgcacaagggatgatgaaat

SEQ ID NO: 7261714 - DNA, 22 bp, Homo sapiens
tcattttcccactgaagctgtc

SEQ ID NO: 7261715 - DNA, 22 bp, Homo sapiens
tcattttcacacataaatagca

SEQ ID NO: 7261716 - DNA, 22 bp, Homo sapiens
tcattttcacacataaatagca

SEQ ID NO: 7261717 - DNA, 22 bp, Homo sapiens
tcattttcaagtttgaacagga

SEQ ID NO: 7261718 - DNA, 22 bp, Homo sapiens
catgggagctatctccatcact

SEQ ID NO: 7261719 - DNA, 22 bp, Homo sapiens
catctttagttattgaatatag

SEQ ID NO: 7261720 - DNA, 21 bp, Homo sapiens
catcttaattgaaagcagaga

SEQ ID NO: 7261721 - DNA, 22 bp, Homo sapiens
catcttaataaatctcctccct

SEQ ID NO: 7261722 - DNA, 17 bp, Homo sapiens
catcttaactatggact

SEQ ID NO: 7261723 - DNA, 22 bp, Homo sapiens
catcttaaccctcagcctccca

SEQ ID NO: 7261724 - DNA, 22 bp, Homo sapiens
catcttaacaggtctctgaggg

SEQ ID NO: 7261725 - DNA, 22 bp, Homo sapiens
ccagcctcatcatattcctgct

SEQ ID NO: 7261726 - DNA, 21 bp, Homo sapiens
ccagctccaggaccttggatc

SEQ ID NO: 7261727 - DNA, 22 bp, Homo sapiens
tctgagatttgtatggtgagac

SEQ ID NO: 7261728 - DNA, 18 bp, Homo sapiens
ccacagcagagttcttac

SEQ ID NO: 7261729 - DNA, 19 bp, Homo sapiens
ccacaaaattattttagtt

SEQ ID NO: 7261730 - DNA, 22 bp, Homo sapiens
ccaaagtattaaatcttagcaa

SEQ ID NO: 7261731 - DNA, 22 bp, Homo sapiens
catttattagttagttcgatgt

SEQ ID NO: 7261732 - DNA, 22 bp, Homo sapiens
tctctagacatggggaatgtca

SEQ ID NO: 7261733 - DNA, 22 bp, Homo sapiens
ccagaggagatgcctcctctgt

SEQ ID NO: 7261734 - DNA, 22 bp, Homo sapiens
ccagaggaggggggtctttctg

SEQ ID NO: 7261735 - DNA, 21 bp, Homo sapiens
ccagatgcaaatgcagacatt

SEQ ID NO: 7261736 - DNA, 22 bp, Homo sapiens
ccagaggaattgggaaacatgt

SEQ ID NO: 7261737 - DNA, 20 bp, Homo sapiens
ccagaagcactcttcatgtt

SEQ ID NO: 7261738 - DNA, 22 bp, Homo sapiens
ccagaagcacctccttttgtgc

SEQ ID NO: 7261739 - DNA, 22 bp, Homo sapiens
ccagaagcaaaacagacagttt

SEQ ID NO: 7261740 - DNA, 22 bp, Homo sapiens
ccagaagcttcaaggagattct

SEQ ID NO: 7261741 - DNA, 21 bp, Homo sapiens
ccagaagctgcttgcaggcta

SEQ ID NO: 7261742 - DNA, 22 bp, Homo sapiens
ccagaagctatgttttagataa

SEQ ID NO: 7261743 - DNA, 22 bp, Homo sapiens
ccagaagccctttgtttgttgt

SEQ ID NO: 7261744 - DNA, 22 bp, Homo sapiens
ccagaagcagagcctgaggcag

SEQ ID NO: 7261745 - DNA, 22 bp, Homo sapiens
ccagaagcttctacacaggaga

SEQ ID NO: 7261746 - DNA, 22 bp, Homo sapiens
taaatagagaatcagcttggag

SEQ ID NO: 7261747 - DNA, 22 bp, Homo sapiens
caggagatgacagggaagaacc

SEQ ID NO: 7261748 - DNA, 22 bp, Homo sapiens
caggagactcagcatccaggat

SEQ ID NO: 7261749 - DNA, 22 bp, Homo sapiens
taaatgtaccttctgccttact

SEQ ID NO: 7261750 - DNA, 22 bp, Homo sapiens
caggagactatggcccaaggcc

SEQ ID NO: 7261751 - DNA, 22 bp, Homo sapiens
caggagacctggtaagccaagt

SEQ ID NO: 7261752 - DNA, 22 bp, Homo sapiens
gttttctaccagggaagagagt

SEQ ID NO: 7261753 - DNA, 22 bp, Homo sapiens
taaaatgacttcctccaacatc

SEQ ID NO: 7261754 - DNA, 22 bp, Homo sapiens
taaaatcagccgaccatggtgg

SEQ ID NO: 7261755 - DNA, 22 bp, Homo sapiens
taacattaggtagacataagcc

SEQ ID NO: 7261756 - DNA, 22 bp, Homo sapiens
taacattgtcagttcaactgct

SEQ ID NO: 7261757 - DNA, 22 bp, Homo sapiens
taacatttgctgtctcctatgt

SEQ ID NO: 7261758 - DNA, 22 bp, Homo sapiens
taacatttcggtgacagtggga

SEQ ID NO: 7261759 - DNA, 22 bp, Homo sapiens
taacatttagaaagtgtccatt

SEQ ID NO: 7261760 - DNA, 22 bp, Homo sapiens
taacatttaaatttttcacata

SEQ ID NO: 7261761 - DNA, 16 bp, Homo sapiens
taacatttttaaaagg

SEQ ID NO: 7261762 - DNA, 22 bp, Homo sapiens
taattgtatggagaaggctgca

SEQ ID NO: 7261763 - DNA, 22 bp, Homo sapiens
cagctctttgagtattccattt

SEQ ID NO: 7261764 - DNA, 22 bp, Homo sapiens
gtttacatattttaattggtga

SEQ ID NO: 7261765 - DNA, 22 bp, Homo sapiens
gtttattccagcaatctgctta

SEQ ID NO: 7261766 - DNA, 22 bp, Homo sapiens
gtttacatgtaatgtgttattg

SEQ ID NO: 7261767 - DNA, 22 bp, Homo sapiens
gtttacatgcatgcaagaatga

SEQ ID NO: 7261768 - DNA, 22 bp, Homo sapiens
gtttacatgtactcattatact

SEQ ID NO: 7261769 - DNA, 22 bp, Homo sapiens
gtttcaaagcacagctcacatt

SEQ ID NO: 7261770 - DNA, 22 bp, Homo sapiens
gtttcaaaagtcaggctattct

SEQ ID NO: 7261771 - DNA, 22 bp, Homo sapiens
gtttattcttcagcaacatctg

SEQ ID NO: 7261772 - DNA, 22 bp, Homo sapiens
cctgggagccgactgactgtgc

SEQ ID NO: 7261773 - DNA, 21 bp, Homo sapiens
cctgggagatcagctgccttc

SEQ ID NO: 7261774 - DNA, 22 bp, Homo sapiens
tgtgaagcatagattctgtaga

SEQ ID NO: 7261775 - DNA, 22 bp, Homo sapiens
tgtgaagaattaatgtgaatca

SEQ ID NO: 7261776 - DNA, 19 bp, Homo sapiens
tgtgtggttggtgaaactc

SEQ ID NO: 7261777 - DNA, 22 bp, Homo sapiens
cctgggagctgtggaaaggctg

SEQ ID NO: 7261778 - DNA, 22 bp, Homo sapiens
cctgggaggcagaggttgcagt

SEQ ID NO: 7261779 - DNA, 22 bp, Homo sapiens
cctgggaggcggaggttgcagg

SEQ ID NO: 7261780 - DNA, 22 bp, Homo sapiens
cctgggaggcggaggttgcagt

SEQ ID NO: 7261781 - DNA, 22 bp, Homo sapiens
tgtaaactgtagaaaatacttt

SEQ ID NO: 7261782 - DNA, 22 bp, Homo sapiens
tgctggagacatagcaggcagc

SEQ ID NO: 7261783 - DNA, 22 bp, Homo sapiens
tgctggagcatctgagagcatc

SEQ ID NO: 7261784 - DNA, 22 bp, Homo sapiens
cctctgagaggccatctctcct

SEQ ID NO: 7261785 - DNA, 22 bp, Homo sapiens
ccctggcctacaggcccagaga

SEQ ID NO: 7261786 - DNA, 22 bp, Homo sapiens
tggatcatgtgatgtcaggagt

SEQ ID NO: 7261787 - DNA, 22 bp, Homo sapiens
tggatcatcttaagaagtgatt

SEQ ID NO: 7261788 - DNA, 22 bp, Homo sapiens
ccctggagctagtctgagcaga

SEQ ID NO: 7261789 - DNA, 22 bp, Homo sapiens
ctgattttcaaaatgtgttaaa

SEQ ID NO: 7261790 - DNA, 22 bp, Homo sapiens
ctgcagaaagctgagatgatta

SEQ ID NO: 7261791 - DNA, 21 bp, Homo sapiens
ctgcagagcatgcaaaatgtt

SEQ ID NO: 7261792 - DNA, 22 bp, Homo sapiens
ctgcagagcataaatctgaata

SEQ ID NO: 7261793 - DNA, 22 bp, Homo sapiens
ctgatgttcatttcttttgtac

SEQ ID NO: 7261794 - DNA, 22 bp, Homo sapiens
ctgatcctcctttaagtagctg

SEQ ID NO: 7261795 - DNA, 22 bp, Homo sapiens
ctctttttcagccttaccaaag

SEQ ID NO: 7261796 - DNA, 22 bp, Homo sapiens
ttttgttttcttagaaacctgg

SEQ ID NO: 7261797 - DNA, 22 bp, Homo sapiens
tttttaagagattctccagtct

SEQ ID NO: 7261798 - DNA, 22 bp, Homo sapiens
tttttaagctcctttgatgtca

SEQ ID NO: 7261799 - DNA, 22 bp, Homo sapiens
tttttaagagtctggaaatagt

SEQ ID NO: 7261800 - DNA, 22 bp, Homo sapiens
ctgagaaggaagcctccactct

SEQ ID NO: 7261801 - DNA, 22 bp, Homo sapiens
ctgaacaaagaaatagtcatgg

SEQ ID NO: 7261802 - DNA, 22 bp, Homo sapiens
ctgaacatcatagagtgtactt

SEQ ID NO: 7261803 - DNA, 22 bp, Homo sapiens
ctgaacatcccgcagtgcacga

SEQ ID NO: 7261804 - DNA, 22 bp, Homo sapiens
ctgaacattcttgaacatctgt

SEQ ID NO: 7261805 - DNA, 22 bp, Homo sapiens
ctgaacttattgagtgcttgct

SEQ ID NO: 7261806 - DNA, 22 bp, Homo sapiens
ttttattcatagggatggagag

SEQ ID NO: 7261807 - DNA, 22 bp, Homo sapiens
ttttattctaagtatgatggga

SEQ ID NO: 7261808 - DNA, 22 bp, Homo sapiens
ttttattcaaatagttcacact

SEQ ID NO: 7261809 - DNA, 22 bp, Homo sapiens
ttttattcatagggatggagag

SEQ ID NO: 7261810 - DNA, 22 bp, Homo sapiens
ttttattctcaagacaatggga

SEQ ID NO: 7261811 - DNA, 22 bp, Homo sapiens
ttttattctcagctccagagag

SEQ ID NO: 7261812 - DNA, 22 bp, Homo sapiens
ctcctctggcttcctggaggca

SEQ ID NO: 7261813 - DNA, 17 bp, Homo sapiens
ctcctctctgggttact

SEQ ID NO: 7261814 - DNA, 22 bp, Homo sapiens
ctcctctctggagttatgcaga

SEQ ID NO: 7261815 - DNA, 22 bp, Homo sapiens
ctcctctggaaattcctctgcc

SEQ ID NO: 7261816 - DNA, 22 bp, Homo sapiens
tttagaatgtgactgtatttga

SEQ ID NO: 7261817 - DNA, 22 bp, Homo sapiens
tttagaatgttagcgttaaagg

SEQ ID NO: 7261818 - DNA, 22 bp, Homo sapiens
tttagaattggctagtgggaat

SEQ ID NO: 7261819 - DNA, 17 bp, Homo sapiens
tttagaatacaatgttt

SEQ ID NO: 7261820 - DNA, 22 bp, Homo sapiens
tttacatgtccttcaagagcag

SEQ ID NO: 7261821 - DNA, 22 bp, Homo sapiens
tttacatgtcaagactggcagt

SEQ ID NO: 7261822 - DNA, 22 bp, Homo sapiens
tttacatgagtagcagatgttc

SEQ ID NO: 7261823 - DNA, 22 bp, Homo sapiens
ttgttaaaatattggagaaagg

SEQ ID NO: 7261824 - DNA, 22 bp, Homo sapiens
tttaaaaaactagtctgagtct

SEQ ID NO: 7261825 - DNA, 22 bp, Homo sapiens
ctccagggatgagacagagtag

SEQ ID NO: 7261826 - DNA, 22 bp, Homo sapiens
ttggccaacatggtgaaacccc

SEQ ID NO: 7261827 - DNA, 22 bp, Homo sapiens
ttgggagttcctactgcggttt

SEQ ID NO: 7261828 - DNA, 22 bp, Homo sapiens
ttgggagtaataaaaaattcca

SEQ ID NO: 7261829 - DNA, 22 bp, Homo sapiens
ctatttatgtgctattttgtat

SEQ ID NO: 7261830 - DNA, 22 bp, Homo sapiens
ctattcaattttgctattgtag

SEQ ID NO: 7261831 - DNA, 22 bp, Homo sapiens
ctatttcagcagaagccggaga

SEQ ID NO: 7261832 - DNA, 22 bp, Homo sapiens
ctatttcaaggcccagatatga

SEQ ID NO: 7261833 - DNA, 22 bp, Homo sapiens
ctatttcattgtgctgagtctg

SEQ ID NO: 7261834 - DNA, 22 bp, Homo sapiens
ctattttctgtctctatagagt

SEQ ID NO: 7261835 - DNA, 22 bp, Homo sapiens
ctatttttctgtaccctaattt

SEQ ID NO: 7261836 - DNA, 20 bp, Homo sapiens
ttgagcttttagtacagaca

SEQ ID NO: 7261837 - DNA, 22 bp, Homo sapiens
ttccgagggctcggcggccgcc

SEQ ID NO: 7261838 - DNA, 22 bp, Homo sapiens
ctaatttttgttctgcattgaa

SEQ ID NO: 7261839 - DNA, 22 bp, Homo sapiens
ctaattttcccaaggccttcta

SEQ ID NO: 7261840 - DNA, 22 bp, Homo sapiens
ctaatttaatgaatgagtctta

SEQ ID NO: 7261841 - DNA, 22 bp, Homo sapiens
ttcagaaaaaacttcaataagt

SEQ ID NO: 7261842 - DNA, 22 bp, Homo sapiens
ttcagaaacagagtgagtgagt

SEQ ID NO: 7261843 - DNA, 22 bp, Homo sapiens
ttcagaaacatcagtggatgga

SEQ ID NO: 7261844 - DNA, 22 bp, Homo sapiens
ttcagaaaggataattggaagg

SEQ ID NO: 7261845 - DNA, 22 bp, Homo sapiens
ttcagaaaggttaatctggatt

SEQ ID NO: 7261846 - DNA, 22 bp, Homo sapiens
ttcagaaaggtaaatggatttc

SEQ ID NO: 7261847 - DNA, 22 bp, Homo sapiens
gagagctgcaaggtagggcggg

SEQ ID NO: 7261848 - DNA, 22 bp, Homo sapiens
gagagctgggaaagccgtggag

SEQ ID NO: 7261849 - DNA, 22 bp, Homo sapiens
gagagctgggggactgtggatg

SEQ ID NO: 7261850 - DNA, 22 bp, Homo sapiens
gaccatcctggccaacgtggta

SEQ ID NO: 7261851 - DNA, 22 bp, Homo sapiens
gacttcttcatgtcttttccac

SEQ ID NO: 7261852 - DNA, 23 bp, Homo sapiens
gaattcttaaggtcactaaagtc

SEQ ID NO: 7261853 - DNA, 22 bp, Homo sapiens
gaattcttttctttctgaaagt

SEQ ID NO: 7261854 - DNA, 22 bp, Homo sapiens
gacacaggattcctggctctgc

SEQ ID NO: 7261855 - DNA, 22 bp, Homo sapiens
gacacagggacgtgctctgcct

SEQ ID NO: 7261856 - DNA, 22 bp, Homo sapiens
cttctttagggatctcttgctg

SEQ ID NO: 7261857 - DNA, 22 bp, Homo sapiens
cttcttcttttaataaatgtct

SEQ ID NO: 7261858 - DNA, 22 bp, Homo sapiens
cttctttactttctagaaataa

SEQ ID NO: 7261859 - DNA, 22 bp, Homo sapiens
cttgggagtagaggcaggagca

SEQ ID NO: 7261860 - DNA, 22 bp, Homo sapiens
cttgggagacacaagaagacat

SEQ ID NO: 7261861 - DNA, 22 bp, Homo sapiens
gaaaacatccagagatagacct

SEQ ID NO: 7261862 - DNA, 22 bp, Homo sapiens
gaaagtttataggttatataat

SEQ ID NO: 7261863 - DNA, 22 bp, Homo sapiens
gaaagtttctcacacatgcaga

SEQ ID NO: 7261864 - DNA, 22 bp, Homo sapiens
gaaagttttcatatataccaaa

SEQ ID NO: 7261865 - DNA, 22 bp, Homo sapiens
gaacacagtttagaaaatgctg

SEQ ID NO: 7261866 - DNA, 22 bp, Homo sapiens
gatattttgagaaatcctatga

SEQ ID NO: 7261867 - DNA, 22 bp, Homo sapiens
gatacacaagtggaaggagacg

SEQ ID NO: 7261868 - DNA, 22 bp, Homo sapiens
gatgagacagaatagcccaagg

SEQ ID NO: 7261869 - DNA, 22 bp, Homo sapiens
gatgcacatgtgagtatagaag

SEQ ID NO: 7261870 - DNA, 22 bp, Homo sapiens
gatgcacattgaacaatcacaa

SEQ ID NO: 7261871 - DNA, 22 bp, Homo sapiens
gatgcacagccatgttaatgtg

SEQ ID NO: 7261872 - DNA, 22 bp, Homo sapiens
gatgcacaggtgagcaggtgca

SEQ ID NO: 7261873 - DNA, 22 bp, Homo sapiens
gatgcacagtgaccctgccagt

SEQ ID NO: 7261874 - DNA, 22 bp, Homo sapiens
gatgcacagagggcctggaact

SEQ ID NO: 7261875 - DNA, 21 bp, Homo sapiens
gatgcacaatgggtaagtaca

SEQ ID NO: 7261876 - DNA, 22 bp, Homo sapiens
gatgcacaaagcagagggaatc

SEQ ID NO: 7261877 - DNA, 22 bp, Homo sapiens
gatgattttgatgcagtaaaga

SEQ ID NO: 7261878 - DNA, 22 bp, Homo sapiens
gagtgctgtatctgagaaagca

SEQ ID NO: 7261879 - DNA, 22 bp, Homo sapiens
gagtgctggggtgcagagaggt

SEQ ID NO: 7261880 - DNA, 22 bp, Homo sapiens
gagtgctgaatgcgagaacaga

SEQ ID NO: 7261881 - DNA, 22 bp, Homo sapiens
gagtgctgctaatgcaagggtg

SEQ ID NO: 7261882 - DNA, 22 bp, Homo sapiens
gagtgagtgctgggctgaggct

SEQ ID NO: 7261883 - DNA, 22 bp, Homo sapiens
gagttgactcctccagaggagt

SEQ ID NO: 7261884 - DNA, 22 bp, Homo sapiens
gagttaaaggaaaataacttta

SEQ ID NO: 7261885 - DNA, 22 bp, Homo sapiens
gaggtcaggctcaagctgggcc

SEQ ID NO: 7261886 - DNA, 22 bp, Homo sapiens
gcaattgctttagggaaaggta

SEQ ID NO: 7261887 - DNA, 22 bp, Homo sapiens
gcaatagattatgatctacagt

SEQ ID NO: 7261888 - DNA, 22 bp, Homo sapiens
gatttttatataaagtgagaaa

SEQ ID NO: 7261889 - DNA, 22 bp, Homo sapiens
gattttctgagccttcaaattt

SEQ ID NO: 7261890 - DNA, 22 bp, Homo sapiens
gatttttatataaagtgagaaa

SEQ ID NO: 7261891 - DNA, 22 bp, Homo sapiens
gatttcttgataattcaaatcc

SEQ ID NO: 7261892 - DNA, 22 bp, Homo sapiens
gcagaagcacaggtgacgggcc

SEQ ID NO: 7261893 - DNA, 22 bp, Homo sapiens
gcagaagcagaggagcctatga

SEQ ID NO: 7261894 - DNA, 22 bp, Homo sapiens
gcagaagctgggcagcgaggtg

SEQ ID NO: 7261895 - DNA, 22 bp, Homo sapiens
gcagaagctgggagaagggatt

SEQ ID NO: 7261896 - DNA, 22 bp, Homo sapiens
gcagaagcccggtcagcgcacg

SEQ ID NO: 7261897 - DNA, 22 bp, Homo sapiens
gcagaagcagggcaggggcaaa

SEQ ID NO: 7261898 - DNA, 22 bp, Homo sapiens
gcagaagcagcagatgggcgca

SEQ ID NO: 7261899 - DNA, 22 bp, Homo sapiens
gcagaagctgttcgaaggccgc

SEQ ID NO: 7261900 - DNA, 22 bp, Homo sapiens
gatttattggtctttcattggt

SEQ ID NO: 7261901 - DNA, 22 bp, Homo sapiens
gatttattgtccctgtcctgct

SEQ ID NO: 7261902 - DNA, 22 bp, Homo sapiens
gatttatttttaatcagcaggg

SEQ ID NO: 7261903 - DNA, 22 bp, Homo sapiens
gattaagagaagtttcttatcg

SEQ ID NO: 7261904 - DNA, 22 bp, Homo sapiens
gatgtttatatctaacttaagt

SEQ ID NO: 7261905 - DNA, 22 bp, Homo sapiens
gattctttggcctttattgaca

SEQ ID NO: 7261906 - DNA, 22 bp, Homo sapiens
gattctttactcagattttgtt

SEQ ID NO: 7261907 - DNA, 22 bp, Homo sapiens
gcagcctctgcagttcaggagg

SEQ ID NO: 7261908 - DNA, 22 bp, Homo sapiens
gccagatgtagatagcaaggta

SEQ ID NO: 7261909 - DNA, 21 bp, Homo sapiens
gcattaaaagcagttgttggt

SEQ ID NO: 7261910 - DNA, 22 bp, Homo sapiens
gctcatgactgtaatcccagca

SEQ ID NO: 7261911 - DNA, 22 bp, Homo sapiens
gctcagaagatatttgatgctg

SEQ ID NO: 7261912 - DNA, 22 bp, Homo sapiens
gctcagaaatggcagatggaga

SEQ ID NO: 7261913 - DNA, 21 bp, Homo sapiens
gctgaagacaaattctcttag

SEQ ID NO: 7261914 - DNA, 22 bp, Homo sapiens
gctctgtgtccacagctggaaa

SEQ ID NO: 7261915 - DNA, 22 bp, Homo sapiens
gctgggagtttgatttgactgg

SEQ ID NO: 7261916 - DNA, 22 bp, Homo sapiens
gctggagatgctatgcagaggg

SEQ ID NO: 7261917 - DNA, 22 bp, Homo sapiens
gctgagctagaaaaggaccaca

SEQ ID NO: 7261918 - DNA, 22 bp, Homo sapiens
gcctgtggttgctttgggatcc

SEQ ID NO: 7261919 - DNA, 22 bp, Homo sapiens
ggagatgccagaattgcaaatt

SEQ ID NO: 7261920 - DNA, 22 bp, Homo sapiens
ggaaggtgctccctggacagag

SEQ ID NO: 7261921 - DNA, 22 bp, Homo sapiens
ggagctgcacgctctgaagcct

SEQ ID NO: 7261922 - DNA, 18 bp, Homo sapiens
ggaaggtgattcagtttt

SEQ ID NO: 7261923 - DNA, 22 bp, Homo sapiens
ggagttgatcagagtaggaggt

SEQ ID NO: 7261924 - DNA, 22 bp, Homo sapiens
ggagttgacagtttagaagctt

SEQ ID NO: 7261925 - DNA, 17 bp, Homo sapiens
ggagttctgcagtcagg

SEQ ID NO: 7261926 - DNA, 22 bp, Homo sapiens
ggcagagacaccgaatgactct

SEQ ID NO: 7261927 - DNA, 22 bp, Homo sapiens
gggcggatcatttgaggtcagg

SEQ ID NO: 7261928 - DNA, 22 bp, Homo sapiens
gggcggatcacctgaggtcagg

SEQ ID NO: 7261929 - DNA, 22 bp, Homo sapiens
ggctgcagaggcgatctgaggt

SEQ ID NO: 7261930 - DNA, 22 bp, Homo sapiens
ggctttgtggggtgaagtaaag

SEQ ID NO: 7261931 - DNA, 22 bp, Homo sapiens
ggccttcacgtgacctggcgtg

SEQ ID NO: 7261932 - DNA, 22 bp, Homo sapiens
ggccttggcctagccctccagg

SEQ ID NO: 7261933 - DNA, 22 bp, Homo sapiens
taaatctttaggaagctcaaac

SEQ ID NO: 7261934 - DNA, 22 bp, Homo sapiens
taacagcagggttacaggcatt

SEQ ID NO: 7261935 - DNA, 22 bp, Homo sapiens
gtttaaagtagcttccttttgg

SEQ ID NO: 7261936 - DNA, 22 bp, Homo sapiens
gtttaaagtcttggaaggagga

SEQ ID NO: 7261937 - DNA, 22 bp, Homo sapiens
gtttaagaaaattcatgttgtt

SEQ ID NO: 7261938 - DNA, 22 bp, Homo sapiens
gtggtgagttcaggctggggtg

SEQ ID NO: 7261939 - DNA, 22 bp, Homo sapiens
gttcaagaccagcctggccaac

SEQ ID NO: 7261940 - DNA, 22 bp, Homo sapiens
gtccttggctgggcttgcctcg

SEQ ID NO: 7261941 - DNA, 22 bp, Homo sapiens
gtccttgaagccatttcagggc

SEQ ID NO: 7261942 - DNA, 22 bp, Homo sapiens
gtccttgagtaagtcatggtgg

SEQ ID NO: 7261943 - DNA, 22 bp, Homo sapiens
gtcccagggaagaaggcagcac

SEQ ID NO: 7261944 - DNA, 22 bp, Homo sapiens
gtacagcacagagcatcgcaca

SEQ ID NO: 7261945 - DNA, 22 bp, Homo sapiens
gtaaaatagaataacgtggcta

SEQ ID NO: 7261946 - DNA, 23 bp, Homo sapiens
gtaaaatacgcagtgcagtgtga

SEQ ID NO: 7261947 - DNA, 22 bp, Homo sapiens
ggtgtccgcgctgtagaaggtc

SEQ ID NO: 7261948 - DNA, 22 bp, Homo sapiens
ggtgagttctcagcttattgca

SEQ ID NO: 7261949 - DNA, 22 bp, Homo sapiens
gtgggagtggagctcagcatgt

SEQ ID NO: 7261950 - DNA, 22 bp, Homo sapiens
gtgggagtggggaagcagagtg

SEQ ID NO: 7261951 - DNA, 22 bp, Homo sapiens
gtgggagtttgaacttcatgtt

SEQ ID NO: 7261952 - DNA, 22 bp, Homo sapiens
tctcttctgaaacctgtcttta

SEQ ID NO: 7261953 - DNA, 22 bp, Homo sapiens
tctcttctatttgagactattt

SEQ ID NO: 7261954 - DNA, 22 bp, Homo sapiens
tctcttctaacactagaaattc

SEQ ID NO: 7261955 - DNA, 22 bp, Homo sapiens
tctcagaaatactatgttgtca

SEQ ID NO: 7261956 - DNA, 23 bp, Homo sapiens
tctcagaaaggagaagtaatttg

SEQ ID NO: 7261957 - DNA, 22 bp, Homo sapiens
tctcagaaatgacaggaggtac

SEQ ID NO: 7261958 - DNA, 22 bp, Homo sapiens
tctcagaacctcagtttgctct

SEQ ID NO: 7261959 - DNA, 22 bp, Homo sapiens
tctcagaacacccttctatggt

SEQ ID NO: 7261960 - DNA, 22 bp, Homo sapiens
tctcagaactttatatgtatca

SEQ ID NO: 7261961 - DNA, 22 bp, Homo sapiens
tctcagaaggcaagggctgggg

SEQ ID NO: 7261962 - DNA, 22 bp, Homo sapiens
tctcagaaaagagcttcagaaa

SEQ ID NO: 7261963 - DNA, 22 bp, Homo sapiens
tctcagaaaaaggagaaactgg

SEQ ID NO: 7261964 - DNA, 22 bp, Homo sapiens
tctcagaaaaactttgagggta

SEQ ID NO: 7261965 - DNA, 22 bp, Homo sapiens
tctcagagtgacaatgagaatt

SEQ ID NO: 7261966 - DNA, 22 bp, Homo sapiens
tctcatttggctttgttttaaa

SEQ ID NO: 7261967 - DNA, 22 bp, Homo sapiens
tctcatttgcctcatctataaa

SEQ ID NO: 7261968 - DNA, 23 bp, Homo sapiens
tctcatttcccttgatctatctt

SEQ ID NO: 7261969 - DNA, 22 bp, Homo sapiens
tctcatttgtgtgcaattcaga

SEQ ID NO: 7261970 - DNA, 22 bp, Homo sapiens
tctcctcccaggctcttccagg

SEQ ID NO: 7261971 - DNA, 22 bp, Homo sapiens
tctccttgtgctgggtccttcc

SEQ ID NO: 7261972 - DNA, 22 bp, Homo sapiens
tctccttgctacccagtatgtc

SEQ ID NO: 7261973 - DNA, 22 bp, Homo sapiens
tctccttgtaagtaaattttac

SEQ ID NO: 7261974 - DNA, 22 bp, Homo sapiens
tctccttgacaggcaggcagac

SEQ ID NO: 7261975 - DNA, 22 bp, Homo sapiens
tctccaggtaaatggcatcctg

SEQ ID NO: 7261976 - DNA, 22 bp, Homo sapiens
tcctgggaccctgggtgcagag

SEQ ID NO: 7261977 - DNA, 22 bp, Homo sapiens
tcctgtctaaagacctgcaggc

SEQ ID NO: 7261978 - DNA, 19 bp, Homo sapiens
tccttctccggccaccccg

SEQ ID NO: 7261979 - DNA, 22 bp, Homo sapiens
tccttggatctttcctatgatt

SEQ ID NO: 7261980 - DNA, 22 bp, Homo sapiens
tctaaaaaagtctgttcacttg

SEQ ID NO: 7261981 - DNA, 23 bp, Homo sapiens
tctaaaattcatcatttacgttc

SEQ ID NO: 7261982 - DNA, 22 bp, Homo sapiens
tctaaacagtttcactcttaat

SEQ ID NO: 7261983 - DNA, 22 bp, Homo sapiens
tctaaacacgtctctttgaata

SEQ ID NO: 7261984 - DNA, 22 bp, Homo sapiens
tctaaacactaagtcttgatgc

SEQ ID NO: 7261985 - DNA, 22 bp, Homo sapiens
tctaaagatttggattcatttg

SEQ ID NO: 7261986 - DNA, 22 bp, Homo sapiens
tcgcaccattgcactccagcca

SEQ ID NO: 7261987 - DNA, 22 bp, Homo sapiens
tcgtgaggctctgcatcgcaca

SEQ ID NO: 7261988 - DNA, 22 bp, Homo sapiens
tctattttgtttccagctctac

SEQ ID NO: 7261989 - DNA, 22 bp, Homo sapiens
tctattttatactcaaatcttc

SEQ ID NO: 7261990 - DNA, 19 bp, Homo sapiens
tctcacaagcaacattgtt

SEQ ID NO: 7261991 - DNA, 22 bp, Homo sapiens
tctacagagagtcatagactca

SEQ ID NO: 7261992 - DNA, 22 bp, Homo sapiens
tctaagaaatcagatgatgagg

SEQ ID NO: 7261993 - DNA, 22 bp, Homo sapiens
tctaacttgtatgtatagtttt

SEQ ID NO: 7261994 - DNA, 22 bp, Homo sapiens
tctaacttgtgagtatagatga

SEQ ID NO: 7261995 - DNA, 22 bp, Homo sapiens
tctaacttagggaatactttag

SEQ ID NO: 7261996 - DNA, 22 bp, Homo sapiens
tctaacttgaactcatgactgt

SEQ ID NO: 7261997 - DNA, 23 bp, Homo sapiens
tctacccacactgctctagaagg

SEQ ID NO: 7261998 - DNA, 22 bp, Homo sapiens
tctagctgagggtaggagacct

SEQ ID NO: 7261999 - DNA, 22 bp, Homo sapiens
tctgattagagcattcttgagt

SEQ ID NO: 7262000 - DNA, 21 bp, Homo sapiens
tctgatggtagatgagatgtg

SEQ ID NO: 7262001 - DNA, 22 bp, Homo sapiens
tctgacattagattaattggaa

SEQ ID NO: 7262002 - DNA, 22 bp, Homo sapiens
tctgaattttgatgtgcattga

SEQ ID NO: 7262003 - DNA, 22 bp, Homo sapiens
tctgagctgtggccattcttcc

SEQ ID NO: 7262004 - DNA, 22 bp, Homo sapiens
tctgagctgcccctttactttg

SEQ ID NO: 7262005 - DNA, 22 bp, Homo sapiens
tctgcatattgttaatggaatg

SEQ ID NO: 7262006 - DNA, 22 bp, Homo sapiens
tctgcagctttcccctgattta

SEQ ID NO: 7262007 - DNA, 22 bp, Homo sapiens
tctgggagacgtgtgttgtcag

SEQ ID NO: 7262008 - DNA, 22 bp, Homo sapiens
tctgggagagcacgtggctgac

SEQ ID NO: 7262009 - DNA, 22 bp, Homo sapiens
tctgggagagggaaagaagact

SEQ ID NO: 7262010 - DNA, 22 bp, Homo sapiens
tctgggagagctgctgtcagag

SEQ ID NO: 7262011 - DNA, 22 bp, Homo sapiens
tctgggaggtaaccatgctgat

SEQ ID NO: 7262012 - DNA, 22 bp, Homo sapiens
tctgggagggagcctcagaatc

SEQ ID NO: 7262013 - DNA, 22 bp, Homo sapiens
tctgggaggtgttttgagaact

SEQ ID NO: 7262014 - DNA, 22 bp, Homo sapiens
tctgggagtgaagcaacagatg

SEQ ID NO: 7262015 - DNA, 22 bp, Homo sapiens
tctgggagtgtgtctggccatc

SEQ ID NO: 7262016 - DNA, 22 bp, Homo sapiens
tctggacaggggcgctttgggg

SEQ ID NO: 7262017 - DNA, 22 bp, Homo sapiens
tctggacagtagagcaatgatt

SEQ ID NO: 7262018 - DNA, 22 bp, Homo sapiens
tctggacatcctggagaatgac

SEQ ID NO: 7262019 - DNA, 22 bp, Homo sapiens
tctgtgacattgaacatctaca

SEQ ID NO: 7262020 - DNA, 22 bp, Homo sapiens
tctgtttaatgggaatgatact

SEQ ID NO: 7262021 - DNA, 22 bp, Homo sapiens
tctgtttagactcagttgaaac

SEQ ID NO: 7262022 - DNA, 22 bp, Homo sapiens
tctgtttagatgctttatctgt

SEQ ID NO: 7262023 - DNA, 22 bp, Homo sapiens
tctgtttatgcatatttaaaac

SEQ ID NO: 7262024 - DNA, 22 bp, Homo sapiens
tctgtttttgaggctatcttct

SEQ ID NO: 7262025 - DNA, 22 bp, Homo sapiens
tcttaaagcttacttcaattgt

SEQ ID NO: 7262026 - DNA, 22 bp, Homo sapiens
tctgtttcttcttctgttatat

SEQ ID NO: 7262027 - DNA, 22 bp, Homo sapiens
tctgtttattcaatttctatat

SEQ ID NO: 7262028 - DNA, 22 bp, Homo sapiens
tctgtagtctctgatatatctg

SEQ ID NO: 7262029 - DNA, 22 bp, Homo sapiens
tctgtagtctgtgccatagctg

SEQ ID NO: 7262030 - DNA, 22 bp, Homo sapiens
tcttggcagtggaataccagga

SEQ ID NO: 7262031 - DNA, 22 bp, Homo sapiens
tcttgaacttctgcacactcag

SEQ ID NO: 7262032 - DNA, 22 bp, Homo sapiens
tctttacacaagacaagaataa

SEQ ID NO: 7262033 - DNA, 22 bp, Homo sapiens
tctttacatcacaattgtatgg

SEQ ID NO: 7262034 - DNA, 22 bp, Homo sapiens
tctttaattgtggaagagcagc

SEQ ID NO: 7262035 - DNA, 22 bp, Homo sapiens
tctttgaatcctttacatctga

SEQ ID NO: 7262036 - DNA, 20 bp, Homo sapiens
tctttagatttatcttatgt

SEQ ID NO: 7262037 - DNA, 22 bp, Homo sapiens
tcttctctacaccagcagcccc

SEQ ID NO: 7262038 - DNA, 22 bp, Homo sapiens
tcttcttcctcatttatacata

SEQ ID NO: 7262039 - DNA, 20 bp, Homo sapiens
tcttctgttgccttgttctg

SEQ ID NO: 7262040 - DNA, 22 bp, Homo sapiens
tcttccagcttctagaggatgc

SEQ ID NO: 7262041 - DNA, 22 bp, Homo sapiens
tcttcaaagaattttagtaatt

SEQ ID NO: 7262042 - DNA, 22 bp, Homo sapiens
tgatgtttaatactatgctttt

SEQ ID NO: 7262043 - DNA, 22 bp, Homo sapiens
tgatgaaagttcagtagtgaat

SEQ ID NO: 7262044 - DNA, 22 bp, Homo sapiens
tgatatttaagcaaaaatatgg

SEQ ID NO: 7262045 - DNA, 22 bp, Homo sapiens
tgagtgctgtctgtctagcctc

SEQ ID NO: 7262046 - DNA, 22 bp, Homo sapiens
tgagtgctgcattagcagatat

SEQ ID NO: 7262047 - DNA, 22 bp, Homo sapiens
tgagtgctaagaataatctgca

SEQ ID NO: 7262048 - DNA, 21 bp, Homo sapiens
tgagtcttttgcacaaggaat

SEQ ID NO: 7262049 - DNA, 22 bp, Homo sapiens
tgatttcatagtatatacatga

SEQ ID NO: 7262050 - DNA, 22 bp, Homo sapiens
tgattttattggtgaggaaatt

SEQ ID NO: 7262051 - DNA, 22 bp, Homo sapiens
tgcagccttggcaaccagggac

SEQ ID NO: 7262052 - DNA, 22 bp, Homo sapiens
tgcagcaggtatggcaagctcc

SEQ ID NO: 7262053 - DNA, 18 bp, Homo sapiens
tgcagcctgtagtcttgt

SEQ ID NO: 7262054 - DNA, 22 bp, Homo sapiens
tgcagcctggtggtcactggag

SEQ ID NO: 7262055 - DNA, 22 bp, Homo sapiens
tgcagcctggcttcgcgcctcc

SEQ ID NO: 7262056 - DNA, 21 bp, Homo sapiens
tgcagcctctgcccagcagtg

SEQ ID NO: 7262057 - DNA, 22 bp, Homo sapiens
tgcagcctctctgcttcaggaa

SEQ ID NO: 7262058 - DNA, 22 bp, Homo sapiens
tgcagcctagacattctggtca

SEQ ID NO: 7262059 - DNA, 22 bp, Homo sapiens
tgcagcagggcccaggcacaga

SEQ ID NO: 7262060 - DNA, 21 bp, Homo sapiens
tgcagcagagtaagcagggga

SEQ ID NO: 7262061 - DNA, 22 bp, Homo sapiens
tgcaggagacataatagggact

SEQ ID NO: 7262062 - DNA, 21 bp, Homo sapiens
tgcagaaatggtttttctaag

SEQ ID NO: 7262063 - DNA, 22 bp, Homo sapiens
tgcagaaattcagaaagcataa

SEQ ID NO: 7262064 - DNA, 22 bp, Homo sapiens
tgcagaagcagagccggtggcc

SEQ ID NO: 7262065 - DNA, 22 bp, Homo sapiens
tgcagaagcagagagttgccaa

SEQ ID NO: 7262066 - DNA, 22 bp, Homo sapiens
tgcagaagaccttccagggctg

SEQ ID NO: 7262067 - DNA, 22 bp, Homo sapiens
tgcagaagatggtctgagcacc

SEQ ID NO: 7262068 - DNA, 22 bp, Homo sapiens
tgcagaaggcctgacattgcac

SEQ ID NO: 7262069 - DNA, 22 bp, Homo sapiens
tgcagaagctgcaggtcagtgg

SEQ ID NO: 7262070 - DNA, 22 bp, Homo sapiens
tgcagaaggaggaggaaatcca

SEQ ID NO: 7262071 - DNA, 22 bp, Homo sapiens
tgcagaagtgagtcatgaggaa

SEQ ID NO: 7262072 - DNA, 22 bp, Homo sapiens
tgcagaagtattccaggcccca

SEQ ID NO: 7262073 - DNA, 22 bp, Homo sapiens
tgcagaagaatgagcttggagt

SEQ ID NO: 7262074 - DNA, 20 bp, Homo sapiens
tgcagaagaacgttctggtt

SEQ ID NO: 7262075 - DNA, 22 bp, Homo sapiens
tgcagaagaaaacagctgtgtg

SEQ ID NO: 7262076 - DNA, 19 bp, Homo sapiens
tgcagaagacacagtggtg

SEQ ID NO: 7262077 - DNA, 22 bp, Homo sapiens
tgcagaagacacaaggtaacgt

SEQ ID NO: 7262078 - DNA, 22 bp, Homo sapiens
tgcagaagaatgtaggcataag

SEQ ID NO: 7262079 - DNA, 22 bp, Homo sapiens
tgcagagggacagccacagctc

SEQ ID NO: 7262080 - DNA, 23 bp, Homo sapiens
tgcagagggactgaagccagctt

SEQ ID NO: 7262081 - DNA, 21 bp, Homo sapiens
tgcagaggcacaaacaagccc

SEQ ID NO: 7262082 - DNA, 22 bp, Homo sapiens
tgcagagattgaacaagaagga

SEQ ID NO: 7262083 - DNA, 19 bp, Homo sapiens
tgcccaggcctcccaaaag

SEQ ID NO: 7262084 - DNA, 22 bp, Homo sapiens
tgcattccatgtgtttcctgag

SEQ ID NO: 7262085 - DNA, 23 bp, Homo sapiens
tgcatcctcatttttcacacgag

SEQ ID NO: 7262086 - DNA, 21 bp, Homo sapiens
tgaaagaggatgtggtcattc

SEQ ID NO: 7262087 - DNA, 22 bp, Homo sapiens
tctttttctgcacacgtgtccc

SEQ ID NO: 7262088 - DNA, 22 bp, Homo sapiens
tcttttagaaaagttgaatgta

SEQ ID NO: 7262089 - DNA, 22 bp, Homo sapiens
tgaaatgtttgggtccagaagt

SEQ ID NO: 7262090 - DNA, 22 bp, Homo sapiens
tgaacgttcatagttatttgtt

SEQ ID NO: 7262091 - DNA, 22 bp, Homo sapiens
tgaacattagttgagtaaagtc

SEQ ID NO: 7262092 - DNA, 22 bp, Homo sapiens
tgaacattggcacaaggcagca

SEQ ID NO: 7262093 - DNA, 22 bp, Homo sapiens
tgaacattcctgaatgaagcat

SEQ ID NO: 7262094 - DNA, 22 bp, Homo sapiens
tgaacattgtcacattcctagc

SEQ ID NO: 7262095 - DNA, 22 bp, Homo sapiens
tgaacttttatttgatgacagg

SEQ ID NO: 7262096 - DNA, 20 bp, Homo sapiens
tgaagattttgtgtttagaa

SEQ ID NO: 7262097 - DNA, 22 bp, Homo sapiens
tgactctcccaagtttgaggga

SEQ ID NO: 7262098 - DNA, 22 bp, Homo sapiens
tgactctgataagacatatggc

SEQ ID NO: 7262099 - DNA, 22 bp, Homo sapiens
tgacttgtctctttgggagaca

SEQ ID NO: 7262100 - DNA, 20 bp, Homo sapiens
tgacttcttcatgctgtact

SEQ ID NO: 7262101 - DNA, 22 bp, Homo sapiens
tgacttcaaggttcagcacctt

SEQ ID NO: 7262102 - DNA, 22 bp, Homo sapiens
tgaaggtgggaattcaccaggt

SEQ ID NO: 7262103 - DNA, 22 bp, Homo sapiens
tgaaggtgacctgacagtggct

SEQ ID NO: 7262104 - DNA, 18 bp, Homo sapiens
tgagaggctattttttgc

SEQ ID NO: 7262105 - DNA, 22 bp, Homo sapiens
tgagaacagttggaagcagtca

SEQ ID NO: 7262106 - DNA, 22 bp, Homo sapiens
tgagaacggatactaagggctg

SEQ ID NO: 7262107 - DNA, 22 bp, Homo sapiens
tgagacagcagattagcaatga

SEQ ID NO: 7262108 - DNA, 22 bp, Homo sapiens
tgaggtggctggatctcagcct

SEQ ID NO: 7262109 - DNA, 22 bp, Homo sapiens
tgctggaggccgagaagcagca

SEQ ID NO: 7262110 - DNA, 22 bp, Homo sapiens
tgcttctccattgatgctaagt

SEQ ID NO: 7262111 - DNA, 22 bp, Homo sapiens
tgcttcagagaagaatggaaag

SEQ ID NO: 7262112 - DNA, 22 bp, Homo sapiens
tgcttcagaggaaaggcaaaag

SEQ ID NO: 7262113 - DNA, 22 bp, Homo sapiens
tgcttaaaggatagtttaaact

SEQ ID NO: 7262114 - DNA, 22 bp, Homo sapiens
tgctgcagggccttccctgcat

SEQ ID NO: 7262115 - DNA, 17 bp, Homo sapiens
tgcctgtgataagcaca

SEQ ID NO: 7262116 - DNA, 22 bp, Homo sapiens
tgcctgtgaaaaccctggggtt

SEQ ID NO: 7262117 - DNA, 22 bp, Homo sapiens
tgcctgtgacccaaggatgcga

SEQ ID NO: 7262118 - DNA, 22 bp, Homo sapiens
tgccttgaacatagtggacagt

SEQ ID NO: 7262119 - DNA, 22 bp, Homo sapiens
tgcctgtgtatgtgcatgcaca

SEQ ID NO: 7262120 - DNA, 22 bp, Homo sapiens
tgcctgtgtatttccggcctgc

SEQ ID NO: 7262121 - DNA, 22 bp, Homo sapiens
tgcctgtgtcagcaggtggaag

SEQ ID NO: 7262122 - DNA, 22 bp, Homo sapiens
tgcctgtgtcacagtgatgttt

SEQ ID NO: 7262123 - DNA, 22 bp, Homo sapiens
tgcctgtgtccccttcttggca

SEQ ID NO: 7262124 - DNA, 22 bp, Homo sapiens
tgcctgtggagccactagtttt

SEQ ID NO: 7262125 - DNA, 22 bp, Homo sapiens
tgcctgtggaaaggctggtgct

SEQ ID NO: 7262126 - DNA, 22 bp, Homo sapiens
tgcctgtgccctttgctgggag

SEQ ID NO: 7262127 - DNA, 22 bp, Homo sapiens
tgcctgtgctgggattgcatgt

SEQ ID NO: 7262128 - DNA, 22 bp, Homo sapiens
tgcctgtgcccttcttggcatt

SEQ ID NO: 7262129 - DNA, 22 bp, Homo sapiens
tgcctgtgatcagctgagttca

SEQ ID NO: 7262130 - DNA, 22 bp, Homo sapiens
tgcctgtgggcagagggccaga

SEQ ID NO: 7262131 - DNA, 19 bp, Homo sapiens
tgcctgtggcgagcatctt

SEQ ID NO: 7262132 - DNA, 22 bp, Homo sapiens
tgcctgtggttccagttttttc

SEQ ID NO: 7262133 - DNA, 22 bp, Homo sapiens
tgcctgtgggtgatgatttgat

SEQ ID NO: 7262134 - DNA, 22 bp, Homo sapiens
tgcctgtgggtgccaccaccct

SEQ ID NO: 7262135 - DNA, 22 bp, Homo sapiens
tgcgccatgtgctctcggccct

SEQ ID NO: 7262136 - DNA, 22 bp, Homo sapiens
tgctatataatggaatttctaa

SEQ ID NO: 7262137 - DNA, 22 bp, Homo sapiens
tgctatttaacttttatgtgta

SEQ ID NO: 7262138 - DNA, 21 bp, Homo sapiens
tgctatttaatttttctgttc

SEQ ID NO: 7262139 - DNA, 22 bp, Homo sapiens
tgctatttggaaaagcatttgg

SEQ ID NO: 7262140 - DNA, 22 bp, Homo sapiens
tgctatttggcacttttgacct

SEQ ID NO: 7262141 - DNA, 19 bp, Homo sapiens
tgctatttgaagaagtgta

SEQ ID NO: 7262142 - DNA, 19 bp, Homo sapiens
tgctatttgaagaagtgta

SEQ ID NO: 7262143 - DNA, 16 bp, Homo sapiens
tgctattttagagagg

SEQ ID NO: 7262144 - DNA, 22 bp, Homo sapiens
tgctattttagacatactttgt

SEQ ID NO: 7262145 - DNA, 22 bp, Homo sapiens
tgctatttgtgagtgtcttcgt

SEQ ID NO: 7262146 - DNA, 22 bp, Homo sapiens
tgctattttggtctacagcact

SEQ ID NO: 7262147 - DNA, 22 bp, Homo sapiens
tggagaagtcaaagtgaacagg

SEQ ID NO: 7262148 - DNA, 22 bp, Homo sapiens
tggagagtaaatggcagaatca

SEQ ID NO: 7262149 - DNA, 22 bp, Homo sapiens
tggagagtaatttctgaagacc

SEQ ID NO: 7262150 - DNA, 22 bp, Homo sapiens
tggagagtctcaaggcaggaaa

SEQ ID NO: 7262151 - DNA, 22 bp, Homo sapiens
tggagagtctctgagccagggc

SEQ ID NO: 7262152 - DNA, 22 bp, Homo sapiens
tggagagtgtagacttcagagt

SEQ ID NO: 7262153 - DNA, 22 bp, Homo sapiens
tggagagttctgtagatatcta

SEQ ID NO: 7262154 - DNA, 23 bp, Homo sapiens
tggagttgatgtccttctgtgct

SEQ ID NO: 7262155 - DNA, 22 bp, Homo sapiens
tggagttgcagctaccagacat

SEQ ID NO: 7262156 - DNA, 22 bp, Homo sapiens
tggagttggccgcccggaccga

SEQ ID NO: 7262157 - DNA, 20 bp, Homo sapiens
tggagttgggctggtttacc

SEQ ID NO: 7262158 - DNA, 20 bp, Homo sapiens
tggagttgtggcagtttgga

SEQ ID NO: 7262159 - DNA, 20 bp, Homo sapiens
tggagttgttctgctaggtc

SEQ ID NO: 7262160 - DNA, 22 bp, Homo sapiens
tggagttgtgtcatctttgtaa

SEQ ID NO: 7262161 - DNA, 22 bp, Homo sapiens
tgcttgaacaaggataaatttg

SEQ ID NO: 7262162 - DNA, 22 bp, Homo sapiens
tggacattccacccatatcaga

SEQ ID NO: 7262163 - DNA, 22 bp, Homo sapiens
tggattcacaccattctcctgc

SEQ ID NO: 7262164 - DNA, 22 bp, Homo sapiens
tgggagcagcagggagatgcgg

SEQ ID NO: 7262165 - DNA, 22 bp, Homo sapiens
tgggaagttaggatgccaggga

SEQ ID NO: 7262166 - DNA, 22 bp, Homo sapiens
tgggaagtaggacagtgcagtt

SEQ ID NO: 7262167 - DNA, 22 bp, Homo sapiens
tggcggaatgtgagattacctg

SEQ ID NO: 7262168 - DNA, 22 bp, Homo sapiens
tgggagtcagacagcctgagat

SEQ ID NO: 7262169 - DNA, 22 bp, Homo sapiens
tgggattcaccatgggcttcag

SEQ ID NO: 7262170 - DNA, 22 bp, Homo sapiens
tggggagtcgctgcagagcgat

SEQ ID NO: 7262171 - DNA, 20 bp, Homo sapiens
tggggagttgagcacgagca

SEQ ID NO: 7262172 - DNA, 22 bp, Homo sapiens
tgtcatagtgtggtagcagtgg

SEQ ID NO: 7262173 - DNA, 22 bp, Homo sapiens
tgtcagtgtctatgaagaattt

SEQ ID NO: 7262174 - DNA, 18 bp, Homo sapiens
tgtccctgcaaataacat

SEQ ID NO: 7262175 - DNA, 22 bp, Homo sapiens
tgtcaaaatgactttactacag

SEQ ID NO: 7262176 - DNA, 22 bp, Homo sapiens
tgtcaaaaataagagagattgt

SEQ ID NO: 7262177 - DNA, 22 bp, Homo sapiens
tgtatttttagacctttagacc

SEQ ID NO: 7262178 - DNA, 22 bp, Homo sapiens
tgtattttcagagtggcatttc

SEQ ID NO: 7262179 - DNA, 22 bp, Homo sapiens
tgtagaaagaatatgtttcata

SEQ ID NO: 7262180 - DNA, 17 bp, Homo sapiens
tgtagcttctccttctc

SEQ ID NO: 7262181 - DNA, 22 bp, Homo sapiens
tgtagctctccagccagcaagg

SEQ ID NO: 7262182 - DNA, 22 bp, Homo sapiens
tgtatgaggcatacatcaggca

SEQ ID NO: 7262183 - DNA, 22 bp, Homo sapiens
tgtacaatctgatgatgtatgg

SEQ ID NO: 7262184 - DNA, 22 bp, Homo sapiens
tgtacaaagagtatagctttga

SEQ ID NO: 7262185 - DNA, 22 bp, Homo sapiens
tgtaacatggttcttactctca

SEQ ID NO: 7262186 - DNA, 22 bp, Homo sapiens
tgtaaaataattctccatgttt

SEQ ID NO: 7262187 - DNA, 23 bp, Homo sapiens
tgtaaaatggggtagtgttacca

SEQ ID NO: 7262188 - DNA, 22 bp, Homo sapiens
tggtgggagtgacgttgccttc

SEQ ID NO: 7262189 - DNA, 22 bp, Homo sapiens
tggtgcccttgtgggtgagatg

SEQ ID NO: 7262190 - DNA, 22 bp, Homo sapiens
tggtcctcaggttctctgtgcg

SEQ ID NO: 7262191 - DNA, 22 bp, Homo sapiens
tggtgagcgatgctgcatgttc

SEQ ID NO: 7262192 - DNA, 22 bp, Homo sapiens
tgtgcagagtaaggcagctgtt

SEQ ID NO: 7262193 - DNA, 22 bp, Homo sapiens
tgtgcagagcccacaggcagct

SEQ ID NO: 7262194 - DNA, 22 bp, Homo sapiens
tgtgacctcatcttaactggaa

SEQ ID NO: 7262195 - DNA, 21 bp, Homo sapiens
tgtgacctgatgtagtacatt

SEQ ID NO: 7262196 - DNA, 22 bp, Homo sapiens
tgtgagtagctgaagcagaaca

SEQ ID NO: 7262197 - DNA, 22 bp, Homo sapiens
tgtgagttattttcaggagttt

SEQ ID NO: 7262198 - DNA, 22 bp, Homo sapiens
tgtgagttcttagaaagtcagt

SEQ ID NO: 7262199 - DNA, 22 bp, Homo sapiens
tgtgaacatttctggttatttg

SEQ ID NO: 7262200 - DNA, 18 bp, Homo sapiens
tgtgaacacatttttctg

SEQ ID NO: 7262201 - DNA, 22 bp, Homo sapiens
tgtgaacagtatgtcatttcac

SEQ ID NO: 7262202 - DNA, 22 bp, Homo sapiens
tgtctttttactatgttcaatc

SEQ ID NO: 7262203 - DNA, 22 bp, Homo sapiens
tgtgggaggtctggaaggctcc

SEQ ID NO: 7262204 - DNA, 22 bp, Homo sapiens
tgttaaatgtattatgtgttct

SEQ ID NO: 7262205 - DNA, 18 bp, Homo sapiens
tgttaaatgaagatttgc

SEQ ID NO: 7262206 - DNA, 22 bp, Homo sapiens
tgtttcaaaacagtgataattt

SEQ ID NO: 7262207 - DNA, 22 bp, Homo sapiens
tgttttatttctccaagaggga

SEQ ID NO: 7262208 - DNA, 22 bp, Homo sapiens
ttaaaaaccatcttcctttcct

SEQ ID NO: 7262209 - DNA, 22 bp, Homo sapiens
ttaaaatttccccaccatgtat

SEQ ID NO: 7262210 - DNA, 22 bp, Homo sapiens
ttcattgatagttttatgtatg

SEQ ID NO: 7262211 - DNA, 22 bp, Homo sapiens
ttcattgagtggtttattctaa

SEQ ID NO: 7262212 - DNA, 22 bp, Homo sapiens
ttcattgaaccactttattctt

SEQ ID NO: 7262213 - DNA, 22 bp, Homo sapiens
ttcattcaaggggttcctgatt

SEQ ID NO: 7262214 - DNA, 21 bp, Homo sapiens
ttcattcatggcataatatag

SEQ ID NO: 7262215 - DNA, 22 bp, Homo sapiens
ttatttctactattttgcctga

SEQ ID NO: 7262216 - DNA, 22 bp, Homo sapiens
ttcagcctgtctgcagacccct

SEQ ID NO: 7262217 - DNA, 22 bp, Homo sapiens
ttatttcattgatttctaagac

SEQ ID NO: 7262218 - DNA, 22 bp, Homo sapiens
ttacattaagccaatggattct

SEQ ID NO: 7262219 - DNA, 22 bp, Homo sapiens
ttacattagacccactttcatg

SEQ ID NO: 7262220 - DNA, 22 bp, Homo sapiens
ttacatgcaggtcagactgcat

SEQ ID NO: 7262221 - DNA, 22 bp, Homo sapiens
ttacagcatttaatgagatctg

SEQ ID NO: 7262222 - DNA, 22 bp, Homo sapiens
ttacagcagtgggaaggagtca

SEQ ID NO: 7262223 - DNA, 22 bp, Homo sapiens
ttacagcagcagggacagacta

SEQ ID NO: 7262224 - DNA, 22 bp, Homo sapiens
ttacagatggatctagcaaaat

SEQ ID NO: 7262225 - DNA, 22 bp, Homo sapiens
ttacagatggggttgcaataaa

SEQ ID NO: 7262226 - DNA, 17 bp, Homo sapiens
ttacagcagcaatagag

SEQ ID NO: 7262227 - DNA, 18 bp, Homo sapiens
ttacagcagcaacaggaa

SEQ ID NO: 7262228 - DNA, 22 bp, Homo sapiens
ttacagcacagtgcttttactg

SEQ ID NO: 7262229 - DNA, 21 bp, Homo sapiens
ttacagcaatgttagcaggaa

SEQ ID NO: 7262230 - DNA, 22 bp, Homo sapiens
ttacagcaaagtgcgcagacct

SEQ ID NO: 7262231 - DNA, 22 bp, Homo sapiens
ttacagatactttgtaggcaag

SEQ ID NO: 7262232 - DNA, 22 bp, Homo sapiens
ttaatacaactgttgtcactgg

SEQ ID NO: 7262233 - DNA, 21 bp, Homo sapiens
ttaatgctatgcagaaaatct

SEQ ID NO: 7262234 - DNA, 22 bp, Homo sapiens
ttaatacagaagcaagacactg

SEQ ID NO: 7262235 - DNA, 22 bp, Homo sapiens
ttaaagagtaatcataggtcaa

SEQ ID NO: 7262236 - DNA, 22 bp, Homo sapiens
ttaaagaggcaggttaaataat

SEQ ID NO: 7262237 - DNA, 22 bp, Homo sapiens
ttaaagcagtttgtatacatgg

SEQ ID NO: 7262238 - DNA, 22 bp, Homo sapiens
ttacaacaaaggcacgtgcatg

SEQ ID NO: 7262239 - DNA, 22 bp, Homo sapiens
agcctgtgttgctctggcgata

SEQ ID NO: 7262240 - DNA, 22 bp, Homo sapiens
agcctgtgtgctttggacaggg

SEQ ID NO: 7262241 - DNA, 22 bp, Homo sapiens
agcctgtgacattgactatgaa

SEQ ID NO: 7262242 - DNA, 22 bp, Homo sapiens
agatttgaaacttgcttcataa

SEQ ID NO: 7262243 - DNA, 22 bp, Homo sapiens
agattttatagataatttccca

SEQ ID NO: 7262244 - DNA, 22 bp, Homo sapiens
acacacatggtattgttcagaa

SEQ ID NO: 7262245 - DNA, 22 bp, Homo sapiens
agcaggtgacagggctgtggtg

SEQ ID NO: 7262246 - DNA, 22 bp, Homo sapiens
agaattgttggggtaataaaag

SEQ ID NO: 7262247 - DNA, 22 bp, Homo sapiens
agaataaatgctacctatcaca

SEQ ID NO: 7262248 - DNA, 22 bp, Homo sapiens
aattatgtagccatatgaaaca

SEQ ID NO: 7262249 - DNA, 22 bp, Homo sapiens
aatttattatatcctaggggaa

SEQ ID NO: 7262250 - DNA, 22 bp, Homo sapiens
aatttattcccgtctctgggct

SEQ ID NO: 7262251 - DNA, 22 bp, Homo sapiens
aatttatttcctgccagtacac

SEQ ID NO: 7262252 - DNA, 22 bp, Homo sapiens
aattttgttttagtggaggctg

SEQ ID NO: 7262253 - DNA, 23 bp, Homo sapiens
acatgggaaatgcaaagagaagt

SEQ ID NO: 7262254 - DNA, 22 bp, Homo sapiens
acatgggacagagaaagaggcc

SEQ ID NO: 7262255 - DNA, 22 bp, Homo sapiens
acattctggatgtctgatgaga

SEQ ID NO: 7262256 - DNA, 22 bp, Homo sapiens
acattcttaacagttaaaaact

SEQ ID NO: 7262257 - DNA, 22 bp, Homo sapiens
acagctttttactaatagattg

SEQ ID NO: 7262258 - DNA, 22 bp, Homo sapiens
acagcttgggatgctttatttc

SEQ ID NO: 7262259 - DNA, 22 bp, Homo sapiens
acagtctttctacattctgtgc

SEQ ID NO: 7262260 - DNA, 22 bp, Homo sapiens
acaggtgattcaggctctggga

SEQ ID NO: 7262261 - DNA, 22 bp, Homo sapiens
acaggtgaggggttctaggctg

SEQ ID NO: 7262262 - DNA, 22 bp, Homo sapiens
acaggtgagggagctttgtgcc

SEQ ID NO: 7262263 - DNA, 22 bp, Homo sapiens
acaggtgaggatctgagcctca

SEQ ID NO: 7262264 - DNA, 22 bp, Homo sapiens
aatatgtttataagatatcttc

SEQ ID NO: 7262265 - DNA, 22 bp, Homo sapiens
aataactggcacatatcacata

SEQ ID NO: 7262266 - DNA, 22 bp, Homo sapiens
aatatcttggcccaactccaga

SEQ ID NO: 7262267 - DNA, 22 bp, Homo sapiens
acttccaggaggtgtcactgaa

SEQ ID NO: 7262268 - DNA, 22 bp, Homo sapiens
acttccagctttataattcagt

SEQ ID NO: 7262269 - DNA, 22 bp, Homo sapiens
aagtaacacatgttacttctgc

SEQ ID NO: 7262270 - DNA, 22 bp, Homo sapiens
aagtgattctagtcatgattct

SEQ ID NO: 7262271 - DNA, 22 bp, Homo sapiens
aagtgagtcacaagtttgcttt

SEQ ID NO: 7262272 - DNA, 22 bp, Homo sapiens
aagtttgtcgaaattatcagca

SEQ ID NO: 7262273 - DNA, 22 bp, Homo sapiens
actcatatactgttgtttttaa

SEQ ID NO: 7262274 - DNA, 22 bp, Homo sapiens
aataaagtagcgtttaaggtgc

SEQ ID NO: 7262275 - DNA, 22 bp, Homo sapiens
aactccttaatgaagtccagtt

SEQ ID NO: 7262276 - DNA, 22 bp, Homo sapiens
aatgtattctgggaaaatgtta

SEQ ID NO: 7262277 - DNA, 22 bp, Homo sapiens
aatgtctttaaagtgcaataga

SEQ ID NO: 7262278 - DNA, 22 bp, Homo sapiens
aatgtctttctcataacagata

SEQ ID NO: 7262279 - DNA, 22 bp, Homo sapiens
aatgttattacacttgtgaaat

SEQ ID NO: 7262280 - DNA, 22 bp, Homo sapiens
aatgttaatgtgtttgcttatg

SEQ ID NO: 7262281 - DNA, 22 bp, Homo sapiens
aatgttaagtttagattataac

SEQ ID NO: 7262282 - DNA, 22 bp, Homo sapiens
aagacattgtcattttataatt

SEQ ID NO: 7262283 - DNA, 22 bp, Homo sapiens
aagacaatgcattactaagaag

SEQ ID NO: 7262284 - DNA, 22 bp, Homo sapiens
acagaagcagccgtcacagata

SEQ ID NO: 7262285 - DNA, 22 bp, Homo sapiens
acagaagcagcgcggctcttct

SEQ ID NO: 7262286 - DNA, 22 bp, Homo sapiens
acagaagcaaagactcaggcaa

SEQ ID NO: 7262287 - DNA, 22 bp, Homo sapiens
acagaagcaaaagcaggatctt

SEQ ID NO: 7262288 - DNA, 22 bp, Homo sapiens
aagaggagggcagattcaaggc

SEQ ID NO: 7262289 - DNA, 22 bp, Homo sapiens
aagaggagtagatgtggttggt

SEQ ID NO: 7262290 - DNA, 23 bp, Homo sapiens
aagaggaggccctgctcccgtcc

SEQ ID NO: 7262291 - DNA, 22 bp, Homo sapiens
aagaggaggattgatgtgggag

SEQ ID NO: 7262292 - DNA, 22 bp, Homo sapiens
aaggggaagtagcaccagaggt

SEQ ID NO: 7262293 - DNA, 22 bp, Homo sapiens
aaggcatttgttggatttctca

SEQ ID NO: 7262294 - DNA, 22 bp, Homo sapiens
aaatttctaagcagccacttcc

SEQ ID NO: 7262295 - DNA, 22 bp, Homo sapiens
aaggacatggaaggaggagata

SEQ ID NO: 7262296 - DNA, 22 bp, Homo sapiens
aaggagaaggcatcattcaagt

SEQ ID NO: 7262297 - DNA, 22 bp, Homo sapiens
aacatttattgagcacctactg

SEQ ID NO: 7262298 - DNA, 22 bp, Homo sapiens
aacatttattgagcacctactg

SEQ ID NO: 7262299 - DNA, 22 bp, Homo sapiens
aacatttattctaattctggga

SEQ ID NO: 7262300 - DNA, 22 bp, Homo sapiens
aacatttatggtagtcattgca

SEQ ID NO: 7262301 - DNA, 22 bp, Homo sapiens
aacatttatgattgaggtaaat

SEQ ID NO: 7262302 - DNA, 22 bp, Homo sapiens
aacatttaggaaggacctcctc

SEQ ID NO: 7262303 - DNA, 22 bp, Homo sapiens
aacatttatatgggttcatgaa

SEQ ID NO: 7262304 - DNA, 22 bp, Homo sapiens
aacatttacaaatccttctgca

SEQ ID NO: 7262305 - DNA, 22 bp, Homo sapiens
aagtttctgatattgttaaagc

SEQ ID NO: 7262306 - DNA, 22 bp, Homo sapiens
aagtttctggaccttacctgct

SEQ ID NO: 7262307 - DNA, 22 bp, Homo sapiens
aataaaatggtcagttttctca

SEQ ID NO: 7262308 - DNA, 22 bp, Homo sapiens
aagttcttgaagactttaaata

SEQ ID NO: 7262309 - DNA, 23 bp, Homo sapiens
aagttcttaggttgatactaatg

SEQ ID NO: 7262310 - DNA, 22 bp, Homo sapiens
aagtcaagtactacaggaaaca

SEQ ID NO: 7262311 - DNA, 22 bp, Homo sapiens
aagtatttcagcggttctttgt

SEQ ID NO: 7262312 - DNA, 22 bp, Homo sapiens
aagtatttcgttctgaaaaagt

SEQ ID NO: 7262313 - DNA, 22 bp, Homo sapiens
aagtatttcgttctgaaaaagt

SEQ ID NO: 7262314 - DNA, 22 bp, Homo sapiens
aagtatttggaatggcattttt

SEQ ID NO: 7262315 - DNA, 22 bp, Homo sapiens
aagtatttctggcctgtgaaag

SEQ ID NO: 7262316 - DNA, 22 bp, Homo sapiens
aacttgcttcaacttatttcac

SEQ ID NO: 7262317 - DNA, 22 bp, Homo sapiens
aacatttgtgaagtacttagat

SEQ ID NO: 7262318 - DNA, 22 bp, Homo sapiens
aacatttgcagaggaaagctat

SEQ ID NO: 7262319 - DNA, 22 bp, Homo sapiens
aactcaaagatgcatgacgctt

SEQ ID NO: 7262320 - DNA, 22 bp, Homo sapiens
aacattaagatggcggaacagt

SEQ ID NO: 7262321 - DNA, 22 bp, Homo sapiens
aacattaattacagtcaaacat

SEQ ID NO: 7262322 - DNA, 22 bp, Homo sapiens
aacattctatgtgcattcagaa

SEQ ID NO: 7262323 - DNA, 22 bp, Homo sapiens
aacaattatcatatacattgca

SEQ ID NO: 7262324 - DNA, 22 bp, Homo sapiens
aacaattagactgacggtatta

SEQ ID NO: 7262325 - DNA, 22 bp, Homo sapiens
aacaaattagttgcaagactgg

SEQ ID NO: 7262326 - DNA, 22 bp, Homo sapiens
aacaaatttagctctgagtgct

SEQ ID NO: 7262327 - DNA, 22 bp, Homo sapiens
aagaggagacttcagcaacttg

SEQ ID NO: 7262328 - DNA, 18 bp, Homo sapiens
aagaggaggaaacccagg

SEQ ID NO: 7262329 - DNA, 22 bp, Homo sapiens
aagaggaggacggttcccagaa

SEQ ID NO: 7262330 - DNA, 18 bp, Homo sapiens
aagaggaggagcaggttg

SEQ ID NO: 7262331 - DNA, 23 bp, Homo sapiens
aagcatggttcacagttagtact

SEQ ID NO: 7262332 - DNA, 22 bp, Homo sapiens
aagaggagaaaggctggctttg

SEQ ID NO: 7262333 - DNA, 22 bp, Homo sapiens
aagaaagtgctttgtaaattat

SEQ ID NO: 7262334 - DNA, 22 bp, Homo sapiens
aaatggcagtagaaaagaatcc

SEQ ID NO: 7262335 - DNA, 22 bp, Homo sapiens
aaatggcaggctctttgctagt

SEQ ID NO: 7262336 - DNA, 22 bp, Homo sapiens
aaatatgttttccagttgtcat

SEQ ID NO: 7262337 - DNA, 22 bp, Homo sapiens
aaatatgtaagattagcactag

SEQ ID NO: 7262338 - DNA, 22 bp, Homo sapiens
aaatagaattaactagctactg

SEQ ID NO: 7262339 - DNA, 22 bp, Homo sapiens
aaacatctatcagcatttttta

SEQ ID NO: 7262340 - DNA, 22 bp, Homo sapiens
aaaatagattctaggatgtctt

SEQ ID NO: 7262341 - DNA, 22 bp, Homo sapiens
aaaaatgctgtggtagctgtgt

SEQ ID NO: 7262342 - DNA, 22 bp, Homo sapiens
aaaaatgcttggacttaataaa

SEQ ID NO: 7262343 - DNA, 22 bp, Homo sapiens
aaaagtctgctttctattatca

SEQ ID NO: 7262344 - DNA, 22 bp, Homo sapiens
aaaaagatgtcctgaagtttag

SEQ ID NO: 7262345 - DNA, 22 bp, Homo sapiens
aaacttgttctcttgtgcctat

SEQ ID NO: 7262346 - DNA, 22 bp, Homo sapiens
aaacatttgcaactcggtttgg

SEQ ID NO: 7262347 - DNA, 23 bp, Homo sapiens
aaacatttctcttttcctgcctc

SEQ ID NO: 7262348 - DNA, 22 bp, Homo sapiens
aaacatttttctaggtcttggt

SEQ ID NO: 7262349 - DNA, 22 bp, Homo sapiens
aaacatttttcttcatcatcct

SEQ ID NO: 7262350 - DNA, 21 bp, Homo sapiens
aaacatctctgcttttgtgtc

SEQ ID NO: 7262351 - DNA, 22 bp, Homo sapiens
aaacatgagcatctcttcaagc

SEQ ID NO: 7262352 - DNA, 22 bp, Homo sapiens
aaacatgagcacttgcttcata

SEQ ID NO: 7262353 - DNA, 22 bp, Homo sapiens
accaagcacaaagatgagtaaa

SEQ ID NO: 7262354 - DNA, 22 bp, Homo sapiens
acattctttgagttttgttaaa

SEQ ID NO: 7262355 - DNA, 22 bp, Homo sapiens
acattctttcgatgtctgattt

SEQ ID NO: 7262356 - DNA, 22 bp, Homo sapiens
aggccacaggattgcacagcat

SEQ ID NO: 7262357 - DNA, 21 bp, Homo sapiens
acagcctccatctcctgggct

SEQ ID NO: 7262358 - DNA, 22 bp, Homo sapiens
agctgcaggaagtagaagcgga

SEQ ID NO: 7262359 - DNA, 20 bp, Homo sapiens
aggagaccaagccaagtgga

SEQ ID NO: 7262360 - DNA, 22 bp, Homo sapiens
aggagaccttttgagtgtgaga

SEQ ID NO: 7262361 - DNA, 22 bp, Homo sapiens
aggagaccttcaccacttccac

SEQ ID NO: 7262362 - DNA, 21 bp, Homo sapiens
aggagaccggcttgtttgtgc

SEQ ID NO: 7262363 - DNA, 22 bp, Homo sapiens
aggagacccaatgccagaaaga

SEQ ID NO: 7262364 - DNA, 22 bp, Homo sapiens
aggagacccagaatgttgctgt

SEQ ID NO: 7262365 - DNA, 22 bp, Homo sapiens
aggaaggagggcagatattaag

SEQ ID NO: 7262366 - DNA, 23 bp, Homo sapiens
aggaaggaggtcctaacagtatc

SEQ ID NO: 7262367 - DNA, 22 bp, Homo sapiens
agtactttttgttcaattgtgc

SEQ ID NO: 7262368 - DNA, 22 bp, Homo sapiens
agtacttttttgatatctgagt

SEQ ID NO: 7262369 - DNA, 22 bp, Homo sapiens
actctgcaatgtggcaagaaca

SEQ ID NO: 7262370 - DNA, 22 bp, Homo sapiens
actgaattttaattagatctgc

SEQ ID NO: 7262371 - DNA, 22 bp, Homo sapiens
actgcacttcaccctgggtgac

SEQ ID NO: 7262372 - DNA, 22 bp, Homo sapiens
actgcactccagcctgggtgat

SEQ ID NO: 7262373 - DNA, 23 bp, Homo sapiens
agtttttaatggtcatagctgag

SEQ ID NO: 7262374 - DNA, 23 bp, Homo sapiens
agtttttaatggtcatagctgag

SEQ ID NO: 7262375 - DNA, 18 bp, Homo sapiens
agtttttaggaagaaatg

SEQ ID NO: 7262376 - DNA, 21 bp, Homo sapiens
agtttttactcttaactgtgg

SEQ ID NO: 7262377 - DNA, 21 bp, Homo sapiens
agtttttactcttaactgtgg

SEQ ID NO: 7262378 - DNA, 18 bp, Homo sapiens
agtttttaggaagaaatg

SEQ ID NO: 7262379 - DNA, 22 bp, Homo sapiens
acttccagcccctgtcagcaaa

SEQ ID NO: 7262380 - DNA, 22 bp, Homo sapiens
acttccagatggccccatctaa

SEQ ID NO: 7262381 - DNA, 22 bp, Homo sapiens
acttctattggtcatgataaaa

SEQ ID NO: 7262382 - DNA, 22 bp, Homo sapiens
acttaaaaagaatcttttcacg

SEQ ID NO: 7262383 - DNA, 22 bp, Homo sapiens
actttaaagcagaatggctatg

SEQ ID NO: 7262384 - DNA, 22 bp, Homo sapiens
agaacatttgtcgatcaatttg

SEQ ID NO: 7262385 - DNA, 22 bp, Homo sapiens
agaacatttgtcaaaaagccaa

SEQ ID NO: 7262386 - DNA, 22 bp, Homo sapiens
agaacattaatgcgaggtatta

SEQ ID NO: 7262387 - DNA, 22 bp, Homo sapiens
atcccaagtagcaatcctggta

SEQ ID NO: 7262388 - DNA, 19 bp, Homo sapiens
atcccaaggagctgggact

SEQ ID NO: 7262389 - DNA, 22 bp, Homo sapiens
atcccacacccctacaacatat

SEQ ID NO: 7262390 - DNA, 22 bp, Homo sapiens
agaaaaagtcaaggaattggac

SEQ ID NO: 7262391 - DNA, 22 bp, Homo sapiens
atatttttccatgtgggactct

SEQ ID NO: 7262392 - DNA, 21 bp, Homo sapiens
atatttttgtttggactgtca

SEQ ID NO: 7262393 - DNA, 21 bp, Homo sapiens
atatttttgtttggactgtca

SEQ ID NO: 7262394 - DNA, 21 bp, Homo sapiens
agaaaaacacgatataagccc

SEQ ID NO: 7262395 - DNA, 21 bp, Homo sapiens
attacagcagtggccaaatgc

SEQ ID NO: 7262396 - DNA, 22 bp, Homo sapiens
agaggctggattgagcatagac

SEQ ID NO: 7262397 - DNA, 22 bp, Homo sapiens
agaggctgcacttgctcatgat

SEQ ID NO: 7262398 - DNA, 16 bp, Homo sapiens
agaggctgtaatggaa

SEQ ID NO: 7262399 - DNA, 21 bp, Homo sapiens
agatgctgtgctccaggagca

SEQ ID NO: 7262400 - DNA, 22 bp, Homo sapiens
agatcacagtggcaactccctt

SEQ ID NO: 7262401 - DNA, 22 bp, Homo sapiens
agagaagggtgtagcctgggcc

SEQ ID NO: 7262402 - DNA, 22 bp, Homo sapiens
agagaaggtcactaaggaccca

SEQ ID NO: 7262403 - DNA, 19 bp, Homo sapiens
agagaggctgtgtgaggga

SEQ ID NO: 7262404 - DNA, 22 bp, Homo sapiens
agagcagatggagctggaagag

SEQ ID NO: 7262405 - DNA, 21 bp, Homo sapiens
agagcacaggtggacaatgct

SEQ ID NO: 7262406 - DNA, 22 bp, Homo sapiens
atgcctgtaatcccagtgcttt

SEQ ID NO: 7262407 - DNA, 22 bp, Homo sapiens
agacacattttacattaactgt

SEQ ID NO: 7262408 - DNA, 22 bp, Homo sapiens
cagagaactccagtggctggcg

SEQ ID NO: 7262409 - DNA, 22 bp, Homo sapiens
cagagaacattcagagctgtag

SEQ ID NO: 7262410 - DNA, 17 bp, Homo sapiens
agccagcagtagctggt

SEQ ID NO: 7262411 - DNA, 22 bp, Homo sapiens
agcccccaaaagtgcttatgat

SEQ ID NO: 7262412 - DNA, 22 bp, Homo sapiens
agcccccacgtttcctgggtcc

SEQ ID NO: 7262413 - DNA, 22 bp, Homo sapiens
agctaattagaaatagattatt

SEQ ID NO: 7262414 - DNA, 22 bp, Homo sapiens
cacatttaattggtttagggtg

SEQ ID NO: 7262415 - DNA, 21 bp, Homo sapiens
cacagagatattggtgagcct

SEQ ID NO: 7262416 - DNA, 22 bp, Homo sapiens
caatacaattaccagttaatca

SEQ ID NO: 7262417 - DNA, 22 bp, Homo sapiens
agcagaggaggatttagttagg

SEQ ID NO: 7262418 - DNA, 21 bp, Homo sapiens
agcagaggctgcctggtgact

SEQ ID NO: 7262419 - DNA, 21 bp, Homo sapiens
agcagaggcagaatgtatgca

SEQ ID NO: 7262420 - DNA, 22 bp, Homo sapiens
agcagaggtgtttattatggga

SEQ ID NO: 7262421 - DNA, 16 bp, Homo sapiens
agcagaggtgagtgaa

SEQ ID NO: 7262422 - DNA, 21 bp, Homo sapiens
agcagaggggacatgtttgat

SEQ ID NO: 7262423 - DNA, 22 bp, Homo sapiens
ccatttatagatgtatttggct

SEQ ID NO: 7262424 - DNA, 22 bp, Homo sapiens
aggctgaggatccctgtgttct

SEQ ID NO: 7262425 - DNA, 22 bp, Homo sapiens
aggcctggcatgagacctgaga

SEQ ID NO: 7262426 - DNA, 22 bp, Homo sapiens
agctggtatttgttagggagtt

SEQ ID NO: 7262427 - DNA, 22 bp, Homo sapiens
aggaaggactgcagcatttggt

SEQ ID NO: 7262428 - DNA, 22 bp, Homo sapiens
catcagaagaaagacaaatgat

SEQ ID NO: 7262429 - DNA, 21 bp, Homo sapiens
aggagttgagtgcacagttgg

SEQ ID NO: 7262430 - DNA, 23 bp, Homo sapiens
aggagttgagggttgggttggca

SEQ ID NO: 7262431 - DNA, 16 bp, Homo sapiens
aggagttgaggctatt

SEQ ID NO: 7262432 - DNA, 22 bp, Homo sapiens
aggagttgtatgtccaagggac

SEQ ID NO: 7262433 - DNA, 22 bp, Homo sapiens
aggagttggtgctctccaaata

SEQ ID NO: 7262434 - DNA, 22 bp, Homo sapiens
aggagttggtcaccgtggccca

SEQ ID NO: 7262435 - DNA, 21 bp, Homo sapiens
aggagttgctgtggcctggtt

SEQ ID NO: 7262436 - DNA, 23 bp, Homo sapiens
aggagttgcatgatttttagagc

SEQ ID NO: 7262437 - DNA, 22 bp, Homo sapiens
aggagttgattacgtttatttt

SEQ ID NO: 7262438 - DNA, 22 bp, Homo sapiens
aggatcatgtggtcattcctga

SEQ ID NO: 7262439 - DNA, 22 bp, Homo sapiens
aggatcatataagctccagcta

SEQ ID NO: 7262440 - DNA, 22 bp, Homo sapiens
aggatcctccttagaaaagacc

SEQ ID NO: 7262441 - DNA, 22 bp, Homo sapiens
aggatgactggaacccaagtga

SEQ ID NO: 7262442 - DNA, 22 bp, Homo sapiens
cctgggaggctgtttccagcct

SEQ ID NO: 7262443 - DNA, 22 bp, Homo sapiens
cctgggagggcaagtgctgatg

SEQ ID NO: 7262444 - DNA, 22 bp, Homo sapiens
cctgggaggtggaggttgcagc

SEQ ID NO: 7262445 - DNA, 22 bp, Homo sapiens
cctgggaggtggaggttgcagt

SEQ ID NO: 7262446 - DNA, 22 bp, Homo sapiens
cctgggaggctgaggctgcagt

SEQ ID NO: 7262447 - DNA, 19 bp, Homo sapiens
ctagcttgtcatttgtgtg

SEQ ID NO: 7262448 - DNA, 22 bp, Homo sapiens
ctagcctgggatttgaacttat

SEQ ID NO: 7262449 - DNA, 22 bp, Homo sapiens
ccttccagggctctccagaacc

SEQ ID NO: 7262450 - DNA, 22 bp, Homo sapiens
agtatttctgaatattatcata

SEQ ID NO: 7262451 - DNA, 22 bp, Homo sapiens
agttatttcagtaacataatag

SEQ ID NO: 7262452 - DNA, 22 bp, Homo sapiens
agttaaatcattactgacagag

SEQ ID NO: 7262453 - DNA, 22 bp, Homo sapiens
agtgtgctgtttccagaagggc

SEQ ID NO: 7262454 - DNA, 22 bp, Homo sapiens
agtgtgggccacgcagctgagc

SEQ ID NO: 7262455 - DNA, 22 bp, Homo sapiens
agtgtcaaattaaataatctgg

SEQ ID NO: 7262456 - DNA, 22 bp, Homo sapiens
agtgtcaattctcaaatctcgg

SEQ ID NO: 7262457 - DNA, 22 bp, Homo sapiens
agtgtgagatgattgaggagca

SEQ ID NO: 7262458 - DNA, 18 bp, Homo sapiens
agtctttatttctttcat

SEQ ID NO: 7262459 - DNA, 22 bp, Homo sapiens
agtctattttcagaagcagttt

SEQ ID NO: 7262460 - DNA, 22 bp, Homo sapiens
agtctatttgctgtccgagcaa

SEQ ID NO: 7262461 - DNA, 22 bp, Homo sapiens
agtctattgcctaacagagagg

SEQ ID NO: 7262462 - DNA, 22 bp, Homo sapiens
agtgagtatttgttgagtgcta

SEQ ID NO: 7262463 - DNA, 22 bp, Homo sapiens
atacaagttaatgagaatgaca

SEQ ID NO: 7262464 - DNA, 22 bp, Homo sapiens
atacacatatcaggtgtataca

SEQ ID NO: 7262465 - DNA, 22 bp, Homo sapiens
atacacaggtgctaggtcaata

SEQ ID NO: 7262466 - DNA, 22 bp, Homo sapiens
atacacagctacattgaacaat

SEQ ID NO: 7262467 - DNA, 19 bp, Homo sapiens
atacacatacgtaaactga

SEQ ID NO: 7262468 - DNA, 22 bp, Homo sapiens
ctgctaaacctctctgagagct

SEQ ID NO: 7262469 - DNA, 22 bp, Homo sapiens
ataaaagaagttttggtacttg

SEQ ID NO: 7262470 - DNA, 22 bp, Homo sapiens
ataaaagatcccttctgagctc

SEQ ID NO: 7262471 - DNA, 22 bp, Homo sapiens
ataaaaggaaagcctgttgtga

SEQ ID NO: 7262472 - DNA, 22 bp, Homo sapiens
atacacattactttctgtctga

SEQ ID NO: 7262473 - DNA, 22 bp, Homo sapiens
ctggcacaggatccgagacctt

SEQ ID NO: 7262474 - DNA, 22 bp, Homo sapiens
ctggcacagccactgcaggcag

SEQ ID NO: 7262475 - DNA, 22 bp, Homo sapiens
ctgggagctgtcaggagcgtgt

SEQ ID NO: 7262476 - DNA, 22 bp, Homo sapiens
atagttttctatgcactgttat

SEQ ID NO: 7262477 - DNA, 22 bp, Homo sapiens
atattcaaattacatttactaa

SEQ ID NO: 7262478 - DNA, 22 bp, Homo sapiens
ctgggagcttgttaggaatgca

SEQ ID NO: 7262479 - DNA, 22 bp, Homo sapiens
atcacaatgtacgttaaaatgt

SEQ ID NO: 7262480 - DNA, 22 bp, Homo sapiens
cttctgagatgttgttttacag

SEQ ID NO: 7262481 - DNA, 22 bp, Homo sapiens
cttcttaaatatttggctgact

SEQ ID NO: 7262482 - DNA, 22 bp, Homo sapiens
cttaagagtctttctgtgttta

SEQ ID NO: 7262483 - DNA, 22 bp, Homo sapiens
cttaaggaaaagtctcttttaa

SEQ ID NO: 7262484 - DNA, 22 bp, Homo sapiens
gaaatgattttagtttatcatg

SEQ ID NO: 7262485 - DNA, 22 bp, Homo sapiens
gaacaatgagtcattcaggtga

SEQ ID NO: 7262486 - DNA, 22 bp, Homo sapiens
gaacatttgatgatgacattgg

SEQ ID NO: 7262487 - DNA, 22 bp, Homo sapiens
gaacatttgatgatgacattgg

SEQ ID NO: 7262488 - DNA, 22 bp, Homo sapiens
gaacatttatattagatagcta

SEQ ID NO: 7262489 - DNA, 22 bp, Homo sapiens
gaacatttccagaaaggaacta

SEQ ID NO: 7262490 - DNA, 22 bp, Homo sapiens
gaacatttatgatgcaatacct

SEQ ID NO: 7262491 - DNA, 22 bp, Homo sapiens
gaaaatctgcttatattatttt

SEQ ID NO: 7262492 - DNA, 19 bp, Homo sapiens
atgctttatgttatttctt

SEQ ID NO: 7262493 - DNA, 22 bp, Homo sapiens
atgccacttcattccagcctcg

SEQ ID NO: 7262494 - DNA, 22 bp, Homo sapiens
gaatgttactttgattttgtcc

SEQ ID NO: 7262495 - DNA, 22 bp, Homo sapiens
gaatgtttaaggaaggcgtggc

SEQ ID NO: 7262496 - DNA, 22 bp, Homo sapiens
gagaggtgaaatagttgtccgg

SEQ ID NO: 7262497 - DNA, 22 bp, Homo sapiens
gagaggtggaggttgcagtgag

SEQ ID NO: 7262498 - DNA, 22 bp, Homo sapiens
gagttagcaaagggtggcaggg

SEQ ID NO: 7262499 - DNA, 22 bp, Homo sapiens
gagttactgggtggaaggcact

SEQ ID NO: 7262500 - DNA, 22 bp, Homo sapiens
gatatttacaaatttgccaata

SEQ ID NO: 7262501 - DNA, 22 bp, Homo sapiens
attttgaaatacttgaaggaaa

SEQ ID NO: 7262502 - DNA, 22 bp, Homo sapiens
attttctagatagatgatgcat

SEQ ID NO: 7262503 - DNA, 22 bp, Homo sapiens
attttaataagatccatttggt

SEQ ID NO: 7262504 - DNA, 22 bp, Homo sapiens
caaatagacttaagcatctgta

SEQ ID NO: 7262505 - DNA, 22 bp, Homo sapiens
gctatttttgagccatttataa

SEQ ID NO: 7262506 - DNA, 22 bp, Homo sapiens
gctatttctttaaattgatctc

SEQ ID NO: 7262507 - DNA, 22 bp, Homo sapiens
gctatttctatattataaagaa

SEQ ID NO: 7262508 - DNA, 22 bp, Homo sapiens
gctatgttcccttttgctataa

SEQ ID NO: 7262509 - DNA, 22 bp, Homo sapiens
gctcgtacaccagcgtggaggt

SEQ ID NO: 7262510 - DNA, 22 bp, Homo sapiens
gcattcatgtccttcctgaacg

SEQ ID NO: 7262511 - DNA, 22 bp, Homo sapiens
atgtttctagttgtatgtcact

SEQ ID NO: 7262512 - DNA, 17 bp, Homo sapiens
gcagcctcttggtagtg

SEQ ID NO: 7262513 - DNA, 19 bp, Homo sapiens
gcagatgatgaggctggtc

SEQ ID NO: 7262514 - DNA, 22 bp, Homo sapiens
gctgggagccccgagccagcgc

SEQ ID NO: 7262515 - DNA, 22 bp, Homo sapiens
gctgggagccctggtctgctcc

SEQ ID NO: 7262516 - DNA, 22 bp, Homo sapiens
gctgggagcaaagccatgcata

SEQ ID NO: 7262517 - DNA, 22 bp, Homo sapiens
gctgggaggaatttggggaata

SEQ ID NO: 7262518 - DNA, 22 bp, Homo sapiens
gctgggagccgtacctgtcacg

SEQ ID NO: 7262519 - DNA, 22 bp, Homo sapiens
gctggcagccaagtgaagaggg

SEQ ID NO: 7262520 - DNA, 22 bp, Homo sapiens
gcttccagcaccagcagagggg

SEQ ID NO: 7262521 - DNA, 22 bp, Homo sapiens
gcttccagaccccagtccctca

SEQ ID NO: 7262522 - DNA, 22 bp, Homo sapiens
caatggttctcaaactatcatg

SEQ ID NO: 7262523 - DNA, 22 bp, Homo sapiens
ggaggagattcccctctcactt

SEQ ID NO: 7262524 - DNA, 22 bp, Homo sapiens
ggaggagacggagtgattagtg

SEQ ID NO: 7262525 - DNA, 22 bp, Homo sapiens
cacagcataatgaaatatactt

SEQ ID NO: 7262526 - DNA, 22 bp, Homo sapiens
ggaagagaatttctctcttttt

SEQ ID NO: 7262527 - DNA, 22 bp, Homo sapiens
ggaagagattctttacattcat

SEQ ID NO: 7262528 - DNA, 22 bp, Homo sapiens
ggagagttgtttttgcctagat

SEQ ID NO: 7262529 - DNA, 19 bp, Homo sapiens
cagaaatagcgaagtgtaa

SEQ ID NO: 7262530 - DNA, 22 bp, Homo sapiens
cagaacagacttaacagggctg

SEQ ID NO: 7262531 - DNA, 22 bp, Homo sapiens
cagaacagtcgcctgcatggat

SEQ ID NO: 7262532 - DNA, 22 bp, Homo sapiens
cagaacaggtcatgcttgctgt

SEQ ID NO: 7262533 - DNA, 20 bp, Homo sapiens
cagaacagtctgagaggcca

SEQ ID NO: 7262534 - DNA, 21 bp, Homo sapiens
gtgaattaattatatgcctta

SEQ ID NO: 7262535 - DNA, 22 bp, Homo sapiens
gtgcaaaagtaattacagtttt

SEQ ID NO: 7262536 - DNA, 22 bp, Homo sapiens
gtcctctgtgtaggctgcagac

SEQ ID NO: 7262537 - DNA, 22 bp, Homo sapiens
cagcatgatgagtgcagtttgg

SEQ ID NO: 7262538 - DNA, 22 bp, Homo sapiens
gtctatttgggatcatgatatg

SEQ ID NO: 7262539 - DNA, 22 bp, Homo sapiens
ggtgcagagtccacagaaagct

SEQ ID NO: 7262540 - DNA, 22 bp, Homo sapiens
cagatgcttcgtgggtgagcac

SEQ ID NO: 7262541 - DNA, 17 bp, Homo sapiens
gtaaggcttgcagatgc

SEQ ID NO: 7262542 - DNA, 22 bp, Homo sapiens
gtaagaggagtgggaagcctca

SEQ ID NO: 7262543 - DNA, 22 bp, Homo sapiens
cagaagcaagtagtgattcttt

SEQ ID NO: 7262544 - DNA, 22 bp, Homo sapiens
cagagagaatatgtagtatgga

SEQ ID NO: 7262545 - DNA, 22 bp, Homo sapiens
cagagagaggggctgcctggcc

SEQ ID NO: 7262546 - DNA, 22 bp, Homo sapiens
cagagagagtggggtgtggatt

SEQ ID NO: 7262547 - DNA, 22 bp, Homo sapiens
cagaggcagccgggggagaacg

SEQ ID NO: 7262548 - DNA, 22 bp, Homo sapiens
catcaatgtgcagagatgaacg

SEQ ID NO: 7262549 - DNA, 17 bp, Homo sapiens
catcaaagaaatttcca

SEQ ID NO: 7262550 - DNA, 22 bp, Homo sapiens
tccaagcactgttaattaaact

SEQ ID NO: 7262551 - DNA, 22 bp, Homo sapiens
tccaagcatgtggtcaggagcc

SEQ ID NO: 7262552 - DNA, 22 bp, Homo sapiens
ccagcacacagtgggtgcccag

SEQ ID NO: 7262553 - DNA, 22 bp, Homo sapiens
catttattggcatgtagtaggt

SEQ ID NO: 7262554 - DNA, 22 bp, Homo sapiens
catttcattcctttgaaagtgg

SEQ ID NO: 7262555 - DNA, 22 bp, Homo sapiens
cattttcatgagtttctgttca

SEQ ID NO: 7262556 - DNA, 21 bp, Homo sapiens
tcctgccttagtccagagcag

SEQ ID NO: 7262557 - DNA, 22 bp, Homo sapiens
ccacaggctgctgcaggtcccg

SEQ ID NO: 7262558 - DNA, 22 bp, Homo sapiens
ccacaggcggagtggcgggcag

SEQ ID NO: 7262559 - DNA, 22 bp, Homo sapiens
caggcctgtgacaccgtgtctg

SEQ ID NO: 7262560 - DNA, 22 bp, Homo sapiens
caggcctgtgagttgaggcccc

SEQ ID NO: 7262561 - DNA, 22 bp, Homo sapiens
tacaatagggcttttgtttatg

SEQ ID NO: 7262562 - DNA, 22 bp, Homo sapiens
tacacagaacctggtgtacagt

SEQ ID NO: 7262563 - DNA, 22 bp, Homo sapiens
tacacttataactctgtgtgtg

SEQ ID NO: 7262564 - DNA, 22 bp, Homo sapiens
tagacatttctggttattgaca

SEQ ID NO: 7262565 - DNA, 22 bp, Homo sapiens
tagaacataagtcattcatttg

SEQ ID NO: 7262566 - DNA, 22 bp, Homo sapiens
tagaacagcatttggctattaa

SEQ ID NO: 7262567 - DNA, 22 bp, Homo sapiens
tcacacatgtaagggctttgga

SEQ ID NO: 7262568 - DNA, 22 bp, Homo sapiens
tcacacatttctcaagtgtagg

SEQ ID NO: 7262569 - DNA, 16 bp, Homo sapiens
tcacacatttgttggt

SEQ ID NO: 7262570 - DNA, 22 bp, Homo sapiens
tatatatatgcacacacaccta

SEQ ID NO: 7262571 - DNA, 22 bp, Homo sapiens
tatattcatattgttgtctctc

SEQ ID NO: 7262572 - DNA, 22 bp, Homo sapiens
tatattcaatgattagtatcag

SEQ ID NO: 7262573 - DNA, 22 bp, Homo sapiens
tggcagaagtacacaagcatgc

SEQ ID NO: 7262574 - DNA, 22 bp, Homo sapiens
tggcagaattttaaagacagat

SEQ ID NO: 7262575 - DNA, 22 bp, Homo sapiens
tggcagaatttctagcagattc

SEQ ID NO: 7262576 - DNA, 22 bp, Homo sapiens
ccctggagtcctggcagttgat

SEQ ID NO: 7262577 - DNA, 22 bp, Homo sapiens
cccttgaggtagactgaacacc

SEQ ID NO: 7262578 - DNA, 22 bp, Homo sapiens
ccccagctgagatttgaggaga

SEQ ID NO: 7262579 - DNA, 19 bp, Homo sapiens
cccagtctaggtcctagga

SEQ ID NO: 7262580 - DNA, 22 bp, Homo sapiens
tgctacagagccaggaagagtg

SEQ ID NO: 7262581 - DNA, 22 bp, Homo sapiens
cctccaggtgttacatatgact

SEQ ID NO: 7262582 - DNA, 22 bp, Homo sapiens
cctcccacatcctagctctgct

SEQ ID NO: 7262583 - DNA, 22 bp, Homo sapiens
cctcccacattgaggacatgct

SEQ ID NO: 7262584 - DNA, 22 bp, Homo sapiens
cctcccacttcttgctgaggtc

SEQ ID NO: 7262585 - DNA, 22 bp, Homo sapiens
tcttcctcaatgtaacaacccc

SEQ ID NO: 7262586 - DNA, 22 bp, Homo sapiens
ccagggcacgttgggacagtac

SEQ ID NO: 7262587 - DNA, 22 bp, Homo sapiens
tgaaggtgtttatacctcagat

SEQ ID NO: 7262588 - DNA, 22 bp, Homo sapiens
ccagggcagtgggagaaggtgc

SEQ ID NO: 7262589 - DNA, 22 bp, Homo sapiens
tgagttgccctgccctgtgctt

SEQ ID NO: 7262590 - DNA, 22 bp, Homo sapiens
tgagttgctatctagatccaga

SEQ ID NO: 7262591 - DNA, 22 bp, Homo sapiens
ccatagcaagaggagcagaaat

SEQ ID NO: 7262592 - DNA, 19 bp, Homo sapiens
tgcagagagaggcaaagaa

SEQ ID NO: 7262593 - DNA, 22 bp, Homo sapiens
tgcagagagatatggcaagagg

SEQ ID NO: 7262594 - DNA, 22 bp, Homo sapiens
tgcactccaggctgggtgacag

SEQ ID NO: 7262595 - DNA, 22 bp, Homo sapiens
ctcagaaaacctctttcttgat

SEQ ID NO: 7262596 - DNA, 20 bp, Homo sapiens
ctcagaaaagctaaggagaa

SEQ ID NO: 7262597 - DNA, 22 bp, Homo sapiens
ttcttaaaattcaagctaggtt

SEQ ID NO: 7262598 - DNA, 22 bp, Homo sapiens
ttcttaaagaggcaaaacacag

SEQ ID NO: 7262599 - DNA, 22 bp, Homo sapiens
ttgcacagtttgaagatgactc

SEQ ID NO: 7262600 - DNA, 22 bp, Homo sapiens
ttgcacatgctatttatgtttt

SEQ ID NO: 7262601 - DNA, 22 bp, Homo sapiens
ttgctgagctttggcaaggaag

SEQ ID NO: 7262602 - DNA, 22 bp, Homo sapiens
ttgcaaaaccatcctaagtaaa

SEQ ID NO: 7262603 - DNA, 22 bp, Homo sapiens
ctcagaaacggagctgccattt

SEQ ID NO: 7262604 - DNA, 22 bp, Homo sapiens
ctcagaaagcaatctggtgagg

SEQ ID NO: 7262605 - DNA, 22 bp, Homo sapiens
ctcagaaacggagctgccattt

SEQ ID NO: 7262606 - DNA, 22 bp, Homo sapiens
ctaaattatttgcacattagag

SEQ ID NO: 7262607 - DNA, 22 bp, Homo sapiens
ttctacatgagaaaatgtattt

SEQ ID NO: 7262608 - DNA, 22 bp, Homo sapiens
ttcctctcctcacatgagtcac

SEQ ID NO: 7262609 - DNA, 22 bp, Homo sapiens
ttcctccttgtcctagttactg

SEQ ID NO: 7262610 - DNA, 22 bp, Homo sapiens
ttcctccttcccattcctgggg

SEQ ID NO: 7262611 - DNA, 22 bp, Homo sapiens
ttcctaaaagctgagtagagaa

SEQ ID NO: 7262612 - DNA, 22 bp, Homo sapiens
ttcctcctctgtaaaacgggca

SEQ ID NO: 7262613 - DNA, 21 bp, Homo sapiens
ttcctcctctggagaagaaga

SEQ ID NO: 7262614 - DNA, 17 bp, Homo sapiens
ttcctcctcaccatgtt

SEQ ID NO: 7262615 - DNA, 22 bp, Homo sapiens
ttcctcctacgcttatcacttt

SEQ ID NO: 7262616 - DNA, 22 bp, Homo sapiens
ttccacttttctctctcatgcc

SEQ ID NO: 7262617 - DNA, 22 bp, Homo sapiens
tggttcctcaagcgctggcggc

SEQ ID NO: 7262618 - DNA, 22 bp, Homo sapiens
tgttgcagaatctcaaaacagt

SEQ ID NO: 7262619 - DNA, 22 bp, Homo sapiens
tgttttctagaaacaatgccta

SEQ ID NO: 7262620 - DNA, 22 bp, Homo sapiens
ttacaatagttccttcttttgt

SEQ ID NO: 7262621 - DNA, 22 bp, Homo sapiens
tgttttctattacctgagattg

SEQ ID NO: 7262622 - DNA, 22 bp, Homo sapiens
tgttttctcttgaaaagcagtc

SEQ ID NO: 7262623 - DNA, 22 bp, Homo sapiens
ttaaaatagccagtgcccctct

SEQ ID NO: 7262624 - DNA, 22 bp, Homo sapiens
ttatgtactctgcaatgtttga

SEQ ID NO: 7262625 - DNA, 22 bp, Homo sapiens
ttcaaaaaggtatgttcaagtc

SEQ ID NO: 7262626 - DNA, 17 bp, Homo sapiens
ttattttttgggctgag

SEQ ID NO: 7262627 - DNA, 22 bp, Homo sapiens
ttatttttaaaagttcacacag

SEQ ID NO: 7262628 - DNA, 22 bp, Homo sapiens
cgcagaagaggttgtctagtcc

SEQ ID NO: 7262629 - DNA, 22 bp, Homo sapiens
cgcaccactgaattccagcctg

SEQ ID NO: 7262630 - DNA, 22 bp, Homo sapiens
ctgcctctggcctcaggcccag

SEQ ID NO: 7262631 - DNA, 22 bp, Homo sapiens
ctgctgagccgcacccaggagc

SEQ ID NO: 7262632 - DNA, 22 bp, Homo sapiens
ttttctcaggtgcttatctaag

SEQ ID NO: 7262633 - DNA, 22 bp, Homo sapiens
tttttcttgtgctggatctaat

SEQ ID NO: 7262634 - DNA, 19 bp, Homo sapiens
tttctgtttgcttctggtt

SEQ ID NO: 7262635 - DNA, 22 bp, Homo sapiens
tttctgttgtatggcttctgca

SEQ ID NO: 7262636 - DNA, 22 bp, Homo sapiens
tttctgttgttggtgtctggct

SEQ ID NO: 7262637 - DNA, 22 bp, Homo sapiens
tttctgttgtacttaaactagg

SEQ ID NO: 7262638 - DNA, 22 bp, Homo sapiens
tttcttatactatattgtcatc

SEQ ID NO: 7262639 - DNA, 22 bp, Homo sapiens
ctccggagaggtcggaaaacag

SEQ ID NO: 7262640 - DNA, 22 bp, Homo sapiens
ttgtttcagctgtatgctatgt

SEQ ID NO: 7262641 - DNA, 22 bp, Homo sapiens
ttgtttcagctgtatgctatgt

SEQ ID NO: 7262642 - DNA, 22 bp, Homo sapiens
ttgtttcagcccagatctttac

SEQ ID NO: 7262643 - DNA, 22 bp, Homo sapiens
tttacaattggttttctctaat

SEQ ID NO: 7262644 - DNA, 22 bp, Homo sapiens
tttcaaagtaaggattttcatc

SEQ ID NO: 7262645 - DNA, 22 bp, Homo sapiens
tttcaaagtcaatatcattacc

SEQ ID NO: 7262646 - DNA, 22 bp, Homo sapiens
ctcctgtcaataggctcctggc

SEQ ID NO: 7262647 - DNA, 22 bp, Homo sapiens
tttcaaagttgggaattgtaat

SEQ ID NO: 7262648 - DNA, 22 bp, Homo sapiens
gaaagagaggggctgagatgca

SEQ ID NO: 7262649 - DNA, 22 bp, Homo sapiens
gaaaattattgaaaatggctct

SEQ ID NO: 7262650 - DNA, 22 bp, Homo sapiens
cttgttttggctagtatgatgt

SEQ ID NO: 7262651 - DNA, 22 bp, Homo sapiens
ctttctttgcagtgagccagag

SEQ ID NO: 7262652 - DNA, 22 bp, Homo sapiens
ctttctttgtccaccaacaatg

SEQ ID NO: 7262653 - DNA, 22 bp, Homo sapiens
cttaaagagtatttaatataat

SEQ ID NO: 7262654 - DNA, 22 bp, Homo sapiens
cttaattacccaatgtggtagg

SEQ ID NO: 7262655 - DNA, 22 bp, Homo sapiens
cttaaagaaattgaggagagga

SEQ ID NO: 7262656 - DNA, 22 bp, Homo sapiens
cttaaaatctggcagttagcta

SEQ ID NO: 7262657 - DNA, 19 bp, Homo sapiens
ctgtttctgagcttgcttt

SEQ ID NO: 7262658 - DNA, 22 bp, Homo sapiens
ctgtttaatgcaatgaaatgag

SEQ ID NO: 7262659 - DNA, 22 bp, Homo sapiens
cttataaagtccatctgaacaa

SEQ ID NO: 7262660 - DNA, 22 bp, Homo sapiens
cttaggagttcacttgaatagt

SEQ ID NO: 7262661 - DNA, 22 bp, Homo sapiens
ctgtcaaagactaaggttctta

SEQ ID NO: 7262662 - DNA, 22 bp, Homo sapiens
gagctgagtatgaaggatgtga

SEQ ID NO: 7262663 - DNA, 22 bp, Homo sapiens
gagctgcttccagagttgagtg

SEQ ID NO: 7262664 - DNA, 22 bp, Homo sapiens
gaggctcacgacgggacgaact

SEQ ID NO: 7262665 - DNA, 20 bp, Homo sapiens
gaggctgaagtgtttttgct

SEQ ID NO: 7262666 - DNA, 22 bp, Homo sapiens
gaggagaggggctcccaagagc

SEQ ID NO: 7262667 - DNA, 22 bp, Homo sapiens
gaggagaggccatcgttgttat

SEQ ID NO: 7262668 - DNA, 22 bp, Homo sapiens
gaggctgagtagctttgtgctc

SEQ ID NO: 7262669 - DNA, 22 bp, Homo sapiens
gagagaaccctaaatgagatat

SEQ ID NO: 7262670 - DNA, 22 bp, Homo sapiens
gacatttaggtagcttccagtt

SEQ ID NO: 7262671 - DNA, 22 bp, Homo sapiens
gacatttagaagttagattcaa

SEQ ID NO: 7262672 - DNA, 22 bp, Homo sapiens
gacatttagctgttttgcattt

SEQ ID NO: 7262673 - DNA, 22 bp, Homo sapiens
gacattgggtgtacaattggca

SEQ ID NO: 7262674 - DNA, 22 bp, Homo sapiens
gacattggctgttcattgggat

SEQ ID NO: 7262675 - DNA, 22 bp, Homo sapiens
gacatttaaattgcaggcagcc

SEQ ID NO: 7262676 - DNA, 22 bp, Homo sapiens
gacatttaaggcagtcacttaa

SEQ ID NO: 7262677 - DNA, 22 bp, Homo sapiens
gacatttaatagtattgtggga

SEQ ID NO: 7262678 - DNA, 22 bp, Homo sapiens
gacatttactgaatactgatta

SEQ ID NO: 7262679 - DNA, 22 bp, Homo sapiens
gacatttagaagtctaatggcc

SEQ ID NO: 7262680 - DNA, 22 bp, Homo sapiens
gacattcacaggtaaacattcc

SEQ ID NO: 7262681 - DNA, 22 bp, Homo sapiens
gacattcaactttgatgattat

SEQ ID NO: 7262682 - DNA, 22 bp, Homo sapiens
gacagagattgaatcaggaaat

SEQ ID NO: 7262683 - DNA, 22 bp, Homo sapiens
gaagcatgctaaggattctcag

SEQ ID NO: 7262684 - DNA, 22 bp, Homo sapiens
gaaggtgtctggcccagagtct

SEQ ID NO: 7262685 - DNA, 22 bp, Homo sapiens
gaatgatttggttgtttagatt

SEQ ID NO: 7262686 - DNA, 20 bp, Homo sapiens
gcaagcatgaagagtagaga

SEQ ID NO: 7262687 - DNA, 22 bp, Homo sapiens
gcaagctgatgtgatagtgaaa

SEQ ID NO: 7262688 - DNA, 22 bp, Homo sapiens
gcatccttttttcctgccctgc

SEQ ID NO: 7262689 - DNA, 22 bp, Homo sapiens
gcatccttgggcccagctcctg

SEQ ID NO: 7262690 - DNA, 22 bp, Homo sapiens
gcatttttgatcccactaggat

SEQ ID NO: 7262691 - DNA, 22 bp, Homo sapiens
gcggggggaggaacatcttgca

SEQ ID NO: 7262692 - DNA, 22 bp, Homo sapiens
gcgcgtcctccctcggctgctg

SEQ ID NO: 7262693 - DNA, 16 bp, Homo sapiens
gcgcctcctcggcctc

SEQ ID NO: 7262694 - DNA, 22 bp, Homo sapiens
gcgccctccacccacagcggct

SEQ ID NO: 7262695 - DNA, 22 bp, Homo sapiens
gcgagaaactaagtgccctttg

SEQ ID NO: 7262696 - DNA, 22 bp, Homo sapiens
gctgcagactgggaggcaggtg

SEQ ID NO: 7262697 - DNA, 22 bp, Homo sapiens
gctgggagaggccctgaagtga

SEQ ID NO: 7262698 - DNA, 22 bp, Homo sapiens
ggagagcttggagtgcgatttt

SEQ ID NO: 7262699 - DNA, 22 bp, Homo sapiens
gcttcctccctgctgctcacta

SEQ ID NO: 7262700 - DNA, 22 bp, Homo sapiens
ggaacattggcattttaaggct

SEQ ID NO: 7262701 - DNA, 21 bp, Homo sapiens
ggaacattgttaatagtctct

SEQ ID NO: 7262702 - DNA, 22 bp, Homo sapiens
ggaacattctagagtgttgtga

SEQ ID NO: 7262703 - DNA, 22 bp, Homo sapiens
ggaacatttaaattcttatttg

SEQ ID NO: 7262704 - DNA, 22 bp, Homo sapiens
ggaacatttcctggcagagagg

SEQ ID NO: 7262705 - DNA, 15 bp, Homo sapiens
ggaacatttctgttt

SEQ ID NO: 7262706 - DNA, 22 bp, Homo sapiens
ggaacattttttaaggcagaaa

SEQ ID NO: 7262707 - DNA, 22 bp, Homo sapiens
ggagttgccaaggcttgaaaat

SEQ ID NO: 7262708 - DNA, 22 bp, Homo sapiens
ggagttgctgagacagaacaca

SEQ ID NO: 7262709 - DNA, 22 bp, Homo sapiens
ggagttgctggatgtggtttaa

SEQ ID NO: 7262710 - DNA, 22 bp, Homo sapiens
ggagttgttctgcaggagagaa

SEQ ID NO: 7262711 - DNA, 22 bp, Homo sapiens
ggagcaccctgctcagccaagc

SEQ ID NO: 7262712 - DNA, 22 bp, Homo sapiens
ggcagaagataggacagggaat

SEQ ID NO: 7262713 - DNA, 22 bp, Homo sapiens
ggcagaagataggacagggaat

SEQ ID NO: 7262714 - DNA, 22 bp, Homo sapiens
ggcagaagacaggcaaatcatg

SEQ ID NO: 7262715 - DNA, 22 bp, Homo sapiens
ggcagaagaaaggctaagtctc

SEQ ID NO: 7262716 - DNA, 19 bp, Homo sapiens
ggcagaaggtgtaggggga

SEQ ID NO: 7262717 - DNA, 22 bp, Homo sapiens
ggcagaaggcaattagagactg

SEQ ID NO: 7262718 - DNA, 22 bp, Homo sapiens
ggcagaaggcctcccagctcct

SEQ ID NO: 7262719 - DNA, 22 bp, Homo sapiens
ggcagaagtgatgggatataac

SEQ ID NO: 7262720 - DNA, 21 bp, Homo sapiens
ggcagaagtagcatggacggg

SEQ ID NO: 7262721 - DNA, 22 bp, Homo sapiens
ggcagaaggttgaagtaatttg

SEQ ID NO: 7262722 - DNA, 22 bp, Homo sapiens
ggctctggggttggcccatctc

SEQ ID NO: 7262723 - DNA, 22 bp, Homo sapiens
gggagctggagctggaagactc

SEQ ID NO: 7262724 - DNA, 22 bp, Homo sapiens
gggagctgagctggaagagaat

SEQ ID NO: 7262725 - DNA, 22 bp, Homo sapiens
ggctttgacatgctgaattaaa

SEQ ID NO: 7262726 - DNA, 22 bp, Homo sapiens
gggaggttgaggctgcagtgag

SEQ ID NO: 7262727 - DNA, 22 bp, Homo sapiens
gggtagtttaattaggaagaaa

SEQ ID NO: 7262728 - DNA, 22 bp, Homo sapiens
gtagctctgtttaaagttcttt

SEQ ID NO: 7262729 - DNA, 22 bp, Homo sapiens
gtagctatttatgatactcatg

SEQ ID NO: 7262730 - DNA, 22 bp, Homo sapiens
gtgattttgagacctatatagt

SEQ ID NO: 7262731 - DNA, 22 bp, Homo sapiens
gtgcctcccgggaccatgcact

SEQ ID NO: 7262732 - DNA, 22 bp, Homo sapiens
gtgcctccatcagtgcctccaa

SEQ ID NO: 7262733 - DNA, 22 bp, Homo sapiens
gtgcctcccggggctcttcctt

SEQ ID NO: 7262734 - DNA, 22 bp, Homo sapiens
gtgagtaaaggttcattgaatt

SEQ ID NO: 7262735 - DNA, 22 bp, Homo sapiens
gtgagttgggggattagaagct

SEQ ID NO: 7262736 - DNA, 22 bp, Homo sapiens
tagattttacttctgtcattac

SEQ ID NO: 7262737 - DNA, 22 bp, Homo sapiens
tagattttttggagactctctg

SEQ ID NO: 7262738 - DNA, 22 bp, Homo sapiens
tagaggagggctgttcttcagt

SEQ ID NO: 7262739 - DNA, 22 bp, Homo sapiens
tagaggagcggcgagctgagct

SEQ ID NO: 7262740 - DNA, 22 bp, Homo sapiens
tacttgctgttagtattttaca

SEQ ID NO: 7262741 - DNA, 22 bp, Homo sapiens
tagccatttttattaatgctgg

SEQ ID NO: 7262742 - DNA, 22 bp, Homo sapiens
tagccattgacttaaagcttat

SEQ ID NO: 7262743 - DNA, 22 bp, Homo sapiens
tatgcacattcacacaaaaatg

SEQ ID NO: 7262744 - DNA, 22 bp, Homo sapiens
tatgcacagttacaagaatatc

SEQ ID NO: 7262745 - DNA, 22 bp, Homo sapiens
tatcttaaatgcatgatagaca

SEQ ID NO: 7262746 - DNA, 22 bp, Homo sapiens
tatcaaaaggagttgaaagggg

SEQ ID NO: 7262747 - DNA, 22 bp, Homo sapiens
tagttaaagattctgttaagag

SEQ ID NO: 7262748 - DNA, 22 bp, Homo sapiens
tattttcaccttctctggatat

SEQ ID NO: 7262749 - DNA, 22 bp, Homo sapiens
tattttcaccatgtatccctgt

SEQ ID NO: 7262750 - DNA, 22 bp, Homo sapiens
tatttctaagagatatctgtac

SEQ ID NO: 7262751 - DNA, 22 bp, Homo sapiens
tatttcaagaacttctatccat

SEQ ID NO: 7262752 - DNA, 22 bp, Homo sapiens
tatttcaacgtatgaaaagctg

SEQ ID NO: 7262753 - DNA, 22 bp, Homo sapiens
tattcacaggcacgaaatattg

SEQ ID NO: 7262754 - DNA, 22 bp, Homo sapiens
gtttacattgctgtttgtgtct

SEQ ID NO: 7262755 - DNA, 22 bp, Homo sapiens
gtttagaatggcaaaattaagt

SEQ ID NO: 7262756 - DNA, 22 bp, Homo sapiens
gttccacaaagattgtctctct

SEQ ID NO: 7262757 - DNA, 22 bp, Homo sapiens
gttccacatcacactacttgat

SEQ ID NO: 7262758 - DNA, 22 bp, Homo sapiens
gtttcttaaatgtagcaggacc

SEQ ID NO: 7262759 - DNA, 22 bp, Homo sapiens
gttttatttccatgagagaccg

SEQ ID NO: 7262760 - DNA, 22 bp, Homo sapiens
gttttataggctgttgctatat

SEQ ID NO: 7262761 - DNA, 22 bp, Homo sapiens
gttttataattgcttcataaga

SEQ ID NO: 7262762 - DNA, 22 bp, Homo sapiens
taaagtgtgtatatacatatgg

SEQ ID NO: 7262763 - DNA, 22 bp, Homo sapiens
taaagtttattggcaccaccat

SEQ ID NO: 7262764 - DNA, 22 bp, Homo sapiens
taaagtttatttgaacatctct

SEQ ID NO: 7262765 - DNA, 22 bp, Homo sapiens
taaagtttgtagcaattgatat

SEQ ID NO: 7262766 - DNA, 22 bp, Homo sapiens
taaagtttggcagacaataaca

SEQ ID NO: 7262767 - DNA, 22 bp, Homo sapiens
taacacaaaagaatatgtgtgt

SEQ ID NO: 7262768 - DNA, 22 bp, Homo sapiens
taaatacttagttttgtgtcta

SEQ ID NO: 7262769 - DNA, 22 bp, Homo sapiens
taacttctggaaatgcatctgc

SEQ ID NO: 7262770 - DNA, 22 bp, Homo sapiens
taagaaatttagttatagaatg

SEQ ID NO: 7262771 - DNA, 22 bp, Homo sapiens
tacacccacattgagcatggga

SEQ ID NO: 7262772 - DNA, 22 bp, Homo sapiens
taatttcttcatctctgcagct

SEQ ID NO: 7262773 - DNA, 22 bp, Homo sapiens
taatttcttcatctctgcagct

SEQ ID NO: 7262774 - DNA, 22 bp, Homo sapiens
taattttccactctgtttatct

SEQ ID NO: 7262775 - DNA, 22 bp, Homo sapiens
tacaatgaccatattatgtaag

SEQ ID NO: 7262776 - DNA, 22 bp, Homo sapiens
taatgcttaattttcacaagcc

SEQ ID NO: 7262777 - DNA, 22 bp, Homo sapiens
taatgcttttccttcaaataag

SEQ ID NO: 7262778 - DNA, 22 bp, Homo sapiens
taagttttaagcaatctgataa

SEQ ID NO: 7262779 - DNA, 22 bp, Homo sapiens
taagcagtttttcttgtattaa

SEQ ID NO: 7262780 - DNA, 22 bp, Homo sapiens
tacagcacttaattaccttgag

SEQ ID NO: 7262781 - DNA, 22 bp, Homo sapiens
tacagcactgtgcatagtggtt

SEQ ID NO: 7262782 - DNA, 22 bp, Homo sapiens
tacattcagaagaatggacacg

SEQ ID NO: 7262783 - DNA, 22 bp, Homo sapiens
tacattatcttgttatctttca

SEQ ID NO: 7262784 - DNA, 22 bp, Homo sapiens
tacgcctgtaatcccagcactt

SEQ ID NO: 7262785 - DNA, 22 bp, Homo sapiens
tacccaaggccctttcaatttc

SEQ ID NO: 7262786 - DNA, 22 bp, Homo sapiens
tacttgctgggtgtaattttct

SEQ ID NO: 7262787 - DNA, 22 bp, Homo sapiens
tcccttgagagttggccaattg

SEQ ID NO: 7262788 - DNA, 22 bp, Homo sapiens
tcccttgaacgctggggctgga

SEQ ID NO: 7262789 - DNA, 22 bp, Homo sapiens
tccaggcccactcagctgaaat

SEQ ID NO: 7262790 - DNA, 19 bp, Homo sapiens
tccaggccattcccagagc

SEQ ID NO: 7262791 - DNA, 22 bp, Homo sapiens
tccaggccactgcagaggctct

SEQ ID NO: 7262792 - DNA, 22 bp, Homo sapiens
tcccaggaaaacactcgaggac

SEQ ID NO: 7262793 - DNA, 22 bp, Homo sapiens
tccagaaaaagtaatttatttg

SEQ ID NO: 7262794 - DNA, 23 bp, Homo sapiens
tcagcctcttaggacttctcacc

SEQ ID NO: 7262795 - DNA, 22 bp, Homo sapiens
tcagcctgcgtcatggtgacac

SEQ ID NO: 7262796 - DNA, 22 bp, Homo sapiens
tcagcttgatccatccaactat

SEQ ID NO: 7262797 - DNA, 22 bp, Homo sapiens
tcagcttgtgggtcagcctctg

SEQ ID NO: 7262798 - DNA, 22 bp, Homo sapiens
tcagcctcattttctgctctgt

SEQ ID NO: 7262799 - DNA, 22 bp, Homo sapiens
tcagcctcaggtgttcagattt

SEQ ID NO: 7262800 - DNA, 22 bp, Homo sapiens
tcagcctccgaaagtgctggga

SEQ ID NO: 7262801 - DNA, 22 bp, Homo sapiens
tcagcctctctgagtccagacc

SEQ ID NO: 7262802 - DNA, 22 bp, Homo sapiens
tcagcctcctaatttcctgtga

SEQ ID NO: 7262803 - DNA, 22 bp, Homo sapiens
tcataaaatgctcctgatattg

SEQ ID NO: 7262804 - DNA, 20 bp, Homo sapiens
tcataaagaggaaataaata

SEQ ID NO: 7262805 - DNA, 22 bp, Homo sapiens
tcaggcctttcttcagagcttc

SEQ ID NO: 7262806 - DNA, 22 bp, Homo sapiens
tcacatgcagtcactgagcagg

SEQ ID NO: 7262807 - DNA, 22 bp, Homo sapiens
tcaccttgtgatctccctgcct

SEQ ID NO: 7262808 - DNA, 22 bp, Homo sapiens
tcactgctttcaaaaattattg

SEQ ID NO: 7262809 - DNA, 22 bp, Homo sapiens
tcagaagcagaaaataggtggg

SEQ ID NO: 7262810 - DNA, 22 bp, Homo sapiens
tcagaagcaaacatcactctag

SEQ ID NO: 7262811 - DNA, 22 bp, Homo sapiens
tcagaagcaagcttctacttct

SEQ ID NO: 7262812 - DNA, 22 bp, Homo sapiens
tcagaagcatgtggggagcctg

SEQ ID NO: 7262813 - DNA, 22 bp, Homo sapiens
tcagaagcatccatttcaccac

SEQ ID NO: 7262814 - DNA, 22 bp, Homo sapiens
tcagaagcaggagtgtgcacaa

SEQ ID NO: 7262815 - DNA, 22 bp, Homo sapiens
tcagaagcagatatttcaaaat

SEQ ID NO: 7262816 - DNA, 22 bp, Homo sapiens
tcagagaattctcagatgactc

SEQ ID NO: 7262817 - DNA, 22 bp, Homo sapiens
tcacagcaaaagtgtgcagagc

SEQ ID NO: 7262818 - DNA, 20 bp, Homo sapiens
tcacacataagtgaacgcac

SEQ ID NO: 7262819 - DNA, 22 bp, Homo sapiens
tcacacatactcatgtgtgagt

SEQ ID NO: 7262820 - DNA, 22 bp, Homo sapiens
tcacagcagtaaagaaaacact

SEQ ID NO: 7262821 - DNA, 22 bp, Homo sapiens
tcaattctagagccttacattg

SEQ ID NO: 7262822 - DNA, 23 bp, Homo sapiens
tcaattatcaatggaaagaagtt

SEQ ID NO: 7262823 - DNA, 22 bp, Homo sapiens
tcaattctggtcctcaggaact

SEQ ID NO: 7262824 - DNA, 21 bp, Homo sapiens
tcaatacaggtgcatgtgtct

SEQ ID NO: 7262825 - DNA, 22 bp, Homo sapiens
tcaatgatagtacaatcagcct

SEQ ID NO: 7262826 - DNA, 22 bp, Homo sapiens
tcaaaaatggtctttgagctgc

SEQ ID NO: 7262827 - DNA, 22 bp, Homo sapiens
tcaaaagaaacaccatgttcct

SEQ ID NO: 7262828 - DNA, 22 bp, Homo sapiens
tttgcatttgttcaagtattga

SEQ ID NO: 7262829 - DNA, 22 bp, Homo sapiens
tttgcattgcattaagtattct

SEQ ID NO: 7262830 - DNA, 22 bp, Homo sapiens
tttgcattgtaatatttagttc

SEQ ID NO: 7262831 - DNA, 20 bp, Homo sapiens
tttgagaccagtctgcccaa

SEQ ID NO: 7262832 - DNA, 22 bp, Homo sapiens
tttgcattagtttagatttcaa

SEQ ID NO: 7262833 - DNA, 22 bp, Homo sapiens
tttgaaatatgtgatgagagag

SEQ ID NO: 7262834 - DNA, 21 bp, Homo sapiens
tttgaaagtgggtgattcttt

SEQ ID NO: 7262835 - DNA, 22 bp, Homo sapiens
tttgacatgcaaagcactttag

SEQ ID NO: 7262836 - DNA, 22 bp, Homo sapiens
tttgacattaaggaacatatat

SEQ ID NO: 7262837 - DNA, 22 bp, Homo sapiens
tttgaagaagctgacctatttt

SEQ ID NO: 7262838 - DNA, 22 bp, Homo sapiens
tttgaagacatattgttacata

SEQ ID NO: 7262839 - DNA, 22 bp, Homo sapiens
tttgaacagacactttctacag

SEQ ID NO: 7262840 - DNA, 22 bp, Homo sapiens
tttgaacaagagcttcacatta

SEQ ID NO: 7262841 - DNA, 22 bp, Homo sapiens
tttgaacagggaatgttccaca

SEQ ID NO: 7262842 - DNA, 22 bp, Homo sapiens
tttgaacagtagcttaggtgtg

SEQ ID NO: 7262843 - DNA, 22 bp, Homo sapiens
tttgaacaggagtatctatagt

SEQ ID NO: 7262844 - DNA, 23 bp, Homo sapiens
tttgaacatttctagattacata

SEQ ID NO: 7262845 - DNA, 22 bp, Homo sapiens
tttgaacatgctgcatgataat

SEQ ID NO: 7262846 - DNA, 22 bp, Homo sapiens
tttgaacatcactgtagggtga

SEQ ID NO: 7262847 - DNA, 22 bp, Homo sapiens
tttgaacattcaacagacccag

SEQ ID NO: 7262848 - DNA, 17 bp, Homo sapiens
ttttggtgagttgtttc

SEQ ID NO: 7262849 - DNA, 22 bp, Homo sapiens
ttttggcttttcctcagcaagc

SEQ ID NO: 7262850 - DNA, 22 bp, Homo sapiens
ttttggctcttggtaggtcaga

SEQ ID NO: 7262851 - DNA, 22 bp, Homo sapiens
ttttttatctatggtagtacca

SEQ ID NO: 7262852 - DNA, 22 bp, Homo sapiens
ttttagaagtgcctatcctatg

SEQ ID NO: 7262853 - DNA, 22 bp, Homo sapiens
ttttacaagctgagtcgttaaa

SEQ ID NO: 7262854 - DNA, 22 bp, Homo sapiens
ttttacaggtcataggtatagt

SEQ ID NO: 7262855 - DNA, 23 bp, Homo sapiens
ttttaatttggacataagaagat

SEQ ID NO: 7262856 - DNA, 22 bp, Homo sapiens
ttttttggtgctcctaggaagg

SEQ ID NO: 7262857 - DNA, 22 bp, Homo sapiens
ttttttggataataaacgatct

SEQ ID NO: 7262858 - DNA, 20 bp, Homo sapiens
tttcaagtcagcaattctca

SEQ ID NO: 7262859 - DNA, 22 bp, Homo sapiens
tttcacaactgcttatttgaga

SEQ ID NO: 7262860 - DNA, 22 bp, Homo sapiens
tttcacattcagatatagactt

SEQ ID NO: 7262861 - DNA, 22 bp, Homo sapiens
tttcgtttgcttatataataga

SEQ ID NO: 7262862 - DNA, 22 bp, Homo sapiens
tttctaaaatagattttatggt

SEQ ID NO: 7262863 - DNA, 22 bp, Homo sapiens
tttcccacacagtccactgcag

SEQ ID NO: 7262864 - DNA, 22 bp, Homo sapiens
tttcataatactgtacatgaaa

SEQ ID NO: 7262865 - DNA, 22 bp, Homo sapiens
tttacagctagacatacctgag

SEQ ID NO: 7262866 - DNA, 22 bp, Homo sapiens
tttacagatctgttgatttgtt

SEQ ID NO: 7262867 - DNA, 22 bp, Homo sapiens
tttaagatcatttgtattatcc

SEQ ID NO: 7262868 - DNA, 22 bp, Homo sapiens
tttaagagcctgtacaaatatt

SEQ ID NO: 7262869 - DNA, 22 bp, Homo sapiens
tttaagagctagtatgtcattt

SEQ ID NO: 7262870 - DNA, 22 bp, Homo sapiens
tttaagagctagtatgtcattt

SEQ ID NO: 7262871 - DNA, 22 bp, Homo sapiens
tttaagagttaaactttgacct

SEQ ID NO: 7262872 - DNA, 22 bp, Homo sapiens
tttaagacttagatttattggg

SEQ ID NO: 7262873 - DNA, 22 bp, Homo sapiens
tttaagagcatttgcaatttat

SEQ ID NO: 7262874 - DNA, 22 bp, Homo sapiens
tttaagagcatttgcaatttat

SEQ ID NO: 7262875 - DNA, 22 bp, Homo sapiens
tttaagaagttatgttataaat

SEQ ID NO: 7262876 - DNA, 22 bp, Homo sapiens
tttatctgttgtacatttatgc

SEQ ID NO: 7262877 - DNA, 22 bp, Homo sapiens
tttagtgtaagcataaagaaca

SEQ ID NO: 7262878 - DNA, 22 bp, Homo sapiens
tttagcttttgtgtcagataag

SEQ ID NO: 7262879 - DNA, 22 bp, Homo sapiens
tttaggatgctctattctgact

SEQ ID NO: 7262880 - DNA, 19 bp, Homo sapiens
tttagcttacgtttcattg

SEQ ID NO: 7262881 - DNA, 22 bp, Homo sapiens
tttatgtttgcattttcaaaga

SEQ ID NO: 7262882 - DNA, 22 bp, Homo sapiens
tttatgtcccttcaaatgttta

SEQ ID NO: 7262883 - DNA, 22 bp, Homo sapiens
ttgctttagggcaaatatttca

SEQ ID NO: 7262884 - DNA, 22 bp, Homo sapiens
ttgcttgcctgttaggagaaac

SEQ ID NO: 7262885 - DNA, 22 bp, Homo sapiens
ttgaggtattgatattttatga

SEQ ID NO: 7262886 - DNA, 22 bp, Homo sapiens
ttgctatttcctgaaataagca

SEQ ID NO: 7262887 - DNA, 22 bp, Homo sapiens
ttgctcagcactggagccagct

SEQ ID NO: 7262888 - DNA, 22 bp, Homo sapiens
ttgctattttgagagtcatagt

SEQ ID NO: 7262889 - DNA, 22 bp, Homo sapiens
ttgcttcagtcagtgctgccca

SEQ ID NO: 7262890 - DNA, 22 bp, Homo sapiens
ttgcctgtttgagagctgtgtt

SEQ ID NO: 7262891 - DNA, 22 bp, Homo sapiens
ttgccattaaaacatgttatct

SEQ ID NO: 7262892 - DNA, 22 bp, Homo sapiens
ttggctatgcttgtgttcagtt

SEQ ID NO: 7262893 - DNA, 22 bp, Homo sapiens
ttgggctcaggagtttgagacc

SEQ ID NO: 7262894 - DNA, 22 bp, Homo sapiens
ttgtgagatgatttgaaagtgt

SEQ ID NO: 7262895 - DNA, 22 bp, Homo sapiens
ttgtagctaggtttttgtagaa

SEQ ID NO: 7262896 - DNA, 22 bp, Homo sapiens
ttgaaagatatgttaatctttc

SEQ ID NO: 7262897 - DNA, 22 bp, Homo sapiens
ttgaaacattacctgtatttcc

SEQ ID NO: 7262898 - DNA, 22 bp, Homo sapiens
ttgaaagacattatttatatat

SEQ ID NO: 7262899 - DNA, 22 bp, Homo sapiens
ttgaggtagtacttattattgg

SEQ ID NO: 7262900 - DNA, 22 bp, Homo sapiens
ttcttctaaatgtgcttattaa

SEQ ID NO: 7262901 - DNA, 22 bp, Homo sapiens
ttcttcagatggtgagacctcc

SEQ ID NO: 7262902 - DNA, 22 bp, Homo sapiens
ttcttcctcacactctcaccca

SEQ ID NO: 7262903 - DNA, 22 bp, Homo sapiens
ttcttctgacactgatgctgta

SEQ ID NO: 7262904 - DNA, 20 bp, Homo sapiens
ttcttctctagttatcttca

SEQ ID NO: 7262905 - DNA, 22 bp, Homo sapiens
ttcttctgcctcccacctgata

SEQ ID NO: 7262906 - DNA, 22 bp, Homo sapiens
ttcttctgattgccttctgcaa

SEQ ID NO: 7262907 - DNA, 22 bp, Homo sapiens
ttcgactctgtgcctgaagagc

SEQ ID NO: 7262908 - DNA, 22 bp, Homo sapiens
ttcgtttagtccacaaatgcat

SEQ ID NO: 7262909 - DNA, 22 bp, Homo sapiens
ttctaaaaccaattctgcttct

SEQ ID NO: 7262910 - DNA, 22 bp, Homo sapiens
ttctaactctgttatgtgtttc

SEQ ID NO: 7262911 - DNA, 22 bp, Homo sapiens
ttctaactctacactagctttg

SEQ ID NO: 7262912 - DNA, 22 bp, Homo sapiens
ttctaaattttggaagatgcag

SEQ ID NO: 7262913 - DNA, 22 bp, Homo sapiens
ttctcactatgtatgtagattg

SEQ ID NO: 7262914 - DNA, 22 bp, Homo sapiens
ttctcagaattgactgggagca

SEQ ID NO: 7262915 - DNA, 22 bp, Homo sapiens
ttctcagaaaatgtagagaaaa

SEQ ID NO: 7262916 - DNA, 22 bp, Homo sapiens
ttctcagaaaagcaagctttct

SEQ ID NO: 7262917 - DNA, 22 bp, Homo sapiens
ttctaactttcaaggtcctttc

SEQ ID NO: 7262918 - DNA, 22 bp, Homo sapiens
ttctcagatatttgtatggaac

SEQ ID NO: 7262919 - DNA, 22 bp, Homo sapiens
ttctcagatatttactgagcat

SEQ ID NO: 7262920 - DNA, 22 bp, Homo sapiens
ttctcagatccatcagaagtcc

SEQ ID NO: 7262921 - DNA, 22 bp, Homo sapiens
ttctcagagtgaccaagtcttt

SEQ ID NO: 7262922 - DNA, 21 bp, Homo sapiens
ttctcagagtctattacagtt

SEQ ID NO: 7262923 - DNA, 22 bp, Homo sapiens
ttctcagaggctgctaagtgca

SEQ ID NO: 7262924 - DNA, 22 bp, Homo sapiens
ttctcagaggagtcgggagctg

SEQ ID NO: 7262925 - DNA, 19 bp, Homo sapiens
ttctcagagcttgcagcac

SEQ ID NO: 7262926 - DNA, 22 bp, Homo sapiens
ttctcagagctcactgtagtaa

SEQ ID NO: 7262927 - DNA, 22 bp, Homo sapiens
ttctcagagcactgctgacaaa

SEQ ID NO: 7262928 - DNA, 18 bp, Homo sapiens
ttctcagactttggaagt

SEQ ID NO: 7262929 - DNA, 22 bp, Homo sapiens
ttctcagacttccagcaccagc

SEQ ID NO: 7262930 - DNA, 22 bp, Homo sapiens
ttctgattgctgatgaggccca

SEQ ID NO: 7262931 - DNA, 17 bp, Homo sapiens
ttctcctctgtgtcctt

SEQ ID NO: 7262932 - DNA, 22 bp, Homo sapiens
ttcaaacaactcatttatgcaa

SEQ ID NO: 7262933 - DNA, 22 bp, Homo sapiens
ttcaaaattgttctaagctctg

SEQ ID NO: 7262934 - DNA, 21 bp, Homo sapiens
ttcaaaatggtgtgtttgtct

SEQ ID NO: 7262935 - DNA, 21 bp, Homo sapiens
ttcaaaatggtgtgtttgtct

SEQ ID NO: 7262936 - DNA, 22 bp, Homo sapiens
ttattttctcctcagaaagtgg

SEQ ID NO: 7262937 - DNA, 22 bp, Homo sapiens
ttatttaattttctcactcaga

SEQ ID NO: 7262938 - DNA, 22 bp, Homo sapiens
ttatttagtctagatgaatttt

SEQ ID NO: 7262939 - DNA, 22 bp, Homo sapiens
ttatttaaaagtggtaagattc

SEQ ID NO: 7262940 - DNA, 22 bp, Homo sapiens
ttatttaatgtgatctgaagag

SEQ ID NO: 7262941 - DNA, 19 bp, Homo sapiens
tcctccttacttcctcttg

SEQ ID NO: 7262942 - DNA, 22 bp, Homo sapiens
ttcatagtgtttccttccagtg

SEQ ID NO: 7262943 - DNA, 20 bp, Homo sapiens
ttcagaaataaggaatgagg

SEQ ID NO: 7262944 - DNA, 22 bp, Homo sapiens
ttcagaaatgaatattggtatt

SEQ ID NO: 7262945 - DNA, 22 bp, Homo sapiens
ttcaatatgatattagctgtgg

SEQ ID NO: 7262946 - DNA, 22 bp, Homo sapiens
ttcccaggaagcctctccaagc

SEQ ID NO: 7262947 - DNA, 23 bp, Homo sapiens
ttccaaggggatgtctccaagtg

SEQ ID NO: 7262948 - DNA, 22 bp, Homo sapiens
ttccaaggcatgttctcaagta

SEQ ID NO: 7262949 - DNA, 19 bp, Homo sapiens
ttccaaaatcaggatttga

SEQ ID NO: 7262950 - DNA, 22 bp, Homo sapiens
agcccccaggagtctccacgcc

SEQ ID NO: 7262951 - DNA, 22 bp, Homo sapiens
agcccccaggatgcaaaatgac

SEQ ID NO: 7262952 - DNA, 22 bp, Homo sapiens
agcccccagtctaaactgttgg

SEQ ID NO: 7262953 - DNA, 19 bp, Homo sapiens
agcccccagacagcaggcc

SEQ ID NO: 7262954 - DNA, 22 bp, Homo sapiens
agctagtatttcattgaggatt

SEQ ID NO: 7262955 - DNA, 22 bp, Homo sapiens
agctatttctcttattatatcc

SEQ ID NO: 7262956 - DNA, 22 bp, Homo sapiens
acacatatatttgcatatacac

SEQ ID NO: 7262957 - DNA, 22 bp, Homo sapiens
acaatttatccattgtatagtt

SEQ ID NO: 7262958 - DNA, 22 bp, Homo sapiens
acaattctgatggtttcccagt

SEQ ID NO: 7262959 - DNA, 22 bp, Homo sapiens
agcaaggaaactatggagagat

SEQ ID NO: 7262960 - DNA, 22 bp, Homo sapiens
acaattctgatggtttcccagt

SEQ ID NO: 7262961 - DNA, 22 bp, Homo sapiens
agcaagattgaggcttcctcag

SEQ ID NO: 7262962 - DNA, 22 bp, Homo sapiens
acaattctctcatatcttatta

SEQ ID NO: 7262963 - DNA, 22 bp, Homo sapiens
acaagtttcattgtttagaacc

SEQ ID NO: 7262964 - DNA, 22 bp, Homo sapiens
acaaatgtctacattgagaata

SEQ ID NO: 7262965 - DNA, 22 bp, Homo sapiens
acaaatgtggacatggataatg

SEQ ID NO: 7262966 - DNA, 22 bp, Homo sapiens
aattatcagatataaaactgca

SEQ ID NO: 7262967 - DNA, 23 bp, Homo sapiens
agaaggtgggcctgctgagttat

SEQ ID NO: 7262968 - DNA, 22 bp, Homo sapiens
agaaggtggctactcagtcatc

SEQ ID NO: 7262969 - DNA, 22 bp, Homo sapiens
aatgtgttcagttaaatgaact

SEQ ID NO: 7262970 - DNA, 22 bp, Homo sapiens
aataatgttgacgatagtctta

SEQ ID NO: 7262971 - DNA, 22 bp, Homo sapiens
aagtttatgttggtaagatatc

SEQ ID NO: 7262972 - DNA, 22 bp, Homo sapiens
aagtcagacagctgagctgcct

SEQ ID NO: 7262973 - DNA, 22 bp, Homo sapiens
acttgtttgaatctctctagag

SEQ ID NO: 7262974 - DNA, 22 bp, Homo sapiens
acttgtttcaactgtactctcc

SEQ ID NO: 7262975 - DNA, 22 bp, Homo sapiens
acttgtttcaactgtactctca

SEQ ID NO: 7262976 - DNA, 22 bp, Homo sapiens
acttgtttggtctcatgtttaa

SEQ ID NO: 7262977 - DNA, 22 bp, Homo sapiens
acttcttttcaaatcatgcaaa

SEQ ID NO: 7262978 - DNA, 22 bp, Homo sapiens
aatgagatggcaatgacttaaa

SEQ ID NO: 7262979 - DNA, 22 bp, Homo sapiens
aatgagaaaacacagaggaggt

SEQ ID NO: 7262980 - DNA, 22 bp, Homo sapiens
aatgaacagtgggtgaggtacc

SEQ ID NO: 7262981 - DNA, 22 bp, Homo sapiens
aagtacatggaggatagctgct

SEQ ID NO: 7262982 - DNA, 22 bp, Homo sapiens
aagtacatttttaacttacagc

SEQ ID NO: 7262983 - DNA, 22 bp, Homo sapiens
aatagtttgaatttatcagatg

SEQ ID NO: 7262984 - DNA, 22 bp, Homo sapiens
aactacaatatgtatgtatgta

SEQ ID NO: 7262985 - DNA, 22 bp, Homo sapiens
aactgtttggaactcttccaca

SEQ ID NO: 7262986 - DNA, 22 bp, Homo sapiens
aaattctttggcctactttgaa

SEQ ID NO: 7262987 - DNA, 22 bp, Homo sapiens
aaattctatgtcaatgtttatt

SEQ ID NO: 7262988 - DNA, 22 bp, Homo sapiens
aaattctaaggtcacaatgttg

SEQ ID NO: 7262989 - DNA, 22 bp, Homo sapiens
aaatgtgtgtatgtacatatat

SEQ ID NO: 7262990 - DNA, 22 bp, Homo sapiens
aaatgtttctacttgtgagcat

SEQ ID NO: 7262991 - DNA, 22 bp, Homo sapiens
aaatgttaggttgtactgagtc

SEQ ID NO: 7262992 - DNA, 22 bp, Homo sapiens
aacaaatggaacacaaatcttt

SEQ ID NO: 7262993 - DNA, 22 bp, Homo sapiens
aagtcattatctcttctaatct

SEQ ID NO: 7262994 - DNA, 23 bp, Homo sapiens
acagacaacactgatgagagaaa

SEQ ID NO: 7262995 - DNA, 22 bp, Homo sapiens
aagcatttcaggtagagatatt

SEQ ID NO: 7262996 - DNA, 22 bp, Homo sapiens
aagcatttatagataagaattt

SEQ ID NO: 7262997 - DNA, 22 bp, Homo sapiens
aagatttactttctttgtaata

SEQ ID NO: 7262998 - DNA, 22 bp, Homo sapiens
aattggctttgagaagtttgag

SEQ ID NO: 7262999 - DNA, 22 bp, Homo sapiens
aattggctatattatttagcct

SEQ ID NO: 7263000 - DNA, 22 bp, Homo sapiens
aatgttttctctgtgaacacat

SEQ ID NO: 7263001 - DNA, 22 bp, Homo sapiens
aatgttttcattatcctaactg

SEQ ID NO: 7263002 - DNA, 22 bp, Homo sapiens
aacttcattcctttttatgact

SEQ ID NO: 7263003 - DNA, 22 bp, Homo sapiens
aacttcatgtaatttaaaacag

SEQ ID NO: 7263004 - DNA, 22 bp, Homo sapiens
aacttcagttgagaaaggcatg

SEQ ID NO: 7263005 - DNA, 17 bp, Homo sapiens
aagagaggctgagctgg

SEQ ID NO: 7263006 - DNA, 22 bp, Homo sapiens
aagagaggacatggtgaacctg

SEQ ID NO: 7263007 - DNA, 22 bp, Homo sapiens
aagagaggggttgcatggaaat

SEQ ID NO: 7263008 - DNA, 22 bp, Homo sapiens
acaaggacgtcacttccacggt

SEQ ID NO: 7263009 - DNA, 22 bp, Homo sapiens
aaagtgttatgcaaaactctgt

SEQ ID NO: 7263010 - DNA, 22 bp, Homo sapiens
aaagttttatatgctgcagcga

SEQ ID NO: 7263011 - DNA, 22 bp, Homo sapiens
aaatagctacatgatctctagg

SEQ ID NO: 7263012 - DNA, 22 bp, Homo sapiens
aaatagatttctctgggtttgt

SEQ ID NO: 7263013 - DNA, 22 bp, Homo sapiens
aaatcctaatgacaagtttagt

SEQ ID NO: 7263014 - DNA, 22 bp, Homo sapiens
aaatgcaggtagtatttatttt

SEQ ID NO: 7263015 - DNA, 22 bp, Homo sapiens
aagcatgcaatctgtgataagg

SEQ ID NO: 7263016 - DNA, 20 bp, Homo sapiens
aagcatggtcaaaacttatg

SEQ ID NO: 7263017 - DNA, 22 bp, Homo sapiens
aagctcttttcaccattaaagt

SEQ ID NO: 7263018 - DNA, 22 bp, Homo sapiens
aaatgtagtatgttgcatgtat

SEQ ID NO: 7263019 - DNA, 22 bp, Homo sapiens
aaatgtattgcataggatattt

SEQ ID NO: 7263020 - DNA, 22 bp, Homo sapiens
aaagctgctatgaacattctat

SEQ ID NO: 7263021 - DNA, 22 bp, Homo sapiens
aaagctgctttaaacatctatg

SEQ ID NO: 7263022 - DNA, 22 bp, Homo sapiens
aaattttctctctaagacttaa

SEQ ID NO: 7263023 - DNA, 22 bp, Homo sapiens
aaagtatttgtgatttttacca

SEQ ID NO: 7263024 - DNA, 22 bp, Homo sapiens
aaagtattcttgactgtttttc

SEQ ID NO: 7263025 - DNA, 22 bp, Homo sapiens
aaagtattcaaaaatatttggt

SEQ ID NO: 7263026 - DNA, 22 bp, Homo sapiens
aaagtagcttagttgatatttc

SEQ ID NO: 7263027 - DNA, 22 bp, Homo sapiens
aaactgaaacatcatcatgttg

SEQ ID NO: 7263028 - DNA, 22 bp, Homo sapiens
aaatgcagattgtcattcagga

SEQ ID NO: 7263029 - DNA, 20 bp, Homo sapiens
aaattactgccacacatttc

SEQ ID NO: 7263030 - DNA, 22 bp, Homo sapiens
aaaaaattatcatagttcctga

SEQ ID NO: 7263031 - DNA, 22 bp, Homo sapiens
aaaaaatcagatctttggttaa

SEQ ID NO: 7263032 - DNA, 22 bp, Homo sapiens
aaaaaattccattctgtgcctt

SEQ ID NO: 7263033 - DNA, 22 bp, Homo sapiens
aaaagagaaagtggcaggcttt

SEQ ID NO: 7263034 - DNA, 22 bp, Homo sapiens
aaaagacatctatttcaggcag

SEQ ID NO: 7263035 - DNA, 22 bp, Homo sapiens
aaaaatctatgactgcttctcc

SEQ ID NO: 7263036 - DNA, 22 bp, Homo sapiens
aaaaatcacttttataggcagc

SEQ ID NO: 7263037 - DNA, 22 bp, Homo sapiens
aaaatctaagtagcgagtaagg

SEQ ID NO: 7263038 - DNA, 22 bp, Homo sapiens
aaaagagagttgccagtctgta

SEQ ID NO: 7263039 - DNA, 22 bp, Homo sapiens
aaaagagaatcctgtacagaga

SEQ ID NO: 7263040 - DNA, 22 bp, Homo sapiens
aaaagagagctgaggagctcca

SEQ ID NO: 7263041 - DNA, 22 bp, Homo sapiens
actgcacttcagcctgggtgtc

SEQ ID NO: 7263042 - DNA, 22 bp, Homo sapiens
actgcacttcagcctgggtgac

SEQ ID NO: 7263043 - DNA, 23 bp, Homo sapiens
actcgtggaattctctgcgatcg

SEQ ID NO: 7263044 - DNA, 22 bp, Homo sapiens
agtctttaacatttggagattg

SEQ ID NO: 7263045 - DNA, 22 bp, Homo sapiens
agtctttacatgtgttatatat

SEQ ID NO: 7263046 - DNA, 19 bp, Homo sapiens
acctggcctcttgagcaag

SEQ ID NO: 7263047 - DNA, 22 bp, Homo sapiens
actcaggaaattgagataatgg

SEQ ID NO: 7263048 - DNA, 22 bp, Homo sapiens
agtatttcttcatatgattact

SEQ ID NO: 7263049 - DNA, 22 bp, Homo sapiens
acgcctgtaatcccagcacttt

SEQ ID NO: 7263050 - DNA, 22 bp, Homo sapiens
acgcctgtaatcccagcacttt

SEQ ID NO: 7263051 - DNA, 22 bp, Homo sapiens
actgtagtctaaatatagtctt

SEQ ID NO: 7263052 - DNA, 22 bp, Homo sapiens
atacattagtgaacaaaagaga

SEQ ID NO: 7263053 - DNA, 22 bp, Homo sapiens
atacatgttgagaaaatatctg

SEQ ID NO: 7263054 - DNA, 22 bp, Homo sapiens
atatgaaagtaagcatgtgtgt

SEQ ID NO: 7263055 - DNA, 22 bp, Homo sapiens
atattcttccaaaacatcattt

SEQ ID NO: 7263056 - DNA, 22 bp, Homo sapiens
atattcttatccttttctctgt

SEQ ID NO: 7263057 - DNA, 22 bp, Homo sapiens
atatttcatggggttccatact

SEQ ID NO: 7263058 - DNA, 22 bp, Homo sapiens
atatttcacgtaggttgttttc

SEQ ID NO: 7263059 - DNA, 22 bp, Homo sapiens
atatttcagctttacttaggaa

SEQ ID NO: 7263060 - DNA, 22 bp, Homo sapiens
atctaaaaggagctctttatct

SEQ ID NO: 7263061 - DNA, 22 bp, Homo sapiens
atctcaaatgattacaccaagc

SEQ ID NO: 7263062 - DNA, 22 bp, Homo sapiens
atctatttctgctaataacaat

SEQ ID NO: 7263063 - DNA, 22 bp, Homo sapiens
acatattaactgcactacacta

SEQ ID NO: 7263064 - DNA, 20 bp, Homo sapiens
acagtttatccagttagcag

SEQ ID NO: 7263065 - DNA, 22 bp, Homo sapiens
aggatgagattgctgtgttgta

SEQ ID NO: 7263066 - DNA, 22 bp, Homo sapiens
acagtcaggaatttgtaaaacg

SEQ ID NO: 7263067 - DNA, 23 bp, Homo sapiens
acagtcgtaggtatccttttcct

SEQ ID NO: 7263068 - DNA, 22 bp, Homo sapiens
acagtgtggtttgagcactggg

SEQ ID NO: 7263069 - DNA, 22 bp, Homo sapiens
acatgcttttcccacaattata

SEQ ID NO: 7263070 - DNA, 22 bp, Homo sapiens
acatattttgaaagctttctaa

SEQ ID NO: 7263071 - DNA, 22 bp, Homo sapiens
acatttgaaatgccatgtgagg

SEQ ID NO: 7263072 - DNA, 22 bp, Homo sapiens
acatttgagcatctactaagtg

SEQ ID NO: 7263073 - DNA, 22 bp, Homo sapiens
aggctgagactgtgcattagtg

SEQ ID NO: 7263074 - DNA, 22 bp, Homo sapiens
acattgtagttgttctgcagca

SEQ ID NO: 7263075 - DNA, 19 bp, Homo sapiens
accaggcctcagaggccct

SEQ ID NO: 7263076 - DNA, 22 bp, Homo sapiens
acatttgtatatatgcagcata

SEQ ID NO: 7263077 - DNA, 18 bp, Homo sapiens
aggcttgggcccagcagc

SEQ ID NO: 7263078 - DNA, 22 bp, Homo sapiens
aggcttggtgccaaggagcctg

SEQ ID NO: 7263079 - DNA, 22 bp, Homo sapiens
aggcttggctggcagccctggg

SEQ ID NO: 7263080 - DNA, 20 bp, Homo sapiens
aggcttggcttggcaggaac

SEQ ID NO: 7263081 - DNA, 22 bp, Homo sapiens
atctcagaaacatatctaatcc

SEQ ID NO: 7263082 - DNA, 22 bp, Homo sapiens
atctcagatctacagatctaca

SEQ ID NO: 7263083 - DNA, 22 bp, Homo sapiens
atctcagagaaatttgaatgca

SEQ ID NO: 7263084 - DNA, 22 bp, Homo sapiens
agaagtttggtcctataaactc

SEQ ID NO: 7263085 - DNA, 22 bp, Homo sapiens
agaagttatccaccttagatgc

SEQ ID NO: 7263086 - DNA, 22 bp, Homo sapiens
atgaacaaaaacaaggcctgtt

SEQ ID NO: 7263087 - DNA, 22 bp, Homo sapiens
atgaacaataaaatagatcaca

SEQ ID NO: 7263088 - DNA, 22 bp, Homo sapiens
atgaacaagtatttgcatgagc

SEQ ID NO: 7263089 - DNA, 22 bp, Homo sapiens
atgaacaagagagggaagattc

SEQ ID NO: 7263090 - DNA, 22 bp, Homo sapiens
atgaacaatgactacatattga

SEQ ID NO: 7263091 - DNA, 22 bp, Homo sapiens
atgaacaataatcatgtctatg

SEQ ID NO: 7263092 - DNA, 22 bp, Homo sapiens
atgaacaatctgttgacttctg

SEQ ID NO: 7263093 - DNA, 22 bp, Homo sapiens
atgcacatgaggcaagcaaaat

SEQ ID NO: 7263094 - DNA, 22 bp, Homo sapiens
atgtatttgcgtatggacatac

SEQ ID NO: 7263095 - DNA, 21 bp, Homo sapiens
agagttgcagcaaatggggga

SEQ ID NO: 7263096 - DNA, 22 bp, Homo sapiens
agagttgcaaacagatacctac

SEQ ID NO: 7263097 - DNA, 22 bp, Homo sapiens
agagttgcatagtgcttttaag

SEQ ID NO: 7263098 - DNA, 22 bp, Homo sapiens
agagttgccagcttatggccaa

SEQ ID NO: 7263099 - DNA, 22 bp, Homo sapiens
agagttgcttatttgagtttct

SEQ ID NO: 7263100 - DNA, 22 bp, Homo sapiens
agagttgctgttggagcagtga

SEQ ID NO: 7263101 - DNA, 22 bp, Homo sapiens
agagttgcttatgtcaggtgag

SEQ ID NO: 7263102 - DNA, 22 bp, Homo sapiens
agagttgctatagaaggatgga

SEQ ID NO: 7263103 - DNA, 22 bp, Homo sapiens
agagttgctccattagaactta

SEQ ID NO: 7263104 - DNA, 22 bp, Homo sapiens
agagttgctgagtatataccca

SEQ ID NO: 7263105 - DNA, 22 bp, Homo sapiens
agagttgcgtccatgcagagtt

SEQ ID NO: 7263106 - DNA, 23 bp, Homo sapiens
agagttgctaaaaacactcagat

SEQ ID NO: 7263107 - DNA, 22 bp, Homo sapiens
agagttgctaaattcaggtctt

SEQ ID NO: 7263108 - DNA, 22 bp, Homo sapiens
agagttgctaatgtgcagaata

SEQ ID NO: 7263109 - DNA, 22 bp, Homo sapiens
agagttgctaccaagatgctag

SEQ ID NO: 7263110 - DNA, 22 bp, Homo sapiens
attgctcagcacaagcagcaga

SEQ ID NO: 7263111 - DNA, 22 bp, Homo sapiens
attgctaggaacaggttgcacc

SEQ ID NO: 7263112 - DNA, 17 bp, Homo sapiens
atttcacttagcatgag

SEQ ID NO: 7263113 - DNA, 22 bp, Homo sapiens
attcatttgctattgtgtatgg

SEQ ID NO: 7263114 - DNA, 22 bp, Homo sapiens
agaggaggctctgggatcgtcc

SEQ ID NO: 7263115 - DNA, 22 bp, Homo sapiens
agaggaggatttgtaaaggtct

SEQ ID NO: 7263116 - DNA, 22 bp, Homo sapiens
agaggagaatccgtttccttgc

SEQ ID NO: 7263117 - DNA, 22 bp, Homo sapiens
agcatacagtaggtgctcagtt

SEQ ID NO: 7263118 - DNA, 22 bp, Homo sapiens
agcatacaccctaaactgctta

SEQ ID NO: 7263119 - DNA, 22 bp, Homo sapiens
caaatagattgttcaatcctga

SEQ ID NO: 7263120 - DNA, 18 bp, Homo sapiens
caaatagcatgatgtcct

SEQ ID NO: 7263121 - DNA, 22 bp, Homo sapiens
agcccagagacaatgctcagta

SEQ ID NO: 7263122 - DNA, 22 bp, Homo sapiens
agcccagaaatgaaaggatgat

SEQ ID NO: 7263123 - DNA, 22 bp, Homo sapiens
agcccagagggtagcagaagaa

SEQ ID NO: 7263124 - DNA, 22 bp, Homo sapiens
cagaggagttcagtacacagcc

SEQ ID NO: 7263125 - DNA, 22 bp, Homo sapiens
cagaaggagggggcaagccctg

SEQ ID NO: 7263126 - DNA, 22 bp, Homo sapiens
cagaaatatcagttgaaagtgc

SEQ ID NO: 7263127 - DNA, 22 bp, Homo sapiens
cagaaatatcacctggactcta

SEQ ID NO: 7263128 - DNA, 22 bp, Homo sapiens
cagacaggttgcaaaacttcaa

SEQ ID NO: 7263129 - DNA, 22 bp, Homo sapiens
cagacaggtagggacagaacat

SEQ ID NO: 7263130 - DNA, 22 bp, Homo sapiens
cagttttatgtcgaatgtatac

SEQ ID NO: 7263131 - DNA, 22 bp, Homo sapiens
catatttagtgtttggagatcg

SEQ ID NO: 7263132 - DNA, 22 bp, Homo sapiens
cagttttaaattttgaatgtct

SEQ ID NO: 7263133 - DNA, 22 bp, Homo sapiens
cagttttaaattgttagataat

SEQ ID NO: 7263134 - DNA, 22 bp, Homo sapiens
cagttttaggacatgtggatgt

SEQ ID NO: 7263135 - DNA, 22 bp, Homo sapiens
aggaccttggaataacaaattc

SEQ ID NO: 7263136 - DNA, 22 bp, Homo sapiens
aggacattcatttcaaggagga

SEQ ID NO: 7263137 - DNA, 22 bp, Homo sapiens
aggattcatggtgcagacaaag

SEQ ID NO: 7263138 - DNA, 19 bp, Homo sapiens
catggtgaaaccccgtctc

SEQ ID NO: 7263139 - DNA, 22 bp, Homo sapiens
ccaagcatggggttcagtagga

SEQ ID NO: 7263140 - DNA, 22 bp, Homo sapiens
ccaagcatttctagccagtcac

SEQ ID NO: 7263141 - DNA, 22 bp, Homo sapiens
ccaagctacttaggagtctgag

SEQ ID NO: 7263142 - DNA, 22 bp, Homo sapiens
cattaaaatatctcatggtgtt

SEQ ID NO: 7263143 - DNA, 22 bp, Homo sapiens
caggcctggttgagccctgaga

SEQ ID NO: 7263144 - DNA, 22 bp, Homo sapiens
agctgcagcactccagtagccg

SEQ ID NO: 7263145 - DNA, 19 bp, Homo sapiens
agctgcagaccagaagtgc

SEQ ID NO: 7263146 - DNA, 22 bp, Homo sapiens
agctgcagagaaaagaggctgg

SEQ ID NO: 7263147 - DNA, 22 bp, Homo sapiens
caggccaggctgcatttgcccc

SEQ ID NO: 7263148 - DNA, 20 bp, Homo sapiens
caggccagaggtttgatggc

SEQ ID NO: 7263149 - DNA, 22 bp, Homo sapiens
caggccagagtccaactccaga

SEQ ID NO: 7263150 - DNA, 22 bp, Homo sapiens
caggccagcagggcctccgtgg

SEQ ID NO: 7263151 - DNA, 22 bp, Homo sapiens
caggccagcggcccgcgcgttc

SEQ ID NO: 7263152 - DNA, 22 bp, Homo sapiens
caggccagcgtccagaacaagc

SEQ ID NO: 7263153 - DNA, 22 bp, Homo sapiens
caggccagcttcctgacatcct

SEQ ID NO: 7263154 - DNA, 22 bp, Homo sapiens
caggccagaggctgttgttgcg

SEQ ID NO: 7263155 - DNA, 22 bp, Homo sapiens
agctgctgcggaaagatgccac

SEQ ID NO: 7263156 - DNA, 22 bp, Homo sapiens
aggctcagttcacgtcaacttt

SEQ ID NO: 7263157 - DNA, 22 bp, Homo sapiens
aggctgaggtaggaggatcgct

SEQ ID NO: 7263158 - DNA, 22 bp, Homo sapiens
aggctgagtcaagttagggtga

SEQ ID NO: 7263159 - DNA, 22 bp, Homo sapiens
aggctgaggtgtgctgtgatcg

SEQ ID NO: 7263160 - DNA, 20 bp, Homo sapiens
aggctgagggtgattgtgtc

SEQ ID NO: 7263161 - DNA, 22 bp, Homo sapiens
ccagcctccatgtagatagctg

SEQ ID NO: 7263162 - DNA, 22 bp, Homo sapiens
ccagcctcatcgcctgcctgtc

SEQ ID NO: 7263163 - DNA, 22 bp, Homo sapiens
ccaggacaagtgtggccatggc

SEQ ID NO: 7263164 - DNA, 22 bp, Homo sapiens
aggccagacagctagaaacagg

SEQ ID NO: 7263165 - DNA, 22 bp, Homo sapiens
aggccagaagtcaaaaactcta

SEQ ID NO: 7263166 - DNA, 22 bp, Homo sapiens
aggccagaagccagaaatgctt

SEQ ID NO: 7263167 - DNA, 22 bp, Homo sapiens
aggccagaacagctctgcacca

SEQ ID NO: 7263168 - DNA, 19 bp, Homo sapiens
aggcttggattgtggccaa

SEQ ID NO: 7263169 - DNA, 21 bp, Homo sapiens
aggcttggatctagacaggcc

SEQ ID NO: 7263170 - DNA, 22 bp, Homo sapiens
agggagttagaaatccaggata

SEQ ID NO: 7263171 - DNA, 18 bp, Homo sapiens
agggagttttagggaagg

SEQ ID NO: 7263172 - DNA, 22 bp, Homo sapiens
agggagttccgatctgtgcacc

SEQ ID NO: 7263173 - DNA, 22 bp, Homo sapiens
agggagttcagaggctggtttg

SEQ ID NO: 7263174 - DNA, 22 bp, Homo sapiens
agggagttagtgatgtggtctc

SEQ ID NO: 7263175 - DNA, 19 bp, Homo sapiens
agggagtttatatttgcac

SEQ ID NO: 7263176 - DNA, 22 bp, Homo sapiens
ccctggaggaccccaatgtggc

SEQ ID NO: 7263177 - DNA, 22 bp, Homo sapiens
ccctggacggggaatatgactt

SEQ ID NO: 7263178 - DNA, 20 bp, Homo sapiens
ccctggactcctgagcaaac

SEQ ID NO: 7263179 - DNA, 22 bp, Homo sapiens
ccctggaggctggaggcagtag

SEQ ID NO: 7263180 - DNA, 22 bp, Homo sapiens
agtcattttgccagtcttcagg

SEQ ID NO: 7263181 - DNA, 22 bp, Homo sapiens
agtcatttatcttagccattat

SEQ ID NO: 7263182 - DNA, 18 bp, Homo sapiens
agtcatttacttttgtga

SEQ ID NO: 7263183 - DNA, 22 bp, Homo sapiens
ctcctcctggacacaggctgtg

SEQ ID NO: 7263184 - DNA, 22 bp, Homo sapiens
agtgatttgcagtatttactaa

SEQ ID NO: 7263185 - DNA, 22 bp, Homo sapiens
agtgatttgactcttttattgt

SEQ ID NO: 7263186 - DNA, 22 bp, Homo sapiens
ctctgtttggcgctgctccttc

SEQ ID NO: 7263187 - DNA, 22 bp, Homo sapiens
cctggtgaatgttcatggactg

SEQ ID NO: 7263188 - DNA, 22 bp, Homo sapiens
agtcagaatctgcattttaacc

SEQ ID NO: 7263189 - DNA, 22 bp, Homo sapiens
agtcagaattcgatcccaggtc

SEQ ID NO: 7263190 - DNA, 22 bp, Homo sapiens
cgtgccactgcactctagcctg

SEQ ID NO: 7263191 - DNA, 22 bp, Homo sapiens
cgtgccactgcactctagcctg

SEQ ID NO: 7263192 - DNA, 22 bp, Homo sapiens
cctggacctgcagcatcagcat

SEQ ID NO: 7263193 - DNA, 22 bp, Homo sapiens
aggtgagtcctgggcacaggta

SEQ ID NO: 7263194 - DNA, 22 bp, Homo sapiens
aggtgagtgtgactgcaagaga

SEQ ID NO: 7263195 - DNA, 22 bp, Homo sapiens
aggtgagttacaggaggaggtc

SEQ ID NO: 7263196 - DNA, 22 bp, Homo sapiens
aggtgagttggtaggaagtttg

SEQ ID NO: 7263197 - DNA, 20 bp, Homo sapiens
ctggggaggaggatgtgttc

SEQ ID NO: 7263198 - DNA, 22 bp, Homo sapiens
atctatttctgctaataacaat

SEQ ID NO: 7263199 - DNA, 22 bp, Homo sapiens
atctcccacaggctgctacttc

SEQ ID NO: 7263200 - DNA, 22 bp, Homo sapiens
atcattaaatataagcttcaca

SEQ ID NO: 7263201 - DNA, 22 bp, Homo sapiens
agtttatttttgataagtcttg

SEQ ID NO: 7263202 - DNA, 22 bp, Homo sapiens
agttttcaatatatgatagtga

SEQ ID NO: 7263203 - DNA, 23 bp, Homo sapiens
agtttctttgagacttgccctgt

SEQ ID NO: 7263204 - DNA, 22 bp, Homo sapiens
ataagtttgtctttgtaaagat

SEQ ID NO: 7263205 - DNA, 22 bp, Homo sapiens
ataattacattatactgttaga

SEQ ID NO: 7263206 - DNA, 20 bp, Homo sapiens
ataattacatagagattgcc

SEQ ID NO: 7263207 - DNA, 16 bp, Homo sapiens
ataattactgctactt

SEQ ID NO: 7263208 - DNA, 22 bp, Homo sapiens
ataattatctcagacacttgtt

SEQ ID NO: 7263209 - DNA, 22 bp, Homo sapiens
ctggccaggcttgggacagaca

SEQ ID NO: 7263210 - DNA, 22 bp, Homo sapiens
atagacattataacacagagct

SEQ ID NO: 7263211 - DNA, 22 bp, Homo sapiens
atagacatagccgtaatttatt

SEQ ID NO: 7263212 - DNA, 22 bp, Homo sapiens
atagtacacatcctacaatgtt

SEQ ID NO: 7263213 - DNA, 22 bp, Homo sapiens
atgggagtgtggttagagacct

SEQ ID NO: 7263214 - DNA, 22 bp, Homo sapiens
atgggagtgtgcttgaggagtt

SEQ ID NO: 7263215 - DNA, 22 bp, Homo sapiens
atgggagttgggtaaggatcat

SEQ ID NO: 7263216 - DNA, 22 bp, Homo sapiens
atgggagttttctctgatgctc

SEQ ID NO: 7263217 - DNA, 22 bp, Homo sapiens
atgggagtgacagggccactgg

SEQ ID NO: 7263218 - DNA, 22 bp, Homo sapiens
atgggagtccaacatcaaggac

SEQ ID NO: 7263219 - DNA, 22 bp, Homo sapiens
atgggagtggaggaaaaaagtt

SEQ ID NO: 7263220 - DNA, 22 bp, Homo sapiens
gagaacaggctctggagtcaga

SEQ ID NO: 7263221 - DNA, 22 bp, Homo sapiens
atgctgtctctgctatccaaag

SEQ ID NO: 7263222 - DNA, 22 bp, Homo sapiens
atgtggatggaagtcagatagc

SEQ ID NO: 7263223 - DNA, 22 bp, Homo sapiens
atgtcataaatatactgttcct

SEQ ID NO: 7263224 - DNA, 22 bp, Homo sapiens
atgccactgcacttcagcctgg

SEQ ID NO: 7263225 - DNA, 22 bp, Homo sapiens
atgccactgcactccagcctag

SEQ ID NO: 7263226 - DNA, 22 bp, Homo sapiens
atgccactgcactccagcctgg

SEQ ID NO: 7263227 - DNA, 22 bp, Homo sapiens
atgctacatagatacaaaaatg

SEQ ID NO: 7263228 - DNA, 22 bp, Homo sapiens
gaaggatttgagattatcctag

SEQ ID NO: 7263229 - DNA, 22 bp, Homo sapiens
atgagcagtttttaagtagcaa

SEQ ID NO: 7263230 - DNA, 22 bp, Homo sapiens
atgagctagaaaaccatgtgga

SEQ ID NO: 7263231 - DNA, 22 bp, Homo sapiens
gaagagatgacaaaggagcatg

SEQ ID NO: 7263232 - DNA, 22 bp, Homo sapiens
ctttttcattggctttaggaca

SEQ ID NO: 7263233 - DNA, 22 bp, Homo sapiens
ctttttatctcttaatgatgtt

SEQ ID NO: 7263234 - DNA, 22 bp, Homo sapiens
atctggaatccttgtggacaat

SEQ ID NO: 7263235 - DNA, 17 bp, Homo sapiens
cttgttttccactggga

SEQ ID NO: 7263236 - DNA, 22 bp, Homo sapiens
ctttattcctacaagattttct

SEQ ID NO: 7263237 - DNA, 22 bp, Homo sapiens
ctttattctgcaaattgccttg

SEQ ID NO: 7263238 - DNA, 22 bp, Homo sapiens
ctttacattaatttctactgat

SEQ ID NO: 7263239 - DNA, 22 bp, Homo sapiens
gatgtgaggactcatgtggagg

SEQ ID NO: 7263240 - DNA, 22 bp, Homo sapiens
gatgtgagtggtagctgggatt

SEQ ID NO: 7263241 - DNA, 22 bp, Homo sapiens
attatctatgtagaatgatttt

SEQ ID NO: 7263242 - DNA, 22 bp, Homo sapiens
attatgtatttggtatagtttg

SEQ ID NO: 7263243 - DNA, 22 bp, Homo sapiens
attaagactattgatatttaca

SEQ ID NO: 7263244 - DNA, 22 bp, Homo sapiens
attaagactgcccatgttttta

SEQ ID NO: 7263245 - DNA, 22 bp, Homo sapiens
gcagcttggatttctgtagttt

SEQ ID NO: 7263246 - DNA, 23 bp, Homo sapiens
gcagcttgtggtttagtagaggg

SEQ ID NO: 7263247 - DNA, 22 bp, Homo sapiens
attcttttaaatggcagtagta

SEQ ID NO: 7263248 - DNA, 21 bp, Homo sapiens
attttcattaattcagtgtgg

SEQ ID NO: 7263249 - DNA, 22 bp, Homo sapiens
atttcttcctctgtcagtaact

SEQ ID NO: 7263250 - DNA, 22 bp, Homo sapiens
atttgtcagtggaagtgattca

SEQ ID NO: 7263251 - DNA, 22 bp, Homo sapiens
attttagatttaagaataaggt

SEQ ID NO: 7263252 - DNA, 22 bp, Homo sapiens
atttgtcaacaggcatttaggt

SEQ ID NO: 7263253 - DNA, 22 bp, Homo sapiens
attttgatgctatctaatgaat

SEQ ID NO: 7263254 - DNA, 22 bp, Homo sapiens
caaaagaagctcttggggctag

SEQ ID NO: 7263255 - DNA, 22 bp, Homo sapiens
gctcccagggcagcgcagaaga

SEQ ID NO: 7263256 - DNA, 22 bp, Homo sapiens
gccagatattcagaggtgaaag

SEQ ID NO: 7263257 - DNA, 22 bp, Homo sapiens
atttcttcaggttcttctagga

SEQ ID NO: 7263258 - DNA, 22 bp, Homo sapiens
cacattaaaatcctaacttcca

SEQ ID NO: 7263259 - DNA, 22 bp, Homo sapiens
cactgcactccagcctgggtga

SEQ ID NO: 7263260 - DNA, 22 bp, Homo sapiens
cactgcactccagcctgggtca

SEQ ID NO: 7263261 - DNA, 22 bp, Homo sapiens
caccaggctgaaccagagggga

SEQ ID NO: 7263262 - DNA, 22 bp, Homo sapiens
cactatttcctggattttgacg

SEQ ID NO: 7263263 - DNA, 22 bp, Homo sapiens
cactctcagcataatgaatgtg

SEQ ID NO: 7263264 - DNA, 22 bp, Homo sapiens
cactgcactccagcctgggaga

SEQ ID NO: 7263265 - DNA, 22 bp, Homo sapiens
caatagaaggcacagataggta

SEQ ID NO: 7263266 - DNA, 22 bp, Homo sapiens
caatagaaaactcaatacttaa

SEQ ID NO: 7263267 - DNA, 22 bp, Homo sapiens
caatatataggaacaacttagg

SEQ ID NO: 7263268 - DNA, 22 bp, Homo sapiens
caattctttgtagaagctctcc

SEQ ID NO: 7263269 - DNA, 22 bp, Homo sapiens
caattcttggagaagaagcata

SEQ ID NO: 7263270 - DNA, 22 bp, Homo sapiens
caattctttcagctgcatttgt

SEQ ID NO: 7263271 - DNA, 22 bp, Homo sapiens
caatgttttgttgaatgaatag

SEQ ID NO: 7263272 - DNA, 21 bp, Homo sapiens
cacacagtgatctatccacat

SEQ ID NO: 7263273 - DNA, 22 bp, Homo sapiens
ggacatggagctccatggaggc

SEQ ID NO: 7263274 - DNA, 22 bp, Homo sapiens
caacacaggttctgcaaaggaa

SEQ ID NO: 7263275 - DNA, 22 bp, Homo sapiens
gtacttctttagtcaatatgta

SEQ ID NO: 7263276 - DNA, 22 bp, Homo sapiens
cagccctcatctcagcttcttt

SEQ ID NO: 7263277 - DNA, 22 bp, Homo sapiens
cagacacacaagcaatctaagt

SEQ ID NO: 7263278 - DNA, 23 bp, Homo sapiens
cagatgaggttggcagcatggtc

SEQ ID NO: 7263279 - DNA, 22 bp, Homo sapiens
cagatgagcatgggcacaagca

SEQ ID NO: 7263280 - DNA, 22 bp, Homo sapiens
cagatgcagcaaaatgacaggc

SEQ ID NO: 7263281 - DNA, 22 bp, Homo sapiens
gggttcctggctcctgtgtggt

SEQ ID NO: 7263282 - DNA, 22 bp, Homo sapiens
gggtccctggaattacttgaca

SEQ ID NO: 7263283 - DNA, 21 bp, Homo sapiens
tgactttatttgacagcccag

SEQ ID NO: 7263284 - DNA, 22 bp, Homo sapiens
tgacaatgggtggacaagatag

SEQ ID NO: 7263285 - DNA, 22 bp, Homo sapiens
tgaagattgagaaattatccaa

SEQ ID NO: 7263286 - DNA, 22 bp, Homo sapiens
tctgcagacaggaagctgaggc

SEQ ID NO: 7263287 - DNA, 22 bp, Homo sapiens
tctgcagagcctcaggagaaca

SEQ ID NO: 7263288 - DNA, 22 bp, Homo sapiens
tctgcagatttatcagcagctg

SEQ ID NO: 7263289 - DNA, 22 bp, Homo sapiens
tcttgtttctgtatataatgac

SEQ ID NO: 7263290 - DNA, 18 bp, Homo sapiens
tctttaagttgtcagagt

SEQ ID NO: 7263291 - DNA, 22 bp, Homo sapiens
cccaagcagggtgcagaggcat

SEQ ID NO: 7263292 - DNA, 22 bp, Homo sapiens
tgattatattctaacttcataa

SEQ ID NO: 7263293 - DNA, 22 bp, Homo sapiens
tgcagaggtttccaggcaagtt

SEQ ID NO: 7263294 - DNA, 22 bp, Homo sapiens
tgcagaggtgaaagactagcaa

SEQ ID NO: 7263295 - DNA, 22 bp, Homo sapiens
tgccctctgcctcctctgcaga

SEQ ID NO: 7263296 - DNA, 22 bp, Homo sapiens
tgcagtctggatgtcctcagat

SEQ ID NO: 7263297 - DNA, 22 bp, Homo sapiens
ccgtggtcacctgagctccttg

SEQ ID NO: 7263298 - DNA, 22 bp, Homo sapiens
ccggctactcgggaggctgacg

SEQ ID NO: 7263299 - DNA, 22 bp, Homo sapiens
ccggctactcgggaggctgacg

SEQ ID NO: 7263300 - DNA, 22 bp, Homo sapiens
ccctgtgagcggctggatgcct

SEQ ID NO: 7263301 - DNA, 22 bp, Homo sapiens
cctcagaagctcaaggacattg

SEQ ID NO: 7263302 - DNA, 22 bp, Homo sapiens
tggcctcaccactagctgggtg

SEQ ID NO: 7263303 - DNA, 22 bp, Homo sapiens
tggcctcagatttcaggggtgg

SEQ ID NO: 7263304 - DNA, 22 bp, Homo sapiens
cctcagaagaagtggaattgat

SEQ ID NO: 7263305 - DNA, 22 bp, Homo sapiens
cctcagaacggaaatggttttg

SEQ ID NO: 7263306 - DNA, 22 bp, Homo sapiens
cctcagaagactttagggaaga

SEQ ID NO: 7263307 - DNA, 22 bp, Homo sapiens
tggctaacaaggtgaaaccccg

SEQ ID NO: 7263308 - DNA, 22 bp, Homo sapiens
tggctaacaaggtgaaaccccg

SEQ ID NO: 7263309 - DNA, 22 bp, Homo sapiens
cctgaggcttgggagttccgcc

SEQ ID NO: 7263310 - DNA, 22 bp, Homo sapiens
cctgaggctctcctgaataatg

SEQ ID NO: 7263311 - DNA, 23 bp, Homo sapiens
cctgcaaagaaacaagccacctg

SEQ ID NO: 7263312 - DNA, 22 bp, Homo sapiens
cctgattagggtctttcaaatg

SEQ ID NO: 7263313 - DNA, 23 bp, Homo sapiens
tgggagctcaagggaggctgccc

SEQ ID NO: 7263314 - DNA, 22 bp, Homo sapiens
cagggcagaacatatagatagt

SEQ ID NO: 7263315 - DNA, 21 bp, Homo sapiens
tagcaatacgtggaccatggg

SEQ ID NO: 7263316 - DNA, 19 bp, Homo sapiens
tagaggagaagggaagtgg

SEQ ID NO: 7263317 - DNA, 22 bp, Homo sapiens
taggagagctgaactattgtct

SEQ ID NO: 7263318 - DNA, 22 bp, Homo sapiens
taggagacattgatcccaagaa

SEQ ID NO: 7263319 - DNA, 22 bp, Homo sapiens
tagctattttgcttggaaatac

SEQ ID NO: 7263320 - DNA, 22 bp, Homo sapiens
tagctatttagcccagataagt

SEQ ID NO: 7263321 - DNA, 22 bp, Homo sapiens
tagctattgttggtagttaccc

SEQ ID NO: 7263322 - DNA, 22 bp, Homo sapiens
tagctatttggaaaattccaat

SEQ ID NO: 7263323 - DNA, 22 bp, Homo sapiens
caggggagtgagtccctctctg

SEQ ID NO: 7263324 - DNA, 22 bp, Homo sapiens
caggggagttttatgcaacaga

SEQ ID NO: 7263325 - DNA, 22 bp, Homo sapiens
tatttcatctggaacaaggtaa

SEQ ID NO: 7263326 - DNA, 22 bp, Homo sapiens
tatttcattctttatcaggagc

SEQ ID NO: 7263327 - DNA, 22 bp, Homo sapiens
tatttcattctttatcaggagc

SEQ ID NO: 7263328 - DNA, 22 bp, Homo sapiens
tatttctttcaggtatgtgttg

SEQ ID NO: 7263329 - DNA, 22 bp, Homo sapiens
tatttccaaaagcctattatga

SEQ ID NO: 7263330 - DNA, 22 bp, Homo sapiens
tatttccacaccttttgaatct

SEQ ID NO: 7263331 - DNA, 22 bp, Homo sapiens
tatttccacctattattttctg

SEQ ID NO: 7263332 - DNA, 22 bp, Homo sapiens
tatttccagaggagtatagaag

SEQ ID NO: 7263333 - DNA, 22 bp, Homo sapiens
cagtgagataccacagagcaaa

SEQ ID NO: 7263334 - DNA, 22 bp, Homo sapiens
tatttcttttcgtgacttattg

SEQ ID NO: 7263335 - DNA, 23 bp, Homo sapiens
cagtgtgacaaaacttattactt

SEQ ID NO: 7263336 - DNA, 22 bp, Homo sapiens
cagttaaaagaagtctatctta

SEQ ID NO: 7263337 - DNA, 22 bp, Homo sapiens
cagttaaaatgtgctataagaa

SEQ ID NO: 7263338 - DNA, 22 bp, Homo sapiens
cagttaaatttggctgttttct

SEQ ID NO: 7263339 - DNA, 22 bp, Homo sapiens
cagttaaagtgcttatcacaga

SEQ ID NO: 7263340 - DNA, 22 bp, Homo sapiens
cagttaaagctgcatgtgtcag

SEQ ID NO: 7263341 - DNA, 22 bp, Homo sapiens
cagttaaacgggccatgtgagt

SEQ ID NO: 7263342 - DNA, 22 bp, Homo sapiens
tctgaattaatcatgcctcttt

SEQ ID NO: 7263343 - DNA, 22 bp, Homo sapiens
tctgaattcagtatggtctttc

SEQ ID NO: 7263344 - DNA, 22 bp, Homo sapiens
tctgcagaattcgaggaagaaa

SEQ ID NO: 7263345 - DNA, 18 bp, Homo sapiens
tcctctctttccccaggg

SEQ ID NO: 7263346 - DNA, 22 bp, Homo sapiens
tcctctgagctcaaaatccagc

SEQ ID NO: 7263347 - DNA, 20 bp, Homo sapiens
tctccagatgcagatgacat

SEQ ID NO: 7263348 - DNA, 22 bp, Homo sapiens
tcatttatcgctgccttttaaa

SEQ ID NO: 7263349 - DNA, 22 bp, Homo sapiens
tcatttatgcaggaatggcata

SEQ ID NO: 7263350 - DNA, 22 bp, Homo sapiens
tcatttatgtctttgccatcca

SEQ ID NO: 7263351 - DNA, 21 bp, Homo sapiens
tcatttattgagaaatgactg

SEQ ID NO: 7263352 - DNA, 22 bp, Homo sapiens
tcatttatttgactttggagtg

SEQ ID NO: 7263353 - DNA, 22 bp, Homo sapiens
tcatttatttataccattgcct

SEQ ID NO: 7263354 - DNA, 22 bp, Homo sapiens
catcttttggcctattctgagg

SEQ ID NO: 7263355 - DNA, 22 bp, Homo sapiens
cataacacctgatggcaatgat

SEQ ID NO: 7263356 - DNA, 22 bp, Homo sapiens
tccagcctcatttctcctgctt

SEQ ID NO: 7263357 - DNA, 17 bp, Homo sapiens
tccagcctcctctgctg

SEQ ID NO: 7263358 - DNA, 22 bp, Homo sapiens
tccaggccccactgaagcccct

SEQ ID NO: 7263359 - DNA, 19 bp, Homo sapiens
tccccagcacctctgagtc

SEQ ID NO: 7263360 - DNA, 22 bp, Homo sapiens
tccccagcattgagggtctctc

SEQ ID NO: 7263361 - DNA, 22 bp, Homo sapiens
catttgtagtatctgtttatat

SEQ ID NO: 7263362 - DNA, 22 bp, Homo sapiens
cattcatttactttcaacagct

SEQ ID NO: 7263363 - DNA, 22 bp, Homo sapiens
cattcattcacattttgtctat

SEQ ID NO: 7263364 - DNA, 22 bp, Homo sapiens
catgtttaattgcgatgtttga

SEQ ID NO: 7263365 - DNA, 22 bp, Homo sapiens
ttaaattagtcaagcttctctg

SEQ ID NO: 7263366 - DNA, 22 bp, Homo sapiens
tgtcaatatgtaataactgaat

SEQ ID NO: 7263367 - DNA, 22 bp, Homo sapiens
tgtcaataactggagtcattat

SEQ ID NO: 7263368 - DNA, 22 bp, Homo sapiens
ttaagaggtggtcgtgtctgtg

SEQ ID NO: 7263369 - DNA, 22 bp, Homo sapiens
ttaagaggagatcatactggag

SEQ ID NO: 7263370 - DNA, 22 bp, Homo sapiens
ttaagagggtgatgctagcatt

SEQ ID NO: 7263371 - DNA, 22 bp, Homo sapiens
ttaagaggtgaggcctttaaga

SEQ ID NO: 7263372 - DNA, 22 bp, Homo sapiens
ttaaattgtcatttgagcaatg

SEQ ID NO: 7263373 - DNA, 22 bp, Homo sapiens
cggagttgtaagggatgtggct

SEQ ID NO: 7263374 - DNA, 18 bp, Homo sapiens
cggatcatgcgctgaggc

SEQ ID NO: 7263375 - DNA, 22 bp, Homo sapiens
cggatcatgtgacctttgagtg

SEQ ID NO: 7263376 - DNA, 22 bp, Homo sapiens
ttcaaagtgcttttaaccttta

SEQ ID NO: 7263377 - DNA, 22 bp, Homo sapiens
cctttttcagcttctagaggct

SEQ ID NO: 7263378 - DNA, 22 bp, Homo sapiens
ttatccaacatgacttatgtcc

SEQ ID NO: 7263379 - DNA, 22 bp, Homo sapiens
ttatttcatataatgttatcaa

SEQ ID NO: 7263380 - DNA, 22 bp, Homo sapiens
ttatttcatgtaaaatttatgt

SEQ ID NO: 7263381 - DNA, 20 bp, Homo sapiens
ttatttcagttgctagattg

SEQ ID NO: 7263382 - DNA, 22 bp, Homo sapiens
ttggatccatctcaggcatagg

SEQ ID NO: 7263383 - DNA, 22 bp, Homo sapiens
ttgcatgcaaggcctccgtggc

SEQ ID NO: 7263384 - DNA, 22 bp, Homo sapiens
ttgcagaacttaaagacagagt

SEQ ID NO: 7263385 - DNA, 22 bp, Homo sapiens
ctcagagaaaaggagcaagggt

SEQ ID NO: 7263386 - DNA, 22 bp, Homo sapiens
ctcagaaaggtgccatttatgt

SEQ ID NO: 7263387 - DNA, 22 bp, Homo sapiens
ctcagaaagtgacaggggggtg

SEQ ID NO: 7263388 - DNA, 22 bp, Homo sapiens
ctcagaaagggttgctgagggc

SEQ ID NO: 7263389 - DNA, 22 bp, Homo sapiens
ttctattaatatgttaattctg

SEQ ID NO: 7263390 - DNA, 22 bp, Homo sapiens
cgttggtctgtcccctggcacc

SEQ ID NO: 7263391 - DNA, 22 bp, Homo sapiens
ctgcagcctaggtgcagctggg

SEQ ID NO: 7263392 - DNA, 22 bp, Homo sapiens
ctgcagcctcaacctcctgagc

SEQ ID NO: 7263393 - DNA, 22 bp, Homo sapiens
ttttgcttgagtgcacaaaatg

SEQ ID NO: 7263394 - DNA, 22 bp, Homo sapiens
ctgccttggtttctagcagggc

SEQ ID NO: 7263395 - DNA, 18 bp, Homo sapiens
ctgcctgttgctgagagg

SEQ ID NO: 7263396 - DNA, 22 bp, Homo sapiens
ctgcctgttcctgatcattcta

SEQ ID NO: 7263397 - DNA, 19 bp, Homo sapiens
ctgcctgttatggagagaa

SEQ ID NO: 7263398 - DNA, 22 bp, Homo sapiens
ctgcctgtgtgtgcctgcagaa

SEQ ID NO: 7263399 - DNA, 22 bp, Homo sapiens
ctgcctgtgggtacaagtggaa

SEQ ID NO: 7263400 - DNA, 22 bp, Homo sapiens
ctgcctgtggacaccctggagg

SEQ ID NO: 7263401 - DNA, 21 bp, Homo sapiens
tttgttcaggcaagttacagt

SEQ ID NO: 7263402 - DNA, 22 bp, Homo sapiens
tttgttcagctctcattgatta

SEQ ID NO: 7263403 - DNA, 22 bp, Homo sapiens
tttgttcattttgagctcatca

SEQ ID NO: 7263404 - DNA, 22 bp, Homo sapiens
tttgaaagacagaatatttttg

SEQ ID NO: 7263405 - DNA, 19 bp, Homo sapiens
tttgaaagagttttattgg

SEQ ID NO: 7263406 - DNA, 22 bp, Homo sapiens
ctctgcagagcctccagcccag

SEQ ID NO: 7263407 - DNA, 22 bp, Homo sapiens
tttcagaaattatattagatgc

SEQ ID NO: 7263408 - DNA, 22 bp, Homo sapiens
tttcagaaattgttattattct

SEQ ID NO: 7263409 - DNA, 22 bp, Homo sapiens
ctccttagtgcctctgcacgag

SEQ ID NO: 7263410 - DNA, 22 bp, Homo sapiens
tttcattatacagcttcataaa

SEQ ID NO: 7263411 - DNA, 22 bp, Homo sapiens
tttcattacgtgtttgacttgt

SEQ ID NO: 7263412 - DNA, 22 bp, Homo sapiens
ctgggagtactgggggatgtca

SEQ ID NO: 7263413 - DNA, 22 bp, Homo sapiens
ctgggagtccaggatacagatg

SEQ ID NO: 7263414 - DNA, 22 bp, Homo sapiens
ctgggagtcagtataagaagca

SEQ ID NO: 7263415 - DNA, 22 bp, Homo sapiens
ctgggagtcaccaggagcaagg

SEQ ID NO: 7263416 - DNA, 22 bp, Homo sapiens
ctgggagtctggcctctggtcc

SEQ ID NO: 7263417 - DNA, 22 bp, Homo sapiens
ctgggagtctggaattttggta

SEQ ID NO: 7263418 - DNA, 22 bp, Homo sapiens
ctgggagtccctggaatagctc

SEQ ID NO: 7263419 - DNA, 22 bp, Homo sapiens
ctgggagtctaagctagcaccg

SEQ ID NO: 7263420 - DNA, 22 bp, Homo sapiens
ctgggagtggtgacagctctcg

SEQ ID NO: 7263421 - DNA, 22 bp, Homo sapiens
ctgggagtgaaaggagggctgc

SEQ ID NO: 7263422 - DNA, 22 bp, Homo sapiens
ctgggagtgtccctctggtaat

SEQ ID NO: 7263423 - DNA, 22 bp, Homo sapiens
ctgggagtgttctaggtcacat

SEQ ID NO: 7263424 - DNA, 22 bp, Homo sapiens
ctgggagttgacgaggcttgta

SEQ ID NO: 7263425 - DNA, 19 bp, Homo sapiens
ctgggagttcactgctgcc

SEQ ID NO: 7263426 - DNA, 22 bp, Homo sapiens
ctgggagtttgttagtaatgca

SEQ ID NO: 7263427 - DNA, 22 bp, Homo sapiens
ctgggagtttctagagaaagac

SEQ ID NO: 7263428 - DNA, 22 bp, Homo sapiens
cttcttctggacaggcagctcc

SEQ ID NO: 7263429 - DNA, 22 bp, Homo sapiens
cttcttcatgtattgatagtct

SEQ ID NO: 7263430 - DNA, 22 bp, Homo sapiens
cttgcttttgctgatgattaag

SEQ ID NO: 7263431 - DNA, 22 bp, Homo sapiens
ctttttctgatgttccatgatt

SEQ ID NO: 7263432 - DNA, 22 bp, Homo sapiens
gaaactttggctaaaagccaga

SEQ ID NO: 7263433 - DNA, 22 bp, Homo sapiens
gaggagagagggactgtctgca

SEQ ID NO: 7263434 - DNA, 22 bp, Homo sapiens
gaggagacatatttttgaagca

SEQ ID NO: 7263435 - DNA, 22 bp, Homo sapiens
gaggagacggggtgcctggagc

SEQ ID NO: 7263436 - DNA, 22 bp, Homo sapiens
gaggagactgacagcagattct

SEQ ID NO: 7263437 - DNA, 22 bp, Homo sapiens
gaggctcaaacctggacagagc

SEQ ID NO: 7263438 - DNA, 22 bp, Homo sapiens
gagatttattgacttaacagta

SEQ ID NO: 7263439 - DNA, 22 bp, Homo sapiens
gagcaatagcaccaattaactc

SEQ ID NO: 7263440 - DNA, 22 bp, Homo sapiens
gagaggagtaggctgatggtgc

SEQ ID NO: 7263441 - DNA, 22 bp, Homo sapiens
gagaggaggtggctatgacagc

SEQ ID NO: 7263442 - DNA, 22 bp, Homo sapiens
gagaggagtagacactttggtt

SEQ ID NO: 7263443 - DNA, 22 bp, Homo sapiens
gagaggagaagcctgcgcttca

SEQ ID NO: 7263444 - DNA, 22 bp, Homo sapiens
gagaacagtgtcatcctataat

SEQ ID NO: 7263445 - DNA, 22 bp, Homo sapiens
gagaaagggaacttacagagtg

SEQ ID NO: 7263446 - DNA, 22 bp, Homo sapiens
gagaacagtgttgtattttttc

SEQ ID NO: 7263447 - DNA, 22 bp, Homo sapiens
gacaacaataatgtggagctga

SEQ ID NO: 7263448 - DNA, 22 bp, Homo sapiens
gaatggctatcggattattagg

SEQ ID NO: 7263449 - DNA, 22 bp, Homo sapiens
gaccttgtaaattttcactcca

SEQ ID NO: 7263450 - DNA, 22 bp, Homo sapiens
gaccttcttgctgtgtcctaac

SEQ ID NO: 7263451 - DNA, 22 bp, Homo sapiens
gacattaatggcaaattaatta

SEQ ID NO: 7263452 - DNA, 22 bp, Homo sapiens
gacctggcatattcattggcac

SEQ ID NO: 7263453 - DNA, 22 bp, Homo sapiens
gcccaagccgccttccagagac

SEQ ID NO: 7263454 - DNA, 22 bp, Homo sapiens
gcagttgctcttgaggcacttt

SEQ ID NO: 7263455 - DNA, 22 bp, Homo sapiens
gcaggtgattcaccctgggcct

SEQ ID NO: 7263456 - DNA, 22 bp, Homo sapiens
gcatttaaatttgaacttcaga

SEQ ID NO: 7263457 - DNA, 22 bp, Homo sapiens
gcatttatttctttactgcatc

SEQ ID NO: 7263458 - DNA, 22 bp, Homo sapiens
gcatttattatctgccaggcac

SEQ ID NO: 7263459 - DNA, 18 bp, Homo sapiens
gcatttatgcggggctac

SEQ ID NO: 7263460 - DNA, 22 bp, Homo sapiens
gcatttatattctgttcggata

SEQ ID NO: 7263461 - DNA, 22 bp, Homo sapiens
gcagcacacggtggtgccctgg

SEQ ID NO: 7263462 - DNA, 22 bp, Homo sapiens
gcaggtgaatgatggactagga

SEQ ID NO: 7263463 - DNA, 22 bp, Homo sapiens
gcaggtgatgtgatgtgagcat

SEQ ID NO: 7263464 - DNA, 22 bp, Homo sapiens
gcaggccattcaggagatgtgc

SEQ ID NO: 7263465 - DNA, 22 bp, Homo sapiens
gcaggccaagccctcgcagaga

SEQ ID NO: 7263466 - DNA, 22 bp, Homo sapiens
gcaggccagctgtgcagatggg

SEQ ID NO: 7263467 - DNA, 22 bp, Homo sapiens
gcagacaatttattagcagatt

SEQ ID NO: 7263468 - DNA, 22 bp, Homo sapiens
gcaataaaatgtaatgattggg

SEQ ID NO: 7263469 - DNA, 22 bp, Homo sapiens
gcaataaagtagcagctcatca

SEQ ID NO: 7263470 - DNA, 22 bp, Homo sapiens
gagtagacattaaattacactg

SEQ ID NO: 7263471 - DNA, 19 bp, Homo sapiens
gagtattttccaacttggt

SEQ ID NO: 7263472 - DNA, 21 bp, Homo sapiens
ggagctgcaggagccgaaggc

SEQ ID NO: 7263473 - DNA, 19 bp, Homo sapiens
ggagcttggtggctgtggc

SEQ ID NO: 7263474 - DNA, 22 bp, Homo sapiens
ggagaacaaatatctggcttct

SEQ ID NO: 7263475 - DNA, 22 bp, Homo sapiens
ggacttgctaaggtggctgaac

SEQ ID NO: 7263476 - DNA, 22 bp, Homo sapiens
gctttttcaaatgaaagctggt

SEQ ID NO: 7263477 - DNA, 22 bp, Homo sapiens
gcttgtttgtgatttctccaga

SEQ ID NO: 7263478 - DNA, 22 bp, Homo sapiens
gctctgtggcattcatgggcag

SEQ ID NO: 7263479 - DNA, 22 bp, Homo sapiens
gctgcagggagctggaaggctc

SEQ ID NO: 7263480 - DNA, 22 bp, Homo sapiens
ggctcactgcaacttccgcctc

SEQ ID NO: 7263481 - DNA, 22 bp, Homo sapiens
ggcagatgttgcagtgagcaga

SEQ ID NO: 7263482 - DNA, 23 bp, Homo sapiens
gggagatgggaaatgaaggctct

SEQ ID NO: 7263483 - DNA, 19 bp, Homo sapiens
gggagttgttctgatccta

SEQ ID NO: 7263484 - DNA, 22 bp, Homo sapiens
gggaggttgaggctgcagtgag

SEQ ID NO: 7263485 - DNA, 22 bp, Homo sapiens
ggggaggacctttccaaggctt

SEQ ID NO: 7263486 - DNA, 22 bp, Homo sapiens
ggggagttaaaatgtgctgcaa

SEQ ID NO: 7263487 - DNA, 22 bp, Homo sapiens
ggggagttcatgcatttgtgga

SEQ ID NO: 7263488 - DNA, 22 bp, Homo sapiens
ggtttaatggagatatttcaga

SEQ ID NO: 7263489 - DNA, 17 bp, Homo sapiens
ggtttaatccttacctg

SEQ ID NO: 7263490 - DNA, 23 bp, Homo sapiens
gggtttccttctggctcctcctt

SEQ ID NO: 7263491 - DNA, 22 bp, Homo sapiens
gtctaattcctgctcttactca

SEQ ID NO: 7263492 - DNA, 22 bp, Homo sapiens
gtgagccgagtatagttcatag

SEQ ID NO: 7263493 - DNA, 21 bp, Homo sapiens
gtcttttaagtgaagagaggc

SEQ ID NO: 7263494 - DNA, 22 bp, Homo sapiens
gtctttatttgagattgtcatt

SEQ ID NO: 7263495 - DNA, 22 bp, Homo sapiens
gtcgtggtcagacaccagaaaa

SEQ ID NO: 7263496 - DNA, 22 bp, Homo sapiens
gtcgtggagctcacagtgtgcc

SEQ ID NO: 7263497 - DNA, 22 bp, Homo sapiens
gtcagaaaacttccctttgagt

SEQ ID NO: 7263498 - DNA, 22 bp, Homo sapiens
gtatttttcattccaagtgaga

SEQ ID NO: 7263499 - DNA, 22 bp, Homo sapiens
gtcaaaaagtagtcatttctgt

SEQ ID NO: 7263500 - DNA, 22 bp, Homo sapiens
gtatttttcagttaggagctta

SEQ ID NO: 7263501 - DNA, 22 bp, Homo sapiens
gtatttttagtagagtcggggt

SEQ ID NO: 7263502 - DNA, 22 bp, Homo sapiens
gtatttttaggtaaggaaagta

SEQ ID NO: 7263503 - DNA, 22 bp, Homo sapiens
tactctcagggttagtacagga

SEQ ID NO: 7263504 - DNA, 22 bp, Homo sapiens
tacttacagaaggaagcaattg

SEQ ID NO: 7263505 - DNA, 22 bp, Homo sapiens
tactagttctcatatgaaataa

SEQ ID NO: 7263506 - DNA, 22 bp, Homo sapiens
taatttcaaatttcttagcgtg

SEQ ID NO: 7263507 - DNA, 22 bp, Homo sapiens
tacacaatgacttaagatgtca

SEQ ID NO: 7263508 - DNA, 22 bp, Homo sapiens
taattgctcgagaaataacctc

SEQ ID NO: 7263509 - DNA, 22 bp, Homo sapiens
taattcttcaggccttttgtct

SEQ ID NO: 7263510 - DNA, 22 bp, Homo sapiens
taagcctgcatgaaccatgaga

SEQ ID NO: 7263511 - DNA, 22 bp, Homo sapiens
gttctttaagtggagaaggaaa

SEQ ID NO: 7263512 - DNA, 22 bp, Homo sapiens
gttgaacatgtgagtctcagga

SEQ ID NO: 7263513 - DNA, 22 bp, Homo sapiens
gtttcacagtctgcagaatttt

SEQ ID NO: 7263514 - DNA, 22 bp, Homo sapiens
gtttcaaataggtttcagcaaa

SEQ ID NO: 7263515 - DNA, 22 bp, Homo sapiens
gtttcacacatcctgcacatag

SEQ ID NO: 7263516 - DNA, 22 bp, Homo sapiens
gtttctttctattgactgaaca

SEQ ID NO: 7263517 - DNA, 22 bp, Homo sapiens
gtttcttttaaaatatgtagac

SEQ ID NO: 7263518 - DNA, 22 bp, Homo sapiens
gtttcttttgtgatcaccaacc

SEQ ID NO: 7263519 - DNA, 20 bp, Homo sapiens
gttttaaggcacaggccttt

SEQ ID NO: 7263520 - DNA, 22 bp, Homo sapiens
taagagattctaaagctactgg

SEQ ID NO: 7263521 - DNA, 22 bp, Homo sapiens
taagagatggttatcaaaagca

SEQ ID NO: 7263522 - DNA, 22 bp, Homo sapiens
taagagatgcttttctaaataa

SEQ ID NO: 7263523 - DNA, 22 bp, Homo sapiens
taagacttccaggaaaaggtgg

SEQ ID NO: 7263524 - DNA, 22 bp, Homo sapiens
taagaggatatttggccagaag

SEQ ID NO: 7263525 - DNA, 22 bp, Homo sapiens
taagcatggtggtaaaagaggt

SEQ ID NO: 7263526 - DNA, 22 bp, Homo sapiens
taaatgttatgcccatcatcca

SEQ ID NO: 7263527 - DNA, 21 bp, Homo sapiens
gttttaagggagaaaacctag

SEQ ID NO: 7263528 - DNA, 20 bp, Homo sapiens
taaagacataagctactatc

SEQ ID NO: 7263529 - DNA, 20 bp, Homo sapiens
tagagagatatgggggttcc

SEQ ID NO: 7263530 - DNA, 22 bp, Homo sapiens
tagagaacaagtatggcacgga

SEQ ID NO: 7263531 - DNA, 22 bp, Homo sapiens
tagactggtgaattagggggaa

SEQ ID NO: 7263532 - DNA, 22 bp, Homo sapiens
tatttgcaggacatagatatgg

SEQ ID NO: 7263533 - DNA, 22 bp, Homo sapiens
tatttgcaggcttttgtcatgg

SEQ ID NO: 7263534 - DNA, 22 bp, Homo sapiens
tatttcttgttattctcgttga

SEQ ID NO: 7263535 - DNA, 22 bp, Homo sapiens
tattgtcacgtcttaattctag

SEQ ID NO: 7263536 - DNA, 22 bp, Homo sapiens
tattgtcaagaagtttatagtg

SEQ ID NO: 7263537 - DNA, 23 bp, Homo sapiens
tattacaattggtcttattaaga

SEQ ID NO: 7263538 - DNA, 23 bp, Homo sapiens
tattacaattggtcttattaaga

SEQ ID NO: 7263539 - DNA, 22 bp, Homo sapiens
tattacaaattataatgggaga

SEQ ID NO: 7263540 - DNA, 22 bp, Homo sapiens
tatttaaaaagaggccagctgg

SEQ ID NO: 7263541 - DNA, 22 bp, Homo sapiens
tatttaactggaaacacaatga

SEQ ID NO: 7263542 - DNA, 22 bp, Homo sapiens
tatttaagatgtgtcataaaga

SEQ ID NO: 7263543 - DNA, 22 bp, Homo sapiens
tatttttgcctctcagataaaa

SEQ ID NO: 7263544 - DNA, 22 bp, Homo sapiens
tattttgtatttatgcaagaaa

SEQ ID NO: 7263545 - DNA, 22 bp, Homo sapiens
tcaaagatagatgttgagaaat

SEQ ID NO: 7263546 - DNA, 20 bp, Homo sapiens
tcaaagcaaagggagatgat

SEQ ID NO: 7263547 - DNA, 22 bp, Homo sapiens
tcaaataatgccattcatcatc

SEQ ID NO: 7263548 - DNA, 22 bp, Homo sapiens
tcaaataccagcaatttcatgt

SEQ ID NO: 7263549 - DNA, 22 bp, Homo sapiens
tcaaagtaagaatttattacaa

SEQ ID NO: 7263550 - DNA, 22 bp, Homo sapiens
tcaaagtataattgcttttttg

SEQ ID NO: 7263551 - DNA, 22 bp, Homo sapiens
tatccaaaggaacaatcacagc

SEQ ID NO: 7263552 - DNA, 22 bp, Homo sapiens
tatcagaaggcacatggagtct

SEQ ID NO: 7263553 - DNA, 22 bp, Homo sapiens
tatgtatccgtgtgtgtacaga

SEQ ID NO: 7263554 - DNA, 22 bp, Homo sapiens
tatgtagcaatagcatcatact

SEQ ID NO: 7263555 - DNA, 18 bp, Homo sapiens
tccaggcctgaagtgtcc

SEQ ID NO: 7263556 - DNA, 22 bp, Homo sapiens
tccattatacttctgattcaaa

SEQ ID NO: 7263557 - DNA, 22 bp, Homo sapiens
tccattctttttacctctcaga

SEQ ID NO: 7263558 - DNA, 22 bp, Homo sapiens
tcccaagagctactcaatggaa

SEQ ID NO: 7263559 - DNA, 22 bp, Homo sapiens
tcccaggctggggccaggtgac

SEQ ID NO: 7263560 - DNA, 22 bp, Homo sapiens
tcaacatacatacatggtcagg

SEQ ID NO: 7263561 - DNA, 22 bp, Homo sapiens
tcaacaataggatatagcaggt

SEQ ID NO: 7263562 - DNA, 22 bp, Homo sapiens
tcacatgctgtgggatctgtat

SEQ ID NO: 7263563 - DNA, 22 bp, Homo sapiens
tcacatgctactgagccagacc

SEQ ID NO: 7263564 - DNA, 22 bp, Homo sapiens
tcagaagccttgattatctaga

SEQ ID NO: 7263565 - DNA, 22 bp, Homo sapiens
tcagaagccaccttttgttggg

SEQ ID NO: 7263566 - DNA, 22 bp, Homo sapiens
tcagaagccggaagtgctcctc

SEQ ID NO: 7263567 - DNA, 22 bp, Homo sapiens
tcagaagccgggcaggttttgg

SEQ ID NO: 7263568 - DNA, 22 bp, Homo sapiens
tcagaataagttatgaaatgaa

SEQ ID NO: 7263569 - DNA, 22 bp, Homo sapiens
tcagaaagcttttacttaaaca

SEQ ID NO: 7263570 - DNA, 22 bp, Homo sapiens
tcactgctctgaaagtacaggg

SEQ ID NO: 7263571 - DNA, 22 bp, Homo sapiens
tcataaagttatcaccaaatcc

SEQ ID NO: 7263572 - DNA, 22 bp, Homo sapiens
tccaaattctatgttctttcca

SEQ ID NO: 7263573 - DNA, 18 bp, Homo sapiens
tccaaaatcatgtatttt

SEQ ID NO: 7263574 - DNA, 22 bp, Homo sapiens
tcatttttttccggtaggaata

SEQ ID NO: 7263575 - DNA, 22 bp, Homo sapiens
tcatttttagcgcgcaaaagtt

SEQ ID NO: 7263576 - DNA, 21 bp, Homo sapiens
tcatttttattgctaccttgc

SEQ ID NO: 7263577 - DNA, 22 bp, Homo sapiens
tcatttataaggatgcaattaa

SEQ ID NO: 7263578 - DNA, 22 bp, Homo sapiens
tcatttatagaagtgggcagta

SEQ ID NO: 7263579 - DNA, 22 bp, Homo sapiens
tcatttatagctaaccttgaat

SEQ ID NO: 7263580 - DNA, 22 bp, Homo sapiens
tcatttctccgacctgctgtcc

SEQ ID NO: 7263581 - DNA, 22 bp, Homo sapiens
tcatttctctgagtctgataat

SEQ ID NO: 7263582 - DNA, 22 bp, Homo sapiens
tcatttcaatgatactactaag

SEQ ID NO: 7263583 - DNA, 22 bp, Homo sapiens
tcatttatcatttgtgctgtag

SEQ ID NO: 7263584 - DNA, 22 bp, Homo sapiens
tcatttatattgtattctgtag

SEQ ID NO: 7263585 - DNA, 22 bp, Homo sapiens
tcatttcagatgcatttagaat

SEQ ID NO: 7263586 - DNA, 23 bp, Homo sapiens
tcatttcaggttgcatggtacca

SEQ ID NO: 7263587 - DNA, 22 bp, Homo sapiens
ttctcagatgattcagataaac

SEQ ID NO: 7263588 - DNA, 22 bp, Homo sapiens
ttctcagattccccttttaata

SEQ ID NO: 7263589 - DNA, 21 bp, Homo sapiens
ttctcagatcgagtagtgaga

SEQ ID NO: 7263590 - DNA, 22 bp, Homo sapiens
ttcctgaatgctgttgtgctgt

SEQ ID NO: 7263591 - DNA, 22 bp, Homo sapiens
ttcctgaattgagctttagaaa

SEQ ID NO: 7263592 - DNA, 22 bp, Homo sapiens
ttccttctggaggctccagggg

SEQ ID NO: 7263593 - DNA, 22 bp, Homo sapiens
ttccttcttccagaggctgccc

SEQ ID NO: 7263594 - DNA, 22 bp, Homo sapiens
ttcttcaaccatctacataaac

SEQ ID NO: 7263595 - DNA, 22 bp, Homo sapiens
ttcttattttcctgaggaagaa

SEQ ID NO: 7263596 - DNA, 22 bp, Homo sapiens
ttcttttaatgttctgaagttt

SEQ ID NO: 7263597 - DNA, 22 bp, Homo sapiens
ttcttttaatgtctggctttca

SEQ ID NO: 7263598 - DNA, 22 bp, Homo sapiens
ttctttgttgtactttcctaca

SEQ ID NO: 7263599 - DNA, 22 bp, Homo sapiens
ttcttttctttaggcattgtgt

SEQ ID NO: 7263600 - DNA, 22 bp, Homo sapiens
ttcttttgcaagactattgatt

SEQ ID NO: 7263601 - DNA, 22 bp, Homo sapiens
ttcttttggactcaaagagaac

SEQ ID NO: 7263602 - DNA, 22 bp, Homo sapiens
ttctttttaaagtgtgtatgca

SEQ ID NO: 7263603 - DNA, 22 bp, Homo sapiens
ttgaacataaatcactggtcag

SEQ ID NO: 7263604 - DNA, 22 bp, Homo sapiens
ttgaacattaacttcagtctat

SEQ ID NO: 7263605 - DNA, 22 bp, Homo sapiens
ttgaacattagaataagtaatt

SEQ ID NO: 7263606 - DNA, 22 bp, Homo sapiens
ttgaacattggcaatttcatat

SEQ ID NO: 7263607 - DNA, 22 bp, Homo sapiens
ttgaacattttctatgttatag

SEQ ID NO: 7263608 - DNA, 22 bp, Homo sapiens
ttgaactaataggtatcttgta

SEQ ID NO: 7263609 - DNA, 22 bp, Homo sapiens
ttctgtgtcttcttgttctgtg

SEQ ID NO: 7263610 - DNA, 22 bp, Homo sapiens
ttctgtctgtaaacttctcaat

SEQ ID NO: 7263611 - DNA, 23 bp, Homo sapiens
ttctgtcttgctgtcagctttct

SEQ ID NO: 7263612 - DNA, 22 bp, Homo sapiens
ttctgtcttctcggttgtttac

SEQ ID NO: 7263613 - DNA, 22 bp, Homo sapiens
ttctgtctctgtgtttacatta

SEQ ID NO: 7263614 - DNA, 22 bp, Homo sapiens
ttcacagctaagagctaagtaa

SEQ ID NO: 7263615 - DNA, 22 bp, Homo sapiens
ttcacagctccttttactcaac

SEQ ID NO: 7263616 - DNA, 19 bp, Homo sapiens
ttcacagctctgtgtcagt

SEQ ID NO: 7263617 - DNA, 22 bp, Homo sapiens
ttcaaagagaaattgtattttc

SEQ ID NO: 7263618 - DNA, 22 bp, Homo sapiens
ttcaaagataatgtagcatttt

SEQ ID NO: 7263619 - DNA, 22 bp, Homo sapiens
ttcataaacaactgatggtaat

SEQ ID NO: 7263620 - DNA, 22 bp, Homo sapiens
ttatataaagataacttttctt

SEQ ID NO: 7263621 - DNA, 22 bp, Homo sapiens
ttataggaaaagttctagaaaa

SEQ ID NO: 7263622 - DNA, 22 bp, Homo sapiens
ttatagaatccagttgttgtat

SEQ ID NO: 7263623 - DNA, 22 bp, Homo sapiens
ttagccattctgataggtatgt

SEQ ID NO: 7263624 - DNA, 23 bp, Homo sapiens
ttagcgaggaaatcagtagagaa

SEQ ID NO: 7263625 - DNA, 22 bp, Homo sapiens
ttagctctttgtagctatttct

SEQ ID NO: 7263626 - DNA, 22 bp, Homo sapiens
ttattaaaatgcggatttggct

SEQ ID NO: 7263627 - DNA, 22 bp, Homo sapiens
ttattaagtgcgtactgtatgc

SEQ ID NO: 7263628 - DNA, 22 bp, Homo sapiens
ttcaaacagtgtagaatatatg

SEQ ID NO: 7263629 - DNA, 22 bp, Homo sapiens
ttgcagaattaagcagagagcc

SEQ ID NO: 7263630 - DNA, 22 bp, Homo sapiens
ttgacaatccctgttagaagtg

SEQ ID NO: 7263631 - DNA, 22 bp, Homo sapiens
ttgacaatgcactgtgctaagt

SEQ ID NO: 7263632 - DNA, 22 bp, Homo sapiens
ttgacaattgggagatataaag

SEQ ID NO: 7263633 - DNA, 23 bp, Homo sapiens
ttgctgagataaagaatgcaggg

SEQ ID NO: 7263634 - DNA, 22 bp, Homo sapiens
ttgctctccagaggctcacagc

SEQ ID NO: 7263635 - DNA, 22 bp, Homo sapiens
ttgcattccatggttttccttc

SEQ ID NO: 7263636 - DNA, 22 bp, Homo sapiens
ttggaacacaatgtttctttca

SEQ ID NO: 7263637 - DNA, 22 bp, Homo sapiens
ttggaaacgtcaccttttcctt

SEQ ID NO: 7263638 - DNA, 22 bp, Homo sapiens
ttggccatctaagcccagccac

SEQ ID NO: 7263639 - DNA, 22 bp, Homo sapiens
tttcatgtggcgatgtctctgg

SEQ ID NO: 7263640 - DNA, 22 bp, Homo sapiens
tttcacatttgttttaagaagt

SEQ ID NO: 7263641 - DNA, 22 bp, Homo sapiens
tttcagactcatctcaagcttt

SEQ ID NO: 7263642 - DNA, 22 bp, Homo sapiens
tttcagaaatggcactgaaatc

SEQ ID NO: 7263643 - DNA, 22 bp, Homo sapiens
tttcaagactcattgagtattg

SEQ ID NO: 7263644 - DNA, 22 bp, Homo sapiens
tttcaagactcattgagtattg

SEQ ID NO: 7263645 - DNA, 22 bp, Homo sapiens
tttaagctaatgtcataattag

SEQ ID NO: 7263646 - DNA, 22 bp, Homo sapiens
tttaagctgtggcattaattct

SEQ ID NO: 7263647 - DNA, 22 bp, Homo sapiens
tttaaggatgatgtgatatata

SEQ ID NO: 7263648 - DNA, 22 bp, Homo sapiens
tttaaggaggggctcacgtggg

SEQ ID NO: 7263649 - DNA, 22 bp, Homo sapiens
tttaaggagctactcaccgtca

SEQ ID NO: 7263650 - DNA, 22 bp, Homo sapiens
tttaaggaaaaaatgtacttag

SEQ ID NO: 7263651 - DNA, 22 bp, Homo sapiens
tttaaggatgtaaaggaagaag

SEQ ID NO: 7263652 - DNA, 22 bp, Homo sapiens
tttaatgatagtcttacgaaaa

SEQ ID NO: 7263653 - DNA, 22 bp, Homo sapiens
tttaaagagaatgtgaaggagt

SEQ ID NO: 7263654 - DNA, 21 bp, Homo sapiens
tttaaagaataggaagggagg

SEQ ID NO: 7263655 - DNA, 22 bp, Homo sapiens
tttaaagaaattcctcatcttt

SEQ ID NO: 7263656 - DNA, 17 bp, Homo sapiens
tttaaactactacaagg

SEQ ID NO: 7263657 - DNA, 19 bp, Homo sapiens
tttaaagtgactggtattt

SEQ ID NO: 7263658 - DNA, 22 bp, Homo sapiens
tttaaagtgctgctcctatcct

SEQ ID NO: 7263659 - DNA, 22 bp, Homo sapiens
tttagcatcgaagtaaatttag

SEQ ID NO: 7263660 - DNA, 21 bp, Homo sapiens
tttagagaatactcactattt

SEQ ID NO: 7263661 - DNA, 22 bp, Homo sapiens
tttagagaccctctgctatttt

SEQ ID NO: 7263662 - DNA, 22 bp, Homo sapiens
tttagagacacactggcatttg

SEQ ID NO: 7263663 - DNA, 20 bp, Homo sapiens
tttacattttgaaacagtga

SEQ ID NO: 7263664 - DNA, 22 bp, Homo sapiens
tttaccaaatagattatgtcag

SEQ ID NO: 7263665 - DNA, 22 bp, Homo sapiens
tttttagagtgttaccagtata

SEQ ID NO: 7263666 - DNA, 22 bp, Homo sapiens
ttttgtttgtgtccactgcagt

SEQ ID NO: 7263667 - DNA, 22 bp, Homo sapiens
tttttataccacctctcactta

SEQ ID NO: 7263668 - DNA, 22 bp, Homo sapiens
ttttaaagagatgctgtgcata

SEQ ID NO: 7263669 - DNA, 22 bp, Homo sapiens
ttttaaaggcagattatggctt

SEQ ID NO: 7263670 - DNA, 22 bp, Homo sapiens
ttttaaaggatactcttgtcta

SEQ ID NO: 7263671 - DNA, 22 bp, Homo sapiens
ttttaaaggatagctctggttg

SEQ ID NO: 7263672 - DNA, 22 bp, Homo sapiens
ttttaaaggctgtatgaccaag

SEQ ID NO: 7263673 - DNA, 22 bp, Homo sapiens
ttttaagaaatgtatgactgtc

SEQ ID NO: 7263674 - DNA, 22 bp, Homo sapiens
ttttaatgggcgactattatgg

SEQ ID NO: 7263675 - DNA, 22 bp, Homo sapiens
ttttctgtattattgtgcttca

SEQ ID NO: 7263676 - DNA, 22 bp, Homo sapiens
ttttatgttgctataataggta

SEQ ID NO: 7263677 - DNA, 22 bp, Homo sapiens
ttttcattgtaaatcaggaaac

SEQ ID NO: 7263678 - DNA, 22 bp, Homo sapiens
tttcctcctagcctccagccgc

SEQ ID NO: 7263679 - DNA, 22 bp, Homo sapiens
tttcctctccggggcctccagg

SEQ ID NO: 7263680 - DNA, 22 bp, Homo sapiens
tttcctctgactgctcccctgc

SEQ ID NO: 7263681 - DNA, 19 bp, Homo sapiens
tttgaaaggattgttattt

SEQ ID NO: 7263682 - DNA, 21 bp, Homo sapiens
tttgaaagccctatgttttca

SEQ ID NO: 7263683 - DNA, 22 bp, Homo sapiens
tttgaaagcctggcttttctct

SEQ ID NO: 7263684 - DNA, 22 bp, Homo sapiens
tttgcttttgtgctctagtggt

SEQ ID NO: 7263685 - DNA, 22 bp, Homo sapiens
tttggtttagggtcatttaaca

SEQ ID NO: 7263686 - DNA, 22 bp, Homo sapiens
tttgatttactggatattctca

SEQ ID NO: 7263687 - DNA, 22 bp, Homo sapiens
tttgctttcttgattcagatta

SEQ ID NO: 7263688 - DNA, 19 bp, Homo sapiens
acagaagcatagaaaagga

SEQ ID NO: 7263689 - DNA, 23 bp, Homo sapiens
acagaagccaggagccgctgggc

SEQ ID NO: 7263690 - DNA, 22 bp, Homo sapiens
acagaagcctttggccatttga

SEQ ID NO: 7263691 - DNA, 21 bp, Homo sapiens
acagaagcggcgagtggcccc

SEQ ID NO: 7263692 - DNA, 22 bp, Homo sapiens
acagaaggcggggacaaggcgg

SEQ ID NO: 7263693 - DNA, 22 bp, Homo sapiens
acagaaggacttgagaaagaca

SEQ ID NO: 7263694 - DNA, 22 bp, Homo sapiens
acagaagctcaagagagcagtg

SEQ ID NO: 7263695 - DNA, 19 bp, Homo sapiens
agcggttctcaaagtcagg

SEQ ID NO: 7263696 - DNA, 22 bp, Homo sapiens
agcacagaatgaggtggaagtg

SEQ ID NO: 7263697 - DNA, 22 bp, Homo sapiens
agcacacagtattagccattgt

SEQ ID NO: 7263698 - DNA, 21 bp, Homo sapiens
acacaacaggcagtcattttc

SEQ ID NO: 7263699 - DNA, 19 bp, Homo sapiens
acaatagaaaagtcttttg

SEQ ID NO: 7263700 - DNA, 22 bp, Homo sapiens
acaacattatacatagaaagct

SEQ ID NO: 7263701 - DNA, 22 bp, Homo sapiens
acaacattatacatagaaagct

SEQ ID NO: 7263702 - DNA, 22 bp, Homo sapiens
aatttcttcagctctaaaatgg

SEQ ID NO: 7263703 - DNA, 22 bp, Homo sapiens
agagttaaggccactgtcagta

SEQ ID NO: 7263704 - DNA, 22 bp, Homo sapiens
agagtgtggaacttgaggagct

SEQ ID NO: 7263705 - DNA, 22 bp, Homo sapiens
acaaagtatttttaggtttgta

SEQ ID NO: 7263706 - DNA, 22 bp, Homo sapiens
agagaagggcctgtatgtaatc

SEQ ID NO: 7263707 - DNA, 22 bp, Homo sapiens
aatgtgtagcatttaatgcagt

SEQ ID NO: 7263708 - DNA, 22 bp, Homo sapiens
agaggaggtggtgatgctttaa

SEQ ID NO: 7263709 - DNA, 22 bp, Homo sapiens
aattcattgccagaatctatga

SEQ ID NO: 7263710 - DNA, 22 bp, Homo sapiens
acatctcagaactgagtaaccg

SEQ ID NO: 7263711 - DNA, 22 bp, Homo sapiens
aagtagcattttcaaaatgtat

SEQ ID NO: 7263712 - DNA, 22 bp, Homo sapiens
aagtatatttagctgagcttgt

SEQ ID NO: 7263713 - DNA, 22 bp, Homo sapiens
aagtttttggtagagaaaagta

SEQ ID NO: 7263714 - DNA, 22 bp, Homo sapiens
aagtttttgattctaagagaga

SEQ ID NO: 7263715 - DNA, 20 bp, Homo sapiens
aagttttctccaaatacagt

SEQ ID NO: 7263716 - DNA, 22 bp, Homo sapiens
aagtgtttaaattatttgcagg

SEQ ID NO: 7263717 - DNA, 22 bp, Homo sapiens
agaacacactgggggaaacaag

SEQ ID NO: 7263718 - DNA, 22 bp, Homo sapiens
aaaacattctgtgaactctcaa

SEQ ID NO: 7263719 - DNA, 22 bp, Homo sapiens
aaaagcactacaatttcgcttc

SEQ ID NO: 7263720 - DNA, 22 bp, Homo sapiens
aaaatgatgctgtaatttggca

SEQ ID NO: 7263721 - DNA, 22 bp, Homo sapiens
aaaatgaggtcaatatcctttt

SEQ ID NO: 7263722 - DNA, 22 bp, Homo sapiens
aaagcagcagcacctgcatttc

SEQ ID NO: 7263723 - DNA, 22 bp, Homo sapiens
aaagcagccactctctctgcct

SEQ ID NO: 7263724 - DNA, 22 bp, Homo sapiens
aaagcagcctgctcatcctgga

SEQ ID NO: 7263725 - DNA, 22 bp, Homo sapiens
aaaagtttaagactcattctag

SEQ ID NO: 7263726 - DNA, 21 bp, Homo sapiens
aaaagtttgacaggaaaggga

SEQ ID NO: 7263727 - DNA, 22 bp, Homo sapiens
aaaatgagacacatgtgactcc

SEQ ID NO: 7263728 - DNA, 22 bp, Homo sapiens
aaaatactactgtcttcttccc

SEQ ID NO: 7263729 - DNA, 19 bp, Homo sapiens
aaagttttattctcatttg

SEQ ID NO: 7263730 - DNA, 22 bp, Homo sapiens
aaagttttattcaagcattagt

SEQ ID NO: 7263731 - DNA, 22 bp, Homo sapiens
aaagttttgttgattgtggaat

SEQ ID NO: 7263732 - DNA, 22 bp, Homo sapiens
aaagttttctgccttcattaga

SEQ ID NO: 7263733 - DNA, 22 bp, Homo sapiens
aaagtttttaagcaagaccctt

SEQ ID NO: 7263734 - DNA, 22 bp, Homo sapiens
aaagttctttttctataaatcc

SEQ ID NO: 7263735 - DNA, 22 bp, Homo sapiens
aaagttgttcagtaagaaactc

SEQ ID NO: 7263736 - DNA, 22 bp, Homo sapiens
aaatgccaaggagagactgtta

SEQ ID NO: 7263737 - DNA, 22 bp, Homo sapiens
aaatcaaaagacatgtgtttta

SEQ ID NO: 7263738 - DNA, 22 bp, Homo sapiens
aaatcactgattaaagttagaa

SEQ ID NO: 7263739 - DNA, 22 bp, Homo sapiens
aaatcactgttattgatcttaa

SEQ ID NO: 7263740 - DNA, 23 bp, Homo sapiens
aaatgacatatggtttctgaagg

SEQ ID NO: 7263741 - DNA, 21 bp, Homo sapiens
aaagcatcacgaacatttggg

SEQ ID NO: 7263742 - DNA, 22 bp, Homo sapiens
aaagcatcagatctgacacttc

SEQ ID NO: 7263743 - DNA, 22 bp, Homo sapiens
aaagcatgactcaagaattact

SEQ ID NO: 7263744 - DNA, 22 bp, Homo sapiens
aaagcatgattagatagatgat

SEQ ID NO: 7263745 - DNA, 22 bp, Homo sapiens
aaagcatggcatgaagaacatg

SEQ ID NO: 7263746 - DNA, 22 bp, Homo sapiens
aaagcatggttaaagacagtgg

SEQ ID NO: 7263747 - DNA, 22 bp, Homo sapiens
aaagcatgtgaatagaatatgg

SEQ ID NO: 7263748 - DNA, 22 bp, Homo sapiens
aacttctttgagctccagtttt

SEQ ID NO: 7263749 - DNA, 22 bp, Homo sapiens
aaagttctggagaaaataatga

SEQ ID NO: 7263750 - DNA, 22 bp, Homo sapiens
aaagttctctatggtgtaaaaa

SEQ ID NO: 7263751 - DNA, 20 bp, Homo sapiens
acacagactcagcttggatg

SEQ ID NO: 7263752 - DNA, 17 bp, Homo sapiens
acacagacaggcagaca

SEQ ID NO: 7263753 - DNA, 22 bp, Homo sapiens
acaatatagtccatgagcatgc

SEQ ID NO: 7263754 - DNA, 22 bp, Homo sapiens
acaatatagtccatgagcatgc

SEQ ID NO: 7263755 - DNA, 22 bp, Homo sapiens
acaatattgtacccagaagttt

SEQ ID NO: 7263756 - DNA, 23 bp, Homo sapiens
acaatgtctgttcataaaatacc

SEQ ID NO: 7263757 - DNA, 22 bp, Homo sapiens
acaaatatttactgaatccact

SEQ ID NO: 7263758 - DNA, 22 bp, Homo sapiens
aagaacagtgtcctgggactcg

SEQ ID NO: 7263759 - DNA, 23 bp, Homo sapiens
acagacaacactgatgagagaaa

SEQ ID NO: 7263760 - DNA, 22 bp, Homo sapiens
acacataagcctaatcatctcc

SEQ ID NO: 7263761 - DNA, 22 bp, Homo sapiens
aataatgtacatacatatttcg

SEQ ID NO: 7263762 - DNA, 22 bp, Homo sapiens
aatctgcacaattcagtttcag

SEQ ID NO: 7263763 - DNA, 22 bp, Homo sapiens
aatgcacatgttgtaataaata

SEQ ID NO: 7263764 - DNA, 22 bp, Homo sapiens
aatgcacatatatgtgtataca

SEQ ID NO: 7263765 - DNA, 22 bp, Homo sapiens
aacagtggggaaaagagttggt

SEQ ID NO: 7263766 - DNA, 22 bp, Homo sapiens
aagtctttttgaatctataact

SEQ ID NO: 7263767 - DNA, 22 bp, Homo sapiens
aagtaacatctgaacatgatgt

SEQ ID NO: 7263768 - DNA, 22 bp, Homo sapiens
aagtaacatgggaacatctgaa

SEQ ID NO: 7263769 - DNA, 22 bp, Homo sapiens
aaggccaggtccctgcagtgca

SEQ ID NO: 7263770 - DNA, 22 bp, Homo sapiens
aaggagtctgggccattcagag

SEQ ID NO: 7263771 - DNA, 22 bp, Homo sapiens
aaggatcaagtggattttctta

SEQ ID NO: 7263772 - DNA, 22 bp, Homo sapiens
atgcttaggttaaatttgtaat

SEQ ID NO: 7263773 - DNA, 22 bp, Homo sapiens
agagaacacgtgcatctgcaat

SEQ ID NO: 7263774 - DNA, 22 bp, Homo sapiens
agagaacagcattgcagctttg

SEQ ID NO: 7263775 - DNA, 22 bp, Homo sapiens
agagaacagacagatgcaatga

SEQ ID NO: 7263776 - DNA, 22 bp, Homo sapiens
agagaacaaattaaaggtggtt

SEQ ID NO: 7263777 - DNA, 22 bp, Homo sapiens
atgccacataattacaaataga

SEQ ID NO: 7263778 - DNA, 22 bp, Homo sapiens
atgactgttatgggactggaac

SEQ ID NO: 7263779 - DNA, 22 bp, Homo sapiens
atgacttctgctttacagagtt

SEQ ID NO: 7263780 - DNA, 22 bp, Homo sapiens
atgattctggcaaatttattat

SEQ ID NO: 7263781 - DNA, 22 bp, Homo sapiens
atgattttctgataaagaactg

SEQ ID NO: 7263782 - DNA, 22 bp, Homo sapiens
agagaacatgacgtaatagtgg

SEQ ID NO: 7263783 - DNA, 22 bp, Homo sapiens
agagaacatattttgtatgatt

SEQ ID NO: 7263784 - DNA, 22 bp, Homo sapiens
agagaacagtgttttgaaggag

SEQ ID NO: 7263785 - DNA, 22 bp, Homo sapiens
agagaacagcctcctagagaaa

SEQ ID NO: 7263786 - DNA, 22 bp, Homo sapiens
agagaacattagcaaaaacagc

SEQ ID NO: 7263787 - DNA, 22 bp, Homo sapiens
atgtgagtgtatacttacgtgt

SEQ ID NO: 7263788 - DNA, 22 bp, Homo sapiens
agagctaagaaacagaattgct

SEQ ID NO: 7263789 - DNA, 21 bp, Homo sapiens
atgttcactgggtcaattaga

SEQ ID NO: 7263790 - DNA, 22 bp, Homo sapiens
attaaggaacaaagccttttga

SEQ ID NO: 7263791 - DNA, 22 bp, Homo sapiens
attaaggattatactctccttt

SEQ ID NO: 7263792 - DNA, 22 bp, Homo sapiens
attaaggaggtaaactatggtt

SEQ ID NO: 7263793 - DNA, 22 bp, Homo sapiens
attaaggagggctgggcatgat

SEQ ID NO: 7263794 - DNA, 18 bp, Homo sapiens
attaaggaattctttaga

SEQ ID NO: 7263795 - DNA, 22 bp, Homo sapiens
attaaggaatgtaggcaagaag

SEQ ID NO: 7263796 - DNA, 22 bp, Homo sapiens
attaaggaagcctattctctcc

SEQ ID NO: 7263797 - DNA, 22 bp, Homo sapiens
agatgtttgtgttatctccatt

SEQ ID NO: 7263798 - DNA, 23 bp, Homo sapiens
agattgttattcccagttcatgt

SEQ ID NO: 7263799 - DNA, 22 bp, Homo sapiens
agatttatgtggtcacactcag

SEQ ID NO: 7263800 - DNA, 22 bp, Homo sapiens
atttgaaatctgggttactctg

SEQ ID NO: 7263801 - DNA, 22 bp, Homo sapiens
atttgaaatcccttctactgta

SEQ ID NO: 7263802 - DNA, 22 bp, Homo sapiens
atttcttttcaagagggtgctt

SEQ ID NO: 7263803 - DNA, 22 bp, Homo sapiens
atttctttctggccacggtttt

SEQ ID NO: 7263804 - DNA, 22 bp, Homo sapiens
caaagttttagtaaacatatat

SEQ ID NO: 7263805 - DNA, 22 bp, Homo sapiens
caaagtttaaagtagatttcag

SEQ ID NO: 7263806 - DNA, 23 bp, Homo sapiens
attttttgtctttgtaactagat

SEQ ID NO: 7263807 - DNA, 22 bp, Homo sapiens
attttgttgaggtaattgtcaa

SEQ ID NO: 7263808 - DNA, 22 bp, Homo sapiens
attgaaaaatgactattgctta

SEQ ID NO: 7263809 - DNA, 22 bp, Homo sapiens
attaatacattatagggattgt

SEQ ID NO: 7263810 - DNA, 22 bp, Homo sapiens
attgaaaatgacatttgtgccc

SEQ ID NO: 7263811 - DNA, 22 bp, Homo sapiens
attgaaaaattcacaattctgg

SEQ ID NO: 7263812 - DNA, 22 bp, Homo sapiens
attgtataacagcatgtatttt

SEQ ID NO: 7263813 - DNA, 22 bp, Homo sapiens
cagcctcctgggacactcaccg

SEQ ID NO: 7263814 - DNA, 22 bp, Homo sapiens
cagcacttcagcattcagattt

SEQ ID NO: 7263815 - DNA, 22 bp, Homo sapiens
cagcactttgagggctcttaat

SEQ ID NO: 7263816 - DNA, 22 bp, Homo sapiens
cagcacttgagctttcatgtaa

SEQ ID NO: 7263817 - DNA, 22 bp, Homo sapiens
agcgccactgcactccagcctg

SEQ ID NO: 7263818 - DNA, 18 bp, Homo sapiens
cagaggagagacattcag

SEQ ID NO: 7263819 - DNA, 22 bp, Homo sapiens
cagaggaggcggtatacactgc

SEQ ID NO: 7263820 - DNA, 22 bp, Homo sapiens
cagaggaggcggtatacactgc

SEQ ID NO: 7263821 - DNA, 20 bp, Homo sapiens
cagaggagtacatatgttca

SEQ ID NO: 7263822 - DNA, 22 bp, Homo sapiens
cagaggagtgggccgttatggt

SEQ ID NO: 7263823 - DNA, 22 bp, Homo sapiens
caattttattggtccaaataca

SEQ ID NO: 7263824 - DNA, 22 bp, Homo sapiens
caatttttgtacttatagtact

SEQ ID NO: 7263825 - DNA, 22 bp, Homo sapiens
caaggaaaaagcgagctcgggg

SEQ ID NO: 7263826 - DNA, 22 bp, Homo sapiens
agcaattggaatttagacaaga

SEQ ID NO: 7263827 - DNA, 20 bp, Homo sapiens
agcaattgtgaacttattca

SEQ ID NO: 7263828 - DNA, 22 bp, Homo sapiens
caatgtttttccttccttaata

SEQ ID NO: 7263829 - DNA, 22 bp, Homo sapiens
cacatttaagcagatgtggacc

SEQ ID NO: 7263830 - DNA, 22 bp, Homo sapiens
cacatttaaaggttgaagctga

SEQ ID NO: 7263831 - DNA, 22 bp, Homo sapiens
cacatttaaaaaatccacgatc

SEQ ID NO: 7263832 - DNA, 22 bp, Homo sapiens
cacatttaagtgcttgttcaga

SEQ ID NO: 7263833 - DNA, 22 bp, Homo sapiens
cacatttaatcctttataagta

SEQ ID NO: 7263834 - DNA, 22 bp, Homo sapiens
cactgcacttcagcctgggtga

SEQ ID NO: 7263835 - DNA, 22 bp, Homo sapiens
agcatttaggagaatttgagaa

SEQ ID NO: 7263836 - DNA, 22 bp, Homo sapiens
cactgcactccatcctgggaaa

SEQ ID NO: 7263837 - DNA, 20 bp, Homo sapiens
aggtgtccacgtggcagggt

SEQ ID NO: 7263838 - DNA, 22 bp, Homo sapiens
agtcacttctattctattaagt

SEQ ID NO: 7263839 - DNA, 19 bp, Homo sapiens
agttatttctaaatttacc

SEQ ID NO: 7263840 - DNA, 22 bp, Homo sapiens
agtgaattagcctatttgtaaa

SEQ ID NO: 7263841 - DNA, 17 bp, Homo sapiens
agtgagaatgtcatgta

SEQ ID NO: 7263842 - DNA, 22 bp, Homo sapiens
agtgattttatcaatttactca

SEQ ID NO: 7263843 - DNA, 22 bp, Homo sapiens
atagctgttgccaatttccatg

SEQ ID NO: 7263844 - DNA, 22 bp, Homo sapiens
atagaacagaaacagatgcaca

SEQ ID NO: 7263845 - DNA, 22 bp, Homo sapiens
actttagaaaagcatccataga

SEQ ID NO: 7263846 - DNA, 22 bp, Homo sapiens
agttgcagccttcaggagaccc

SEQ ID NO: 7263847 - DNA, 20 bp, Homo sapiens
agttcacaggccaaatttct

SEQ ID NO: 7263848 - DNA, 22 bp, Homo sapiens
atacaagttgtgataatgtaaa

SEQ ID NO: 7263849 - DNA, 22 bp, Homo sapiens
agaaagaacgttggttatctta

SEQ ID NO: 7263850 - DNA, 22 bp, Homo sapiens
atattaaatggattttgggagc

SEQ ID NO: 7263851 - DNA, 22 bp, Homo sapiens
atattaaaactatggttttcag

SEQ ID NO: 7263852 - DNA, 22 bp, Homo sapiens
atcaattcttaggaaaatagct

SEQ ID NO: 7263853 - DNA, 22 bp, Homo sapiens
agaaatagtcacattggaggaa

SEQ ID NO: 7263854 - DNA, 22 bp, Homo sapiens
agaaatatgctgattagatgaa

SEQ ID NO: 7263855 - DNA, 19 bp, Homo sapiens
agaaatagccttccttgtc

SEQ ID NO: 7263856 - DNA, 22 bp, Homo sapiens
agaaatagcagagtcaggcggg

SEQ ID NO: 7263857 - DNA, 22 bp, Homo sapiens
agaagctaattcatgtcttatg

SEQ ID NO: 7263858 - DNA, 22 bp, Homo sapiens
acattaaagagtaaggttagtt

SEQ ID NO: 7263859 - DNA, 22 bp, Homo sapiens
acattaaatttcatagtgatta

SEQ ID NO: 7263860 - DNA, 22 bp, Homo sapiens
acattaaaatggagaattttga

SEQ ID NO: 7263861 - DNA, 22 bp, Homo sapiens
acattaaaattgggtggggtaa

SEQ ID NO: 7263862 - DNA, 22 bp, Homo sapiens
acattaaacttgcttggctgta

SEQ ID NO: 7263863 - DNA, 22 bp, Homo sapiens
acattaaaaaatgttgcatgaa

SEQ ID NO: 7263864 - DNA, 22 bp, Homo sapiens
agggctttctttgtaaaagaag

SEQ ID NO: 7263865 - DNA, 22 bp, Homo sapiens
acatctcatgaatgataaatca

SEQ ID NO: 7263866 - DNA, 22 bp, Homo sapiens
aggcagattttctttactcagt

SEQ ID NO: 7263867 - DNA, 22 bp, Homo sapiens
aggaggccaggccctcaagcct

SEQ ID NO: 7263868 - DNA, 22 bp, Homo sapiens
acagtgaggaagcagctgtgct

SEQ ID NO: 7263869 - DNA, 22 bp, Homo sapiens
acagcatccttctaaagtagct

SEQ ID NO: 7263870 - DNA, 22 bp, Homo sapiens
acagcatccctgaagataacca

SEQ ID NO: 7263871 - DNA, 22 bp, Homo sapiens
acaggacaaaaatctggatggc

SEQ ID NO: 7263872 - DNA, 22 bp, Homo sapiens
acaggacaggctgggctagact

SEQ ID NO: 7263873 - DNA, 22 bp, Homo sapiens
acaggacatggcttctgtgacg

SEQ ID NO: 7263874 - DNA, 22 bp, Homo sapiens
acaggacatgtaccaggtggtc

SEQ ID NO: 7263875 - DNA, 22 bp, Homo sapiens
acaggacatgtaccaggtggtc

SEQ ID NO: 7263876 - DNA, 22 bp, Homo sapiens
ccattttctgcagctgccgcgg

SEQ ID NO: 7263877 - DNA, 22 bp, Homo sapiens
ccagggcagaaaaagagggaat

SEQ ID NO: 7263878 - DNA, 22 bp, Homo sapiens
aggcctgggacgggagccgtga

SEQ ID NO: 7263879 - DNA, 22 bp, Homo sapiens
cctacagttatattcttgattg

SEQ ID NO: 7263880 - DNA, 22 bp, Homo sapiens
aggggcgtgctcttccccgacg

SEQ ID NO: 7263881 - DNA, 22 bp, Homo sapiens
aggcttggctctcctatgagaa

SEQ ID NO: 7263882 - DNA, 22 bp, Homo sapiens
catcttaatttctaacaggcac

SEQ ID NO: 7263883 - DNA, 22 bp, Homo sapiens
cagtatttgttccctatcaatg

SEQ ID NO: 7263884 - DNA, 22 bp, Homo sapiens
cataacatctgtgaagcaggaa

SEQ ID NO: 7263885 - DNA, 22 bp, Homo sapiens
catttcaatacagtttgtaaat

SEQ ID NO: 7263886 - DNA, 22 bp, Homo sapiens
catttcaaacagttacagctgc

SEQ ID NO: 7263887 - DNA, 22 bp, Homo sapiens
catttattggttaggccagcag

SEQ ID NO: 7263888 - DNA, 22 bp, Homo sapiens
cattcggaggtagttgaggtta

SEQ ID NO: 7263889 - DNA, 22 bp, Homo sapiens
cagtatttggaatatagctaag

SEQ ID NO: 7263890 - DNA, 22 bp, Homo sapiens
cagtatttcctcttcttaactt

SEQ ID NO: 7263891 - DNA, 22 bp, Homo sapiens
cagtatttgttacagcattagc

SEQ ID NO: 7263892 - DNA, 22 bp, Homo sapiens
ctctgcattttaacagatgatt

SEQ ID NO: 7263893 - DNA, 22 bp, Homo sapiens
ctctcagacacccatttggaaa

SEQ ID NO: 7263894 - DNA, 22 bp, Homo sapiens
ctctcagatggagtgtgaatgg

SEQ ID NO: 7263895 - DNA, 22 bp, Homo sapiens
agtcctggccccaaggaaggat

SEQ ID NO: 7263896 - DNA, 22 bp, Homo sapiens
agtcctcccttggggccacctt

SEQ ID NO: 7263897 - DNA, 22 bp, Homo sapiens
ctaagaggaagtactctgttat

SEQ ID NO: 7263898 - DNA, 20 bp, Homo sapiens
ctaagaggtccttccacatc

SEQ ID NO: 7263899 - DNA, 22 bp, Homo sapiens
agtatgttgacttattcttgga

SEQ ID NO: 7263900 - DNA, 22 bp, Homo sapiens
agtatttcctggcttatctgct

SEQ ID NO: 7263901 - DNA, 22 bp, Homo sapiens
agtatttagagacacaagatgg

SEQ ID NO: 7263902 - DNA, 22 bp, Homo sapiens
cctgtgcatccggtggtcattg

SEQ ID NO: 7263903 - DNA, 18 bp, Homo sapiens
cctgtgacagaggcatca

SEQ ID NO: 7263904 - DNA, 22 bp, Homo sapiens
atagcaatgatcaagacagaca

SEQ ID NO: 7263905 - DNA, 22 bp, Homo sapiens
atagcaatcagtgtatttgaaa

SEQ ID NO: 7263906 - DNA, 22 bp, Homo sapiens
atagatttgaatttaagacttg

SEQ ID NO: 7263907 - DNA, 22 bp, Homo sapiens
atacctgtgtatccacaagcgt

SEQ ID NO: 7263908 - DNA, 22 bp, Homo sapiens
ataacagctcttaaacaccata

SEQ ID NO: 7263909 - DNA, 22 bp, Homo sapiens
ataaatgtgaattagagctttg

SEQ ID NO: 7263910 - DNA, 22 bp, Homo sapiens
ctgcctctcaggtccctgagat

SEQ ID NO: 7263911 - DNA, 22 bp, Homo sapiens
ctgcctctattcactgaggcag

SEQ ID NO: 7263912 - DNA, 22 bp, Homo sapiens
ctgcagagagtaactgaaatat

SEQ ID NO: 7263913 - DNA, 22 bp, Homo sapiens
ctgcagagcaagtaacatcctc

SEQ ID NO: 7263914 - DNA, 22 bp, Homo sapiens
agttatttactcctttgtctct

SEQ ID NO: 7263915 - DNA, 22 bp, Homo sapiens
agttattactctttaacatatt

SEQ ID NO: 7263916 - DNA, 22 bp, Homo sapiens
agttatttaaaatgattgtcct

SEQ ID NO: 7263917 - DNA, 22 bp, Homo sapiens
agttatttactcctttgtctct

SEQ ID NO: 7263918 - DNA, 22 bp, Homo sapiens
cttcccacagaattcaatcagt

SEQ ID NO: 7263919 - DNA, 22 bp, Homo sapiens
cttcccactagtatcacagagc

SEQ ID NO: 7263920 - DNA, 22 bp, Homo sapiens
cttcattaaccaaaatgcaata

SEQ ID NO: 7263921 - DNA, 22 bp, Homo sapiens
cttcattaatgtctataagttt

SEQ ID NO: 7263922 - DNA, 22 bp, Homo sapiens
cttagatgaagtcacagaaccc

SEQ ID NO: 7263923 - DNA, 22 bp, Homo sapiens
cttagagatgggttttacttag

SEQ ID NO: 7263924 - DNA, 22 bp, Homo sapiens
cttcctcctccatctcgaaggc

SEQ ID NO: 7263925 - DNA, 21 bp, Homo sapiens
atcagaaaatgtaatggagca

SEQ ID NO: 7263926 - DNA, 21 bp, Homo sapiens
atcagaaaatgtaatggagca

SEQ ID NO: 7263927 - DNA, 22 bp, Homo sapiens
atcagaaaaacataatgttatt

SEQ ID NO: 7263928 - DNA, 23 bp, Homo sapiens
atcaaaggatgtagagaagaagc

SEQ ID NO: 7263929 - DNA, 22 bp, Homo sapiens
atatttaactggtcccaatata

SEQ ID NO: 7263930 - DNA, 22 bp, Homo sapiens
atatttaaacagggtaccaata

SEQ ID NO: 7263931 - DNA, 22 bp, Homo sapiens
atggttatgcaaacatgatgca

SEQ ID NO: 7263932 - DNA, 22 bp, Homo sapiens
gaggagacagtggagccgctac

SEQ ID NO: 7263933 - DNA, 22 bp, Homo sapiens
ctttctttcgaagacgtgatta

SEQ ID NO: 7263934 - DNA, 22 bp, Homo sapiens
gaaatagacactttctatgaat

SEQ ID NO: 7263935 - DNA, 22 bp, Homo sapiens
gaaatagaagctgccaatttct

SEQ ID NO: 7263936 - DNA, 22 bp, Homo sapiens
gaaatagaggacagctggatca

SEQ ID NO: 7263937 - DNA, 22 bp, Homo sapiens
gaaatagatctctgggatgcaa

SEQ ID NO: 7263938 - DNA, 22 bp, Homo sapiens
gaaatagtacagcatagttctt

SEQ ID NO: 7263939 - DNA, 22 bp, Homo sapiens
atgatattttagtaaagtgata

SEQ ID NO: 7263940 - DNA, 22 bp, Homo sapiens
atgaacatcggaaatgagactg

SEQ ID NO: 7263941 - DNA, 22 bp, Homo sapiens
atgaacatcctaggaggcattt

SEQ ID NO: 7263942 - DNA, 22 bp, Homo sapiens
atgaacattaaaatggtagaat

SEQ ID NO: 7263943 - DNA, 22 bp, Homo sapiens
atgaacatgtgactcagacctg

SEQ ID NO: 7263944 - DNA, 22 bp, Homo sapiens
atgaacatctctgatccaagca

SEQ ID NO: 7263945 - DNA, 22 bp, Homo sapiens
atgaacatttggtttggcagca

SEQ ID NO: 7263946 - DNA, 23 bp, Homo sapiens
atgaacattagtttcagatattg

SEQ ID NO: 7263947 - DNA, 22 bp, Homo sapiens
cttctttaccaagagatagagt

SEQ ID NO: 7263948 - DNA, 22 bp, Homo sapiens
cttctttaatgtatacaaaaga

SEQ ID NO: 7263949 - DNA, 22 bp, Homo sapiens
atgcacaggaccacacataatg

SEQ ID NO: 7263950 - DNA, 22 bp, Homo sapiens
atgcacaggtgctgatgcacgc

SEQ ID NO: 7263951 - DNA, 22 bp, Homo sapiens
atgcacagatccccaggaccct

SEQ ID NO: 7263952 - DNA, 22 bp, Homo sapiens
atgcacagctgaacactctaaa

SEQ ID NO: 7263953 - DNA, 22 bp, Homo sapiens
atgctatttaccacacatcatt

SEQ ID NO: 7263954 - DNA, 22 bp, Homo sapiens
gacaattgcttttgccgaataa

SEQ ID NO: 7263955 - DNA, 22 bp, Homo sapiens
gacatttatgaaggagatatgc

SEQ ID NO: 7263956 - DNA, 22 bp, Homo sapiens
gacatttattagaaaactatca

SEQ ID NO: 7263957 - DNA, 22 bp, Homo sapiens
gacatttattggattttacgag

SEQ ID NO: 7263958 - DNA, 22 bp, Homo sapiens
attttagagctccaagtacagc

SEQ ID NO: 7263959 - DNA, 22 bp, Homo sapiens
atttttcagcttcattgaggca

SEQ ID NO: 7263960 - DNA, 22 bp, Homo sapiens
caaaataccacgacttgtttta

SEQ ID NO: 7263961 - DNA, 22 bp, Homo sapiens
caaaattagaaatgcagctgtt

SEQ ID NO: 7263962 - DNA, 22 bp, Homo sapiens
caaaattagggagtgagctgga

SEQ ID NO: 7263963 - DNA, 22 bp, Homo sapiens
caaagcgcagaggagcctccgg

SEQ ID NO: 7263964 - DNA, 22 bp, Homo sapiens
caaatagaaggtactcagagaa

SEQ ID NO: 7263965 - DNA, 22 bp, Homo sapiens
caaatagacaagatggcaggaa

SEQ ID NO: 7263966 - DNA, 22 bp, Homo sapiens
caaatagaactcacagacaaga

SEQ ID NO: 7263967 - DNA, 22 bp, Homo sapiens
gcccccaggctctggagaacct

SEQ ID NO: 7263968 - DNA, 22 bp, Homo sapiens
gcccccagctctcaagctcaaa

SEQ ID NO: 7263969 - DNA, 22 bp, Homo sapiens
gcccccaggcactacatgtgaa

SEQ ID NO: 7263970 - DNA, 22 bp, Homo sapiens
gcccccagaagggccacagatt

SEQ ID NO: 7263971 - DNA, 22 bp, Homo sapiens
atttgctagcaagtattctgaa

SEQ ID NO: 7263972 - DNA, 17 bp, Homo sapiens
gcccccagaaatctcag

SEQ ID NO: 7263973 - DNA, 19 bp, Homo sapiens
attcttcagcagtgagacc

SEQ ID NO: 7263974 - DNA, 22 bp, Homo sapiens
attctttaattcaattgaagga

SEQ ID NO: 7263975 - DNA, 22 bp, Homo sapiens
attctttagccagcaggtatat

SEQ ID NO: 7263976 - DNA, 22 bp, Homo sapiens
attctttattgctgatggttat

SEQ ID NO: 7263977 - DNA, 22 bp, Homo sapiens
gcatagtaggctgtcaaaaatg

SEQ ID NO: 7263978 - DNA, 22 bp, Homo sapiens
caagttttgattttgcagtaaa

SEQ ID NO: 7263979 - DNA, 22 bp, Homo sapiens
caagttttagcaagtggaaagg

SEQ ID NO: 7263980 - DNA, 22 bp, Homo sapiens
caagcatgtcttcttaagcaat

SEQ ID NO: 7263981 - DNA, 22 bp, Homo sapiens
caagccagctcctgccacagag

SEQ ID NO: 7263982 - DNA, 22 bp, Homo sapiens
cacagatacctagtgaaacata

SEQ ID NO: 7263983 - DNA, 19 bp, Homo sapiens
cacagatgattgacacata

SEQ ID NO: 7263984 - DNA, 22 bp, Homo sapiens
cacagatgaagtaaacaactct

SEQ ID NO: 7263985 - DNA, 22 bp, Homo sapiens
cacagaagtgtgtataactctt

SEQ ID NO: 7263986 - DNA, 22 bp, Homo sapiens
cacagaagtttcatagtctcga

SEQ ID NO: 7263987 - DNA, 22 bp, Homo sapiens
ggcctgtgggaggacagctggg

SEQ ID NO: 7263988 - DNA, 23 bp, Homo sapiens
cagaaagccctttccccacagta

SEQ ID NO: 7263989 - DNA, 22 bp, Homo sapiens
cagaaagccaactccaactgtc

SEQ ID NO: 7263990 - DNA, 22 bp, Homo sapiens
cagaaagcaaaatggatctctg

SEQ ID NO: 7263991 - DNA, 22 bp, Homo sapiens
cagaaagctctttcaatcttgc

SEQ ID NO: 7263992 - DNA, 22 bp, Homo sapiens
cagaaagctctttcaatcttgc

SEQ ID NO: 7263993 - DNA, 23 bp, Homo sapiens
cagaaataaactggtttgtagat

SEQ ID NO: 7263994 - DNA, 22 bp, Homo sapiens
cacatttacatataaaactttc

SEQ ID NO: 7263995 - DNA, 18 bp, Homo sapiens
cacatttacctggctccc

SEQ ID NO: 7263996 - DNA, 22 bp, Homo sapiens
cacatttaggaggtggggaagc

SEQ ID NO: 7263997 - DNA, 22 bp, Homo sapiens
cacatttagaggttagcatggt

SEQ ID NO: 7263998 - DNA, 22 bp, Homo sapiens
cacatttacttttatcccttgg

SEQ ID NO: 7263999 - DNA, 22 bp, Homo sapiens
cacatttatgggctgggaggca

SEQ ID NO: 7264000 - DNA, 22 bp, Homo sapiens
cacatttatttgaggctaattg

SEQ ID NO: 7264001 - DNA, 22 bp, Homo sapiens
cacatttatctgttctttctag

SEQ ID NO: 7264002 - DNA, 22 bp, Homo sapiens
cacatttatctctctccggtga

SEQ ID NO: 7264003 - DNA, 22 bp, Homo sapiens
cacatttaggttcctatagcca

SEQ ID NO: 7264004 - DNA, 22 bp, Homo sapiens
gtcccaggctccatggcagcca

SEQ ID NO: 7264005 - DNA, 22 bp, Homo sapiens
gtcccaggcttatgtggagctt

SEQ ID NO: 7264006 - DNA, 22 bp, Homo sapiens
gtcataatataaaaactgactt

SEQ ID NO: 7264007 - DNA, 22 bp, Homo sapiens
gtcataaagcttgttgcattta

SEQ ID NO: 7264008 - DNA, 22 bp, Homo sapiens
cagcctgtagaatacagtaaat

SEQ ID NO: 7264009 - DNA, 22 bp, Homo sapiens
cagccttcaaggcttagctcag

SEQ ID NO: 7264010 - DNA, 22 bp, Homo sapiens
cagctattaatgtttttgctga

SEQ ID NO: 7264011 - DNA, 22 bp, Homo sapiens
cagctattctctgaaatgaata

SEQ ID NO: 7264012 - DNA, 20 bp, Homo sapiens
cagcctccactcactcagct

SEQ ID NO: 7264013 - DNA, 22 bp, Homo sapiens
cagactgtagagtttgagaagt

SEQ ID NO: 7264014 - DNA, 22 bp, Homo sapiens
cagaccccgagtttgcagagtt

SEQ ID NO: 7264015 - DNA, 22 bp, Homo sapiens
cagaggatatactatctggaaa

SEQ ID NO: 7264016 - DNA, 22 bp, Homo sapiens
cagcacatagtaggtattcact

SEQ ID NO: 7264017 - DNA, 20 bp, Homo sapiens
tagatttcatacttctcttt

SEQ ID NO: 7264018 - DNA, 22 bp, Homo sapiens
tagcttctcataatttatgctg

SEQ ID NO: 7264019 - DNA, 22 bp, Homo sapiens
tcaatagataaagctacataaa

SEQ ID NO: 7264020 - DNA, 22 bp, Homo sapiens
tattttatctgccagagtggag

SEQ ID NO: 7264021 - DNA, 22 bp, Homo sapiens
tattttaggtaatatccattgt

SEQ ID NO: 7264022 - DNA, 22 bp, Homo sapiens
tatttgaagattcttctgatgt

SEQ ID NO: 7264023 - DNA, 21 bp, Homo sapiens
cagtattttaagcagtgagtt

SEQ ID NO: 7264024 - DNA, 22 bp, Homo sapiens
cagtatttttaagctgctttgt

SEQ ID NO: 7264025 - DNA, 22 bp, Homo sapiens
tattatgcataggcaataatgg

SEQ ID NO: 7264026 - DNA, 22 bp, Homo sapiens
tattatcattaactgttgaatt

SEQ ID NO: 7264027 - DNA, 22 bp, Homo sapiens
taagtattggcctatagctaga

SEQ ID NO: 7264028 - DNA, 22 bp, Homo sapiens
cagctattttctcattaaggat

SEQ ID NO: 7264029 - DNA, 22 bp, Homo sapiens
cagctattggtccacaggtatg

SEQ ID NO: 7264030 - DNA, 22 bp, Homo sapiens
cagctattggcaagaagtggtg

SEQ ID NO: 7264031 - DNA, 22 bp, Homo sapiens
cagctattgataaatgttgggg

SEQ ID NO: 7264032 - DNA, 19 bp, Homo sapiens
caggccagtgtcagggggc

SEQ ID NO: 7264033 - DNA, 22 bp, Homo sapiens
caggccagttttgatttaagcc

SEQ ID NO: 7264034 - DNA, 22 bp, Homo sapiens
caggccagtgtgcttcccaggc

SEQ ID NO: 7264035 - DNA, 22 bp, Homo sapiens
caggccagtgggaaatagggat

SEQ ID NO: 7264036 - DNA, 22 bp, Homo sapiens
caggccaggtggcaggcaaaac

SEQ ID NO: 7264037 - DNA, 22 bp, Homo sapiens
caggccaggtgctctagaatca

SEQ ID NO: 7264038 - DNA, 22 bp, Homo sapiens
caggccagggttgagaagagaa

SEQ ID NO: 7264039 - DNA, 22 bp, Homo sapiens
caggccagagcgcgtggttggg

SEQ ID NO: 7264040 - DNA, 22 bp, Homo sapiens
caggccagggagaatatgaagc

SEQ ID NO: 7264041 - DNA, 20 bp, Homo sapiens
tacattgtagaaatattcaa

SEQ ID NO: 7264042 - DNA, 22 bp, Homo sapiens
caggcctgatacactgaactct

SEQ ID NO: 7264043 - DNA, 22 bp, Homo sapiens
caggcctgcttcttacccttca

SEQ ID NO: 7264044 - DNA, 22 bp, Homo sapiens
caggcctgaccctgagcttcac

SEQ ID NO: 7264045 - DNA, 22 bp, Homo sapiens
tacatttataaggcttctctgt

SEQ ID NO: 7264046 - DNA, 22 bp, Homo sapiens
tacatttacagagccttctctg

SEQ ID NO: 7264047 - DNA, 22 bp, Homo sapiens
tactttaaaaactgataattca

SEQ ID NO: 7264048 - DNA, 22 bp, Homo sapiens
tagaaaagctctaaggcctctc

SEQ ID NO: 7264049 - DNA, 22 bp, Homo sapiens
catgggaggtctgcaaggtgct

SEQ ID NO: 7264050 - DNA, 17 bp, Homo sapiens
tccaggagaggcaatgg

SEQ ID NO: 7264051 - DNA, 22 bp, Homo sapiens
cattctcaatagtagatgagta

SEQ ID NO: 7264052 - DNA, 22 bp, Homo sapiens
catttattgagtggccacagtg

SEQ ID NO: 7264053 - DNA, 22 bp, Homo sapiens
catttattctcagatccttgtc

SEQ ID NO: 7264054 - DNA, 22 bp, Homo sapiens
catttattcatgatctgtagct

SEQ ID NO: 7264055 - DNA, 22 bp, Homo sapiens
catttattcatttgctagggct

SEQ ID NO: 7264056 - DNA, 22 bp, Homo sapiens
catttattcagctcagtcggtt

SEQ ID NO: 7264057 - DNA, 22 bp, Homo sapiens
tctaaggagcgctccagaaaaa

SEQ ID NO: 7264058 - DNA, 22 bp, Homo sapiens
tcctgggcttaagtgatcctcc

SEQ ID NO: 7264059 - DNA, 18 bp, Homo sapiens
cataattttctttcttta

SEQ ID NO: 7264060 - DNA, 20 bp, Homo sapiens
cagttgaaataatttgtttg

SEQ ID NO: 7264061 - DNA, 22 bp, Homo sapiens
cagttgaaaagattttattctg

SEQ ID NO: 7264062 - DNA, 22 bp, Homo sapiens
cagttgcctactacatggcagg

SEQ ID NO: 7264063 - DNA, 22 bp, Homo sapiens
cataaaaggtagcagtttgaaa

SEQ ID NO: 7264064 - DNA, 22 bp, Homo sapiens
cataaaagccacctatttaaag

SEQ ID NO: 7264065 - DNA, 22 bp, Homo sapiens
catcttaaaatgtgtcataact

SEQ ID NO: 7264066 - DNA, 22 bp, Homo sapiens
catcttaaattaaagcttaagg

SEQ ID NO: 7264067 - DNA, 22 bp, Homo sapiens
tgcacagagagatgagacacgt

SEQ ID NO: 7264068 - DNA, 22 bp, Homo sapiens
tgcacagacatacacatatatg

SEQ ID NO: 7264069 - DNA, 22 bp, Homo sapiens
tgcacagagcaggcaccagcgg

SEQ ID NO: 7264070 - DNA, 22 bp, Homo sapiens
tgcctgtgttgattactttgtc

SEQ ID NO: 7264071 - DNA, 22 bp, Homo sapiens
tgcctgtgtgaccacgggcaag

SEQ ID NO: 7264072 - DNA, 22 bp, Homo sapiens
tgcctgtgtggggtctgccgcc

SEQ ID NO: 7264073 - DNA, 22 bp, Homo sapiens
tgcctgtgtggtctgcgcatta

SEQ ID NO: 7264074 - DNA, 22 bp, Homo sapiens
cctgagctccagtagcagccag

SEQ ID NO: 7264075 - DNA, 17 bp, Homo sapiens
cctcttcctctcagctg

SEQ ID NO: 7264076 - DNA, 22 bp, Homo sapiens
tgggagttaacattggtctctg

SEQ ID NO: 7264077 - DNA, 22 bp, Homo sapiens
tgggagttgggtgggagacttc

SEQ ID NO: 7264078 - DNA, 22 bp, Homo sapiens
tgggagttgggcagaacaagtg

SEQ ID NO: 7264079 - DNA, 23 bp, Homo sapiens
tgggagttgagtgaggttgcttt

SEQ ID NO: 7264080 - DNA, 22 bp, Homo sapiens
tgggagttcacgtgatattcac

SEQ ID NO: 7264081 - DNA, 22 bp, Homo sapiens
tgggagttgagacattttgccc

SEQ ID NO: 7264082 - DNA, 22 bp, Homo sapiens
tgggagttagttatactgtgac

SEQ ID NO: 7264083 - DNA, 22 bp, Homo sapiens
tgggagtttgttagaaatgcag

SEQ ID NO: 7264084 - DNA, 22 bp, Homo sapiens
cctcagttttctcatctgtaaa

SEQ ID NO: 7264085 - DNA, 22 bp, Homo sapiens
cctcagaatagtcctcagatca

SEQ ID NO: 7264086 - DNA, 22 bp, Homo sapiens
cctcagaaggacaagagacaaa

SEQ ID NO: 7264087 - DNA, 22 bp, Homo sapiens
ccaggccagagtgcagtggcac

SEQ ID NO: 7264088 - DNA, 22 bp, Homo sapiens
ccaggccagcaggcacacctgc

SEQ ID NO: 7264089 - DNA, 22 bp, Homo sapiens
ccaggccagcgctggctggagg

SEQ ID NO: 7264090 - DNA, 22 bp, Homo sapiens
ccaggccagcctggagcatggc

SEQ ID NO: 7264091 - DNA, 22 bp, Homo sapiens
ccaggcctggaccatgccaggg

SEQ ID NO: 7264092 - DNA, 22 bp, Homo sapiens
tctttcttattagccattgttc

SEQ ID NO: 7264093 - DNA, 22 bp, Homo sapiens
ccaggccattcccagagttgct

SEQ ID NO: 7264094 - DNA, 18 bp, Homo sapiens
ccaggccatgaacctctg

SEQ ID NO: 7264095 - DNA, 19 bp, Homo sapiens
ccaggccatcccagttccc

SEQ ID NO: 7264096 - DNA, 22 bp, Homo sapiens
ccaggccagtgtttggtccagg

SEQ ID NO: 7264097 - DNA, 21 bp, Homo sapiens
ccaggccaggcctacggggat

SEQ ID NO: 7264098 - DNA, 22 bp, Homo sapiens
ccaggccaggagagcgaggttt

SEQ ID NO: 7264099 - DNA, 22 bp, Homo sapiens
ccaggccagggctgcagcgagc

SEQ ID NO: 7264100 - DNA, 22 bp, Homo sapiens
tctttgaaagctgttctagagt

SEQ ID NO: 7264101 - DNA, 22 bp, Homo sapiens
tctcagaatcaggacctacttc

SEQ ID NO: 7264102 - DNA, 22 bp, Homo sapiens
tctcagaatccttgcccaggtg

SEQ ID NO: 7264103 - DNA, 19 bp, Homo sapiens
tctcagaattaagagtgct

SEQ ID NO: 7264104 - DNA, 19 bp, Homo sapiens
tctcagaattggcaatcat

SEQ ID NO: 7264105 - DNA, 22 bp, Homo sapiens
tctcagaattgtgtccactggg

SEQ ID NO: 7264106 - DNA, 22 bp, Homo sapiens
tctcagaagggtggtgctggag

SEQ ID NO: 7264107 - DNA, 22 bp, Homo sapiens
tctcagaagtgatcaggatgtt

SEQ ID NO: 7264108 - DNA, 22 bp, Homo sapiens
tctcagaataaattcctaactt

SEQ ID NO: 7264109 - DNA, 22 bp, Homo sapiens
ccaggaccacacgacaggagag

SEQ ID NO: 7264110 - DNA, 22 bp, Homo sapiens
ccaggacagggagacgggagcc

SEQ ID NO: 7264111 - DNA, 22 bp, Homo sapiens
tctgggagatccaagcagaact

SEQ ID NO: 7264112 - DNA, 22 bp, Homo sapiens
tctgggagcacacgcagtgatc

SEQ ID NO: 7264113 - DNA, 22 bp, Homo sapiens
tctgggagctggctttgcctca

SEQ ID NO: 7264114 - DNA, 22 bp, Homo sapiens
tctgggagcagctcagcagatt

SEQ ID NO: 7264115 - DNA, 22 bp, Homo sapiens
tctgggagcctgaaagtgaatg

SEQ ID NO: 7264116 - DNA, 22 bp, Homo sapiens
ccaggggaaacagggagcactc

SEQ ID NO: 7264117 - DNA, 22 bp, Homo sapiens
tgacaatagcgatttatcttgc

SEQ ID NO: 7264118 - DNA, 22 bp, Homo sapiens
tgagacatgtgaatatttgtac

SEQ ID NO: 7264119 - DNA, 19 bp, Homo sapiens
tgagaaggcagtggggagc

SEQ ID NO: 7264120 - DNA, 19 bp, Homo sapiens
tgagaaggtttccgtgggt

SEQ ID NO: 7264121 - DNA, 22 bp, Homo sapiens
tgatttcttccttgtcattaga

SEQ ID NO: 7264122 - DNA, 22 bp, Homo sapiens
tgattttacttagcatgatgtt

SEQ ID NO: 7264123 - DNA, 23 bp, Homo sapiens
tgattttaaaaagtaagttatca

SEQ ID NO: 7264124 - DNA, 22 bp, Homo sapiens
ttaaagctgagccctcagaagc

SEQ ID NO: 7264125 - DNA, 22 bp, Homo sapiens
ttagaagttcaggtctgtaatc

SEQ ID NO: 7264126 - DNA, 22 bp, Homo sapiens
ttagaagtcatctagtctaaaa

SEQ ID NO: 7264127 - DNA, 22 bp, Homo sapiens
cctgggagtggcactcacagca

SEQ ID NO: 7264128 - DNA, 19 bp, Homo sapiens
cctgggagtcagctgaagg

SEQ ID NO: 7264129 - DNA, 22 bp, Homo sapiens
cctgggagtgtcagacttgctt

SEQ ID NO: 7264130 - DNA, 22 bp, Homo sapiens
cctgggaggtggatgttgcggt

SEQ ID NO: 7264131 - DNA, 22 bp, Homo sapiens
cgccgcctgctgcagcagctgt

SEQ ID NO: 7264132 - DNA, 19 bp, Homo sapiens
ttcacaattatgaaattag

SEQ ID NO: 7264133 - DNA, 22 bp, Homo sapiens
ctacttctgtgatgaaactaca

SEQ ID NO: 7264134 - DNA, 17 bp, Homo sapiens
ctacttcttctattctt

SEQ ID NO: 7264135 - DNA, 22 bp, Homo sapiens
ctacttcttgatctgtcgacct

SEQ ID NO: 7264136 - DNA, 22 bp, Homo sapiens
ctacttctaagtacatggtgat

SEQ ID NO: 7264137 - DNA, 22 bp, Homo sapiens
ctacagcagagctacactaact

SEQ ID NO: 7264138 - DNA, 22 bp, Homo sapiens
ctacagcagagaccagccacat

SEQ ID NO: 7264139 - DNA, 22 bp, Homo sapiens
ctaaatcatcatttatgtttgt

SEQ ID NO: 7264140 - DNA, 22 bp, Homo sapiens
ctatggtctggaccgaggtcct

SEQ ID NO: 7264141 - DNA, 22 bp, Homo sapiens
ctatgtttatctgtatttctgt

SEQ ID NO: 7264142 - DNA, 22 bp, Homo sapiens
ctattaaatactcttcaaattg

SEQ ID NO: 7264143 - DNA, 22 bp, Homo sapiens
ctagatttctagttcattatcc

SEQ ID NO: 7264144 - DNA, 22 bp, Homo sapiens
ttgtacaacgttttaaatttga

SEQ ID NO: 7264145 - DNA, 22 bp, Homo sapiens
ttgaaatactgcattgttcagt

SEQ ID NO: 7264146 - DNA, 22 bp, Homo sapiens
ctcccaggactcagaggagaag

SEQ ID NO: 7264147 - DNA, 22 bp, Homo sapiens
ctccattgaacatcctctcaga

SEQ ID NO: 7264148 - DNA, 22 bp, Homo sapiens
tttaagttccttttcaacaact

SEQ ID NO: 7264149 - DNA, 22 bp, Homo sapiens
tttaacagatgctatgtctacc

SEQ ID NO: 7264150 - DNA, 22 bp, Homo sapiens
ctcccaggcagggctgcccact

SEQ ID NO: 7264151 - DNA, 22 bp, Homo sapiens
ctcccaggcacagggaggagcc

SEQ ID NO: 7264152 - DNA, 22 bp, Homo sapiens
tttcacatagaaagtgatttac

SEQ ID NO: 7264153 - DNA, 22 bp, Homo sapiens
tttcacataaatattatgccta

SEQ ID NO: 7264154 - DNA, 22 bp, Homo sapiens
tttaggttcttggaatcagtct

SEQ ID NO: 7264155 - DNA, 22 bp, Homo sapiens
tttagtatataaaaagagaagt

SEQ ID NO: 7264156 - DNA, 22 bp, Homo sapiens
tttaatcataagaaggaaaata

SEQ ID NO: 7264157 - DNA, 22 bp, Homo sapiens
tttaatcaggcaaagcataata

SEQ ID NO: 7264158 - DNA, 22 bp, Homo sapiens
ctgaccaacatggtgaaacctt

SEQ ID NO: 7264159 - DNA, 22 bp, Homo sapiens
ttttagctgttgattgttcccc

SEQ ID NO: 7264160 - DNA, 22 bp, Homo sapiens
ttttaagaggaggctgtttgaa

SEQ ID NO: 7264161 - DNA, 22 bp, Homo sapiens
ttttaagatgctagtatttcag

SEQ ID NO: 7264162 - DNA, 22 bp, Homo sapiens
ttttaagaactgttctgtgctt

SEQ ID NO: 7264163 - DNA, 22 bp, Homo sapiens
tttgtacagtgaaagcgaggtt

SEQ ID NO: 7264164 - DNA, 19 bp, Homo sapiens
ctgggccagagctgtcctc

SEQ ID NO: 7264165 - DNA, 22 bp, Homo sapiens
cttgtagaattgaaatggtctc

SEQ ID NO: 7264166 - DNA, 22 bp, Homo sapiens
cttgatttattacccactatat

SEQ ID NO: 7264167 - DNA, 22 bp, Homo sapiens
cttgatttcagccttgtgatat

SEQ ID NO: 7264168 - DNA, 22 bp, Homo sapiens
cttcctctgtgtcctgggcttc

SEQ ID NO: 7264169 - DNA, 22 bp, Homo sapiens
cttcctctgtgtcctgggcttg

SEQ ID NO: 7264170 - DNA, 22 bp, Homo sapiens
gagctactgaaatattgatttt

SEQ ID NO: 7264171 - DNA, 22 bp, Homo sapiens
gagcctcctcctggtgtgccga

SEQ ID NO: 7264172 - DNA, 20 bp, Homo sapiens
gagcttcaactcagcaaaca

SEQ ID NO: 7264173 - DNA, 22 bp, Homo sapiens
gagcttcacgggggacagcatt

SEQ ID NO: 7264174 - DNA, 22 bp, Homo sapiens
gagcttctgccatagagggact

SEQ ID NO: 7264175 - DNA, 22 bp, Homo sapiens
gaggcaatgggctatagcattg

SEQ ID NO: 7264176 - DNA, 22 bp, Homo sapiens
gagccagattttatgcaagaca

SEQ ID NO: 7264177 - DNA, 22 bp, Homo sapiens
gagatttaattggattaactta

SEQ ID NO: 7264178 - DNA, 22 bp, Homo sapiens
gagatgtgatcctttgctgtgt

SEQ ID NO: 7264179 - DNA, 23 bp, Homo sapiens
gagatgtgggtttgttcagtgtc

SEQ ID NO: 7264180 - DNA, 22 bp, Homo sapiens
gagaggcttaagggctgtgaag

SEQ ID NO: 7264181 - DNA, 22 bp, Homo sapiens
ctttcataaaggaaatgatgag

SEQ ID NO: 7264182 - DNA, 22 bp, Homo sapiens
gaacaggaacatattggctctc

SEQ ID NO: 7264183 - DNA, 21 bp, Homo sapiens
gaacaggaaaagctggcttca

SEQ ID NO: 7264184 - DNA, 22 bp, Homo sapiens
gaacatttggatttgtaaattt

SEQ ID NO: 7264185 - DNA, 22 bp, Homo sapiens
gaacatttggatttgtaaattt

SEQ ID NO: 7264186 - DNA, 22 bp, Homo sapiens
gaacatttggcatgagaatttg

SEQ ID NO: 7264187 - DNA, 21 bp, Homo sapiens
gaacatttgggttgtttctac

SEQ ID NO: 7264188 - DNA, 20 bp, Homo sapiens
gaacatttggccatactgag

SEQ ID NO: 7264189 - DNA, 22 bp, Homo sapiens
gaagaggactgtggcatcctag

SEQ ID NO: 7264190 - DNA, 22 bp, Homo sapiens
gaagttttagtcaaaatgtaga

SEQ ID NO: 7264191 - DNA, 22 bp, Homo sapiens
gaagttttctgaggctgtagct

SEQ ID NO: 7264192 - DNA, 22 bp, Homo sapiens
gacacagaatgggtgctcagta

SEQ ID NO: 7264193 - DNA, 22 bp, Homo sapiens
gacaggtgaaacagcaaggtaa

SEQ ID NO: 7264194 - DNA, 18 bp, Homo sapiens
gacaggtgggtgagacca

SEQ ID NO: 7264195 - DNA, 22 bp, Homo sapiens
gacaggtgtgatgatttaggct

SEQ ID NO: 7264196 - DNA, 22 bp, Homo sapiens
gacaggtgctaagggacctggc

SEQ ID NO: 7264197 - DNA, 22 bp, Homo sapiens
gacaggtggggaaactaaggta

SEQ ID NO: 7264198 - DNA, 22 bp, Homo sapiens
gacaggtgggtacctttatgga

SEQ ID NO: 7264199 - DNA, 22 bp, Homo sapiens
gcagtggaagcctctttaagca

SEQ ID NO: 7264200 - DNA, 22 bp, Homo sapiens
gccctggagagggatatggcat

SEQ ID NO: 7264201 - DNA, 22 bp, Homo sapiens
gccctggatgtacaggcatgtt

SEQ ID NO: 7264202 - DNA, 22 bp, Homo sapiens
gccctggatgctcatggcatca

SEQ ID NO: 7264203 - DNA, 22 bp, Homo sapiens
gcaaagtaaaaatagattctga

SEQ ID NO: 7264204 - DNA, 22 bp, Homo sapiens
gcaaagcatcagtagaaatgtt

SEQ ID NO: 7264205 - DNA, 22 bp, Homo sapiens
gcacacatatatatgagcatgt

SEQ ID NO: 7264206 - DNA, 20 bp, Homo sapiens
gcacacatagaaatgcatat

SEQ ID NO: 7264207 - DNA, 22 bp, Homo sapiens
gcacacatgcatgtgtgcatcc

SEQ ID NO: 7264208 - DNA, 22 bp, Homo sapiens
gcagaggatcaggctctggaaa

SEQ ID NO: 7264209 - DNA, 22 bp, Homo sapiens
gcagcctcaaactccccagctc

SEQ ID NO: 7264210 - DNA, 20 bp, Homo sapiens
gcagcctcaacaggcacagc

SEQ ID NO: 7264211 - DNA, 22 bp, Homo sapiens
gcagcctctgatgatggccgta

SEQ ID NO: 7264212 - DNA, 22 bp, Homo sapiens
gcaggaatctaacccaaggaga

SEQ ID NO: 7264213 - DNA, 23 bp, Homo sapiens
gctcagatgccctaggaggtggc

SEQ ID NO: 7264214 - DNA, 22 bp, Homo sapiens
gcgtctcaaggcccccaggcca

SEQ ID NO: 7264215 - DNA, 22 bp, Homo sapiens
gctggagagataggcatggggt

SEQ ID NO: 7264216 - DNA, 19 bp, Homo sapiens
ggagactcagcccatgcct

SEQ ID NO: 7264217 - DNA, 22 bp, Homo sapiens
ggaagattcagcatatatgagt

SEQ ID NO: 7264218 - DNA, 22 bp, Homo sapiens
ggaagattttccattcctcttt

SEQ ID NO: 7264219 - DNA, 22 bp, Homo sapiens
ggaagatttcccgtagctgtgc

SEQ ID NO: 7264220 - DNA, 22 bp, Homo sapiens
ggaagattcagttatctcatga

SEQ ID NO: 7264221 - DNA, 22 bp, Homo sapiens
ggccttgggcgagtccctcagt

SEQ ID NO: 7264222 - DNA, 22 bp, Homo sapiens
ggccttgggcagacacgtcaca

SEQ ID NO: 7264223 - DNA, 22 bp, Homo sapiens
ggagtgctccgcgagagggatg

SEQ ID NO: 7264224 - DNA, 22 bp, Homo sapiens
ggcaaagagatgatctttgcaa

SEQ ID NO: 7264225 - DNA, 22 bp, Homo sapiens
ggctctggagatgtccgacctg

SEQ ID NO: 7264226 - DNA, 22 bp, Homo sapiens
gggagcttctggaaggcaggaa

SEQ ID NO: 7264227 - DNA, 22 bp, Homo sapiens
ggcttggcttgggctcagaggc

SEQ ID NO: 7264228 - DNA, 22 bp, Homo sapiens
gggacattgtcaatggtggtag

SEQ ID NO: 7264229 - DNA, 18 bp, Homo sapiens
gggagctgggaagctggt

SEQ ID NO: 7264230 - DNA, 22 bp, Homo sapiens
ggtttaattacctgcatctcaa

SEQ ID NO: 7264231 - DNA, 22 bp, Homo sapiens
ggtttaattggtccaggatggg

SEQ ID NO: 7264232 - DNA, 22 bp, Homo sapiens
ggtttaatgggtgaaggcatga

SEQ ID NO: 7264233 - DNA, 22 bp, Homo sapiens
ggtgttgcagttgaagactggt

SEQ ID NO: 7264234 - DNA, 22 bp, Homo sapiens
ggtgtccttgctccttcagctt

SEQ ID NO: 7264235 - DNA, 22 bp, Homo sapiens
ggtgtccttcgtccgctggcat

SEQ ID NO: 7264236 - DNA, 22 bp, Homo sapiens
ggggaagaggcgtgatggatcc

SEQ ID NO: 7264237 - DNA, 17 bp, Homo sapiens
gtcctgggaggagagag

SEQ ID NO: 7264238 - DNA, 22 bp, Homo sapiens
gtccccgacgtttggcttgatg

SEQ ID NO: 7264239 - DNA, 22 bp, Homo sapiens
gtcattttgctgcatatttaga

SEQ ID NO: 7264240 - DNA, 23 bp, Homo sapiens
gtatttcagcattctcagttaaa

SEQ ID NO: 7264241 - DNA, 22 bp, Homo sapiens
gtattcttaaggattgagcaaa

SEQ ID NO: 7264242 - DNA, 22 bp, Homo sapiens
gtattcttatactcagtgagct

SEQ ID NO: 7264243 - DNA, 22 bp, Homo sapiens
gtattcttggttatcaaaatac

SEQ ID NO: 7264244 - DNA, 22 bp, Homo sapiens
gtatttaattccattaagttag

SEQ ID NO: 7264245 - DNA, 22 bp, Homo sapiens
ggtttgacagcttggggctgtc

SEQ ID NO: 7264246 - DNA, 22 bp, Homo sapiens
gtacatttcagtttccttaaga

SEQ ID NO: 7264247 - DNA, 22 bp, Homo sapiens
gtacatttatttttgcagcata

SEQ ID NO: 7264248 - DNA, 22 bp, Homo sapiens
gtgaacattttcttgcaaattg

SEQ ID NO: 7264249 - DNA, 22 bp, Homo sapiens
gtgaacatcagattacatgaga

SEQ ID NO: 7264250 - DNA, 22 bp, Homo sapiens
gtgaacattgaggcagaaagga

SEQ ID NO: 7264251 - DNA, 22 bp, Homo sapiens
tccaggccacatggatggcgat

SEQ ID NO: 7264252 - DNA, 22 bp, Homo sapiens
tccaggccaatgtagcaggccc

SEQ ID NO: 7264253 - DNA, 22 bp, Homo sapiens
tcccaagcttagggctctcagt

SEQ ID NO: 7264254 - DNA, 22 bp, Homo sapiens
tcactctgacttggcctccaac

SEQ ID NO: 7264255 - DNA, 22 bp, Homo sapiens
tcactttgacagagaaatgaat

SEQ ID NO: 7264256 - DNA, 19 bp, Homo sapiens
tcacttctgttagcatgga

SEQ ID NO: 7264257 - DNA, 20 bp, Homo sapiens
tcagcacagctgacaaggtt

SEQ ID NO: 7264258 - DNA, 22 bp, Homo sapiens
tatttcttcgggattcaagcta

SEQ ID NO: 7264259 - DNA, 20 bp, Homo sapiens
tcaagttttgcttgacaaga

SEQ ID NO: 7264260 - DNA, 22 bp, Homo sapiens
tcaatttcttggtttgataata

SEQ ID NO: 7264261 - DNA, 22 bp, Homo sapiens
tcaatttcattctattagttaa

SEQ ID NO: 7264262 - DNA, 20 bp, Homo sapiens
tcacacatggtaagctatga

SEQ ID NO: 7264263 - DNA, 20 bp, Homo sapiens
tcacaatatgagctcataca

SEQ ID NO: 7264264 - DNA, 22 bp, Homo sapiens
tcaggccacttcacaggtgatt

SEQ ID NO: 7264265 - DNA, 22 bp, Homo sapiens
tcaggccacggctcactgagac

SEQ ID NO: 7264266 - DNA, 22 bp, Homo sapiens
tcaggccaaggtagacatgact

SEQ ID NO: 7264267 - DNA, 22 bp, Homo sapiens
tcaggccaaagaaacagcatga

SEQ ID NO: 7264268 - DNA, 22 bp, Homo sapiens
tcattatttgctttagttatgt

SEQ ID NO: 7264269 - DNA, 23 bp, Homo sapiens
tcattcaaggctggtatctttca

SEQ ID NO: 7264270 - DNA, 21 bp, Homo sapiens
tcatatttctcttgctattgt

SEQ ID NO: 7264271 - DNA, 22 bp, Homo sapiens
tcatatttaggcctttaattca

SEQ ID NO: 7264272 - DNA, 22 bp, Homo sapiens
tagaaaagataacattctgtgc

SEQ ID NO: 7264273 - DNA, 22 bp, Homo sapiens
tagaaaggaagctacttagggg

SEQ ID NO: 7264274 - DNA, 22 bp, Homo sapiens
tagaggtgagatattttatttt

SEQ ID NO: 7264275 - DNA, 22 bp, Homo sapiens
tatacaatggctgaatcatcca

SEQ ID NO: 7264276 - DNA, 20 bp, Homo sapiens
tataaattcagagctttggt

SEQ ID NO: 7264277 - DNA, 22 bp, Homo sapiens
tatctaaaggatttaatttagt

SEQ ID NO: 7264278 - DNA, 20 bp, Homo sapiens
tatctaaatgcttacattac

SEQ ID NO: 7264279 - DNA, 21 bp, Homo sapiens
tatctactggtgtctttcaga

SEQ ID NO: 7264280 - DNA, 22 bp, Homo sapiens
tatagtttcatgagctttttaa

SEQ ID NO: 7264281 - DNA, 22 bp, Homo sapiens
tatttattcattcagcaagcat

SEQ ID NO: 7264282 - DNA, 22 bp, Homo sapiens
tatttattctttgtactgcctt

SEQ ID NO: 7264283 - DNA, 22 bp, Homo sapiens
tatttattggacagtgttgctg

SEQ ID NO: 7264284 - DNA, 21 bp, Homo sapiens
tatttattaatttgtaaggct

SEQ ID NO: 7264285 - DNA, 22 bp, Homo sapiens
tattctgtgtgatatgtaaatg

SEQ ID NO: 7264286 - DNA, 22 bp, Homo sapiens
tattctcagtgctataagtaga

SEQ ID NO: 7264287 - DNA, 22 bp, Homo sapiens
tattacatccacttttattgca

SEQ ID NO: 7264288 - DNA, 22 bp, Homo sapiens
tatgtgaagagattaaaaaata

SEQ ID NO: 7264289 - DNA, 22 bp, Homo sapiens
gttgcagactcaagaaaataaa

SEQ ID NO: 7264290 - DNA, 22 bp, Homo sapiens
gttgcagatactgaagcacagg

SEQ ID NO: 7264291 - DNA, 22 bp, Homo sapiens
gttgcagacactccacagtcga

SEQ ID NO: 7264292 - DNA, 22 bp, Homo sapiens
gttgctcaatgggaataagaat

SEQ ID NO: 7264293 - DNA, 22 bp, Homo sapiens
gttgtaaatacagcagataatt

SEQ ID NO: 7264294 - DNA, 22 bp, Homo sapiens
gtgtgggaaggctaggatgctg

SEQ ID NO: 7264295 - DNA, 22 bp, Homo sapiens
gttaaggatcttgagatgagga

SEQ ID NO: 7264296 - DNA, 22 bp, Homo sapiens
gtgctcctggccacatgaagct

SEQ ID NO: 7264297 - DNA, 22 bp, Homo sapiens
taaaggtttattcaacaaaata

SEQ ID NO: 7264298 - DNA, 22 bp, Homo sapiens
taaattatggctggcagagcag

SEQ ID NO: 7264299 - DNA, 22 bp, Homo sapiens
taaaagttttagttgtacataa

SEQ ID NO: 7264300 - DNA, 22 bp, Homo sapiens
gtttttattgtgtaaatgtggg

SEQ ID NO: 7264301 - DNA, 22 bp, Homo sapiens
gtttttattgtgtaaatgtggg

SEQ ID NO: 7264302 - DNA, 22 bp, Homo sapiens
gtttttatctaatagcagttat

SEQ ID NO: 7264303 - DNA, 22 bp, Homo sapiens
gtttttatatcctgtggagtgt

SEQ ID NO: 7264304 - DNA, 22 bp, Homo sapiens
gttttcttcctgcaattggcat

SEQ ID NO: 7264305 - DNA, 22 bp, Homo sapiens
tacagcacattgtgatggcact

SEQ ID NO: 7264306 - DNA, 22 bp, Homo sapiens
tacagcacagcaaagaggacgg

SEQ ID NO: 7264307 - DNA, 22 bp, Homo sapiens
tacagcacaaagggcctttacc

SEQ ID NO: 7264308 - DNA, 22 bp, Homo sapiens
tacagaagctgagacactgaga

SEQ ID NO: 7264309 - DNA, 22 bp, Homo sapiens
tacagcacggtgcatttactac

SEQ ID NO: 7264310 - DNA, 21 bp, Homo sapiens
tacagcaccgagtaggccctc

SEQ ID NO: 7264311 - DNA, 22 bp, Homo sapiens
tacagcactctggggagcatga

SEQ ID NO: 7264312 - DNA, 22 bp, Homo sapiens
taaggtttctagtttctaaact

SEQ ID NO: 7264313 - DNA, 22 bp, Homo sapiens
taaggtttgtggggagcaaaag

SEQ ID NO: 7264314 - DNA, 22 bp, Homo sapiens
taagtgttgctctctctcagct

SEQ ID NO: 7264315 - DNA, 22 bp, Homo sapiens
taatactgaaaggagtatcagc

SEQ ID NO: 7264316 - DNA, 22 bp, Homo sapiens
taattatagccgctattttgct

SEQ ID NO: 7264317 - DNA, 22 bp, Homo sapiens
taattacaggtccaaaacaatc

SEQ ID NO: 7264318 - DNA, 22 bp, Homo sapiens
ttagaaaatttgcttctttgga

SEQ ID NO: 7264319 - DNA, 22 bp, Homo sapiens
ttagaggaaagtgactccgatg

SEQ ID NO: 7264320 - DNA, 22 bp, Homo sapiens
ttacttctttggccttcagcca

SEQ ID NO: 7264321 - DNA, 22 bp, Homo sapiens
ttacttcttgtctcatgcctat

SEQ ID NO: 7264322 - DNA, 22 bp, Homo sapiens
ttacttcttacaaaagaaatat

SEQ ID NO: 7264323 - DNA, 21 bp, Homo sapiens
ttacttctgcttgttattgtc

SEQ ID NO: 7264324 - DNA, 22 bp, Homo sapiens
ttacatattatccaaaactgct

SEQ ID NO: 7264325 - DNA, 22 bp, Homo sapiens
ttacatcagaaggaaacagcgt

SEQ ID NO: 7264326 - DNA, 22 bp, Homo sapiens
ttacatcattgagacatacata

SEQ ID NO: 7264327 - DNA, 22 bp, Homo sapiens
ttacacaacatctgtattatta

SEQ ID NO: 7264328 - DNA, 22 bp, Homo sapiens
tgttttggaacaaaagctattc

SEQ ID NO: 7264329 - DNA, 22 bp, Homo sapiens
tgttttggtagattgattatgg

SEQ ID NO: 7264330 - DNA, 22 bp, Homo sapiens
tgttttggtttaagtatatgaa

SEQ ID NO: 7264331 - DNA, 22 bp, Homo sapiens
tgttttctgggtggaaggtact

SEQ ID NO: 7264332 - DNA, 23 bp, Homo sapiens
tgttttcttgtcctggtataatt

SEQ ID NO: 7264333 - DNA, 22 bp, Homo sapiens
tgttttctgatggttaatgagt

SEQ ID NO: 7264334 - DNA, 22 bp, Homo sapiens
ttaaagctaggtggaacaaatt

SEQ ID NO: 7264335 - DNA, 22 bp, Homo sapiens
ttaaatattatgttgtctgcaa

SEQ ID NO: 7264336 - DNA, 22 bp, Homo sapiens
tgtttttaaataatgatagaaa

SEQ ID NO: 7264337 - DNA, 22 bp, Homo sapiens
ttaaagcatcctgtcagtctgt

SEQ ID NO: 7264338 - DNA, 22 bp, Homo sapiens
ttaaattaggactctagttctg

SEQ ID NO: 7264339 - DNA, 22 bp, Homo sapiens
ttaacaatagagtttcttcagg

SEQ ID NO: 7264340 - DNA, 22 bp, Homo sapiens
ttaaatggggatgagtagatgg

SEQ ID NO: 7264341 - DNA, 22 bp, Homo sapiens
ttaaatgatgcatatcatttag

SEQ ID NO: 7264342 - DNA, 22 bp, Homo sapiens
ttaaatgaacgagatatgcaac

SEQ ID NO: 7264343 - DNA, 22 bp, Homo sapiens
ttaattactaagcacaatgcaa

SEQ ID NO: 7264344 - DNA, 22 bp, Homo sapiens
ttaattcagtcaaagaaaccat

SEQ ID NO: 7264345 - DNA, 22 bp, Homo sapiens
tgtgtgaatggattattctatt

SEQ ID NO: 7264346 - DNA, 22 bp, Homo sapiens
tgtgtaaatttatttacataaa

SEQ ID NO: 7264347 - DNA, 22 bp, Homo sapiens
tgtgtaaaatctgattaatact

SEQ ID NO: 7264348 - DNA, 22 bp, Homo sapiens
tgtggagtggtctgaaggctcc

SEQ ID NO: 7264349 - DNA, 22 bp, Homo sapiens
tgtttgagttctagcgcattta

SEQ ID NO: 7264350 - DNA, 21 bp, Homo sapiens
tgtttcatgctattttcttgt

SEQ ID NO: 7264351 - DNA, 21 bp, Homo sapiens
tgtttaatacatatttgtgga

SEQ ID NO: 7264352 - DNA, 22 bp, Homo sapiens
tgtttaataattctatgatagt

SEQ ID NO: 7264353 - DNA, 22 bp, Homo sapiens
tgtttaatcttcaggacagtct

SEQ ID NO: 7264354 - DNA, 22 bp, Homo sapiens
tgtttaatctataaaatggaga

SEQ ID NO: 7264355 - DNA, 22 bp, Homo sapiens
tgtttaattgggccaacagcgg

SEQ ID NO: 7264356 - DNA, 22 bp, Homo sapiens
tgtttaatttcacaaagttgac

SEQ ID NO: 7264357 - DNA, 22 bp, Homo sapiens
tgtttaatgaagatggtttttc

SEQ ID NO: 7264358 - DNA, 22 bp, Homo sapiens
tgtttaatgcattgaccttggg

SEQ ID NO: 7264359 - DNA, 22 bp, Homo sapiens
tgtttaattcaccatcatgttc

SEQ ID NO: 7264360 - DNA, 22 bp, Homo sapiens
tgtttaatttttcatgagccaa

SEQ ID NO: 7264361 - DNA, 22 bp, Homo sapiens
tgttcaaatcttttgcttattt

SEQ ID NO: 7264362 - DNA, 20 bp, Homo sapiens
ttccacatctttgcacatgc

SEQ ID NO: 7264363 - DNA, 22 bp, Homo sapiens
ttcctgaacatttctaagttga

SEQ ID NO: 7264364 - DNA, 22 bp, Homo sapiens
ttcctgaagtcaaagatctaaa

SEQ ID NO: 7264365 - DNA, 22 bp, Homo sapiens
ttccttctattcagctccaaga

SEQ ID NO: 7264366 - DNA, 22 bp, Homo sapiens
ttctagaatgatatgaggtact

SEQ ID NO: 7264367 - DNA, 22 bp, Homo sapiens
ttcacattccgcggctattttc

SEQ ID NO: 7264368 - DNA, 22 bp, Homo sapiens
ttcaacaattaagtatcagcct

SEQ ID NO: 7264369 - DNA, 22 bp, Homo sapiens
ttagagtgtagcaggaagaggc

SEQ ID NO: 7264370 - DNA, 22 bp, Homo sapiens
ttcaacaagtcttttttcactg

SEQ ID NO: 7264371 - DNA, 22 bp, Homo sapiens
ttcacaatagctggcatcatct

SEQ ID NO: 7264372 - DNA, 22 bp, Homo sapiens
ttcaatttcataatatctagct

SEQ ID NO: 7264373 - DNA, 22 bp, Homo sapiens
ttcaatttagtgatgttgttgg

SEQ ID NO: 7264374 - DNA, 20 bp, Homo sapiens
ttctagtttggagttattaa

SEQ ID NO: 7264375 - DNA, 22 bp, Homo sapiens
ttctagttaaagtatgtattag

SEQ ID NO: 7264376 - DNA, 22 bp, Homo sapiens
ttctggaaagcatttgaggccc

SEQ ID NO: 7264377 - DNA, 22 bp, Homo sapiens
ttctgcttagagggcatttgca

SEQ ID NO: 7264378 - DNA, 22 bp, Homo sapiens
ttctgcttattcaaatgatctt

SEQ ID NO: 7264379 - DNA, 20 bp, Homo sapiens
ttctgcttgcaaatatcaag

SEQ ID NO: 7264380 - DNA, 22 bp, Homo sapiens
ttctgctttcagttcttctggg

SEQ ID NO: 7264381 - DNA, 22 bp, Homo sapiens
ttctgcttttagctaaactata

SEQ ID NO: 7264382 - DNA, 22 bp, Homo sapiens
ttcttctttccaattacatggt

SEQ ID NO: 7264383 - DNA, 18 bp, Homo sapiens
ttctttaattcagtttga

SEQ ID NO: 7264384 - DNA, 22 bp, Homo sapiens
ttctttaaaatagtgagaaaga

SEQ ID NO: 7264385 - DNA, 22 bp, Homo sapiens
ttctgtttgccatatatagtag

SEQ ID NO: 7264386 - DNA, 22 bp, Homo sapiens
ttcttaaaacttatggacaggt

SEQ ID NO: 7264387 - DNA, 22 bp, Homo sapiens
ttgaagattctttttgttagta

SEQ ID NO: 7264388 - DNA, 22 bp, Homo sapiens
ttctttattgagacttcattgt

SEQ ID NO: 7264389 - DNA, 22 bp, Homo sapiens
ttgaatggcttctaggttctcc

SEQ ID NO: 7264390 - DNA, 22 bp, Homo sapiens
ttgaattataagtgtgtctact

SEQ ID NO: 7264391 - DNA, 22 bp, Homo sapiens
ttgattttaaaatagtgacact

SEQ ID NO: 7264392 - DNA, 22 bp, Homo sapiens
ttgatttcaaaatatatgcttg

SEQ ID NO: 7264393 - DNA, 21 bp, Homo sapiens
ttgatttagcagatctagctg

SEQ ID NO: 7264394 - DNA, 22 bp, Homo sapiens
tttttggcagctcagaaacttc

SEQ ID NO: 7264395 - DNA, 22 bp, Homo sapiens
tttttgctccacaactttgaag

SEQ ID NO: 7264396 - DNA, 22 bp, Homo sapiens
tttttgatactcaagaggggta

SEQ ID NO: 7264397 - DNA, 22 bp, Homo sapiens
ttttctttaatctggtggggtg

SEQ ID NO: 7264398 - DNA, 22 bp, Homo sapiens
ttttctaacatctagtaatttg

SEQ ID NO: 7264399 - DNA, 22 bp, Homo sapiens
ttttggctccagtggtttgtgc

SEQ ID NO: 7264400 - DNA, 22 bp, Homo sapiens
ttttgaagaagatgggaattta

SEQ ID NO: 7264401 - DNA, 19 bp, Homo sapiens
ttttgaagtatgagacagg

SEQ ID NO: 7264402 - DNA, 22 bp, Homo sapiens
tttctttatcctcctttgcaca

SEQ ID NO: 7264403 - DNA, 22 bp, Homo sapiens
tttgcaaatatgtgtttctatt

SEQ ID NO: 7264404 - DNA, 22 bp, Homo sapiens
tttgttcttgcaacagttatta

SEQ ID NO: 7264405 - DNA, 23 bp, Homo sapiens
tttgtacattgaggaggcagaat

SEQ ID NO: 7264406 - DNA, 22 bp, Homo sapiens
tttgttttctgtaggcctttcc

SEQ ID NO: 7264407 - DNA, 22 bp, Homo sapiens
tttgtttctgcaatacctatag

SEQ ID NO: 7264408 - DNA, 22 bp, Homo sapiens
ttttagtttggatttctaaagc

SEQ ID NO: 7264409 - DNA, 22 bp, Homo sapiens
ttttataaagagagtcagttgg

SEQ ID NO: 7264410 - DNA, 22 bp, Homo sapiens
ttttatagctgaatagtattcc

SEQ ID NO: 7264411 - DNA, 22 bp, Homo sapiens
tttcttatgtgcagagtgagta

SEQ ID NO: 7264412 - DNA, 23 bp, Homo sapiens
tttctgttcctctagctttgcat

SEQ ID NO: 7264413 - DNA, 22 bp, Homo sapiens
tttcttatattctgtcattgtt

SEQ ID NO: 7264414 - DNA, 19 bp, Homo sapiens
tttctgtctgtgttttgcc

SEQ ID NO: 7264415 - DNA, 20 bp, Homo sapiens
tttctgtgagaaacactgtt

SEQ ID NO: 7264416 - DNA, 22 bp, Homo sapiens
tttcttgtaagatgtttattaa

SEQ ID NO: 7264417 - DNA, 20 bp, Homo sapiens
tttcttgtcggctgttgctg

SEQ ID NO: 7264418 - DNA, 22 bp, Homo sapiens
tttcttctctaatctcaatgat

SEQ ID NO: 7264419 - DNA, 22 bp, Homo sapiens
tttctttaattctcacagcaat

SEQ ID NO: 7264420 - DNA, 22 bp, Homo sapiens
tttctttaaaggaactctgttt

SEQ ID NO: 7264421 - DNA, 22 bp, Homo sapiens
tttctttatcatagcatctttg

SEQ ID NO: 7264422 - DNA, 22 bp, Homo sapiens
tttctactttggaatgcactga

SEQ ID NO: 7264423 - DNA, 22 bp, Homo sapiens
tttcctgagtcagagacaccag

SEQ ID NO: 7264424 - DNA, 22 bp, Homo sapiens
tttcaaagagttgtaaattact

SEQ ID NO: 7264425 - DNA, 22 bp, Homo sapiens
tttcaaagacagccatatttgt

SEQ ID NO: 7264426 - DNA, 22 bp, Homo sapiens
tttcaaagaccattaactatca

SEQ ID NO: 7264427 - DNA, 22 bp, Homo sapiens
tttcattgtcatctatcttaga

SEQ ID NO: 7264428 - DNA, 20 bp, Homo sapiens
tttcattgtcagaatcttat

SEQ ID NO: 7264429 - DNA, 22 bp, Homo sapiens
ttggtgaacacatacacatttt

SEQ ID NO: 7264430 - DNA, 22 bp, Homo sapiens
ttggtgaattgagaccatttgt

SEQ ID NO: 7264431 - DNA, 22 bp, Homo sapiens
ttgcaacacaaagtttgattcc

SEQ ID NO: 7264432 - DNA, 22 bp, Homo sapiens
ttggttcagtaggcatgcctgg

SEQ ID NO: 7264433 - DNA, 20 bp, Homo sapiens
ttgtttaaaggtgaagaggc

SEQ ID NO: 7264434 - DNA, 22 bp, Homo sapiens
ttgttaaaaatagatttccagg

SEQ ID NO: 7264435 - DNA, 22 bp, Homo sapiens
ttgttttattctgcaatttccc

SEQ ID NO: 7264436 - DNA, 22 bp, Homo sapiens
ttgtttctttgaagtttctaga

SEQ ID NO: 7264437 - DNA, 22 bp, Homo sapiens
ttgtttctgagttttcatgtat

SEQ ID NO: 7264438 - DNA, 22 bp, Homo sapiens
tttaattctggcataatagctc

SEQ ID NO: 7264439 - DNA, 22 bp, Homo sapiens
tttaaaatcagatgggagttgg

SEQ ID NO: 7264440 - DNA, 22 bp, Homo sapiens
ttgtttttagagaagccctgaa

SEQ ID NO: 7264441 - DNA, 22 bp, Homo sapiens
tttaaaatttagacctctccac

SEQ ID NO: 7264442 - DNA, 22 bp, Homo sapiens
tttactgaatttggtatattcc

SEQ ID NO: 7264443 - DNA, 21 bp, Homo sapiens
tttactgagcacttactatgt

SEQ ID NO: 7264444 - DNA, 22 bp, Homo sapiens
tttacaaggcagaactgattaa

SEQ ID NO: 7264445 - DNA, 22 bp, Homo sapiens
tttatagatgtctgtattataa

SEQ ID NO: 7264446 - DNA, 23 bp, Homo sapiens
tttatagcagcatgatttataat

SEQ ID NO: 7264447 - DNA, 23 bp, Homo sapiens
tttatagcagcatgatttatagt

SEQ ID NO: 7264448 - DNA, 22 bp, Homo sapiens
cagcacatctccaagaatttct

SEQ ID NO: 7264449 - DNA, 22 bp, Homo sapiens
cagcacatctgattatatgact

SEQ ID NO: 7264450 - DNA, 18 bp, Homo sapiens
cagaaagttatttactct

SEQ ID NO: 7264451 - DNA, 20 bp, Homo sapiens
cacagactgtatgggcacca

SEQ ID NO: 7264452 - DNA, 22 bp, Homo sapiens
gcctcacagactgactgaaagc

SEQ ID NO: 7264453 - DNA, 22 bp, Homo sapiens
ctttctgattttaagctctaat

SEQ ID NO: 7264454 - DNA, 22 bp, Homo sapiens
ctttctgatccctgcaaccctc

SEQ ID NO: 7264455 - DNA, 22 bp, Homo sapiens
ctttctgaagtttaagttctaa

SEQ ID NO: 7264456 - DNA, 22 bp, Homo sapiens
ctttctgaaagacattttaact

SEQ ID NO: 7264457 - DNA, 22 bp, Homo sapiens
atgaacagtatgcaacatgatt

SEQ ID NO: 7264458 - DNA, 22 bp, Homo sapiens
atgaacagtacaaagcacagac

SEQ ID NO: 7264459 - DNA, 22 bp, Homo sapiens
atgatcagcagttttcagtgtt

SEQ ID NO: 7264460 - DNA, 22 bp, Homo sapiens
gaaatttattatctacatcatt

SEQ ID NO: 7264461 - DNA, 22 bp, Homo sapiens
atgatcagggcagaagcagaag

SEQ ID NO: 7264462 - DNA, 22 bp, Homo sapiens
atatgctaattagagggcatta

SEQ ID NO: 7264463 - DNA, 22 bp, Homo sapiens
ctggagaattctatgaaatatt

SEQ ID NO: 7264464 - DNA, 22 bp, Homo sapiens
catctcctttggtctacttcca

SEQ ID NO: 7264465 - DNA, 20 bp, Homo sapiens
catctcctgcctccatgttc

SEQ ID NO: 7264466 - DNA, 22 bp, Homo sapiens
catgagactgccttttcaaacc

SEQ ID NO: 7264467 - DNA, 22 bp, Homo sapiens
acctcatctggtttgtaaggca

SEQ ID NO: 7264468 - DNA, 22 bp, Homo sapiens
agaagccaaatgccagtgacct

SEQ ID NO: 7264469 - DNA, 22 bp, Homo sapiens
agaagccaaaggggccagatat

SEQ ID NO: 7264470 - DNA, 23 bp, Homo sapiens
cacatggattaaatgagaccaca

SEQ ID NO: 7264471 - DNA, 22 bp, Homo sapiens
agcccttagtacatttctcaag

SEQ ID NO: 7264472 - DNA, 22 bp, Homo sapiens
agatttatgtggtcacactcag

SEQ ID NO: 7264473 - DNA, 22 bp, Homo sapiens
agattctaccagagctagtttg

SEQ ID NO: 7264474 - DNA, 22 bp, Homo sapiens
aatctcatgagcttcttgtccc

SEQ ID NO: 7264475 - DNA, 22 bp, Homo sapiens
acagacatttaataaatgctga

SEQ ID NO: 7264476 - DNA, 18 bp, Homo sapiens
acagaaatagctgtgcct

SEQ ID NO: 7264477 - DNA, 20 bp, Homo sapiens
acacagactcagcttggatg

SEQ ID NO: 7264478 - DNA, 22 bp, Homo sapiens
aacatgatgacaaaggtatatt

SEQ ID NO: 7264479 - DNA, 22 bp, Homo sapiens
aaattcagatggctttcttttc

SEQ ID NO: 7264480 - DNA, 22 bp, Homo sapiens
aaattagatatgtgtgagactc

SEQ ID NO: 7264481 - DNA, 22 bp, Homo sapiens
aaatcacagggtctctaagtat

SEQ ID NO: 7264482 - DNA, 22 bp, Homo sapiens
aaagacagtggattcaaaatcc

SEQ ID NO: 7264483 - DNA, 22 bp, Homo sapiens
aaacttagtagagttcatatta

SEQ ID NO: 7264484 - DNA, 22 bp, Homo sapiens
aaatccagtttgtcatttccca

SEQ ID NO: 7264485 - DNA, 22 bp, Homo sapiens
agcacacaggacttgattcatg

SEQ ID NO: 7264486 - DNA, 22 bp, Homo sapiens
acagaagtgttgaagttttcat

SEQ ID NO: 7264487 - DNA, 22 bp, Homo sapiens
acagaagtgtctttttcattca

SEQ ID NO: 7264488 - DNA, 22 bp, Homo sapiens
taaggcaaaggggaagttatca

SEQ ID NO: 7264489 - DNA, 22 bp, Homo sapiens
taaacaagctgtctgatattct

SEQ ID NO: 7264490 - DNA, 20 bp, Homo sapiens
taaattagccttgaagatta

SEQ ID NO: 7264491 - DNA, 22 bp, Homo sapiens
taaattaaagattggagaagga

SEQ ID NO: 7264492 - DNA, 22 bp, Homo sapiens
taaattcagtgagtaatttctg

SEQ ID NO: 7264493 - DNA, 20 bp, Homo sapiens
tcatggaatctcactctagt

SEQ ID NO: 7264494 - DNA, 22 bp, Homo sapiens
tcagcagaaaggcactagatga

SEQ ID NO: 7264495 - DNA, 22 bp, Homo sapiens
tcacaggctctccaccatgagg

SEQ ID NO: 7264496 - DNA, 22 bp, Homo sapiens
tcacaggctctagggattaaga

SEQ ID NO: 7264497 - DNA, 20 bp, Homo sapiens
tatttctgggcaaccattta

SEQ ID NO: 7264498 - DNA, 22 bp, Homo sapiens
tcaccagatctctctgtaatgg

SEQ ID NO: 7264499 - DNA, 23 bp, Homo sapiens
tcaccagaaggggtcaataaaga

SEQ ID NO: 7264500 - DNA, 22 bp, Homo sapiens
gtgaaattgtatttggcattga

SEQ ID NO: 7264501 - DNA, 22 bp, Homo sapiens
gaaatcaaacccttttctgata

SEQ ID NO: 7264502 - DNA, 22 bp, Homo sapiens
gagaattagggcgtaattcaga

SEQ ID NO: 7264503 - DNA, 22 bp, Homo sapiens
cttgatctacatagtgaaaccc

SEQ ID NO: 7264504 - DNA, 22 bp, Homo sapiens
ctgggaggcagaggttgcagtg

SEQ ID NO: 7264505 - DNA, 22 bp, Homo sapiens
tttcacagttagcatgaggact

SEQ ID NO: 7264506 - DNA, 22 bp, Homo sapiens
tttcacagtcaatttggagtca

SEQ ID NO: 7264507 - DNA, 22 bp, Homo sapiens
ctcacagagctcatactgggag

SEQ ID NO: 7264508 - DNA, 22 bp, Homo sapiens
ttcatgaatgttccatgtgagt

SEQ ID NO: 7264509 - DNA, 22 bp, Homo sapiens
ttcacagaattgtcttgactgg

SEQ ID NO: 7264510 - DNA, 22 bp, Homo sapiens
tgttacaggaaatagaattacc

SEQ ID NO: 7264511 - DNA, 17 bp, Homo sapiens
cctcttcctctcagctg

SEQ ID NO: 7264512 - DNA, 22 bp, Homo sapiens
cctcttcctcaccatctacaac

SEQ ID NO: 7264513 - DNA, 22 bp, Homo sapiens
catgaacatttgtttacatctg

SEQ ID NO: 7264514 - DNA, 22 bp, Homo sapiens
cattgttaattggtatcttaca

SEQ ID NO: 7264515 - DNA, 22 bp, Homo sapiens
ttgtctaatgagctccacttca

SEQ ID NO: 7264516 - DNA, 22 bp, Homo sapiens
tttcattttggttatgccataa

SEQ ID NO: 7264517 - DNA, 22 bp, Homo sapiens
tttctgaaaactgaagtagtgc

SEQ ID NO: 7264518 - DNA, 21 bp, Homo sapiens
tttctgaaggcaacatctatc

SEQ ID NO: 7264519 - DNA, 22 bp, Homo sapiens
tttctgaagggcagcagactct

SEQ ID NO: 7264520 - DNA, 23 bp, Homo sapiens
tttctgaagttgagatggacttt

SEQ ID NO: 7264521 - DNA, 22 bp, Homo sapiens
ttgattctacttaaaacatatg

SEQ ID NO: 7264522 - DNA, 20 bp, Homo sapiens
ttctatacatatcactgaaa

SEQ ID NO: 7264523 - DNA, 22 bp, Homo sapiens
ttcatggagttgagaaggctaa

SEQ ID NO: 7264524 - DNA, 18 bp, Homo sapiens
ttcatcatgactctgtgg

SEQ ID NO: 7264525 - DNA, 22 bp, Homo sapiens
ttctagaaccatgacttcaggg

SEQ ID NO: 7264526 - DNA, 22 bp, Homo sapiens
ttctacaatatgaataatgaag

SEQ ID NO: 7264527 - DNA, 22 bp, Homo sapiens
ttctagaaactggagcaaacag

SEQ ID NO: 7264528 - DNA, 22 bp, Homo sapiens
ttctagaaacacatgcaaacag

SEQ ID NO: 7264529 - DNA, 22 bp, Homo sapiens
ttaagtcacttatctaaagaca

SEQ ID NO: 7264530 - DNA, 22 bp, Homo sapiens
ttaacacttgaactctacatgt

SEQ ID NO: 7264531 - DNA, 22 bp, Homo sapiens
ttaacttgtcagaaaatacagt

SEQ ID NO: 7264532 - DNA, 22 bp, Homo sapiens
ttagagagaaccatcaggatct

SEQ ID NO: 7264533 - DNA, 20 bp, Homo sapiens
ttagaagggccagatgaagg

SEQ ID NO: 7264534 - DNA, 22 bp, Homo sapiens
gtcacagaggctgccagggttg

SEQ ID NO: 7264535 - DNA, 22 bp, Homo sapiens
attctgatcattcaagatgtca

SEQ ID NO: 7264536 - DNA, 22 bp, Homo sapiens
ctttggaaaagcataccaagga

SEQ ID NO: 7264537 - DNA, 22 bp, Homo sapiens
gaagccttgaactgcaaacccc

SEQ ID NO: 7264538 - DNA, 22 bp, Homo sapiens
atacatgactcacacattctgc

SEQ ID NO: 7264539 - DNA, 22 bp, Homo sapiens
aggcttctctgcaagatgttaa

SEQ ID NO: 7264540 - DNA, 22 bp, Homo sapiens
catggatatattgtacagtagc

SEQ ID NO: 7264541 - DNA, 22 bp, Homo sapiens
catggacagtgggacagtgtgt

SEQ ID NO: 7264542 - DNA, 22 bp, Homo sapiens
catggacaacctccattcgagt

SEQ ID NO: 7264543 - DNA, 22 bp, Homo sapiens
catggacatatgagacctttcc

SEQ ID NO: 7264544 - DNA, 22 bp, Homo sapiens
agcctcttccagctcctttcta

SEQ ID NO: 7264545 - DNA, 22 bp, Homo sapiens
cagcatcaacattctcagctct

SEQ ID NO: 7264546 - DNA, 22 bp, Homo sapiens
cagcatcaccaacttgagcaat

SEQ ID NO: 7264547 - DNA, 22 bp, Homo sapiens
caaattaatgtgtctcaaaata

SEQ ID NO: 7264548 - DNA, 22 bp, Homo sapiens
agaggcctgtgtgctccagtgg

SEQ ID NO: 7264549 - DNA, 22 bp, Homo sapiens
agaggcctttctgttgagtgaa

SEQ ID NO: 7264550 - DNA, 20 bp, Homo sapiens
agatacagtttaattactct

SEQ ID NO: 7264551 - DNA, 22 bp, Homo sapiens
atggccagcaagttcagaattt

SEQ ID NO: 7264552 - DNA, 22 bp, Homo sapiens
atggccagggtggcactgtggt

SEQ ID NO: 7264553 - DNA, 22 bp, Homo sapiens
agacagcatgatacatgatgct

SEQ ID NO: 7264554 - DNA, 22 bp, Homo sapiens
agacagcagggagcaggattca

SEQ ID NO: 7264555 - DNA, 22 bp, Homo sapiens
atgaaatttgctgctaagttcc

SEQ ID NO: 7264556 - DNA, 22 bp, Homo sapiens
atgaaatttgaccaattattta

SEQ ID NO: 7264557 - DNA, 22 bp, Homo sapiens
atgaaattgatcttgaactttt

SEQ ID NO: 7264558 - DNA, 20 bp, Homo sapiens
atgaaattcctgttttctga

SEQ ID NO: 7264559 - DNA, 20 bp, Homo sapiens
atcggcttgcctggaaacaa

SEQ ID NO: 7264560 - DNA, 22 bp, Homo sapiens
agaaattaggaaagtaacactt

SEQ ID NO: 7264561 - DNA, 22 bp, Homo sapiens
acctggagtcatttgaggagta

SEQ ID NO: 7264562 - DNA, 22 bp, Homo sapiens
actggaaaaccactgaaatgag

SEQ ID NO: 7264563 - DNA, 22 bp, Homo sapiens
actggaaaggctctgaatggga

SEQ ID NO: 7264564 - DNA, 22 bp, Homo sapiens
aaattaagggtgagaagagttg

SEQ ID NO: 7264565 - DNA, 22 bp, Homo sapiens
aaattaagagtaactctgtaga

SEQ ID NO: 7264566 - DNA, 21 bp, Homo sapiens
aaactgaccttgcctgagaca

SEQ ID NO: 7264567 - DNA, 22 bp, Homo sapiens
aacagcaatagcactattcatt

SEQ ID NO: 7264568 - DNA, 22 bp, Homo sapiens
aatgaacatataaagagatctt

SEQ ID NO: 7264569 - DNA, 22 bp, Homo sapiens
aatgaacaagagagagaacttt

SEQ ID NO: 7264570 - DNA, 22 bp, Homo sapiens
aattaggcaaattaatttctct

SEQ ID NO: 7264571 - DNA, 22 bp, Homo sapiens
aattttattagaaggcaagggg

SEQ ID NO: 7264572 - DNA, 22 bp, Homo sapiens
aattttattaactggatgtagc

SEQ ID NO: 7264573 - DNA, 22 bp, Homo sapiens
acagaaattgctaatagctcat

SEQ ID NO: 7264574 - DNA, 22 bp, Homo sapiens
tccatggagtttttatttggta

SEQ ID NO: 7264575 - DNA, 22 bp, Homo sapiens
taccagggaacagggatattaa

SEQ ID NO: 7264576 - DNA, 22 bp, Homo sapiens
ggccagctgctcagtgtctctg

SEQ ID NO: 7264577 - DNA, 21 bp, Homo sapiens
ggccagctgcatatgtcactg

SEQ ID NO: 7264578 - DNA, 22 bp, Homo sapiens
gcacagacagaatccctactcc

SEQ ID NO: 7264579 - DNA, 21 bp, Homo sapiens
gcagttaatagcagagcacac

SEQ ID NO: 7264580 - DNA, 17 bp, Homo sapiens
gcagttaaattaagatg

SEQ ID NO: 7264581 - DNA, 22 bp, Homo sapiens
gaggaggttccgggtggagaag

SEQ ID NO: 7264582 - DNA, 22 bp, Homo sapiens
gaaattaaccacctttggcttt

SEQ ID NO: 7264583 - DNA, 22 bp, Homo sapiens
gaaattaagcaggggtctgtgg

SEQ ID NO: 7264584 - DNA, 21 bp, Homo sapiens
ctttgcatctatatgttctca

SEQ ID NO: 7264585 - DNA, 22 bp, Homo sapiens
ctgggaggcggaggttgcagtg

SEQ ID NO: 7264586 - DNA, 20 bp, Homo sapiens
ctgtggcatcttgaaggagg

SEQ ID NO: 7264587 - DNA, 22 bp, Homo sapiens
ctccttcccctactcagcatcc

SEQ ID NO: 7264588 - DNA, 22 bp, Homo sapiens
tttggaatgtagtttaatcatc

SEQ ID NO: 7264589 - DNA, 22 bp, Homo sapiens
ctggagaagaggtagtatgtag

SEQ ID NO: 7264590 - DNA, 22 bp, Homo sapiens
ctggagaaacatcaggcatagg

SEQ ID NO: 7264591 - DNA, 22 bp, Homo sapiens
tcctctccatgtctcacgccac

SEQ ID NO: 7264592 - DNA, 22 bp, Homo sapiens
tctcaacaccacttgctgaaga

SEQ ID NO: 7264593 - DNA, 22 bp, Homo sapiens
tcacagacctggtgggaggtgg

SEQ ID NO: 7264594 - DNA, 22 bp, Homo sapiens
tcacagactcaagggcatagga

SEQ ID NO: 7264595 - DNA, 18 bp, Homo sapiens
tcacagacttactgggcc

SEQ ID NO: 7264596 - DNA, 22 bp, Homo sapiens
tcacagacttgtctccagggat

SEQ ID NO: 7264597 - DNA, 21 bp, Homo sapiens
tcacagactggtcagtgaggc

SEQ ID NO: 7264598 - DNA, 22 bp, Homo sapiens
tagctagaaagtttcagctgtg

SEQ ID NO: 7264599 - DNA, 17 bp, Homo sapiens
cctcacagggaccagac

SEQ ID NO: 7264600 - DNA, 20 bp, Homo sapiens
cctcacagggcagagagggg

SEQ ID NO: 7264601 - DNA, 22 bp, Homo sapiens
tggaagaatgtttgccttataa

SEQ ID NO: 7264602 - DNA, 22 bp, Homo sapiens
ccatggaagaactgatgtgcca

SEQ ID NO: 7264603 - DNA, 22 bp, Homo sapiens
ttttctgaagtttaagacattt

SEQ ID NO: 7264604 - DNA, 22 bp, Homo sapiens
tttcacagatgttttggagtct

SEQ ID NO: 7264605 - DNA, 22 bp, Homo sapiens
tttcacagaactcactaaggag

SEQ ID NO: 7264606 - DNA, 22 bp, Homo sapiens
ttagctttcttggagaattaca

SEQ ID NO: 7264607 - DNA, 22 bp, Homo sapiens
ttagctttggattgcatttagt

SEQ ID NO: 7264608 - DNA, 22 bp, Homo sapiens
ttcacagagagaactcaaacca

SEQ ID NO: 7264609 - DNA, 22 bp, Homo sapiens
ttcacagctccttttactcaac

SEQ ID NO: 7264610 - DNA, 22 bp, Homo sapiens
ttcacagattgactggattcct

SEQ ID NO: 7264611 - DNA, 20 bp, Homo sapiens
ttgaaattggatggtagcta

SEQ ID NO: 7264612 - DNA, 22 bp, Homo sapiens
ttgaaatcaccactagcatttg

SEQ ID NO: 7264613 - DNA, 22 bp, Homo sapiens
cagaagcagtgagagatgtgca

SEQ ID NO: 7264614 - DNA, 22 bp, Homo sapiens
cagaagcacatgtttacatgta

SEQ ID NO: 7264615 - DNA, 22 bp, Homo sapiens
cagcagactggagtaggcagtg

SEQ ID NO: 7264616 - DNA, 20 bp, Homo sapiens
cagaaatttgtaaaagggat

SEQ ID NO: 7264617 - DNA, 22 bp, Homo sapiens
ggaggggatttagtagatgcta

SEQ ID NO: 7264618 - DNA, 22 bp, Homo sapiens
cacagctaactttcactgagca

SEQ ID NO: 7264619 - DNA, 22 bp, Homo sapiens
caaattagaggtttgttttgat

SEQ ID NO: 7264620 - DNA, 22 bp, Homo sapiens
atcatcagggacatttctgtgc

SEQ ID NO: 7264621 - DNA, 22 bp, Homo sapiens
ctcacagtctctccctaatttt

SEQ ID NO: 7264622 - DNA, 22 bp, Homo sapiens
ctcacagttggctcattaatga

SEQ ID NO: 7264623 - DNA, 22 bp, Homo sapiens
agttaaatcattactgacagag

SEQ ID NO: 7264624 - DNA, 22 bp, Homo sapiens
ctagctgacgggttgataggtg

SEQ ID NO: 7264625 - DNA, 22 bp, Homo sapiens
ccctccattaaaacagacctat

SEQ ID NO: 7264626 - DNA, 22 bp, Homo sapiens
atgatatacttcctagaacagt

SEQ ID NO: 7264627 - DNA, 22 bp, Homo sapiens
atgatacattgcaaaattttaa

SEQ ID NO: 7264628 - DNA, 22 bp, Homo sapiens
agacttctcttggctatattat

SEQ ID NO: 7264629 - DNA, 23 bp, Homo sapiens
acttttcaattagctatgcttaa

SEQ ID NO: 7264630 - DNA, 22 bp, Homo sapiens
agcttagcacacacaggcaggt

SEQ ID NO: 7264631 - DNA, 22 bp, Homo sapiens
aaatcagttgttatattaaaga

SEQ ID NO: 7264632 - DNA, 22 bp, Homo sapiens
aacattagatttgtttttctag

SEQ ID NO: 7264633 - DNA, 21 bp, Homo sapiens
aacattagtaatttgactttt

SEQ ID NO: 7264634 - DNA, 22 bp, Homo sapiens
aaattagatcagtggattttct

SEQ ID NO: 7264635 - DNA, 22 bp, Homo sapiens
aaattaactatcacttttgtga

SEQ ID NO: 7264636 - DNA, 22 bp, Homo sapiens
aagcacatctcaaacttcatct

SEQ ID NO: 7264637 - DNA, 22 bp, Homo sapiens
aagcacattaaggaacattgaa

SEQ ID NO: 7264638 - DNA, 22 bp, Homo sapiens
aagtgattttcttcttagttat

SEQ ID NO: 7264639 - DNA, 22 bp, Homo sapiens
aagtgattttcctacttgctaa

SEQ ID NO: 7264640 - DNA, 22 bp, Homo sapiens
aagtgaaattgccattcttata

SEQ ID NO: 7264641 - DNA, 22 bp, Homo sapiens
aatatggcttgttactatgttt

SEQ ID NO: 7264642 - DNA, 22 bp, Homo sapiens
acaggcttttacggatatcttt

SEQ ID NO: 7264643 - DNA, 22 bp, Homo sapiens
agagaaatagattggtccagaa

SEQ ID NO: 7264644 - DNA, 22 bp, Homo sapiens
aatgtataaccataggaaattt

SEQ ID NO: 7264645 - DNA, 22 bp, Homo sapiens
agcaggtgacagggctgtggtg

SEQ ID NO: 7264646 - DNA, 22 bp, Homo sapiens
agcactttcctggcaaatgtgg

SEQ ID NO: 7264647 - DNA, 22 bp, Homo sapiens
agcacttatgtgattaggacag

SEQ ID NO: 7264648 - DNA, 19 bp, Homo sapiens
tcacagcatctgtctgaac

SEQ ID NO: 7264649 - DNA, 22 bp, Homo sapiens
tcacagcatttttagaaagatt

SEQ ID NO: 7264650 - DNA, 22 bp, Homo sapiens
tcacagcattgagtgtactaga

SEQ ID NO: 7264651 - DNA, 22 bp, Homo sapiens
tcacagcaggcagatattgttg

SEQ ID NO: 7264652 - DNA, 22 bp, Homo sapiens
tcacagcaccaggatctctcca

SEQ ID NO: 7264653 - DNA, 22 bp, Homo sapiens
tcacagcaaatgctgcttctca

SEQ ID NO: 7264654 - DNA, 22 bp, Homo sapiens
tcacagacatggtgaggtaaca

SEQ ID NO: 7264655 - DNA, 22 bp, Homo sapiens
tcacagacagaagggatgggat

SEQ ID NO: 7264656 - DNA, 22 bp, Homo sapiens
tcacagacacattaaacatgtg

SEQ ID NO: 7264657 - DNA, 22 bp, Homo sapiens
tcatccagtaccatggaaggca

SEQ ID NO: 7264658 - DNA, 22 bp, Homo sapiens
tcatccctaaggacagctctgc

SEQ ID NO: 7264659 - DNA, 22 bp, Homo sapiens
tccaggagaaggccatccagcg

SEQ ID NO: 7264660 - DNA, 22 bp, Homo sapiens
tacagcagagtgggatgcatct

SEQ ID NO: 7264661 - DNA, 22 bp, Homo sapiens
tatgcctacctccaaaatatat

SEQ ID NO: 7264662 - DNA, 22 bp, Homo sapiens
tatgctactagaaataaaatgg

SEQ ID NO: 7264663 - DNA, 22 bp, Homo sapiens
tatgctagatggaaaaatattg

SEQ ID NO: 7264664 - DNA, 22 bp, Homo sapiens
tatactctgagaaacgtgtcac

SEQ ID NO: 7264665 - DNA, 22 bp, Homo sapiens
tagtggatgttcagagatttga

SEQ ID NO: 7264666 - DNA, 22 bp, Homo sapiens
tagtatatctttagtacatagt

SEQ ID NO: 7264667 - DNA, 22 bp, Homo sapiens
gtaaattatttcaagatcatct

SEQ ID NO: 7264668 - DNA, 22 bp, Homo sapiens
gtaaatcagtgtcattttagaa

SEQ ID NO: 7264669 - DNA, 22 bp, Homo sapiens
ggctagcttagagtcatgctag

SEQ ID NO: 7264670 - DNA, 22 bp, Homo sapiens
ggagttgattttggatatatta

SEQ ID NO: 7264671 - DNA, 22 bp, Homo sapiens
gctcacaggtctgtggctattg

SEQ ID NO: 7264672 - DNA, 22 bp, Homo sapiens
gcacttaactggaaaagaattt

SEQ ID NO: 7264673 - DNA, 22 bp, Homo sapiens
ctttctcttcagcacccagccc

SEQ ID NO: 7264674 - DNA, 22 bp, Homo sapiens
tgttttcatttgatgtaacaaa

SEQ ID NO: 7264675 - DNA, 17 bp, Homo sapiens
tgttttcattcattgct

SEQ ID NO: 7264676 - DNA, 17 bp, Homo sapiens
ttcctctcacatttttt

SEQ ID NO: 7264677 - DNA, 22 bp, Homo sapiens
ttctgaaatgagatataaggta

SEQ ID NO: 7264678 - DNA, 22 bp, Homo sapiens
ttctgaaaattgggtcatactt

SEQ ID NO: 7264679 - DNA, 18 bp, Homo sapiens
ccatcaccctaactagtg

SEQ ID NO: 7264680 - DNA, 22 bp, Homo sapiens
tggagaattctatgttgagggg

SEQ ID NO: 7264681 - DNA, 22 bp, Homo sapiens
tagcagcaggggaaacagctgt

SEQ ID NO: 7264682 - DNA, 22 bp, Homo sapiens
tagcagcacctacacgtcagag

SEQ ID NO: 7264683 - DNA, 22 bp, Homo sapiens
tacagcagggcgctgtgatgaa

SEQ ID NO: 7264684 - DNA, 22 bp, Homo sapiens
catcagctgagggtgagcagaa

SEQ ID NO: 7264685 - DNA, 22 bp, Homo sapiens
ttcatcaggcatcatgctcaag

SEQ ID NO: 7264686 - DNA, 22 bp, Homo sapiens
ttcaatcattccaacactttaa

SEQ ID NO: 7264687 - DNA, 21 bp, Homo sapiens
ttcatcagccagaaatcaagc

SEQ ID NO: 7264688 - DNA, 22 bp, Homo sapiens
ttatgctaaatgaatcaagtca

SEQ ID NO: 7264689 - DNA, 22 bp, Homo sapiens
tttagcgtagctgacagctaat

SEQ ID NO: 7264690 - DNA, 22 bp, Homo sapiens
attagaagcgtgaatcctttca

SEQ ID NO: 7264691 - DNA, 22 bp, Homo sapiens
attagaagatagtgatttctgc

SEQ ID NO: 7264692 - DNA, 22 bp, Homo sapiens
attcctgattaacgacctttca

SEQ ID NO: 7264693 - DNA, 23 bp, Homo sapiens
attcctgaggctccttatgcacc

SEQ ID NO: 7264694 - DNA, 22 bp, Homo sapiens
attcctgagacttatctgtttc

SEQ ID NO: 7264695 - DNA, 22 bp, Homo sapiens
attcctgactgctagtcattca

SEQ ID NO: 7264696 - DNA, 22 bp, Homo sapiens
attcctgactgttagagtttgc

SEQ ID NO: 7264697 - DNA, 22 bp, Homo sapiens
atgagttgaagctacaagaggc

SEQ ID NO: 7264698 - DNA, 23 bp, Homo sapiens
atgcatcatgaaaactagagagc

SEQ ID NO: 7264699 - DNA, 22 bp, Homo sapiens
gaggggagaggcttatggatca

SEQ ID NO: 7264700 - DNA, 22 bp, Homo sapiens
atggctggatttgatccatggg

SEQ ID NO: 7264701 - DNA, 22 bp, Homo sapiens
atggccagtctattcatggtta

SEQ ID NO: 7264702 - DNA, 22 bp, Homo sapiens
atacaagactcagcacagacgg

SEQ ID NO: 7264703 - DNA, 22 bp, Homo sapiens
atcctcacatttgggcaggtga

SEQ ID NO: 7264704 - DNA, 22 bp, Homo sapiens
atatatatgctgatggctgcca

SEQ ID NO: 7264705 - DNA, 22 bp, Homo sapiens
atatatattgcccaggctggtt

SEQ ID NO: 7264706 - DNA, 22 bp, Homo sapiens
atatggctgttgcacatctaag

SEQ ID NO: 7264707 - DNA, 22 bp, Homo sapiens
aggaaattgtctttttccttgt

SEQ ID NO: 7264708 - DNA, 21 bp, Homo sapiens
atggctggtggctcagcctcc

SEQ ID NO: 7264709 - DNA, 22 bp, Homo sapiens
atgtccaatttcagagtctcat

SEQ ID NO: 7264710 - DNA, 22 bp, Homo sapiens
atgtacagccacttcacagtta

SEQ ID NO: 7264711 - DNA, 22 bp, Homo sapiens
agaagcacaccagtagacaggg

SEQ ID NO: 7264712 - DNA, 22 bp, Homo sapiens
agatgaaagatttttatagaga

SEQ ID NO: 7264713 - DNA, 22 bp, Homo sapiens
cacagtcacatatctatgtgtg

SEQ ID NO: 7264714 - DNA, 22 bp, Homo sapiens
actgattgcattcatagggttt

SEQ ID NO: 7264715 - DNA, 22 bp, Homo sapiens
agaaaatttattcatgttagtt

SEQ ID NO: 7264716 - DNA, 22 bp, Homo sapiens
aggctagctttggctcagtaaa

SEQ ID NO: 7264717 - DNA, 22 bp, Homo sapiens
aggctagctgtttcagggctag

SEQ ID NO: 7264718 - DNA, 22 bp, Homo sapiens
aggctagctaatgagtactgtg

SEQ ID NO: 7264719 - DNA, 22 bp, Homo sapiens
aaaattaagtgtctgggaagcc

SEQ ID NO: 7264720 - DNA, 22 bp, Homo sapiens
aaaactgaggtttcctgaagaa

SEQ ID NO: 7264721 - DNA, 22 bp, Homo sapiens
aaaactgaaatacgatccaatg

SEQ ID NO: 7264722 - DNA, 22 bp, Homo sapiens
aagcaagttctcatcatttata

SEQ ID NO: 7264723 - DNA, 17 bp, Homo sapiens
acaacagaaatgtattc

SEQ ID NO: 7264724 - DNA, 22 bp, Homo sapiens
acactgaatgctgtttagaaat

SEQ ID NO: 7264725 - DNA, 22 bp, Homo sapiens
acagactgtcatgacactatat

SEQ ID NO: 7264726 - DNA, 22 bp, Homo sapiens
acagactgtgagtatgcatagt

SEQ ID NO: 7264727 - DNA, 22 bp, Homo sapiens
acagtctttctacattctgtgc

SEQ ID NO: 7264728 - DNA, 22 bp, Homo sapiens
aaggcctttgccccgatacagg

SEQ ID NO: 7264729 - DNA, 22 bp, Homo sapiens
agaaatgacacacatgagacat

SEQ ID NO: 7264730 - DNA, 22 bp, Homo sapiens
agaaattatgcagtagttttat

SEQ ID NO: 7264731 - DNA, 22 bp, Homo sapiens
agaaattattagtgaatagtct

SEQ ID NO: 7264732 - DNA, 21 bp, Homo sapiens
gtatatcagcagtgaattcaa

SEQ ID NO: 7264733 - DNA, 22 bp, Homo sapiens
ggctcagccccgtaacacagca

SEQ ID NO: 7264734 - DNA, 22 bp, Homo sapiens
gccatcatatcccctgtgacct

SEQ ID NO: 7264735 - DNA, 21 bp, Homo sapiens
gcaggggatagaaatggtctg

SEQ ID NO: 7264736 - DNA, 22 bp, Homo sapiens
gattttatagtcaggaaaaaga

SEQ ID NO: 7264737 - DNA, 20 bp, Homo sapiens
gcaattaatttttggttaca

SEQ ID NO: 7264738 - DNA, 21 bp, Homo sapiens
gatacagagggccactgattg

SEQ ID NO: 7264739 - DNA, 22 bp, Homo sapiens
gatatatgtaaaagtagacaga

SEQ ID NO: 7264740 - DNA, 22 bp, Homo sapiens
gatcatcatctttcaggcaagt

SEQ ID NO: 7264741 - DNA, 22 bp, Homo sapiens
gatcatcaagcaagaacctgat

SEQ ID NO: 7264742 - DNA, 22 bp, Homo sapiens
gaaatttacaactttctcatgg

SEQ ID NO: 7264743 - DNA, 22 bp, Homo sapiens
gaacttaacggcaactatttaa

SEQ ID NO: 7264744 - DNA, 22 bp, Homo sapiens
ctcagcaggtaccacatgatct

SEQ ID NO: 7264745 - DNA, 22 bp, Homo sapiens
ttcctttctctggactgcagcc

SEQ ID NO: 7264746 - DNA, 22 bp, Homo sapiens
ctgaaattctgcctctgcacaa

SEQ ID NO: 7264747 - DNA, 22 bp, Homo sapiens
ctggagaaaatccatgtgtatg

SEQ ID NO: 7264748 - DNA, 22 bp, Homo sapiens
gttcacagtctacatagtaaag

SEQ ID NO: 7264749 - DNA, 22 bp, Homo sapiens
gttattctacagtcattgaagt

SEQ ID NO: 7264750 - DNA, 21 bp, Homo sapiens
tacatcagttttcttggctca

SEQ ID NO: 7264751 - DNA, 21 bp, Homo sapiens
caggatgatgataattcatgg

SEQ ID NO: 7264752 - DNA, 22 bp, Homo sapiens
taaactgaagctcaactcaaat

SEQ ID NO: 7264753 - DNA, 22 bp, Homo sapiens
tctgaaataggaaagcaaatgg

SEQ ID NO: 7264754 - DNA, 22 bp, Homo sapiens
tctgaaataggagccatgtaga

SEQ ID NO: 7264755 - DNA, 22 bp, Homo sapiens
tctgaaataggcttcttttggt

SEQ ID NO: 7264756 - DNA, 22 bp, Homo sapiens
tctgaaatattggtaatacttt

SEQ ID NO: 7264757 - DNA, 22 bp, Homo sapiens
catgatacttgaatttggaagg

SEQ ID NO: 7264758 - DNA, 22 bp, Homo sapiens
catgatcagaaagagaagctag

SEQ ID NO: 7264759 - DNA, 22 bp, Homo sapiens
catgatcaccacttgacagccc

SEQ ID NO: 7264760 - DNA, 22 bp, Homo sapiens
tcactcagcattcactgggcct

SEQ ID NO: 7264761 - DNA, 22 bp, Homo sapiens
ttaaagcaaccatcaatttgga

SEQ ID NO: 7264762 - DNA, 22 bp, Homo sapiens
ttagaagcactaattactcaca

SEQ ID NO: 7264763 - DNA, 22 bp, Homo sapiens
ttatttcttgtctatgtagcca

SEQ ID NO: 7264764 - DNA, 21 bp, Homo sapiens
tgtgaaatagctatgctacat

SEQ ID NO: 7264765 - DNA, 22 bp, Homo sapiens
tggttctaaaggactatacaga

SEQ ID NO: 7264766 - DNA, 23 bp, Homo sapiens
tggttctaggcctataattatat

SEQ ID NO: 7264767 - DNA, 22 bp, Homo sapiens
tggccagcccttcagccatgcc

SEQ ID NO: 7264768 - DNA, 22 bp, Homo sapiens
tggccagcagagttcactctct

SEQ ID NO: 7264769 - DNA, 21 bp, Homo sapiens
tggccagctgctcgtctcctc

SEQ ID NO: 7264770 - DNA, 22 bp, Homo sapiens
tggccagccttgtcatcgcttt

SEQ ID NO: 7264771 - DNA, 22 bp, Homo sapiens
tggaattatctgaagtgatttg

SEQ ID NO: 7264772 - DNA, 22 bp, Homo sapiens
tggaaattactaacacttagag

SEQ ID NO: 7264773 - DNA, 22 bp, Homo sapiens
tgctcacattaggcatccatgg

SEQ ID NO: 7264774 - DNA, 22 bp, Homo sapiens
tgctcacactcatgtccacgct

SEQ ID NO: 7264775 - DNA, 22 bp, Homo sapiens
tgctcacagcccagaacataat

SEQ ID NO: 7264776 - DNA, 22 bp, Homo sapiens
tgaggccaggacccccagcagg

SEQ ID NO: 7264777 - DNA, 22 bp, Homo sapiens
tgaggccagcttcagcagtgga

SEQ ID NO: 7264778 - DNA, 22 bp, Homo sapiens
tgaggccacttccccacagccc

SEQ ID NO: 7264779 - DNA, 22 bp, Homo sapiens
tgaggccacagtatcagaacag

SEQ ID NO: 7264780 - DNA, 19 bp, Homo sapiens
tgaggccaaggtcacagat

SEQ ID NO: 7264781 - DNA, 22 bp, Homo sapiens
tgacacagttgtcgactctaca

SEQ ID NO: 7264782 - DNA, 22 bp, Homo sapiens
tgacacagtatcaaacatgatt

SEQ ID NO: 7264783 - DNA, 22 bp, Homo sapiens
tgacacagtgggggatcctttt

SEQ ID NO: 7264784 - DNA, 22 bp, Homo sapiens
tgacacagattagagacatacc

SEQ ID NO: 7264785 - DNA, 22 bp, Homo sapiens
tgacacagggcatgcagcagaa

SEQ ID NO: 7264786 - DNA, 22 bp, Homo sapiens
tgaaattattcttaccaaggtg

SEQ ID NO: 7264787 - DNA, 22 bp, Homo sapiens
tgaaattatgcattgttgtacc

SEQ ID NO: 7264788 - DNA, 22 bp, Homo sapiens
tgaaattagaaatatgtatggg

SEQ ID NO: 7264789 - DNA, 22 bp, Homo sapiens
tgaaattagtgaagttacagtt

SEQ ID NO: 7264790 - DNA, 22 bp, Homo sapiens
tgaaatcattgccaagtattga

SEQ ID NO: 7264791 - DNA, 22 bp, Homo sapiens
tgaaatcatgtagttattgcaa

SEQ ID NO: 7264792 - DNA, 22 bp, Homo sapiens
tgatatcagctggcagcagtgg

SEQ ID NO: 7264793 - DNA, 22 bp, Homo sapiens
tgattctttctccaccaattca

SEQ ID NO: 7264794 - DNA, 22 bp, Homo sapiens
tcgtgaggctctgcatcgcaca

SEQ ID NO: 7264795 - DNA, 22 bp, Homo sapiens
tccttacatagtgctgaaatat

SEQ ID NO: 7264796 - DNA, 22 bp, Homo sapiens
tctgaaataaatgcactgttag

SEQ ID NO: 7264797 - DNA, 22 bp, Homo sapiens
tctgaaatagaagtgtctttct

SEQ ID NO: 7264798 - DNA, 22 bp, Homo sapiens
tctgaaatgcaggcaatttgct

SEQ ID NO: 7264799 - DNA, 22 bp, Homo sapiens
aatcataattcaaataagctta

SEQ ID NO: 7264800 - DNA, 22 bp, Homo sapiens
aatcagcaaatgcttactcagg

SEQ ID NO: 7264801 - DNA, 23 bp, Homo sapiens
actttattgaccccaggtcagtt

SEQ ID NO: 7264802 - DNA, 22 bp, Homo sapiens
actgatacaaaagcacttggga

SEQ ID NO: 7264803 - DNA, 22 bp, Homo sapiens
actggagtaaaggtcacttgtg

SEQ ID NO: 7264804 - DNA, 22 bp, Homo sapiens
acatttaaatacctatgtttct

SEQ ID NO: 7264805 - DNA, 22 bp, Homo sapiens
acatttaaatatgccttatatt

SEQ ID NO: 7264806 - DNA, 22 bp, Homo sapiens
acattttgaaagggaaattgtt

SEQ ID NO: 7264807 - DNA, 17 bp, Homo sapiens
agctcctgcccatggct

SEQ ID NO: 7264808 - DNA, 22 bp, Homo sapiens
acacattaaaacgtctacaatg

SEQ ID NO: 7264809 - DNA, 22 bp, Homo sapiens
agacaatttcaaagtaatatta

SEQ ID NO: 7264810 - DNA, 22 bp, Homo sapiens
agaccctgtcagtgttaggaaa

SEQ ID NO: 7264811 - DNA, 20 bp, Homo sapiens
agaccctgtgtcctgtggcc

SEQ ID NO: 7264812 - DNA, 22 bp, Homo sapiens
agaccctgcacctctcgtgggc

SEQ ID NO: 7264813 - DNA, 22 bp, Homo sapiens
aagatggtcttgagatattata

SEQ ID NO: 7264814 - DNA, 22 bp, Homo sapiens
acacatgaaagacattaaggtg

SEQ ID NO: 7264815 - DNA, 22 bp, Homo sapiens
aagcaccaagttcaacattccc

SEQ ID NO: 7264816 - DNA, 22 bp, Homo sapiens
aagcaccaccctcccaacctgt

SEQ ID NO: 7264817 - DNA, 22 bp, Homo sapiens
aagactttctgtaaagctacag

SEQ ID NO: 7264818 - DNA, 22 bp, Homo sapiens
aattttactaatctgagtgtga

SEQ ID NO: 7264819 - DNA, 19 bp, Homo sapiens
aatagattaattatcctct

SEQ ID NO: 7264820 - DNA, 22 bp, Homo sapiens
aagtggttattttgatctagaa

SEQ ID NO: 7264821 - DNA, 22 bp, Homo sapiens
aagtgcttctgggattaggagt

SEQ ID NO: 7264822 - DNA, 22 bp, Homo sapiens
aacactttttatatattgtatc

SEQ ID NO: 7264823 - DNA, 22 bp, Homo sapiens
aaacagcaattacttttgcacc

SEQ ID NO: 7264824 - DNA, 22 bp, Homo sapiens
aaagaaatagatggcatttaaa

SEQ ID NO: 7264825 - DNA, 22 bp, Homo sapiens
aagattaaaggggagacaagct

SEQ ID NO: 7264826 - DNA, 22 bp, Homo sapiens
aaatcttcctgaaatttgttca

SEQ ID NO: 7264827 - DNA, 22 bp, Homo sapiens
aagactataccatcttagttac

SEQ ID NO: 7264828 - DNA, 22 bp, Homo sapiens
aacatataaactcttaagttca

SEQ ID NO: 7264829 - DNA, 22 bp, Homo sapiens
acatttaaccaaactgtttaat

SEQ ID NO: 7264830 - DNA, 22 bp, Homo sapiens
acatttatataactcactagga

SEQ ID NO: 7264831 - DNA, 22 bp, Homo sapiens
accatttgaaggaatcattgac

SEQ ID NO: 7264832 - DNA, 22 bp, Homo sapiens
acatttttgggttgatgtctga

SEQ ID NO: 7264833 - DNA, 22 bp, Homo sapiens
acatttttcacatttgtagggt

SEQ ID NO: 7264834 - DNA, 19 bp, Homo sapiens
acagtttgggaaatgagca

SEQ ID NO: 7264835 - DNA, 22 bp, Homo sapiens
acagtttggcgtgattgatagt

SEQ ID NO: 7264836 - DNA, 22 bp, Homo sapiens
atatatttgagaatattcatga

SEQ ID NO: 7264837 - DNA, 22 bp, Homo sapiens
acttggtggaacgtgtatttta

SEQ ID NO: 7264838 - DNA, 22 bp, Homo sapiens
acttggtgaagtcaggtgatta

SEQ ID NO: 7264839 - DNA, 19 bp, Homo sapiens
actttggtgattagaggga

SEQ ID NO: 7264840 - DNA, 22 bp, Homo sapiens
actttggtgatacagatacggc

SEQ ID NO: 7264841 - DNA, 22 bp, Homo sapiens
actttggtgaatcagttttgtt

SEQ ID NO: 7264842 - DNA, 22 bp, Homo sapiens
actttggtcttagaggaggaat

SEQ ID NO: 7264843 - DNA, 22 bp, Homo sapiens
actttggtctctgcccctggtg

SEQ ID NO: 7264844 - DNA, 17 bp, Homo sapiens
actttggtcctgtgctc

SEQ ID NO: 7264845 - DNA, 22 bp, Homo sapiens
actttggtcccatgtgtgtaaa

SEQ ID NO: 7264846 - DNA, 22 bp, Homo sapiens
actttggttcacagctgttcat

SEQ ID NO: 7264847 - DNA, 20 bp, Homo sapiens
actttggttattgggaccat

SEQ ID NO: 7264848 - DNA, 22 bp, Homo sapiens
actttggttataggagccaaaa

SEQ ID NO: 7264849 - DNA, 22 bp, Homo sapiens
actttggtgcgaagtcacttta

SEQ ID NO: 7264850 - DNA, 22 bp, Homo sapiens
actttggtttccctgttcgtaa

SEQ ID NO: 7264851 - DNA, 22 bp, Homo sapiens
agtttacatgacgtgtatttca

SEQ ID NO: 7264852 - DNA, 22 bp, Homo sapiens
agtttacatcttcaatctcatt

SEQ ID NO: 7264853 - DNA, 22 bp, Homo sapiens
actgaatatattccattgcatg

SEQ ID NO: 7264854 - DNA, 22 bp, Homo sapiens
actgaatagtgctgcattgtac

SEQ ID NO: 7264855 - DNA, 22 bp, Homo sapiens
actgaattacagtctgcatttt

SEQ ID NO: 7264856 - DNA, 22 bp, Homo sapiens
actgaagtagtcattgtcatta

SEQ ID NO: 7264857 - DNA, 22 bp, Homo sapiens
actgaagtgaaggcaatctttt

SEQ ID NO: 7264858 - DNA, 22 bp, Homo sapiens
actgaagtctcttttgttctct

SEQ ID NO: 7264859 - DNA, 22 bp, Homo sapiens
actgctctctgcaagtagatgg

SEQ ID NO: 7264860 - DNA, 22 bp, Homo sapiens
agtctcttcctcatgcatatgt

SEQ ID NO: 7264861 - DNA, 22 bp, Homo sapiens
actgaaatactgctcttggatt

SEQ ID NO: 7264862 - DNA, 22 bp, Homo sapiens
acgggccttctcttcaggcgag

SEQ ID NO: 7264863 - DNA, 22 bp, Homo sapiens
agatgaagcctgtacttagtct

SEQ ID NO: 7264864 - DNA, 22 bp, Homo sapiens
agatgaagatgccactaagacc

SEQ ID NO: 7264865 - DNA, 22 bp, Homo sapiens
atttattatgggatttggctca

SEQ ID NO: 7264866 - DNA, 22 bp, Homo sapiens
attcttcatttactgttacttg

SEQ ID NO: 7264867 - DNA, 22 bp, Homo sapiens
atgtgtcttggagttttaatgt

SEQ ID NO: 7264868 - DNA, 22 bp, Homo sapiens
attacagtagcaaaagaccgga

SEQ ID NO: 7264869 - DNA, 22 bp, Homo sapiens
attacagtggacagctatgcac

SEQ ID NO: 7264870 - DNA, 22 bp, Homo sapiens
attacagtaggattggaaagga

SEQ ID NO: 7264871 - DNA, 22 bp, Homo sapiens
attacagtgccacctcgtggtc

SEQ ID NO: 7264872 - DNA, 22 bp, Homo sapiens
attataaatattttctaggggt

SEQ ID NO: 7264873 - DNA, 22 bp, Homo sapiens
atgcagggtctccgtgtgacga

SEQ ID NO: 7264874 - DNA, 22 bp, Homo sapiens
catggcctgcctcctcctggtg

SEQ ID NO: 7264875 - DNA, 22 bp, Homo sapiens
cagtccatatgccataattctt

SEQ ID NO: 7264876 - DNA, 22 bp, Homo sapiens
ccagtgcacaatggaacaactc

SEQ ID NO: 7264877 - DNA, 22 bp, Homo sapiens
aggcatttgatgaagattggct

SEQ ID NO: 7264878 - DNA, 22 bp, Homo sapiens
aggcagtgctcaagacagcagc

SEQ ID NO: 7264879 - DNA, 22 bp, Homo sapiens
cccagctctgccatctacccac

SEQ ID NO: 7264880 - DNA, 22 bp, Homo sapiens
cccagctctgcagacctgccct

SEQ ID NO: 7264881 - DNA, 22 bp, Homo sapiens
atatgattccactattgtatgg

SEQ ID NO: 7264882 - DNA, 22 bp, Homo sapiens
atatatatcgagttcatgtctc

SEQ ID NO: 7264883 - DNA, 22 bp, Homo sapiens
atatacttttcactaatggcta

SEQ ID NO: 7264884 - DNA, 22 bp, Homo sapiens
atataatacaacctgctaagtg

SEQ ID NO: 7264885 - DNA, 22 bp, Homo sapiens
atcctctatgatatgtatgggt

SEQ ID NO: 7264886 - DNA, 22 bp, Homo sapiens
ataatcaaagtcctatgacatc

SEQ ID NO: 7264887 - DNA, 22 bp, Homo sapiens
ataatacatggttaacctcttt

SEQ ID NO: 7264888 - DNA, 22 bp, Homo sapiens
atactttagagctagattgcct

SEQ ID NO: 7264889 - DNA, 22 bp, Homo sapiens
atacttctttaagagtaagtct

SEQ ID NO: 7264890 - DNA, 22 bp, Homo sapiens
ctgaggcatcatggagaacagt

SEQ ID NO: 7264891 - DNA, 22 bp, Homo sapiens
ctgagggtgctattcttgcctt

SEQ ID NO: 7264892 - DNA, 22 bp, Homo sapiens
agtttacaaagtttcactgttc

SEQ ID NO: 7264893 - DNA, 22 bp, Homo sapiens
agtttgaattttaatctcggtg

SEQ ID NO: 7264894 - DNA, 22 bp, Homo sapiens
agtttgaagcacatgaatggca

SEQ ID NO: 7264895 - DNA, 22 bp, Homo sapiens
ctcaaatatgtggtcagaaagc

SEQ ID NO: 7264896 - DNA, 19 bp, Homo sapiens
cctttggtttttggttcat

SEQ ID NO: 7264897 - DNA, 22 bp, Homo sapiens
cctttggtcttgatgaactgtt

SEQ ID NO: 7264898 - DNA, 22 bp, Homo sapiens
cctttggtcacctccactctta

SEQ ID NO: 7264899 - DNA, 22 bp, Homo sapiens
cctttggttgagtgaaagtaag

SEQ ID NO: 7264900 - DNA, 19 bp, Homo sapiens
cctttggtttccatgacat

SEQ ID NO: 7264901 - DNA, 22 bp, Homo sapiens
cctttggtggttttcagagatc

SEQ ID NO: 7264902 - DNA, 22 bp, Homo sapiens
cctttggtggcttcaaaatggc

SEQ ID NO: 7264903 - DNA, 22 bp, Homo sapiens
cctttggtgttattgggagaca

SEQ ID NO: 7264904 - DNA, 22 bp, Homo sapiens
atgccactgcgctctagcctgg

SEQ ID NO: 7264905 - DNA, 22 bp, Homo sapiens
ctttggtctgtccatcctgcct

SEQ ID NO: 7264906 - DNA, 22 bp, Homo sapiens
ctttggtctcttctaaagaatg

SEQ ID NO: 7264907 - DNA, 22 bp, Homo sapiens
ctttggtctgtggcttgggtct

SEQ ID NO: 7264908 - DNA, 22 bp, Homo sapiens
ctttggtgttcattaaacatgg

SEQ ID NO: 7264909 - DNA, 22 bp, Homo sapiens
atctttttatctgtttggaaca

SEQ ID NO: 7264910 - DNA, 20 bp, Homo sapiens
cttgttgattctaggaatga

SEQ ID NO: 7264911 - DNA, 22 bp, Homo sapiens
atgaaatatcttgaagaaattc

SEQ ID NO: 7264912 - DNA, 22 bp, Homo sapiens
cttggtctaatggtaataagca

SEQ ID NO: 7264913 - DNA, 18 bp, Homo sapiens
cttggtaagtaaaacagc

SEQ ID NO: 7264914 - DNA, 22 bp, Homo sapiens
attcttcacacctgttcctgtt

SEQ ID NO: 7264915 - DNA, 22 bp, Homo sapiens
attgaactataattatgatttg

SEQ ID NO: 7264916 - DNA, 22 bp, Homo sapiens
attgaacttaacagtaagtggc

SEQ ID NO: 7264917 - DNA, 22 bp, Homo sapiens
attgaactgtctttgaagaaat

SEQ ID NO: 7264918 - DNA, 22 bp, Homo sapiens
attgaactgtagtcttctgtct

SEQ ID NO: 7264919 - DNA, 22 bp, Homo sapiens
attgaactgatatttggtgtag

SEQ ID NO: 7264920 - DNA, 22 bp, Homo sapiens
attgcactttcccctgtgagaa

SEQ ID NO: 7264921 - DNA, 22 bp, Homo sapiens
attattcatggtcttccacaat

SEQ ID NO: 7264922 - DNA, 22 bp, Homo sapiens
attattcttatgtcatcatggc

SEQ ID NO: 7264923 - DNA, 22 bp, Homo sapiens
attacaagtagactaactttca

SEQ ID NO: 7264924 - DNA, 22 bp, Homo sapiens
gatgataagatggagttgaatt

SEQ ID NO: 7264925 - DNA, 22 bp, Homo sapiens
atttcagcagcccatgtttgga

SEQ ID NO: 7264926 - DNA, 22 bp, Homo sapiens
attggaaatacagtagaaaaat

SEQ ID NO: 7264927 - DNA, 22 bp, Homo sapiens
attggacactgtggatgactta

SEQ ID NO: 7264928 - DNA, 22 bp, Homo sapiens
attttttagaacctggcctgat

SEQ ID NO: 7264929 - DNA, 22 bp, Homo sapiens
gcctctctgggctgccgaggct

SEQ ID NO: 7264930 - DNA, 22 bp, Homo sapiens
gtatttctttccattatagtca

SEQ ID NO: 7264931 - DNA, 22 bp, Homo sapiens
cagccacttgtgatgctgggga

SEQ ID NO: 7264932 - DNA, 22 bp, Homo sapiens
cagccactggtgccaggctgtt

SEQ ID NO: 7264933 - DNA, 22 bp, Homo sapiens
cagccactgtggtctagctgca

SEQ ID NO: 7264934 - DNA, 22 bp, Homo sapiens
cagccacttcgagcttcctgat

SEQ ID NO: 7264935 - DNA, 22 bp, Homo sapiens
cagccactacaattggttccat

SEQ ID NO: 7264936 - DNA, 22 bp, Homo sapiens
cagccactctcagacagtccca

SEQ ID NO: 7264937 - DNA, 22 bp, Homo sapiens
cagccactgaactcctggctat

SEQ ID NO: 7264938 - DNA, 22 bp, Homo sapiens
gtatttggtctatttggcatcc

SEQ ID NO: 7264939 - DNA, 22 bp, Homo sapiens
gggaaagaagatctagatactg

SEQ ID NO: 7264940 - DNA, 22 bp, Homo sapiens
cacacccttgctaacacttgtt

SEQ ID NO: 7264941 - DNA, 22 bp, Homo sapiens
cacacatttcagatgctacaat

SEQ ID NO: 7264942 - DNA, 22 bp, Homo sapiens
caagattatcttcttcttgtta

SEQ ID NO: 7264943 - DNA, 22 bp, Homo sapiens
gctcctggagagattgagaaag

SEQ ID NO: 7264944 - DNA, 19 bp, Homo sapiens
gctcctggatgacctgtgg

SEQ ID NO: 7264945 - DNA, 22 bp, Homo sapiens
caaagtatatttcatagtctca

SEQ ID NO: 7264946 - DNA, 22 bp, Homo sapiens
ggcctcgcggcttctggtggct

SEQ ID NO: 7264947 - DNA, 22 bp, Homo sapiens
ggcctctcatgcccagagccaa

SEQ ID NO: 7264948 - DNA, 22 bp, Homo sapiens
ggcctctcatgtcctgggcttc

SEQ ID NO: 7264949 - DNA, 17 bp, Homo sapiens
cactgagaggtttgaga

SEQ ID NO: 7264950 - DNA, 22 bp, Homo sapiens
tcaccattggcaattataaaac

SEQ ID NO: 7264951 - DNA, 22 bp, Homo sapiens
tatttacttttaaattgagaac

SEQ ID NO: 7264952 - DNA, 22 bp, Homo sapiens
tattggacagtccagtgagaat

SEQ ID NO: 7264953 - DNA, 22 bp, Homo sapiens
catatcttctgacatgatcagg

SEQ ID NO: 7264954 - DNA, 22 bp, Homo sapiens
tctgaaatattggtaatacttt

SEQ ID NO: 7264955 - DNA, 22 bp, Homo sapiens
tctgaaataggaaagcaaatgg

SEQ ID NO: 7264956 - DNA, 22 bp, Homo sapiens
ccagctctaaacggctctgtgg

SEQ ID NO: 7264957 - DNA, 22 bp, Homo sapiens
ccagctctcagcgggagactca

SEQ ID NO: 7264958 - DNA, 22 bp, Homo sapiens
ccagctctagccccatgtggct

SEQ ID NO: 7264959 - DNA, 22 bp, Homo sapiens
ccactctgctgtgctccatgat

SEQ ID NO: 7264960 - DNA, 20 bp, Homo sapiens
catttagaaattggcatgga

SEQ ID NO: 7264961 - DNA, 22 bp, Homo sapiens
catttagacatttgatttgggg

SEQ ID NO: 7264962 - DNA, 22 bp, Homo sapiens
catttgaatgagattgctgtaa

SEQ ID NO: 7264963 - DNA, 22 bp, Homo sapiens
caggagacagtgttattttatt

SEQ ID NO: 7264964 - DNA, 22 bp, Homo sapiens
taaaaagttgaaaggacttatc

SEQ ID NO: 7264965 - DNA, 22 bp, Homo sapiens
gtttggtcatttgtaaaatgtg

SEQ ID NO: 7264966 - DNA, 22 bp, Homo sapiens
gtttggttccaaagcccattct

SEQ ID NO: 7264967 - DNA, 22 bp, Homo sapiens
gtttggttggctgtctttaaca

SEQ ID NO: 7264968 - DNA, 22 bp, Homo sapiens
taaatgtataggcactaaacct

SEQ ID NO: 7264969 - DNA, 22 bp, Homo sapiens
taactttgatcacttgataagg

SEQ ID NO: 7264970 - DNA, 22 bp, Homo sapiens
taactttatgacatgtcttgct

SEQ ID NO: 7264971 - DNA, 22 bp, Homo sapiens
taatttacagagatacagtcag

SEQ ID NO: 7264972 - DNA, 22 bp, Homo sapiens
taatttactcagatgttcaatc

SEQ ID NO: 7264973 - DNA, 22 bp, Homo sapiens
taatttacagttcgccatgtct

SEQ ID NO: 7264974 - DNA, 22 bp, Homo sapiens
taatttacttgcaaataacaat

SEQ ID NO: 7264975 - DNA, 22 bp, Homo sapiens
gttacagtgggtttggggccca

SEQ ID NO: 7264976 - DNA, 22 bp, Homo sapiens
gttacagtttgggcttgattca

SEQ ID NO: 7264977 - DNA, 22 bp, Homo sapiens
gttcacagcttcttaggtcata

SEQ ID NO: 7264978 - DNA, 22 bp, Homo sapiens
gttacagtcaggagatattttg

SEQ ID NO: 7264979 - DNA, 22 bp, Homo sapiens
gttacagtgagaagatagccta

SEQ ID NO: 7264980 - DNA, 22 bp, Homo sapiens
gttacagtgcatgtggcttctg

SEQ ID NO: 7264981 - DNA, 22 bp, Homo sapiens
gttacagtgcttggcaataagt

SEQ ID NO: 7264982 - DNA, 22 bp, Homo sapiens
gttcacagtctacatagtaaag

SEQ ID NO: 7264983 - DNA, 22 bp, Homo sapiens
gttgcttttttgataggtggaa

SEQ ID NO: 7264984 - DNA, 22 bp, Homo sapiens
gtttattccagcaatctgctta

SEQ ID NO: 7264985 - DNA, 22 bp, Homo sapiens
gtttattattcaacttcatgtt

SEQ ID NO: 7264986 - DNA, 22 bp, Homo sapiens
ctggagttagagtagacactga

SEQ ID NO: 7264987 - DNA, 22 bp, Homo sapiens
ctggaattatgaccaaaggtcc

SEQ ID NO: 7264988 - DNA, 22 bp, Homo sapiens
ctggaattgatagaagggagct

SEQ ID NO: 7264989 - DNA, 22 bp, Homo sapiens
ctggaatttttgtcgtggagta

SEQ ID NO: 7264990 - DNA, 22 bp, Homo sapiens
ctggaattgcataatatgtcct

SEQ ID NO: 7264991 - DNA, 22 bp, Homo sapiens
ctgaactatttggaatgaagat

SEQ ID NO: 7264992 - DNA, 22 bp, Homo sapiens
ctgaactatgtaaaagtaagct

SEQ ID NO: 7264993 - DNA, 22 bp, Homo sapiens
ctgaactaggattggaatgaga

SEQ ID NO: 7264994 - DNA, 22 bp, Homo sapiens
ctgaactatcctgcaactgcag

SEQ ID NO: 7264995 - DNA, 22 bp, Homo sapiens
ctgagaaatttattggttggaa

SEQ ID NO: 7264996 - DNA, 22 bp, Homo sapiens
tttttaagctcctttgatgtca

SEQ ID NO: 7264997 - DNA, 22 bp, Homo sapiens
ttttattctcagctccagagag

SEQ ID NO: 7264998 - DNA, 22 bp, Homo sapiens
ttttattctcaagacaatggga

SEQ ID NO: 7264999 - DNA, 22 bp, Homo sapiens
tttgtgaatgccttataagcat

SEQ ID NO: 7265000 - DNA, 22 bp, Homo sapiens
ttgataaaatgatgaaatcact

SEQ ID NO: 7265001 - DNA, 22 bp, Homo sapiens
ttgagaaacagattggcaccgt

SEQ ID NO: 7265002 - DNA, 22 bp, Homo sapiens
ttgacttttcttggtcacatga

SEQ ID NO: 7265003 - DNA, 22 bp, Homo sapiens
ttccatttggcacttcactgag

SEQ ID NO: 7265004 - DNA, 22 bp, Homo sapiens
ttgtatttgggtagtatagaga

SEQ ID NO: 7265005 - DNA, 22 bp, Homo sapiens
ttgtatttgattgtcatatcgt

SEQ ID NO: 7265006 - DNA, 22 bp, Homo sapiens
ttgtattttgttatgctactgc

SEQ ID NO: 7265007 - DNA, 22 bp, Homo sapiens
tttacagttccatgtgataggc

SEQ ID NO: 7265008 - DNA, 22 bp, Homo sapiens
tttacagttaagaaatgttacc

SEQ ID NO: 7265009 - DNA, 22 bp, Homo sapiens
ctcctggctcgcccccagctga

SEQ ID NO: 7265010 - DNA, 22 bp, Homo sapiens
cctctgtgatttctgagccaat

SEQ ID NO: 7265011 - DNA, 22 bp, Homo sapiens
cccaggctcctgctgtgttgac

SEQ ID NO: 7265012 - DNA, 22 bp, Homo sapiens
cccagctcaagcagagagctaa

SEQ ID NO: 7265013 - DNA, 22 bp, Homo sapiens
cccagctgatttttgcagagat

SEQ ID NO: 7265014 - DNA, 21 bp, Homo sapiens
cctctgtgctaaagggctccc

SEQ ID NO: 7265015 - DNA, 19 bp, Homo sapiens
cctggccctgctgcgcggg

SEQ ID NO: 7265016 - DNA, 22 bp, Homo sapiens
cctggcctgtgaatctgagagc

SEQ ID NO: 7265017 - DNA, 22 bp, Homo sapiens
cctggctccagctgcctgtcct

SEQ ID NO: 7265018 - DNA, 22 bp, Homo sapiens
tgtctcttggctctatcactta

SEQ ID NO: 7265019 - DNA, 22 bp, Homo sapiens
tgtctcttgagtttgttttaat

SEQ ID NO: 7265020 - DNA, 22 bp, Homo sapiens
tgtctcttactttgattcttgg

SEQ ID NO: 7265021 - DNA, 22 bp, Homo sapiens
tgtctcttcagcccatggcttc

SEQ ID NO: 7265022 - DNA, 22 bp, Homo sapiens
tgtctcttctgcctccagctgt

SEQ ID NO: 7265023 - DNA, 22 bp, Homo sapiens
tgtctctgtctcccaggttgtg

SEQ ID NO: 7265024 - DNA, 22 bp, Homo sapiens
tgtcattatttgcctactgact

SEQ ID NO: 7265025 - DNA, 22 bp, Homo sapiens
tgtctttatgcacactgacttg

SEQ ID NO: 7265026 - DNA, 22 bp, Homo sapiens
tgtctttatatatttggaaaat

SEQ ID NO: 7265027 - DNA, 22 bp, Homo sapiens
tgtctttagttttactgtctgg

SEQ ID NO: 7265028 - DNA, 22 bp, Homo sapiens
tgtctttagttgcttagatttg

SEQ ID NO: 7265029 - DNA, 22 bp, Homo sapiens
tgtctttacttaataaatatac

SEQ ID NO: 7265030 - DNA, 22 bp, Homo sapiens
gaattgtagagggaacagaagc

SEQ ID NO: 7265031 - DNA, 22 bp, Homo sapiens
gacttaatgcttcattacctta

SEQ ID NO: 7265032 - DNA, 22 bp, Homo sapiens
gactttattttaacggagattc

SEQ ID NO: 7265033 - DNA, 21 bp, Homo sapiens
ctttggtttctgacttgcata

SEQ ID NO: 7265034 - DNA, 22 bp, Homo sapiens
ctttggttcaggagtacctctc

SEQ ID NO: 7265035 - DNA, 22 bp, Homo sapiens
ctttggttctgtccttcccaga

SEQ ID NO: 7265036 - DNA, 21 bp, Homo sapiens
ctttggtttcctcctgccttc

SEQ ID NO: 7265037 - DNA, 22 bp, Homo sapiens
ctggctggtcatgtcatgagcc

SEQ ID NO: 7265038 - DNA, 22 bp, Homo sapiens
gataagcactatataagtattt

SEQ ID NO: 7265039 - DNA, 22 bp, Homo sapiens
gagtttatgtctttcattgttc

SEQ ID NO: 7265040 - DNA, 22 bp, Homo sapiens
gataacaatatgaagtagatat

SEQ ID NO: 7265041 - DNA, 22 bp, Homo sapiens
gatttggttgcaggaagtaatt

SEQ ID NO: 7265042 - DNA, 22 bp, Homo sapiens
gatttggtggctacatttgtaa

SEQ ID NO: 7265043 - DNA, 17 bp, Homo sapiens
gattagaaaacacatga

SEQ ID NO: 7265044 - DNA, 22 bp, Homo sapiens
gatttattgtccctgtcctgct

SEQ ID NO: 7265045 - DNA, 22 bp, Homo sapiens
gatttatagtatgtgctttcag

SEQ ID NO: 7265046 - DNA, 22 bp, Homo sapiens
gatgcgggcccgctccactgcc

SEQ ID NO: 7265047 - DNA, 22 bp, Homo sapiens
gatgctgtggggttgaccctgg

SEQ ID NO: 7265048 - DNA, 22 bp, Homo sapiens
gctcctgggtgtggctgcccct

SEQ ID NO: 7265049 - DNA, 19 bp, Homo sapiens
gctcctgggcctcactcat

SEQ ID NO: 7265050 - DNA, 22 bp, Homo sapiens
gctcctggcaggcagtgtgtgt

SEQ ID NO: 7265051 - DNA, 21 bp, Homo sapiens
ggctcctgctttgtgaggggc

SEQ ID NO: 7265052 - DNA, 22 bp, Homo sapiens
ggctcctgctgtcctttgaagc

SEQ ID NO: 7265053 - DNA, 22 bp, Homo sapiens
ggccttcctggcggctcagggt

SEQ ID NO: 7265054 - DNA, 22 bp, Homo sapiens
ggccttcctgctgctccgggcc

SEQ ID NO: 7265055 - DNA, 21 bp, Homo sapiens
ggccttcccctgcagtctccg

SEQ ID NO: 7265056 - DNA, 22 bp, Homo sapiens
ggctcctgggagatagaggtca

SEQ ID NO: 7265057 - DNA, 22 bp, Homo sapiens
ggctcctgggatgggactgagc

SEQ ID NO: 7265058 - DNA, 22 bp, Homo sapiens
ggctcctgttatttaatgagga

SEQ ID NO: 7265059 - DNA, 22 bp, Homo sapiens
ggaaagatgtaatattatctaa

SEQ ID NO: 7265060 - DNA, 19 bp, Homo sapiens
ggagaagcccaggaatcct

SEQ ID NO: 7265061 - DNA, 22 bp, Homo sapiens
ggagaagccaggtgataagcaa

SEQ ID NO: 7265062 - DNA, 22 bp, Homo sapiens
ggagaagccacacattgggtgt

SEQ ID NO: 7265063 - DNA, 19 bp, Homo sapiens
ggagaagcatctagaaata

SEQ ID NO: 7265064 - DNA, 22 bp, Homo sapiens
ggagaagcaggtgctttgggtc

SEQ ID NO: 7265065 - DNA, 17 bp, Homo sapiens
ggagacagggtctttaa

SEQ ID NO: 7265066 - DNA, 22 bp, Homo sapiens
gtggaattgctggataatatca

SEQ ID NO: 7265067 - DNA, 22 bp, Homo sapiens
gtggaattggatgtggggtttt

SEQ ID NO: 7265068 - DNA, 22 bp, Homo sapiens
gtggaatttttacctatgaatg

SEQ ID NO: 7265069 - DNA, 22 bp, Homo sapiens
gtggaattgatttttggaggac

SEQ ID NO: 7265070 - DNA, 22 bp, Homo sapiens
gtggaattgatgaggcacatta

SEQ ID NO: 7265071 - DNA, 22 bp, Homo sapiens
gtggaattcaaaatgtaggcat

SEQ ID NO: 7265072 - DNA, 22 bp, Homo sapiens
gtggaattaattcagttaatgc

SEQ ID NO: 7265073 - DNA, 22 bp, Homo sapiens
gtggaattagctgcctaggaaa

SEQ ID NO: 7265074 - DNA, 22 bp, Homo sapiens
gtggaattatgcatttcttcac

SEQ ID NO: 7265075 - DNA, 22 bp, Homo sapiens
gttgtattcttcaatatcagag

SEQ ID NO: 7265076 - DNA, 22 bp, Homo sapiens
gtttttgtcgagttccttgacc

SEQ ID NO: 7265077 - DNA, 22 bp, Homo sapiens
taaatccagcttctaatttaga

SEQ ID NO: 7265078 - DNA, 22 bp, Homo sapiens
tctctggcagggatatctggct

SEQ ID NO: 7265079 - DNA, 22 bp, Homo sapiens
tctaccatgtgctgtgcattgg

SEQ ID NO: 7265080 - DNA, 22 bp, Homo sapiens
tctatgtagtgccagctagtat

SEQ ID NO: 7265081 - DNA, 22 bp, Homo sapiens
tcctggccaagtagatgtggcg

SEQ ID NO: 7265082 - DNA, 22 bp, Homo sapiens
tcctggccctgtggcctgcagt

SEQ ID NO: 7265083 - DNA, 22 bp, Homo sapiens
tcctggcccactatgccagcat

SEQ ID NO: 7265084 - DNA, 22 bp, Homo sapiens
tcttcaatatgtgtttaatatt

SEQ ID NO: 7265085 - DNA, 22 bp, Homo sapiens
tcttcaatttagaatggattta

SEQ ID NO: 7265086 - DNA, 19 bp, Homo sapiens
tctttagccagagctctgg

SEQ ID NO: 7265087 - DNA, 19 bp, Homo sapiens
tctttagtcacatttttat

SEQ ID NO: 7265088 - DNA, 22 bp, Homo sapiens
tctttagacatccagtttctct

SEQ ID NO: 7265089 - DNA, 22 bp, Homo sapiens
tcttataatctctattttaatg

SEQ ID NO: 7265090 - DNA, 22 bp, Homo sapiens
tctggaattttattgatcaaaa

SEQ ID NO: 7265091 - DNA, 22 bp, Homo sapiens
tctggcccagcccctgaggtca

SEQ ID NO: 7265092 - DNA, 22 bp, Homo sapiens
tctggcccctggtctctggtgt

SEQ ID NO: 7265093 - DNA, 22 bp, Homo sapiens
tctggcccatgatcctgctaac

SEQ ID NO: 7265094 - DNA, 22 bp, Homo sapiens
tctgccctcattgctgcctgga

SEQ ID NO: 7265095 - DNA, 23 bp, Homo sapiens
tgattgaaatgaggagtatttgt

SEQ ID NO: 7265096 - DNA, 22 bp, Homo sapiens
tgatgctctcctaatatgaaaa

SEQ ID NO: 7265097 - DNA, 22 bp, Homo sapiens
tgatggaaacttgggtaagtca

SEQ ID NO: 7265098 - DNA, 22 bp, Homo sapiens
tgatggaagtgactgtcagttc

SEQ ID NO: 7265099 - DNA, 19 bp, Homo sapiens
tgatggaatttgacattcc

SEQ ID NO: 7265100 - DNA, 22 bp, Homo sapiens
tgatagcagcaaagacattttt

SEQ ID NO: 7265101 - DNA, 22 bp, Homo sapiens
tgagttatctaaaatagtcaaa

SEQ ID NO: 7265102 - DNA, 22 bp, Homo sapiens
tgcaaaaactgcaattgctttt

SEQ ID NO: 7265103 - DNA, 23 bp, Homo sapiens
tgcaaagaaatctgggtcattgt

SEQ ID NO: 7265104 - DNA, 22 bp, Homo sapiens
tgcacgtgggctctctgctctt

SEQ ID NO: 7265105 - DNA, 22 bp, Homo sapiens
tgcacatgtgcctgtggcacat

SEQ ID NO: 7265106 - DNA, 22 bp, Homo sapiens
tgcacattagtgtttgagatgc

SEQ ID NO: 7265107 - DNA, 22 bp, Homo sapiens
tgcacatggcctgagtgcctga

SEQ ID NO: 7265108 - DNA, 20 bp, Homo sapiens
tgcacatggcagccatctag

SEQ ID NO: 7265109 - DNA, 22 bp, Homo sapiens
tgcacatggcaatgctgctccc

SEQ ID NO: 7265110 - DNA, 17 bp, Homo sapiens
tgcatgtcctttgttcc

SEQ ID NO: 7265111 - DNA, 22 bp, Homo sapiens
tgcatttatttgaattgatcta

SEQ ID NO: 7265112 - DNA, 22 bp, Homo sapiens
tgcatttcagaagaaaattcgg

SEQ ID NO: 7265113 - DNA, 22 bp, Homo sapiens
tgcagggcttcctcttggagtt

SEQ ID NO: 7265114 - DNA, 22 bp, Homo sapiens
tgcagggccatggtggcggctg

SEQ ID NO: 7265115 - DNA, 22 bp, Homo sapiens
tgcagggccagactgggttgga

SEQ ID NO: 7265116 - DNA, 22 bp, Homo sapiens
tgcagggcagtttgtttcggca

SEQ ID NO: 7265117 - DNA, 22 bp, Homo sapiens
tgcagggctacaggactacaac

SEQ ID NO: 7265118 - DNA, 22 bp, Homo sapiens
tgcagggcccttggggttgaac

SEQ ID NO: 7265119 - DNA, 22 bp, Homo sapiens
tgcagggcagtggaggttgagt

SEQ ID NO: 7265120 - DNA, 22 bp, Homo sapiens
tgcagggcacacgcacgggtgt

SEQ ID NO: 7265121 - DNA, 22 bp, Homo sapiens
tgaaagatgctcaatgaatggt

SEQ ID NO: 7265122 - DNA, 22 bp, Homo sapiens
tgaactgagcagtttcctggga

SEQ ID NO: 7265123 - DNA, 22 bp, Homo sapiens
tgaagattttcgggtacttgat

SEQ ID NO: 7265124 - DNA, 22 bp, Homo sapiens
tgaagaatgttgcagtgagcat

SEQ ID NO: 7265125 - DNA, 22 bp, Homo sapiens
tcttttagagcatttctgattc

SEQ ID NO: 7265126 - DNA, 22 bp, Homo sapiens
tcttttagtaataaatatttgt

SEQ ID NO: 7265127 - DNA, 22 bp, Homo sapiens
tctttgtactttctggctgtcc

SEQ ID NO: 7265128 - DNA, 22 bp, Homo sapiens
tctttttttcctgtgcagagct

SEQ ID NO: 7265129 - DNA, 22 bp, Homo sapiens
tctttttatattgacaaaaggt

SEQ ID NO: 7265130 - DNA, 22 bp, Homo sapiens
tcttttgttgcctacttattaa

SEQ ID NO: 7265131 - DNA, 22 bp, Homo sapiens
tgacaggaaacatgcagtgatt

SEQ ID NO: 7265132 - DNA, 21 bp, Homo sapiens
tgactgaaatagaatttagct

SEQ ID NO: 7265133 - DNA, 22 bp, Homo sapiens
tgactcttaaatatactgttga

SEQ ID NO: 7265134 - DNA, 21 bp, Homo sapiens
tgacatttccaatataaagcc

SEQ ID NO: 7265135 - DNA, 22 bp, Homo sapiens
tgacatttcagatatggtattt

SEQ ID NO: 7265136 - DNA, 22 bp, Homo sapiens
tgacatttaagcctctgatttc

SEQ ID NO: 7265137 - DNA, 22 bp, Homo sapiens
tgacatttcggtgtatgtgatg

SEQ ID NO: 7265138 - DNA, 22 bp, Homo sapiens
tgacatttcttgttgatataaa

SEQ ID NO: 7265139 - DNA, 22 bp, Homo sapiens
tgacatttgagagagatataca

SEQ ID NO: 7265140 - DNA, 22 bp, Homo sapiens
tgaagttttctggttgattaag

SEQ ID NO: 7265141 - DNA, 22 bp, Homo sapiens
tgaagctagtattaactcagat

SEQ ID NO: 7265142 - DNA, 22 bp, Homo sapiens
tgaagctacaaaagattattgc

SEQ ID NO: 7265143 - DNA, 22 bp, Homo sapiens
tgacaattgttgtgaattcttc

SEQ ID NO: 7265144 - DNA, 22 bp, Homo sapiens
tgaattgggcctggaaactggt

SEQ ID NO: 7265145 - DNA, 23 bp, Homo sapiens
tgaggcaggcggatcacgaggtc

SEQ ID NO: 7265146 - DNA, 22 bp, Homo sapiens
tgaggcagggagagtggatatg

SEQ ID NO: 7265147 - DNA, 22 bp, Homo sapiens
tgaggcaggagaatggcgggaa

SEQ ID NO: 7265148 - DNA, 22 bp, Homo sapiens
tgaggcaggaggttgagaactg

SEQ ID NO: 7265149 - DNA, 22 bp, Homo sapiens
tgaggcaggaggattgcaggat

SEQ ID NO: 7265150 - DNA, 22 bp, Homo sapiens
tgaggcaggagttcaggctgcg

SEQ ID NO: 7265151 - DNA, 22 bp, Homo sapiens
tgaggcaggactgagcgggatg

SEQ ID NO: 7265152 - DNA, 22 bp, Homo sapiens
tgaggcaggacatggacaactg

SEQ ID NO: 7265153 - DNA, 22 bp, Homo sapiens
tgaggcaggaatggggaaaagt

SEQ ID NO: 7265154 - DNA, 22 bp, Homo sapiens
tgaggatggcagtgtgctcagc

SEQ ID NO: 7265155 - DNA, 22 bp, Homo sapiens
tgagacagcagtcagggaaata

SEQ ID NO: 7265156 - DNA, 22 bp, Homo sapiens
tgagaagctgctgacttagcct

SEQ ID NO: 7265157 - DNA, 22 bp, Homo sapiens
tgagaagctctgaaacagtatc

SEQ ID NO: 7265158 - DNA, 23 bp, Homo sapiens
tgagaagccgccgggcagcctgg

SEQ ID NO: 7265159 - DNA, 20 bp, Homo sapiens
tgagaagctcctgtctcctc

SEQ ID NO: 7265160 - DNA, 22 bp, Homo sapiens
tgagaagctgcttgtgctgtat

SEQ ID NO: 7265161 - DNA, 23 bp, Homo sapiens
tgagaagccattagagcaggtgg

SEQ ID NO: 7265162 - DNA, 23 bp, Homo sapiens
tgagaagccaggggagcgtgagg

SEQ ID NO: 7265163 - DNA, 22 bp, Homo sapiens
tgagaagcagtttcagtaagaa

SEQ ID NO: 7265164 - DNA, 22 bp, Homo sapiens
tgagaagcattaggaagaacat

SEQ ID NO: 7265165 - DNA, 22 bp, Homo sapiens
tgagaagcccaagccgggtggt

SEQ ID NO: 7265166 - DNA, 22 bp, Homo sapiens
tgagaagcccacactctttcct

SEQ ID NO: 7265167 - DNA, 22 bp, Homo sapiens
tgagaagcagcttacaggtgtc

SEQ ID NO: 7265168 - DNA, 22 bp, Homo sapiens
tgagaagcacagctcactcacg

SEQ ID NO: 7265169 - DNA, 22 bp, Homo sapiens
tgctatttctatctcatttaaa

SEQ ID NO: 7265170 - DNA, 22 bp, Homo sapiens
tgctatttggcacttttgacct

SEQ ID NO: 7265171 - DNA, 22 bp, Homo sapiens
tgctatttaacttttatgtgta

SEQ ID NO: 7265172 - DNA, 22 bp, Homo sapiens
tgcctgtgacccaaggatgcga

SEQ ID NO: 7265173 - DNA, 22 bp, Homo sapiens
tgctgtgaggttgagaaggaag

SEQ ID NO: 7265174 - DNA, 20 bp, Homo sapiens
tgctgggcatgcagtggaaa

SEQ ID NO: 7265175 - DNA, 22 bp, Homo sapiens
tgctgggccaaagcagggtttt

SEQ ID NO: 7265176 - DNA, 22 bp, Homo sapiens
tgctgggctagaagctgaggcc

SEQ ID NO: 7265177 - DNA, 21 bp, Homo sapiens
tgctgggctgcaggggatgca

SEQ ID NO: 7265178 - DNA, 22 bp, Homo sapiens
tggaaatttatcaagatataca

SEQ ID NO: 7265179 - DNA, 22 bp, Homo sapiens
tgctttataacttagtttatgg

SEQ ID NO: 7265180 - DNA, 22 bp, Homo sapiens
tggaatgatctgatgtatttta

SEQ ID NO: 7265181 - DNA, 22 bp, Homo sapiens
tggaaggggccaggcgcggagt

SEQ ID NO: 7265182 - DNA, 22 bp, Homo sapiens
tggagaaggggcagggtctcca

SEQ ID NO: 7265183 - DNA, 22 bp, Homo sapiens
tggcctctgaggcacctttgcc

SEQ ID NO: 7265184 - DNA, 22 bp, Homo sapiens
tggcctctgcactgggctcccc

SEQ ID NO: 7265185 - DNA, 22 bp, Homo sapiens
tggctattcttgttgctgtgtg

SEQ ID NO: 7265186 - DNA, 21 bp, Homo sapiens
tggctgagccaggtgtgtgga

SEQ ID NO: 7265187 - DNA, 20 bp, Homo sapiens
tggtgttatcctgaagaatt

SEQ ID NO: 7265188 - DNA, 20 bp, Homo sapiens
tgtacacagtactttacaat

SEQ ID NO: 7265189 - DNA, 19 bp, Homo sapiens
tgtacctgggtcatggtgc

SEQ ID NO: 7265190 - DNA, 22 bp, Homo sapiens
tgtacctttttctgtgcatgct

SEQ ID NO: 7265191 - DNA, 22 bp, Homo sapiens
tgtaccataggtctatcattct

SEQ ID NO: 7265192 - DNA, 22 bp, Homo sapiens
tgtaccatctcagcattcagga

SEQ ID NO: 7265193 - DNA, 22 bp, Homo sapiens
tgtacacatttttatgttaaca

SEQ ID NO: 7265194 - DNA, 22 bp, Homo sapiens
tgtacttgaacttgactgtaga

SEQ ID NO: 7265195 - DNA, 22 bp, Homo sapiens
tgtatttgagttatgaaagaga

SEQ ID NO: 7265196 - DNA, 22 bp, Homo sapiens
tgtatttttaggaatgcgctat

SEQ ID NO: 7265197 - DNA, 21 bp, Homo sapiens
tgtcacatgtggatggtattt

SEQ ID NO: 7265198 - DNA, 22 bp, Homo sapiens
tgggtgaagaggctatgctact

SEQ ID NO: 7265199 - DNA, 22 bp, Homo sapiens
tgggtgaatgcatttgttcctg

SEQ ID NO: 7265200 - DNA, 22 bp, Homo sapiens
tggtatttgtcattcgagttct

SEQ ID NO: 7265201 - DNA, 22 bp, Homo sapiens
tgggcctcctttccattcagag

SEQ ID NO: 7265202 - DNA, 22 bp, Homo sapiens
tgggcctctgtttcctcatctg

SEQ ID NO: 7265203 - DNA, 22 bp, Homo sapiens
tgggcctcatcttcaatgagtc

SEQ ID NO: 7265204 - DNA, 22 bp, Homo sapiens
tgggcctcccatgtcttaggga

SEQ ID NO: 7265205 - DNA, 22 bp, Homo sapiens
tgggcctcaccttcttggcagc

SEQ ID NO: 7265206 - DNA, 22 bp, Homo sapiens
tgggcgacagagcaagactccg

SEQ ID NO: 7265207 - DNA, 22 bp, Homo sapiens
tgggctgaaatgctgtggacta

SEQ ID NO: 7265208 - DNA, 22 bp, Homo sapiens
tgtgaaatattggcaatttcat

SEQ ID NO: 7265209 - DNA, 22 bp, Homo sapiens
tgtgaaatatttatatactcaa

SEQ ID NO: 7265210 - DNA, 22 bp, Homo sapiens
tgtgaaatcacaggctatttag

SEQ ID NO: 7265211 - DNA, 22 bp, Homo sapiens
tgtgaaatgtgtgtataattaa

SEQ ID NO: 7265212 - DNA, 22 bp, Homo sapiens
tgtgaaatgaagataattcttg

SEQ ID NO: 7265213 - DNA, 23 bp, Homo sapiens
tgtgacagtgacaatactgactt

SEQ ID NO: 7265214 - DNA, 22 bp, Homo sapiens
tgtgagacaattgcatcagggc

SEQ ID NO: 7265215 - DNA, 22 bp, Homo sapiens
tgtcttttggagcatctttctt

SEQ ID NO: 7265216 - DNA, 22 bp, Homo sapiens
tgtctttaattctacatatctc

SEQ ID NO: 7265217 - DNA, 22 bp, Homo sapiens
tgtcttttacctaatgagctgg

SEQ ID NO: 7265218 - DNA, 22 bp, Homo sapiens
tgtctgctaaattactattaca

SEQ ID NO: 7265219 - DNA, 22 bp, Homo sapiens
ttaaaattatggcccatttgga

SEQ ID NO: 7265220 - DNA, 22 bp, Homo sapiens
tgttttatgagccatataacct

SEQ ID NO: 7265221 - DNA, 22 bp, Homo sapiens
tgttttatcaagatggcatgtc

SEQ ID NO: 7265222 - DNA, 22 bp, Homo sapiens
tgtttcaaaacagtgataattt

SEQ ID NO: 7265223 - DNA, 22 bp, Homo sapiens
tgtttcaaagaaagaaaatata

SEQ ID NO: 7265224 - DNA, 19 bp, Homo sapiens
tgttgaagattatttgtgg

SEQ ID NO: 7265225 - DNA, 22 bp, Homo sapiens
tgtggaattgacatggtaaaca

SEQ ID NO: 7265226 - DNA, 22 bp, Homo sapiens
ttatttgacttcttgctatgct

SEQ ID NO: 7265227 - DNA, 22 bp, Homo sapiens
ttagataacagtagaatatcaa

SEQ ID NO: 7265228 - DNA, 22 bp, Homo sapiens
ttagataatgtagagatatgag

SEQ ID NO: 7265229 - DNA, 22 bp, Homo sapiens
ttattcttggatctgagtctct

SEQ ID NO: 7265230 - DNA, 22 bp, Homo sapiens
ttaaagcactaaatgatgaggg

SEQ ID NO: 7265231 - DNA, 22 bp, Homo sapiens
ttacatgactgcccttgtcagg

SEQ ID NO: 7265232 - DNA, 22 bp, Homo sapiens
ttacattagacccactttcatg

SEQ ID NO: 7265233 - DNA, 22 bp, Homo sapiens
ttacatgtttacggatacactt

SEQ ID NO: 7265234 - DNA, 22 bp, Homo sapiens
ttacatgttctcatacacagag

SEQ ID NO: 7265235 - DNA, 22 bp, Homo sapiens
acagaactgggggcacagatag

SEQ ID NO: 7265236 - DNA, 22 bp, Homo sapiens
acagtgctgtcaaatatgtttt

SEQ ID NO: 7265237 - DNA, 22 bp, Homo sapiens
acattacctggcatttgatctt

SEQ ID NO: 7265238 - DNA, 22 bp, Homo sapiens
acattacttaccttgggttcta

SEQ ID NO: 7265239 - DNA, 22 bp, Homo sapiens
acatacattgcctcattggtaa

SEQ ID NO: 7265240 - DNA, 22 bp, Homo sapiens
aatatgcaaagcgtgttatctg

SEQ ID NO: 7265241 - DNA, 22 bp, Homo sapiens
aatatgcaagcttccaggtaga

SEQ ID NO: 7265242 - DNA, 22 bp, Homo sapiens
aatatgcagcttatcttctagg

SEQ ID NO: 7265243 - DNA, 22 bp, Homo sapiens
aatattatcaaaagctttttca

SEQ ID NO: 7265244 - DNA, 22 bp, Homo sapiens
aatattcatttgcagaagaagt

SEQ ID NO: 7265245 - DNA, 22 bp, Homo sapiens
acttatttattcattcagctca

SEQ ID NO: 7265246 - DNA, 22 bp, Homo sapiens
actgactatgtgactttaggca

SEQ ID NO: 7265247 - DNA, 22 bp, Homo sapiens
aagttttattggctatagcact

SEQ ID NO: 7265248 - DNA, 22 bp, Homo sapiens
acagaagcagccgtcacagata

SEQ ID NO: 7265249 - DNA, 22 bp, Homo sapiens
aagcaaaaggttacacttctgg

SEQ ID NO: 7265250 - DNA, 22 bp, Homo sapiens
aagacattgtggagatgttgct

SEQ ID NO: 7265251 - DNA, 22 bp, Homo sapiens
aagacattttgaaattggaagc

SEQ ID NO: 7265252 - DNA, 22 bp, Homo sapiens
aagacattggcattgactgtaa

SEQ ID NO: 7265253 - DNA, 22 bp, Homo sapiens
aattatttaactcctttggaga

SEQ ID NO: 7265254 - DNA, 22 bp, Homo sapiens
aatgtctttctcataacagata

SEQ ID NO: 7265255 - DNA, 22 bp, Homo sapiens
aatgtctttctgttctatgaga

SEQ ID NO: 7265256 - DNA, 22 bp, Homo sapiens
aatgtctttaaagtgcaataga

SEQ ID NO: 7265257 - DNA, 22 bp, Homo sapiens
aagtatttctggcctgtgaaag

SEQ ID NO: 7265258 - DNA, 22 bp, Homo sapiens
aagttctttcatatcttaatta

SEQ ID NO: 7265259 - DNA, 22 bp, Homo sapiens
aataaacaaatccttccttccc

SEQ ID NO: 7265260 - DNA, 22 bp, Homo sapiens
aactgagacacgaactatgatt

SEQ ID NO: 7265261 - DNA, 22 bp, Homo sapiens
aactgactcccatgattaggtc

SEQ ID NO: 7265262 - DNA, 22 bp, Homo sapiens
aacacatgggtgtttattgtac

SEQ ID NO: 7265263 - DNA, 22 bp, Homo sapiens
aactttggtcagagaaattgtg

SEQ ID NO: 7265264 - DNA, 22 bp, Homo sapiens
aaatatcatttataacttttaa

SEQ ID NO: 7265265 - DNA, 22 bp, Homo sapiens
aaacatttttctaggtcttggt

SEQ ID NO: 7265266 - DNA, 22 bp, Homo sapiens
aaaaagagaaatgctctagtcc

SEQ ID NO: 7265267 - DNA, 22 bp, Homo sapiens
aaacaaatagtgcatgggaatt

SEQ ID NO: 7265268 - DNA, 22 bp, Homo sapiens
aaacaaatttcaagctgtgaca

SEQ ID NO: 7265269 - DNA, 22 bp, Homo sapiens
agctgggaggctcctctgtgac

SEQ ID NO: 7265270 - DNA, 23 bp, Homo sapiens
acatacataagcaccacattttg

SEQ ID NO: 7265271 - DNA, 22 bp, Homo sapiens
acatacatatgacaactttcct

SEQ ID NO: 7265272 - DNA, 22 bp, Homo sapiens
acatacatgggattaaaaaatt

SEQ ID NO: 7265273 - DNA, 22 bp, Homo sapiens
acatacatggtgctttcttggt

SEQ ID NO: 7265274 - DNA, 23 bp, Homo sapiens
acttttcaattagctatgcttaa

SEQ ID NO: 7265275 - DNA, 22 bp, Homo sapiens
atagatattagcaaaattttat

SEQ ID NO: 7265276 - DNA, 22 bp, Homo sapiens
actttggacgccatgctgtttg

SEQ ID NO: 7265277 - DNA, 22 bp, Homo sapiens
actttggacaatttattactgt

SEQ ID NO: 7265278 - DNA, 22 bp, Homo sapiens
atacaaagacaaatctcaatct

SEQ ID NO: 7265279 - DNA, 23 bp, Homo sapiens
agtttttaatggtcatagctgag

SEQ ID NO: 7265280 - DNA, 21 bp, Homo sapiens
agttttatattataagctaaa

SEQ ID NO: 7265281 - DNA, 21 bp, Homo sapiens
atatttttgtttggactgtca

SEQ ID NO: 7265282 - DNA, 22 bp, Homo sapiens
atatttttccatgtgggactct

SEQ ID NO: 7265283 - DNA, 22 bp, Homo sapiens
agaaagccaatctgtaaagtct

SEQ ID NO: 7265284 - DNA, 22 bp, Homo sapiens
actgaattttaattagatctgc

SEQ ID NO: 7265285 - DNA, 22 bp, Homo sapiens
agtaccatcatttagatgtgtt

SEQ ID NO: 7265286 - DNA, 21 bp, Homo sapiens
agactttgcttgcagagagtc

SEQ ID NO: 7265287 - DNA, 22 bp, Homo sapiens
atgccaaaatgttacatttctt

SEQ ID NO: 7265288 - DNA, 22 bp, Homo sapiens
atgaagcttgaggtgagagctg

SEQ ID NO: 7265289 - DNA, 22 bp, Homo sapiens
atgaagtaggactgaacttggg

SEQ ID NO: 7265290 - DNA, 22 bp, Homo sapiens
attttcaagggagaggcctctg

SEQ ID NO: 7265291 - DNA, 22 bp, Homo sapiens
attttcaccctgaatatattga

SEQ ID NO: 7265292 - DNA, 22 bp, Homo sapiens
attacagtaaatgctacaggca

SEQ ID NO: 7265293 - DNA, 22 bp, Homo sapiens
attacagtaacagctacaatgc

SEQ ID NO: 7265294 - DNA, 22 bp, Homo sapiens
caataattgctttccagagtta

SEQ ID NO: 7265295 - DNA, 22 bp, Homo sapiens
caataatttacattggatacca

SEQ ID NO: 7265296 - DNA, 20 bp, Homo sapiens
caataatttacttccctatt

SEQ ID NO: 7265297 - DNA, 23 bp, Homo sapiens
caccactttctccttctccttgg

SEQ ID NO: 7265298 - DNA, 22 bp, Homo sapiens
agctcctgggccaagcccatgc

SEQ ID NO: 7265299 - DNA, 22 bp, Homo sapiens
agccagctaagggaagcatgat

SEQ ID NO: 7265300 - DNA, 22 bp, Homo sapiens
cactttatatgcattacctcat

SEQ ID NO: 7265301 - DNA, 22 bp, Homo sapiens
cactttattataaatttgagag

SEQ ID NO: 7265302 - DNA, 22 bp, Homo sapiens
ccagctcttttggctgagtgag

SEQ ID NO: 7265303 - DNA, 22 bp, Homo sapiens
ccagctctggcttcttgctggg

SEQ ID NO: 7265304 - DNA, 22 bp, Homo sapiens
ccatttgaaatgaatgttttta

SEQ ID NO: 7265305 - DNA, 22 bp, Homo sapiens
aggatgacatgaagtggtgttc

SEQ ID NO: 7265306 - DNA, 22 bp, Homo sapiens
cagggttgcatgcatctgtggg

SEQ ID NO: 7265307 - DNA, 22 bp, Homo sapiens
agctgggactcaactgtctggg

SEQ ID NO: 7265308 - DNA, 22 bp, Homo sapiens
agctgaaacttcccattaattg

SEQ ID NO: 7265309 - DNA, 22 bp, Homo sapiens
agctcttttgctctccaagttt

SEQ ID NO: 7265310 - DNA, 22 bp, Homo sapiens
agtagcttggccctttgttctt

SEQ ID NO: 7265311 - DNA, 22 bp, Homo sapiens
agtctttattgtcgtcactaga

SEQ ID NO: 7265312 - DNA, 22 bp, Homo sapiens
agtctttatacagaaatatatg

SEQ ID NO: 7265313 - DNA, 22 bp, Homo sapiens
agtctttatgattgtcaaagta

SEQ ID NO: 7265314 - DNA, 22 bp, Homo sapiens
agtctattttagctgcatatgt

SEQ ID NO: 7265315 - DNA, 22 bp, Homo sapiens
agtctatattgtgaaagtaaaa

SEQ ID NO: 7265316 - DNA, 22 bp, Homo sapiens
agtgcttttatatcattaatcc

SEQ ID NO: 7265317 - DNA, 22 bp, Homo sapiens
cttaacaagcccaactttcatt

SEQ ID NO: 7265318 - DNA, 22 bp, Homo sapiens
atcagcacaacgtacagagaaa

SEQ ID NO: 7265319 - DNA, 22 bp, Homo sapiens
atattattctagtaacagtgat

SEQ ID NO: 7265320 - DNA, 22 bp, Homo sapiens
atattcaaattacatttactaa

SEQ ID NO: 7265321 - DNA, 22 bp, Homo sapiens
ctggccttgttcctccccaagt

SEQ ID NO: 7265322 - DNA, 22 bp, Homo sapiens
ctggccttcagactcggactga

SEQ ID NO: 7265323 - DNA, 22 bp, Homo sapiens
ctggcctttagccccagtgtct

SEQ ID NO: 7265324 - DNA, 22 bp, Homo sapiens
ctggcctttcgtgagagctggg

SEQ ID NO: 7265325 - DNA, 22 bp, Homo sapiens
atatacttggagactatcattg

SEQ ID NO: 7265326 - DNA, 22 bp, Homo sapiens
atatacttccccattatggggg

SEQ ID NO: 7265327 - DNA, 22 bp, Homo sapiens
atacatgtaactgcattgtaat

SEQ ID NO: 7265328 - DNA, 22 bp, Homo sapiens
atacatgtacataaatgtagca

SEQ ID NO: 7265329 - DNA, 22 bp, Homo sapiens
atacatgtgggtctaaacatat

SEQ ID NO: 7265330 - DNA, 22 bp, Homo sapiens
atacatgtgtccctgatttatt

SEQ ID NO: 7265331 - DNA, 22 bp, Homo sapiens
atacatgtgtgagcgaagatgt

SEQ ID NO: 7265332 - DNA, 22 bp, Homo sapiens
ctggccctatgagcctcctgat

SEQ ID NO: 7265333 - DNA, 22 bp, Homo sapiens
ctggcctcacagaggctaagcc

SEQ ID NO: 7265334 - DNA, 22 bp, Homo sapiens
ctggcctcagagggtcatggtg

SEQ ID NO: 7265335 - DNA, 22 bp, Homo sapiens
ctggcctcatagccaagctgtg

SEQ ID NO: 7265336 - DNA, 22 bp, Homo sapiens
ctgctgggcctggtctctgagg

SEQ ID NO: 7265337 - DNA, 22 bp, Homo sapiens
ctgctgggctcctcatgtgact

SEQ ID NO: 7265338 - DNA, 22 bp, Homo sapiens
ctgctggggaggcgcctcgacg

SEQ ID NO: 7265339 - DNA, 22 bp, Homo sapiens
atacacatgcacacatgtgtgt

SEQ ID NO: 7265340 - DNA, 22 bp, Homo sapiens
gctatttttgagccatttataa

SEQ ID NO: 7265341 - DNA, 18 bp, Homo sapiens
attttgaactgggaatat

SEQ ID NO: 7265342 - DNA, 17 bp, Homo sapiens
atttacattgtcaccga

SEQ ID NO: 7265343 - DNA, 22 bp, Homo sapiens
gcaactgaacatgtgtgtggcc

SEQ ID NO: 7265344 - DNA, 22 bp, Homo sapiens
gcactggtttatttaagaacaa

SEQ ID NO: 7265345 - DNA, 22 bp, Homo sapiens
attgttgacttgattactcaac

SEQ ID NO: 7265346 - DNA, 22 bp, Homo sapiens
gcaggctgtggtatgttgggca

SEQ ID NO: 7265347 - DNA, 22 bp, Homo sapiens
gcagggctgggatttgagccca

SEQ ID NO: 7265348 - DNA, 22 bp, Homo sapiens
gatctgaagagcaatgaaatat

SEQ ID NO: 7265349 - DNA, 22 bp, Homo sapiens
gatctgaagatatgaaatattt

SEQ ID NO: 7265350 - DNA, 22 bp, Homo sapiens
atgtttccttatagataaaagc

SEQ ID NO: 7265351 - DNA, 22 bp, Homo sapiens
atgtttcaagagaaaaagagac

SEQ ID NO: 7265352 - DNA, 22 bp, Homo sapiens
atgcttttccaggagaaatata

SEQ ID NO: 7265353 - DNA, 22 bp, Homo sapiens
gactttggattcattatctgga

SEQ ID NO: 7265354 - DNA, 22 bp, Homo sapiens
gaaaatagttcatcacaatgat

SEQ ID NO: 7265355 - DNA, 22 bp, Homo sapiens
gaaaataggctgcatctccttc

SEQ ID NO: 7265356 - DNA, 22 bp, Homo sapiens
gaaatctacttagtgtctggat

SEQ ID NO: 7265357 - DNA, 22 bp, Homo sapiens
gtctcttagtcaatattttctg

SEQ ID NO: 7265358 - DNA, 22 bp, Homo sapiens
gtctcttagtctcattttctgc

SEQ ID NO: 7265359 - DNA, 22 bp, Homo sapiens
gtcttagatttcaccgataatg

SEQ ID NO: 7265360 - DNA, 22 bp, Homo sapiens
gtctcttagaatcgcatattgt

SEQ ID NO: 7265361 - DNA, 22 bp, Homo sapiens
tcataagtggtttatatgcttg

SEQ ID NO: 7265362 - DNA, 22 bp, Homo sapiens
tcacttaaaaattctagttatg

SEQ ID NO: 7265363 - DNA, 22 bp, Homo sapiens
catgtacaaggatgctcagagt

SEQ ID NO: 7265364 - DNA, 22 bp, Homo sapiens
catgtacatgcctactatcaat

SEQ ID NO: 7265365 - DNA, 22 bp, Homo sapiens
tcctggccttagcgaggcggtc

SEQ ID NO: 7265366 - DNA, 22 bp, Homo sapiens
cattttcagcacccatctgaaa

SEQ ID NO: 7265367 - DNA, 22 bp, Homo sapiens
tccagtttctctcaatcaatta

SEQ ID NO: 7265368 - DNA, 19 bp, Homo sapiens
tccagtttggcaggaagac

SEQ ID NO: 7265369 - DNA, 18 bp, Homo sapiens
tatattctgtgccctggt

SEQ ID NO: 7265370 - DNA, 22 bp, Homo sapiens
tcaaaggagtttaagttactgg

SEQ ID NO: 7265371 - DNA, 22 bp, Homo sapiens
cagtctgggactgagctccacc

SEQ ID NO: 7265372 - DNA, 22 bp, Homo sapiens
cctcctggcttttcccattgaa

SEQ ID NO: 7265373 - DNA, 22 bp, Homo sapiens
tggcatttgtagccacttgcct

SEQ ID NO: 7265374 - DNA, 22 bp, Homo sapiens
tgggctcctcgtcactcgctgt

SEQ ID NO: 7265375 - DNA, 22 bp, Homo sapiens
tgggctccagcacctgtgctct

SEQ ID NO: 7265376 - DNA, 22 bp, Homo sapiens
tgagtttaatgatatttatatg

SEQ ID NO: 7265377 - DNA, 22 bp, Homo sapiens
tgaaacaattagaatgtaatga

SEQ ID NO: 7265378 - DNA, 22 bp, Homo sapiens
tcttttgtggatgaagaaatgg

SEQ ID NO: 7265379 - DNA, 22 bp, Homo sapiens
tctttggtttctgtctctgtaa

SEQ ID NO: 7265380 - DNA, 22 bp, Homo sapiens
tctttggtttctgtctctgtaa

SEQ ID NO: 7265381 - DNA, 22 bp, Homo sapiens
tcttttgtagctaacacattca

SEQ ID NO: 7265382 - DNA, 22 bp, Homo sapiens
tcttaattgagaacagtgtagg

SEQ ID NO: 7265383 - DNA, 22 bp, Homo sapiens
ttctctttttgcatctcaacct

SEQ ID NO: 7265384 - DNA, 20 bp, Homo sapiens
ctcacttacctttttctata

SEQ ID NO: 7265385 - DNA, 22 bp, Homo sapiens
ctcacttagcaggttaatatca

SEQ ID NO: 7265386 - DNA, 23 bp, Homo sapiens
ttgaagttctgctgtgttatagg

SEQ ID NO: 7265387 - DNA, 22 bp, Homo sapiens
ttgaagttgcacattataattt

SEQ ID NO: 7265388 - DNA, 22 bp, Homo sapiens
ttgaagttctgcatttctaata

SEQ ID NO: 7265389 - DNA, 23 bp, Homo sapiens
ttgcactgatcaatttgataagc

SEQ ID NO: 7265390 - DNA, 22 bp, Homo sapiens
ttgcacagcaacgtgaatgtac

SEQ ID NO: 7265391 - DNA, 22 bp, Homo sapiens
tgttgcacacataggagtgatc

SEQ ID NO: 7265392 - DNA, 22 bp, Homo sapiens
tgttggaattaggatacagagg

SEQ ID NO: 7265393 - DNA, 22 bp, Homo sapiens
ttaaaatagccagtgcccctct

SEQ ID NO: 7265394 - DNA, 22 bp, Homo sapiens
ttaatatgttgaaatttattag

SEQ ID NO: 7265395 - DNA, 22 bp, Homo sapiens
ttacaagtttctggcttcatcc

SEQ ID NO: 7265396 - DNA, 22 bp, Homo sapiens
ttattattgtgacctgagaatg

SEQ ID NO: 7265397 - DNA, 22 bp, Homo sapiens
ttattattgtggttgcattatc

SEQ ID NO: 7265398 - DNA, 22 bp, Homo sapiens
ttattattttgtgtacagcaaa

SEQ ID NO: 7265399 - DNA, 22 bp, Homo sapiens
ttatttttaaaagttcacacag

SEQ ID NO: 7265400 - DNA, 17 bp, Homo sapiens
ttattttttgggctgag

SEQ ID NO: 7265401 - DNA, 21 bp, Homo sapiens
ttactaaacaaaacatgcagg

SEQ ID NO: 7265402 - DNA, 22 bp, Homo sapiens
ccttggtgctctgctgggatgg

SEQ ID NO: 7265403 - DNA, 22 bp, Homo sapiens
ccttggtgatctgggctggaag

SEQ ID NO: 7265404 - DNA, 22 bp, Homo sapiens
ctctctggatatttgtatgctg

SEQ ID NO: 7265405 - DNA, 22 bp, Homo sapiens
ctctctggcacttcattgctgt

SEQ ID NO: 7265406 - DNA, 22 bp, Homo sapiens
ctctctggcccatcctgttgcc

SEQ ID NO: 7265407 - DNA, 20 bp, Homo sapiens
ctgagatatgaggcctttgg

SEQ ID NO: 7265408 - DNA, 20 bp, Homo sapiens
cttagctagtaagaagctgt

SEQ ID NO: 7265409 - DNA, 22 bp, Homo sapiens
cttacagtgttgagggaattaa

SEQ ID NO: 7265410 - DNA, 22 bp, Homo sapiens
cttacagtgaccctgcagattt

SEQ ID NO: 7265411 - DNA, 22 bp, Homo sapiens
cttacagtgatcaacacaaaga

SEQ ID NO: 7265412 - DNA, 22 bp, Homo sapiens
cttacagtacttctaatatgat

SEQ ID NO: 7265413 - DNA, 22 bp, Homo sapiens
ctgggccttgcatcccagagcc

SEQ ID NO: 7265414 - DNA, 22 bp, Homo sapiens
gaatatttgtaattactgttga

SEQ ID NO: 7265415 - DNA, 22 bp, Homo sapiens
gaatattttcagtacagatggt

SEQ ID NO: 7265416 - DNA, 22 bp, Homo sapiens
gaagggcttggctgggaggcca

SEQ ID NO: 7265417 - DNA, 22 bp, Homo sapiens
gacatttagctgttttgcattt

SEQ ID NO: 7265418 - DNA, 22 bp, Homo sapiens
gagcatttttgtctgcatttta

SEQ ID NO: 7265419 - DNA, 22 bp, Homo sapiens
gagcatttggttatagtaattt

SEQ ID NO: 7265420 - DNA, 23 bp, Homo sapiens
gcactggaaaaatgaagattact

SEQ ID NO: 7265421 - DNA, 22 bp, Homo sapiens
gcagggctagatatttgcaagt

SEQ ID NO: 7265422 - DNA, 22 bp, Homo sapiens
gcagggctaggtcttctagggc

SEQ ID NO: 7265423 - DNA, 22 bp, Homo sapiens
gcagggctattggaaggagatg

SEQ ID NO: 7265424 - DNA, 22 bp, Homo sapiens
gcagggctaatggggcaagtag

SEQ ID NO: 7265425 - DNA, 22 bp, Homo sapiens
gccaagctcaccttctgatgga

SEQ ID NO: 7265426 - DNA, 22 bp, Homo sapiens
gcattttgaggctgggggagca

SEQ ID NO: 7265427 - DNA, 19 bp, Homo sapiens
gcatttctctttacagcca

SEQ ID NO: 7265428 - DNA, 22 bp, Homo sapiens
gcagggctcaacaggacacccc

SEQ ID NO: 7265429 - DNA, 22 bp, Homo sapiens
gcagggctcattgccaggcatt

SEQ ID NO: 7265430 - DNA, 22 bp, Homo sapiens
gcagggctccactgtggccaag

SEQ ID NO: 7265431 - DNA, 22 bp, Homo sapiens
gcagggctctgctgtagtccta

SEQ ID NO: 7265432 - DNA, 22 bp, Homo sapiens
gctctcagggtgatggcatact

SEQ ID NO: 7265433 - DNA, 22 bp, Homo sapiens
gctcctggtgctgtagagattt

SEQ ID NO: 7265434 - DNA, 22 bp, Homo sapiens
gcttcctggaacaactgttgct

SEQ ID NO: 7265435 - DNA, 22 bp, Homo sapiens
ggctcctgaggaccaggcacag

SEQ ID NO: 7265436 - DNA, 22 bp, Homo sapiens
ggctcctgagaatgggccatca

SEQ ID NO: 7265437 - DNA, 22 bp, Homo sapiens
ggctgagggttaagatcagaca

SEQ ID NO: 7265438 - DNA, 18 bp, Homo sapiens
ggctgaggttgactagaa

SEQ ID NO: 7265439 - DNA, 22 bp, Homo sapiens
gtaaatgtgcttcttttaactt

SEQ ID NO: 7265440 - DNA, 22 bp, Homo sapiens
gtaaatgtgaatgtcatttagc

SEQ ID NO: 7265441 - DNA, 22 bp, Homo sapiens
gtcaacttgcaagatgctgggc

SEQ ID NO: 7265442 - DNA, 22 bp, Homo sapiens
gtcttatagtacaatttgaagt

SEQ ID NO: 7265443 - DNA, 22 bp, Homo sapiens
gtcttatagtacaatttgaagt

SEQ ID NO: 7265444 - DNA, 22 bp, Homo sapiens
gtcttcaacaataactaccact

SEQ ID NO: 7265445 - DNA, 22 bp, Homo sapiens
tagaataagttgatgatatatg

SEQ ID NO: 7265446 - DNA, 22 bp, Homo sapiens
tagcaccaaaactgaagaacat

SEQ ID NO: 7265447 - DNA, 22 bp, Homo sapiens
tagcaccaaacatatactcagt

SEQ ID NO: 7265448 - DNA, 22 bp, Homo sapiens
tagcaccaatatgtgcttttca

SEQ ID NO: 7265449 - DNA, 22 bp, Homo sapiens
tagcacatgccgggagtgatct

SEQ ID NO: 7265450 - DNA, 22 bp, Homo sapiens
tagcaccatgatggaagagctg

SEQ ID NO: 7265451 - DNA, 22 bp, Homo sapiens
tagcaccatttaaacatctctg

SEQ ID NO: 7265452 - DNA, 22 bp, Homo sapiens
tagcaccacaatcaagatacag

SEQ ID NO: 7265453 - DNA, 22 bp, Homo sapiens
tagcaccactggtgggaaaaac

SEQ ID NO: 7265454 - DNA, 22 bp, Homo sapiens
tagcaccacttcatgctttcag

SEQ ID NO: 7265455 - DNA, 22 bp, Homo sapiens
tagcaccaggaaggtttaggat

SEQ ID NO: 7265456 - DNA, 22 bp, Homo sapiens
tagcaccatacccggcagctcg

SEQ ID NO: 7265457 - DNA, 22 bp, Homo sapiens
tagcacgtgtacacacagcatg

SEQ ID NO: 7265458 - DNA, 22 bp, Homo sapiens
tagtgtctagtgagtttgatgc

SEQ ID NO: 7265459 - DNA, 22 bp, Homo sapiens
tatattataagccctttcagaa

SEQ ID NO: 7265460 - DNA, 22 bp, Homo sapiens
tatattatcataaaaccattca

SEQ ID NO: 7265461 - DNA, 22 bp, Homo sapiens
tatcaatatctcagtgtgcttc

SEQ ID NO: 7265462 - DNA, 22 bp, Homo sapiens
tatgcattatacattaatttct

SEQ ID NO: 7265463 - DNA, 22 bp, Homo sapiens
tatgctctgagacctttgtgca

SEQ ID NO: 7265464 - DNA, 22 bp, Homo sapiens
tatgctttaacattaaacaaca

SEQ ID NO: 7265465 - DNA, 22 bp, Homo sapiens
tattgtatcttaccacatgtat

SEQ ID NO: 7265466 - DNA, 22 bp, Homo sapiens
tattgcatctcttcatatctgt

SEQ ID NO: 7265467 - DNA, 22 bp, Homo sapiens
tattgcacaatgagctgtgtat

SEQ ID NO: 7265468 - DNA, 22 bp, Homo sapiens
tatttctaagctgtaagtctga

SEQ ID NO: 7265469 - DNA, 22 bp, Homo sapiens
tatttggtatcagtgacagctg

SEQ ID NO: 7265470 - DNA, 22 bp, Homo sapiens
tatttggtggctgattatcttt

SEQ ID NO: 7265471 - DNA, 22 bp, Homo sapiens
tatttggtgaatctatggtcag

SEQ ID NO: 7265472 - DNA, 22 bp, Homo sapiens
tatttggttcttcttctgtgta

SEQ ID NO: 7265473 - DNA, 22 bp, Homo sapiens
tatttgtagaatggattaaggg

SEQ ID NO: 7265474 - DNA, 22 bp, Homo sapiens
tattttcattctgtgtgactgt

SEQ ID NO: 7265475 - DNA, 22 bp, Homo sapiens
tacattaaggatatggacatga

SEQ ID NO: 7265476 - DNA, 22 bp, Homo sapiens
tacttattggttcagaagttta

SEQ ID NO: 7265477 - DNA, 22 bp, Homo sapiens
tactgtaatgagattagcttcc

SEQ ID NO: 7265478 - DNA, 22 bp, Homo sapiens
taccttggggttttgttgctct

SEQ ID NO: 7265479 - DNA, 22 bp, Homo sapiens
taagttacacttaacttactag

SEQ ID NO: 7265480 - DNA, 22 bp, Homo sapiens
taagtttaaatgtacatgaagc

SEQ ID NO: 7265481 - DNA, 22 bp, Homo sapiens
taatgaactctttactttggga

SEQ ID NO: 7265482 - DNA, 22 bp, Homo sapiens
tacaatgtaattctgattatgt

SEQ ID NO: 7265483 - DNA, 22 bp, Homo sapiens
tacacattagtgaggtattttg

SEQ ID NO: 7265484 - DNA, 22 bp, Homo sapiens
tacacatatgtgtgtatatgtg

SEQ ID NO: 7265485 - DNA, 22 bp, Homo sapiens
tacacatatgtccattaatcag

SEQ ID NO: 7265486 - DNA, 22 bp, Homo sapiens
taagataatccattataatgtt

SEQ ID NO: 7265487 - DNA, 22 bp, Homo sapiens
taacaatttgcttcatttgttt

SEQ ID NO: 7265488 - DNA, 22 bp, Homo sapiens
taacacatgtctgggatgtgaa

SEQ ID NO: 7265489 - DNA, 23 bp, Homo sapiens
taacacagtcctggtctttggcc

SEQ ID NO: 7265490 - DNA, 22 bp, Homo sapiens
taaagtttgtagcaattgatat

SEQ ID NO: 7265491 - DNA, 21 bp, Homo sapiens
taaataataagttgctgagat

SEQ ID NO: 7265492 - DNA, 22 bp, Homo sapiens
gtttacaaatattttaaatggt

SEQ ID NO: 7265493 - DNA, 22 bp, Homo sapiens
gtttataaggcccaatatttct

SEQ ID NO: 7265494 - DNA, 22 bp, Homo sapiens
gttagaaacacattcttattga

SEQ ID NO: 7265495 - DNA, 22 bp, Homo sapiens
tcaatgatagtacaatcagcct

SEQ ID NO: 7265496 - DNA, 22 bp, Homo sapiens
tcaaacatgaaagcttgatttt

SEQ ID NO: 7265497 - DNA, 22 bp, Homo sapiens
tcaattatttgatatgaaaggg

SEQ ID NO: 7265498 - DNA, 22 bp, Homo sapiens
tcacatctgtgtgattgtcatt

SEQ ID NO: 7265499 - DNA, 22 bp, Homo sapiens
tttaggaacttaggtttatgga

SEQ ID NO: 7265500 - DNA, 22 bp, Homo sapiens
tttatgttcctcttgagctttc

SEQ ID NO: 7265501 - DNA, 22 bp, Homo sapiens
ttgttgaattagttgactgtgt

SEQ ID NO: 7265502 - DNA, 22 bp, Homo sapiens
ttgttgacgacttgactttctc

SEQ ID NO: 7265503 - DNA, 22 bp, Homo sapiens
ttgttgcagagatgaatgacat

SEQ ID NO: 7265504 - DNA, 22 bp, Homo sapiens
ttgtactttggggaaatgttga

SEQ ID NO: 7265505 - DNA, 22 bp, Homo sapiens
ttgtgatctgtgttgatggcct

SEQ ID NO: 7265506 - DNA, 22 bp, Homo sapiens
ttggcttggagagttgaaatgt

SEQ ID NO: 7265507 - DNA, 22 bp, Homo sapiens
ttggccttccctacctgggcca

SEQ ID NO: 7265508 - DNA, 22 bp, Homo sapiens
ttggcctccacattttccaggt

SEQ ID NO: 7265509 - DNA, 22 bp, Homo sapiens
ttggcctcatggacagctcatc

SEQ ID NO: 7265510 - DNA, 22 bp, Homo sapiens
ttgcatttgacaaattatttaa

SEQ ID NO: 7265511 - DNA, 23 bp, Homo sapiens
ttgcttgagcccaggaagtggag

SEQ ID NO: 7265512 - DNA, 22 bp, Homo sapiens
ttgcttgaacccaggaagtgga

SEQ ID NO: 7265513 - DNA, 22 bp, Homo sapiens
ttgctttagaatctgcttctgg

SEQ ID NO: 7265514 - DNA, 22 bp, Homo sapiens
ttggaacactagaatctgtact

SEQ ID NO: 7265515 - DNA, 22 bp, Homo sapiens
ttggaacatgccggggtccagg

SEQ ID NO: 7265516 - DNA, 22 bp, Homo sapiens
ttggaacaggattcaattaaag

SEQ ID NO: 7265517 - DNA, 22 bp, Homo sapiens
ttggaattcagcttgcttataa

SEQ ID NO: 7265518 - DNA, 22 bp, Homo sapiens
ttggaattcaagttgtagctta

SEQ ID NO: 7265519 - DNA, 22 bp, Homo sapiens
ttggaattaaaaggagaacttc

SEQ ID NO: 7265520 - DNA, 22 bp, Homo sapiens
ttggaattaatatttgtataca

SEQ ID NO: 7265521 - DNA, 23 bp, Homo sapiens
ttatgcaagcttcctggtctcag

SEQ ID NO: 7265522 - DNA, 22 bp, Homo sapiens
ttatttatggcactgttggtgg

SEQ ID NO: 7265523 - DNA, 22 bp, Homo sapiens
ttccatttattcttgtccagat

SEQ ID NO: 7265524 - DNA, 22 bp, Homo sapiens
ttctccatttaacttccttatg

SEQ ID NO: 7265525 - DNA, 22 bp, Homo sapiens
ttctctttatgtatttagtggg

SEQ ID NO: 7265526 - DNA, 22 bp, Homo sapiens
ttctcagaaaagcaagctttct

SEQ ID NO: 7265527 - DNA, 22 bp, Homo sapiens
ttttactttggatacagtactt

SEQ ID NO: 7265528 - DNA, 22 bp, Homo sapiens
ttttacttaattcttggtcatg

SEQ ID NO: 7265529 - DNA, 22 bp, Homo sapiens
ttttttatctatggtagtacca

SEQ ID NO: 7265530 - DNA, 22 bp, Homo sapiens
ttttttatatcaactgaagtct

SEQ ID NO: 7265531 - DNA, 22 bp, Homo sapiens
ttttttatagcaatgaacccac

SEQ ID NO: 7265532 - DNA, 22 bp, Homo sapiens
tttttgtctagcgtctctagtt

SEQ ID NO: 7265533 - DNA, 22 bp, Homo sapiens
tttttgtcatctatttctggtg

SEQ ID NO: 7265534 - DNA, 22 bp, Homo sapiens
tttttgtctagcgtctctagtt

SEQ ID NO: 7265535 - DNA, 22 bp, Homo sapiens
tttttgttctgattatactggt

SEQ ID NO: 7265536 - DNA, 22 bp, Homo sapiens
tttttgtagtcattagaagagg

SEQ ID NO: 7265537 - DNA, 22 bp, Homo sapiens
tttttgtatagaaatgaactaa

SEQ ID NO: 7265538 - DNA, 22 bp, Homo sapiens
ttttgtatagtcaaagacaaga

SEQ ID NO: 7265539 - DNA, 22 bp, Homo sapiens
ttttggttctgggatacagaga

SEQ ID NO: 7265540 - DNA, 22 bp, Homo sapiens
ttttggttgttgggtaagagta

SEQ ID NO: 7265541 - DNA, 22 bp, Homo sapiens
ttttggtttcccttcttatggt

SEQ ID NO: 7265542 - DNA, 22 bp, Homo sapiens
ttttggtttggctccaaatagg

SEQ ID NO: 7265543 - DNA, 20 bp, Homo sapiens
ttttggtcttcagacaaggc

SEQ ID NO: 7265544 - DNA, 22 bp, Homo sapiens
ttttggtctgtagagtgactct

SEQ ID NO: 7265545 - DNA, 22 bp, Homo sapiens
ttttggtctccaagccatgtgt

SEQ ID NO: 7265546 - DNA, 22 bp, Homo sapiens
ttttggtcaggttggtctcgaa

SEQ ID NO: 7265547 - DNA, 22 bp, Homo sapiens
ttttggtcagtgtactgggctg

SEQ ID NO: 7265548 - DNA, 21 bp, Homo sapiens
ttttggtcctggcttaggagc

SEQ ID NO: 7265549 - DNA, 22 bp, Homo sapiens
ttttggtcaacagtacatgcgg

SEQ ID NO: 7265550 - DNA, 21 bp, Homo sapiens
tttgaactagaggtaaattcc

SEQ ID NO: 7265551 - DNA, 20 bp, Homo sapiens
tttgaactttgtactctgtt

SEQ ID NO: 7265552 - DNA, 22 bp, Homo sapiens
acacattatctcattaaatact

SEQ ID NO: 7265553 - DNA, 23 bp, Homo sapiens
acactgtctcatggatagactgc

SEQ ID NO: 7265554 - DNA, 22 bp, Homo sapiens
agcaccatttctctaaagcact

SEQ ID NO: 7265555 - DNA, 22 bp, Homo sapiens
acaattttccccataggttatc

SEQ ID NO: 7265556 - DNA, 22 bp, Homo sapiens
agccatttggacttctggtagg

SEQ ID NO: 7265557 - DNA, 22 bp, Homo sapiens
agccatttcctgaactctggac

SEQ ID NO: 7265558 - DNA, 22 bp, Homo sapiens
acaaacttatgtttcatatgta

SEQ ID NO: 7265559 - DNA, 22 bp, Homo sapiens
acaaacttccatcatgaatttt

SEQ ID NO: 7265560 - DNA, 22 bp, Homo sapiens
agcaccatcagatgcaatatct

SEQ ID NO: 7265561 - DNA, 22 bp, Homo sapiens
agcaccatcgggttcttgcttt

SEQ ID NO: 7265562 - DNA, 19 bp, Homo sapiens
agcaccatagccctgaaag

SEQ ID NO: 7265563 - DNA, 22 bp, Homo sapiens
agcaccatcacagctgtatgtc

SEQ ID NO: 7265564 - DNA, 19 bp, Homo sapiens
aatgtttaagagaaaaagg

SEQ ID NO: 7265565 - DNA, 22 bp, Homo sapiens
aattatattgtggtgtgaatgt

SEQ ID NO: 7265566 - DNA, 22 bp, Homo sapiens
aagtgctttcatatagtcttaa

SEQ ID NO: 7265567 - DNA, 22 bp, Homo sapiens
aagtttcaaatataaaattaca

SEQ ID NO: 7265568 - DNA, 22 bp, Homo sapiens
aagtttactggggagatcacct

SEQ ID NO: 7265569 - DNA, 22 bp, Homo sapiens
aataattagtgggacagagaac

SEQ ID NO: 7265570 - DNA, 22 bp, Homo sapiens
aaggcagtaggatcttccacag

SEQ ID NO: 7265571 - DNA, 22 bp, Homo sapiens
aaggcagtactttatgtccata

SEQ ID NO: 7265572 - DNA, 22 bp, Homo sapiens
aaggcagtcaaagcagacttct

SEQ ID NO: 7265573 - DNA, 22 bp, Homo sapiens
aaagtatatttacttactgtga

SEQ ID NO: 7265574 - DNA, 22 bp, Homo sapiens
aaagtattcaaaaatatttggt

SEQ ID NO: 7265575 - DNA, 22 bp, Homo sapiens
aactaaatctggcatttagagc

SEQ ID NO: 7265576 - DNA, 22 bp, Homo sapiens
aagctgaagccggatcaaaaag

SEQ ID NO: 7265577 - DNA, 22 bp, Homo sapiens
aagctgaatctgaaatagaatt

SEQ ID NO: 7265578 - DNA, 22 bp, Homo sapiens
aagctgaattttctaaaagaat

SEQ ID NO: 7265579 - DNA, 22 bp, Homo sapiens
aaataattgagttggtcaatat

SEQ ID NO: 7265580 - DNA, 22 bp, Homo sapiens
aaagtgttgattttatagtgca

SEQ ID NO: 7265581 - DNA, 22 bp, Homo sapiens
aaagtgtggagattgaactaaa

SEQ ID NO: 7265582 - DNA, 22 bp, Homo sapiens
aaataattatagcgagtctatc

SEQ ID NO: 7265583 - DNA, 22 bp, Homo sapiens
aaataagaggacagatgtttgg

SEQ ID NO: 7265584 - DNA, 22 bp, Homo sapiens
aaataagcacttaactgtatca

SEQ ID NO: 7265585 - DNA, 22 bp, Homo sapiens
aaataagcacttaactgtatca

SEQ ID NO: 7265586 - DNA, 22 bp, Homo sapiens
aaactcagatgtggtgaagacc

SEQ ID NO: 7265587 - DNA, 22 bp, Homo sapiens
aaaaataggtcaaccgtgtatg

SEQ ID NO: 7265588 - DNA, 22 bp, Homo sapiens
aaacacttcaaggacttctgtc

SEQ ID NO: 7265589 - DNA, 22 bp, Homo sapiens
aattggtttgaataaataaaga

SEQ ID NO: 7265590 - DNA, 22 bp, Homo sapiens
aattgtacaggaagttgctgga

SEQ ID NO: 7265591 - DNA, 22 bp, Homo sapiens
aatataatgctgttttatgcca

SEQ ID NO: 7265592 - DNA, 22 bp, Homo sapiens
agtatttgatcagatgatagta

SEQ ID NO: 7265593 - DNA, 22 bp, Homo sapiens
agtatttgatacagtcttctag

SEQ ID NO: 7265594 - DNA, 22 bp, Homo sapiens
agtatttgttgaatgagtgaat

SEQ ID NO: 7265595 - DNA, 22 bp, Homo sapiens
agtatttgttgattgatatgaa

SEQ ID NO: 7265596 - DNA, 22 bp, Homo sapiens
agtattttcgccatcacaagaa

SEQ ID NO: 7265597 - DNA, 22 bp, Homo sapiens
agtattttcaaccatagcctgg

SEQ ID NO: 7265598 - DNA, 22 bp, Homo sapiens
atacatgttgtaccatatgttt

SEQ ID NO: 7265599 - DNA, 22 bp, Homo sapiens
atacatgtttgctggataaaca

SEQ ID NO: 7265600 - DNA, 22 bp, Homo sapiens
atacatgttgagaaaatatctg

SEQ ID NO: 7265601 - DNA, 22 bp, Homo sapiens
acttctgataaagagcatgtgc

SEQ ID NO: 7265602 - DNA, 22 bp, Homo sapiens
ataaaatttgctactgttaaat

SEQ ID NO: 7265603 - DNA, 22 bp, Homo sapiens
agggctgacagtgaggagtcaa

SEQ ID NO: 7265604 - DNA, 22 bp, Homo sapiens
acccagctaaccctaccctgga

SEQ ID NO: 7265605 - DNA, 20 bp, Homo sapiens
acccagctctgtgccctggg

SEQ ID NO: 7265606 - DNA, 22 bp, Homo sapiens
acattgtatacagacttagtca

SEQ ID NO: 7265607 - DNA, 22 bp, Homo sapiens
acatttgactgtagatacttgc

SEQ ID NO: 7265608 - DNA, 22 bp, Homo sapiens
acatttgaagacgacagtggaa

SEQ ID NO: 7265609 - DNA, 22 bp, Homo sapiens
acatttgaggatgttaagaatg

SEQ ID NO: 7265610 - DNA, 22 bp, Homo sapiens
acatttgagtcatatttgctta

SEQ ID NO: 7265611 - DNA, 22 bp, Homo sapiens
acatttgatatggagttgtgta

SEQ ID NO: 7265612 - DNA, 22 bp, Homo sapiens
acatttgatggagttagtaggt

SEQ ID NO: 7265613 - DNA, 22 bp, Homo sapiens
acatttctcttagagttggact

SEQ ID NO: 7265614 - DNA, 20 bp, Homo sapiens
acatgcttgagaggatgcag

SEQ ID NO: 7265615 - DNA, 23 bp, Homo sapiens
acagtcgtaggtatccttttcct

SEQ ID NO: 7265616 - DNA, 22 bp, Homo sapiens
acagtttgaagtttagaagtct

SEQ ID NO: 7265617 - DNA, 21 bp, Homo sapiens
acatacattatctttttaaaa

SEQ ID NO: 7265618 - DNA, 18 bp, Homo sapiens
acatacattctgtctgca

SEQ ID NO: 7265619 - DNA, 22 bp, Homo sapiens
atgaacaatgactacatattga

SEQ ID NO: 7265620 - DNA, 22 bp, Homo sapiens
agacattttaacatctgggttt

SEQ ID NO: 7265621 - DNA, 22 bp, Homo sapiens
atgcacctgaactccatcagct

SEQ ID NO: 7265622 - DNA, 22 bp, Homo sapiens
atgacaaaagaagacatgaggt

SEQ ID NO: 7265623 - DNA, 22 bp, Homo sapiens
agacattttggaaagtattact

SEQ ID NO: 7265624 - DNA, 22 bp, Homo sapiens
agacattttgcaatgggtagct

SEQ ID NO: 7265625 - DNA, 22 bp, Homo sapiens
agagaagcagggagtcatctgt

SEQ ID NO: 7265626 - DNA, 22 bp, Homo sapiens
agagaagctgacaggggcgtgc

SEQ ID NO: 7265627 - DNA, 22 bp, Homo sapiens
agagaagcattcttctcagggc

SEQ ID NO: 7265628 - DNA, 22 bp, Homo sapiens
atggccttagtgatgattaata

SEQ ID NO: 7265629 - DNA, 22 bp, Homo sapiens
atgtgggccgtgcgggtgtcct

SEQ ID NO: 7265630 - DNA, 22 bp, Homo sapiens
agataaattcctaagatttcag

SEQ ID NO: 7265631 - DNA, 22 bp, Homo sapiens
agataaacccaacttaatgaag

SEQ ID NO: 7265632 - DNA, 21 bp, Homo sapiens
attgctctgttgtgtctagaa

SEQ ID NO: 7265633 - DNA, 22 bp, Homo sapiens
atttctctgcctcagcttctgc

SEQ ID NO: 7265634 - DNA, 22 bp, Homo sapiens
attgagtagtaggaaaataact

SEQ ID NO: 7265635 - DNA, 22 bp, Homo sapiens
attgagtattgtaaataaaaca

SEQ ID NO: 7265636 - DNA, 22 bp, Homo sapiens
attattattgttgatgttaggg

SEQ ID NO: 7265637 - DNA, 22 bp, Homo sapiens
attattatggttgctcttttcc

SEQ ID NO: 7265638 - DNA, 22 bp, Homo sapiens
attattataaagtgcatgacct

SEQ ID NO: 7265639 - DNA, 20 bp, Homo sapiens
agcacattaaacatactcct

SEQ ID NO: 7265640 - DNA, 22 bp, Homo sapiens
catgtcccaaatgcaggcaaag

SEQ ID NO: 7265641 - DNA, 22 bp, Homo sapiens
catggctgaacactcagtgact

SEQ ID NO: 7265642 - DNA, 23 bp, Homo sapiens
ccaagcttctaatgctgctgagc

SEQ ID NO: 7265643 - DNA, 22 bp, Homo sapiens
ccaagcttctttcctactacag

SEQ ID NO: 7265644 - DNA, 23 bp, Homo sapiens
ccaagcttgtccctgcctgcttt

SEQ ID NO: 7265645 - DNA, 19 bp, Homo sapiens
aggagaagtagcagaaatt

SEQ ID NO: 7265646 - DNA, 22 bp, Homo sapiens
catagcggtattccacgtggtt

SEQ ID NO: 7265647 - DNA, 22 bp, Homo sapiens
agctgtggaagactgtcagggt

SEQ ID NO: 7265648 - DNA, 22 bp, Homo sapiens
agggctcctatgccccatggac

SEQ ID NO: 7265649 - DNA, 18 bp, Homo sapiens
agggctgatgagtttggg

SEQ ID NO: 7265650 - DNA, 22 bp, Homo sapiens
ccagcctgaaatgcctcatcct

SEQ ID NO: 7265651 - DNA, 22 bp, Homo sapiens
atacatctcatgtaagagataa

SEQ ID NO: 7265652 - DNA, 22 bp, Homo sapiens
ataattaatttcagtaatctcc

SEQ ID NO: 7265653 - DNA, 22 bp, Homo sapiens
ataatttacaactgcttttaat

SEQ ID NO: 7265654 - DNA, 20 bp, Homo sapiens
ataatttaccctgcaccact

SEQ ID NO: 7265655 - DNA, 22 bp, Homo sapiens
ataggcacaaccattaaaataa

SEQ ID NO: 7265656 - DNA, 23 bp, Homo sapiens
ataataattatggcagcaaagtg

SEQ ID NO: 7265657 - DNA, 22 bp, Homo sapiens
agtttcaattcttttcacaaag

SEQ ID NO: 7265658 - DNA, 22 bp, Homo sapiens
agtttatttttgataagtcttg

SEQ ID NO: 7265659 - DNA, 22 bp, Homo sapiens
ctgggctgtcaatggccctctg

SEQ ID NO: 7265660 - DNA, 22 bp, Homo sapiens
ctgggctgtaatgtggcactga

SEQ ID NO: 7265661 - DNA, 22 bp, Homo sapiens
atagtatttccagaaatagtct

SEQ ID NO: 7265662 - DNA, 22 bp, Homo sapiens
atagtcttagatcagataaagt

SEQ ID NO: 7265663 - DNA, 22 bp, Homo sapiens
atatcaaagctagtggaaattt

SEQ ID NO: 7265664 - DNA, 22 bp, Homo sapiens
cctggctcagagtatgtcatcg

SEQ ID NO: 7265665 - DNA, 22 bp, Homo sapiens
aggttatcatcagttgagcact

SEQ ID NO: 7265666 - DNA, 22 bp, Homo sapiens
ctcttaatgaggctgacttgta

SEQ ID NO: 7265667 - DNA, 20 bp, Homo sapiens
ctcttaattgctcacattag

SEQ ID NO: 7265668 - DNA, 22 bp, Homo sapiens
ctgaagctgggcacttcctttt

SEQ ID NO: 7265669 - DNA, 22 bp, Homo sapiens
ctgaagcttagtttacgctcca

SEQ ID NO: 7265670 - DNA, 22 bp, Homo sapiens
agtgaccgaggcacttggcaac

SEQ ID NO: 7265671 - DNA, 22 bp, Homo sapiens
ctccagttggccccagttggtt

SEQ ID NO: 7265672 - DNA, 22 bp, Homo sapiens
agtcattttctgcctgtaatct

SEQ ID NO: 7265673 - DNA, 22 bp, Homo sapiens
agtcattttgctaaatgagggt

SEQ ID NO: 7265674 - DNA, 22 bp, Homo sapiens
agtcatatttatataatttccc

SEQ ID NO: 7265675 - DNA, 22 bp, Homo sapiens
agtcatatgacccttcacaaac

SEQ ID NO: 7265676 - DNA, 22 bp, Homo sapiens
agtcttaatagagaaaaactgt

SEQ ID NO: 7265677 - DNA, 16 bp, Homo sapiens
atgctgctattagagg

SEQ ID NO: 7265678 - DNA, 22 bp, Homo sapiens
gaatttcctctaaacccctgag

SEQ ID NO: 7265679 - DNA, 22 bp, Homo sapiens
atgccactgcacttcagcctgg

SEQ ID NO: 7265680 - DNA, 22 bp, Homo sapiens
ctttggtctccgtcatcaatca

SEQ ID NO: 7265681 - DNA, 21 bp, Homo sapiens
ctttggtcaacagtccctgaa

SEQ ID NO: 7265682 - DNA, 22 bp, Homo sapiens
ctttggtcaattgctgcgggga

SEQ ID NO: 7265683 - DNA, 22 bp, Homo sapiens
ctttggtcagagggatggagtt

SEQ ID NO: 7265684 - DNA, 22 bp, Homo sapiens
ctttggtccagaagtggcctct

SEQ ID NO: 7265685 - DNA, 22 bp, Homo sapiens
ctttttatctcttaatgatgtt

SEQ ID NO: 7265686 - DNA, 22 bp, Homo sapiens
ctttttataccgtgccagttga

SEQ ID NO: 7265687 - DNA, 22 bp, Homo sapiens
ctttttatagctatgtcctatg

SEQ ID NO: 7265688 - DNA, 22 bp, Homo sapiens
atgacattgaatatgttaacta

SEQ ID NO: 7265689 - DNA, 23 bp, Homo sapiens
atgagcacccactatggaattgc

SEQ ID NO: 7265690 - DNA, 22 bp, Homo sapiens
ctttattctgcaaattgccttg

SEQ ID NO: 7265691 - DNA, 22 bp, Homo sapiens
ctttattcctacaagattttct

SEQ ID NO: 7265692 - DNA, 22 bp, Homo sapiens
atctttgggatcctgatttact

SEQ ID NO: 7265693 - DNA, 22 bp, Homo sapiens
attcttttttaaggaatagaac

SEQ ID NO: 7265694 - DNA, 22 bp, Homo sapiens
attgtactcacaaaacatgagt

SEQ ID NO: 7265695 - DNA, 22 bp, Homo sapiens
attgtacataaaatgtatgtct

SEQ ID NO: 7265696 - DNA, 22 bp, Homo sapiens
attgtacatgcagtgagtcatc

SEQ ID NO: 7265697 - DNA, 22 bp, Homo sapiens
attgtacatatgatgtatgtaa

SEQ ID NO: 7265698 - DNA, 22 bp, Homo sapiens
atttatgattagcctattgttg

SEQ ID NO: 7265699 - DNA, 22 bp, Homo sapiens
atttattaagcatctgctatgt

SEQ ID NO: 7265700 - DNA, 22 bp, Homo sapiens
caaagaatcactcatctttagc

SEQ ID NO: 7265701 - DNA, 22 bp, Homo sapiens
caaaagcaaagtccctgaatgt

SEQ ID NO: 7265702 - DNA, 22 bp, Homo sapiens
attttgaatcaccttggaagaa

SEQ ID NO: 7265703 - DNA, 22 bp, Homo sapiens
attttgacattgcggcattgct

SEQ ID NO: 7265704 - DNA, 22 bp, Homo sapiens
atttgtatcaatctcaatatat

SEQ ID NO: 7265705 - DNA, 21 bp, Homo sapiens
atttggtcaaggacaactctg

SEQ ID NO: 7265706 - DNA, 22 bp, Homo sapiens
atttggtcaagcaaacccccat

SEQ ID NO: 7265707 - DNA, 21 bp, Homo sapiens
atttggtcaatgtctgcgtga

SEQ ID NO: 7265708 - DNA, 22 bp, Homo sapiens
atttggtcactaggaaaatcaa

SEQ ID NO: 7265709 - DNA, 22 bp, Homo sapiens
atttggtcacaccagtccacat

SEQ ID NO: 7265710 - DNA, 22 bp, Homo sapiens
atttggtagaggctcggtgtta

SEQ ID NO: 7265711 - DNA, 22 bp, Homo sapiens
atttggtcagaactctctttag

SEQ ID NO: 7265712 - DNA, 22 bp, Homo sapiens
atttggtcatgttcagtgtaga

SEQ ID NO: 7265713 - DNA, 22 bp, Homo sapiens
atttggtcccagggagtcctac

SEQ ID NO: 7265714 - DNA, 22 bp, Homo sapiens
atttggtcccttgttgtgtccc

SEQ ID NO: 7265715 - DNA, 22 bp, Homo sapiens
atttggtcctgctgggggattt

SEQ ID NO: 7265716 - DNA, 22 bp, Homo sapiens
atttggtctacattttccaaat

SEQ ID NO: 7265717 - DNA, 22 bp, Homo sapiens
atttggtctccatactggttag

SEQ ID NO: 7265718 - DNA, 22 bp, Homo sapiens
atttggaattcgagtaattcca

SEQ ID NO: 7265719 - DNA, 22 bp, Homo sapiens
atttggttcccaagctacgtgt

SEQ ID NO: 7265720 - DNA, 22 bp, Homo sapiens
atttggtttcaggattctcagg

SEQ ID NO: 7265721 - DNA, 22 bp, Homo sapiens
atttggttactcagttgtctga

SEQ ID NO: 7265722 - DNA, 22 bp, Homo sapiens
atttggttatggtcatggacac

SEQ ID NO: 7265723 - DNA, 22 bp, Homo sapiens
atttggtcttgtatcctggagg

SEQ ID NO: 7265724 - DNA, 22 bp, Homo sapiens
atttggtctgtaattacatgga

SEQ ID NO: 7265725 - DNA, 21 bp, Homo sapiens
attttcattaattcagtgtgg

SEQ ID NO: 7265726 - DNA, 22 bp, Homo sapiens
gtactgaaaagttttctaatct

SEQ ID NO: 7265727 - DNA, 22 bp, Homo sapiens
gtactgaataacaaagtctgtc

SEQ ID NO: 7265728 - DNA, 22 bp, Homo sapiens
gtacacactatgtattgtacac

SEQ ID NO: 7265729 - DNA, 22 bp, Homo sapiens
cagccctctgaagaggcgcttg

SEQ ID NO: 7265730 - DNA, 22 bp, Homo sapiens
caatttcactaataatatttac

SEQ ID NO: 7265731 - DNA, 22 bp, Homo sapiens
cacagtctcctctcttagcctg

SEQ ID NO: 7265732 - DNA, 22 bp, Homo sapiens
tgaggcagtgctgggaagcctg

SEQ ID NO: 7265733 - DNA, 22 bp, Homo sapiens
tgaggcagtattttagtgactt

SEQ ID NO: 7265734 - DNA, 18 bp, Homo sapiens
tgaggcagtcagtgatgg

SEQ ID NO: 7265735 - DNA, 18 bp, Homo sapiens
cccagctccacttccctc

SEQ ID NO: 7265736 - DNA, 22 bp, Homo sapiens
cccagctccagagccagaaaca

SEQ ID NO: 7265737 - DNA, 22 bp, Homo sapiens
tgaagatattttaaaatactga

SEQ ID NO: 7265738 - DNA, 22 bp, Homo sapiens
tgaagataaattgtactgaaga

SEQ ID NO: 7265739 - DNA, 22 bp, Homo sapiens
tgaacacattttcttcagtaga

SEQ ID NO: 7265740 - DNA, 22 bp, Homo sapiens
tgaacacagcatattttgttac

SEQ ID NO: 7265741 - DNA, 22 bp, Homo sapiens
tgacaattgtgggcagtttgtg

SEQ ID NO: 7265742 - DNA, 17 bp, Homo sapiens
tgactttatttgcttgg

SEQ ID NO: 7265743 - DNA, 22 bp, Homo sapiens
tgactttggactagtgatttaa

SEQ ID NO: 7265744 - DNA, 22 bp, Homo sapiens
tgactttgtgccatttttataa

SEQ ID NO: 7265745 - DNA, 22 bp, Homo sapiens
tgagagtacttatatgaacatt

SEQ ID NO: 7265746 - DNA, 22 bp, Homo sapiens
tggaagggaaagtttggggtcc

SEQ ID NO: 7265747 - DNA, 22 bp, Homo sapiens
tgctttcattcacaaaatagca

SEQ ID NO: 7265748 - DNA, 23 bp, Homo sapiens
tggcctctccccacctggcagaa

SEQ ID NO: 7265749 - DNA, 21 bp, Homo sapiens
tggcctcccacacttccatgg

SEQ ID NO: 7265750 - DNA, 22 bp, Homo sapiens
tagctactagtgaattttggta

SEQ ID NO: 7265751 - DNA, 22 bp, Homo sapiens
tagtctttttaataaataatgc

SEQ ID NO: 7265752 - DNA, 19 bp, Homo sapiens
tagtctttattcttaattt

SEQ ID NO: 7265753 - DNA, 19 bp, Homo sapiens
tagtctttattcttaattt

SEQ ID NO: 7265754 - DNA, 22 bp, Homo sapiens
tagtcttttgagaagtatatct

SEQ ID NO: 7265755 - DNA, 22 bp, Homo sapiens
tactgtattgttggctcttttg

SEQ ID NO: 7265756 - DNA, 22 bp, Homo sapiens
tactgtctaataagattgatgg

SEQ ID NO: 7265757 - DNA, 22 bp, Homo sapiens
tactgtctatacacttgattac

SEQ ID NO: 7265758 - DNA, 22 bp, Homo sapiens
tactgtctggcaattaagaatc

SEQ ID NO: 7265759 - DNA, 22 bp, Homo sapiens
tcacactttccatggctgttaa

SEQ ID NO: 7265760 - DNA, 22 bp, Homo sapiens
tcacactttatttatttcatgc

SEQ ID NO: 7265761 - DNA, 21 bp, Homo sapiens
tcacacttgattggcttagac

SEQ ID NO: 7265762 - DNA, 22 bp, Homo sapiens
cagttacagagccagttagaga

SEQ ID NO: 7265763 - DNA, 18 bp, Homo sapiens
cagttacaccttcattca

SEQ ID NO: 7265764 - DNA, 22 bp, Homo sapiens
cataaaatggcttgttctttaa

SEQ ID NO: 7265765 - DNA, 19 bp, Homo sapiens
cataaatgtacaagataca

SEQ ID NO: 7265766 - DNA, 22 bp, Homo sapiens
cagtttatatataagcacattg

SEQ ID NO: 7265767 - DNA, 22 bp, Homo sapiens
catttggtcactatcctttttg

SEQ ID NO: 7265768 - DNA, 22 bp, Homo sapiens
catttggtcattaggtctcctt

SEQ ID NO: 7265769 - DNA, 22 bp, Homo sapiens
catttggtggctacagagtaac

SEQ ID NO: 7265770 - DNA, 22 bp, Homo sapiens
catttggtgttaggcatgttaa

SEQ ID NO: 7265771 - DNA, 22 bp, Homo sapiens
cattgcacgggcgtctgtctgt

SEQ ID NO: 7265772 - DNA, 22 bp, Homo sapiens
cattgcacagccctgtggtgat

SEQ ID NO: 7265773 - DNA, 22 bp, Homo sapiens
tcatttatttgactttggagtg

SEQ ID NO: 7265774 - DNA, 22 bp, Homo sapiens
tcatttatgtctttgccatcca

SEQ ID NO: 7265775 - DNA, 22 bp, Homo sapiens
tcatttatgcaggaatggcata

SEQ ID NO: 7265776 - DNA, 22 bp, Homo sapiens
ctgctgaatgtctctttggttt

SEQ ID NO: 7265777 - DNA, 22 bp, Homo sapiens
tttggaatcatagatatattca

SEQ ID NO: 7265778 - DNA, 22 bp, Homo sapiens
tttggaatgcccatggactggt

SEQ ID NO: 7265779 - DNA, 22 bp, Homo sapiens
ttttgcttaatctagattttgc

SEQ ID NO: 7265780 - DNA, 22 bp, Homo sapiens
tttattcagcagcagcagtggt

SEQ ID NO: 7265781 - DNA, 22 bp, Homo sapiens
tttatgctactcaatagtcagt

SEQ ID NO: 7265782 - DNA, 22 bp, Homo sapiens
tttcattacgtgtttgacttgt

SEQ ID NO: 7265783 - DNA, 18 bp, Homo sapiens
ctctctttccactctttg

SEQ ID NO: 7265784 - DNA, 22 bp, Homo sapiens
ctcagggatggtgaagcaccca

SEQ ID NO: 7265785 - DNA, 22 bp, Homo sapiens
ttatttcatataatgttatcaa

SEQ ID NO: 7265786 - DNA, 22 bp, Homo sapiens
cctttggtaattctgtgtagag

SEQ ID NO: 7265787 - DNA, 22 bp, Homo sapiens
cctttggtaacattccaacctt

SEQ ID NO: 7265788 - DNA, 22 bp, Homo sapiens
ttagcaccttgaacagaccctg

SEQ ID NO: 7265789 - DNA, 22 bp, Homo sapiens
ctgtctgttgaccatagtttgc

SEQ ID NO: 7265790 - DNA, 22 bp, Homo sapiens
ctgggctcagcccatgctgtcc

SEQ ID NO: 7265791 - DNA, 22 bp, Homo sapiens
ctgggcctcaccctagaccaat

SEQ ID NO: 7265792 - DNA, 22 bp, Homo sapiens
cttcttcatctgtaaaacttgg

SEQ ID NO: 7265793 - DNA, 20 bp, Homo sapiens
cttcttcagcctatgcttca

SEQ ID NO: 7265794 - DNA, 22 bp, Homo sapiens
cttcttcagcacaatattgatg

SEQ ID NO: 7265795 - DNA, 22 bp, Homo sapiens
cttcttcaacctgaaagtttca

SEQ ID NO: 7265796 - DNA, 22 bp, Homo sapiens
cttcactgtttggttcacagca

SEQ ID NO: 7265797 - DNA, 22 bp, Homo sapiens
cttttttaaggtagctcctcct

SEQ ID NO: 7265798 - DNA, 22 bp, Homo sapiens
ctttggaatcattgcttattca

SEQ ID NO: 7265799 - DNA, 22 bp, Homo sapiens
gacattaatttctttggtaatt

SEQ ID NO: 7265800 - DNA, 22 bp, Homo sapiens
gacattaaatgtcttagttgcc

SEQ ID NO: 7265801 - DNA, 22 bp, Homo sapiens
gaatgtttttcattggtgactc

SEQ ID NO: 7265802 - DNA, 22 bp, Homo sapiens
gaatttacagggtgagcttcag

SEQ ID NO: 7265803 - DNA, 22 bp, Homo sapiens
gaatttacaagttgaataacaa

SEQ ID NO: 7265804 - DNA, 22 bp, Homo sapiens
gagaagctgttggagaattttt

SEQ ID NO: 7265805 - DNA, 22 bp, Homo sapiens
gagcaaaggtgcagtttgaaat

SEQ ID NO: 7265806 - DNA, 22 bp, Homo sapiens
gagcaccagcagtcccctggca

SEQ ID NO: 7265807 - DNA, 22 bp, Homo sapiens
gagcaccaaggctctgccatgg

SEQ ID NO: 7265808 - DNA, 23 bp, Homo sapiens
gagcaccagggcttttgagacat

SEQ ID NO: 7265809 - DNA, 22 bp, Homo sapiens
gagcacatgtggagagtctggg

SEQ ID NO: 7265810 - DNA, 22 bp, Homo sapiens
gcctccctccaccactgcaggt

SEQ ID NO: 7265811 - DNA, 22 bp, Homo sapiens
gcacatgctcaatgtgtatgta

SEQ ID NO: 7265812 - DNA, 22 bp, Homo sapiens
gcacatgcttgagtgtgatgtg

SEQ ID NO: 7265813 - DNA, 22 bp, Homo sapiens
gcagcaaacttccacaagtaga

SEQ ID NO: 7265814 - DNA, 22 bp, Homo sapiens
gcaggcctaagagaaggcattg

SEQ ID NO: 7265815 - DNA, 22 bp, Homo sapiens
gctttggttcaaccaggcaatt

SEQ ID NO: 7265816 - DNA, 22 bp, Homo sapiens
gctttggtgatacttgctggct

SEQ ID NO: 7265817 - DNA, 22 bp, Homo sapiens
gctttggtcttctagctgtgag

SEQ ID NO: 7265818 - DNA, 22 bp, Homo sapiens
gctttggtacctcctgctgatc

SEQ ID NO: 7265819 - DNA, 22 bp, Homo sapiens
gctttggtcaggtgtccagccc

SEQ ID NO: 7265820 - DNA, 22 bp, Homo sapiens
ggagaagcagcttcttgatgaa

SEQ ID NO: 7265821 - DNA, 22 bp, Homo sapiens
ggcctctcttgggacagctgtc

SEQ ID NO: 7265822 - DNA, 22 bp, Homo sapiens
ggcctctctggcatggctgccc

SEQ ID NO: 7265823 - DNA, 22 bp, Homo sapiens
ggctggagatatgtctggaaca

SEQ ID NO: 7265824 - DNA, 22 bp, Homo sapiens
gtatttttcattccaagtgaga

SEQ ID NO: 7265825 - DNA, 22 bp, Homo sapiens
gtatttttaggtaaggaaagta

SEQ ID NO: 7265826 - DNA, 22 bp, Homo sapiens
gtcctggcttagttcgctgtaa

SEQ ID NO: 7265827 - DNA, 22 bp, Homo sapiens
gtctttatttgagattgtcatt

SEQ ID NO: 7265828 - DNA, 22 bp, Homo sapiens
gtctttagttgaaacatgtggt

SEQ ID NO: 7265829 - DNA, 22 bp, Homo sapiens
gtctttagagctcctggcatct

SEQ ID NO: 7265830 - DNA, 22 bp, Homo sapiens
gtctttatatttactaaagaat

SEQ ID NO: 7265831 - DNA, 22 bp, Homo sapiens
ggttcacactaagcttaagtgg

SEQ ID NO: 7265832 - DNA, 22 bp, Homo sapiens
ggttcacatattgagagtattc

SEQ ID NO: 7265833 - DNA, 22 bp, Homo sapiens
gggcttaaggccagtgtgcttt

SEQ ID NO: 7265834 - DNA, 22 bp, Homo sapiens
tacagtgtctgcaactgcacac

SEQ ID NO: 7265835 - DNA, 22 bp, Homo sapiens
tacagtgcttggtatctagtaa

SEQ ID NO: 7265836 - DNA, 22 bp, Homo sapiens
tacagtctctgataactgtcag

SEQ ID NO: 7265837 - DNA, 22 bp, Homo sapiens
tacatgtaggtgacattttaat

SEQ ID NO: 7265838 - DNA, 22 bp, Homo sapiens
tacatgtatgtttatcttgaga

SEQ ID NO: 7265839 - DNA, 22 bp, Homo sapiens
tacatgaagttgtctaaactgg

SEQ ID NO: 7265840 - DNA, 22 bp, Homo sapiens
taaatgatttatgtatgtgaaa

SEQ ID NO: 7265841 - DNA, 22 bp, Homo sapiens
taagacaagcctcgcatttgta

SEQ ID NO: 7265842 - DNA, 22 bp, Homo sapiens
taacatgttaagaaattagata

SEQ ID NO: 7265843 - DNA, 18 bp, Homo sapiens
taacatgttttcattaag

SEQ ID NO: 7265844 - DNA, 22 bp, Homo sapiens
gtttcttttgtgatcaccaacc

SEQ ID NO: 7265845 - DNA, 22 bp, Homo sapiens
gtttcactgcactatagcacca

SEQ ID NO: 7265846 - DNA, 22 bp, Homo sapiens
gttctttaggggcccaatttcc

SEQ ID NO: 7265847 - DNA, 22 bp, Homo sapiens
gtttattagagttttctgtctg

SEQ ID NO: 7265848 - DNA, 22 bp, Homo sapiens
tatgtattctcagatttactaa

SEQ ID NO: 7265849 - DNA, 22 bp, Homo sapiens
tattaaattatggatttaggag

SEQ ID NO: 7265850 - DNA, 22 bp, Homo sapiens
tattaatatgtgtgtgcatgta

SEQ ID NO: 7265851 - DNA, 22 bp, Homo sapiens
tatcagatgacatcttctatgg

SEQ ID NO: 7265852 - DNA, 22 bp, Homo sapiens
tcaaatatgtgatagaagctaa

SEQ ID NO: 7265853 - DNA, 22 bp, Homo sapiens
tcaaagatgatgctgaagttat

SEQ ID NO: 7265854 - DNA, 22 bp, Homo sapiens
tattttgactattaaaccaaca

SEQ ID NO: 7265855 - DNA, 22 bp, Homo sapiens
tattgtgacttttactgagtaa

SEQ ID NO: 7265856 - DNA, 22 bp, Homo sapiens
tattgtgagtataactgcattt

SEQ ID NO: 7265857 - DNA, 22 bp, Homo sapiens
tattgtatcttctgtttagaag

SEQ ID NO: 7265858 - DNA, 22 bp, Homo sapiens
tattgtattaaggattcaagta

SEQ ID NO: 7265859 - DNA, 22 bp, Homo sapiens
tattttctggacagtcttgctt

SEQ ID NO: 7265860 - DNA, 22 bp, Homo sapiens
tattttgacgattttatgcaaa

SEQ ID NO: 7265861 - DNA, 22 bp, Homo sapiens
tattttgacgattttatgcaaa

SEQ ID NO: 7265862 - DNA, 22 bp, Homo sapiens
tatttggaatagcttgctaatg

SEQ ID NO: 7265863 - DNA, 22 bp, Homo sapiens
tagactttgatattgtacaccc

SEQ ID NO: 7265864 - DNA, 22 bp, Homo sapiens
tagtttcatatgcaaaatagta

SEQ ID NO: 7265865 - DNA, 22 bp, Homo sapiens
tccattatacttctgattcaaa

SEQ ID NO: 7265866 - DNA, 22 bp, Homo sapiens
tccatttactattctcatatcg

SEQ ID NO: 7265867 - DNA, 22 bp, Homo sapiens
tcatttatcatttgtgctgtag

SEQ ID NO: 7265868 - DNA, 22 bp, Homo sapiens
tcatttatcatttgtgctgtag

SEQ ID NO: 7265869 - DNA, 22 bp, Homo sapiens
tcatttatattgtattctgtag

SEQ ID NO: 7265870 - DNA, 22 bp, Homo sapiens
tcatttaatagcttttgtcttt

SEQ ID NO: 7265871 - DNA, 22 bp, Homo sapiens
tcatttaattggttttgctcgt

SEQ ID NO: 7265872 - DNA, 22 bp, Homo sapiens
tcatttaaaatgtaccaggatt

SEQ ID NO: 7265873 - DNA, 22 bp, Homo sapiens
tcatttaataatttttgagtag

SEQ ID NO: 7265874 - DNA, 22 bp, Homo sapiens
tcataaatgcagtgtcataaat

SEQ ID NO: 7265875 - DNA, 22 bp, Homo sapiens
tcaacagaagtgatagctatta

SEQ ID NO: 7265876 - DNA, 22 bp, Homo sapiens
ttgaactaataggtatcttgta

SEQ ID NO: 7265877 - DNA, 22 bp, Homo sapiens
ttgaactagaagctttggaact

SEQ ID NO: 7265878 - DNA, 22 bp, Homo sapiens
ttcttttaatgtctggctttca

SEQ ID NO: 7265879 - DNA, 19 bp, Homo sapiens
ttctttggtggtggtgacc

SEQ ID NO: 7265880 - DNA, 17 bp, Homo sapiens
ttccagtttagtattgt

SEQ ID NO: 7265881 - DNA, 22 bp, Homo sapiens
ttcaaagataattaccaaacat

SEQ ID NO: 7265882 - DNA, 22 bp, Homo sapiens
ttcaaagataatgtagcatttt

SEQ ID NO: 7265883 - DNA, 21 bp, Homo sapiens
ttcaaagagtgggcattgtca

SEQ ID NO: 7265884 - DNA, 22 bp, Homo sapiens
ttcatttaatcagaatctctaa

SEQ ID NO: 7265885 - DNA, 22 bp, Homo sapiens
ttcatttaatttgtgtattaac

SEQ ID NO: 7265886 - DNA, 22 bp, Homo sapiens
ttcatttattcagcaggtattt

SEQ ID NO: 7265887 - DNA, 22 bp, Homo sapiens
ttattgtggcagaggtatggtt

SEQ ID NO: 7265888 - DNA, 22 bp, Homo sapiens
ttattaataaagtggcatagcc

SEQ ID NO: 7265889 - DNA, 22 bp, Homo sapiens
ttattctttaaacatatatgtt

SEQ ID NO: 7265890 - DNA, 22 bp, Homo sapiens
tttattctgtgctacatgaaga

SEQ ID NO: 7265891 - DNA, 22 bp, Homo sapiens
tttattcttgagagtgagaaga

SEQ ID NO: 7265892 - DNA, 22 bp, Homo sapiens
tttattctataggcattaagca

SEQ ID NO: 7265893 - DNA, 22 bp, Homo sapiens
tttattctagctcagaatagtt

SEQ ID NO: 7265894 - DNA, 22 bp, Homo sapiens
tttcatgtctgaattctttagt

SEQ ID NO: 7265895 - DNA, 22 bp, Homo sapiens
tttcattgagactatagacatc

SEQ ID NO: 7265896 - DNA, 22 bp, Homo sapiens
tttacagtgagagcttagtgag

SEQ ID NO: 7265897 - DNA, 22 bp, Homo sapiens
tttacagtgtcttgttgactgt

SEQ ID NO: 7265898 - DNA, 22 bp, Homo sapiens
tttacagtctctatagtcaaaa

SEQ ID NO: 7265899 - DNA, 22 bp, Homo sapiens
tttacagtctgtctagcaatgt

SEQ ID NO: 7265900 - DNA, 22 bp, Homo sapiens
tttacagtctatgttgaattaa

SEQ ID NO: 7265901 - DNA, 22 bp, Homo sapiens
tttacagtccccaggtgaggat

SEQ ID NO: 7265902 - DNA, 22 bp, Homo sapiens
tttacagtcaccaaactttgct

SEQ ID NO: 7265903 - DNA, 22 bp, Homo sapiens
tttacagtatagtaggactcat

SEQ ID NO: 7265904 - DNA, 22 bp, Homo sapiens
tttacagtaaggtggatggtac

SEQ ID NO: 7265905 - DNA, 22 bp, Homo sapiens
tttaatcttcaaaatagtctta

SEQ ID NO: 7265906 - DNA, 22 bp, Homo sapiens
ttggagatatgtgaaaaaaaca

SEQ ID NO: 7265907 - DNA, 22 bp, Homo sapiens
ttgtattttttcctggcggtgg

SEQ ID NO: 7265908 - DNA, 22 bp, Homo sapiens
ttgtacctaaaggtaaatgggc

SEQ ID NO: 7265909 - DNA, 22 bp, Homo sapiens
ttgtacctcttacctctatagc

SEQ ID NO: 7265910 - DNA, 22 bp, Homo sapiens
ttgtacctttgcagccccaggt

SEQ ID NO: 7265911 - DNA, 22 bp, Homo sapiens
ttgtactagaaaggatgtcaaa

SEQ ID NO: 7265912 - DNA, 22 bp, Homo sapiens
ttgtactatcaccatgtcatgt

SEQ ID NO: 7265913 - DNA, 22 bp, Homo sapiens
ttggaattcctgttgtttcgtc

SEQ ID NO: 7265914 - DNA, 22 bp, Homo sapiens
ttggaattgaggatttacatag

SEQ ID NO: 7265915 - DNA, 22 bp, Homo sapiens
ttggaattggacatgttgaagg

SEQ ID NO: 7265916 - DNA, 22 bp, Homo sapiens
ttggaattgctattgataacaa

SEQ ID NO: 7265917 - DNA, 22 bp, Homo sapiens
ttggaattgctcataagagaga

SEQ ID NO: 7265918 - DNA, 22 bp, Homo sapiens
ttggaattgtgaactaagtgat

SEQ ID NO: 7265919 - DNA, 22 bp, Homo sapiens
ttggaatttagggaatattcat

SEQ ID NO: 7265920 - DNA, 22 bp, Homo sapiens
ttggaatttagtaaaataatgc

SEQ ID NO: 7265921 - DNA, 22 bp, Homo sapiens
ttggaatttcatgtaagtgact

SEQ ID NO: 7265922 - DNA, 22 bp, Homo sapiens
ttggaatttgagaccaagaaaa

SEQ ID NO: 7265923 - DNA, 22 bp, Homo sapiens
ttggaatttgcttcagctaata

SEQ ID NO: 7265924 - DNA, 21 bp, Homo sapiens
ttggaatttgggagctatgtg

SEQ ID NO: 7265925 - DNA, 22 bp, Homo sapiens
ttggaattttccaggtacagtg

SEQ ID NO: 7265926 - DNA, 22 bp, Homo sapiens
ttggaaatacgagtagtatcat

SEQ ID NO: 7265927 - DNA, 22 bp, Homo sapiens
ttggaaatacagcagttacttt

SEQ ID NO: 7265928 - DNA, 22 bp, Homo sapiens
ttgcattgttgcaatgaagtat

SEQ ID NO: 7265929 - DNA, 22 bp, Homo sapiens
ttgacaatccctgttagaagtg

SEQ ID NO: 7265930 - DNA, 22 bp, Homo sapiens
ttttatgtgtgaaatgctgtct

SEQ ID NO: 7265931 - DNA, 22 bp, Homo sapiens
ttttatgttcctgaagctatct

SEQ ID NO: 7265932 - DNA, 22 bp, Homo sapiens
ttttatgttcctctttatgcga

SEQ ID NO: 7265933 - DNA, 22 bp, Homo sapiens
ttttattggagtgataccaagc

SEQ ID NO: 7265934 - DNA, 22 bp, Homo sapiens
ttttaattgcaattatggtccc

SEQ ID NO: 7265935 - DNA, 23 bp, Homo sapiens
ttttaatttggacataagaagat

SEQ ID NO: 7265936 - DNA, 22 bp, Homo sapiens
ttttatgtaatccttactgtcg

SEQ ID NO: 7265937 - DNA, 22 bp, Homo sapiens
ttttatgtaatccttactgtcg

SEQ ID NO: 7265938 - DNA, 22 bp, Homo sapiens
tttgctttgggaggttgtctgg

SEQ ID NO: 7265939 - DNA, 22 bp, Homo sapiens
tttgataatacacaagagaaag

SEQ ID NO: 7265940 - DNA, 22 bp, Homo sapiens
tttgagttttacctgtattact

SEQ ID NO: 7265941 - DNA, 22 bp, Homo sapiens
tttggtttagggtcatttaaca

SEQ ID NO: 7265942 - DNA, 22 bp, Homo sapiens
tttggtgtctgaaaataacagt

SEQ ID NO: 7265943 - DNA, 22 bp, Homo sapiens
tttggtcttttgtaagttatct

SEQ ID NO: 7265944 - DNA, 22 bp, Homo sapiens
tttgtaaaagcccaagctgtag

SEQ ID NO: 7265945 - DNA, 22 bp, Homo sapiens
tttggaaaatattgaactggtt

SEQ ID NO: 7265946 - DNA, 22 bp, Homo sapiens
tttttataccacctctcactta

SEQ ID NO: 7265947 - DNA, 22 bp, Homo sapiens
acacccagctgggccacctcca

SEQ ID NO: 7265948 - DNA, 22 bp, Homo sapiens
acaagttttggaagtcttaagg

SEQ ID NO: 7265949 - DNA, 23 bp, Homo sapiens
aatttggttgatgaaagcattgt

SEQ ID NO: 7265950 - DNA, 22 bp, Homo sapiens
aatttggttttaagagcatcag

SEQ ID NO: 7265951 - DNA, 23 bp, Homo sapiens
aatttggtatatctgaaccactg

SEQ ID NO: 7265952 - DNA, 22 bp, Homo sapiens
aatttggtgtcttagtttccct

SEQ ID NO: 7265953 - DNA, 22 bp, Homo sapiens
aatttggtgtgttccaggaact

SEQ ID NO: 7265954 - DNA, 22 bp, Homo sapiens
aatgtattatacataatttgtg

SEQ ID NO: 7265955 - DNA, 21 bp, Homo sapiens
aatgtatgtttatctcacagt

SEQ ID NO: 7265956 - DNA, 22 bp, Homo sapiens
aatgctctctgccatagctaac

SEQ ID NO: 7265957 - DNA, 22 bp, Homo sapiens
aatgctctgtctctgacagtgg

SEQ ID NO: 7265958 - DNA, 22 bp, Homo sapiens
aatgctctttaacctattctga

SEQ ID NO: 7265959 - DNA, 22 bp, Homo sapiens
acttttatgataatcaatgttc

SEQ ID NO: 7265960 - DNA, 22 bp, Homo sapiens
aagtgtttacttaaagtcatgg

SEQ ID NO: 7265961 - DNA, 22 bp, Homo sapiens
aataagcaagcctgtgtgcaag

SEQ ID NO: 7265962 - DNA, 20 bp, Homo sapiens
aatagcacagctcaaacatt

SEQ ID NO: 7265963 - DNA, 22 bp, Homo sapiens
acatgacagtgcttagcaaact

SEQ ID NO: 7265964 - DNA, 22 bp, Homo sapiens
aaaataacttctactatttgca

SEQ ID NO: 7265965 - DNA, 22 bp, Homo sapiens
aaaacactgcaaagctgattgg

SEQ ID NO: 7265966 - DNA, 22 bp, Homo sapiens
aaatatttgtctgaggcggttg

SEQ ID NO: 7265967 - DNA, 23 bp, Homo sapiens
aaatattcttttttagtaagtgc

SEQ ID NO: 7265968 - DNA, 22 bp, Homo sapiens
aaatatagtgacacttatagtc

SEQ ID NO: 7265969 - DNA, 22 bp, Homo sapiens
aaatagtcctgggaatagtact

SEQ ID NO: 7265970 - DNA, 22 bp, Homo sapiens
aaatatagcaattatgcctact

SEQ ID NO: 7265971 - DNA, 20 bp, Homo sapiens
aaagtctgtttatctctgga

SEQ ID NO: 7265972 - DNA, 22 bp, Homo sapiens
acacacatgcctttcctaagta

SEQ ID NO: 7265973 - DNA, 22 bp, Homo sapiens
acacataagcctaatcatctcc

SEQ ID NO: 7265974 - DNA, 22 bp, Homo sapiens
aatatcttctaaggatagaact

SEQ ID NO: 7265975 - DNA, 22 bp, Homo sapiens
aatatttctgtagctatgttct

SEQ ID NO: 7265976 - DNA, 22 bp, Homo sapiens
aagtctttttgaatctataact

SEQ ID NO: 7265977 - DNA, 21 bp, Homo sapiens
attttgtacatagaatttgtc

SEQ ID NO: 7265978 - DNA, 22 bp, Homo sapiens
attttggtagtgggaggttgag

SEQ ID NO: 7265979 - DNA, 22 bp, Homo sapiens
attttgttgaggtaattgtcaa

SEQ ID NO: 7265980 - DNA, 22 bp, Homo sapiens
attttgttaatgtcaccgtgct

SEQ ID NO: 7265981 - DNA, 22 bp, Homo sapiens
attttgttatagaactctgtga

SEQ ID NO: 7265982 - DNA, 22 bp, Homo sapiens
attttttatataccaaggtggg

SEQ ID NO: 7265983 - DNA, 22 bp, Homo sapiens
attttttagccaagactctgca

SEQ ID NO: 7265984 - DNA, 22 bp, Homo sapiens
attgtattctgcacctttgtta

SEQ ID NO: 7265985 - DNA, 22 bp, Homo sapiens
attgtattataattaggccaaa

SEQ ID NO: 7265986 - DNA, 22 bp, Homo sapiens
atggaattaataggggaatact

SEQ ID NO: 7265987 - DNA, 22 bp, Homo sapiens
atggaattgagcatcagttgtt

SEQ ID NO: 7265988 - DNA, 22 bp, Homo sapiens
atggaattgaagacagcatagg

SEQ ID NO: 7265989 - DNA, 22 bp, Homo sapiens
atggaatttctccggctccacc

SEQ ID NO: 7265990 - DNA, 22 bp, Homo sapiens
atggaattaaaagtcaagtaat

SEQ ID NO: 7265991 - DNA, 22 bp, Homo sapiens
atggaatttggactggaagtcc

SEQ ID NO: 7265992 - DNA, 22 bp, Homo sapiens
atggaatttgcaataacaggat

SEQ ID NO: 7265993 - DNA, 22 bp, Homo sapiens
atggaatttggagattaggcat

SEQ ID NO: 7265994 - DNA, 22 bp, Homo sapiens
atgactttcctggcaaaagttg

SEQ ID NO: 7265995 - DNA, 22 bp, Homo sapiens
atgactttgttgttttccagcg

SEQ ID NO: 7265996 - DNA, 22 bp, Homo sapiens
atgaccagccgagataaacaga

SEQ ID NO: 7265997 - DNA, 22 bp, Homo sapiens
atcttaatcgagtccatgaaaa

SEQ ID NO: 7265998 - DNA, 22 bp, Homo sapiens
cacatttaatcctttataagta

SEQ ID NO: 7265999 - DNA, 22 bp, Homo sapiens
cacatttaagtgcttgttcaga

SEQ ID NO: 7266000 - DNA, 22 bp, Homo sapiens
caagcttgtttctcctgggggt

SEQ ID NO: 7266001 - DNA, 22 bp, Homo sapiens
agaagccaaaggggccagatat

SEQ ID NO: 7266002 - DNA, 22 bp, Homo sapiens
agaagccattccctgtaggctc

SEQ ID NO: 7266003 - DNA, 21 bp, Homo sapiens
agaagcctggggaatgtggct

SEQ ID NO: 7266004 - DNA, 22 bp, Homo sapiens
agaagccatagtctgggaggca

SEQ ID NO: 7266005 - DNA, 22 bp, Homo sapiens
agaaatatgctgattagatgaa

SEQ ID NO: 7266006 - DNA, 22 bp, Homo sapiens
atatagttgggtttcattctac

SEQ ID NO: 7266007 - DNA, 22 bp, Homo sapiens
ataagcttgatgtaactaacca

SEQ ID NO: 7266008 - DNA, 22 bp, Homo sapiens
ataacactaaatgtatgtaaca

SEQ ID NO: 7266009 - DNA, 22 bp, Homo sapiens
ataacagactgatttttaaatg

SEQ ID NO: 7266010 - DNA, 22 bp, Homo sapiens
agggctgaagggaggtgctcat

SEQ ID NO: 7266011 - DNA, 22 bp, Homo sapiens
agggctgacaaatggcagtgac

SEQ ID NO: 7266012 - DNA, 22 bp, Homo sapiens
accacttatcatcactatctca

SEQ ID NO: 7266013 - DNA, 23 bp, Homo sapiens
acagggctagctgacagtggtat

SEQ ID NO: 7266014 - DNA, 22 bp, Homo sapiens
acatagttagcttagagatact

SEQ ID NO: 7266015 - DNA, 22 bp, Homo sapiens
cagtgtggctgagacagaggct

SEQ ID NO: 7266016 - DNA, 22 bp, Homo sapiens
cagtgtggcttagggaataggc

SEQ ID NO: 7266017 - DNA, 22 bp, Homo sapiens
cattgcactttgggtccaggac

SEQ ID NO: 7266018 - DNA, 22 bp, Homo sapiens
ccacctgtgcttggtactccat

SEQ ID NO: 7266019 - DNA, 22 bp, Homo sapiens
agggcattggcacagatctgct

SEQ ID NO: 7266020 - DNA, 22 bp, Homo sapiens
cctctgtgggccgggcctgctg

SEQ ID NO: 7266021 - DNA, 22 bp, Homo sapiens
cctacataacactgccaaactg

SEQ ID NO: 7266022 - DNA, 22 bp, Homo sapiens
agggctgacagtggcgtggcgt

SEQ ID NO: 7266023 - DNA, 22 bp, Homo sapiens
agggctgagaatgacagggccg

SEQ ID NO: 7266024 - DNA, 20 bp, Homo sapiens
agggctgagaagggactagc

SEQ ID NO: 7266025 - DNA, 22 bp, Homo sapiens
agggctgagactaaggccagat

SEQ ID NO: 7266026 - DNA, 22 bp, Homo sapiens
agggctgagcccaggcatgtag

SEQ ID NO: 7266027 - DNA, 22 bp, Homo sapiens
agggctgaggcgagggagatgc

SEQ ID NO: 7266028 - DNA, 22 bp, Homo sapiens
aggctgtggcatcacatcagga

SEQ ID NO: 7266029 - DNA, 22 bp, Homo sapiens
atacatacgtacatacgtatgt

SEQ ID NO: 7266030 - DNA, 22 bp, Homo sapiens
atagcaccatgactaaacaatt

SEQ ID NO: 7266031 - DNA, 22 bp, Homo sapiens
ataagcacacaaatacatatat

SEQ ID NO: 7266032 - DNA, 20 bp, Homo sapiens
atatgcatgtgttttcactt

SEQ ID NO: 7266033 - DNA, 22 bp, Homo sapiens
atatgcattaacattgtaggag

SEQ ID NO: 7266034 - DNA, 22 bp, Homo sapiens
atatgcatatgtcaaaacttat

SEQ ID NO: 7266035 - DNA, 22 bp, Homo sapiens
atatgcatctgtgtgcgtgtct

SEQ ID NO: 7266036 - DNA, 22 bp, Homo sapiens
atatgcattcatacttagtgga

SEQ ID NO: 7266037 - DNA, 22 bp, Homo sapiens
ctgggctcagatgagaggaagg

SEQ ID NO: 7266038 - DNA, 22 bp, Homo sapiens
atatgcacatacatacataggt

SEQ ID NO: 7266039 - DNA, 22 bp, Homo sapiens
atatgcacactctgcccacaga

SEQ ID NO: 7266040 - DNA, 22 bp, Homo sapiens
atatgcatataaagcttttagt

SEQ ID NO: 7266041 - DNA, 22 bp, Homo sapiens
atcaaagaatgtgactgaaata

SEQ ID NO: 7266042 - DNA, 22 bp, Homo sapiens
atcaaatacaaagggcataagg

SEQ ID NO: 7266043 - DNA, 22 bp, Homo sapiens
atctgaagtccttataatctga

SEQ ID NO: 7266044 - DNA, 22 bp, Homo sapiens
atcctgtgttgctactggagga

SEQ ID NO: 7266045 - DNA, 22 bp, Homo sapiens
atcctgtggggcggctgcaggg

SEQ ID NO: 7266046 - DNA, 22 bp, Homo sapiens
agtcttatggttaaatagatgc

SEQ ID NO: 7266047 - DNA, 22 bp, Homo sapiens
agtcttatggccatctctgatt

SEQ ID NO: 7266048 - DNA, 22 bp, Homo sapiens
agtcttatggttaaatagatgc

SEQ ID NO: 7266049 - DNA, 22 bp, Homo sapiens
agtcttatatcactatgctctg

SEQ ID NO: 7266050 - DNA, 22 bp, Homo sapiens
ctgaaataaagttgctaaaatt

SEQ ID NO: 7266051 - DNA, 23 bp, Homo sapiens
ctgaaataccagaaaatcagtgt

SEQ ID NO: 7266052 - DNA, 22 bp, Homo sapiens
ctgacttttttcagccacagtg

SEQ ID NO: 7266053 - DNA, 22 bp, Homo sapiens
ctgactttgctcataggtcaaa

SEQ ID NO: 7266054 - DNA, 22 bp, Homo sapiens
ctgactttagaacccaaaaagt

SEQ ID NO: 7266055 - DNA, 22 bp, Homo sapiens
ctgactttgacttggtcattga

SEQ ID NO: 7266056 - DNA, 22 bp, Homo sapiens
atgatatttgcaatgtgcttgc

SEQ ID NO: 7266057 - DNA, 22 bp, Homo sapiens
gaaagtatttacattaacatct

SEQ ID NO: 7266058 - DNA, 22 bp, Homo sapiens
atgacagtactggtgacaatac

SEQ ID NO: 7266059 - DNA, 22 bp, Homo sapiens
atgacagtaggtaaatgatagc

SEQ ID NO: 7266060 - DNA, 22 bp, Homo sapiens
atgacagttctacacttaatct

SEQ ID NO: 7266061 - DNA, 22 bp, Homo sapiens
atgacaggaataactatgatgg

SEQ ID NO: 7266062 - DNA, 22 bp, Homo sapiens
atgacaggtgattttatgcttt

SEQ ID NO: 7266063 - DNA, 22 bp, Homo sapiens
atgacaggttttgtggattata

SEQ ID NO: 7266064 - DNA, 22 bp, Homo sapiens
atgaactatcatcagttccacc

SEQ ID NO: 7266065 - DNA, 22 bp, Homo sapiens
atgaactacatgatcctgaaat

SEQ ID NO: 7266066 - DNA, 22 bp, Homo sapiens
atgaactaagagtcattagtgt

SEQ ID NO: 7266067 - DNA, 22 bp, Homo sapiens
atgaactagccaggttgtgctg

SEQ ID NO: 7266068 - DNA, 22 bp, Homo sapiens
gaataattttgatcagaaggga

SEQ ID NO: 7266069 - DNA, 22 bp, Homo sapiens
gaataattgtgatgcttgaagt

SEQ ID NO: 7266070 - DNA, 22 bp, Homo sapiens
gaatatttttaaagggactaat

SEQ ID NO: 7266071 - DNA, 22 bp, Homo sapiens
gatatattttccatggtctgca

SEQ ID NO: 7266072 - DNA, 23 bp, Homo sapiens
atgtctctgggcagtagggcttg

SEQ ID NO: 7266073 - DNA, 19 bp, Homo sapiens
atgtctctgtagcacatac

SEQ ID NO: 7266074 - DNA, 22 bp, Homo sapiens
atgtctctcaggtttaacttta

SEQ ID NO: 7266075 - DNA, 22 bp, Homo sapiens
atgtgacaatatttggtcttat

SEQ ID NO: 7266076 - DNA, 22 bp, Homo sapiens
atgtctgctttccttttaatca

SEQ ID NO: 7266077 - DNA, 22 bp, Homo sapiens
atgtctctttactcttagaacc

SEQ ID NO: 7266078 - DNA, 22 bp, Homo sapiens
atgtctctttagagcaacagta

SEQ ID NO: 7266079 - DNA, 22 bp, Homo sapiens
atttggaacaaatattagtaaa

SEQ ID NO: 7266080 - DNA, 22 bp, Homo sapiens
atttggaaaagcggtaacttgc

SEQ ID NO: 7266081 - DNA, 22 bp, Homo sapiens
atttggaatagctgtagaaata

SEQ ID NO: 7266082 - DNA, 22 bp, Homo sapiens
atttggaagtttttgtgggaat

SEQ ID NO: 7266083 - DNA, 22 bp, Homo sapiens
atttggaagtttggagtgaagg

SEQ ID NO: 7266084 - DNA, 22 bp, Homo sapiens
atttggaatgtgtttgatcacc

SEQ ID NO: 7266085 - DNA, 22 bp, Homo sapiens
atttggaatggtctggcatttg

SEQ ID NO: 7266086 - DNA, 22 bp, Homo sapiens
atttttatgacaaaccatcctc

SEQ ID NO: 7266087 - DNA, 22 bp, Homo sapiens
attgtctctttcaataacttgt

SEQ ID NO: 7266088 - DNA, 22 bp, Homo sapiens
attgtcacttaaaagtgcatgt

SEQ ID NO: 7266089 - DNA, 20 bp, Homo sapiens
gcagtgtgtatgaatagctg

SEQ ID NO: 7266090 - DNA, 22 bp, Homo sapiens
attctttacattggcttcttcc

SEQ ID NO: 7266091 - DNA, 22 bp, Homo sapiens
attcttcagtatgtgtggattg

SEQ ID NO: 7266092 - DNA, 22 bp, Homo sapiens
gcagggctgatgttattgacga

SEQ ID NO: 7266093 - DNA, 22 bp, Homo sapiens
gcagggctgcagagggcactgt

SEQ ID NO: 7266094 - DNA, 22 bp, Homo sapiens
gcagggctgggacttactggta

SEQ ID NO: 7266095 - DNA, 22 bp, Homo sapiens
attacagtgggtaaacagaatt

SEQ ID NO: 7266096 - DNA, 22 bp, Homo sapiens
attacagttctacacatccttt

SEQ ID NO: 7266097 - DNA, 22 bp, Homo sapiens
attacagttaatttaccttctt

SEQ ID NO: 7266098 - DNA, 23 bp, Homo sapiens
attacagttaattacaacatctt

SEQ ID NO: 7266099 - DNA, 22 bp, Homo sapiens
attacagttctgcaggtagttt

SEQ ID NO: 7266100 - DNA, 21 bp, Homo sapiens
cactttaatggatatttgttt

SEQ ID NO: 7266101 - DNA, 22 bp, Homo sapiens
cacatttagaggttagcatggt

SEQ ID NO: 7266102 - DNA, 22 bp, Homo sapiens
cagcaccatttgcagcctcttt

SEQ ID NO: 7266103 - DNA, 22 bp, Homo sapiens
cagcaccagcatattccagggc

SEQ ID NO: 7266104 - DNA, 22 bp, Homo sapiens
cagcaccaggcagacctggagc

SEQ ID NO: 7266105 - DNA, 22 bp, Homo sapiens
gtcatatacactgcatgtaatc

SEQ ID NO: 7266106 - DNA, 22 bp, Homo sapiens
gtcatataggtaggattcagct

SEQ ID NO: 7266107 - DNA, 22 bp, Homo sapiens
gtcattattctgggattctata

SEQ ID NO: 7266108 - DNA, 22 bp, Homo sapiens
cagcaccattttcctggtcagc

SEQ ID NO: 7266109 - DNA, 22 bp, Homo sapiens
catttaagagaaatatttagtt

SEQ ID NO: 7266110 - DNA, 22 bp, Homo sapiens
catttacacttctaaccacaag

SEQ ID NO: 7266111 - DNA, 22 bp, Homo sapiens
catttattcatgatctgtagct

SEQ ID NO: 7266112 - DNA, 22 bp, Homo sapiens
cattagctatctgtttacatta

SEQ ID NO: 7266113 - DNA, 22 bp, Homo sapiens
cataatgaacattagctactgt

SEQ ID NO: 7266114 - DNA, 22 bp, Homo sapiens
tactttatcagcgtcaaaggta

SEQ ID NO: 7266115 - DNA, 22 bp, Homo sapiens
caggcctgagacatctgagata

SEQ ID NO: 7266116 - DNA, 20 bp, Homo sapiens
tacattgtagaaatattcaa

SEQ ID NO: 7266117 - DNA, 22 bp, Homo sapiens
tacatgtttactccaagtcagg

SEQ ID NO: 7266118 - DNA, 22 bp, Homo sapiens
taatatttctaccctgctgcct

SEQ ID NO: 7266119 - DNA, 22 bp, Homo sapiens
taataattagttattgatcgtg

SEQ ID NO: 7266120 - DNA, 21 bp, Homo sapiens
taataattccactacagagta

SEQ ID NO: 7266121 - DNA, 22 bp, Homo sapiens
taataattggcaatgttgagca

SEQ ID NO: 7266122 - DNA, 22 bp, Homo sapiens
taataattttaaagaaggctag

SEQ ID NO: 7266123 - DNA, 22 bp, Homo sapiens
taataattggctaaccctggga

SEQ ID NO: 7266124 - DNA, 22 bp, Homo sapiens
tattatgcaaatattcctacct

SEQ ID NO: 7266125 - DNA, 22 bp, Homo sapiens
tattattaaatggcagaatttt

SEQ ID NO: 7266126 - DNA, 22 bp, Homo sapiens
tcaatagataaagctacataaa

SEQ ID NO: 7266127 - DNA, 22 bp, Homo sapiens
tagattgtaagctccttgaggg

SEQ ID NO: 7266128 - DNA, 23 bp, Homo sapiens
cagggctggtagggaagagcgtg

SEQ ID NO: 7266129 - DNA, 22 bp, Homo sapiens
tggctgagaccatcagggtgta

SEQ ID NO: 7266130 - DNA, 22 bp, Homo sapiens
cccaggctggagggcagtgtca

SEQ ID NO: 7266131 - DNA, 22 bp, Homo sapiens
cccaggctggcactgctgaagt

SEQ ID NO: 7266132 - DNA, 22 bp, Homo sapiens
cccaggctggtcctgaactcct

SEQ ID NO: 7266133 - DNA, 22 bp, Homo sapiens
cccattcatcctcgcttccttc

SEQ ID NO: 7266134 - DNA, 22 bp, Homo sapiens
tggaagggagctggaatttgga

SEQ ID NO: 7266135 - DNA, 22 bp, Homo sapiens
tgaggcagatatttattgggtt

SEQ ID NO: 7266136 - DNA, 21 bp, Homo sapiens
tctggaagaaaaaagtattat

SEQ ID NO: 7266137 - DNA, 22 bp, Homo sapiens
ccagctctgcagggcctggggt

SEQ ID NO: 7266138 - DNA, 22 bp, Homo sapiens
tctttcttctttcatagtgtga

SEQ ID NO: 7266139 - DNA, 22 bp, Homo sapiens
tctttggtcatcatgggaagca

SEQ ID NO: 7266140 - DNA, 22 bp, Homo sapiens
tctttggtcagaaagattacac

SEQ ID NO: 7266141 - DNA, 22 bp, Homo sapiens
tctttggtattcacttgtgaag

SEQ ID NO: 7266142 - DNA, 23 bp, Homo sapiens
tctttggtaaataaagtggggat

SEQ ID NO: 7266143 - DNA, 22 bp, Homo sapiens
tctttggtgatatctctttggt

SEQ ID NO: 7266144 - DNA, 22 bp, Homo sapiens
tctttggtgaatggtcatccag

SEQ ID NO: 7266145 - DNA, 22 bp, Homo sapiens
tctttggttgcactgcaggtgt

SEQ ID NO: 7266146 - DNA, 22 bp, Homo sapiens
tcttcacatggagaagcaactc

SEQ ID NO: 7266147 - DNA, 23 bp, Homo sapiens
tgttccagatacgccttttcctc

SEQ ID NO: 7266148 - DNA, 22 bp, Homo sapiens
ttagaaaaaggctgtggtctta

SEQ ID NO: 7266149 - DNA, 22 bp, Homo sapiens
cctgtctgcatgatccctgcca

SEQ ID NO: 7266150 - DNA, 22 bp, Homo sapiens
cctgtctggaacatggcctgtt

SEQ ID NO: 7266151 - DNA, 22 bp, Homo sapiens
cctgtctgtcctttgcattctt

SEQ ID NO: 7266152 - DNA, 22 bp, Homo sapiens
ctacttgttcactgtaggtcgc

SEQ ID NO: 7266153 - DNA, 22 bp, Homo sapiens
ctcctggccctgagctcccagg

SEQ ID NO: 7266154 - DNA, 22 bp, Homo sapiens
tttagtatcctatctcatttaa

SEQ ID NO: 7266155 - DNA, 22 bp, Homo sapiens
tttatttaccttatgtcctcca

SEQ ID NO: 7266156 - DNA, 22 bp, Homo sapiens
tttatttaccttatgtcctcca

SEQ ID NO: 7266157 - DNA, 22 bp, Homo sapiens
ctcctggcactcagtgtggaag

SEQ ID NO: 7266158 - DNA, 22 bp, Homo sapiens
ctcctggcaggctgagtgaaat

SEQ ID NO: 7266159 - DNA, 22 bp, Homo sapiens
ctcctggcactgtcttgaccca

SEQ ID NO: 7266160 - DNA, 17 bp, Homo sapiens
ctcctggccacccctct

SEQ ID NO: 7266161 - DNA, 22 bp, Homo sapiens
ctcctggcagttccccttgtca

SEQ ID NO: 7266162 - DNA, 22 bp, Homo sapiens
ctcctggccccagatcccaatc

SEQ ID NO: 7266163 - DNA, 22 bp, Homo sapiens
ctcctggccacgttcttgctgg

SEQ ID NO: 7266164 - DNA, 22 bp, Homo sapiens
tttattgttgggtcttaagctg

SEQ ID NO: 7266165 - DNA, 22 bp, Homo sapiens
ttgtgaaatcgtgtttggaagc

SEQ ID NO: 7266166 - DNA, 20 bp, Homo sapiens
ttgtggtttagattatctga

SEQ ID NO: 7266167 - DNA, 22 bp, Homo sapiens
ttgtgtaattagcaaacaaatc

SEQ ID NO: 7266168 - DNA, 22 bp, Homo sapiens
ttgtctttggaaatttaatgtt

SEQ ID NO: 7266169 - DNA, 22 bp, Homo sapiens
ttttcacttaaggaatttcatg

SEQ ID NO: 7266170 - DNA, 22 bp, Homo sapiens
tttgcaaagttatttagactca

SEQ ID NO: 7266171 - DNA, 22 bp, Homo sapiens
ctgaggcatgggaagttgggtg

SEQ ID NO: 7266172 - DNA, 21 bp, Homo sapiens
ctgaggcatgcaggcctgggc

SEQ ID NO: 7266173 - DNA, 22 bp, Homo sapiens
ctgggctgcaggagtggggcaa

SEQ ID NO: 7266174 - DNA, 22 bp, Homo sapiens
ctggcccaggtggtcgttgagg

SEQ ID NO: 7266175 - DNA, 22 bp, Homo sapiens
ctggccctcggagtccagctgc

SEQ ID NO: 7266176 - DNA, 22 bp, Homo sapiens
cttgatctacatagtgaaaccc

SEQ ID NO: 7266177 - DNA, 22 bp, Homo sapiens
cttcctggccattgccatggca

SEQ ID NO: 7266178 - DNA, 22 bp, Homo sapiens
cttatttgcccatgtttcttta

SEQ ID NO: 7266179 - DNA, 22 bp, Homo sapiens
gaagattgaaggctgggaatta

SEQ ID NO: 7266180 - DNA, 19 bp, Homo sapiens
gaagcctgaaataaagtga

SEQ ID NO: 7266181 - DNA, 22 bp, Homo sapiens
gaatatcccgctatgcaaagta

SEQ ID NO: 7266182 - DNA, 22 bp, Homo sapiens
gtgaactattgggtatcataaa

SEQ ID NO: 7266183 - DNA, 22 bp, Homo sapiens
gtgaactaaggattcaaacttc

SEQ ID NO: 7266184 - DNA, 22 bp, Homo sapiens
gtgaactatttcggaaggggaa

SEQ ID NO: 7266185 - DNA, 22 bp, Homo sapiens
gtgcatttgtgcatgcacatgt

SEQ ID NO: 7266186 - DNA, 22 bp, Homo sapiens
gtaaaaaggccaagcccttgtg

SEQ ID NO: 7266187 - DNA, 22 bp, Homo sapiens
gtattattaagtgtatttgacc

SEQ ID NO: 7266188 - DNA, 22 bp, Homo sapiens
gtcattttctagaattatttga

SEQ ID NO: 7266189 - DNA, 22 bp, Homo sapiens
ggtttcaaagtggacagttagt

SEQ ID NO: 7266190 - DNA, 22 bp, Homo sapiens
ggtcacttcagataactggtgt

SEQ ID NO: 7266191 - DNA, 22 bp, Homo sapiens
ggagacagtgacttagagactg

SEQ ID NO: 7266192 - DNA, 22 bp, Homo sapiens
gctgggcttctcaatgctgcct

SEQ ID NO: 7266193 - DNA, 22 bp, Homo sapiens
gctgtgtatcagatgccacggg

SEQ ID NO: 7266194 - DNA, 22 bp, Homo sapiens
gctactgatcaggtttgcttta

SEQ ID NO: 7266195 - DNA, 22 bp, Homo sapiens
gctgaggctcaagtcatgggtc

SEQ ID NO: 7266196 - DNA, 22 bp, Homo sapiens
gctgaggccccagggtgatggg

SEQ ID NO: 7266197 - DNA, 22 bp, Homo sapiens
gcagggctgtaatttgagcctg

SEQ ID NO: 7266198 - DNA, 22 bp, Homo sapiens
gcagggctgggtgggagacaga

SEQ ID NO: 7266199 - DNA, 22 bp, Homo sapiens
gcagggctggggctgctcctga

SEQ ID NO: 7266200 - DNA, 22 bp, Homo sapiens
gcagggctgttcaggagggtgg

SEQ ID NO: 7266201 - DNA, 22 bp, Homo sapiens
gcagggctgtggacactttggt

SEQ ID NO: 7266202 - DNA, 22 bp, Homo sapiens
gcagggcttagaaatggtggct

SEQ ID NO: 7266203 - DNA, 22 bp, Homo sapiens
gccagctctgtggctgtacttg

SEQ ID NO: 7266204 - DNA, 22 bp, Homo sapiens
tcaagaatttttaatgtgactg

SEQ ID NO: 7266205 - DNA, 20 bp, Homo sapiens
tcaattttctacaacatttg

SEQ ID NO: 7266206 - DNA, 22 bp, Homo sapiens
tcattatagagttgtattttag

SEQ ID NO: 7266207 - DNA, 22 bp, Homo sapiens
tccagtttatttttggcagggt

SEQ ID NO: 7266208 - DNA, 22 bp, Homo sapiens
tccagtttcatagctaaggaac

SEQ ID NO: 7266209 - DNA, 22 bp, Homo sapiens
tcattgcagactaacaatctca

SEQ ID NO: 7266210 - DNA, 22 bp, Homo sapiens
taactaactagtgttcaaaata

SEQ ID NO: 7266211 - DNA, 22 bp, Homo sapiens
taaattatgttccatgtccttt

SEQ ID NO: 7266212 - DNA, 22 bp, Homo sapiens
taaattatgtcacatgactctg

SEQ ID NO: 7266213 - DNA, 22 bp, Homo sapiens
gtttttatatcctgtggagtgt

SEQ ID NO: 7266214 - DNA, 22 bp, Homo sapiens
gtttttatctaatagcagttat

SEQ ID NO: 7266215 - DNA, 22 bp, Homo sapiens
gtttttattgtgtaaatgtggg

SEQ ID NO: 7266216 - DNA, 22 bp, Homo sapiens
gttgcacaacttgaatggctgg

SEQ ID NO: 7266217 - DNA, 22 bp, Homo sapiens
taataattaacagtgatgggtc

SEQ ID NO: 7266218 - DNA, 22 bp, Homo sapiens
taatgtttttctcaacattgct

SEQ ID NO: 7266219 - DNA, 22 bp, Homo sapiens
taatagcattatcatcaaaact

SEQ ID NO: 7266220 - DNA, 19 bp, Homo sapiens
tacatacttattctaaaag

SEQ ID NO: 7266221 - DNA, 22 bp, Homo sapiens
tacatctagccttacaattatt

SEQ ID NO: 7266222 - DNA, 22 bp, Homo sapiens
tacaacaatttccacattagaa

SEQ ID NO: 7266223 - DNA, 22 bp, Homo sapiens
tacaacactggttcgacatgtg

SEQ ID NO: 7266224 - DNA, 22 bp, Homo sapiens
tattcaaagtaccttcattgcc

SEQ ID NO: 7266225 - DNA, 22 bp, Homo sapiens
tattccaaaatcccaaactgcc

SEQ ID NO: 7266226 - DNA, 22 bp, Homo sapiens
tattgacactttttgtgtagcc

SEQ ID NO: 7266227 - DNA, 22 bp, Homo sapiens
tatttattggacagtgttgctg

SEQ ID NO: 7266228 - DNA, 22 bp, Homo sapiens
tatttattcattcagcaagcat

SEQ ID NO: 7266229 - DNA, 22 bp, Homo sapiens
tataggactgatcacattttca

SEQ ID NO: 7266230 - DNA, 22 bp, Homo sapiens
tatagcacacagtttataaaag

SEQ ID NO: 7266231 - DNA, 22 bp, Homo sapiens
tatccaattcaccattgatggg

SEQ ID NO: 7266232 - DNA, 22 bp, Homo sapiens
tactttggaagagttcatacag

SEQ ID NO: 7266233 - DNA, 22 bp, Homo sapiens
tactttggggacaatatggaat

SEQ ID NO: 7266234 - DNA, 22 bp, Homo sapiens
ttacttttctattcgatatgtg

SEQ ID NO: 7266235 - DNA, 22 bp, Homo sapiens
ttacttcttgtctcatgcctat

SEQ ID NO: 7266236 - DNA, 21 bp, Homo sapiens
ttactttagaaattgcctttt

SEQ ID NO: 7266237 - DNA, 22 bp, Homo sapiens
ttactttagatcatactgtgtg

SEQ ID NO: 7266238 - DNA, 22 bp, Homo sapiens
ttactgtaaaggtcacatggtg

SEQ ID NO: 7266239 - DNA, 22 bp, Homo sapiens
ttacaaacaacagacatttatt

SEQ ID NO: 7266240 - DNA, 22 bp, Homo sapiens
ttacatgacaaagctttggctc

SEQ ID NO: 7266241 - DNA, 22 bp, Homo sapiens
ttacagtgactcacattaacaa

SEQ ID NO: 7266242 - DNA, 22 bp, Homo sapiens
ttacagtattgttaaactcttt

SEQ ID NO: 7266243 - DNA, 19 bp, Homo sapiens
ttacaggttgacatcaatt

SEQ ID NO: 7266244 - DNA, 22 bp, Homo sapiens
ttaacaatagagtttcttcagg

SEQ ID NO: 7266245 - DNA, 22 bp, Homo sapiens
tgttatttgggaaagttgtaca

SEQ ID NO: 7266246 - DNA, 22 bp, Homo sapiens
tgttatctgagcaacgtcgacg

SEQ ID NO: 7266247 - DNA, 22 bp, Homo sapiens
tgtttgaataacttggatatat

SEQ ID NO: 7266248 - DNA, 21 bp, Homo sapiens
tgtgtgaccttggacttgagc

SEQ ID NO: 7266249 - DNA, 22 bp, Homo sapiens
tgtgtgacacattgatatgtgc

SEQ ID NO: 7266250 - DNA, 22 bp, Homo sapiens
tgtgtgacctggggtgagatag

SEQ ID NO: 7266251 - DNA, 22 bp, Homo sapiens
ttagataaattaagactttaca

SEQ ID NO: 7266252 - DNA, 22 bp, Homo sapiens
ttctcttttagaggctccatga

SEQ ID NO: 7266253 - DNA, 22 bp, Homo sapiens
ttctcttttcaccagttgctaa

SEQ ID NO: 7266254 - DNA, 22 bp, Homo sapiens
ttctttagcaacttggatttag

SEQ ID NO: 7266255 - DNA, 22 bp, Homo sapiens
ttctttatcagttactcatagg

SEQ ID NO: 7266256 - DNA, 22 bp, Homo sapiens
ttctttaggtagatccagtttt

SEQ ID NO: 7266257 - DNA, 22 bp, Homo sapiens
ttgatgaaggtagatttgaaat

SEQ ID NO: 7266258 - DNA, 22 bp, Homo sapiens
ttgcaaataatagcctgaaact

SEQ ID NO: 7266259 - DNA, 22 bp, Homo sapiens
ttgaatgaccatgatgcaaggg

SEQ ID NO: 7266260 - DNA, 22 bp, Homo sapiens
ttctttatgttaatgaatctat

SEQ ID NO: 7266261 - DNA, 22 bp, Homo sapiens
tttctttatcatagcatctttg

SEQ ID NO: 7266262 - DNA, 22 bp, Homo sapiens
tttcttatgagcaagactctat

SEQ ID NO: 7266263 - DNA, 19 bp, Homo sapiens
tttcttccaaagactatgg

SEQ ID NO: 7266264 - DNA, 22 bp, Homo sapiens
tttcttccaaaggcacgttctc

SEQ ID NO: 7266265 - DNA, 22 bp, Homo sapiens
tttcaaagaccattaactatca

SEQ ID NO: 7266266 - DNA, 22 bp, Homo sapiens
ttggttgtgatacaagattttg

SEQ ID NO: 7266267 - DNA, 23 bp, Homo sapiens
ttggtttacaggaataagcaggg

SEQ ID NO: 7266268 - DNA, 22 bp, Homo sapiens
ttgtctctaagtgtgatcttca

SEQ ID NO: 7266269 - DNA, 22 bp, Homo sapiens
ttggtgaacacatacacatttt

SEQ ID NO: 7266270 - DNA, 22 bp, Homo sapiens
ttggtgactccccaccatgatg

SEQ ID NO: 7266271 - DNA, 22 bp, Homo sapiens
ttgtttttaaacatgtgactga

SEQ ID NO: 7266272 - DNA, 18 bp, Homo sapiens
ttgttttaagactctgtc

SEQ ID NO: 7266273 - DNA, 22 bp, Homo sapiens
ttgtgacaatacagcatggaga

SEQ ID NO: 7266274 - DNA, 22 bp, Homo sapiens
tttattaatgtagcatccatgg

SEQ ID NO: 7266275 - DNA, 22 bp, Homo sapiens
tttatacttcataatgtctatt

SEQ ID NO: 7266276 - DNA, 22 bp, Homo sapiens
tttatttgtcttgccatttagt

SEQ ID NO: 7266277 - DNA, 22 bp, Homo sapiens
tttattattctgttctctctac

SEQ ID NO: 7266278 - DNA, 22 bp, Homo sapiens
tttattatccagtgttgtcatg

SEQ ID NO: 7266279 - DNA, 22 bp, Homo sapiens
tttactttgtgtcaagtcaaga

SEQ ID NO: 7266280 - DNA, 22 bp, Homo sapiens
tttacttttggtaaggtcattt

SEQ ID NO: 7266281 - DNA, 22 bp, Homo sapiens
tttactttctcaagtatatagg

SEQ ID NO: 7266282 - DNA, 22 bp, Homo sapiens
tttaaaatttagacctctccac

SEQ ID NO: 7266283 - DNA, 22 bp, Homo sapiens
tttaatttgtatttctagaggg

SEQ ID NO: 7266284 - DNA, 22 bp, Homo sapiens
tttgtactgaagattgtaaact

SEQ ID NO: 7266285 - DNA, 22 bp, Homo sapiens
tttgtattacaaagtcacagta

SEQ ID NO: 7266286 - DNA, 22 bp, Homo sapiens
tttgtataagaacattctagca

SEQ ID NO: 7266287 - DNA, 22 bp, Homo sapiens
tttgtataaattggagcaatgt

SEQ ID NO: 7266288 - DNA, 22 bp, Homo sapiens
tttctttatcctcctttgcaca

SEQ ID NO: 7266289 - DNA, 22 bp, Homo sapiens
tttggcaaacttttaggacttt

SEQ ID NO: 7266290 - DNA, 22 bp, Homo sapiens
tttggcaatatctgaattatag

SEQ ID NO: 7266291 - DNA, 22 bp, Homo sapiens
tttggcaagaaaatgtgattga

SEQ ID NO: 7266292 - DNA, 23 bp, Homo sapiens
ttttgcaataagtcactggaata

SEQ ID NO: 7266293 - DNA, 22 bp, Homo sapiens
ttttatctacctatgctcattt

SEQ ID NO: 7266294 - DNA, 22 bp, Homo sapiens
gtcatcatttttagcatatggg

SEQ ID NO: 7266295 - DNA, 22 bp, Homo sapiens
gtgctgtgtctatcaggaataa

SEQ ID NO: 7266296 - DNA, 22 bp, Homo sapiens
cagcacatctgattatatgact

SEQ ID NO: 7266297 - DNA, 22 bp, Homo sapiens
cagcacataatcagtgattgtg

SEQ ID NO: 7266298 - DNA, 22 bp, Homo sapiens
cagcacagtgcagatgctgact

SEQ ID NO: 7266299 - DNA, 22 bp, Homo sapiens
cagcacagtttgcttggcagag

SEQ ID NO: 7266300 - DNA, 23 bp, Homo sapiens
cagcacagtacatttcctgtctc

SEQ ID NO: 7266301 - DNA, 22 bp, Homo sapiens
cagcaaagtaagctgacatgta

SEQ ID NO: 7266302 - DNA, 22 bp, Homo sapiens
cacaggaatgaacagggaaaga

SEQ ID NO: 7266303 - DNA, 22 bp, Homo sapiens
cacaggaattagcagcctaaaa

SEQ ID NO: 7266304 - DNA, 22 bp, Homo sapiens
cacaggaatcagcattaatggc

SEQ ID NO: 7266305 - DNA, 18 bp, Homo sapiens
cacaggaaggggaatatc

SEQ ID NO: 7266306 - DNA, 18 bp, Homo sapiens
gctttgcagaaatacaga

SEQ ID NO: 7266307 - DNA, 22 bp, Homo sapiens
attacatgagagaatgtaaata

SEQ ID NO: 7266308 - DNA, 22 bp, Homo sapiens
attactatgatttgatcattac

SEQ ID NO: 7266309 - DNA, 22 bp, Homo sapiens
attactagattgtcaagattta

SEQ ID NO: 7266310 - DNA, 22 bp, Homo sapiens
gcactatagctgcagcacagag

SEQ ID NO: 7266311 - DNA, 22 bp, Homo sapiens
attcactaggttgcaaaactgt

SEQ ID NO: 7266312 - DNA, 22 bp, Homo sapiens
gcactagatactgttcaggaaa

SEQ ID NO: 7266313 - DNA, 22 bp, Homo sapiens
gcatatcagcatcaaaacacag

SEQ ID NO: 7266314 - DNA, 22 bp, Homo sapiens
attgtgattagagaatatagag

SEQ ID NO: 7266315 - DNA, 22 bp, Homo sapiens
gataatttaagtcttgggggct

SEQ ID NO: 7266316 - DNA, 22 bp, Homo sapiens
atgtttaagaaagtcttccata

SEQ ID NO: 7266317 - DNA, 22 bp, Homo sapiens
atgtttaaaggagtcagagact

SEQ ID NO: 7266318 - DNA, 22 bp, Homo sapiens
atgcacaggaccacacataatg

SEQ ID NO: 7266319 - DNA, 22 bp, Homo sapiens
gacatttgtatgacactttaaa

SEQ ID NO: 7266320 - DNA, 22 bp, Homo sapiens
atgaacatcggaaatgagactg

SEQ ID NO: 7266321 - DNA, 22 bp, Homo sapiens
atgaaacagtgaattagtcaag

SEQ ID NO: 7266322 - DNA, 22 bp, Homo sapiens
atgaaacacacacgcgcatact

SEQ ID NO: 7266323 - DNA, 22 bp, Homo sapiens
gaaacatttgttgagtacttgc

SEQ ID NO: 7266324 - DNA, 22 bp, Homo sapiens
gaaacattgtgttctacagatt

SEQ ID NO: 7266325 - DNA, 22 bp, Homo sapiens
atgatcaagaattttgtattcc

SEQ ID NO: 7266326 - DNA, 22 bp, Homo sapiens
atgatgaaatgataggtttgtt

SEQ ID NO: 7266327 - DNA, 22 bp, Homo sapiens
atgatgaaattttctatcatgt

SEQ ID NO: 7266328 - DNA, 19 bp, Homo sapiens
atgatgcagagctgactca

SEQ ID NO: 7266329 - DNA, 22 bp, Homo sapiens
agttagagacacatgcacatgc

SEQ ID NO: 7266330 - DNA, 22 bp, Homo sapiens
agttagagcgcatattttatta

SEQ ID NO: 7266331 - DNA, 22 bp, Homo sapiens
agttagagttaatttcctaaca

SEQ ID NO: 7266332 - DNA, 22 bp, Homo sapiens
cctgtgcatccggtggtcattg

SEQ ID NO: 7266333 - DNA, 22 bp, Homo sapiens
cctgtgcaggctccataataga

SEQ ID NO: 7266334 - DNA, 22 bp, Homo sapiens
cctgtgcagcccttgccagttt

SEQ ID NO: 7266335 - DNA, 22 bp, Homo sapiens
cctgtgcactatctgcattttt

SEQ ID NO: 7266336 - DNA, 19 bp, Homo sapiens
cctgtgcacatgtgtcctt

SEQ ID NO: 7266337 - DNA, 22 bp, Homo sapiens
cctgtgcaatgttgaggtttca

SEQ ID NO: 7266338 - DNA, 22 bp, Homo sapiens
cctgtgcattgaccacactctc

SEQ ID NO: 7266339 - DNA, 22 bp, Homo sapiens
cctgtgcattgagtttgcaccc

SEQ ID NO: 7266340 - DNA, 22 bp, Homo sapiens
cctgtgcatgccagggtacacc

SEQ ID NO: 7266341 - DNA, 22 bp, Homo sapiens
cctgtgcattgcagggtgttca

SEQ ID NO: 7266342 - DNA, 19 bp, Homo sapiens
aggtcattgatagtgcagg

SEQ ID NO: 7266343 - DNA, 22 bp, Homo sapiens
aggtcattacaattatcatttt

SEQ ID NO: 7266344 - DNA, 22 bp, Homo sapiens
aggtcattaaagttaaatgagg

SEQ ID NO: 7266345 - DNA, 20 bp, Homo sapiens
ctaagcactttgataaactg

SEQ ID NO: 7266346 - DNA, 22 bp, Homo sapiens
agtatgcaaatgtcataagcat

SEQ ID NO: 7266347 - DNA, 22 bp, Homo sapiens
atattgatcttggaactgattt

SEQ ID NO: 7266348 - DNA, 22 bp, Homo sapiens
atattgcaatagatgcatcatt

SEQ ID NO: 7266349 - DNA, 22 bp, Homo sapiens
atatgcagtctcttgcccttct

SEQ ID NO: 7266350 - DNA, 22 bp, Homo sapiens
atattacttcctggtataaaat

SEQ ID NO: 7266351 - DNA, 22 bp, Homo sapiens
ataacttcatcaaataggcaca

SEQ ID NO: 7266352 - DNA, 22 bp, Homo sapiens
ataacatggagtttgtcattta

SEQ ID NO: 7266353 - DNA, 22 bp, Homo sapiens
ataacagtgacctctcagcacc

SEQ ID NO: 7266354 - DNA, 22 bp, Homo sapiens
ataacatgacctgtgcttcaca

SEQ ID NO: 7266355 - DNA, 22 bp, Homo sapiens
ctgatcatgtgggaggatatgt

SEQ ID NO: 7266356 - DNA, 22 bp, Homo sapiens
ctgcacaatgcaccatcaagtt

SEQ ID NO: 7266357 - DNA, 19 bp, Homo sapiens
atactaggtcatgataatc

SEQ ID NO: 7266358 - DNA, 22 bp, Homo sapiens
atacagtgaatacttacagtgt

SEQ ID NO: 7266359 - DNA, 22 bp, Homo sapiens
atacagtataactaataaaccc

SEQ ID NO: 7266360 - DNA, 20 bp, Homo sapiens
atacagtaggtgctcaatat

SEQ ID NO: 7266361 - DNA, 22 bp, Homo sapiens
atacagtattacctgttcagga

SEQ ID NO: 7266362 - DNA, 22 bp, Homo sapiens
ataccatttccatgttacatta

SEQ ID NO: 7266363 - DNA, 21 bp, Homo sapiens
atacattctattaagcattta

SEQ ID NO: 7266364 - DNA, 22 bp, Homo sapiens
atacagtaatttgtaactcatc

SEQ ID NO: 7266365 - DNA, 22 bp, Homo sapiens
atacagtaattgcataggcttc

SEQ ID NO: 7266366 - DNA, 22 bp, Homo sapiens
atacagtagacaatctcatgaa

SEQ ID NO: 7266367 - DNA, 22 bp, Homo sapiens
atacagtagggaccatgtctga

SEQ ID NO: 7266368 - DNA, 22 bp, Homo sapiens
aggctgtggggttctgctttca

SEQ ID NO: 7266369 - DNA, 22 bp, Homo sapiens
cccaggaatgagcaggcagggg

SEQ ID NO: 7266370 - DNA, 23 bp, Homo sapiens
ccactagcacctgttcaacttct

SEQ ID NO: 7266371 - DNA, 22 bp, Homo sapiens
cataacatgtacatataaatgc

SEQ ID NO: 7266372 - DNA, 22 bp, Homo sapiens
cataacattaagcctctatttc

SEQ ID NO: 7266373 - DNA, 22 bp, Homo sapiens
cataagaaatttaacagaactt

SEQ ID NO: 7266374 - DNA, 22 bp, Homo sapiens
cataacattgagcagcattcct

SEQ ID NO: 7266375 - DNA, 22 bp, Homo sapiens
catcttgaaggtttctttagct

SEQ ID NO: 7266376 - DNA, 20 bp, Homo sapiens
catcttgaaggtcttccaca

SEQ ID NO: 7266377 - DNA, 22 bp, Homo sapiens
cagtaacatttcaaggtagagg

SEQ ID NO: 7266378 - DNA, 22 bp, Homo sapiens
acagtgaatgcccaagaaaagt

SEQ ID NO: 7266379 - DNA, 22 bp, Homo sapiens
acagtgacaacccaggataaat

SEQ ID NO: 7266380 - DNA, 22 bp, Homo sapiens
acagtgaaaagtagctaacaca

SEQ ID NO: 7266381 - DNA, 22 bp, Homo sapiens
acagtgaatgagaatggagaaa

SEQ ID NO: 7266382 - DNA, 23 bp, Homo sapiens
acagtgaaacacgcagtaagagt

SEQ ID NO: 7266383 - DNA, 23 bp, Homo sapiens
acagtgaaacacgcagtaagagt

SEQ ID NO: 7266384 - DNA, 22 bp, Homo sapiens
aggacttagaacattatgtact

SEQ ID NO: 7266385 - DNA, 22 bp, Homo sapiens
acagtgcagggtgggaagaagg

SEQ ID NO: 7266386 - DNA, 22 bp, Homo sapiens
acagtgcagggcgggaagaagg

SEQ ID NO: 7266387 - DNA, 22 bp, Homo sapiens
acagtggagctcagatgaaaat

SEQ ID NO: 7266388 - DNA, 22 bp, Homo sapiens
acaggatttcaccatgttggcc

SEQ ID NO: 7266389 - DNA, 22 bp, Homo sapiens
acaggattaataaaaaattgta

SEQ ID NO: 7266390 - DNA, 22 bp, Homo sapiens
acaggaagtttggaaagcctca

SEQ ID NO: 7266391 - DNA, 22 bp, Homo sapiens
ataacactaaatgtatgtaaca

SEQ ID NO: 7266392 - DNA, 22 bp, Homo sapiens
atacactaatcatgtgctcagt

SEQ ID NO: 7266393 - DNA, 22 bp, Homo sapiens
atacactactaagcacagattg

SEQ ID NO: 7266394 - DNA, 22 bp, Homo sapiens
atacacgtgtgtgtacatgcac

SEQ ID NO: 7266395 - DNA, 22 bp, Homo sapiens
ataggaaagaaaattatgtagg

SEQ ID NO: 7266396 - DNA, 22 bp, Homo sapiens
agaaagagctcgggattaacag

SEQ ID NO: 7266397 - DNA, 22 bp, Homo sapiens
agaagctgagaatgaattaaga

SEQ ID NO: 7266398 - DNA, 19 bp, Homo sapiens
agtgagcatggcttgactg

SEQ ID NO: 7266399 - DNA, 22 bp, Homo sapiens
agtgagcagtacttactcctgc

SEQ ID NO: 7266400 - DNA, 22 bp, Homo sapiens
agtgtctttagcaagtttagtc

SEQ ID NO: 7266401 - DNA, 22 bp, Homo sapiens
agtaacatgctaatttgattat

SEQ ID NO: 7266402 - DNA, 22 bp, Homo sapiens
agtaacatttagcttctcactg

SEQ ID NO: 7266403 - DNA, 22 bp, Homo sapiens
caattacttttgcaccaatata

SEQ ID NO: 7266404 - DNA, 22 bp, Homo sapiens
caattactggtccacagaaatt

SEQ ID NO: 7266405 - DNA, 21 bp, Homo sapiens
caattactatgaaccagttga

SEQ ID NO: 7266406 - DNA, 21 bp, Homo sapiens
caattacttttgcaccgactt

SEQ ID NO: 7266407 - DNA, 22 bp, Homo sapiens
caatttgattaataccatactt

SEQ ID NO: 7266408 - DNA, 22 bp, Homo sapiens
caatttgacaagttgcatgttt

SEQ ID NO: 7266409 - DNA, 22 bp, Homo sapiens
cacaggaagaggtatacaattc

SEQ ID NO: 7266410 - DNA, 22 bp, Homo sapiens
cacatttaagtgcttgttcaga

SEQ ID NO: 7266411 - DNA, 22 bp, Homo sapiens
cacggtcacccatcagagtcca

SEQ ID NO: 7266412 - DNA, 22 bp, Homo sapiens
cactagatgataatcagctgga

SEQ ID NO: 7266413 - DNA, 20 bp, Homo sapiens
agcatttgaaatatgactat

SEQ ID NO: 7266414 - DNA, 19 bp, Homo sapiens
agcatttggaattctacac

SEQ ID NO: 7266415 - DNA, 19 bp, Homo sapiens
agcatttggaattctacac

SEQ ID NO: 7266416 - DNA, 22 bp, Homo sapiens
agcctattccaggatgagctca

SEQ ID NO: 7266417 - DNA, 22 bp, Homo sapiens
atgactaagtgcattttaattg

SEQ ID NO: 7266418 - DNA, 22 bp, Homo sapiens
atgcaaattaacatatagtaga

SEQ ID NO: 7266419 - DNA, 22 bp, Homo sapiens
atgattgaaaatgacattgcca

SEQ ID NO: 7266420 - DNA, 22 bp, Homo sapiens
atgatatatgtgttgagcttgc

SEQ ID NO: 7266421 - DNA, 22 bp, Homo sapiens
atgctgaggttgttgtcctatt

SEQ ID NO: 7266422 - DNA, 22 bp, Homo sapiens
atgctgaggtgtgtttaattta

SEQ ID NO: 7266423 - DNA, 22 bp, Homo sapiens
atgctgagataaggctttagtc

SEQ ID NO: 7266424 - DNA, 22 bp, Homo sapiens
atgctgagactggagcagctgg

SEQ ID NO: 7266425 - DNA, 22 bp, Homo sapiens
atgctgagaaacagacgtgttg

SEQ ID NO: 7266426 - DNA, 22 bp, Homo sapiens
agagctataacagcactgtaca

SEQ ID NO: 7266427 - DNA, 22 bp, Homo sapiens
attgagcagcttctctgccatc

SEQ ID NO: 7266428 - DNA, 22 bp, Homo sapiens
attcaaactgtgttaggcagca

SEQ ID NO: 7266429 - DNA, 22 bp, Homo sapiens
agcaagtggaatcatggaaaag

SEQ ID NO: 7266430 - DNA, 22 bp, Homo sapiens
agatttatgtggtcacactcag

SEQ ID NO: 7266431 - DNA, 22 bp, Homo sapiens
atttgaaccactcagaactcat

SEQ ID NO: 7266432 - DNA, 22 bp, Homo sapiens
atttgaatggcttaacacaacg

SEQ ID NO: 7266433 - DNA, 22 bp, Homo sapiens
aacagtgctgcattcattgagc

SEQ ID NO: 7266434 - DNA, 22 bp, Homo sapiens
aaatggaagaagtgcaatactg

SEQ ID NO: 7266435 - DNA, 22 bp, Homo sapiens
aaatggaagctatttatgattc

SEQ ID NO: 7266436 - DNA, 22 bp, Homo sapiens
aaatggaagtgtatttagtgtt

SEQ ID NO: 7266437 - DNA, 19 bp, Homo sapiens
aaatggagctaatcttgtc

SEQ ID NO: 7266438 - DNA, 22 bp, Homo sapiens
aaatggatctgtggaatacatt

SEQ ID NO: 7266439 - DNA, 22 bp, Homo sapiens
aatacagtaattttgatgagtt

SEQ ID NO: 7266440 - DNA, 22 bp, Homo sapiens
aatacagtgaaagtgagcaagg

SEQ ID NO: 7266441 - DNA, 22 bp, Homo sapiens
aatgcacagctaaagtggttcc

SEQ ID NO: 7266442 - DNA, 22 bp, Homo sapiens
aatgcacataaatatggtctta

SEQ ID NO: 7266443 - DNA, 22 bp, Homo sapiens
aatgtacaaaagtcagccaact

SEQ ID NO: 7266444 - DNA, 22 bp, Homo sapiens
acacttgataggtcaaatcagt

SEQ ID NO: 7266445 - DNA, 22 bp, Homo sapiens
acagctgctgcttctcactggg

SEQ ID NO: 7266446 - DNA, 22 bp, Homo sapiens
acaatgtaggagtatgacagta

SEQ ID NO: 7266447 - DNA, 22 bp, Homo sapiens
aagaactgtatcaagatgtagt

SEQ ID NO: 7266448 - DNA, 22 bp, Homo sapiens
aagaacttcctaatatattttc

SEQ ID NO: 7266449 - DNA, 22 bp, Homo sapiens
aacatgatgacattgtaagctt

SEQ ID NO: 7266450 - DNA, 22 bp, Homo sapiens
aacatgattggaaaatgctgtc

SEQ ID NO: 7266451 - DNA, 21 bp, Homo sapiens
aacatgatatgtgtatggatt

SEQ ID NO: 7266452 - DNA, 22 bp, Homo sapiens
aaattggatgcacatttagaaa

SEQ ID NO: 7266453 - DNA, 22 bp, Homo sapiens
aaattggattgggagaatgtga

SEQ ID NO: 7266454 - DNA, 22 bp, Homo sapiens
aacatgaagttttctatagtga

SEQ ID NO: 7266455 - DNA, 22 bp, Homo sapiens
aaaggattctcttgatttcagt

SEQ ID NO: 7266456 - DNA, 22 bp, Homo sapiens
aaaggattaaataaatgtgctg

SEQ ID NO: 7266457 - DNA, 22 bp, Homo sapiens
aaatgattgtcaaagttctgtt

SEQ ID NO: 7266458 - DNA, 22 bp, Homo sapiens
aaatggaactgggctactaggt

SEQ ID NO: 7266459 - DNA, 22 bp, Homo sapiens
aaatggaaaatgctgttttggt

SEQ ID NO: 7266460 - DNA, 23 bp, Homo sapiens
aaaacagcttcctccagtggctc

SEQ ID NO: 7266461 - DNA, 22 bp, Homo sapiens
aaaacagacagccagtgtagag

SEQ ID NO: 7266462 - DNA, 22 bp, Homo sapiens
aaaagaggagtggtttatgaca

SEQ ID NO: 7266463 - DNA, 22 bp, Homo sapiens
aaaacattgaattgcacactat

SEQ ID NO: 7266464 - DNA, 22 bp, Homo sapiens
aaatgtgagttatagcaataga

SEQ ID NO: 7266465 - DNA, 23 bp, Homo sapiens
aaatgtgagggaaaatctttctg

SEQ ID NO: 7266466 - DNA, 22 bp, Homo sapiens
acatgcatacacgtacatacct

SEQ ID NO: 7266467 - DNA, 22 bp, Homo sapiens
acatgaagcaagaaagatgcta

SEQ ID NO: 7266468 - DNA, 22 bp, Homo sapiens
aaggattagtaggtacagttca

SEQ ID NO: 7266469 - DNA, 22 bp, Homo sapiens
acatttcagattcatgaagtga

SEQ ID NO: 7266470 - DNA, 22 bp, Homo sapiens
aataaaatggtcagttttctca

SEQ ID NO: 7266471 - DNA, 22 bp, Homo sapiens
aatgctcaaaatgtttcatcta

SEQ ID NO: 7266472 - DNA, 22 bp, Homo sapiens
agacatttatgtttctctagga

SEQ ID NO: 7266473 - DNA, 22 bp, Homo sapiens
agagcaaagggacatggaagag

SEQ ID NO: 7266474 - DNA, 22 bp, Homo sapiens
agaggattgatcaaacactgca

SEQ ID NO: 7266475 - DNA, 22 bp, Homo sapiens
agaggattgttactgattagct

SEQ ID NO: 7266476 - DNA, 22 bp, Homo sapiens
agaggaatatgggtgcactaga

SEQ ID NO: 7266477 - DNA, 22 bp, Homo sapiens
agagttatattggttgagaatt

SEQ ID NO: 7266478 - DNA, 22 bp, Homo sapiens
agagttatggacttaatgcagg

SEQ ID NO: 7266479 - DNA, 22 bp, Homo sapiens
aatttgattttcttaaaccata

SEQ ID NO: 7266480 - DNA, 22 bp, Homo sapiens
aatttgaaacatagtcaccact

SEQ ID NO: 7266481 - DNA, 21 bp, Homo sapiens
agatgctgatgctgcaggtcc

SEQ ID NO: 7266482 - DNA, 22 bp, Homo sapiens
agatgctgattgaatagatttc

SEQ ID NO: 7266483 - DNA, 22 bp, Homo sapiens
acaacagtaggaaaacatgtct

SEQ ID NO: 7266484 - DNA, 22 bp, Homo sapiens
agatgctggatggaaaatgatc

SEQ ID NO: 7266485 - DNA, 22 bp, Homo sapiens
agatgcagagttgcttaagcat

SEQ ID NO: 7266486 - DNA, 22 bp, Homo sapiens
agatgcagacttggttcaggca

SEQ ID NO: 7266487 - DNA, 22 bp, Homo sapiens
agatgcagatttggattcagga

SEQ ID NO: 7266488 - DNA, 21 bp, Homo sapiens
agatgcagtgacccactgggg

SEQ ID NO: 7266489 - DNA, 22 bp, Homo sapiens
agatgctatacattgtaagaca

SEQ ID NO: 7266490 - DNA, 22 bp, Homo sapiens
acaacattcttaaatacactga

SEQ ID NO: 7266491 - DNA, 22 bp, Homo sapiens
agattttgtctcaatacttctg

SEQ ID NO: 7266492 - DNA, 22 bp, Homo sapiens
agcacaatgtgaaaagagctct

SEQ ID NO: 7266493 - DNA, 22 bp, Homo sapiens
agcacaatagagcagttaaaaa

SEQ ID NO: 7266494 - DNA, 22 bp, Homo sapiens
acaccatactcatgttggttcc

SEQ ID NO: 7266495 - DNA, 18 bp, Homo sapiens
acacagtggatgcctggt

SEQ ID NO: 7266496 - DNA, 22 bp, Homo sapiens
acacagtgccaaattgcagtta

SEQ ID NO: 7266497 - DNA, 22 bp, Homo sapiens
acacagtgtgtgcagtcggacg

SEQ ID NO: 7266498 - DNA, 22 bp, Homo sapiens
acagcagcgtgaagtgtgttat

SEQ ID NO: 7266499 - DNA, 22 bp, Homo sapiens
agctgatacatttcttgtagcc

SEQ ID NO: 7266500 - DNA, 22 bp, Homo sapiens
tacttttagcctatttgattct

SEQ ID NO: 7266501 - DNA, 22 bp, Homo sapiens
tagaggcattaatgaataaaca

SEQ ID NO: 7266502 - DNA, 22 bp, Homo sapiens
tagcagctatgccattttgaca

SEQ ID NO: 7266503 - DNA, 22 bp, Homo sapiens
tagctgaaggctacagcagaac

SEQ ID NO: 7266504 - DNA, 22 bp, Homo sapiens
taggattatttgttctatttct

SEQ ID NO: 7266505 - DNA, 22 bp, Homo sapiens
taggaaaatatctcttattggg

SEQ ID NO: 7266506 - DNA, 22 bp, Homo sapiens
tataggattggttcccatttta

SEQ ID NO: 7266507 - DNA, 22 bp, Homo sapiens
tatacactgatataaggagtaa

SEQ ID NO: 7266508 - DNA, 20 bp, Homo sapiens
tatttacaacttagagcctc

SEQ ID NO: 7266509 - DNA, 20 bp, Homo sapiens
tatttacaacttagagcctc

SEQ ID NO: 7266510 - DNA, 22 bp, Homo sapiens
tattattatgcatagcatgaaa

SEQ ID NO: 7266511 - DNA, 22 bp, Homo sapiens
tattattatattggatgagact

SEQ ID NO: 7266512 - DNA, 22 bp, Homo sapiens
tatgtgcaggggcaggagctca

SEQ ID NO: 7266513 - DNA, 22 bp, Homo sapiens
tattactgttacttcacactgt

SEQ ID NO: 7266514 - DNA, 22 bp, Homo sapiens
tatgagcaagagtttgtgaagg

SEQ ID NO: 7266515 - DNA, 22 bp, Homo sapiens
tacaacagacaggaataagatt

SEQ ID NO: 7266516 - DNA, 21 bp, Homo sapiens
tacaacaggttttatttcgat

SEQ ID NO: 7266517 - DNA, 22 bp, Homo sapiens
tacaacagacctagatgaatga

SEQ ID NO: 7266518 - DNA, 22 bp, Homo sapiens
tacaacagttcatgaaatgaaa

SEQ ID NO: 7266519 - DNA, 22 bp, Homo sapiens
tacaacagtaatcaaggttttt

SEQ ID NO: 7266520 - DNA, 22 bp, Homo sapiens
tacatctatctagatgctcaga

SEQ ID NO: 7266521 - DNA, 18 bp, Homo sapiens
tacatctatatagtgttt

SEQ ID NO: 7266522 - DNA, 22 bp, Homo sapiens
tacatcatgtaagcagaatcat

SEQ ID NO: 7266523 - DNA, 22 bp, Homo sapiens
tacatcatggtgagcaggaggc

SEQ ID NO: 7266524 - DNA, 23 bp, Homo sapiens
tacattctgtatttttatagagt

SEQ ID NO: 7266525 - DNA, 22 bp, Homo sapiens
tacagtacctgccacgttgttg

SEQ ID NO: 7266526 - DNA, 22 bp, Homo sapiens
tacagtagacaggaccacaggc

SEQ ID NO: 7266527 - DNA, 22 bp, Homo sapiens
tacagtacacaggtaccaagct

SEQ ID NO: 7266528 - DNA, 22 bp, Homo sapiens
taatggttttttggagactgct

SEQ ID NO: 7266529 - DNA, 22 bp, Homo sapiens
gttgatacacctcatggttact

SEQ ID NO: 7266530 - DNA, 22 bp, Homo sapiens
taaaatggtaactttcatttgc

SEQ ID NO: 7266531 - DNA, 22 bp, Homo sapiens
taaacagaaagcagatgtactt

SEQ ID NO: 7266532 - DNA, 22 bp, Homo sapiens
taactcactccaaaaaggcatt

SEQ ID NO: 7266533 - DNA, 22 bp, Homo sapiens
taactgatgttcccttactgta

SEQ ID NO: 7266534 - DNA, 20 bp, Homo sapiens
taactgatcattttcaccag

SEQ ID NO: 7266535 - DNA, 22 bp, Homo sapiens
taactgatgtgaacttaccatt

SEQ ID NO: 7266536 - DNA, 22 bp, Homo sapiens
taaattgttttctagaagttgt

SEQ ID NO: 7266537 - DNA, 21 bp, Homo sapiens
tcactacaatgttctcttata

SEQ ID NO: 7266538 - DNA, 20 bp, Homo sapiens
tcagcacagctgacaaggtt

SEQ ID NO: 7266539 - DNA, 22 bp, Homo sapiens
gcatgctgcagggaatgcttgt

SEQ ID NO: 7266540 - DNA, 22 bp, Homo sapiens
gcacataactgaccacatctaa

SEQ ID NO: 7266541 - DNA, 17 bp, Homo sapiens
gcacagtgatattattt

SEQ ID NO: 7266542 - DNA, 22 bp, Homo sapiens
gcacagtgggtggtcatgtaca

SEQ ID NO: 7266543 - DNA, 22 bp, Homo sapiens
gcacacatgcatgcacaggagt

SEQ ID NO: 7266544 - DNA, 22 bp, Homo sapiens
gcacagtgataggcagttgtgc

SEQ ID NO: 7266545 - DNA, 22 bp, Homo sapiens
gcaaataaatgctcactgctgt

SEQ ID NO: 7266546 - DNA, 22 bp, Homo sapiens
gcaaataatatactttgatctc

SEQ ID NO: 7266547 - DNA, 22 bp, Homo sapiens
gcgtcaattccatcattcttct

SEQ ID NO: 7266548 - DNA, 22 bp, Homo sapiens
ggacatcttggttgcttccaag

SEQ ID NO: 7266549 - DNA, 22 bp, Homo sapiens
ggaatcttaatggcatggagtt

SEQ ID NO: 7266550 - DNA, 22 bp, Homo sapiens
ggaatcttcagccatgccaaga

SEQ ID NO: 7266551 - DNA, 22 bp, Homo sapiens
ggaatctttgaaggattttaag

SEQ ID NO: 7266552 - DNA, 22 bp, Homo sapiens
ggaatctttttcataagcctca

SEQ ID NO: 7266553 - DNA, 22 bp, Homo sapiens
ggtttactcgtagtggcggttt

SEQ ID NO: 7266554 - DNA, 22 bp, Homo sapiens
gtattagttatctactgctgtg

SEQ ID NO: 7266555 - DNA, 22 bp, Homo sapiens
gtattcatttatttactcatcc

SEQ ID NO: 7266556 - DNA, 22 bp, Homo sapiens
gtgcatttgtgcatgcacatgt

SEQ ID NO: 7266557 - DNA, 22 bp, Homo sapiens
gtgaagaaggcaatacaaagaa

SEQ ID NO: 7266558 - DNA, 22 bp, Homo sapiens
gacaacagtggtttcaggttcc

SEQ ID NO: 7266559 - DNA, 22 bp, Homo sapiens
gaagattgaaggctgggaatta

SEQ ID NO: 7266560 - DNA, 20 bp, Homo sapiens
gaacatttggccatactgag

SEQ ID NO: 7266561 - DNA, 21 bp, Homo sapiens
gaacatttgggttgtttctac

SEQ ID NO: 7266562 - DNA, 22 bp, Homo sapiens
gaacatttggatttgtaaattt

SEQ ID NO: 7266563 - DNA, 22 bp, Homo sapiens
gagatgctgtcaggctatctgt

SEQ ID NO: 7266564 - DNA, 22 bp, Homo sapiens
gagatgctgaaatctgagtgta

SEQ ID NO: 7266565 - DNA, 22 bp, Homo sapiens
gagctgaacaaattgcgagtgg

SEQ ID NO: 7266566 - DNA, 22 bp, Homo sapiens
gagctgaagtttccatttgtac

SEQ ID NO: 7266567 - DNA, 22 bp, Homo sapiens
ctgtttaaccagatctcatatc

SEQ ID NO: 7266568 - DNA, 18 bp, Homo sapiens
cttcagtgacagtctggc

SEQ ID NO: 7266569 - DNA, 22 bp, Homo sapiens
cttgtcagccaattgtggattt

SEQ ID NO: 7266570 - DNA, 22 bp, Homo sapiens
ctgttaagcaacatgagtaagt

SEQ ID NO: 7266571 - DNA, 22 bp, Homo sapiens
ctggctttctgcacagaattgg

SEQ ID NO: 7266572 - DNA, 22 bp, Homo sapiens
ctggctttctgaacatcagtga

SEQ ID NO: 7266573 - DNA, 22 bp, Homo sapiens
ctggctttggaaacaatttatc

SEQ ID NO: 7266574 - DNA, 22 bp, Homo sapiens
tttgcaaataaataagtgctcg

SEQ ID NO: 7266575 - DNA, 22 bp, Homo sapiens
ttttagtgcctgattaatgggt

SEQ ID NO: 7266576 - DNA, 22 bp, Homo sapiens
tttgtacactgtctactatgaa

SEQ ID NO: 7266577 - DNA, 22 bp, Homo sapiens
tttgtacatcctaattctgagt

SEQ ID NO: 7266578 - DNA, 22 bp, Homo sapiens
ctcatttatgtaatgattaagg

SEQ ID NO: 7266579 - DNA, 22 bp, Homo sapiens
ttcttttacattaagatttcag

SEQ ID NO: 7266580 - DNA, 22 bp, Homo sapiens
ttgaaagtaataactttgttca

SEQ ID NO: 7266581 - DNA, 22 bp, Homo sapiens
tttagtatcctatctcatttaa

SEQ ID NO: 7266582 - DNA, 22 bp, Homo sapiens
tttaatctattccctaaacacc

SEQ ID NO: 7266583 - DNA, 21 bp, Homo sapiens
tttcaatgtgttctttgtagt

SEQ ID NO: 7266584 - DNA, 22 bp, Homo sapiens
tttcacatacagtgtatagtag

SEQ ID NO: 7266585 - DNA, 22 bp, Homo sapiens
ctacaggagtaaaataatttca

SEQ ID NO: 7266586 - DNA, 22 bp, Homo sapiens
ctacagtatgaaacctttactc

SEQ ID NO: 7266587 - DNA, 22 bp, Homo sapiens
ctacagtagaggttgtcaggga

SEQ ID NO: 7266588 - DNA, 22 bp, Homo sapiens
ctattacatttctggacattca

SEQ ID NO: 7266589 - DNA, 22 bp, Homo sapiens
ttcaggatatgtgatatctgaa

SEQ ID NO: 7266590 - DNA, 22 bp, Homo sapiens
ttcaggatgaaagtgtgcaaca

SEQ ID NO: 7266591 - DNA, 22 bp, Homo sapiens
ttcaggatggcggatgttgggg

SEQ ID NO: 7266592 - DNA, 22 bp, Homo sapiens
ttcatctgtagcatcttccaat

SEQ ID NO: 7266593 - DNA, 22 bp, Homo sapiens
ttcatctggtctagtttttagt

SEQ ID NO: 7266594 - DNA, 22 bp, Homo sapiens
ttcatctgcttcttgattttgc

SEQ ID NO: 7266595 - DNA, 22 bp, Homo sapiens
ttcatctggaatttatgttata

SEQ ID NO: 7266596 - DNA, 22 bp, Homo sapiens
ttcatctgctggtttttggcat

SEQ ID NO: 7266597 - DNA, 22 bp, Homo sapiens
ttactaagagaagtaaatattt

SEQ ID NO: 7266598 - DNA, 22 bp, Homo sapiens
tgttaatcaacaacaaacagtg

SEQ ID NO: 7266599 - DNA, 22 bp, Homo sapiens
tggggcagggatgggaaactat

SEQ ID NO: 7266600 - DNA, 21 bp, Homo sapiens
tgacataatccatagtacaaa

SEQ ID NO: 7266601 - DNA, 22 bp, Homo sapiens
tgatttcttctaatttccatca

SEQ ID NO: 7266602 - DNA, 22 bp, Homo sapiens
tgatttctcttggcaatatgtt

SEQ ID NO: 7266603 - DNA, 22 bp, Homo sapiens
tgcaaatagcctgatgaaagaa

SEQ ID NO: 7266604 - DNA, 22 bp, Homo sapiens
tgcaaataagctattatggaat

SEQ ID NO: 7266605 - DNA, 22 bp, Homo sapiens
tgctgtgctctttaaggtgctg

SEQ ID NO: 7266606 - DNA, 22 bp, Homo sapiens
tgctgtgctccattgtcttcac

SEQ ID NO: 7266607 - DNA, 22 bp, Homo sapiens
tgctgtgctggcggcagaggcc

SEQ ID NO: 7266608 - DNA, 22 bp, Homo sapiens
tagcttccagaatttaatgtca

SEQ ID NO: 7266609 - DNA, 22 bp, Homo sapiens
caggtattaataaatggagagt

SEQ ID NO: 7266610 - DNA, 20 bp, Homo sapiens
caggtattacttcctttatg

SEQ ID NO: 7266611 - DNA, 20 bp, Homo sapiens
caggtattacatctgcacct

SEQ ID NO: 7266612 - DNA, 22 bp, Homo sapiens
caggtattcatagaattcagag

SEQ ID NO: 7266613 - DNA, 23 bp, Homo sapiens
caggtattgatttttcttctagg

SEQ ID NO: 7266614 - DNA, 17 bp, Homo sapiens
caggtatttaggcattg

SEQ ID NO: 7266615 - DNA, 22 bp, Homo sapiens
caggtattttcaaggcttgtgt

SEQ ID NO: 7266616 - DNA, 22 bp, Homo sapiens
cataacatccttgctactttga

SEQ ID NO: 7266617 - DNA, 22 bp, Homo sapiens
cataatttgtggtagtggggga

SEQ ID NO: 7266618 - DNA, 22 bp, Homo sapiens
cataattttccatggtttgcta

SEQ ID NO: 7266619 - DNA, 22 bp, Homo sapiens
cataatttgatatgcttgatgg

SEQ ID NO: 7266620 - DNA, 22 bp, Homo sapiens
tcaatcacgtgttccatgttct

SEQ ID NO: 7266621 - DNA, 22 bp, Homo sapiens
catgaacattgcagggatgtga

SEQ ID NO: 7266622 - DNA, 22 bp, Homo sapiens
catgcatattactagcacagca

SEQ ID NO: 7266623 - DNA, 22 bp, Homo sapiens
catgcatatatgctacatgcaa

SEQ ID NO: 7266624 - DNA, 22 bp, Homo sapiens
catggaactgtataaaggcact

SEQ ID NO: 7266625 - DNA, 22 bp, Homo sapiens
cattctcaatagtagatgagta

SEQ ID NO: 7266626 - DNA, 22 bp, Homo sapiens
cattacatctttgatgcagtat

SEQ ID NO: 7266627 - DNA, 22 bp, Homo sapiens
cattctgaccctatgatttaag

SEQ ID NO: 7266628 - DNA, 22 bp, Homo sapiens
cattctgagctaatatgcttat

SEQ ID NO: 7266629 - DNA, 22 bp, Homo sapiens
cattgttaccatcttttaccta

SEQ ID NO: 7266630 - DNA, 22 bp, Homo sapiens
cattgttatagcattacacacc

SEQ ID NO: 7266631 - DNA, 22 bp, Homo sapiens
ttttatcattacccagctgaaa

SEQ ID NO: 7266632 - DNA, 23 bp, Homo sapiens
ttttgcaataagtcactggaata

SEQ ID NO: 7266633 - DNA, 23 bp, Homo sapiens
tttgtacattgaggaggcagaat

SEQ ID NO: 7266634 - DNA, 22 bp, Homo sapiens
tttgtacatgaatgtgcaccca

SEQ ID NO: 7266635 - DNA, 22 bp, Homo sapiens
tttgtacaattagcagaggcta

SEQ ID NO: 7266636 - DNA, 22 bp, Homo sapiens
tttgcaatgtgaaattaaagaa

SEQ ID NO: 7266637 - DNA, 22 bp, Homo sapiens
tttgtacatgtaagattgcatc

SEQ ID NO: 7266638 - DNA, 22 bp, Homo sapiens
tttgtcaaatcaaaccacattc

SEQ ID NO: 7266639 - DNA, 20 bp, Homo sapiens
tttgtcaactgcatccagca

SEQ ID NO: 7266640 - DNA, 22 bp, Homo sapiens
tttgtcaagtttgcaaatacgt

SEQ ID NO: 7266641 - DNA, 22 bp, Homo sapiens
tttgtcaatcccttgaaaacct

SEQ ID NO: 7266642 - DNA, 22 bp, Homo sapiens
tttgttcacatttaggactctc

SEQ ID NO: 7266643 - DNA, 22 bp, Homo sapiens
ttttatacacatgaacatgcag

SEQ ID NO: 7266644 - DNA, 22 bp, Homo sapiens
ttttatcaatcattaagacatt

SEQ ID NO: 7266645 - DNA, 22 bp, Homo sapiens
tttactgtctcagagagacaaa

SEQ ID NO: 7266646 - DNA, 22 bp, Homo sapiens
tttactgtgcattagaatcacc

SEQ ID NO: 7266647 - DNA, 22 bp, Homo sapiens
tttatagtagcatgatttatag

SEQ ID NO: 7266648 - DNA, 22 bp, Homo sapiens
tttatagtagcatgatttataa

SEQ ID NO: 7266649 - DNA, 22 bp, Homo sapiens
ttgttttagtaggtacactgag

SEQ ID NO: 7266650 - DNA, 22 bp, Homo sapiens
ttgcaagaaataatcgaataga

SEQ ID NO: 7266651 - DNA, 22 bp, Homo sapiens
ttgcaagagagtctgaaaaatg

SEQ ID NO: 7266652 - DNA, 22 bp, Homo sapiens
tttctactttggaatgcactga

SEQ ID NO: 7266653 - DNA, 21 bp, Homo sapiens
tttctccaagtgactgattcc

SEQ ID NO: 7266654 - DNA, 22 bp, Homo sapiens
tttcttcatagaccttgtcttg

SEQ ID NO: 7266655 - DNA, 22 bp, Homo sapiens
ttgagcacaggtgaacagcatc

SEQ ID NO: 7266656 - DNA, 22 bp, Homo sapiens
ttgagcaattaggaaataaaga

SEQ ID NO: 7266657 - DNA, 22 bp, Homo sapiens
ttgagcaaaggagtaaaatgca

SEQ ID NO: 7266658 - DNA, 22 bp, Homo sapiens
ttgagcaatgctgcaaagagat

SEQ ID NO: 7266659 - DNA, 22 bp, Homo sapiens
ttgattttaaaatagtgacact

SEQ ID NO: 7266660 - DNA, 22 bp, Homo sapiens
ttgattcaaaggggacaagtgg

SEQ ID NO: 7266661 - DNA, 22 bp, Homo sapiens
ttcttgatgtaccaacttggga

SEQ ID NO: 7266662 - DNA, 21 bp, Homo sapiens
ttctgttttttgtaccagggc

SEQ ID NO: 7266663 - DNA, 22 bp, Homo sapiens
ttctgtttgccatatatagtag

SEQ ID NO: 7266664 - DNA, 22 bp, Homo sapiens
ttctgttttagaaataagtagt

SEQ ID NO: 7266665 - DNA, 22 bp, Homo sapiens
ttctgaatgatagtcttgaact

SEQ ID NO: 7266666 - DNA, 21 bp, Homo sapiens
ttagagttgccattatatgta

SEQ ID NO: 7266667 - DNA, 21 bp, Homo sapiens
ttagagtagagaacatgatcc

SEQ ID NO: 7266668 - DNA, 22 bp, Homo sapiens
ttcagtgtcaatttttaaatat

SEQ ID NO: 7266669 - DNA, 20 bp, Homo sapiens
ttcatgggagcaaagaggcc

SEQ ID NO: 7266670 - DNA, 22 bp, Homo sapiens
tgttatactatttagaggtaca

SEQ ID NO: 7266671 - DNA, 22 bp, Homo sapiens
tgttcagaacaaaggtaaatga

SEQ ID NO: 7266672 - DNA, 22 bp, Homo sapiens
ttaaattagtcaagcttctctg

SEQ ID NO: 7266673 - DNA, 22 bp, Homo sapiens
ttaaatgtgatttcatttatgt

SEQ ID NO: 7266674 - DNA, 22 bp, Homo sapiens
ttaaagcatgttgcttaacagg

SEQ ID NO: 7266675 - DNA, 22 bp, Homo sapiens
ttaacattgtccttagcagatt

SEQ ID NO: 7266676 - DNA, 22 bp, Homo sapiens
ttacatgaatacataaccattc

SEQ ID NO: 7266677 - DNA, 22 bp, Homo sapiens
ttacactatgaatgagaatata

SEQ ID NO: 7266678 - DNA, 18 bp, Homo sapiens
ttacactagccttggttc

SEQ ID NO: 7266679 - DNA, 21 bp, Homo sapiens
ttactggcagcagaaacctga

SEQ ID NO: 7266680 - DNA, 22 bp, Homo sapiens
ttactgtagaagagaatgattc

SEQ ID NO: 7266681 - DNA, 22 bp, Homo sapiens
ttactgtactagtgagactagg

SEQ ID NO: 7266682 - DNA, 22 bp, Homo sapiens
ttactactgctttactactggg

SEQ ID NO: 7266683 - DNA, 22 bp, Homo sapiens
ttagagcttcccaattaaaacg

SEQ ID NO: 7266684 - DNA, 22 bp, Homo sapiens
ttagaggcatgattcagtaaag

SEQ ID NO: 7266685 - DNA, 22 bp, Homo sapiens
ttagagcaggagttgacagatt

SEQ ID NO: 7266686 - DNA, 17 bp, Homo sapiens
ttagagctacatgttga

SEQ ID NO: 7266687 - DNA, 22 bp, Homo sapiens
ttagagctgatagtacactggt

SEQ ID NO: 7266688 - DNA, 22 bp, Homo sapiens
caatagctatgtaacctgaaga

SEQ ID NO: 7266689 - DNA, 22 bp, Homo sapiens
caactactggtgctcaggaaat

SEQ ID NO: 7266690 - DNA, 22 bp, Homo sapiens
gtagaaaaagcagtaagtctca

SEQ ID NO: 7266691 - DNA, 23 bp, Homo sapiens
ggtattcattcatttatgctaag

SEQ ID NO: 7266692 - DNA, 22 bp, Homo sapiens
gggtaaatctcttttcatggct

SEQ ID NO: 7266693 - DNA, 22 bp, Homo sapiens
cagaataaaggtacaattgagt

SEQ ID NO: 7266694 - DNA, 22 bp, Homo sapiens
cagaataaacagaaacgtagct

SEQ ID NO: 7266695 - DNA, 22 bp, Homo sapiens
atttggtcacaccagtccacat

SEQ ID NO: 7266696 - DNA, 22 bp, Homo sapiens
atttgtagtgaagtgaaaataa

SEQ ID NO: 7266697 - DNA, 22 bp, Homo sapiens
atttgtcatatataatactctt

SEQ ID NO: 7266698 - DNA, 22 bp, Homo sapiens
atttgtcatgtatgtaaagttg

SEQ ID NO: 7266699 - DNA, 22 bp, Homo sapiens
atttgtcactgagagagttaga

SEQ ID NO: 7266700 - DNA, 22 bp, Homo sapiens
attttgatgctatctaatgaat

SEQ ID NO: 7266701 - DNA, 22 bp, Homo sapiens
attttgcacactatgcagcttt

SEQ ID NO: 7266702 - DNA, 22 bp, Homo sapiens
atttatcaacatgtaccattgg

SEQ ID NO: 7266703 - DNA, 22 bp, Homo sapiens
atttatcatcagaccttttaaa

SEQ ID NO: 7266704 - DNA, 22 bp, Homo sapiens
attctgatcattcaagatgtca

SEQ ID NO: 7266705 - DNA, 22 bp, Homo sapiens
attctgatatgaacacacatat

SEQ ID NO: 7266706 - DNA, 22 bp, Homo sapiens
attctgatatcttattctagct

SEQ ID NO: 7266707 - DNA, 22 bp, Homo sapiens
attatatgtgggatagaattta

SEQ ID NO: 7266708 - DNA, 22 bp, Homo sapiens
attatgcatatacatttgacta

SEQ ID NO: 7266709 - DNA, 22 bp, Homo sapiens
attatgcattccaaccttattc

SEQ ID NO: 7266710 - DNA, 22 bp, Homo sapiens
attaacatgcagccagacacac

SEQ ID NO: 7266711 - DNA, 22 bp, Homo sapiens
attaaattttcactaggctccc

SEQ ID NO: 7266712 - DNA, 22 bp, Homo sapiens
attaaattggatctgcatagtt

SEQ ID NO: 7266713 - DNA, 22 bp, Homo sapiens
attaaattggacgctgggggaa

SEQ ID NO: 7266714 - DNA, 22 bp, Homo sapiens
atgttattaaagtacagattct

SEQ ID NO: 7266715 - DNA, 23 bp, Homo sapiens
atgttattattagcagtcttgcc

SEQ ID NO: 7266716 - DNA, 22 bp, Homo sapiens
atgagcagatgctcctgcctct

SEQ ID NO: 7266717 - DNA, 22 bp, Homo sapiens
atgagcagcattgctcctctta

SEQ ID NO: 7266718 - DNA, 22 bp, Homo sapiens
atgagcaattaggaagaaaaca

SEQ ID NO: 7266719 - DNA, 22 bp, Homo sapiens
atgagcaaggctttgtgatagt

SEQ ID NO: 7266720 - DNA, 22 bp, Homo sapiens
atgcataaagaaagctatctgg

SEQ ID NO: 7266721 - DNA, 22 bp, Homo sapiens
gacaggaaacaagaaggcagga

SEQ ID NO: 7266722 - DNA, 22 bp, Homo sapiens
atgctacaggaagacgtcaggc

SEQ ID NO: 7266723 - DNA, 22 bp, Homo sapiens
gaagctaaaccacagctaagaa

SEQ ID NO: 7266724 - DNA, 22 bp, Homo sapiens
gaagctaatgagataaatgcca

SEQ ID NO: 7266725 - DNA, 22 bp, Homo sapiens
gaagctaatgatttattttctg

SEQ ID NO: 7266726 - DNA, 22 bp, Homo sapiens
atgattacatgtgttaatatac

SEQ ID NO: 7266727 - DNA, 22 bp, Homo sapiens
atgattactcccatttgataga

SEQ ID NO: 7266728 - DNA, 17 bp, Homo sapiens
atgattacatctttcct

SEQ ID NO: 7266729 - DNA, 22 bp, Homo sapiens
atgctgtggggagtgagggtag

SEQ ID NO: 7266730 - DNA, 22 bp, Homo sapiens
atgctgtgtcctagtgaaagaa

SEQ ID NO: 7266731 - DNA, 22 bp, Homo sapiens
agtgcacagcgtgatgtattgg

SEQ ID NO: 7266732 - DNA, 22 bp, Homo sapiens
ctctgtttttcaatagttcttg

SEQ ID NO: 7266733 - DNA, 20 bp, Homo sapiens
agtggcaggcgatcattact

SEQ ID NO: 7266734 - DNA, 20 bp, Homo sapiens
aggtttatatttagaggtgt

SEQ ID NO: 7266735 - DNA, 22 bp, Homo sapiens
aggtttattaagtaaatagagc

SEQ ID NO: 7266736 - DNA, 22 bp, Homo sapiens
aggtttatgattctgcacgtgg

SEQ ID NO: 7266737 - DNA, 22 bp, Homo sapiens
ctaaacatgcaagagcttctgg

SEQ ID NO: 7266738 - DNA, 22 bp, Homo sapiens
ctaaacatggcttagaacactc

SEQ ID NO: 7266739 - DNA, 22 bp, Homo sapiens
aggtatattgaatgcttactta

SEQ ID NO: 7266740 - DNA, 22 bp, Homo sapiens
aggtgattttctccttacgatt

SEQ ID NO: 7266741 - DNA, 22 bp, Homo sapiens
aggtattatgctgctgaatgct

SEQ ID NO: 7266742 - DNA, 22 bp, Homo sapiens
ctgtttcatagagttgtgaatt

SEQ ID NO: 7266743 - DNA, 22 bp, Homo sapiens
ataataacacctgaataggaaa

SEQ ID NO: 7266744 - DNA, 22 bp, Homo sapiens
ataataacaatgccagatgcct

SEQ ID NO: 7266745 - DNA, 22 bp, Homo sapiens
atagacatggtcttttgtcatt

SEQ ID NO: 7266746 - DNA, 22 bp, Homo sapiens
atagaaatgtattttggactag

SEQ ID NO: 7266747 - DNA, 22 bp, Homo sapiens
atacatgactcacacattctgc

SEQ ID NO: 7266748 - DNA, 22 bp, Homo sapiens
atacatgacagcatagcatcct

SEQ ID NO: 7266749 - DNA, 22 bp, Homo sapiens
atacatgatacttagtacgtag

SEQ ID NO: 7266750 - DNA, 23 bp, Homo sapiens
agggaaatactgcaatttttgga

SEQ ID NO: 7266751 - DNA, 22 bp, Homo sapiens
agggaaatctcagctctaaaat

SEQ ID NO: 7266752 - DNA, 22 bp, Homo sapiens
agggaaatctttcaacacttca

SEQ ID NO: 7266753 - DNA, 22 bp, Homo sapiens
agggaaattaatgtgagcaatg

SEQ ID NO: 7266754 - DNA, 22 bp, Homo sapiens
agctgtgctgtggtcatctggg

SEQ ID NO: 7266755 - DNA, 22 bp, Homo sapiens
agctgtgcctattcgtggcaag

SEQ ID NO: 7266756 - DNA, 22 bp, Homo sapiens
agctgtgccttgctgcacggtg

SEQ ID NO: 7266757 - DNA, 22 bp, Homo sapiens
agctgtgctgccaagttgctga

SEQ ID NO: 7266758 - DNA, 22 bp, Homo sapiens
agctgtgcacactgtgaagtag

SEQ ID NO: 7266759 - DNA, 19 bp, Homo sapiens
agctgtgcagacacttcgc

SEQ ID NO: 7266760 - DNA, 22 bp, Homo sapiens
agctgcagaggtttgtgcaaca

SEQ ID NO: 7266761 - DNA, 17 bp, Homo sapiens
agctgcagatgaagttg

SEQ ID NO: 7266762 - DNA, 22 bp, Homo sapiens
cagtggctgagagtggacactg

SEQ ID NO: 7266763 - DNA, 22 bp, Homo sapiens
cattaaacaaccttgaatcaat

SEQ ID NO: 7266764 - DNA, 22 bp, Homo sapiens
aggatttaggagctggctaacg

SEQ ID NO: 7266765 - DNA, 19 bp, Homo sapiens
aggatttattatgtgctca

SEQ ID NO: 7266766 - DNA, 22 bp, Homo sapiens
catgtacattctgtagatggag

SEQ ID NO: 7266767 - DNA, 22 bp, Homo sapiens
catgtatacagtagaatactat

SEQ ID NO: 7266768 - DNA, 22 bp, Homo sapiens
catgtatagttggaactacatc

SEQ ID NO: 7266769 - DNA, 22 bp, Homo sapiens
aggattaaagtatatttttgag

SEQ ID NO: 7266770 - DNA, 22 bp, Homo sapiens
caaatagattgttcaatcctga

SEQ ID NO: 7266771 - DNA, 19 bp, Homo sapiens
agcacagtttccacatgca

SEQ ID NO: 7266772 - DNA, 22 bp, Homo sapiens
cagcagcattgctctggattcc

SEQ ID NO: 7266773 - DNA, 22 bp, Homo sapiens
agcatataggaaatgttgaatc

SEQ ID NO: 7266774 - DNA, 22 bp, Homo sapiens
attcatttagagggattaagca

SEQ ID NO: 7266775 - DNA, 22 bp, Homo sapiens
attcatttaggtattcacttac

SEQ ID NO: 7266776 - DNA, 20 bp, Homo sapiens
atttggcatgaagtattgat

SEQ ID NO: 7266777 - DNA, 22 bp, Homo sapiens
atttggcaacattaattgaatc

SEQ ID NO: 7266778 - DNA, 22 bp, Homo sapiens
agaggtctcagttatgtttaaa

SEQ ID NO: 7266779 - DNA, 22 bp, Homo sapiens
agaggtattagatttgcatagg

SEQ ID NO: 7266780 - DNA, 22 bp, Homo sapiens
agaggtattaggtaattcagta

SEQ ID NO: 7266781 - DNA, 22 bp, Homo sapiens
agagatgcatctcttaaaattg

SEQ ID NO: 7266782 - DNA, 22 bp, Homo sapiens
agagatgcagggtacatggaat

SEQ ID NO: 7266783 - DNA, 19 bp, Homo sapiens
agagatgctaagagtcttt

SEQ ID NO: 7266784 - DNA, 22 bp, Homo sapiens
agagatgctgacgtttacattt

SEQ ID NO: 7266785 - DNA, 22 bp, Homo sapiens
agagatgctgcccgcagacgtg

SEQ ID NO: 7266786 - DNA, 22 bp, Homo sapiens
agagatgcattcagcatggatg

SEQ ID NO: 7266787 - DNA, 22 bp, Homo sapiens
agagatgccacctttttgctgt

SEQ ID NO: 7266788 - DNA, 22 bp, Homo sapiens
agagatgcccttgaaaggatta

SEQ ID NO: 7266789 - DNA, 22 bp, Homo sapiens
agagatgcggttccatggttat

SEQ ID NO: 7266790 - DNA, 22 bp, Homo sapiens
agagatgctgtgggtagaggca

SEQ ID NO: 7266791 - DNA, 22 bp, Homo sapiens
agacattttagacataaaagat

SEQ ID NO: 7266792 - DNA, 22 bp, Homo sapiens
atgacaaaatgaatgcagctag

SEQ ID NO: 7266793 - DNA, 22 bp, Homo sapiens
atgcaagaaacagagacgctga

SEQ ID NO: 7266794 - DNA, 22 bp, Homo sapiens
atgcaagacataaataatcttt

SEQ ID NO: 7266795 - DNA, 22 bp, Homo sapiens
atgcacatcactctgaagaaaa

SEQ ID NO: 7266796 - DNA, 22 bp, Homo sapiens
atgcacatcttacagatgcaga

SEQ ID NO: 7266797 - DNA, 22 bp, Homo sapiens
atgcactactagatgcaaaagt

SEQ ID NO: 7266798 - DNA, 22 bp, Homo sapiens
atgcacatgaggcaagcaaaat

SEQ ID NO: 7266799 - DNA, 22 bp, Homo sapiens
agacatttggaagatacacata

SEQ ID NO: 7266800 - DNA, 22 bp, Homo sapiens
agacatttcctgtgaacctact

SEQ ID NO: 7266801 - DNA, 22 bp, Homo sapiens
agacatttcctagacatcaatg

SEQ ID NO: 7266802 - DNA, 22 bp, Homo sapiens
agacatttattgaacacctagc

SEQ ID NO: 7266803 - DNA, 22 bp, Homo sapiens
atgaacaatctgttgacttctg

SEQ ID NO: 7266804 - DNA, 22 bp, Homo sapiens
atgaacaatctggcaagaactt

SEQ ID NO: 7266805 - DNA, 22 bp, Homo sapiens
atgaacaacttgaagctccatg

SEQ ID NO: 7266806 - DNA, 22 bp, Homo sapiens
atgaacaagagagggaagattc

SEQ ID NO: 7266807 - DNA, 22 bp, Homo sapiens
atgaacaataaaatagatcaca

SEQ ID NO: 7266808 - DNA, 22 bp, Homo sapiens
atgaacaataaaatagatcaca

SEQ ID NO: 7266809 - DNA, 22 bp, Homo sapiens
atgaaacatgctttgtggatga

SEQ ID NO: 7266810 - DNA, 22 bp, Homo sapiens
acagtttgagaaccactagcct

SEQ ID NO: 7266811 - DNA, 22 bp, Homo sapiens
acagttcccgtcttgcacagct

SEQ ID NO: 7266812 - DNA, 22 bp, Homo sapiens
acaggatagtttttaatcttcc

SEQ ID NO: 7266813 - DNA, 22 bp, Homo sapiens
agctgaatctcaggcatccttt

SEQ ID NO: 7266814 - DNA, 22 bp, Homo sapiens
agctgagagcccctgccctgtg

SEQ ID NO: 7266815 - DNA, 22 bp, Homo sapiens
agctgagaggtggcaagctgta

SEQ ID NO: 7266816 - DNA, 22 bp, Homo sapiens
agctggatgaatttggaacact

SEQ ID NO: 7266817 - DNA, 22 bp, Homo sapiens
acatgctatgagagattacttc

SEQ ID NO: 7266818 - DNA, 23 bp, Homo sapiens
acatcagagttagttcaatcagg

SEQ ID NO: 7266819 - DNA, 22 bp, Homo sapiens
acatcagagggctcacatgatc

SEQ ID NO: 7266820 - DNA, 22 bp, Homo sapiens
acatcagtccaccactgcagtt

SEQ ID NO: 7266821 - DNA, 22 bp, Homo sapiens
acatttgatggagttagtaggt

SEQ ID NO: 7266822 - DNA, 22 bp, Homo sapiens
acatttgattccatcctctact

SEQ ID NO: 7266823 - DNA, 22 bp, Homo sapiens
acatttgagtcatatttgctta

SEQ ID NO: 7266824 - DNA, 20 bp, Homo sapiens
acatttgagtatcatctact

SEQ ID NO: 7266825 - DNA, 22 bp, Homo sapiens
acatttgaggatgttaagaatg

SEQ ID NO: 7266826 - DNA, 20 bp, Homo sapiens
acatttgaagtcgcatttct

SEQ ID NO: 7266827 - DNA, 22 bp, Homo sapiens
acatttgactgtagatacttgc

SEQ ID NO: 7266828 - DNA, 22 bp, Homo sapiens
acatttgagatgccttttaggt

SEQ ID NO: 7266829 - DNA, 22 bp, Homo sapiens
acatttgagcatatttcttgtc

SEQ ID NO: 7266830 - DNA, 22 bp, Homo sapiens
acatttgagcatctactaagtg

SEQ ID NO: 7266831 - DNA, 22 bp, Homo sapiens
acatttgactacatttatatat

SEQ ID NO: 7266832 - DNA, 22 bp, Homo sapiens
acatttgactctgttcatatta

SEQ ID NO: 7266833 - DNA, 22 bp, Homo sapiens
acattgatgatcccacttacag

SEQ ID NO: 7266834 - DNA, 22 bp, Homo sapiens
acattgattgagcacccattat

SEQ ID NO: 7266835 - DNA, 22 bp, Homo sapiens
acatttgtatatatgcagcata

SEQ ID NO: 7266836 - DNA, 22 bp, Homo sapiens
ataaaatttgctactgttaaat

SEQ ID NO: 7266837 - DNA, 22 bp, Homo sapiens
ataaaatggtaaacgaagctga

SEQ ID NO: 7266838 - DNA, 21 bp, Homo sapiens
ataaacagcatgtgatccatg

SEQ ID NO: 7266839 - DNA, 22 bp, Homo sapiens
actgtgcaaatgacaggcacac

SEQ ID NO: 7266840 - DNA, 22 bp, Homo sapiens
actgtgcaagtcaaagatgggc

SEQ ID NO: 7266841 - DNA, 22 bp, Homo sapiens
actgtgcaatgagtaataaact

SEQ ID NO: 7266842 - DNA, 22 bp, Homo sapiens
actgtgcacaattctaagtcct

SEQ ID NO: 7266843 - DNA, 22 bp, Homo sapiens
actgtgcatggtatccttgatg

SEQ ID NO: 7266844 - DNA, 22 bp, Homo sapiens
actgtgcattccccaacctgtg

SEQ ID NO: 7266845 - DNA, 22 bp, Homo sapiens
actgtgcatttcatgtcttttc

SEQ ID NO: 7266846 - DNA, 22 bp, Homo sapiens
actgtgcatttgaagggatcat

SEQ ID NO: 7266847 - DNA, 22 bp, Homo sapiens
actgtgcatttgtcatggggtt

SEQ ID NO: 7266848 - DNA, 22 bp, Homo sapiens
actgtgcatgaaccgaaacaaa

SEQ ID NO: 7266849 - DNA, 22 bp, Homo sapiens
actgtgcatctattgccattta

SEQ ID NO: 7266850 - DNA, 22 bp, Homo sapiens
actgtgcaggtgaactgtttgc

SEQ ID NO: 7266851 - DNA, 22 bp, Homo sapiens
actgtgcagtgttgtaacccga

SEQ ID NO: 7266852 - DNA, 22 bp, Homo sapiens
actgtgcacacaaaaatagatt

SEQ ID NO: 7266853 - DNA, 22 bp, Homo sapiens
actgtgcaccctggacagtgtc

SEQ ID NO: 7266854 - DNA, 21 bp, Homo sapiens
actgtgcagcctgaggatgtg

SEQ ID NO: 7266855 - DNA, 22 bp, Homo sapiens
actgtgcagctgagtgctaatt

SEQ ID NO: 7266856 - DNA, 22 bp, Homo sapiens
actgtgcaggggaagagagaaa

SEQ ID NO: 7266857 - DNA, 22 bp, Homo sapiens
actgtgcaggtagatgcctggg

SEQ ID NO: 7266858 - DNA, 23 bp, Homo sapiens
ataatgcaagtggtggtaatctg

SEQ ID NO: 7266859 - DNA, 22 bp, Homo sapiens
ataatgcacctttgagtatggc

SEQ ID NO: 7266860 - DNA, 22 bp, Homo sapiens
atacattagctcatatgattaa

SEQ ID NO: 7266861 - DNA, 22 bp, Homo sapiens
atacattcaaaggaaggataga

SEQ ID NO: 7266862 - DNA, 22 bp, Homo sapiens
atctaaactatagtacctagtc

SEQ ID NO: 7266863 - DNA, 22 bp, Homo sapiens
atatggaatggtaatctacaat

SEQ ID NO: 7266864 - DNA, 22 bp, Homo sapiens
agtaaacagaaagcaagatgat

SEQ ID NO: 7266865 - DNA, 22 bp, Homo sapiens
agtaaacaggcatgatagtgtt

SEQ ID NO: 7266866 - DNA, 19 bp, Homo sapiens
actagcacccaggtaaatg

SEQ ID NO: 7266867 - DNA, 22 bp, Homo sapiens
agtaaacactgtctttatatat

SEQ ID NO: 7266868 - DNA, 22 bp, Homo sapiens
agtaaacactaaaatgactgcg

SEQ ID NO: 7266869 - DNA, 22 bp, Homo sapiens
agtaaacaatgtatgaggacag

SEQ ID NO: 7266870 - DNA, 22 bp, Homo sapiens
agtgtacatagttaggaacatc

SEQ ID NO: 7266871 - DNA, 22 bp, Homo sapiens
agtgcagtgatgaataatggtt

SEQ ID NO: 7266872 - DNA, 22 bp, Homo sapiens
actgagctgtgacaatgcttaa

SEQ ID NO: 7266873 - DNA, 22 bp, Homo sapiens
agtgcatgaaagcatacaaggc

SEQ ID NO: 7266874 - DNA, 22 bp, Homo sapiens
aatagtgcttttgtacatagga

SEQ ID NO: 7266875 - DNA, 22 bp, Homo sapiens
aatagtgctgctgtggacatgg

SEQ ID NO: 7266876 - DNA, 22 bp, Homo sapiens
aacatgtaaatatcattgtact

SEQ ID NO: 7266877 - DNA, 18 bp, Homo sapiens
aacaggatcctccacttc

SEQ ID NO: 7266878 - DNA, 22 bp, Homo sapiens
aacaggatgtcatttctcatgt

SEQ ID NO: 7266879 - DNA, 22 bp, Homo sapiens
aacagagctgaccagtgagggc

SEQ ID NO: 7266880 - DNA, 22 bp, Homo sapiens
aaggtattatttgcaatcattt

SEQ ID NO: 7266881 - DNA, 23 bp, Homo sapiens
aaggtatttattttaaaggtaag

SEQ ID NO: 7266882 - DNA, 22 bp, Homo sapiens
aaggtattttctaatgtatact

SEQ ID NO: 7266883 - DNA, 22 bp, Homo sapiens
aaggtattggcagggctgagtt

SEQ ID NO: 7266884 - DNA, 22 bp, Homo sapiens
aaggtattggggaatatttgac

SEQ ID NO: 7266885 - DNA, 22 bp, Homo sapiens
aaggtattggtctggtcttcct

SEQ ID NO: 7266886 - DNA, 22 bp, Homo sapiens
aaggtattattgtctatgtact

SEQ ID NO: 7266887 - DNA, 22 bp, Homo sapiens
aaggtcattgttgcatgttctc

SEQ ID NO: 7266888 - DNA, 19 bp, Homo sapiens
aaatgtgatggtacaattc

SEQ ID NO: 7266889 - DNA, 22 bp, Homo sapiens
aaattgatgttcccagttgaaa

SEQ ID NO: 7266890 - DNA, 22 bp, Homo sapiens
aattggaagaattgatttgctt

SEQ ID NO: 7266891 - DNA, 22 bp, Homo sapiens
acactggagggtccagggatgt

SEQ ID NO: 7266892 - DNA, 22 bp, Homo sapiens
aagcatttcaggtagagatatt

SEQ ID NO: 7266893 - DNA, 22 bp, Homo sapiens
aagcatttctgtttatctatcg

SEQ ID NO: 7266894 - DNA, 22 bp, Homo sapiens
aagcatttgtgaaattcagatg

SEQ ID NO: 7266895 - DNA, 22 bp, Homo sapiens
aagcatttggttctgaagactc

SEQ ID NO: 7266896 - DNA, 18 bp, Homo sapiens
aaacagtgcctaagtgtc

SEQ ID NO: 7266897 - DNA, 22 bp, Homo sapiens
aaacagtgatgttgagtgtaaa

SEQ ID NO: 7266898 - DNA, 22 bp, Homo sapiens
aaacagtttcattttcatgacc

SEQ ID NO: 7266899 - DNA, 22 bp, Homo sapiens
aaacagtttataacatgatact

SEQ ID NO: 7266900 - DNA, 22 bp, Homo sapiens
aaacagttaattgctttcagtt

SEQ ID NO: 7266901 - DNA, 22 bp, Homo sapiens
aaacagtttctaatcatggaga

SEQ ID NO: 7266902 - DNA, 22 bp, Homo sapiens
aaagggctttatatcagtgtgt

SEQ ID NO: 7266903 - DNA, 22 bp, Homo sapiens
aaacattgttatgataaattac

SEQ ID NO: 7266904 - DNA, 22 bp, Homo sapiens
aaaggtcttaaggttaagcagg

SEQ ID NO: 7266905 - DNA, 22 bp, Homo sapiens
aaactagagatggcaggtggaa

SEQ ID NO: 7266906 - DNA, 21 bp, Homo sapiens
aaactagagtgtggcaaagct

SEQ ID NO: 7266907 - DNA, 22 bp, Homo sapiens
aaactagaaatcagcaagatag

SEQ ID NO: 7266908 - DNA, 22 bp, Homo sapiens
aaatagatttcctagcattgga

SEQ ID NO: 7266909 - DNA, 22 bp, Homo sapiens
aaatagattgctgaggcattac

SEQ ID NO: 7266910 - DNA, 22 bp, Homo sapiens
aagctgaaaatgagactctaca

SEQ ID NO: 7266911 - DNA, 22 bp, Homo sapiens
aagctgaaacattagcctaaac

SEQ ID NO: 7266912 - DNA, 22 bp, Homo sapiens
aagctgaagacacagctccagt

SEQ ID NO: 7266913 - DNA, 22 bp, Homo sapiens
acagtagctaatattgcattat

SEQ ID NO: 7266914 - DNA, 22 bp, Homo sapiens
aaggaaatgtgcctgacactgc

SEQ ID NO: 7266915 - DNA, 22 bp, Homo sapiens
aaggaaattaggttattttgct

SEQ ID NO: 7266916 - DNA, 22 bp, Homo sapiens
aaggaaatacaacatgtattca

SEQ ID NO: 7266917 - DNA, 22 bp, Homo sapiens
acagtacagtgcagaggaagat

SEQ ID NO: 7266918 - DNA, 22 bp, Homo sapiens
acagtacctgctctcaagcaaa

SEQ ID NO: 7266919 - DNA, 22 bp, Homo sapiens
acagtacatagatctctaccct

SEQ ID NO: 7266920 - DNA, 22 bp, Homo sapiens
aagtacatgttgttcaaaagcc

SEQ ID NO: 7266921 - DNA, 22 bp, Homo sapiens
aagtacattatatgagcagaat

SEQ ID NO: 7266922 - DNA, 22 bp, Homo sapiens
actaaatgagatactgtcttca

SEQ ID NO: 7266923 - DNA, 22 bp, Homo sapiens
actaaatgcattggtatctatt

SEQ ID NO: 7266924 - DNA, 22 bp, Homo sapiens
actaacatttgtgtatgtcttg

SEQ ID NO: 7266925 - DNA, 22 bp, Homo sapiens
aatgaacacagccctctacttt

SEQ ID NO: 7266926 - DNA, 22 bp, Homo sapiens
aatacactattttgtgctcagt

SEQ ID NO: 7266927 - DNA, 22 bp, Homo sapiens
acttgaattatatttctagaga

SEQ ID NO: 7266928 - DNA, 22 bp, Homo sapiens
aattactgatgcctgtgttcca

SEQ ID NO: 7266929 - DNA, 22 bp, Homo sapiens
aatgtttgcctgactagagtgg

SEQ ID NO: 7266930 - DNA, 22 bp, Homo sapiens
aatgcaaacttcttgttacttg

SEQ ID NO: 7266931 - DNA, 22 bp, Homo sapiens
aatgcaaactccactggagcag

SEQ ID NO: 7266932 - DNA, 22 bp, Homo sapiens
acaattaccctggcttgataaa

SEQ ID NO: 7266933 - DNA, 22 bp, Homo sapiens
acaaatggagaaactgaggccc

SEQ ID NO: 7266934 - DNA, 22 bp, Homo sapiens
acaaatggaaggtgttctcttc

SEQ ID NO: 7266935 - DNA, 22 bp, Homo sapiens
acaatttgaggctactcaattg

SEQ ID NO: 7266936 - DNA, 22 bp, Homo sapiens
acacagatttcactggaataga

SEQ ID NO: 7266937 - DNA, 22 bp, Homo sapiens
agcaccatttctctaaagcact

SEQ ID NO: 7266938 - DNA, 22 bp, Homo sapiens
acaattctgggtatttatatag

SEQ ID NO: 7266939 - DNA, 19 bp, Homo sapiens
acacatttgcacaatccac

SEQ ID NO: 7266940 - DNA, 22 bp, Homo sapiens
acacatttgcataatacctcat

SEQ ID NO: 7266941 - DNA, 22 bp, Homo sapiens
acacattttcaacactgtcaag

SEQ ID NO: 7266942 - DNA, 22 bp, Homo sapiens
tcaaccagagtttttcttaata

SEQ ID NO: 7266943 - DNA, 22 bp, Homo sapiens
tcagaacagaagaaggaacacg

SEQ ID NO: 7266944 - DNA, 22 bp, Homo sapiens
tcatcttaggtgatgagacagt

SEQ ID NO: 7266945 - DNA, 22 bp, Homo sapiens
tcagtaacctttagcacagttg

SEQ ID NO: 7266946 - DNA, 22 bp, Homo sapiens
tcattgtttctgcttttcatga

SEQ ID NO: 7266947 - DNA, 22 bp, Homo sapiens
tcatttataaggatgcaattaa

SEQ ID NO: 7266948 - DNA, 22 bp, Homo sapiens
tcatttgttctcattctctact

SEQ ID NO: 7266949 - DNA, 22 bp, Homo sapiens
tcatttgttcatctgctcttct

SEQ ID NO: 7266950 - DNA, 22 bp, Homo sapiens
tcatttgtgtgagtgatttgac

SEQ ID NO: 7266951 - DNA, 22 bp, Homo sapiens
tcatttgtggaagtgattgtgg

SEQ ID NO: 7266952 - DNA, 22 bp, Homo sapiens
tcatttgtaccattttttaaga

SEQ ID NO: 7266953 - DNA, 21 bp, Homo sapiens
tcatttgtgatctgatttcca

SEQ ID NO: 7266954 - DNA, 22 bp, Homo sapiens
tccatgtttcagcatctacatc

SEQ ID NO: 7266955 - DNA, 22 bp, Homo sapiens
tagcagcttaagtaattagaat

SEQ ID NO: 7266956 - DNA, 22 bp, Homo sapiens
tagcagctgcatcattttacag

SEQ ID NO: 7266957 - DNA, 22 bp, Homo sapiens
tagcagctggggctattcatca

SEQ ID NO: 7266958 - DNA, 22 bp, Homo sapiens
tagctgagaggccaattgaact

SEQ ID NO: 7266959 - DNA, 22 bp, Homo sapiens
tagctgagagctcacttgagga

SEQ ID NO: 7266960 - DNA, 22 bp, Homo sapiens
tatttgatggttctaaaacagc

SEQ ID NO: 7266961 - DNA, 22 bp, Homo sapiens
tatcagcaggccaaagctgcaa

SEQ ID NO: 7266962 - DNA, 22 bp, Homo sapiens
tatcactacactaagatacaga

SEQ ID NO: 7266963 - DNA, 22 bp, Homo sapiens
tatgaattctgttcattgatga

SEQ ID NO: 7266964 - DNA, 22 bp, Homo sapiens
tatgaacacactttggaagtga

SEQ ID NO: 7266965 - DNA, 22 bp, Homo sapiens
tatgtcatgtcttagagaatga

SEQ ID NO: 7266966 - DNA, 22 bp, Homo sapiens
tatgtaaaggattgagatgaat

SEQ ID NO: 7266967 - DNA, 22 bp, Homo sapiens
gtttatattcaacggagtatct

SEQ ID NO: 7266968 - DNA, 23 bp, Homo sapiens
gtgttcatcccagtctgtgcaat

SEQ ID NO: 7266969 - DNA, 22 bp, Homo sapiens
gttaaattcgatgatggataaa

SEQ ID NO: 7266970 - DNA, 22 bp, Homo sapiens
taagacatttgaaatgtgatcc

SEQ ID NO: 7266971 - DNA, 22 bp, Homo sapiens
taagacatcattaaacagcaat

SEQ ID NO: 7266972 - DNA, 22 bp, Homo sapiens
taagacatagccaagagcatcc

SEQ ID NO: 7266973 - DNA, 20 bp, Homo sapiens
taacaggaagcattatttta

SEQ ID NO: 7266974 - DNA, 22 bp, Homo sapiens
taacatgaaactccaaatggta

SEQ ID NO: 7266975 - DNA, 21 bp, Homo sapiens
taaaactgtaactttgtcctg

SEQ ID NO: 7266976 - DNA, 22 bp, Homo sapiens
tacatgaatgtttcaatattgt

SEQ ID NO: 7266977 - DNA, 22 bp, Homo sapiens
tacatgcacatgaacatgtgtg

SEQ ID NO: 7266978 - DNA, 22 bp, Homo sapiens
tacatgtacattgggcattaat

SEQ ID NO: 7266979 - DNA, 22 bp, Homo sapiens
tacagtcagagtgcctttctaa

SEQ ID NO: 7266980 - DNA, 21 bp, Homo sapiens
tacagtgaggtgttaggatgt

SEQ ID NO: 7266981 - DNA, 22 bp, Homo sapiens
tacagtgagactggctcaggga

SEQ ID NO: 7266982 - DNA, 22 bp, Homo sapiens
tacagtgaggtggtttccttta

SEQ ID NO: 7266983 - DNA, 22 bp, Homo sapiens
tacagtgacagatagggataga

SEQ ID NO: 7266984 - DNA, 22 bp, Homo sapiens
tacagtgaccctatttccaaat

SEQ ID NO: 7266985 - DNA, 19 bp, Homo sapiens
tacagtgaaccaggaggag

SEQ ID NO: 7266986 - DNA, 22 bp, Homo sapiens
tacagtgcttggtatctagtaa

SEQ ID NO: 7266987 - DNA, 22 bp, Homo sapiens
tacagtgcatagaggcatgata

SEQ ID NO: 7266988 - DNA, 22 bp, Homo sapiens
tacagtgcacatttcttaggaa

SEQ ID NO: 7266989 - DNA, 22 bp, Homo sapiens
tacagtgcaatgtgatgtagat

SEQ ID NO: 7266990 - DNA, 22 bp, Homo sapiens
tacagtgatttctactggtgtt

SEQ ID NO: 7266991 - DNA, 22 bp, Homo sapiens
tacagtaggattttcagggtct

SEQ ID NO: 7266992 - DNA, 22 bp, Homo sapiens
tactaggcaattatgtaaataa

SEQ ID NO: 7266993 - DNA, 22 bp, Homo sapiens
taagcattaactctgctgcaag

SEQ ID NO: 7266994 - DNA, 21 bp, Homo sapiens
tacaagatagaggtaatatat

SEQ ID NO: 7266995 - DNA, 22 bp, Homo sapiens
tacaacattgtgttgcttcata

SEQ ID NO: 7266996 - DNA, 22 bp, Homo sapiens
ggttggtaactccctgtgcagt

SEQ ID NO: 7266997 - DNA, 22 bp, Homo sapiens
gtcactgtatccaggttccagc

SEQ ID NO: 7266998 - DNA, 22 bp, Homo sapiens
gtagttacccagaacactggaa

SEQ ID NO: 7266999 - DNA, 22 bp, Homo sapiens
gtcaaacaaattaacatatcca

SEQ ID NO: 7267000 - DNA, 22 bp, Homo sapiens
gtcaaacagcctcctgttctaa

SEQ ID NO: 7267001 - DNA, 22 bp, Homo sapiens
gtcaaataattttctcaatagt

SEQ ID NO: 7267002 - DNA, 18 bp, Homo sapiens
ggctgtgcgtggaggctg

SEQ ID NO: 7267003 - DNA, 22 bp, Homo sapiens
ggctgtgcgtcatccggctgca

SEQ ID NO: 7267004 - DNA, 22 bp, Homo sapiens
ggctgtgctttgttaggttgtc

SEQ ID NO: 7267005 - DNA, 22 bp, Homo sapiens
ggctgtgcttggtgtccttgga

SEQ ID NO: 7267006 - DNA, 22 bp, Homo sapiens
ggctgtgctttgcccaaagggc

SEQ ID NO: 7267007 - DNA, 22 bp, Homo sapiens
ggctgtgctgagggggaagccc

SEQ ID NO: 7267008 - DNA, 22 bp, Homo sapiens
ggcactatgagttataagtgga

SEQ ID NO: 7267009 - DNA, 22 bp, Homo sapiens
gctcagtgttcatctgtatgca

SEQ ID NO: 7267010 - DNA, 22 bp, Homo sapiens
gctcagtgtttctggtagaaaa

SEQ ID NO: 7267011 - DNA, 19 bp, Homo sapiens
gcataaaatgtcaatgtgt

SEQ ID NO: 7267012 - DNA, 22 bp, Homo sapiens
gagcacagaaggagaaatatgg

SEQ ID NO: 7267013 - DNA, 22 bp, Homo sapiens
gacaacaggcagacgtcagaaa

SEQ ID NO: 7267014 - DNA, 21 bp, Homo sapiens
gacatccatgtgagtggcagt

SEQ ID NO: 7267015 - DNA, 22 bp, Homo sapiens
gacatcatggagaggataaata

SEQ ID NO: 7267016 - DNA, 22 bp, Homo sapiens
gacatcatgtcactaactgcta

SEQ ID NO: 7267017 - DNA, 22 bp, Homo sapiens
gacatcatgttctgctaatagt

SEQ ID NO: 7267018 - DNA, 22 bp, Homo sapiens
gacatcatatcaggaggcatgt

SEQ ID NO: 7267019 - DNA, 22 bp, Homo sapiens
gacatcatggagaggacaaaca

SEQ ID NO: 7267020 - DNA, 22 bp, Homo sapiens
gacatcatagggtgggaggaaa

SEQ ID NO: 7267021 - DNA, 22 bp, Homo sapiens
gagctcagggcattgagcaaga

SEQ ID NO: 7267022 - DNA, 22 bp, Homo sapiens
gagctcagcaaaggtctgtgtg

SEQ ID NO: 7267023 - DNA, 22 bp, Homo sapiens
ttatcacttatgagctttttgc

SEQ ID NO: 7267024 - DNA, 22 bp, Homo sapiens
ttataactttggatatgacaag

SEQ ID NO: 7267025 - DNA, 22 bp, Homo sapiens
ttagttttcccatctttatggt

SEQ ID NO: 7267026 - DNA, 22 bp, Homo sapiens
ttaaattttagaaacagactct

SEQ ID NO: 7267027 - DNA, 22 bp, Homo sapiens
ttaaattccagcctcataatag

SEQ ID NO: 7267028 - DNA, 20 bp, Homo sapiens
tgtcaatagcactgaggctg

SEQ ID NO: 7267029 - DNA, 22 bp, Homo sapiens
tgtcaatatcaggcagacctaa

SEQ ID NO: 7267030 - DNA, 22 bp, Homo sapiens
ttacagtttagtccaagccaga

SEQ ID NO: 7267031 - DNA, 22 bp, Homo sapiens
ttgcatatcctccaacacatgg

SEQ ID NO: 7267032 - DNA, 22 bp, Homo sapiens
ttggatccatctcaggcatagg

SEQ ID NO: 7267033 - DNA, 23 bp, Homo sapiens
tttctcaaagagtggcagcttca

SEQ ID NO: 7267034 - DNA, 22 bp, Homo sapiens
tttctcaacagagtatgccctt

SEQ ID NO: 7267035 - DNA, 22 bp, Homo sapiens
tttctcaacctcaacactattt

SEQ ID NO: 7267036 - DNA, 22 bp, Homo sapiens
tttctcaagtactgcacatgaa

SEQ ID NO: 7267037 - DNA, 22 bp, Homo sapiens
tttctcaactgtattatgcaga

SEQ ID NO: 7267038 - DNA, 22 bp, Homo sapiens
tttctacagctggtgcaacttt

SEQ ID NO: 7267039 - DNA, 22 bp, Homo sapiens
tttctacagtactgatttcata

SEQ ID NO: 7267040 - DNA, 22 bp, Homo sapiens
tttctacaacacttctgaatct

SEQ ID NO: 7267041 - DNA, 22 bp, Homo sapiens
tttctacagaagatacactgct

SEQ ID NO: 7267042 - DNA, 22 bp, Homo sapiens
tttatgcagcctcagtatcaga

SEQ ID NO: 7267043 - DNA, 22 bp, Homo sapiens
tttatgcacaattagtcttata

SEQ ID NO: 7267044 - DNA, 21 bp, Homo sapiens
tttatgcagataatgctattt

SEQ ID NO: 7267045 - DNA, 23 bp, Homo sapiens
tttatattcctaatgtcttgagc

SEQ ID NO: 7267046 - DNA, 22 bp, Homo sapiens
tttgttcatgcctatattctca

SEQ ID NO: 7267047 - DNA, 22 bp, Homo sapiens
ctgcctttgtgatcagttcttt

SEQ ID NO: 7267048 - DNA, 22 bp, Homo sapiens
ctggagatgtccgggtgctgtt

SEQ ID NO: 7267049 - DNA, 22 bp, Homo sapiens
tcatcataatatggaatcttgt

SEQ ID NO: 7267050 - DNA, 22 bp, Homo sapiens
tcattcattgcaagcacacgca

SEQ ID NO: 7267051 - DNA, 22 bp, Homo sapiens
tcattcatctggtgttagtcct

SEQ ID NO: 7267052 - DNA, 22 bp, Homo sapiens
tcattcatgaggtgctagtgct

SEQ ID NO: 7267053 - DNA, 22 bp, Homo sapiens
catgttaaaatatacattctga

SEQ ID NO: 7267054 - DNA, 22 bp, Homo sapiens
catttgtaatactgacttgcag

SEQ ID NO: 7267055 - DNA, 22 bp, Homo sapiens
catttgtacagaacagctttat

SEQ ID NO: 7267056 - DNA, 22 bp, Homo sapiens
catttgtagctatttactgtat

SEQ ID NO: 7267057 - DNA, 22 bp, Homo sapiens
catttgtaggatgcttcttgtt

SEQ ID NO: 7267058 - DNA, 22 bp, Homo sapiens
catttgtagtatctgtttatat

SEQ ID NO: 7267059 - DNA, 22 bp, Homo sapiens
catttgtagttaaaaatgtctc

SEQ ID NO: 7267060 - DNA, 22 bp, Homo sapiens
catttgtatagtgcttagacca

SEQ ID NO: 7267061 - DNA, 22 bp, Homo sapiens
catttgtatctgggctgctgtg

SEQ ID NO: 7267062 - DNA, 22 bp, Homo sapiens
catttgtatgttcctccttagg

SEQ ID NO: 7267063 - DNA, 22 bp, Homo sapiens
catttgtatcatatgtatctta

SEQ ID NO: 7267064 - DNA, 22 bp, Homo sapiens
cattcattagaatagatatgta

SEQ ID NO: 7267065 - DNA, 22 bp, Homo sapiens
cattcattcagcaactgttatt

SEQ ID NO: 7267066 - DNA, 22 bp, Homo sapiens
cattcatttactttcaacagct

SEQ ID NO: 7267067 - DNA, 22 bp, Homo sapiens
cataaactctctgtaccaatat

SEQ ID NO: 7267068 - DNA, 22 bp, Homo sapiens
cagttaccatcttcagtgatga

SEQ ID NO: 7267069 - DNA, 20 bp, Homo sapiens
cagtggcttctgtggaatat

SEQ ID NO: 7267070 - DNA, 22 bp, Homo sapiens
cagtgaagttctactgaatggt

SEQ ID NO: 7267071 - DNA, 22 bp, Homo sapiens
cagtgacgtaaactgcatgtgc

SEQ ID NO: 7267072 - DNA, 20 bp, Homo sapiens
tcacaggagggaaggcaggt

SEQ ID NO: 7267073 - DNA, 22 bp, Homo sapiens
cagtagcttgcttaggctttta

SEQ ID NO: 7267074 - DNA, 22 bp, Homo sapiens
tactgtgcaaaaatgaatattg

SEQ ID NO: 7267075 - DNA, 22 bp, Homo sapiens
tatcatgatcagcaactaatca

SEQ ID NO: 7267076 - DNA, 22 bp, Homo sapiens
tatcagtagataaacggattgc

SEQ ID NO: 7267077 - DNA, 22 bp, Homo sapiens
taggggttacctttagcatctc

SEQ ID NO: 7267078 - DNA, 22 bp, Homo sapiens
taggtacattattagatgcatg

SEQ ID NO: 7267079 - DNA, 22 bp, Homo sapiens
taggaaattgccaatatatgac

SEQ ID NO: 7267080 - DNA, 22 bp, Homo sapiens
taggaaatttgaaatatgtggg

SEQ ID NO: 7267081 - DNA, 22 bp, Homo sapiens
tgtacatgaataaaagatcttg

SEQ ID NO: 7267082 - DNA, 22 bp, Homo sapiens
tgtacatagatcttgaaaatta

SEQ ID NO: 7267083 - DNA, 22 bp, Homo sapiens
tgtacatgtgtctgtatatctt

SEQ ID NO: 7267084 - DNA, 22 bp, Homo sapiens
tgtacatacatagatatacaca

SEQ ID NO: 7267085 - DNA, 22 bp, Homo sapiens
tgtacatacatagatatacaca

SEQ ID NO: 7267086 - DNA, 21 bp, Homo sapiens
tgtaagtttcatctgaattgg

SEQ ID NO: 7267087 - DNA, 22 bp, Homo sapiens
tgtcaataacatttacttctat

SEQ ID NO: 7267088 - DNA, 22 bp, Homo sapiens
tgagcagacttgatgaggcagc

SEQ ID NO: 7267089 - DNA, 22 bp, Homo sapiens
tgcagtgatttgtacaattaga

SEQ ID NO: 7267090 - DNA, 19 bp, Homo sapiens
tgcatatatctatgaaaga

SEQ ID NO: 7267091 - DNA, 22 bp, Homo sapiens
tgatgacagcaaaaaatgctag

SEQ ID NO: 7267092 - DNA, 22 bp, Homo sapiens
tgatgacaaactttcctgatgc

SEQ ID NO: 7267093 - DNA, 22 bp, Homo sapiens
tgatgacagtgttacagctcca

SEQ ID NO: 7267094 - DNA, 22 bp, Homo sapiens
tgattagacaaaggaatcatgc

SEQ ID NO: 7267095 - DNA, 22 bp, Homo sapiens
tttgatcagcaagataaataga

SEQ ID NO: 7267096 - DNA, 22 bp, Homo sapiens
tttgatcatgaagaggataaac

SEQ ID NO: 7267097 - DNA, 22 bp, Homo sapiens
tttgatatcttggtatacagat

SEQ ID NO: 7267098 - DNA, 22 bp, Homo sapiens
tttgatactgagaaaaacaaat

SEQ ID NO: 7267099 - DNA, 22 bp, Homo sapiens
tttgatatcctatacaagtaaa

SEQ ID NO: 7267100 - DNA, 22 bp, Homo sapiens
tttgattctgtaaaataacagg

SEQ ID NO: 7267101 - DNA, 22 bp, Homo sapiens
tttgatgagtttaataacagcc

SEQ ID NO: 7267102 - DNA, 22 bp, Homo sapiens
tttgatgatgatgataaagttt

SEQ ID NO: 7267103 - DNA, 22 bp, Homo sapiens
tttgacaaaggaaaaatgcaca

SEQ ID NO: 7267104 - DNA, 22 bp, Homo sapiens
tttgttcaatccagacaatagc

SEQ ID NO: 7267105 - DNA, 22 bp, Homo sapiens
tttgtaaatagcagtactcatg

SEQ ID NO: 7267106 - DNA, 22 bp, Homo sapiens
tttgtaaaggcctgaatttcag

SEQ ID NO: 7267107 - DNA, 22 bp, Homo sapiens
ttttcattgttcctcgagcatt

SEQ ID NO: 7267108 - DNA, 22 bp, Homo sapiens
ttttctcaagatccaatgcact

SEQ ID NO: 7267109 - DNA, 19 bp, Homo sapiens
ttttctcagcttctagcgg

SEQ ID NO: 7267110 - DNA, 22 bp, Homo sapiens
ttttctcaggtgcttatctaag

SEQ ID NO: 7267111 - DNA, 22 bp, Homo sapiens
ttgcagctgcagtaaatgttca

SEQ ID NO: 7267112 - DNA, 22 bp, Homo sapiens
ttgcagcttagtgatgttatct

SEQ ID NO: 7267113 - DNA, 22 bp, Homo sapiens
ttgcagcttcgagtctatctgt

SEQ ID NO: 7267114 - DNA, 22 bp, Homo sapiens
ttgcagcttctaccactgtttc

SEQ ID NO: 7267115 - DNA, 22 bp, Homo sapiens
ttgctgtgtcatttgtttaatc

SEQ ID NO: 7267116 - DNA, 23 bp, Homo sapiens
ttggaaatggggagaacagattc

SEQ ID NO: 7267117 - DNA, 22 bp, Homo sapiens
ttgtacattctgaatctgtcct

SEQ ID NO: 7267118 - DNA, 22 bp, Homo sapiens
ttgtaaatgaccttttctaatt

SEQ ID NO: 7267119 - DNA, 22 bp, Homo sapiens
ttgtaaatagtagtaagatgcc

SEQ ID NO: 7267120 - DNA, 19 bp, Homo sapiens
tttaagcatagaggccaga

SEQ ID NO: 7267121 - DNA, 22 bp, Homo sapiens
tttaagcaagttgacatagcat

SEQ ID NO: 7267122 - DNA, 22 bp, Homo sapiens
tttaatgtagcgtgaaatgatt

SEQ ID NO: 7267123 - DNA, 22 bp, Homo sapiens
ttattacactgaaagaattgcg

SEQ ID NO: 7267124 - DNA, 22 bp, Homo sapiens
ttatatgattgagcatcttggt

SEQ ID NO: 7267125 - DNA, 22 bp, Homo sapiens
ttatatgaactggactttagga

SEQ ID NO: 7267126 - DNA, 22 bp, Homo sapiens
ttatacatgtgttttgagatga

SEQ ID NO: 7267127 - DNA, 22 bp, Homo sapiens
ttatacatgtttataaggttga

SEQ ID NO: 7267128 - DNA, 22 bp, Homo sapiens
ttatacctgaagcaggtgatgt

SEQ ID NO: 7267129 - DNA, 22 bp, Homo sapiens
ttatagcagcatgatttacaat

SEQ ID NO: 7267130 - DNA, 22 bp, Homo sapiens
ttatagcagcatgatttatagt

SEQ ID NO: 7267131 - DNA, 22 bp, Homo sapiens
ttatagcagcatgatttataat

SEQ ID NO: 7267132 - DNA, 22 bp, Homo sapiens
ttatagtgggcccaacatggcg

SEQ ID NO: 7267133 - DNA, 22 bp, Homo sapiens
ttatagtgcataattaacatgg

SEQ ID NO: 7267134 - DNA, 22 bp, Homo sapiens
ttatatactgtggtagtactgt

SEQ ID NO: 7267135 - DNA, 22 bp, Homo sapiens
ttcatttaatttgtgtattaac

SEQ ID NO: 7267136 - DNA, 22 bp, Homo sapiens
ttcagcacaagactagacaggt

SEQ ID NO: 7267137 - DNA, 22 bp, Homo sapiens
ttgaattcatttctcattgagt

SEQ ID NO: 7267138 - DNA, 19 bp, Homo sapiens
ttgaaattgtttgatatgg

SEQ ID NO: 7267139 - DNA, 22 bp, Homo sapiens
gtgctgaggatacagctgtgaa

SEQ ID NO: 7267140 - DNA, 20 bp, Homo sapiens
gtgctgagggctgggcaatg

SEQ ID NO: 7267141 - DNA, 22 bp, Homo sapiens
gtaagcacatgtgtgtgcatgg

SEQ ID NO: 7267142 - DNA, 22 bp, Homo sapiens
gtaaacatcagccactctattt

SEQ ID NO: 7267143 - DNA, 22 bp, Homo sapiens
caatggatattttatgtgagaa

SEQ ID NO: 7267144 - DNA, 22 bp, Homo sapiens
gaaatgaactgattatcattgc

SEQ ID NO: 7267145 - DNA, 22 bp, Homo sapiens
gaacatttgatgatgacattgg

SEQ ID NO: 7267146 - DNA, 22 bp, Homo sapiens
gaacatttatgatgcaatacct

SEQ ID NO: 7267147 - DNA, 22 bp, Homo sapiens
gaacatttatattagatagcta

SEQ ID NO: 7267148 - DNA, 22 bp, Homo sapiens
atgcaagcaatctgagctttgg

SEQ ID NO: 7267149 - DNA, 22 bp, Homo sapiens
atgcaagatgtatagaagactt

SEQ ID NO: 7267150 - DNA, 22 bp, Homo sapiens
atgcaaatgctagagaatgttg

SEQ ID NO: 7267151 - DNA, 22 bp, Homo sapiens
atgaataaaacattttaatcag

SEQ ID NO: 7267152 - DNA, 22 bp, Homo sapiens
atgaatcaagtgagaacagcat

SEQ ID NO: 7267153 - DNA, 22 bp, Homo sapiens
atcttcatcaagttcacagtgg

SEQ ID NO: 7267154 - DNA, 22 bp, Homo sapiens
atgcttttccaggagaaatata

SEQ ID NO: 7267155 - DNA, 22 bp, Homo sapiens
atgcttttatgtcacatggtca

SEQ ID NO: 7267156 - DNA, 22 bp, Homo sapiens
gacataaaattcaataatttgt

SEQ ID NO: 7267157 - DNA, 22 bp, Homo sapiens
gacataaaccttgagatattaa

SEQ ID NO: 7267158 - DNA, 17 bp, Homo sapiens
gagtgcagacacaagca

SEQ ID NO: 7267159 - DNA, 22 bp, Homo sapiens
atgtaacattgaattatatagt

SEQ ID NO: 7267160 - DNA, 22 bp, Homo sapiens
atgtacaatctatcacaagaag

SEQ ID NO: 7267161 - DNA, 22 bp, Homo sapiens
atgtacaacctgcatgacagtc

SEQ ID NO: 7267162 - DNA, 22 bp, Homo sapiens
attgttatgaaaataagatgtt

SEQ ID NO: 7267163 - DNA, 22 bp, Homo sapiens
atttaaatgcttaagagggttt

SEQ ID NO: 7267164 - DNA, 22 bp, Homo sapiens
atttaaattttctgatggagag

SEQ ID NO: 7267165 - DNA, 22 bp, Homo sapiens
gcaaccatttggaatgtaaaaa

SEQ ID NO: 7267166 - DNA, 20 bp, Homo sapiens
gcaaatggatcccacaagcc

SEQ ID NO: 7267167 - DNA, 20 bp, Homo sapiens
gcaaatggacactcagggaa

SEQ ID NO: 7267168 - DNA, 21 bp, Homo sapiens
gcagaatagtctctgtcttca

SEQ ID NO: 7267169 - DNA, 22 bp, Homo sapiens
atttacatttatttgagaaggt

SEQ ID NO: 7267170 - DNA, 20 bp, Homo sapiens
atttgcatctgaataactta

SEQ ID NO: 7267171 - DNA, 21 bp, Homo sapiens
atttgcattaaaatattacgc

SEQ ID NO: 7267172 - DNA, 22 bp, Homo sapiens
atttgcatttacatagcataga

SEQ ID NO: 7267173 - DNA, 22 bp, Homo sapiens
atttgcatatctgatagactaa

SEQ ID NO: 7267174 - DNA, 22 bp, Homo sapiens
atttgcaaagtcgtatctgtga

SEQ ID NO: 7267175 - DNA, 22 bp, Homo sapiens
atttgcaatgatttcagtgctt

SEQ ID NO: 7267176 - DNA, 22 bp, Homo sapiens
atttgcaattactcatgtcatt

SEQ ID NO: 7267177 - DNA, 22 bp, Homo sapiens
atttgcaattttactttgcagt

SEQ ID NO: 7267178 - DNA, 22 bp, Homo sapiens
atttgatagtatgacagggcag

SEQ ID NO: 7267179 - DNA, 22 bp, Homo sapiens
caaatagacttaagcatctgta

SEQ ID NO: 7267180 - DNA, 19 bp, Homo sapiens
atacacatacgtaaactga

SEQ ID NO: 7267181 - DNA, 22 bp, Homo sapiens
ataaacatctgtttctcttctg

SEQ ID NO: 7267182 - DNA, 22 bp, Homo sapiens
ataaactgggtatcaagaggcc

SEQ ID NO: 7267183 - DNA, 22 bp, Homo sapiens
ataaagctaagacttacatgaa

SEQ ID NO: 7267184 - DNA, 20 bp, Homo sapiens
atacacatgcagacagatgc

SEQ ID NO: 7267185 - DNA, 22 bp, Homo sapiens
atatacgtatattccaaagggt

SEQ ID NO: 7267186 - DNA, 22 bp, Homo sapiens
atagtgcattttattatcagca

SEQ ID NO: 7267187 - DNA, 22 bp, Homo sapiens
ctgtaaatatgaagaatatatg

SEQ ID NO: 7267188 - DNA, 22 bp, Homo sapiens
atcataaaccactttgtaatct

SEQ ID NO: 7267189 - DNA, 22 bp, Homo sapiens
atcataactgtaattcatctac

SEQ ID NO: 7267190 - DNA, 22 bp, Homo sapiens
atcataaaattgcaccatttct

SEQ ID NO: 7267191 - DNA, 22 bp, Homo sapiens
atcatacagcctttgttagtgt

SEQ ID NO: 7267192 - DNA, 22 bp, Homo sapiens
agtggagttgagttgatggatt

SEQ ID NO: 7267193 - DNA, 22 bp, Homo sapiens
agtgattagaaagtacacttgg

SEQ ID NO: 7267194 - DNA, 22 bp, Homo sapiens
ctgagctgagccaaatctgtct

SEQ ID NO: 7267195 - DNA, 19 bp, Homo sapiens
agtgtcagaattcattgaa

SEQ ID NO: 7267196 - DNA, 22 bp, Homo sapiens
agtgtcagctaattattcatga

SEQ ID NO: 7267197 - DNA, 22 bp, Homo sapiens
agtaaacagtatctttagtgtc

SEQ ID NO: 7267198 - DNA, 22 bp, Homo sapiens
agtaaacatttcagatttattt

SEQ ID NO: 7267199 - DNA, 22 bp, Homo sapiens
agtaaacatgtaattgttcatt

SEQ ID NO: 7267200 - DNA, 22 bp, Homo sapiens
agtaaacatagaatgttcttcc

SEQ ID NO: 7267201 - DNA, 22 bp, Homo sapiens
agtaaacataatttacctgtag

SEQ ID NO: 7267202 - DNA, 22 bp, Homo sapiens
cctgtttattgtgaagaaccca

SEQ ID NO: 7267203 - DNA, 22 bp, Homo sapiens
agctgccctttatgatgctgaa

SEQ ID NO: 7267204 - DNA, 22 bp, Homo sapiens
aggaattaacaatatatttagg

SEQ ID NO: 7267205 - DNA, 22 bp, Homo sapiens
aggataactataggataatgct

SEQ ID NO: 7267206 - DNA, 22 bp, Homo sapiens
cagtgcaggaagtgagatgcct

SEQ ID NO: 7267207 - DNA, 22 bp, Homo sapiens
cagtgcaggaagtgagatgcct

SEQ ID NO: 7267208 - DNA, 17 bp, Homo sapiens
cagtgcagataagtgag

SEQ ID NO: 7267209 - DNA, 22 bp, Homo sapiens
cagtggaagctggctgtgaaga

SEQ ID NO: 7267210 - DNA, 22 bp, Homo sapiens
ccctattagtgaccacatcata

SEQ ID NO: 7267211 - DNA, 21 bp, Homo sapiens
ccctgcttggggcagaacaac

SEQ ID NO: 7267212 - DNA, 22 bp, Homo sapiens
agctaagctctcagatactaag

SEQ ID NO: 7267213 - DNA, 20 bp, Homo sapiens
agctaaccctactttctttg

SEQ ID NO: 7267214 - DNA, 22 bp, Homo sapiens
agctaacatgactagaagcttc

SEQ ID NO: 7267215 - DNA, 19 bp, Homo sapiens
agctaactcactaactatg

SEQ ID NO: 7267216 - DNA, 22 bp, Homo sapiens
attacagtaacagctacaatgc

SEQ ID NO: 7267217 - DNA, 22 bp, Homo sapiens
attacagtaaatgctacaggca

SEQ ID NO: 7267218 - DNA, 22 bp, Homo sapiens
attacactaatgtgacaacaat

SEQ ID NO: 7267219 - DNA, 22 bp, Homo sapiens
agagtgcatgacatgatcttgg

SEQ ID NO: 7267220 - DNA, 22 bp, Homo sapiens
attttagtacctcaagtatcca

SEQ ID NO: 7267221 - DNA, 22 bp, Homo sapiens
attttagttttagcatccatgc

SEQ ID NO: 7267222 - DNA, 22 bp, Homo sapiens
attggtagttttgtatttctct

SEQ ID NO: 7267223 - DNA, 22 bp, Homo sapiens
agatgctgtgaggaagctagga

SEQ ID NO: 7267224 - DNA, 22 bp, Homo sapiens
agatgctgtcacacacactgtt

SEQ ID NO: 7267225 - DNA, 22 bp, Homo sapiens
agatgcagaaaaactaagtgat

SEQ ID NO: 7267226 - DNA, 22 bp, Homo sapiens
agatgctgggaggctgagtgca

SEQ ID NO: 7267227 - DNA, 22 bp, Homo sapiens
agatcatagcacaaaagtgaca

SEQ ID NO: 7267228 - DNA, 22 bp, Homo sapiens
agacaacatgatcagcagtcct

SEQ ID NO: 7267229 - DNA, 22 bp, Homo sapiens
agacaacaccaaatgctagtgt

SEQ ID NO: 7267230 - DNA, 22 bp, Homo sapiens
atgatatacttcctagaacagt

SEQ ID NO: 7267231 - DNA, 22 bp, Homo sapiens
atgatatagagagtagattaaa

SEQ ID NO: 7267232 - DNA, 22 bp, Homo sapiens
atgcggtgaattgactgtttct

SEQ ID NO: 7267233 - DNA, 23 bp, Homo sapiens
agtacattcgaaaaattctgtga

SEQ ID NO: 7267234 - DNA, 22 bp, Homo sapiens
agtacatgcagaactaacagat

SEQ ID NO: 7267235 - DNA, 22 bp, Homo sapiens
agtacatgtggtcctggccaga

SEQ ID NO: 7267236 - DNA, 22 bp, Homo sapiens
agtcactaggctgaaagtggag

SEQ ID NO: 7267237 - DNA, 22 bp, Homo sapiens
aggtcatttttgccttctattt

SEQ ID NO: 7267238 - DNA, 22 bp, Homo sapiens
accctgttggtggatcagattg

SEQ ID NO: 7267239 - DNA, 22 bp, Homo sapiens
actgagctctgatgagatttgg

SEQ ID NO: 7267240 - DNA, 22 bp, Homo sapiens
agtgctcatgcacatttatagt

SEQ ID NO: 7267241 - DNA, 22 bp, Homo sapiens
actgccctcccatctattgcaa

SEQ ID NO: 7267242 - DNA, 22 bp, Homo sapiens
atcagtgctgagagactatcaa

SEQ ID NO: 7267243 - DNA, 19 bp, Homo sapiens
agaaaaactggtactgctg

SEQ ID NO: 7267244 - DNA, 22 bp, Homo sapiens
agaacatttgtcgatcaatttg

SEQ ID NO: 7267245 - DNA, 22 bp, Homo sapiens
agaacagtcgtggtgagagaaa

SEQ ID NO: 7267246 - DNA, 22 bp, Homo sapiens
acttaaaaagaatcttttcacg

SEQ ID NO: 7267247 - DNA, 22 bp, Homo sapiens
actttgcagggcttgatatcca

SEQ ID NO: 7267248 - DNA, 23 bp, Homo sapiens
actttgcatacccaaattgtttt

SEQ ID NO: 7267249 - DNA, 22 bp, Homo sapiens
acatgaaactgttgcattagaa

SEQ ID NO: 7267250 - DNA, 22 bp, Homo sapiens
acattctttctcttcaggaaac

SEQ ID NO: 7267251 - DNA, 22 bp, Homo sapiens
acattctttgagttttgttaaa

SEQ ID NO: 7267252 - DNA, 22 bp, Homo sapiens
acattctttcgatgtctgattt

SEQ ID NO: 7267253 - DNA, 22 bp, Homo sapiens
acattctagatatgttatattt

SEQ ID NO: 7267254 - DNA, 22 bp, Homo sapiens
acattacagcaagtttacgtta

SEQ ID NO: 7267255 - DNA, 22 bp, Homo sapiens
acattcattgagcaacaacaat

SEQ ID NO: 7267256 - DNA, 22 bp, Homo sapiens
acattgatatttcaaatacagg

SEQ ID NO: 7267257 - DNA, 22 bp, Homo sapiens
agctgcttgggaaccatcaatt

SEQ ID NO: 7267258 - DNA, 22 bp, Homo sapiens
aaaaatgtcattatggaactga

SEQ ID NO: 7267259 - DNA, 22 bp, Homo sapiens
aaacatttttcttcatcatcct

SEQ ID NO: 7267260 - DNA, 22 bp, Homo sapiens
aaacatttgcaactcggtttgg

SEQ ID NO: 7267261 - DNA, 22 bp, Homo sapiens
aaacatgatgcctgtactaaga

SEQ ID NO: 7267262 - DNA, 22 bp, Homo sapiens
aaacatgagttaaaagtaactg

SEQ ID NO: 7267263 - DNA, 22 bp, Homo sapiens
aaacatgagcatctcttcaagc

SEQ ID NO: 7267264 - DNA, 22 bp, Homo sapiens
aaacatgaatagatattaaaca

SEQ ID NO: 7267265 - DNA, 22 bp, Homo sapiens
aaatactgttttattccatgat

SEQ ID NO: 7267266 - DNA, 22 bp, Homo sapiens
aaatactgttgaatgaagtaag

SEQ ID NO: 7267267 - DNA, 22 bp, Homo sapiens
aaacagttttttaagtctctag

SEQ ID NO: 7267268 - DNA, 22 bp, Homo sapiens
aaagtgccttctattttagtga

SEQ ID NO: 7267269 - DNA, 22 bp, Homo sapiens
aaagtgcctgactcatagttag

SEQ ID NO: 7267270 - DNA, 23 bp, Homo sapiens
aacacattgctaattacattcaa

SEQ ID NO: 7267271 - DNA, 22 bp, Homo sapiens
aaagcacatagtagaaggattt

SEQ ID NO: 7267272 - DNA, 22 bp, Homo sapiens
aactatttttggagctaactct

SEQ ID NO: 7267273 - DNA, 22 bp, Homo sapiens
aacatttgagaaaaatactctt

SEQ ID NO: 7267274 - DNA, 22 bp, Homo sapiens
aacatttgaaaatcaagaatct

SEQ ID NO: 7267275 - DNA, 22 bp, Homo sapiens
aacatttgtgaagtacttagat

SEQ ID NO: 7267276 - DNA, 20 bp, Homo sapiens
aacatttgtagtcaggcaca

SEQ ID NO: 7267277 - DNA, 22 bp, Homo sapiens
aacatttgtgtttgctaaaaat

SEQ ID NO: 7267278 - DNA, 22 bp, Homo sapiens
aacattctatgtgcattcagaa

SEQ ID NO: 7267279 - DNA, 22 bp, Homo sapiens
aacagtactggacaaggagtca

SEQ ID NO: 7267280 - DNA, 18 bp, Homo sapiens
aacagtttccagattctc

SEQ ID NO: 7267281 - DNA, 22 bp, Homo sapiens
aacattgaatttaaaatacagt

SEQ ID NO: 7267282 - DNA, 22 bp, Homo sapiens
aacattctggttctaaaaacct

SEQ ID NO: 7267283 - DNA, 22 bp, Homo sapiens
aacatttattgagcacctactg

SEQ ID NO: 7267284 - DNA, 22 bp, Homo sapiens
aatcacattacagcatatctgt

SEQ ID NO: 7267285 - DNA, 22 bp, Homo sapiens
aaattagtacattgcaaagtcc

SEQ ID NO: 7267286 - DNA, 22 bp, Homo sapiens
aaattagtcggtttaggaattt

SEQ ID NO: 7267287 - DNA, 22 bp, Homo sapiens
aaattattatgcccctctataa

SEQ ID NO: 7267288 - DNA, 22 bp, Homo sapiens
aaattattacaagctagttggc

SEQ ID NO: 7267289 - DNA, 22 bp, Homo sapiens
aatgttagtaacttgagtattt

SEQ ID NO: 7267290 - DNA, 22 bp, Homo sapiens
aatgtgaaaccgcacagaataa

SEQ ID NO: 7267291 - DNA, 22 bp, Homo sapiens
aattactgtctcctgctggtgt

SEQ ID NO: 7267292 - DNA, 22 bp, Homo sapiens
aattactgtctgtaaagggaat

SEQ ID NO: 7267293 - DNA, 22 bp, Homo sapiens
aagacattggacaatccagagg

SEQ ID NO: 7267294 - DNA, 22 bp, Homo sapiens
aagacattgtcattttataatt

SEQ ID NO: 7267295 - DNA, 22 bp, Homo sapiens
aagacatttatttgaatcaatt

SEQ ID NO: 7267296 - DNA, 22 bp, Homo sapiens
aagatttttttccacagactca

SEQ ID NO: 7267297 - DNA, 22 bp, Homo sapiens
aataacagaaacttgagcatca

SEQ ID NO: 7267298 - DNA, 22 bp, Homo sapiens
aataacagagtcttcaagatag

SEQ ID NO: 7267299 - DNA, 22 bp, Homo sapiens
aagtgattttcttcttagttat

SEQ ID NO: 7267300 - DNA, 22 bp, Homo sapiens
aagtgatttgcatgcttaattc

SEQ ID NO: 7267301 - DNA, 22 bp, Homo sapiens
aataacaggctcatcagatgct

SEQ ID NO: 7267302 - DNA, 22 bp, Homo sapiens
aataacagattttcaagctgtg

SEQ ID NO: 7267303 - DNA, 22 bp, Homo sapiens
aataacagggttgatttgcaat

SEQ ID NO: 7267304 - DNA, 22 bp, Homo sapiens
agaaaatattcattgagaggct

SEQ ID NO: 7267305 - DNA, 22 bp, Homo sapiens
aatatgcactctgatttagcag

SEQ ID NO: 7267306 - DNA, 22 bp, Homo sapiens
aatatgcaaagcgtgttatctg

SEQ ID NO: 7267307 - DNA, 22 bp, Homo sapiens
aatatgcaaataggtgtaatga

SEQ ID NO: 7267308 - DNA, 22 bp, Homo sapiens
aatatgatccttaaccttcatg

SEQ ID NO: 7267309 - DNA, 22 bp, Homo sapiens
aatatgcatgtatacatgtgta

SEQ ID NO: 7267310 - DNA, 22 bp, Homo sapiens
aatatgcattatacagactgat

SEQ ID NO: 7267311 - DNA, 22 bp, Homo sapiens
aatcttgagtgttactctcatt

SEQ ID NO: 7267312 - DNA, 22 bp, Homo sapiens
aatcttgagtatcagaccaaga

SEQ ID NO: 7267313 - DNA, 22 bp, Homo sapiens
acatgcattctctaaaagcaaa

SEQ ID NO: 7267314 - DNA, 22 bp, Homo sapiens
acattagaacattaatattggg

SEQ ID NO: 7267315 - DNA, 22 bp, Homo sapiens
acattcttaacagttaaaaact

SEQ ID NO: 7267316 - DNA, 20 bp, Homo sapiens
acattttggcatactctcaa

SEQ ID NO: 7267317 - DNA, 22 bp, Homo sapiens
aaggtttattaaaagttgatgg

SEQ ID NO: 7267318 - DNA, 22 bp, Homo sapiens
acagtgcagtgtgatgagtatt

SEQ ID NO: 7267319 - DNA, 22 bp, Homo sapiens
acagtgcagtgtgatgagtatt

SEQ ID NO: 7267320 - DNA, 22 bp, Homo sapiens
agctcagtggctcagtgggtat

SEQ ID NO: 7267321 - DNA, 18 bp, Homo sapiens
agattttgagaaatacaa

SEQ ID NO: 7267322 - DNA, 22 bp, Homo sapiens
acacactttaaattaaacctct

SEQ ID NO: 7267323 - DNA, 22 bp, Homo sapiens
agagatatatatttgtttacca

SEQ ID NO: 7267324 - DNA, 22 bp, Homo sapiens
agaataaatgctacctatcaca

SEQ ID NO: 7267325 - DNA, 22 bp, Homo sapiens
aatggaatgcctcacatgtatt

SEQ ID NO: 7267326 - DNA, 22 bp, Homo sapiens
aatggaattctccattagatgt

SEQ ID NO: 7267327 - DNA, 22 bp, Homo sapiens
aatggagaccctaaggaagagg

SEQ ID NO: 7267328 - DNA, 22 bp, Homo sapiens
aattttgtttaagtgatctgct

SEQ ID NO: 7267329 - DNA, 22 bp, Homo sapiens
aattttgtgtgggatcaaagga

SEQ ID NO: 7267330 - DNA, 22 bp, Homo sapiens
aattttgttcttggaaatcagg

SEQ ID NO: 7267331 - DNA, 22 bp, Homo sapiens
tcactacaaaagtctccctttc

SEQ ID NO: 7267332 - DNA, 22 bp, Homo sapiens
tcactacaaccgctacctgaca

SEQ ID NO: 7267333 - DNA, 22 bp, Homo sapiens
tcaattctgcctctaaatattt

SEQ ID NO: 7267334 - DNA, 22 bp, Homo sapiens
tcaattacagtgtcaccttaag

SEQ ID NO: 7267335 - DNA, 22 bp, Homo sapiens
tcaattactaaccaaataatgt

SEQ ID NO: 7267336 - DNA, 22 bp, Homo sapiens
tcaaacagcaggtctttcatag

SEQ ID NO: 7267337 - DNA, 22 bp, Homo sapiens
tcaaacaggactacattctcat

SEQ ID NO: 7267338 - DNA, 22 bp, Homo sapiens
tcacatcatggagaattatggg

SEQ ID NO: 7267339 - DNA, 22 bp, Homo sapiens
tcacatcattaagacttctcct

SEQ ID NO: 7267340 - DNA, 22 bp, Homo sapiens
tcacatcaacattatagcatga

SEQ ID NO: 7267341 - DNA, 22 bp, Homo sapiens
tcacatcaccctgctcttaatt

SEQ ID NO: 7267342 - DNA, 22 bp, Homo sapiens
tcacatcactagctggtaatga

SEQ ID NO: 7267343 - DNA, 19 bp, Homo sapiens
tcataaactgggcacagtg

SEQ ID NO: 7267344 - DNA, 22 bp, Homo sapiens
tcataaacacactagtatgatt

SEQ ID NO: 7267345 - DNA, 22 bp, Homo sapiens
tcataaaatgctcctgatattg

SEQ ID NO: 7267346 - DNA, 22 bp, Homo sapiens
tcataaaacacaccaggtagtt

SEQ ID NO: 7267347 - DNA, 19 bp, Homo sapiens
tcataaaaatggtaaccca

SEQ ID NO: 7267348 - DNA, 22 bp, Homo sapiens
tcaggattatttcagtggcttt

SEQ ID NO: 7267349 - DNA, 22 bp, Homo sapiens
tcattacacagttcagtggaaa

SEQ ID NO: 7267350 - DNA, 22 bp, Homo sapiens
tccctgttttatatcctaacaa

SEQ ID NO: 7267351 - DNA, 22 bp, Homo sapiens
gttagagcacatactttgcatg

SEQ ID NO: 7267352 - DNA, 22 bp, Homo sapiens
gttagcaccagtgctcataaca

SEQ ID NO: 7267353 - DNA, 22 bp, Homo sapiens
taaacatgttgacatcttacct

SEQ ID NO: 7267354 - DNA, 22 bp, Homo sapiens
taaacagagtgctagttcacgg

SEQ ID NO: 7267355 - DNA, 22 bp, Homo sapiens
taaacatggattctgatcacag

SEQ ID NO: 7267356 - DNA, 22 bp, Homo sapiens
taaacatggctgtttcagttat

SEQ ID NO: 7267357 - DNA, 20 bp, Homo sapiens
taaacagtatttactaggag

SEQ ID NO: 7267358 - DNA, 22 bp, Homo sapiens
taataacaattgtaggacatga

SEQ ID NO: 7267359 - DNA, 22 bp, Homo sapiens
taccttctaggtgatggttaca

SEQ ID NO: 7267360 - DNA, 22 bp, Homo sapiens
tacttcatgagttaatatgcag

SEQ ID NO: 7267361 - DNA, 22 bp, Homo sapiens
tactggcaatttcatatggtgc

SEQ ID NO: 7267362 - DNA, 18 bp, Homo sapiens
tacaggaaaagtgttaca

SEQ ID NO: 7267363 - DNA, 22 bp, Homo sapiens
tacaggaaagaaatttgaactc

SEQ ID NO: 7267364 - DNA, 22 bp, Homo sapiens
tacaggaagttacagactatga

SEQ ID NO: 7267365 - DNA, 22 bp, Homo sapiens
tacaggaagtctcagtacagta

SEQ ID NO: 7267366 - DNA, 22 bp, Homo sapiens
tacaggaaggagcacatcggga

SEQ ID NO: 7267367 - DNA, 22 bp, Homo sapiens
tacaggaaggctctggaggtgc

SEQ ID NO: 7267368 - DNA, 18 bp, Homo sapiens
tacaggaaggggttctcg

SEQ ID NO: 7267369 - DNA, 22 bp, Homo sapiens
tacaggagagatttagtaatca

SEQ ID NO: 7267370 - DNA, 20 bp, Homo sapiens
tacaggaatcaagactgcat

SEQ ID NO: 7267371 - DNA, 20 bp, Homo sapiens
tatttgtatttgggaaagtt

SEQ ID NO: 7267372 - DNA, 22 bp, Homo sapiens
tatttgtatgtgtgtacatata

SEQ ID NO: 7267373 - DNA, 22 bp, Homo sapiens
tatgcatagtgatttagaacag

SEQ ID NO: 7267374 - DNA, 22 bp, Homo sapiens
tatgcatagtggaattagcaaa

SEQ ID NO: 7267375 - DNA, 22 bp, Homo sapiens
tatgcataggtatctatactca

SEQ ID NO: 7267376 - DNA, 22 bp, Homo sapiens
tatgcacattcacacaaaaatg

SEQ ID NO: 7267377 - DNA, 22 bp, Homo sapiens
tatgcacattcacacaaaaatg

SEQ ID NO: 7267378 - DNA, 22 bp, Homo sapiens
tatctgtttattgttactgtca

SEQ ID NO: 7267379 - DNA, 22 bp, Homo sapiens
tatctgttgtcttttacatgta

SEQ ID NO: 7267380 - DNA, 20 bp, Homo sapiens
tatatgcagccaacactccc

SEQ ID NO: 7267381 - DNA, 22 bp, Homo sapiens
tatatgcaattttttagtgcaa

SEQ ID NO: 7267382 - DNA, 22 bp, Homo sapiens
tatatgcagattttcatcatcg

SEQ ID NO: 7267383 - DNA, 22 bp, Homo sapiens
tatagaggccaccaacatgaaa
